US008575070B2

(12) United States Patent
Watt et al.

(10) Patent No.: US 8,575,070 B2
(45) Date of Patent: Nov. 5, 2013

(54) METHODS OF CONSTRUCTING AND SCREENING LIBRARIES OF PEPTIDE STRUCTURES

(75) Inventors: Paul Michael Watt, Mount Claremont (AU); Roland Dunbrack, Philadelphia, PA (US)

(73) Assignee: Phylogica Limited, Subiaco (AU)

( * ) Notice: Subject to any disclaimer, the term of this patent is extended or adjusted under 35 U.S.C. 154(b) by 288 days.

(21) Appl. No.: 11/672,419

(22) Filed: Feb. 7, 2007

(65) Prior Publication Data

US 2008/0081768 A1    Apr. 3, 2008

(30) Foreign Application Priority Data

Feb. 20, 2006   (AU) ............................... 2006900864

(51) Int. Cl.
- C40B 50/04 (2006.01)
- C40B 50/02 (2006.01)
- C40B 20/04 (2006.01)
- C40B 20/06 (2006.01)
- C40B 20/08 (2006.01)
- C40B 30/04 (2006.01)

(52) U.S. Cl.
USPC ............ 506/25; 506/24; 506/4; 506/5; 506/6; 506/9

(58) Field of Classification Search
USPC ...................................... 506/4, 5, 6, 9, 24, 25
See application file for complete search history.

(56) References Cited

U.S. PATENT DOCUMENTS

| | | | |
|---|---|---|---|
| 5,516,637 A | 5/1996 | Huang et al. | |
| 5,763,239 A | 6/1998 | Short et al. | |
| 5,783,431 A | 7/1998 | Peterson et al. | |
| 5,821,047 A | 10/1998 | Garrard et al. | |
| 5,834,247 A | 11/1998 | Comb et al. | |
| 6,083,715 A | 7/2000 | Georgiou et al. | |
| 6,174,673 B1 | 1/2001 | Short et al. | |
| 6,190,908 B1 | 2/2001 | Kang | |
| 6,225,530 B1 | 5/2001 | Weigel et al. | |
| 6,238,884 B1 | 5/2001 | Short et al. | |
| 6,297,004 B1 | 10/2001 | Russell et al. | |
| 6,316,223 B1 | 11/2001 | Payan et al. | |
| 6,319,690 B1 | 11/2001 | Little et al. | |
| 6,361,969 B1 | 3/2002 | Galeotti et al. | |
| 6,436,694 B1 | 8/2002 | Tally et al. | |
| 6,475,726 B1 | 11/2002 | Tally et al. | |
| 6,521,425 B2 | 2/2003 | Perler et al. | |
| 6,560,542 B1 * | 5/2003 | Mandell et al. | 702/19 |
| 6,579,675 B2 | 6/2003 | Kamb | |
| 6,583,275 B1 | 6/2003 | Doucette-Stamm et al. | |
| 6,720,139 B1 | 4/2004 | Zyskind et al. | |
| 6,720,413 B1 | 4/2004 | Schweinfest et al. | |
| 6,846,625 B1 | 1/2005 | Tally et al. | |
| 6,994,982 B1 | 2/2006 | Watt | |
| 7,270,969 B2 * | 9/2007 | Watt et al. | 435/7.37 |
| 7,315,786 B2 * | 1/2008 | Dahiyat et al. | 702/19 |
| 7,803,765 B2 | 9/2010 | Watt et al. | |
| 2002/0150906 A1 | 10/2002 | Debe | |
| 2002/0155564 A1 | 10/2002 | Medrano et al. | |
| 2002/0164735 A1 | 11/2002 | Olson et al. | |
| 2002/0177170 A1 | 11/2002 | Luo et al. | |
| 2003/0215846 A1 * | 11/2003 | Watt et al. | 435/6 |
| 2005/0027457 A1 * | 2/2005 | Mandell et al. | 702/19 |
| 2005/0287580 A1 | 12/2005 | Watt et al. | |
| 2007/0031832 A1 | 2/2007 | Watt | |
| 2008/0139401 A1 | 6/2008 | Watt | |
| 2009/0170722 A1 | 7/2009 | Watt et al. | |

FOREIGN PATENT DOCUMENTS

| | | |
|---|---|---|
| AU | 756617 | 2/2000 |
| AU | 771534 | 11/2000 |
| EP | 1277835 | 1/2003 |
| WO | WO9517412 | 6/1995 |
| WO | 9623075 | 8/1996 |
| WO | 9624684 | 8/1996 |
| WO | 9640979 | 12/1996 |
| WO | WO9815172 | 4/1998 |
| WO | WO9816835 | 4/1998 |
| WO | 9819162 | 5/1998 |
| WO | WO9935282 | 7/1999 |
| WO | 9939210 | 8/1999 |
| WO | WO0068373 | 11/2000 |

(Continued)

OTHER PUBLICATIONS

Krissinel et al., 2004, Secondary-structure matching (SSM), a new tool for fast protein structure alignment in three dimensions, Acta Cryst., D60: 2256-2268.*

(Continued)

*Primary Examiner* — Amber D Steele

(74) *Attorney, Agent, or Firm* — Carol L. Francis; Bozicevic, Field & Francis LLP

(57) ABSTRACT

The present invention provides the means for producing libraries of peptide structures for drug screening applications that are capable of folding or assuming their native conformations independently of artificial scaffolds or flanking sequences in the proteins from which they are derived. The libraries can be highly diverse such that they are representative of the repertoire of protein structures existing in nature. The libraries can also be non-redundant or normalized such that the bias towards specific structures existing in source data sets and/or in nature is/are removed. In a particularly preferred embodiment, the present invention provides 30,000 independent fold structures produced by this method. The present invention also provides computer-readable media and systems comprising structural data in relation to the peptide libraries, and methods for displaying and screening the libraries.

33 Claims, 1 Drawing Sheet

(56) References Cited

FOREIGN PATENT DOCUMENTS

| WO | WO0076308 | 12/2000 |
|---|---|---|
| WO | WO0111086 | 2/2001 |
| WO | 03014325 | 2/2003 |
| WO | WO03012055 | 2/2003 |
| WO | WO03040168 | 5/2003 |
| WO | WO03046147 | 6/2003 |
| WO | WO03076621 | 9/2003 |
| WO | WO2004074479 | 9/2004 |
| WO | WO2006017913 | 2/2006 |

OTHER PUBLICATIONS

Lessel, et al., Creation and characterization of a new, non-redundant fragment data bank, Protein engineering, vol. 10, No. 6, pp. 659-664, 1997.
Wang, et al., Pisces: recent improvement to a PDB sequence culling server, Nucleic acid research. vol. 33, W94-W98, 2005.
Wang, et al., Predicting protein secondary structure be a support vector machine based on a new coding scheme, Genome Informatics, 15(2): 181-190 (2004).
Lee, et al. (1994). "Structure-Antigenicity Relationship of Peptides from the Pre-s2 Region of the Hepatitus B Virus Surface Antigen," Biochem Mol Biol Int. 34(1):159-168.
Sali, et al., Comparative protein modelling by satisfaction of spatial restraints., J Mol Biol. Dec. 5, 1993;234(3):779-815.
Alekshun, M.N. (Dec. 2001) "Beyond Comparison—Antibodies From Genome Data?" Nature Biotechnology 19:1124-1125.
Amann, E. et al. (1985) "ATG Vectors for Regulated High-Level Expression of Cloned Genes in *Escherichia coli*," Gene 40:183-190.
Amstutz, P. et al. (2001) "In vitro Display Technologies: Novel Developments and Applications," Current Opinion in Biotechnology 12:400-405.
Andre, S. et al. (Jan. 17, 2005). "Identification of Peptide Ligands for Malignancy- and Growth-Related Galectins Using Random Phage-Display and Designed Combinatorial Peptide Libraries," Bioorganic & Medicinal Chemistry 13(2):563-573.
Angrist, M. (1998) "Less is More: Compact Genomes Pay Dividends," Genome Research 8:683-685.
Arenkov, P, et al (2000). "Protein Microchips: Use for Immunoassay and Enzymatic Reactions," Analytical Biochemistry 278: 123-131.
Balaban, N. et al. (Apr. 17, 1998). "Autoinducer of Virulence as a Target for Vaccine and Therapy Against *Staphylococcus aureus*," Science 280:438-440.
Basbous, J. et al. (Oct. 31, 2003). "The HBZ Factor of Human T-cell Leukemia Virus Type 1 Dimerizes with Transcription Factors JunB and cJun Modulates Their Transcriptional Activity," The Journal of Biological Chemistry 278 (44): 43620-43627.
Baud, F. et al. (Oct. 26, 1999). "Measures of Residue Density in Protein Structures," Proc. Natl. Acad. Sci. USA 96:12494-12499.
Behrens, A. et al. (Mar. 1999). "Amino-Terminal Phosphorylation of c-Jun Regulates Stress-Induced Apoptosis and Cellular Proliferation," Nature Genetics 21:326-329.
Berzofky, J.A. (Sep. 6, 1985). "Intrinsic and Extrinsic Factors in Protein Antigenic Structure," Science 229(4717):932-940.
Blum, J.H. et al. (Feb. 29, 2000), "Isolation of Peptide Aptamers That Inhibit Intracellular Processes," Proc. Natl. Acad. Sci. USA 97(5):2241-2246.
Bonaldo, M. et al. (1996). "Normalisation and Subtraction: Two Approaches to Facilitate Gene Discovery," Genome Res. 6:791-806.
Bremnes, T. et al. (1998). "Selection of Phage Displayed Peptides From a Random 10-mer Library Recognising a Peptide Target," Immunotechnology 4:21-28.
Britten, R.J. et al. (Aug. 9, 1968). "Repeated Sequences in DNA," Science 161(3841):529-540.
Brodin, N. T. et al. (May 15, 1990). "Rat Monoclonal Antibodies Produced Against Rat Colorectal Adenocarcinomas Define Tumor- and Colon-Associated, Auto-Immunogenic Antigens," Int. J. Cancer 45(5):902-910.
Burioni, R. et al. (1998). "A New Subtraction Technique for Molecular Cloning of Rare Antiviral Antibody Specificities From Phage Display Libraries," Res. Virol. 149:327-330.
Campbell, A.P. et al. (1997). "Solution Secondary Structure of a Bacterially Expressed Peptide from the Receptor Binding Domain of Pseudomonas aeruginosa Pili Strain PAK: A Heteronuclear Multidimensional NMR Study" Biochem. 36(42):12791-12801.
Caponigro, G. et al. (Jun. 1998). "Transdominant Genetic Analysis of a Growth Control Pathway," Proc. Natl. Acad. Sci USA 95:7508-7513.
Chapman, M.D, et al. (Nov. 1984). "Recognition of two Dermatophagoides pteronyssinus-specific Epitopes on Antigen P1 by using Monoclonal Antibodies: Binding to Each Epitope can be Inhibited by Serum from Dust Mite-Allergic Patients," J. Immunol 133(5):2488-2495.
Chevray, P.M. et al. (Jul. 1992). "Protein Interaction Cloning in Yeast: Identification of Mammalian Proteins that React with the Leucine Zipper of Jun," Proc. Natl. Acad. Sci. USA 89: 5789-5793.
Choi, Y. et al. (Mar. 2003). "Identification of Bioactive Moleculesby Adipogenesis Profiling of Organic Compounds" FASEB Meeting on Experimental Biology: Translating the Genome, San Diego, CA, Apr. 11-15 2003, 17(4-5):A605, Abstract No. 377.23, one page.
Colas et al. (Apr. 11, 1996). "Genetic Selection of Peptide Aptamers That Recognize and Inhibit Cyclin-Dependent Kinase 2," Nature 380:548-550.
Colbére-Garapin et al. (1981). "A New Dominant Hybrid Selective Marker for Higher Eukaryotic Cells," J. Mol. Biol.150:I-14.
Cordwell, S.J. (1999) "Microbial Genomes and 'Missing' Enzymes: Redefining Biochemical Pathways," Arch. Microbial. 172:269-279.
Davies, J.M. et al. (Jun. 2000). "Use of Phage Display Technology to Investigate Allergen- Antibody Interactions," J. Allergy Clin. Immunol. 105(6): 1085-1 092 2000.
Dayalan, S. et al. (2006). "Dihedral Angle and Secondary Structure Database of Short Amino Acid Fragments", Bioinformation 1(3):78-80.
De Soultrait et al. (2002). "A Novel Short Peptide is a Specific Inhibitor of the Human Immunodeficiency Virus Type 1 Integrase," J. Mol. Biol. 318:45-58.
Dent et al. (2000). "The Genetics of Ivermectin Resistance in Caenorhabditis elegans," Proc. Natl. Acad. Sci. USA 97:2674-2679.
Derossi et al. (1994). "The Third Helix of the Antennapedia Homeodomain Translocates Through Biological Membranes," J. Biol. Chem. 269: 10444-10450.
Deveraeux et al. (1984). "A Comprehensive Set of Sequence Analysis Programs for the VAX," Nucl. Acids Res. 12:387-395.
Devito et al. (2002). "An Array of Target-Specific Screening Strains for Antibacterial Discovert," Nature Biotechnology 20:478-483.
Erdos, G. et al. (2006). "Construction and Characterization of a Highly Redundant Pseudonomas aeruginosa Genornic Library Prepared From 12 Clinical Isolates: Application to Studies of Gene Distribution Among Populations," Intl. Journal of Pediatric Otorhinolaryngology.
Estus, S. et al. (Dec. 1994). "Altered Gene Expression in Neurons During Programmed Cell Death: Identification of c-Jun as Necessary for Neuronal Apoptosis," The Journal of Cell Biology 127(6):1717-1727.
Faber et al. (1999). "Polyglutamine-Mediated Dysfunction and Apoptotic Death of a Caenorhabditis elegans Sensory Neuron," Proc. Natl. Acad. Sci. 96: 179-184.
Fabret et al. (2000). "Efficient Gene Targeted Random Mutagenesis in Genetically Stable *Escherichia coli* strains," Nucl. Acids Res. 28:e95.
Fahraeus et al. (1996). "Inhibition of prb Phosphorylation and Cell-Cycle Progression by a 20-Residue Peptide Derived From p16 CDKN2/INK4An," Curr. Biol. 6(1):84-91.
Fang, Y. et al. (2002). "G-Protein-Coupled Receptor Microarrays," ChemBioChem., 3: 987-991.
Fehrsen et al. (1999). "Cross-Reactive Epitope Mimics in a Fragmented-Genome Phage Display Library Derived from the Rickettsia, Cowdria ruminantiurn," Immunotechnology 4: 175-184.
Filipe, S.R. (2001). "The Role of murMN Operon in Penicillin Resistance and Antibiotic Tolerance of *Streptococcus pneumoniae*," Microbial Drug Resistance 7(4):303-316.

(56) References Cited

OTHER PUBLICATIONS

Fitzgerald (2000). "In vitro Display Technologies—New Tools for Drug Discovery," Drug Discovery Today 5:253-258.
Franzoni et al. (1997). "Structure of the C-Terminal Fragment 300-320 of the Rat Angiotensin II AT Ia Receptor and Its Relevance with Respect to G-Protein-Coupling," J. Biol. Chem. 272:9734-9741.
Furmonaviciene, R. et al. (1999). "The Use of Phage-Peptide Libraries to Define the Epitope Specificity of a Mouse Monoclonal Anti-Der p 1 Response," Clin. Exp. Allergy 29: 1563-1 571.
Futch, W.S. Jr. et al. (Mar. 15, 2003). "Dissection of Macrophage Tumoricidal and Protozoacidal Activities Using TCell Hybridomas and Recombinant Lymphokines," Infection and Immunity 50(3): 709-715.
Garcia, M. et al. (Mar. 15, 2002). "The Mitochondrial Toxin 3-Nitropropionic Acid Induces Striatal Neurodegeneration via a c-Jun N-Terminal Kinase/c-Jun Module," The Journal of Neuroscience 22(6):2174-2184.
Gargala, G. et al. (1999). "Enzyme Immunoassay Detection of Cryptosporidium parvum Inhibition by Sinefungin in Sporozoite Infected HCT-8 Enterocytic Cells," International Journal of Parasitology 29: 703-709.
Gegg et al. (1997). "Probing Minimal Independent Folding Units in Dihydrofolate Reductase by Molecular Dissection," Protein Sci. 6: 1885-1892.
GenBank Accession No. AAH36335 (last updated May 20, 2005), located at <http://www.ncbi.nlm.nih.gov/entrez/viewer.fcgi?dbrotein&id=23273658, last visited Apr. 1, 2008, three pages.
GenBank Accession No. AAN49594 (last updated Feb. 1, 2006), <http://www.ncbi.nlm.nih.gov/entrez/viewer.fcgi?dbrotein&id=24196153>, last visited Apr. 1, 2008, two pages.
GenBank Accession No. AAS70149 (last updated Jan. 4, 2006), <http://www.ncbi.nlm.nih.gov/entrez/viewer.fcgi?dbrotein&id=45600665>, last visited Apr. 1, 2008, two pages.
GenBank Accession No. AAV59791 (last updated Jan. 21, 2005), <http://www.ncbi.nlm.nih.gov/entrez/viewer.fcgi?dbrotein&id=55736149>, last visited Apr. 1, 2008, three pages.
GenBank Accession No. CAD25932 (last updated Apr. 16, 2005), <http://www.ncbi.nlm.nih.gov/entrez/viewer.fcgi?dbrotein&id=19069547>, last visited Apr. 1, 2008, two pages.
GenBank Accession No. CAI310659 (last updated Sep. 22, 2004), <http://www.ncbi.nlm.nih.gov/entrez/viewer.fcgi?dbrote&id=5O949409>, last visited Apr. 1, 2008, two pages.
Getzoff et al. (1987). "Mechanisms of Antibody Binding to a Protein," Science 235:1191-1196.
Granger-Schnarr, M. et al. (May 1992). "Transformation and Transactivation Suppressor Activity of the c-Jun Leucine Zipper Fused to a Bacterial Repressor," Proc. Natl. Acad. Sci. USA 89:4236-4239.
Greene et al. (1992). "IgE Binding Structures of the Major House Dust Mite Allergen DER p 1," Mol. Immunology 29:257-262.
Haley, K.J. et al. (Aug. 1998). "Tumor Necrosis Factor Induces Neuroendocrine Differentiation in Small Cell Lung Cancer Cell Lines," American Journal of Physiology 275(2 pt 1):L3 11-L321.
Halstead, J.R. et al. (1999). "A Family 26 Mannanase Produced by Clostridium thermocellum as a Component of the Cellulosome Contains a Domain Which is Conserved in Mannanases from Anaerobic Fungi," Microbiology 145:3101-3108.
Harrison, A. et al. (2003). "Recognizing the fold of a protein structure", Bioinformatics 19(14):1748-1759.
Hegde S. S. et al. (Mar. 9, 2001). "FemABX Family Members Are Novel Nonribosomal Peptidyltransferases and Important Pathogen-SpecificDrug Targets," The Journal of Biological Chemistry 276(10):6998-7003.
Hengeveld et al. (2002). "Functional and Structural Characterization of a Synthetic Peptide Representing the N-Terminal Domain of Prokaryotic Pyruvate Dehydrogenase," Biochem. 41:7490-7500.
Heymann et al. (1989). "Antigenic and Structural Analysis of Group I1 Allergens (Der f II and Der p II) From House Dust Mites (Dermatophagoides spp.)" J. Allergy Clin. Immunol. 83:1055-1067.
Hofmann et al. (1996). "Rapid Retroviral Delivery of Tetracycline-Inducible Genes in a Single Autoregulatory Cassette," Proc. Natl. Acad. Sci. 93:5185-5190.
Hoogenboom et al. (1991). "Multi-Subunit Proteins on the Surface of Filamentous Phage: Methodologies for Displaying Antibody (Fab) Heavy and Light Chainms," Nucleic acids Res. 19:4133-4137.
Horng et al. (2002). "Characterization of Large Peptide Fragments Derived from the N-Terminal Domain of the Ribosomal Protein L9: Definition of the Minimum Folding Motif and Characterization of Local Electrostatic Interactions," Biochem. 41: 13360-13369.
Hosen, N. et al. (2004). "Identification of a Gene Element Essential for Leukemia -Specific Expression of Transgenes," Leukemia 18:415-419.
Houshmand et al. (1999). "Use of Bacteriophage T7 Displayed Peptides for Determination of Monoclonal Antibody Specificity and Biosensor Analysis of the Binding Reaction," Anal. Biochem. 268:363-370.
Humphrey et al. (1997). "Chemical Synthesis of Natural Product Peptides; Coupling Methods for the Incorporation of Noncoded Amino Acids into Peptides," Chem. Rev. 97:2243-2266.
International Preliminary Report on Patentability mailed on Feb. 20, 2007, for PCT Application No. PCT/AU2005/001255, filed Aug. 22, 2005, ten pages.
International Search Report mailed on Aug. 16, 2005, for PCT Application No. PCT/AU2005/000801, filed Jun. 3, 2005, eight pages.
International Search Report mailed on Nov. 17, 2005, for PCT Application No. PCT/AU2005/001255, filed Aug. 22, 2005, six pages.
Irbäck, et al. (1996). "Evidence for Nonrandom Hydrophobicity Structures in Protein Chains," Proc. Natl. Acad. Sci. 93:9533-9538.
Kabouridis, P. S. (Nov. 2003). "Biological Applications of Protein Transduction Technology," Trends in Biotechnology 21(11): 498-503.
Kinzler et al. (1989). "Whole Genome PCR: Application to the Identification of Sequences Bound by Gene Regulatory Proteins," Nucleic Acids Res. 17:3645-3653.
Kolonin et al. (Nov. 1998). "Targeting Cyclin-Dependent Kinases in Drosophilia with Peptide Aptamers," Proc. Natl. Acad. Sci. 95: 14266-14271.
Koncz et al. (1987). "Expression and Assembly of Functional Bacterial Luciferase in Plants," Proc. Natl. Acad. Sci. 84:131-135.
Koo, J.H. et al. (Mar. 8, 2001). "Purification and Characterization of Bex, an OMP Parter," Annual Meeting of the Federation of American Societies for Experimental Biology on Experimental Biology Orlando, FL, Mar. 31-Apr. 4, 2001, 15(5):A894, Abstract No. 695.14, one page.
Kopczynski et al. (1998). "A High Throughput Screen to Identify Secreted and Transmembrane Proteins Involved in Drosophilia embryogenesis," Proc. Natl. Acad. Sci. 95:9973-9978.
Lambros, C. et al. (Jun. 1979). "Synchronization of Plasmodium Falciparum Erythrocytic Stages in Culture," J. Parasitology 65(3):418-420.
Layne, M.D. et al. (Jun. 18, 1998). "Aortic Carboxypeptidase-Like Protein, Novel Protein with Discoidin and Carboxypeptidase-Like Domains, Is Up-Regulated During Vascular Smooth Muscle Cell Differentiation," The Journal of Biological Chemistry 273(25):15654-15660.
Lee, Y. et al. (2003). "ProteoChip: A Highly Sensitive Protein Microarray Prepared by a Novel Method of Protein Immobilization for Application of Protein-Protein Interaction Studies," Proteomics, 3:2289-2304.
Leitner, A. et al. (1998) "A Mimotope Defined by Phage Display Inhibits IgE Binding to the Plant Panallergen Profiling," Eur. J. Immunol. 28:2921-2927.
Lesley et al. (1991). "Use of in vitro Protein Syntheses from Polymerase Chain Reaction-Generated Templates to Study Interaction of *Escherichia coli* Transcription Factors with Core RNA Polymerase and for Epitope Mapping of Monoclonal Antibodies," J. Biol. Chem. 266:2632-2638.
Lind, et al. (1988). "The Binding of Mouse Hybridoma and Human IgE Antibodies to the Major Fecal Allergen, Der p 1, of Dermatophagoides pteronyssinus," J. Immunol 40:4256-4262.
Maidhof, H. et al. (Jun. 1991). "femA, Which Encodes a Factor Essential for Expression of Methicillin Resistance, Affects Glycine

(56) References Cited

OTHER PUBLICATIONS

Content of Peptidoglycan in Methicillin-Resistant and Methicillin-Susceptible *Staphylococcus aureus* Strains," Journal of Bacteriology 173(11):3507-351.
Marcello et al. (Sep. 1994). "Specific Inhibition of Herpes Virus Replication by Receptor-Mediated Entry of an Antiviral Peptide Linked to *Escherichia coli* Enterotoxin B Subunit," Proc. Natl. Acad. Sci. 91:8994-8998.
Marsh et al. (2000). "Expanded Polyglutamine Peptides Alone are Intrinsically Cytotoxic and Cause Neurodegeneration in Drosophilia," Hum. Mol. Genet. 9: 13-25.
Mazmanian, S. K. et al. (Jul. 30, 1999). "*Staphylococcus aureus* Sortase, an Enzyme that Anchors Surface Proteins to the Cell Wall," Science, 285:760-763.
Mazmanian, S. K. et al. (May 9, 2000) "*Staphylococcus aureus* Sortase Mutants Defective in the Display of Surface Proteins and in the Pathogenesis of Animal Infections," Proc. Natl. Acad. Sci. 97(10):5510-5515.
McCafferty et al. (1990). "Phage Antibodies: Filamentous Phage Displaying Antibody Variable Domains," Nature 348:552-554.
McConnell et al. (1994). "Constrained Peptide Libraries as a Tool for Finding Mimotopes," Gene 15 1:115-118.
McElveen, J.E. (1998). "Primary Sequence and Molecular Model of the Variable Region of a Mouse Monoclonal Anti- Der p 1 Antibody Showing a Similar Epitope Specificity as Human IgE," Clinical and Experimental Allergy 28:1427-1434.
Mennuni et al. (1997). "Identification of a Novel Type 1 Diabetes-Specific Epitope by Screening Phage Libraries with Sera from Pre-Diabetic Patients," J. Mol. Biol. 268:599-606.
Michiels, F. et al. (Nov. 2002). "Arrayed Adenoviral Expression Libraries for Functional Screening," Nature Biotechnology 20: 1154-1157.
Miller, V.L. et al. (Sep. 2001). "Identification of Regions of All Required for the Invasion and Serum Resistance Phenotypes," Molecular Microbiology 41(5):1053-1062.
Morris et al. (2000). "Translocating Peptides and Proteins and Their Use for Genen Delivery," Curr. Opinion Biotech. 11:461-466.
Morris et al. (2001). "A Peptide Carrier for the Delivery of Biologically Active Proteins into Mammalian Cells," Nature Biotech. 19:1173-1176.
Mulligan et al. (1981). "Selection for Animal Cells that Express the *Escherichia coli* Gene Coding for Xanthine- Guanine Phosphoribosyltransferase," Proc. Natl. Acad. Sci. USA 78:2072-2076.
Nedelkov, D. et al. (2001). "Analysis of Native Proteins from Biological Fluids by Biomolecular Interaction Analysis Mass Spectrometry (BIA/MS): Exploring the Limit of Detection, Identification of Non-Specific Binding and Detection of Multi-Protein Complexes," Biosensors & Bioelectronics 16•1071-1078.
Needleman et al. (1970). "A General Method Applicable to the Search for Similarities in the Amino Acid Sequence of Two Proteins," J. Mol. Biol. 48:443-453.
Neidigh et al. (2002). "Designing a 20-Residue Protein," Nature Structural Biology 9:425-430.
Nelson, K.E. et al. (Oct. 2000). "Status of Genome Projects for Nonpathogenic Bacteria and Archaea," Nature Biotechnology 18:1049-1054.
Nelson R.W. et al. (2000). "Biosensor Chip Mass Spectrometry: A Chip-Based Proteomics Approach," Electrophoresis 21:1155-1163.
Nelson, R.W. et al. (1999). "BIAMS of Epitope-Tagged Peptides Directly from *E.coli* Lysate: Multiplex Detection and Protein Identification at Low-Fermtomole to Subfemtomole Levels," Anal. Chem. 713:2858-2865.
Nemoto N. et al. (1999). "Fluorescence Labeling of the C-Terminus of Proteins with a Puromycin Analogue in Cell- Free Translation Systems," FEBS Letters 462:43-46.
Ness et al. (2002). "Synthetic Shuffling Expands Functional Protein Diversity by Allowing Amino Acids to Recombine Independently," Nature Biotechnology 20:1251-1255.

Norman et al. (1999). "Genetic Selection of Peptide Inhibitors of Biological Pathways," Science 285:591-595.
Oefner, P.J. et al. (1996). "Efficient Random Subcloning of DNA Sheared in a Recirculating Point-Sink Flow System," Nucleic Acids Research 24(20):3879-3886.
O'Hare et al. (1981). "Transformation of Mouse Fibroblasts to Methotrexate Resistance by a Recombinant Plasmid Expressing a Prokaryotic Dihydrofolate Reductase," Proc. Natl. Acad. Sci. USA 78:1527-1531.
Palzkill et al. (1998). "Mapping Protein-Ligand Interactions Using Whole Genome Phage Display Libraries," Gene 221:79-83.
Pande et al. (1994). "Nonrandomness in Protein Sequences: Evidence for a Physically Driven Stage of Evolution?" Proc. Natl. Acad. Sci. USA 91:12972-12975.
Pavlickova, P. et al. (2003). "Microarray of Recombinant Antibodies Using a Streptavidin Sensor Surface Self-Assembled onto a Gold Layer," BioTechniques 34(1):124-130.
Phelan et al. (May 1998). "Intercellular Delivery of Functional p53 by the Herpes Virus Protein VP22," Nature Biotechnol. 16:440-443.
Pincus et al. (1998). "Peptides that Mimic the Group B Streptococcal Type I11 Capsular Polysaccharide Antigen," J. Immunol. 160:293-298.
Pini et al. (Aug. 21, 1998). "Design and Use of a Phage Display Library," J. Biol. Chem. 21769-21776.
Postier, B.L. et al. (2003). "The Construction and Use of Bacterial DNA Microarrays Based on an Optimized Two- Stage PCR Strategy," BMC Genomics, vol. 4, 11 pages.
Raivich, G. and A. Behrens. (2006) "Role of the AP-1 Transcription Factor c-Jun in Developing, Adult and Injured Brain," Progress in Neurobiology 78:347-363.
Read et al. (2001). "Finding Drug Targets in Microbial Genomes," Drug Disc. Today 6:887-892.
Richter et al. (2000). "Refolding, Purification, and Characterization of Human Recombinant pde4a Constructs Expressed in *Escherichia coli*," Protein Expression and Purification 19:375-383.
Robben et al. (2002). "Selection and Identification of Dense Granule Antigen GRA3 by Toxoplasma gindii Whole Genome Phage Display," J. Biol. Chem. 277:17544-17547.
Roberts et al. (1997). "RNA-Peptide Fusions for the in vitro Selection of Peptides and Proteins," Proc. Natl. Acad. Sci. USA 94: 12297-12302.
Rogers et al. (1997). "Behavioral and Functional Analysis of Mouse Phenotype: SHRPA, a Proposed Protocol for Comprehensive Phenotype Assessment," Mamm. Genome 8:711-713.
Rohrer, S. et al. (Aug. 1999). ":The Essential *Staphylococcus aureus* Gene *fmhB* is Involved in the First Step of Peptidoglycan Pentaglycine Interpeptide Formation," Proc. Natl. Acad. Sci. USA, 96: 9351-9356.
Rosenthal, P. J. et al. (Jul. 1996). "Antimalarial Effects of Vinyl Sulfone Cysteine Proteinase Inhibitors," Antimicrobial Agents and Chemotherapy 40(7): 1600-1 603.
Sali, A. and T.Blundell. (1993) "Comparative Protein Modelling by Satisfaction of Spactial Restraints," J. Mol. Biol. 234:779-815.
Santerre et al. (1984). "Expression of Prokaryotic Genes for Hygromycin B and G418 Resistance as Dominant- Selection Markers in Mouse L Cells," Gene 30:147-156.
Satyal et al. (2000). "Polyglutamine Aggregates Alter Protein Folding Homeostatis in Caenorhabditis elegans," Proc. Natl. Acad. Sci. USA 97:5750-5755.
Shimatake et al. (198 1). "Purified *h* Regulatory Protein cII Positively Activates Promoters for Lysogenic Development," Nature 292:128-132.
Sieber et al. (2001). "Libraries of Hybrid Proteins from Distantly Related Sequences," Nature Biotechnology 19:456-460.
Soares, M.B. (1997). "Identification and Cloning of Differentially Expressed Genes," Curr. Opinion Biotechnol. 8:542-546.
Stengelin et al. (1988). "Isolation of cDNAs for Two Distinct Human Fc Receptors by Ligand Affinity Cloning," EMBO Journal 7:1053-1059.
Stranden, A.M. et al. (Jan. 1997). "Cell Wall Monoglycine Cross-Bridges and Mathicillin Hypersusceptibility in a femAB Null Mutant of Methicillin-Resistant *Staphylococcus aureus*," Journal of Bacteriology 179(1): 9-16.

(56) References Cited

OTHER PUBLICATIONS

Studier et al. (1986). "Use of Bacteriophage T7 RNA Polymerase to Direct Selective High-Level Expression of Cloned Genes," J. Mol. Biol. 189:113-130.
Sugita et al. "Combined Use of Oligonucleotide and Tissue Microarrays Identifies Cancer/Testis Antigens as Biomarkers in Lung Carcinoma," Cancer Res 62:3971-3979.
Supplementary Partial European Search Report for EP Application No. 04712970.5 mailed Apr. 26, 2006, five pages.
Supplementary Partial European Search Report for EP Application No. 04712970.5 mailed Aug. 3, 2006, seven pages.
Theiss, H.D. et al. (2003). "Enhancement of Gene Transfer With Recombinant Adeno-Associated Virus (rAAV) Vectors into Primary B-Cell Chronic Lymphocytic Leukemia Cells by CpG-oligodeoxynucleotides," Experimental Hematology 3 1: 1223-1229.
Thomas et al. (1990). "Expression in *Escherichia coli* of a High-Molecular-Weight Protective Surface Antigen Found in Nontypeable and Type B Haemophilus influenzae," Infect. & Immun. 58: 1909-191.
Thumm, G. et al. (1997). "Studies on Prolysostaphin Processing and Characterization of the Lysostaphin Immunity Factor (Lif) of *Staphylococcus simulans* Biovar Staphylolyticus," Molecular Microbiology 23(6):1251-1265.
Tiozzo, E. et al. (1998). "Wide-Spectrum Antibiotic Activity of Synthetic, Amphipathic Peptides," Biochem. & Biophys. Res. Comm. 249(1):202-206.
Tokmakov et al. (1 997). "Inhibition of MAPK Pathway by a Synthetic Peptide Corresponding to the Activation Segment of MAPK," Biochem. Biophys. Res. Comm. 252:214-219.
Tokmakov et al. (1997)."Phosphorylation-Sensitive Secondary Structure in a Synthetic Peptide Corresponding to the Activation Loop of MAP Kinase," Biochem. Biophys. Res. Commun. 236:243-247.
Tortosa, P. et al (Mar. 2000). "Characterisation of ylbF, a New Gene Involved in Competence Development and Sporulation in *Bacillus subtilis*," Molecular Microbiology 35(5) : 11 10-1 119.
Tripet et al. (1997). "Demonstration of Coiled-Coli Interactions Within the Kinesin Neck Region Using Synthetic Peptides," J. Biol. Chem. 272:8946-8956.
Urbanek, M. et al. (Jan. 2003). "Variation in Resistin Gene Promoter Not Associated With Polycystic Ovary Syndrome," Diabetes 52: 214-2 17.
Valentini, S.R. et al (Feb. 1994). "Glucocorticoid-Regulated Gene in Transformed to Normal Phenotypic Reversion," Brazilian J Med Biol Res 27(2): 541-546.
Van Regenmortel M.H.V. (1989). "Structural and Functional Approaches to the Study of Protein Antigenicity," Immunology Today 10:266-272.
Vidal et al. (1999). "Yeast Forward and Reverse In1 -hybrid Systems," Nucl. Acids Res. 27:919-929.
Vranken et al. (2002). "Solution Structures of a 30-Residue Amino-Terminal Domain of the Carp Granulin-1 Protein and its Amino-Terminally Truncated 3-30 Subfragment: Implications for the Conformational Stability of the Stack of Two 0-Hairpins," Proteins 47: 14-24.
Wigler et al. (1980). "Transformation of Mammalian Cells with an Amplifiable Dominant-Acting Gene," Proc. Natl. Acad. Sci. USA 77:3567-3570.
Wittrup, K.D. (2001). "Protein Engineering by Cell-Surface Display," Current Opinion in Biotechnology 12:395-399.
Wong, et al. (1996). "Use of Tagged Random Hexamer Amplification (TRHA) to Clone and Sequence Minute Quantities of DNA-Application to a 180 kb Plasmid Isolated From Sphingomonas F199," Nucleic Acids. Res. 24:3778-3783.
Xu et al. (2001). "Dominant Effector Genetics in Mammalian Cells," Nature Genetics 27:23-29.
Xu et al. (Nov. 1997). "Cells That Register Logical Relationships Among Proteins," Proc. Natl. Acad. Sci. USA 94: 12473-12478.
Yang (1999). "Cloning, Expression, and Characterization of a DNA Binding Domain of gpNul, a Phage *h* DNA Packaging Protein," Biochem. 38:465-477.
Yang et al. (1998). "A 20-Kilodalton N-Terminal Fragment of the DI5 Protein Contains a Protective Epitope(s) Against *Haemophilus influenzae* Type A and Type B," Infect. And Immun. 66:3349-3354.
Yang, P. et al (Dec. 17, 1999). "Direct Activation of the Fission Yeast PAK Shkl by the Novel SH3 Domain Protein, Skb5," The Journal of Biological Chemistry 274(51): 36052-36057.
Yang et al. (2000). "An Integrated Approach to the Analysis and Modeling of Protein Sequences and Structures. 111. A Comparative Study of Sequence Conservation in Protein Structural Families using Multiple Structural Alignments," J. Mol. Biol. 301:691-711.
Yao, S.Q. et al. (1997). "Inhibiting Dimerization and DNA Binding of c-Jun," in Peptides: Frontiers of Peptide Science,Proceedings of the 15th Amernican Peptide Symposium, Nashville, TN, Jun. 14-19, 1997, Tam, J.P. et al. eds. Kluwer Academic Publishers, Dordrecht, Netherlands, pp75 1-752.
Yasueda et al. (1996). "Species-Specific Measurement of the Second Group of Dermatophagoides Mite Allergens, Der p 2 and Der f 2, Using a Monoclonal Antibody-based ELISA," Clin. Exp. Allergy. 26:171-177.
Young, K.H. (1998). "Yeast Two-Hybrid: So Many Interactions, (in) so Little Time," Biology of Reproduction 58:302-311.
Zhang et al. (1992). "Whole Genome Amplification From a Single Cell: Implications for Genetic Analysis," Proc. Natl. Acad. Sci. USA 895847-5851.
Zhou, J.M. et al. (2002). "A Novel Strategy by the Action of Ricin that Connects Phenotype and Genotype Without Loss of the Diversity of Libraries," J. Am. Chem. Soc. 124(4):538-543.
Zhou, X-F. et al. (Feb. 1999). "Ligand-Activated Retinoic Acid Receptor Inhibits AP-1 Transactivation by Disrupting c-Junlc-Fos Dimerization," Mol. Endocrin. 13(2):276-285.
Tsai et al. (2000). "Anatomy of protein structures: Visualizing how a one-dimensional protein chain folds into a three-dimensional shape" PNAS, 97:12038-12043.
Sambrook et al. (1989). "Screening Expression Libraries with Antibodies and Oligonucleotides" Molecular Cloning: A Laboratory Manual Second Edition, Cold Spring Harbor Laboratory Press, USA. Chapter 12, p. 12.2.
Shafikhani et al. (1997). "Generation of Large Libraries of Random Mutants in *Bacillus subtilis* by PCR-based Plasmid Multimerization" Biotechniques 23(2):304-310.
Yao, S. et al. (1998). "Uncoiling c-Jun Coiled Coils: Inhibitory Effects of Truncated Fos Peptides on Jun Dimerization and DNA binding in Vitro" Biopolymers 47(4):277-283.
Bains et al (1997) "Zipping up transcription factors: Rational Design of Anti-Jun and Anti-Fos Peptides" Letters in Peptide Science 4:67-77.
Bianco et al (2006) "Solid-phase synthesis of CD40L mimetics" Org. Biomol. Chem 4:1461-1463.
Canchaya et al (2003) "Prophage Genomics" Microbiology and Molecular Biology Reviews 67(2):238-276.
Canchaya et al (2003) "Prophage Genomics" Microbiology and Molecular Biology Reviews 67(3):473. Erratum.
Chen et al (2006) "Thermal injury-induced peroxynitrite production and pulmonary inducible nitric oxide synthase expression depend on JNK/AP-1 signalling" Crit Care Med 34(1):142-150.
Chloupkova et al (2003) "MDL1 is a High Copy Suppressor of ATM1: Evidence for a Role in Resistance to Oxidative Stress" JMB 331:155-165.
Day et al (2003) "A consensus view offold space: Combining SCOP, CATH, and the Dali Domain Dictionary" Protein Science 12:2150-2160.
Deambrosis et al (2009) "Inhibition of CD4O-CD154 Costimulatory Pathway by a Cyclic Peptide Targeting CD 154" J Mol Med 87:181-197.
Encode Project Consortium (2007) "Identification and analysis of functional elements in 1% of the human genome by the ENCODE pilot project" Nature 447:799- 816.
Fischer et al (2000) "A Rapid Test for Identification of Autonomous Folding Units in Protein" J. Mol. Biol. 302:701-712.

(56) References Cited

OTHER PUBLICATIONS

Floudas et al (2006) "Advances in protein structure prediction and de novo protein design: A review" Chemical Engineering Science 61:966-988.
Fromant et al (1995) "Direct random mutagenesis of gene-sized DNA fragments using polymerase chain reaction" Analytical Biochemistry 224:347-353.
Gaasterland et al (1998) "Microbial Genescapes: Phyletic and Functional Patterns of ORF Distribution among Prokaryotes" Microbial and Comparative Genomics 3(4):199-217.
GenBank Accession No. XP975325, last updated Jul. 21, 2008, <http://www.ncbi.nlm.nih.gov/protein/91084013>, 1 page.
GenBank Accession No. YP284595, last updated Jun. 10, 2013, <http://www.ncbi.nlm.nih.gov/protein/71907008>, 2 pages.
GenBank Accession No. ZP01044355, last updated Nov. 26, 2012, <http://www.ncbi.nlm.nih.gov/protein/ZP01044355.1?report=genpept>, 1 page.
Giesen et al (2002) "The Oncogenic Activity of Cyclin E is Not Confined to Cdk2 Activation Alone but Relies on Several Other, District Functions of the Protein" J Biol. Chem. 277(42):39909-39918.
Guda et al (2006) "DMAPS: a database of multiple alignments for protein structures" Nucleic Acids Research 34: D273-D276.
http://users.rcn.com/jkimball.ma.ultranet/BiologyPages/G/GenomeSizes.html (2001), 3 pages.
Inouye et al (1997) "Mutational Analysis of STE5 in the Yeast *Saccharomyces cerevisiae*: Application of a Differential Interaction Trap Assay for Examining Protein-Protein Interactions" Genetics 147:479-492.
Izawa et al (2004) "A screening system for antioxidants using thioredoxin-deficient yeast: discover of thermostable antioxidant activity from *Agaricus blazei* Murill" Applied Microbial and Cell Physiology 64:537-542.
Kern et al (1992) "Oncogenic Forms of P53 Inhibit P53-Regulated Gene Expression" Science 256:5058:827-830.
Kitagawa et al (2005) "Identification of Three Novel Peptides That Inhibit CD40-CD154 Interaction" Mod Rheumatol 15:423-426.
Lowman et al (1998) "Molecular Mimics of Insulin-like Growth Faction 1(IGF-1) for Inhibiting IGF-1:IGF-Binding Protein Interactions" Biochemistry 37:8870-8878.
Maggio et al (2001) "Recent developments in computational proteomics" Trends in Bioechnology 19(7):266-272.
Olins et al (1995) "Saturation Mutagenesis of Human Interleukin-3" JBC 270(40):23754-23760.
Phylogica Beyond Antibodies, (Oct. 2005) PowerPoint slides, 30 pages.
Polacco et al (2006) "Automated discovery of 30 motifs for protein function annotation" Bioinformatics 22(6):723-730.
Santangelo et al (1986) "Cloning of open reading frames and promoters from the *Saccharomyces cerevisiae* genome: construction of genomic libraries of random small fragments" Gene, 46(2-3):181-6.
Serebriiskii et al (1999) "A two-hybrid dual bait system to discriminate specificity of protein Interactions" J Biol Chem 274(24):17080-17087.
Serebriiskii et al (2000) "Approaches to Detecting False Positives in Yeast Two-Hybrid Systems" Biotechniques 28 (2):328-336.
Serebriiskii (2002) "Detection of Peptides, Proteins, and Drugs that Selectively Interact with Protein Targets" Genome Res. 12:1785-1791.
Serebriiskii et al (2004) "Analysis of Protein-Protein Interactions Utilizing Dual Bait Yeast Two-Hybrid System" Chapter 19 in Methods of Molecular Biology, Fu, H., ed, Humana Press, Inc. Totwas:New Jersey, 261:263-296.
Sigal et al (2000) "Oncogenic Mutations of the p53 Tumor Suppressor: The Demons of the Guardian of the Genome" Cancer Research 60:6788-6793.
Skelton et al (2001) "Structure-Function Analysis of a Phage Display-Derived Peptide That Binds to Insulin-like Growth Faction Binding Protein 1" Biochemistry 40:8487-8489.
Szwarcwort-Cohen et al (2009) "Human Cdk2 is a functional homolog of budding yeast Ime2, the meiosis-specific Cdk-like kinase" Cell Cycle 8(4):647-654.
Waddell et al (2001) "A 'non-hybrids' screen for functional antagonizers of human p53 transactivator function: dominant negativity in fission yeast" Oncogene 20:6001-6008.
Watt P (2006) "Screening for peptide drugs from the nature repertoire of biodiverse protein folds" Nature Biotechnology, 24(2):177-183.

\* cited by examiner

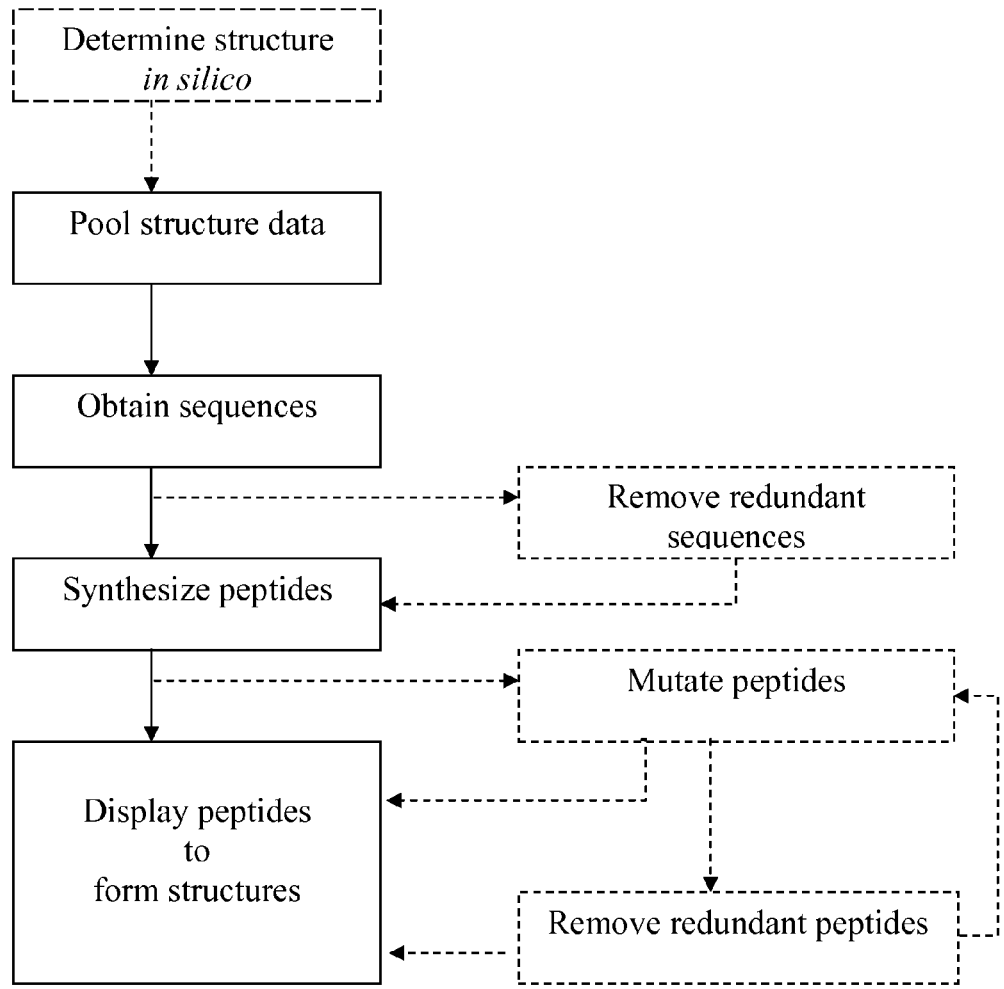

METHODS OF CONSTRUCTING AND SCREENING LIBRARIES OF PEPTIDE STRUCTURES

RELATED APPLICATION DATA

This application claims priority from Australian Patent Application No. 2006900864 filed on Feb. 20, 2006, the contents of which are incorporated herein in their entire.

FIELD OF THE INVENTION

The present invention relates to libraries and databases of structural peptides and methods for producing and/or screening same.

Sequence Listing

The present specification incorporates by reference in its entirety the Sequence Listing, which is provided as duplicate electronic associated files, each filed concurrently herewith and named "Copy_1_131467_sequence_listing_ST25.txt" and "Copy_2_131467_sequence_listing_ST25.txt". Each of these associated files was created on Feb. 6, 2007 and is 10,134 KB in size. This sequence information was prepared using PatentIn Version 3.3. Each sequence is identified in the sequence listing by the numeric indicator <210> followed by the sequence identifier (e.g. <210>1, <210>2, <210>3, etc). The length and type of sequence (DNA, protein (PRT), etc), and source organism for each nucleotide sequence, are indicated by information provided in the numeric indicator fields <211>, <212> and <213> respectively. Sequences referred to in the sequence listing are defined by the term "SEQ ID NO:", followed by the sequence identifier (eg. SEQ ID NO: 1 refers to the sequence in the sequence listing designated as <400>1).

General

As used herein the term "derived from" shall be taken to indicate that a specified integer may be obtained from a particular source albeit not necessarily directly from that source.

Throughout this specification, unless the context requires otherwise, the word "comprise", or variations such as "comprises" or "comprising", will be understood to imply the inclusion of a stated step or element or integer or group of steps or elements or integers but not the exclusion of any other step or element or integer or group of elements or integers.

Throughout this specification, unless specifically stated otherwise or the context requires otherwise, reference to a single step, composition of matter, group of steps or group of compositions of matter shall be taken to encompass one and a plurality (i.e. one or more) of those steps, compositions of matter, groups of steps or group of compositions of matter.

Each embodiment described herein is to be applied mutatis mutandis to each and every other embodiment unless specifically stated otherwise.

Those skilled in the art will appreciate that the invention described herein is susceptible to variations and modifications other than those specifically described. It is to be understood that the invention includes all such variations and modifications. The invention also includes all of the steps, features, compositions and compounds referred to or indicated in this specification, individually or collectively, and any and all combinations or any two or more of said steps or features.

The present invention is not to be limited in scope by the specific embodiments described herein, which are intended for the purpose of exemplification only. Functionally-equivalent products, compositions and methods are clearly within the scope of the invention, as described herein.

The present invention is performed without undue experimentation using, unless otherwise indicated, conventional techniques of molecular biology, microbiology, virology, recombinant DNA technology, peptide synthesis in solution, solid phase peptide synthesis, and immunology. Such procedures are described, for example, in the following texts that are incorporated by reference:

(i) J. F. Ramalho Ortigão, "The Chemistry of Peptide Synthesis" In: Knowledge database of Access to Virtual Laboratory website (Interactiva, Germany);

(ii) Sakakibara, D., Teichman, J., Lien, E. Land Fenichel, R. L. (1976). *Biochem. Biophys. Res. Commun.* 73 336-342

(iii) Merrifield, R. B. (1963). *J. Am. Chem. Soc.* 85. 2149-2154.

(iv) Barany, G. and Merrifield, R. B. (1979) in *The Peptides* (Gross, E. and Meienhofer, J. eds.), vol. 2, pp. 1-284, Academic Press, New York.

(v) Wüinsch, E., ed. (1974) *Synthese von Peptiden in Houben-Weyls Metoden der Organischen Chemie* (Müler, E., ed.), vol. 15, 4th edn., Parts 1 and 2, Thieme, Stuttgart.

(vi) Bodanszky, M. (1984) *Principles of Peptide Synthesis*, Springer-Verlag, Heidelberg.

(vii) Bodanszky, M. & Bodanszky, A. (1984) *The Practice of Peptide Synthesis*, Springer-Verlag, Heidelberg.

(viii) Bodanszky, M. (1985) *Int. J. Peptide Protein Res.* 25, 449-474.

BACKGROUND OF THE INVENTION

Description of the Related Art

The majority of biological processes in living organisms are mediated by proteins and their interactions with specific ligands e.g., other proteins, antigens, antibodies, nucleic acids, lipids and carbohydrates. Not only are such interactions involved in normal biological processes, protein interactions are also causative of processes involved in diseases or disorders. As a consequence, protein interactions are important targets for the development of new therapeutic compounds.

To identify suitable therapeutic compounds, the pharmaceutical industry has particularly focussed on screening processes to identify small molecule compounds capable of interacting with a protein and/or inhibiting a protein interaction. To function as a drug suitable for administration to a subject a small molecule must be capable of binding to a target with high affinity and selectivity.

Often, small molecules and short peptides do not effectively modulate protein interactions because they do not generally possess a required shape e.g., to fit into complex protein surfaces or bind to relatively featureless interfaces. As a consequence, small-molecules ands short peptides are generally unable to bind to many surfaces of a target protein with sufficiently-high affinity and specificity to modulate binding of a ligand to the target, or to otherwise agonize or antagonize the activity of the target protein. Accordingly, there is a high attrition rate for the screening of such molecules as drug leads for therapeutic applications, particularly for targets such as protein interactions.

By way of example, notwithstanding that short random peptides may be sufficiently small for commercial i.e., large-scale production by chemical synthesis, they generally provide highly-variable bioactivities against target proteins, and interactions with their targets are generally low affinity interactions. For example, in a screen of a random peptide library to identify a peptide capable of dissociating HIV protease fewer than about $1 \times 10^{-6}$ peptides displayed the desired activity (Park and Raines *Nat. Biotechnol.*, 18: 548-550, 2000). This low "hit" rate appears to be a result of the inability of the such random peptides to assume stable secondary structure and/or tertiary structure to thereby facilitate binding to a target protein.

In response to the low "hit" rate for identifying new drug leads, the pharmaceutical industry has expended some effort in developing synthetic scaffolds for presenting ligands to proteins, with a view to modulating activity of the target protein. However, such constraint of random peptide libraries has failed to increase the "hit" rate for identifying new drug candidates based on random peptide sequences to a level that makes peptides a viable alternative to small molecules. For example, random peptides have been constrained within scaffold structures e.g., the active site loop of thioredoxin ("Trx"; Colas et al. *Nature*, 380: 548-550, 1996) and tested for binding to cyclin-dependent kinase-2 (Cdk-2), however fewer than $2 \times 10^{-5}$ of the Trx-constrained peptides actually blocked the target. Thus, the provision of synthetic scaffolds does not necessarily enhance "hit" rate. It is also possible that the limited repertoire of artificial scaffolds available to the industry will necessarily limit the diversity of structures that can be produced using such approaches, and may even mask or modify any native structures formed.

Native proteins have considerable structural features, including protein "domains" that are generally of functional significance. Until the present invention, such structural features have largely been utilized to determine evolutionary relationships between proteins, and for dissecting dynamic folding pathways i.e., how particular proteins fold. For example, the CATH database (Orengo et al., *Structure* 5, 1093-1108, 1997) classifies proteins according to a hierarchy of Class, Architecture, Topology and Homologous superfamily based upon structure, sequence, and functional considerations. In particular, the CATH hierarchy acknowledges three basic structural features i.e., class, architecture and topology. Protein "class" is highest in the CATH hierarchy and, in this context is a reference to the secondary structure composition and packing of a protein i.e., mainly α-helix, mainly β-strand, and α-β including alternating α/β in which the secondary structures alternate along the protein chain, and α+β in which the α and β regions are largely segregated. Thus, the "class" to which a protein belongs is a global assignment based on secondary structure considerations. Protein "architecture" refers to the overall shape of a protein based upon groups of similar secondary structural arrangements irrespective of the order in which they are connected in the protein. Protein "topology" describes the relative associations and orientations of secondary structures in 3D and the order in which they are connected. Protein "folds" are recognized in the CATH hierarchy as a function of topology, however the literature is confusing in this respect, because a fold can adopt a specific architecture e.g., Orengo and Thornton, Ann. Rev. Biochem. 74, 867-900, 2005.

As used herein, the term "fold" is therefore taken in its broadest context to mean a tertiary structure formed by the folding of multiple secondary structures including aspects of both architecture and topology. Herein, the term "subdomain" is used interchangeably with the term "fold". A "fold" may form independently or in association with other parts of a protein or other proteins or a scaffold structure.

From a practical perspective, there are significant limitations in utilizing structure data for drug screening applications. For example, structure data are limited, especially when compared to the huge volumes of sequence data available. This is notwithstanding the recent developments of computational methods for obtaining source data consisting essentially of fold recognition and threading algorithm that provide specific sequence annotations e.g., PSI-BLAST or IMPALA (Muller et al., J. Mol. Biol. 293, 1257-1271, 1999; Buchan et al. Genome Res. 12, 503-514, 2002; J. Mol. Biol. 287.797-815, 1999). Such methods are often of limited applicability for drug screening applications because the lengths of annotated sequences produced there from are often too long for practical applications, not being restricted to single folds and more often than not containing flanking sequences. More importantly, such annotated sequence data provides no indication of structural considerations outside the context of the native protein. This is partly due to the fact that these methods have been developed largely as research tools for determining evolutionary relationships between proteins and for assessing how individual proteins fold in nature. For example, Table 1 herein includes descriptions of segments of proteins comprising protein domains.

TABLE 1

Exemplary structures adopted by homologous superfamilies of proteins

| Class of secondary structure | Architecture and/or topology of folds within proteins |
|---|---|
| α-helix | α-helices; folded leaf, partly opened |
| α-helix | 2α-helices; antiparallel hairpin, left-handed twist |
| α-helix | tandem repeat of two calcium-binding loop-helix motifs comprising α--helices |
| α-helix | helix-extended loop-helix; parallel α-helices |
| α-helix | 2α-helices: one short, one long; aromatic-rich interface |
| α-helix | 3α-helices; folded leaf, opened |
| α-helix | 3-α-helices; bundle, closed or partly opened, right-handed twist; up-and down |
| α-helix | 3-α-helices; bundle, closed or partly opened, right-handed twist; up-and down |
| α-helix | 3α-helices; bundle, right-handed twist |
| α-helix | 3-4α-helices |
| α-helix | 3α-helices; architecture is similar to that of the "winged helix" fold |
| α-helix | 3α-helices; bundle, closed, left-handed twist; up-and-down |
| α-helix | 3α-helices; bundle, closed, left-handed twist; up-and-down; mirror topology to the spectrin-like fold |
| α-helix | 3α-helices; bundle, closed, right-handed twist; up-and-down |
| α-helix | 3α-helices; bundle, closed, left-handed twist, up-and-down |
| α-helix | core: 3α-helices; bundle, closed, left-handed twist; up-and-down |
| α-helix | 3α-helices; bundle, partly opened |
| α-helix | 3α-helices, the first one is shorter than the other two; bundle, partly opened |
| α-helix | 3 short α-helices; irregular array |
| α-helix | 3 short α-helices; irregular array |
| α-helix | 3α-helices; irregular array |

TABLE 1-continued

Exemplary structures adopted by homologous superfamilies of proteins

| Class of secondary structure | Architecture and/or topology of folds within proteins |
|---|---|
| α-helix | 3α-helices; irregular array; disulfide-rich |
| α-helix | α-helices; irregular array; disulfide-rich |
| α-helix | 3α-helices; irregular array |
| α-helix | 3α-helices; bundle, closed, right-handed twist; up-and-down |
| α-helix | 3α-helices; bundle, closed, left-handed twist; parallel |
| α-helix | 3α-helices; irregular array |
| α-helix | 3α-helices; long middle helix is flanked at each end with shorter ones |
| α-helix | 3α-helices; bundle, open |
| α-helix | α-helices; irregular array |
| α-helix | 4α-helices; bundle, closed or partly opened, left-handed twist; up-and-down |
| α-helix | 4α-helices; bundle, closed, right-handed twist; 1 crossover connection |
| α-helix | 4α-helices; bundle, closed, left-handed twist; 1 crossover connection |
| α-helix | 4α-helices; bundle, closed; left-handed twist; 2 crossover connections |
| α-helix | 4α-helices; bundle; one loop crosses over one side of the bundle |
| α-helix | 4α-helices; bundle; helix 3 is shorter than others; up-and-down |
| α-helix | 4α-helices; bundle; minor mirror variant of up-and-down topology |
| α-helix | 4α-helices; dimer of identical alpha-hairpin subunits; bundle, closed, left-handed twist |
| α-helix | 4α-helices; bundle, closed, right-handed twist |
| α-helix | 4α-helices; bundle, closed, right-handed twist |
| α-helix | 4α-helices; bundle, closed, right-handed twist |
| α-helix | 4α-helices; bundle, closed, left-handed twist |
| α-helix | 4α-helices; bundle, closed, right-handed twist |
| α-helix | 4α-helices; folded leaf, closed |
| α-helix | 4α-helices; orthogonal array |
| α-helix | 4α-helices; the long C-terminal helix protrudes from the domain and binds to DNA |
| α-helix | 4-α-helices; bundle, closed, left-handed twist; 2 crossover connections |
| α-helix | 4α-helices; array of 2 hairpins, opened |
| α-helix | 4α-helices: bundle |
| α-helix | 4α-helices: bundle |
| α-helix | 4α-helices: open bundle; capped by two small 3-stranded beta-sheets duplication: consists of two structural repeats |
| α-helix | 4α-helices: bundle; flanked by two short beta-hairpins duplication: consists of two structural repeats |
| α-helix | 4α-helices; array of 2 hairpins, opened |
| α-helix | 4 helices; bundle, closed, left-handed twist; right-handed super helix |
| α-helix | 4α-helices; bundle, left-handed twist; right-handed super helix |
| α-helix | 4α-helices; bundle, right-handed twist; right-handed super helix |
| α-helix | 4 long α-helices; bundle, left-handed twist (coiled coil); right-handed super helix |
| α-helix | 4α-helices; bundle, left-handed twist; left-handed super helix |
| α-helix | 4α-helices; bundle, right-handed twist; left-handed super helix |
| α-helix | 4α-helices; irregular array |
| α-helix | 2α-helices and adjacent loops |
| α-helix | 4α-helices; irregular array |
| α-helix | 4α-helices; irregular array |
| α-helix | 4α-helices; irregular array, disulfide-linked |
| α-helix | 4α-helices irregular array, disulfide-linked |
| α-helix | 4α-helices; irregular array, disulfide-linked |
| α-helix | 4α-helices; folded leaf; right-handed super helix |
| α-helix | 4α-helices; folded leaf; right-handed super helix |
| α-helix | 4α-helices; bundle |
| α-helix | 4 long α-helices; bundle |
| α-helix | 4 helices; bundle, partly opened |
| α-helix | core: 4α-helices; bundle, partly opened, capped with a beta-sheet |
| α-helix | 4α-helices, bundle |
| α-helix | 4 helices; the three last helices form a bundle similar to that of the RuvA C-domain |
| α-helix | 4α-helices; an orthogonal array |
| α-helix | 4α-helices; an orthogonal array |
| α-helix | 4α-helices; up-and-down bundle |
| α-helix | 4α-helices; open up-and-down bundle; binds alpha-helical peptides |
| α-helix | 4α-helices; open up-and-down bundle; flexible N-terminal tail |
| α-helix | 4α-helices; array |
| α-helix | 4α-helices; bundle, closed, left-handed twist |
| α-helix | 4α-helices dimer of identical alpha-hairpin subunits; open bundle |
| α-helix | 4-5α-helices; bundle of two orthogonally packed alpha-hairpins |
| α-helix | 4-5α-helices; right-handed super helix |
| α-helix | 5α-helices; right-handed super helix; swapped dimer with the two long C-terminal helices |
| α-helix | α-helices array; two long helices form a hairpin that dimerizes into a 4-helical bundle |
| α-helix | 5α-helices; bundle, closed, left-handed twist |

TABLE 1-continued

Exemplary structures adopted by homologous superfamilies of proteins

| Class of secondary structure | Architecture and/or topology of folds within proteins |
|---|---|
| α-helix | 5α-helices; bundle, closed, left-handed twist |
| α-helix | 5α-helices; bundle, closed, left-handed twist; helices 2-5 adopt the Four-helical up-and-down bundle fold |
| α-helix | 5α-helices; bundle, closed, left-handed twist |
| α-helix | 5α-helices; folded leaf, closed |
| α-helix | 5α-helices; folded leaf, closed |
| α-helix | 5α-helices; folded leaf |
| α-helix | 5α-helices; irregular array; left-handed super helix |
| α-helix | 4-5α-helices; bundle; left-handed super helix |
| α-helix | 5α-helices; bundle |
| α-helix | 5α-helices; bundle |
| α-helix | α-helices; bundle |
| α-helix | 5α-helices; bundle |
| α-helix | α-helices; one helix is surrounded by the others |
| α-helix | 5α-helices; one helix is surrounded by the others |
| α-helix | 5α-helices; one helix is surrounded by the others |
| α-helix | 5α-helices; contains one more helix and a beta-hairpin outside the core |
| α-helix | 5α-helices: bundle |
| α-helix | α-helical bundle; up-and-down; right-handed twist |
| α-helix | 5α-helices: orthogonal array |
| α-helix | 5α-helices: orthogonal array |
| α-helix | 5α-helices: irregular array |
| α-helix | 5α-helices; array |
| α-helix | 5α-helices; orthogonal array; folding similarity to the TipA-S domain |
| α-helix | 5α-helices; array |
| α-helix | 6α-helices: bundle; left-handed twist, up-and-down topology |
| α-helix | 6α-helices, homodimer of 3-helical domains |
| α-helix | 6α-helices, homodimer of 3-helical domains |
| α-helix | 6α-helices, homodimer of 3-helical domains |
| α-helix | 6α-helices, heterodimer of 3-helical domains |
| α-helix | dimer of 3α-helical segments; consists of two subdomains: 4-helical bundle and coiled coil |
| α-helix | 6α-helices: closed bundle; greek-key; internal pseudo twofold symmetry |
| α-helix | 6α-helices: closed bundle; greek-key; internal pseudo twofold symmetry |
| α-helix | 6α-helices: bundle; one central helix is surrounded by 5 others |
| α-helix | 6α-helices: bundle; one central helix is surrounded by 5 others |
| α-helix | 6α-helices: array |
| α-helix | 6α-helices: orthogonal array |
| α-helix | irregular array of 6 short α-helices |
| α-helix | 6α-helices; one central helix is surrounded by 5 others |
| α-helix | 6α-helices; one central helix is surrounded by 5 others |
| α-helix | 6α-helices; bundle; one central helix is surrounded by 5 others |
| α-helix | Multiple α-helices |
| α-helix | Multihelical; core: 5-helical bundle |
| α-helix | multihelical; contains compact array of 6 short helices |
| α-helix | multihelical; irregular array of long and short helices |
| α-helix | multihelical; irregular array of long and short helices |
| α-helix | multihelical bundle; contains buried central helix |
| α-helix | multihelical; contains two buried central helices |
| α-helix | multihelical; can be divided into two subdomains |
| α-helix | multihelical; consists of two all-alpha subdomains contains a 4-helical bundle with left-handed twist and up-and-down topology |
| α-helix | multihelical; consists of two all-alpha subdomains each containing a 3-helical bundle with right-handed twist |
| α-helix | multihelical; consists of two all-alpha subdomains; contains a 4-helical bundle with left-handed twist and up-and-down topology |
| α-helix | multihelical; consists of two tightly associated 3-helical bundles with different twists |
| α-helix | multihelical; consists of two all-alpha subdomains; dimer |
| α-helix | multihelical; consists of two all-alpha subdomains |
| A-helix | multihelical; consists of two all-alpha domains |
| A-helix | multihelical; consists of two different 3-helical domains connected by a long, partly helical linker |
| α-helix | multihelical; consists of two different alpha-helical bundles (4-helical and 3-helical) |
| α-helix | multihelical; consists of two different alpha-helical bundles |
| α-helix | multihelical; consists of two different alpha-helical bundles |
| α-helix | multihelical; consists of two different all-alpha subdomains, 4 helices each |
| α-helix | multihelical; consists of two all-alpha domains |
| α-helix | multihelical; consists of two all-alpha domains |
| α-helix | multihelical; consists of two all-alpha subdomains |
| α-helix | multihelical consists of two all-alpha subdomains subdomain 1 (residues 10-100) is a 4-helical bundle |
| α-helix | multihelical |

TABLE 1-continued

Exemplary structures adopted by homologous superfamilies of proteins

| Class of secondary structure | Architecture and/or topology of folds within proteins |
|---|---|
| α-helix | multihelical; consists of two all-alpha subdomains |
| α-helix | multihelical; common core is formed around two long antiparallel helices related by (pseudo) twofold symmetry |
| α-helix | multihelical |
| α-helix | multihelical; up to seven alpha-hairpins are arranged in closed circular array |
| α-helix | multihelical; consists of two all-alpha domains |
| α-helix | multihelical |
| α-helix | multihelical; forms intertwined dimer of identical 5-helical subunits |
| α-helix | multihelical; intertwined tetramer |
| α-helix | multihelical; intertwined trimer of identical 3-helical subunits |
| α-helix | multihelical; consists of two all-alpha domains |
| α-helix | multihelical; core: 5-helical bundle; binds cofactor at the beginning of third helix |
| α-helix | multihelical; contains a 3-helical bundle surrounded by several shorter helices |
| α-helix | multihelical; contains a 3-helical Hin recombinase-like subdomain and two long dimerisation helices |
| α-helix | multihelical oligomeric protein |
| α-helix | multihelical; consists of a conserved 4-helical core and a variable insert subdomain |
| α-helix | multihelical; consists of 2 all-alpha subdomains |
| α-helix | multihelical; consists of 2 all-alpha subdomains, "rigid" one and "mobile" one |
| α-helix | multihelical; consists of 2 all-alpha subdomains connected by a long helix |
| α-helix | multihelical; array of longer and shorter helices; contains an alpha-hairpin dimerisation subdomain |
| α-helix | multihelical; bundle of longer and shorter helices |
| α-helix | multihelical; three-helical bundle in the core is surrounded by non-conserved helices |
| α-helix | multihelical; consists of two subdomains |
| α-helix | multihelical |
| α-helix | multihelical |
| α-helix | multihelical; can be divided into an alpha-alpha super helix domain and a long alpha-hairpin dimerization domain |
| α-helix | multihelical; can be divided into three subdomains (neck, body and tail) |
| α-helix | multihelical; 2 (curved) layers; alpha/alpha; right-banded super helix |
| α-helix | multihelical |
| α-helix | multihelical; consists of two all-alpha subdomains |
| α-helix | multihelical; interlocked (homo)dimer |
| α-helix | multihelical; interlocked heterodimer with F-box proteins |
| α-helix | multihelical; interlocked heterodimer with the Skp1 dimerisation domain |
| α-helix | multihelical; 3 layers or orthogonally packed helices |
| α-helix | multihelical |
| α-helix | multihelical; consist of two subdomains |
| α-helix | multihelical; open array |
| α-helix | multihelical; 2 layers or orthogonally packed helices |
| α-helix | multihelical bundle; contains buried central helix |
| α-helix | multihelical; consists of two topologically similar alpha-helical bundles |
| α-helix | multihelical; consists of 2 four-helical bundles |
| α-helix | multihelical; one domain consists of two similar disulfide-linked subdomains |
| α-helix | multihelical, consists of three all-alpha domains |
| α-helix | multihelical, consists of three all-alpha domains |
| α-helix | multihelical; core: 8 helices (C-J) are arranged in 2 parallel layers |
| α-helix | multihelical; 8 helices arranged in 2 parallel layers |
| α-helix | multihelical; bundle |
| α-helix | multihelical; core: 6 helices, bundle |
| α-helix | multihelical; forms a boat-shaped protein shell around cofactors |
| α-helix | multihelical; bundle |
| α-helix | multihelical; contains 4-helical bundle and 2-helical arm |
| α-helix | multihelical; array |
| α-helix | multihelical; array |
| α-helix | multihelical; bundle |
| α-helix | multihelical; bundle |
| α-helix | multihelical; bundle |
| α-helix | multihelical; array |
| α-helix | common core: 2 helices, disulfide-linked, and a calcium-binding loop |
| α-helix | 5 helices: irregular disulfide-linked array; also contains a small beta-hairpin |
| α-helix | 5 helices: irregular disulfide-linked array; form homodimer |
| α-helix | 5 helices: irregular disulfide-linked array; topological similarity to the Fungal elicitin fold |
| α-helix | 6 helices: irregular non-globular array; also contains two small b-hairpins |
| α-helix | 3 helices, non-globular array; forms interlocked heterodimers with its targets |
| α-helix | variable number of helices and little beta structure |
| β-sheet | sandwich; 7 strands in 2 sheets; greek-key |
| β-sheet | sandwich; 9 strands in 2 sheet; greek-key; subclass of immunoglobin-like fold |
| β-sheet | sandwich; 7 strands in 2 sheets, greek-key |

TABLE 1-continued

Exemplary structures adopted by homologous superfamilies of proteins

| Class of secondary structure | Architecture and/or topology of folds within proteins |
|---|---|
| β-sheet | sandwich; 6 strands in 2 sheets |
| β-sheet | sandwich; 6 strands in 2 sheets |
| β-sheet | sandwich; 6 strands in 2 sheets |
| β-sheet | six-stranded beta-sandwich, jelly-roll/greek-key topology |
| β-sheet | sandwich; 7 strands in 2 sheets, greek-key |
| β-sheet | sandwich; 7 strands in 2 sheets, greek-key; permutation of the immunoglobulin-like fold |
| β-sheet | sandwich; 8 strands in 2 sheets; greek-key |
| β-sheet | sandwich; 8 strands in 2 sheets; greek-key |
| β-sheet | sandwich; 8 strands in 2 sheets; meander |
| β-sheet | sandwich; 8 strands in 2 sheets; meander |
| β-sheet | sandwich; 8 strands in 2 sheets; jelly-roll; some members can have additional 1-2 strands |
| β-sheet | sandwich; 8 strands in 2 sheets; greek-key |
| β-sheet | sandwich; 8 strands in 2 sheets; complex topology |
| β-sheet | sandwich; 8 strands in 2 sheets; jelly-roll |
| β-sheet | sandwich; 8 strands in 2 sheets; jelly-roll; similarity to the Nucleoplasmin-like/VP fold |
| β-sheet | sandwich; 8 strands in 2 sheets; jelly-roll |
| β-sheet | sandwich; 8 strands in 2 sheets; jelly-roll |
| β-sheet | sandwich; 8 strands in 2 sheets; greek-key |
| β-sheet | beta-sandwich: 8 strands in 2 sheets |
| β-sheet | sandwich; 8 strands in 2 sheets; complex topology with the crossing loops |
| β-sheet | sandwich; 8 strands in 2 sheets; greek-key: partial topological similarity to immunoglobulin-like folds |
| β-sheet | sandwich; 8 strands in 2 sheets; greek-key: partial topological similarity to immunoglobulin-like folds |
| β-sheet | sandwich; 8 strands in 2 sheets; greek-key: partial topological similarity to immunoglobulin-like folds |
| β-sheet | sandwich; 9 strands in 2 sheets; jelly-roll |
| β-sheet | sandwich; 9 strands in 2 sheets; jelly-roll; form trimers |
| β-sheet | sandwich; 9 strands in 2 sheets; greek-key |
| β-sheet | sandwich; 9 strands in 2 sheets; greek-key |
| β-sheet | sandwich; 9 strands in 2 sheets; greek-key/jelly-roll |
| β-sheet | sandwich; 9 strands in 2 sheets; jelly-roll |
| β-sheet | sandwich; 9 strands in 2 sheets; greek-key; contains a few helices in loop regions |
| β-sheet | sandwich; 9 strands in 2 sheets; unusual topology with 2 crossover loops |
| β-sheet | sandwich, 10 strands in 2 sheets; greek-key |
| β-sheet | sandwich, 10 strands in 2 sheets; jelly-roll |
| β-sheet | sandwich, 10 strands in 2 sheets; jelly-roll |
| β-sheet | sandwich, 10 strands in 2 sheets; "folded meander" |
| β-sheet | sandwich, 10 strands in 2 sheets |
| β-sheet | sandwich; 11 strands in 2 sheets |
| β-sheet | sandwich; 11 strands in 2 sheets; greek-key |
| β-sheet | sandwich; 11 strands in 2 sheets; greek-key |
| β-sheet | sandwich; 14 strands in 2 sheets; greek-key |
| β-sheet | sandwich; 12-14 strands in 2 sheets; complex topology |
| β-sheet | sandwich; 18 strands in 2 sheets |
| β-sheet | duplication: two beta-sandwiches of similar topologies are fused together in a single three beta-sheet domain |
| β-sheet | consists of two beta-sandwich domains of similar topologies |
| β-sheet | consists of two different beta-sandwich domains of partial topological similarity to immunoglobulin-like folds |
| β-sheet | consists of two different beta-sandwich domains unrelated to other beta sandwich folds |
| β-sheet | consists of two all-beta subdomains: conserved small domain has a rubredoxin-like fold; larger domain consists of 6 beta-stands packed in either sandwich of two 3-stranded sheets or closed barrel (n = 6; S = 8) |
| β-sheet | this fold is formed by three glycine-rich regions inserted into a small 8-stranded beta-sandwich |
| β-sheet | barrel, partly opened; $n^* = 4$, $S^* = 8$; meander |
| β-sheet | contains barrel, partly opened; $n^* = 4$, $S^* = 8$; meander |
| β-sheet | contains barrel, partly opened; $n^* = 4$, $S^* = 8$; meander; capped by alpha-helix |
| β-sheet | core: barrel, in some members open; $n^* = 4$, $S^* = 8$; meander |
| β-sheet | core: barrel, open; $n^* = 4$, $S^* = 8$; meander; SH3-like topology |
| β-sheet | core: barrel, open; $n^* = 4$, $S^* = 8$; meander; SH3-like topology; some similarity to the Sm-like fold |
| β-sheet | core: barrel, open; $n^* = 4$, $S^* = 8$; meander; SH3-like topology; some similarity to the Sm-like fold |
| β-sheet | core: barrel, closed; $n = 4$, $S = 8$; complex topology; helix-containing crossover connection |
| β-sheet | barrel, closed; $n = 5$, $S = 8$, meander |
| β-sheet | barrel, closed or partly opened $n = 5$, $S = 10$ or $S = 8$; greek-key |

TABLE 1-continued

Exemplary structures adopted by homologous superfamilies of proteins

| Class of secondary structure | Architecture and/or topology of folds within proteins |
|---|---|
| β-sheet | core: barrel, partly opened; n* = 5, S* = 8; meander |
| β-sheet | barrel, closed; n = 6, S = 12; and a hairpin triplet; meander |
| β-sheet | barrel, closed; n = 6, S = 10; greek-key |
| β-sheet | barrel, closed; n = 6, S = 10; greek-key |
| β-sheet | barrel; n = 6, S = 10; greek-key |
| β-sheet | core: barrel; n = 6, S = 10; greek-key; topologically similar to the FMN-binding split barrel |
| β-sheet | segment-swapped dimer forming two identical conjoint barrels (n = 6, S = 10) topologically similar to the FMN-binding split barrel |
| β-sheet | barrel, open; n* = 6, S* = 10; greek key |
| β-sheet | barrel, closed; n = 6, S = 8; greek-key |
| β-sheet | barrel; n = 6, S = 8, greek-key; similar to one trypsin-like protease barrel |
| β-sheet | barrel; n = 6, S = 8, greek-key |
| β-sheet | barrel, closed; n = 6, S = 8; greek-key |
| β-sheet | barrel, closed; n = 6, S = 8, greek-key, partial similarity to the OB-fold |
| β-sheet | barrel, closed; n = 6, S = 10, complex topology |
| β-sheet | core: barrel, closed; n = 6, S = 8; topology is similar to that of the acid proteases barrel |
| β-sheet | barrel, closed; n = 6, S = 8; a crossover loop topology |
| β-sheet | barrel, closed; n = 6, S = 10; complex topology with crossover (psi) loops |
| β-sheet | barrel, closed; n = 6, S = 10; complex topology |
| β-sheet | barrel, closed; n = 6, S = 10; meander; capped at both ends by alpha-helices |
| β-sheet | barrel, partly opened; n* = 6, S* = 12; meander; capped by an alpha-helix |
| β-sheet | barrel, closed; n = 6, S = 12; mixed beta-sheet |
| β-sheet | core: barrel, closed; n = 7, S = 8; complex topology |
| β-sheet | barrel, closed; n = 7, S = 10; complex topology |
| β-sheet | barrel, closed; n = 7, S = 10; order: 1234765; strands 1 and 5 are parallel to each other |
| β-sheet | barrel, closed; n = 7, S = 10; complex topology |
| β-sheet | barrel, closed; n = 7, S = 10; greek-key topology; one overside connection |
| β-sheet | barrel, closed; n = 7, S = 10; complex topology |
| β-sheet | core: barrel, closed; n = 7, S = 12; meander |
| β-sheet | barrel, closed or opened; n = 8, S = 12; meander |
| β-sheet | barrel, closed; n = 8, S = 10; meander |
| β-sheet | barrel, closed; n = 8, S = 10; complex topology |
| β-sheet | barrel, closed; n = 8, S = 10; one overside connection |
| β-sheet | barrel, closed; n = 8, S = 10; mixed sheet; two overside connections |
| β-sheet | barrel, partly open; n* = 8, S* = 10; one psi loop |
| β-sheet | dimer of two non-identical subunits; forms two similar barrels, n = 8, S = 10 each, that are fused together with the formation of third barrel, n = 6, S = 8 |
| β-sheet | consists of four 4-stranded beta-sheet motifs; meander |
| β-sheet | consists of five 4-stranded beta-sheet motifs; meander |
| β-sheet | consists of six 4-stranded beta-sheet motifs; meander |
| β-sheet | consists of seven 4-stranded beta-sheet motifs; meander |
| β-sheet | consists of eight 4-stranded beta-sheet motifs; meander |
| β-sheet | folded sheet; greek-key |
| β-sheet | core: 3-stranded meander beta-sheet |
| β-sheet | small mixed beta-sheet, 4 "generalized" strands |
| β-sheet | coiled antiparallel beta-sheet of 5 strands, order 51324; complex topology, crossing loops |
| β-sheet | twisted meander beta-sheet of 6 strands |
| β-sheet | core: twisted 7-stranded beta-sheet (half-barrel) of complex topology |
| β-sheet | core: twisted 7-stranded beta-sheet (half-barrel) |
| β-sheet | single sheet; 10 strands |
| β-sheet | 11 stranded sheet partly folded in a corner-like structure filled with a few short helices |
| β-sheet | single sheet; 16 strands; meander |
| β-sheet | single sheet formed by beta-hairpin repeats; exposed on both sides in the middle |
| β-sheet | consists of 3 4-stranded sheets; strands are parallel to the 3-fold axis |
| β-sheet | consists of 3 4-stranded sheets; strands are perpendicular to the 3-fold axis |
| β-sheet | superhelix turns are made of parallel beta-strands and (short) turns |
| β-sheet | superhelix turns are made of parallel beta-strands and (short) turns |
| β-sheet | one turn of helix is made by two pairs of antiparallel strands linked with short turns |
| β-sheet | (homo)trimer; each chain donates 3 beta-strands per turn of the helix |
| β-sheet | trimer formed by the interlocking beta-hairpin repeat units |
| β-sheet | trimer; contains two different beta-prism-like domains connected by an linker subdomain of less regular structure |
| β-sheet | Trp-rich beta-hairpin repeat units form helical structures of 3 units per turn |
| β-sheet | sandwich of half-barrel shaped beta-sheets |
| β-sheet | double-stranded ribbon sharply bent in two places; the ribbon ends form incomplete barrel; jelly-roll |
| β-sheet | multisheet protein with a mixture of beta-sandwich and beta-prism features |

TABLE 1-continued

Exemplary structures adopted by homologous superfamilies of proteins

| Class of secondary structure | Architecture and/or topology of folds within proteins |
|---|---|
| β-sheet | multisheet protein containing partial beta-propeller and beta-sandwich regions |
| β-sheet | multisheet protein with a mixture of beta-sandwich and beta-barrel features |
| β-sheet | complex fold made of five beta-hairpin units and a b-ribbon arc |
| β-sheet | complex fold made of several coiled beta-sheets; contains an SH3-like barrel |
| β-sheet | complex fold made of several coiled beta-sheets |
| β-sheet | complex fold made of several coiled beta-sheets |
| β-sheet | complex fold |
| β-sheet | complex fold; consists of two intertwined subdomains |
| β-sheet | complex fold |
| β-sheet | complex fold made of bifurcated and partly folded beta-sheet |
| β-sheet | complex fold made of bifurcated and coiled beta-sheets |
| β-sheet | complex fold made of bifurcated and coiled b-sheets |
| β-sheet | pseudobarrel; mixed sheet of 7 strand folded upon itself and "buckled" by two beta-turns |
| β-sheet | pseudobarrel; sandwich of two sheets packed at a positive interstrand angle and interconnected with many short turns |
| β-sheet | pseudobarrel; capped on both ends by alpha-helices |
| β-sheet | pseudobarrel; capped at one end by an alpha-helix |
| β-sheet | pseudobarrel; capped on both ends by alpha-helices |
| β-sheet | pseudobarrel; mixed folded sheet of 5 strands; order 13452; strand 1 and 3 are parallel to each other |
| β-sheet | pseudobarrel; some similarity to OB-fold |
| β-sheet | non-globular proline-rich hairpin |
| α/β | contains parallel beta-sheet barrel, closed; n = 8, S = 8; strand order 12345678 |
| α/β | core: 3 layers, a/b/a; parallel beta-sheet of 6 strands, order 321456 |
| α/β | core: 3 layers, b/b/a; central parallel beta-sheet of 5 strands, order 32145; top antiparallel beta-sheet of 3 strands, meander |
| α/β | 3 layers: a/b/a; parallel beta-sheet of 5 strands, order 32145; Rossmann-like |
| α/β | 3 layers: a/b/a; parallel beta-sheet of 5 strands, order 32145; incomplete Rossmann-like fold; binds UDP group |
| α/β | variant of beta/alpha barrel; parallel beta-sheet barrel, closed, n = 7, S = 8; strand order 1234567; some members may have fewer strands |
| α/β | contains: barrel, closed; n = 10, S = 10; accommodates a hairpin loop inside the barrel |
| α/β | 3 layers: b/b/a; the central sheet is parallel, and the other one is antiparallel; there are some variations in topology |
| α/β | 2 layers, a/b; parallel beta-sheet of 3 strands, order 123 |
| α/β | core: 3 layers, a/b/a; parallel beta-sheet of 4 strands, order 1234; structural similarity of the MurF and HprK extends beyond the core. |
| α/β | 2 curved layers, a/b; parallel beta-sheet; order 1234...N; there are sequence similarities between different superfamilies |
| α/β | core: three turns of irregular (beta-beta-alpha)n superhelix |
| α/β | core: 4 turns of a (beta-alpha)n superhelix |
| α/β | core: 4 turns of (beta-beta-alpha)n superhelix |
| α/β | 3 layers, a/b/a; core: parallel beta-sheet of 4 strands, order 2134 |
| α/β | 3 layers, a/b/a; core: parallel beta-sheet of 4 strands, order 2134 |
| α/β | 3 layers, a/b/a; core: parallel beta-sheet of 4 strands, order 2134 |
| α/β | 3 layers, a/b/a; core: parallel beta-sheet of 4 strands, order 2134 |
| α/β | 3 layers, a/b/a; parallel beta-sheet of 4 strands, order 2134 |
| α/β | 3 layers, a/b/a; core: parallel beta-sheet of 4 strands, order 2134 |
| α/β | core: 3 layers; a/b/a; parallel beta-sheet of 4 strands; 2134 |
| α/β | 3 layers, a/b/a; parallel beta-sheet of 4 strands, order 2134 |
| α/β | 3 layers, a/b/a; parallel beta-sheet of 4 strands, order 2134 |
| α/β | 3 layers, a/b/a; core: parallel beta-sheet of 4 strands, order 3214 |
| α/β | 3 layers, a/b/a; core: parallel beta-sheet of 4 strands, order 1423 |
| α/β | 3 layers, a/b/a; parallel beta-sheet of 5 strands, order 21345 |
| α/β | 3 layers, a/b/a; parallel beta-sheet of 5 strands, order 32145 |
| α/β | 3 layers, a/b/a; parallel beta-sheet of 5 strands, order 32145 |
| α/β | core: 3 layers, a/b/a; parallel beta-sheet of 5 strands, order 32145 |
| α/β | 3 layers, a/b/a; parallel beta-sheet of 5 strands, order 32145; Rossmann-like |
| α/β | 3 layers, a/b/a; parallel beta-sheet of 5 strands, order 32145; Rossmann-like |
| α/β | 3 layers, a/b/a, core: parallel beta-sheet of 5 strands, order 43215 |
| α/β | 3 layers, a/b/a; core: parallel beta-sheet of 5 strands, order 32145 |
| α/β | 3 layers, a/b/a, core: parallel beta-sheet of 5 strands, order 21354; topological similarity to a part of the arginase/deacetylase fold |
| α/β | core: 3 layers: a/b/a, parallel beta-sheet of 5 strands, order 21435; contains a deep trefoil knot |
| α/β | 3 layers: a/b/a; parallel or mixed beta-sheet of 4 to 6 strands |
| α/β | 3 layers: a/b/a; parallel beta-sheet of 6 strands, order 321456; Rossmann-like |
| α/β | 3 layers: a/b/a; parallel beta-sheet of 6 strands, order 321456 |
| α/β | 3 layers: a/b/a; parallel beta-sheet of 6 strands, order 321456; also contains a C-terminal alpha + beta subdomain |
| α/β | 3 layers: a/b/a; parallel beta-sheet of 6 strands, order 321456 |

TABLE 1-continued

Exemplary structures adopted by homologous superfamilies of proteins

| Class of secondary structure | Architecture and/or topology of folds within proteins |
|---|---|
| α/β | 3 layers: a/b/a; parallel beta-sheet of 6 strands, order 321456 |
| α/β | core: 3 layers: a/b/a; parallel or mixed beta-sheet of 6 strands, order 321456 |
| α/β | 3 layers: a/b/a; parallel beta-sheet of 6 strands, order 321456 |
| α/β | 3 layers: a/b/a; parallel beta-sheet of 6 strands, order 432156 |
| α/β | 3 layers: a/b/a; parallel beta-sheet of 6 strands, order 342156 |
| α/β | 3 layers: a/b/a; parallel beta-sheet of 6 strands, order 213456 |
| α/β | 3 layers: a/b/a; parallel beta-sheet of 6 strands, order 213465 |
| α/β | 3 layers: a/b/a, parallel or mixed beta-sheets of variable sizes |
| α/β | 3 layers: a/b/a, parallel beta-sheet of 6 strands, order 324156 |
| α/β | 3 layers: a/b/a, parallel beta-sheet of 7 strands, order 7165243 |
| α/β | 3 layers: a/b/a, parallel beta-sheet of 7 strands, order 3214567 |
| α/β | 3 layers: a/b/a, parallel beta-sheet of 7 strands, order 4321567 |
| α/β | 3 layers: a/b/a, parallel beta-sheet of 7 strands, order 3421567 |
| α/β | 3 layers: a/b/a, parallel beta-sheet of 7 strands, order 2314567; left-handed crossover connection between strands 2 & 3 |
| α/β | core: 3 layers, a/b/a; parallel beta-sheet of 7 strands, order 2134756 |
| α/β | 3 layers: a/b/a, parallel beta-sheet of 8 strands, order 21387456 |
| α/β | 3 layers: a/b/a; parallel beta-sheet of 8 strands, order 54321678 |
| α/β | beta(2)-(alpha-beta)2-beta; 2 layers, a/b; mixed beta-sheet of 5 strands, order 12345; strands 1 & 5 are antiparallel to the rest |
| α/β | beta(2)-(alpha-beta)2-beta(3); 3 layers, a/b/b; some topological similarity to the N-terminal domain of MinC |
| α/β | core: 2 layers, a/b; mixed beta-sheet of 6 strands, order 324561; strands 3 & 6 are antiparallel to the rest |
| α/β | 3 layers: a/b/a; parallel beta-sheet of 4 strands, order 2134 |
| α/β | core: 3 layers, a/b/a; parallel beta-sheet of 4 strands, order 1423 |
| α/β | 3 layers: a/b/a; parallel beta-sheet of 5 strands, order 32451 |
| α/β | core: 3 layers, a/b/a; mixed beta-sheet of 4 strands, order 4312; strand 3 is antiparallel to the rest |
| α/β | 3 layers: a/b/a; mixed beta-sheet of 4 strands, order 2143, strand 4 is antiparallel to the rest |
| α/β | 3 layers: a/b/a; mixed beta-sheet of 5 strands, order 13245, strand 1 is antiparallel to the rest |
| α/β | 3 layers: a/b/a; mixed beta-sheet of 5 strands, order 32145, strand 5 is antiparallel to the rest |
| α/β | 3 layers: a/b/a; mixed beta-sheet of five strands, order 21345; strand 4 is antiparallel to the rest |
| α/β | core: 3 layers, b + a/b/a; the central mixed sheet of 5 strands: order 21534; strand 2 is antiparallel to the rest |
| α/β | core: 3 layers, a/b/a; mixed beta-sheet of 5 strands, order 12345; strands 2 &, in some families, 5 are antiparallel to the rest |
| α/β | Core: 3 layers: a/b/a; mixed beta-sheet of 5 strands, order 21345; strand 5 is antiparallel to the rest |
| α/β | 3 layers: a/b/a; mixed beta-sheet of 5 strands, order 21345; strand 5 is antiparallel to the rest |
| α/β | 3 layers: a/b/a; mixed beta-sheet of 5 strands, order 32145; strand 2 is antiparallel to the rest |
| α/β | core: 3 layers, a/b/a; mixed sheet of 5 strands: order 21354; strand 4 is antiparallel to the rest; contains crossover loops |
| α/β | 3 layers: a/b/a; mixed beta-sheet of 5 strands; order: 21354, strand 5 is antiparallel to the rest; permutation of the Phosphorylase/hydrolase-like fold |
| α/β | 3 layers: a/b/a; mixed beta-sheet of five strands, order 21345; strand 1 is antiparallel to the rest |
| α/β | 3 layers: a/b/a; mixed beta-sheet of 6 strands; order: 213546, strand 5 is antiparallel to the rest; topological similarity to the MogA-like family fold |
| α/β | 3 layers, a/b/a; core: mixed beta-sheet of 6 strands, order 213456, strand 6 is antiparallel to the rest |
| α/β | 3 layers: a/b/a; mixed beta-sheet of 6 strands, order 165243, strand 3 is antiparallel to the rest |
| α/β | 3 layers: a/b/a; mixed beta-sheet of 6 strands, order 126345; strand 1 is antiparallel to the rest |
| α/β | core: 3 layers, a/b/a; mixed beta-sheet of 6 strands, order 324156; strand 5 is antiparallel to the rest |
| α/β | core: 3 layers, a/b/a; mixed beta-sheet of 6 strands, order 321456; strand 3 is antiparallel to the rest |
| α/β | core: 3 layers, a/b/a; mixed beta-sheet of 6 strands, order 321456; strand 3 is antiparallel to the rest |
| α/β | 3 layers: a/b/a; mixed beta-sheet of 6 strands, order 231456; strand 3 is antiparallel to the rest |
| α/β | 3 layers: a/b/a; mixed beta-sheet of 6 strands, order 251634; strand 6 is antiparallel to the rest |
| α/β | core: 3 layers, a/b/a; mixed beta-sheet of 6 strands, order 432156; strand 4 is antiparallel to the rest |

TABLE 1-continued

Exemplary structures adopted by homologous superfamilies of proteins

| Class of secondary structure | Architecture and/or topology of folds within proteins |
|---|---|
| α/β | core: 3 layers, a/b/a; mixed sheet of 7 strands, order 1237456; strands 1, 6 and 7 are antiparallel to the rest |
| α/β | 3 layers: a/b/a; mixed beta-sheet of 7 strands, order 3214567; strand 6 is antiparallel to the rest |
| α/β | core: 3 layers, a/b/a; mixed beta-sheet of 7 strands, order 3214576; strand 7 is antiparallel to the rest |
| α/β | 3 layers, a/b/a; mixed beta-sheet of 7 strands, order 3214576; strand 7 is antiparallel to the rest; topological similarity to SAM-dependent methyltransferases |
| α/β | main domain: 3 layers: a/b/a, mixed beta-sheet of 7 strands, order 3245671; strand 7 is antiparallel to the rest |
| α/β | 3 layers: a/b/a; mixed beta-sheet of 7 strands, order 3214657; strand 6 is antiparallel to the rest |
| α/β | 3 layers: a/b/a; mixed beta-sheet of 8 strands, order 32145678; strands 6 and 8 are antiparallel to the rest |
| α/β | core: 3 layers, a/b/a; mixed beta-sheet of 8 strands, order 12435678, strand 2 is antiparallel to the rest |
| α/β | core: 3 layers, a/b/a; mixed beta-sheet of 8 strands, order 32145687; strand 7 is antiparallel to the rest |
| α/β | 3 layers: a/b/a; mixed beta-sheet of 8 strands, order 34251687; strand 8 is antiparallel to the rest |
| α/β | core: 3 layers: a/b/a; mixed beta-sheet of 8 strands, order 21345678, strand 7 is antiparallel to the rest |
| α/β | 3 layers: a/b/a; mixed (mainly parallel) beta-sheet of 8 strands, order 32145678; strand 8 is antiparallel to the rest |
| α/β | 3 layers: a/b/a; mixed (mainly parallel) beta-sheet of 8 strands, order 34215786; strand 8 is antiparallel to the rest |
| α/β | core: 3 layers: a/b/a; mixed beta-sheet of 8 strands, order 45321678, strands 4 and 5 are antiparallel to the rest |
| α/β | core: 3 layers: a/b/a; mixed beta-sheet of 8 strands, order 43516728, strand 7 is antiparallel to the rest |
| α/β | 3 layers: a/b/a; mixed beta-sheet of 8 strands, order 78612354; strands 3, 4 and 8 are antiparallel to the rest |
| α/β | 3 layers: a/b/a; mixed beta-sheet of 9 strands, order 918736452; strands 1, 2 and 8 are antiparallel to the rest |
| α/β | 3 layers: a/b/a; mixed (mostly antiparallel) beta-sheet of 9 strands, order 432159876; left-handed crossover between strands 4 and 5 |
| α/β | 3 layers: a/b/a; mixed beta-sheet of 9 strands, order 342156798; strands 3, 8 and 9 are antiparallel to the rest; left-handed crossover connection between strands 6 and 7 |
| α/β | consists of two intertwined (sub)domains related by pseudo dyad; duplication |
| α/β | possible duplication: the topologies of N- and C-terminal halves are similar; 3 layers: a/b/a; single mixed beta-sheet of 10 strands, order 213549A867 (A = 10); strands from 5 to 9 are antiparallel to the rest |
| α/β | consists of two similar domains related by pseudo dyad; duplication |
| α/β | consists of two similar domains related by pseudo dyad; duplication |
| α/β | 3 layers: a/b/a; parallel beta-sheet of 5 strands, order 21345 |
| α/β | contains of two similar intertwined domains related by pseudo dyad; duplication |
| α/β | consists of two similar domains with 3 layers (a/b/a) each; duplication |
| α/β | consists of three similar domains with 3 layers (a/b/a) each; duplication |
| α/β | consists of three similar domains with 3 layers (a/b/a) each; duplication |
| α/β | consists of two domains of similar topology, 3 layers (a/b/a) each |
| α/β | consists of two non-similar domains, 3 layers (a/b/a) each |
| α/β | consists of two non-similar domains with 3 layers (a/b/a) each |
| α/β | consists of two non-similar alpha/beta domains, 3 layers (a/b/a) each |
| α/β | consists of two non-similar domains, 3 layers (a/b/a) each |
| α/β | consists of two non-similar domains |
| α/β | consists of two non-similar domains |
| α/β | 2 different domains; d1: [core: 3 layers, a/b/a; parallel sheet of 5 strands, order: 2134]; D2: [2 layers, a/b; mixed sheet of 6 strands, order 321645; strands 2 and 6 are antiparallel to the rest] |
| α/β | consists of two non-similar domains |
| α/β | consists of two different alpha/beta domains; (1) of the Flavodoxin-like fold (scop_cf 52171); (2) similar to the Restriction endonuclease-like fold (scop_cf 52979), inserted into domain 1 |
| α/β | contains a P-loop NTP-binding motif; mixed beta-sheet folds into a barrel-like structure with helices packed on one side |
| α/β | contains mixed beta-sheets; topology is partly similar to that of the catalytic C-terminal domain |
| α/β | duplication: tandem repeat of two domains; 3 layers (a/b/a); parallel beta-sheet of 4 strands, order 2134 |
| α/β | consists of two similar intertwined domain with 3 layers (a/b/a) each: duplication |

TABLE 1-continued

Exemplary structures adopted by homologous superfamilies of proteins

| Class of secondary structure | Architecture and/or topology of folds within proteins |
| --- | --- |
| α/β | consists of two similar intertwined domain with 3 layers (a/b/a) each: duplication |
| α/β | consists of two similar domains related by pseudo dyad; duplication |
| α/β | consist of two intertwined domains; duplication: contains two structural repeats of alpha-beta-(beta-alpha)3 motif with mixed beta-sheet, order: 1432, strand 1 is antiparallel to the rest |
| α/β | consist of two intertwined domains; contains partial duplication |
| α/β | consist of two different alpha/beta domains; N-terminal domain has a SurE-like topology with a left-handed beta-alpha-beta unit |
| α/β | core: alpha-beta(2)-(alpha-beta)2; 3 layers (a/b/a); mixed beta-sheet of 4 strands, order 2134; strand 2 is antiparallel to the rest |
| α/β | single helix packs against antiparallel beta-sheet |
| α/β | common alpha + beta motif for the active site region |
| α/β | consists of one alpha-helix and 4 strands of antiparallel beta-sheet and contains the catalytic triad Cys-His-Asn |
| α/β | core: (alpha)-beta-omega_loop-beta-alpha; embedded in larger different structures |
| α/β | contains long curved beta-sheet and 3 helices |
| α/β | beta-alpha-beta-alpha(2); antiparallel beta-ribbon |
| α/β | beta-alpha(2)-beta; antiparallel strands |
| α/β | alpha-beta(2)-alpha; antiparallel hairpin |
| α/β | alpha-beta(2)-alpha; 2 layers a/b; antiparallel beta-hairpin |
| α/β | alpha(3)-beta(2); antiparallel hairpin |
| α/β | beta(3)-alpha |
| α/β | beta(3)-alpha; 2 layers: alpha/beta |
| α/β | alpha1-beta3; 2 layers: alpha/beta: order 132 |
| α/β | beta-alpha-beta(2); 2 layers: alpha/beta; antiparallel beta-sheet: order 132 |
| α/β | beta-(alpha)-beta-alpha-beta(2); 3 layers: alpha/beta/alpha; antiparallel beta-sheet: order 1243 |
| α/β | beta-(2)-alpha(2)-beta(2); 2 layers: beta/alpha; antiparallel beta-sheet: order 1243; topological similarity to the common core of ribosomal proteins L23 and L15e |
| α/β | beta-(2)-alpha(3)-beta(2); 2 layers: beta/alpha; mixed beta-sheet: order 1234; stands 2 and 3 a parallel to each other |
| α/β | alpha-beta(3)-alpha-beta(2); 3 layers: alpha/beta/alpha |
| α/β | alpha-beta(3)-alpha-beta(2)-alpha; 2 layers: alpha/beta |
| α/β | beta(2)-alpha(2)-beta; 2 layers: 3-stranded antiparallel beta-sheet, order 213; HTH motif; also includes the extra N-terminal, DNA minor groove-binding helix |
| α/β | alpha-beta(4)-alpha-beta(2)-alpha; 2 layers: alpha/beta |
| α/β | beta(4)-alpha-beta(2)-alpha; 2 layers: alpha/beta; antiparallel beta-sheet, order: 651234 |
| α/β | core: beta(3)-alpha-beta-alpha; 2 layers: alpha/beta; left-handed crossover |
| α/β | core: beta(2)-alpha-beta(2); mixed beta-sheet 2143 |
| α/β | alpha + beta sandwich |
| α/β | Core: alpha-beta(4); helix packs against coiled antiparallel beta-sheet |
| α/β | alpha-beta-alpha-beta-alpha(2)-beta(3); antiparallel beta-sheet; order: 15432 |
| α/β | alpha(2)-beta(4)-alpha, 2 layers: alpha/beta, antiparallel beta sheet, meander |
| α/β | beta(3)-alpha-beta(2)-alpha; 2 layers, alpha/beta; antiparallel beta-sheet, order: 12543 |
| α/β | core: alpha-beta(3)-alpha, 2 layers: alpha/beta, three-stranded antiparallel beta sheet, strand order 123 |
| α/β | core: beta(2)-alpha(2), 2 layers: alpha/beta; long C-terminal helix forms dimeric parallel and tetrameric antiparallel coiled coils |
| α/β | helix-swapped dimer of beta(4)-alpha motifs |
| α/β | beta-BETA(2)-beta-alpha-beta(2); antiparallel sheet: order 2134 packed against helix and BETA-hairpin on the same side; irregular C-terminal tail |
| α/β | Dimeric |
| α/β | alpha-beta(4)-alpha(3); core: meander beta-sheet plus one helix 2 |
| α/β | core: three short helices packed against a barrel-like beta-sheet; some similarity to the SH3-like fold |
| α/β | beta*-alpha-beta(2)-alpha-beta-alpha; mixed beta sheet forms a partly open barrel: (n* = 4, S* = 8) |
| α/β | beta-alpha-beta(4)-alpha-beta(2); contains beta-sheet barrel (n = 5, S = 8) |
| α/β | beta(3)-alpha(2)-beta; 2 layers; mixed beta-sheet, order 4123, strands 1 and 4 are parallel to each other |
| α/β | mixed beta-sheet folds into a barrel (n = 8, S = 14) around the central helix |
| α/β | beta-sheet folds into a barrel (n = 11, S = 14) around the central helix |
| α/β | beta-sheet folds into a barrel (n = 12, S = 12) around the central helix |
| α/β | contains very long N-terminal helix, which end is packed against beta-sheet |
| α/β | core: beta(7)-alpha(2); N- and C-terminal extensions form a coiled coil subdomain |
| α/β | beta(6)-alpha; antiparallel beta-sheet, meander |
| α/β | beta(3)-alpha-beta(3)-alpha; 3 layers a/b/a |

TABLE 1-continued

Exemplary structures adopted by homologous superfamilies of proteins

| Class of secondary structure | Architecture and/or topology of folds within proteins |
|---|---|
| α/β | alpha(2)-beta(5)-alpha(2); 3 layers a/b/a; meander beta-sheet |
| α/β | core: beta(2)-alpha-beta(2); antiparallel beta-sheet |
| α/β | beta(4)-alpha-beta; 2 layers: alpha/beta; mixed beta-sheet, order: 51234 |
| α/β | alpha-beta-X-beta(2); 2 layers: alpha/beta; mixed beta-sheet, order: 123 |
| α/β | beta-alpha-beta-(alpha)-beta(2); 2 layers: alpha/beta; mixed beta-sheet, order: 1342 |
| α/β | beta(2)-alpha-beta; 2 layers: alpha/beta |
| α/β | beta-alpha-beta(3); 2 layers: alpha/beta |
| α/β | beta-alpha-beta(3); 2 layers: alpha/beta |
| α/β | beta(2)-alpha-beta(3); 2 layers: alpha/beta |
| α/β | multiple repeats of beta(2)-alpha(2) motif |
| α/β | beta(2)-alpha(3)-beta; two layers: alpha/beta; antiparallel sheet: order 213 |
| α/β | beta(4)-alpha(2); two layers: alpha/beta; antiparallel sheet: order 1432 |
| α/β | beta(2)-alpha(2)-beta(2)-alpha-beta; two layers: alpha/beta; antiparallel sheet: order 51234 |
| α/β | beta-alpha(2)-beta(4)-alpha-beta(2); two layers: alpha/beta; bifurcated coiled beta-sheet: order of the first 5 strands: 23154 |
| α/β | beta(4)-alpha(2)-beta(2)-alpha; antiparallel sheet: order 123465 |
| α/β | beta-alpha-beta(6)-alpha(2); antiparallel sheet: order 165432 |
| α/β | beta(3)-alpha(2)-beta-alpha(2)-beta3; 2 layers alpha/beta; antiparallel sheet: order 1234567 |
| α/β | alpha-beta(6)-alpha(2)-beta-alpha(n); 3 layers alpha/beta/alpha; antiparallel sheet: order 1234567 |
| α/β | beta(4)-alpha-beta(2)-alpha(2); mixed, predominately antiparallel beta-sheet, order: 123465, strands 4 and 5 are parallel to each other |
| α/β | core: beta-alpha-beta(4); 2 layers: alpha/beta |
| α/β | core: beta-alpha-beta(4); 2 layers: alpha/beta |
| α/β | core: beta-alpha(2)-beta-X-beta(2); 2 layers: alpha/beta; antiparallel beta-sheet: order 1342 |
| α/β | alpha + beta sandwich; loop across free side of beta-sheet |
| α/β | alpha-beta-loop-beta(3); loop across free side of beta-sheet |
| α/β | core: beta-BETA-alpha-beta-BETA-beta-alpha; contains a beta-hammerhead motif similar to that in barrel-sandwich hybrids |
| α/β | core: beta(2)-alpha(2)-beta(2)-alpha(2); 2 layers a/b; mixed sheet: 2143 |
| α/β | beta(2)-alpha(n)-beta: 2 layers a/b: antiparallel sheet: 123 |
| α/β | alpha-beta(2)-alpha-beta-alpha(2); 3 strands of antiparallel sheet: 213 |
| α/β | beta-alpha(2)-beta-alpha-beta; 2 layers, alpha/beta |
| α/β | beta-alpha-beta(2)-alpha(2); 3 layers, alpha/beta/alpha; antiparallel beta-sheet: order 123 |
| α/β | beta-alpha(3)-beta(2); 2 layers, alpha/beta; antiparallel beta-sheet: order 123 |
| α/β | alpha-beta(3)-alpha(2); 2 layers, alpha/beta |
| α/β | (beta)-alpha-beta(3)-alpha; 2 layers, alpha/beta |
| α/β | alpha-beta(3)-alpha; 2 layers: alpha/beta |
| α/β | duplication: consists of two beta(3)-alpha repeats; 3 layers, beta/alpha/beta |
| α/β | beta-alpha-beta(2)-alpha; 2 layers: alpha/beta |
| α/β | alpha(2)-beta(3)-alpha(3); 2 layers alpha/beta, 3-stranded antiparallel beta-sheet; order 123 |
| α/β | alpha(3)-beta-alpha(2)-beta(2); 2 layers alpha/beta, 3-stranded antiparallel beta-sheet; order 123 |
| α/β | beta-alpha(2)-beta(2)-alpha; 2 layers: alpha/beta |
| α/β | core: alpha-beta(2)-(alpha)-beta; 2 layers: alpha/beta |
| α/β | core: alpha-beta-turn-beta-X-beta-(alpha); mixed beta-sheet, order of core strands: 123 |
| α/β | alpha(2)-beta(4); 2 layers: alpha/beta; antiparallel beta-sheet: order 2143 |
| α/β | alpha-beta(3)-alpha-beta-alpha; bifurcated coiled beta-sheet |
| α/β | beta(3)-alpha(3); meander and up-and-down bundle |
| α/β | beta-alpha(3)-beta(2); 2 layers: alpha/beta; related to the enolase/MLE N-domain fold by a circular permutation |
| α/β | alpha-beta-alpha(3)-beta(2); 2 layers: alpha/beta; |
| α/β | 3-helical bundle packed against 3-stranded mixed beta-sheet |
| α/β | beta(3)-alpha(4); meander beta-sheet packed against array of helices; contains Pro-rich stretch |
| α/β | beta(3)-alpha(5); meander beta-sheet packed against array of helices |
| α/β | beta-alpha-beta(2)-alpha; 2 layers: alpha/beta; mixed sheet 213; crossing loops |
| α/β | alpha-beta(3)-alpha(3); 2 layers, a/b; mixed beta-sheet, order: 132; crossing loops |
| α/β | alpha + beta sandwich with antiparallel beta-sheet; (beta-alpha-beta) × 2 |
| α/β | consists of two alpha + beta subdomains with some similarity to the ferredoxin-like fold |
| α/β | beta-alpha-beta-X-beta(2)-alpha(2)-beta; antiparallel beta-sheet, order 24153; topological similarity to the ferredoxin-like fold (scop_cf 54861) |
| multi | contains a cluster of helices and a beta-sandwich |
| multi | contains a cluster of helices and a beta-sandwich |
| multi | contains a cluster of helices and an alpha + beta sandwich |

TABLE 1-continued

Exemplary structures adopted by homologous superfamilies of proteins

| Class of secondary structure | Architecture and/or topology of folds within proteins |
|---|---|
| multi | consists of an all-alpha and alpha + beta domains |
| multi | contains a helical bundle with a buried helix and an alpha + beta insert domain |
| multi | consists of an all-alpha and alpha + beta domains connected by antiparallel coiled coil |
| multi | contains a cluster of helices and an alpha/beta domain |
| multi | contains an (8, 10) beta-barrel and an all-alpha domain |
| multi | 2 domains: (1) all-alpha: 5 helices; (2) contains an open beta-sheet barrel: n* = 5, S* = 8; complex topology |
| multi | N-terminal domain is an alpha + beta, C-terminal domain is an alpha/beta with mixed beta-sheet |
| multi | divided into morphological domains including "palm", "thumb" and "fingers"; the catalytic "palm" domain is conserved to all members |
| multi | Multidomain subunits of complex domain organization |
| multi | 3 domains: (1&2) alpha + beta, with domain 2 being inserted in domain 1; (3) all-alpha |
| multi | 4 domains: (1) Toprim alpha/beta; (2&4) "winged helix"-like; (3) barrel: n = 6, S = 8 |
| multi | 4 domains: (1) toprim alpha/beta; (2) "winged helix"-like; (3) alpha + beta; (4) all-alpha |
| multi | 2 domains: (1) toprim alpha/beta; (2) "winged helix"-like |
| multi | 2 domains: (1) alpha + beta; (2) toprim alpha/beta |
| multi | consists of three domains: alpha-helical dimerisation domain (res. 1-53) with HhH motif (Pfam 00633); 'treble cleft' C4 zinc-finger domain (54-76; Pfam 02132); and Toprim domain (76-199; segment-swapped dimer; Pfam 01751) |
| multi | 2 domains: alpha + beta and all-beta |
| multi | 2 domains: (1) alpha + beta: beta3-alpha2-beta2; (2) alpha/beta, a part of its mixed sheet forms barrel: n = 6, S = 8 |
| multi | 3 domains: (1) all-alpha; (2&3) alpha + beta |
| multi | 2 domains: (1) alpa/beta; (2) Fe—S cluster-bound |
| multi | 2 domains: (1) alpha/beta of a Rossmann-fold topology, binds NAD (2) multihelical array |
| multi | 4 domains: (1&2) duplication: share the same alpha/beta fold; (3) beta-barrel; (4) alpha + beta |
| multi | 2 domains: (1) alpha + beta; (2) alpha/beta (interrupts domain 1) |
| multi | 4 domains: (1) 3-helical bundle; (2) alpha + beta of ferredoxin-like fold (3 and 4) alpha + beta of dsRDB-like fold |
| multi | 3 domains: (1) 3-helical bundle; (2 and 3) alpha + beta of different folds: domain 3 has a ferredoxin-like fold and is inserted in domain 2 |
| multi | 3 domains: (1) 4-helical bundle; (2) alpha + beta; (3) "winged helix"-like |
| multi | 3 domains: (1 and 2) alpha + beta; (3) mostly alpha, inserted in domain 2 |
| multi | 3 domains: (1) spectrin repeat-like 3-helical bundle; (2 and 3) alpha/beta: Rossmann-fold topology |
| multi | 3 domains: (1) protozoan pheromone-like alpha-helical bundle; (2) rubredoxin-like domain lacking metal-binding site; (3) alpha + beta heterodimerisation domain: alpha-beta(5)-alpha |
| multi | 2 domains: (1) alpha-helical bundle; (2) beta-barrel (n = 5, S = 8) |
| multi | 3 domains: (1) alpha-helical bundle; (2&3) complex all-beta folds |
| multi | 2 closely associated domains: (1) all-alpha, EF-hand like; (2) alpha + beta, Frataxin-like |
| multi | 2 domains; d1: [all-alpha; 3-helical bundle, similar to the immunoglobulin/albumin-binding domain-like fold (scop_cf 46996)]; d2: [alpha/beta; 3 layers, a/b/a; 6-stranded mixed beta-sheet, order: 321456, strand 6 is antiparallel to the rest] |
| multi | 3 domains; d1: alpha + beta [alpha(2)-beta(3); mixed sheet: 213]; d2: alpha/beta of the NAD(P)-binding Rossmann-fold superfamily (scop_sf 51735, most similar to scop_fa 51883 and scop_fa 51736); d3: alpha + beta of the glutamine synthetase/guanido kinase fold (scop_cf 55930); d1 and d3 form a single beta-sheet |
| multi | 2 domains: d1 [alpha/beta; related to the PFK N-terminal domain (scop_sf 53784)]; d2 [all-beta; atypical beta-sandwich made of 4 structural repeats of beta(3) unit] |
| multi | 2 domains; d1 (1-64, 174-335) [alpha/beta; 3 layers, a/b/a; mixed beta sheet of 9 strands, order: 219863457; strands 1, 5 and 8 are antiparallel to the rest]; d2 (65-142) [all-beta: barrel, closed (n = 6, S = 10); greek-key; topologically similar to the split barrel fold (scop_cf 50474) |
| multi | 2 domains: (1) alpha + beta (res 1-192), a circularly permuted rS5 domain 2-like fold (scop_cf 54210); (2) alpha/beta with parallel beta-sheet of 4 strands, order 2134 |
| multi | consists of two domains; d1: alpha + beta (78-190; alpha-beta(4)-alpha-beta-alpha; 3 layers; antiparallel beta-sheet of 5 strands; order 51234); d2: alpha/beta similar to the G-domain fold (191-381; scop_fa 52592) |
| multi | 2 domains: (1) all-alpha, (2) alpha + beta; asymmetric homodimer with each domain intertwining with its counterpart |

TABLE 1-continued

Exemplary structures adopted by homologous superfamilies of proteins

| Class of secondary structure | Architecture and/or topology of folds within proteins |
| --- | --- |
| multi | 4 domains: three intertwined predominately alpha domains and one jelly-roll beta-sandwich |
| multi | large protein without apparent domain division; has a number of all-alpha regions and one all beta domain near the C-end |
| multi | large protein without apparent domain division |
| multi | large protein without apparent domain division |
| membrane + surface | multi-helical domains of various folds which unfold in the membrane |
| membrane + surface | core: up-and-down bundle of seven transmembrane helices tilted 20 degrees with respect to the plane of the membrane |
| membrane + surface | five transmembrane helices forming a sheet-like structure |
| membrane + surface | 12 transmembrane helices in an approximate threefold rotational symmetric arrangement |
| membrane + surface | core: 7 transmembrane helices organized into two bundles, one formed by the first two helices and the other by the rest |
| membrane + surface | two antiparallel transmembrane helices |
| membrane + surface | core: up-and-down bundle of four transmembrane helices |
| membrane + surface | core: 8 helices, 2 short helices are surrounded by 6 long transmembrane helices |
| membrane + surface | 11 transmembrane helices; duplication: consist of 2 structural repeats of five helices each plus extra C-terminal helix |
| membrane + surface | 12 transmembrane helices; duplication: the N- and C-terminal halves are structurally similar |
| membrane + surface | core: 18 transmembrane helices |
| membrane + surface | oligomeric transmembrane alpha-helical proteins |
| membrane + surface | oligomeric transmembrane alpha-helical protein |
| membrane + surface | oligomeric transmembrane alpha-helical protein |
| membrane + surface | heteropentameric transmembrane alpha-helical protein; 4 transmembrane helices per subunit |
| membrane + surface | oligomeric fold; 3 transmembrane helices per subunit |
| membrane + surface | oligomeric fold; 3 transmembrane helices per subunit |
| membrane + surface | 9 transmembrane helices |
| membrane + surface | 10 transmembrane helices forming of a gated channel |
| membrane + surface | core: 11 transmembrane helices |
| membrane + surface | core: hairpin of two transmembrane helices |
| membrane + surface | core: three transmembrane helices, bundle |
| membrane + surface | multihelical; complex architecture with several transmembrane helices |
| membrane + surface | multihelical; complex architecture with several transmembrane helices |
| membrane + surface | 12 transmembrane helices; duplication: the N- and C-terminal halves of the whole proteins are structurally similar |
| membrane + surface | core: three transmembrane helices, up-and-down bundle |
| membrane + surface | core: four transmembrane helices, up-and-down bundle, binds one or two heme groups in between the helices |
| membrane + surface | membrane-associated alpha-helical protein; no transmembrane helices |
| membrane + surface | membrane-associated alpha-helical protein; no transmembrane helices |
| membrane + surface | 2 helices, hairpin |
| membrane + surface | core: multihelical; consists of three transmembrane regions of 2, 2 and 6 helices, separated by cytoplasmic domains |
| membrane + surface | membrane all-alpha fold |
| membrane + surface | membrane all-alpha fold; 6-helical "barrel" with internal binding cavity |
| membrane + surface | membrane all-alpha fold; three transmembrane helices |
| membrane + surface | , gathers together transmembrane barrels of different (n, S) |
| membrane + surface | subunit fold contains tandem repeat of alpha-beta hairpin-alpha(2) motif |
| membrane + surface | consists of three domains: beta-barrel (res. 29-38, 170-259; scop_cf 50412); barrel-sandwich hybrid (39-72, 135-169; scop_sf 51230) and long alpha-hairpin (73-134; scop_cf 46556) |
| membrane + surface | subunit fold contains beta-sandwich of Ig-like (grerk-key) topology and a beta-ribbon arm that forms an oligomeric transmembrane barrel |
| membrane + surface | contains several large open beta-sheets |
| membrane + surface | 3 domains: (1) alpha + beta; (2&3) all-beta |
| membrane + surface | 2 domains: (1) alpha + beta; (2) all-beta, similar to the CalB domain fold but the two last strands are transposed |
| membrane + surface | 2 intertwined domains; all-beta and alpha + beta |
| membrane + surface | 2 domains: d1: complexed all-beta fold; d2: coiled-coil (trimeric) helical region |
| membrane + surface | 3 intertwined all-beta domains |
| membrane + surface | trimer; one subunit consists of an alpha/beta oligomerization subdomain [3-stranded parallel beta-sheet, order 213], and an antiparallel coiled coil |
| membrane + surface | 4 domains: I (res. 14-225) and II (226-487) are beta-sandwiches of similar gamma-crystallin like topologies; III (488-594) has a beta-grasp like fold; IV (595-735) has an Ig-like fold |
| Other | nearly all-alpha |
| Other | disulfide crosslinked alpha-helical hairpin |
| Other | disulfide-bound fold; contains beta-hairpin with two adjacent disulfides |
| Other | disulfide-rich fold; all-beta: 3 antiparallel strands |
| Other | disulfide-rich fold; all-beta: 3 antiparallel strands |
| Other | disulfide-rich fold; all-beta: 3 antiparallel strands |

TABLE 1-continued

Exemplary structures adopted by homologous superfamilies of proteins

| Class of secondary structure | Architecture and/or topology of folds within proteins |
|---|---|
| Other | disulfide-rich; alpha + beta: 3 antiparallel strands followed by a short alpha helix |
| Other | disulfide-rich fold: nearly all-beta |
| Other | disulfide-rich alpha + beta fold |
| Other | Disulfide-rich fold, nearly all-beta |
| Other | alpha + beta fold with two crossing loops |
| Other | disulfide-rich fold |
| Other | disulfide-rich calcium-binding fold |
| Other | disulfide-rich alpha + beta fold |
| Other | disulfide-rich fold; nearly all-beta |
| Other | disulfide-rich small alpha + beta fold; topological similarity to the Ovomucoid domain III |
| Other | disulfide-rich fold; common core is alpha + beta with two conserved disulfides |
| Other | disulfide-rich fold; all-beta; duplication: contains two structural repeats |
| Other | disulfide-rich fold; common core is all-beta |
| Other | disulfide-rich all-beta fold |
| Other | disulfide-rich all-alpha fold |
| Other | small disulfide-rich |
| Other | disulfide-rich; nearly all-beta |
| Other | disulfide-rich; nearly all-beta |
| Other | disulfide-rich; alpha + beta |
| Other | duplication: consists of three similar disulfide-rich domains |
| Other | duplication: consists of two similar disulfide-rich domains, alpha + beta |
| Other | disulfide-rich; all-beta: open barrel, 5 strands; OB-fold-like |
| Other | disulfide-rich, all-beta |
| Other | disulfide-rich, alpha + beta |
| Other | disulfide-rich, alpha + beta |
| Other | disulfide-rich, alpha + beta |
| Other | disulfide-rich, alpha + beta |
| Other | disulfide-rich |
| Other | disulfide-rich, all-alpha |
| Other | disulfide-rich; all-alpha |
| Other | disulfide-rich, alpha + beta |
| Other | disulfide-rich |
| Other | disulfide-rich; all-alpha; calcium-binding |
| Other | disulfide-rich |
| Other | disulfide-rich all-beta fold; contains beta sandwich of 5 strands |
| Other | disulfide-rich six-stranded beta-sandwich; jelly-roll |
| Other | bipartite cysteine-rich all-alpha domain; a single helix in the N-terminal part (chain A) is linked by disulfides to the C-terminal part (chain B) [3-helical bundle of the RuvA C-terminal domain-like fold (scop_cf 46928) |
| Other | Calcium ion-bound |
| Other | a few helical turns and a disulfide-crosslinked loop |
| Other | a few helical turns assembled without a hydrophobic core? |
| Other | folds around 4Fe—4S cluster |
| Other | folds around 4Fe—4S cluster |
| Other | alpha + beta metal(zinc)-bound fold: beta-hairpin + alpha-helix |
| Other | all-alpha dimetal(zinc)-bound fold |
| Other | alpha + beta metal(zinc)-bound fold |
| Other | consist of two different zn-binding subdomains, each subdomain resembles a distorted glucocorticoid receptor-like fold |
| Other | metal(zinc)-bound fold |
| Other | metal(zinc or iron)-bound fold; sequence contains two CX(n)C motifs, in most cases n = 2 |
| Other | zinc-bound beta-ribbon motif |
| Other | zinc-bound beta-ribbon motif |
| Other | zinc-bound alpha + beta motif |
| Other | dimetal(zinc)-bound alpha + beta motif; structurally diverse |
| Other | zinc-bound alpha + beta motif |
| Other | metal(iron)-bound fold |
| Other | metal(zinc)-bound alpha + beta fold |
| Other | metal(zinc)-bound alpha + beta fold |
| Other | dimetal(zinc)-bound alpha + beta fold |
| Other | dimetal(zinc)-bound alpha + beta fold |
| Other | metal(zinc)-bound alpha + beta fold |
| Other | metal(zinc)-bound alpha + beta fold |
| Other | metal(zinc)-bound alpha + beta fold |
| Other | Zn-binding, all-alpha fold |
| Other | all-alpha fold; Zn-binding sites are in the loops connecting helices |
| Other | alpha-helical fold with two Zn-binding sites |
| Other | metal(zinc)-bound extended beta-hairpin fold |
| Other | metal(zinc)-bound fold |
| Other | metal(zinc)-bound fold |
| Other | metal(calcium)-bound fold |

Terms used in Table 1 will be apparent to the skilled artisan. However, the following definitions are provided for clarity below.

"Meander" is a simple topology of a beta-sheet where any two consecutive strands are adjacent and antiparallel.

"Up-and-down" is the simplest topology for a helical bundle or folded leaf, in which consecutive helices are adjacent and antiparallel; it is approximately equivalent to the meander topology of a beta-sheet.

"Crossover connection" links secondary structures at the opposite ends of the structural core and goes across the surface of the domain.

"Greek-key" is a topology for a small number of beta sheet strands in which some interstrand connections going across the end of barrel or, in a sandwich fold, between beta sheets.

"Jelly-roll" is a variant of Greek key topology with both ends of a sandwich or a barrel fold being crossed by two interstrand connections.

"All-alpha" class has the number of secondary structures in the domain or common core described as 3-, 4-, 5-, 6- or multi-helical.

"Bundle" is an array of alpha-helices each oriented roughly along the same (bundle) axis. It may have twist, left-handed if each helix makes a positive angle to the bundle axis, or be right-handed if each helix makes a negative angle to the bundle axis.

"Folded leaf" is a layer of alpha-helices wrapped around a single hydrophobic core but not with the simple geometry of a bundle.

"Array" (of hairpins) is an assembly of alpha-helices that can not be described as a bundle or a folded leaf.

"Closed", "partly opened" and "opened" for all-alpha structures describes the extent in which the hydrophobic core is screened by the comprising alpha-helices. "Opened" means that there is space for at least one more helix to be easily attached to the core.

Beta-sheets can be "antiparallel" (i.e., the strand direction in any two adjacent strands are antiparallel), "parallel" (all strands are parallel each other) or "mixed" (there is one strand at least that is parallel to one of its two neighbours and antiparallel to the other).

"All-beta" class includes two major fold groups: sandwiches and barrels. The "sandwich" folds are made of two beta-sheets which are usually twisted and pack so their strands are aligned. The "barrel" fold are made of single beta-sheet that twists and coils upon itself so, in most cases, the first strand in the beta sheet hydrogen bond to the last strand. The strand directions in the two opposite sides of a barrel fold are roughly orthogonal. Orthogonal packing of sheets is also seen in a few special cases of sandwich folds "Barrel structures" are usually closed by main-chain hydrogen bonds between the first and last strands of the beta sheet, in this case it is defined by the two integer numbers: the number of strand in the beta sheet, n, and a measure of the extent the extent to which the strands in the sheet are staggered the shear number, S.

"Partly open barrel" has the edge strands not properly hydrogen bonded because one of the strands is in two parts connected with a linker of more than one residue. These edge strands can be treated as a single but interrupted strand, allowing classification with the effective strand and shear numbers, n* and S*. In the few open barrels the beta sheets are connected by only a few side-chain hydrogen bonds between the edge strands.

An additional limitation on the use of available structure data on proteins for screening applications, as opposed to theoretical analyses of individual proteins is that they are largely biased data sets containing large numbers of redundant sequences and sequence annotations. For example, the CATH database is a hierarchical classification of domains, within protein structures, in the Protein Data Bank (PDB; Berman et al., Nucl. Acids Res. 28, 235-242, 2000) and, as a consequence, provides structure data that is reflective of the PDB. For example, there are about 32 architectures described in the CATH database, however there is an enormous amount of bias in those architectures, because approximately 30% of folds and 50% of protein superfamilies are contained within about 4-5 architectures, in particular $\alpha\beta$-sandwiches (two- and three-layer), $\alpha\beta$-barrel, $\beta$-barrel, $\alpha$-updown structures (see Orengo et al., Ann. Rev. Biochem. 74, 867-900, 2005). As with architecture of proteins, there is enormous bias in the population of folds in public databases, such that less than 0.1% of fold groups are very; large, accounting for nearly 40% of all sequence families in the PDB, see Orengo et al., Ann. Rev. Biochem. 74, 867-900 (2005). Many folds are also reported as sharing common structural motifs due to the recurrence of simple structural motifs e.g., $\alpha\beta$-motifs, $\beta\beta$-motifs, split $\beta\alpha\beta$-motifs. These biases may not necessarily be reflective of a true distribution of protein structures in nature and, in fact, may arise because the bulk of information available to date is based on crystallization studies or limited classes of proteins that have been studied extensively (Ranea et al., J. Mol. Biol. 36, 871-887, 2004).

On the other hand, it is likely that there does exist a bias in nature towards particular folds, simply because of the evolutionary constraints applied to protein structure and function determination. For example, nearly 80 different folds are classified as adopting a three-layer $\alpha\beta$-sandwich architecture, and the most highly-populated fold groups adopt regular architectures (e.g., TIM barrel fold, $\alpha\beta$-barrel, Rossman fold; three-layer, $\alpha\beta$-sandwich; $\alpha\beta$-plait, two-layer $\alpha\beta$-sandwich) that may be more stable when mutated (Orengo et al., ibid.). In support of this conclusion, recent statistical analyses suggest that more highly-represented folds i.e., "superfolds" support a much broader repertoire of primary sequences than other folds (Shakhnovich et al., J. Mol. Biol. 326, 1-9, 2003). Thus, whilst peptide libraries have been produced from native proteins e.g., using proteolytic digestions products (see, for example WO2004/008148) the source protein samples are inevitably biased for common structures such that less common structures are under-represented, or lost.

In general, methods known in the art for producing peptide libraries generally attempt to provide large numbers of sequences in order to be "representative" of the complement of proteins in the source organism(s) from which the sequences were derived. In so doing, these methods inevitable introduce redundancy into the libraries e.g., by virtue of the natural bias towards the more common regular folds, as discussed supra.

Accordingly, there is a need in the art for libraries of peptides capable of forming structures such as protein folds that retain their structures when isolated from their native contexts i.e., when sequences flanking the folds in the full-length proteins from which they are derived are substantially removed. The production of such libraries is not trite, because many folds are buried in proteins in connection with other parts of the protein, upon which their stability depends i.e., they are not independent. Additionally, whilst it is clearly desirable from a practical perspective to produce synthetic peptide libraries for high-throughput screening approaches, such libraries have an upper limit of peptide length that can readily be synthesized and displayed, whereas many sequence annotations indicate structures that are much longer than such practical considerations permit. Furthermore, based on the hypothesis that distinct folds are conserved generally such that variations in primary amino acid sequence largely affect their ligand-binding affinities, it is desirable for such libraries to separately display distinct folds. However, there is an absence of large data sets of distinct folds that could readily be adapted to the synthesis of peptide libraries, and a natural bias towards folds that appear capable of withstanding mutations. Moreover, one needs to be particularly judicious in the choice of particular sequences in a library if one is to represent the natural repertoire of sequences comprehensively, without undue bias for more commonly used classes of folds at the expense of less commonly used structures.

SUMMARY OF THE INVENTION

The present invention is predicated in part on the understanding by the inventors that protein structures, including secondary structures (i.e., conformations), assemblies of secondary structures, and tertiary structures (e.g., folds or subdomains) formed by interactions between secondary structures, are both necessary and sufficient for high affinity, protein interactions to occur; and that there are a limited number of "folds" in nature. This is notwithstanding enormous diversity in primary amino acid sequences of proteins having conserved structure.

Unless specifically stated or the context requires otherwise, the term "structure" is to be taken in its broadest context to mean shape as opposed to a primary sequence of amino acids.

The term "secondary structure" will be known by those skilled in the biochemical and biophysical arts to refer to a conformation assumed by a primary amino acid sequence such as, for example an α-helical structure or β-sheet.

As used herein, the term "assemblies" is meant a collection or plurality of stated integers. Accordingly, the term "assemblies of secondary structures" are a plurality of conformations including those that are loosely-associated with one another and those that are folded onto one another i.e., folds.

By "ligand" in the present context is meant a molecule having a binding affinity for a particular secondary structure, assembly of secondary structures or fold. Ligands include, but are not limited to, enzyme substrates, cofactors, receptors, binding partners in protein-protein interactions or DNA-protein interactions or RNA-protein interactions etc., antibodies, antigens, agonists, antagonists, inverse agonists. Ligands may be nucleic acid (e.g., DNA, mRNA, rRNA, tRNA, RNTAi, ribozyme, antisense RNA, minizyme, etc), amino acid, peptide, protein, carbohydrate or other organic molecule, small molecule, metal ion, etc.

The inventors have now applied these realizations to a new generation of peptide libraries for drug discovery, said libraries comprising peptides e.g., synthetic peptides, that form such secondary and tertiary structures. The secondary structures (i.e., conformations), assemblies of secondary structures, and tertiary structures (e.g., folds) contained within the structure libraries described herein are generally independent of the need for flanking sequences in the proteins from which they are derived, in the sense that they have a high probability of maintaining sufficient structure when isolated from those flanking sequences in the protein of origin i.e., "their native context". This is subject to the proviso that one or more other sequences (e.g., a linker, tag, or protein transduction domain) may be added to a primary sequence that folds or associates with another integer to produce a secondary structure, assemblies of secondary structures, or fold. Libraries produced using the method described herein according to any embodiment are useful for identifying a peptide capable of binding to a target molecule and, as a consequence, having a bioactivity of interest. Such peptides represent attractive therapeutic and/or diagnostic compounds in addition to reagents for therapeutic target validation.

The libraries produced in accordance with the inventive method are based on "source data" comprising annotations of primary sequences determined and/or predicted structures for proteins from which the component peptides are derived. Exemplary source data include, for example, protein sequence resources such as PRINTS, Pfam, SMART, ProDom, InterPro, TIGRFAMs, ADDA, CHOP, ProtoNet, SYSTERS, iProClass, SWISSPROT, COG/KOG, and protein structure family resources such as CAMPASS (Cambridge University, UK), CATH database (University College, London, UK), CE (SDSC, La Jolla, Calif., USA), DHS (University College, London, UK), ENTREZ/MMDB (NCBI, Bethesda Md., USA), Structural Classification of Protein Database (SCOP) (Andreeva et al., *Nucl. Acid Res.* 32:D226-D229, 2004), or the Protein Data Bank (PDB) (Berman et al., *Nucleic Acid Res.* 28: 235, 2000). It is to be understood that such source data generally need additional refinement to enrich for particular amino acid sequence products capable of independently-forming secondary structures and/or assemblies of secondary structures and/or folds suitable for practical application in drug screening and to ensure that an optimal structural diversity of the library is achieved Accordingly, the present invention provides a method for producing a peptide library, said method comprising:
(i) obtaining a plurality of amino acid sequences capable of independently-forming, secondary structures and/or assemblies of secondary structures and/or folds;
(ii) producing peptides having the amino acid sequences obtained at (i); and
(iii) displaying the peptides at (ii) such that said peptides form secondary structures and/or assemblies of secondary structures and/or folds.

It is to be understood that, notwithstanding the involvement of primary amino acid sequences in the determination of protein secondary structures and folds and the construction of the library, the present invention is not merely a method for producing a library of peptides characterized by their primary amino acid sequences. The present invention provides libraries of peptides characterized by their ability to form stable assemblies of secondary structures and/or tertiary structures, and especially stable tertiary structures. The libraries produced in accordance with the present invention provide a significant advantage over libraries characterized by mere primary sequence, because the libraries of the invention combine individual peptides according to their shape (a major determinant of affinity for a particular ligand), and display these shapes independent of their native context. In contrast, libraries of peptides characterized by primary structure do not comprise peptides necessarily selected for such affinity characteristics.

In this example, the assemblies of secondary structures and/or folds are more likely to be independent i.e., an assembly or fold having a low propensity to be in contact with the rest of the protein from which it is derived, as determined by structural studies or predictive methods. Thus, by "amino acid sequences capable of independently-forming secondary structures and/or assemblies of secondary structures and/or folds" is meant a sequence that, on average, has a predicted probability of forming (i.e., is likely to form) a stated structure without the need for flanking sequences derived from the same protein as that sequence i.e., in its native context, and without the need for artificial scaffolding of the peptide, whether or not such structure formation is autonomous or induced. Alternatively, or in addition, the sequence may have been tested empirically to form one or more of such structures. The advantage of such independence is that structures formed by peptide libraries made as described herein have a greater propensity i.e., likelihood of being stable when displayed e.g., by virtue of being compact when folded and/or with some hydrophobic surface area buried. Preferred fragments have a higher degree of independence predicted from their low contact in the context of the full protein structure, because such fragments will generally not require extensive contact(s) with other sequences in the native protein to fold or retain a folded conformation. "Independence", while construed here to not require the context of the source protein to form particular structures, shall not, in this context, exclude those sequences which are able to form induced folds on target proteins which are distinct from the source protein.

In a particularly preferred example, fragments of proteins that are computationally predicted to fold independently are identified e.g., according to one or more criteria selected from compactness, non-polar buried surface area, and degree of independence, and fragments having a propensity to fold independently are selected.

By "compactness" is meant overall surface area of a fragment, when determined in isolation i.e., when removed from the full protein structure.

By "non-polar buried surface area" is meant the amount of non-polar surface area buried within the fragment.

By "degree of independence" is meant the degree of contact the fragment has with the rest of the protein.

Preferably, fragments of proteins that are computationally predicted to fold independently are identified e.g., according to two or three criteria selected from compactness, non-polar buried surface area, and degree of independence, and fragments having a propensity to fold independently are selected.

More preferably, fragments of proteins that are computationally predicted to fold independently are identified e.g., according to the criteria of compactness, non-polar buried surface area, and degree of independence, and fragments having a propensity to fold independently are selected.

Preferably, the amino acid sequences are capable of forming secondary structures and/or folds and the peptides are displayed so as to form secondary structures and/or folds.

More preferably, the amino acid sequences are capable of forming assemblies of secondary structures and/or folds and the peptides are displayed so as to form assemblies of secondary structures and/or folds.

Still more preferably, the amino acid sequences are capable of forming folds and the peptides are displayed so as to form folds.

A particular structure may form autonomously, or be induced. By, "autonomous" is meant that structure formation is not dependent upon the interaction of a primary or secondary structure with a ligand, or by external intervention e.g., by denaturation and renaturation. By "induced" is meant that structure formation depends upon an interaction with a ligand, or by external intervention e.g., by denaturation and renaturation albeit not including constraint of ha peptide by means of an artificial scaffold.

Since the peptides produced by this method may also comprise single amino acid chains that mimic tertiary structures produced by interaction of non-contiguous portions of native proteins, it is also within the scope of the invention for the resultant library to comprise single chain peptide mimetics of tertiary structures.

Preferably, the obtained data set of sequences having a capability for producing a particular structure is refined by size-selection. More preferably, the method of the present invention preferably comprises the additional step of size-selecting sequences at (i) to thereby identify a sub-set of sequences having the average length of an independent protein fold.

Without being bound by theory or mode of action, such size selection permits the identification of a data set of fold sequences that are amenable to large-scale production of synthetic peptides for the purposes of display. Preferred amino acid sequences capable of forming secondary structures and/or assemblies of secondary structures and/or folds will not exceed 100 or 75 or 50 or 40 or 30 amino acids in length. The minimum length of such sequences is about 5 amino acid residues, however sequences of at least about 15 amino acid residues, more preferably at least 20 amino acid residues, still more preferably at least 25 amino acid residues in length can form such structures. Longer peptides are not to be excluded, especially where it is desired to produce multidomains or mixed domain peptides e.g., for binding to multiple ligands. For convenience in synthesis and display, and as exemplified herein, a preferred size class for peptides having amino acid sequences capable of forming secondary structures and/or assemblies of secondary structures and/or folds is in the range of about 20 amino acid residues in length to about 30 amino acid residues in length.

By producing an extensive repertoire of distinct sequence structures e.g., by reducing redundancy and/or identifying related sequences to an additional data set and/or by mutational approaches, peptides capable of forming structurally distinct secondary structures and/or associations of secondary structures and/or folds are produced. As a consequence, the diversity of the peptide library is enhanced, thereby increasing the probability of identifying a peptide having a desirable bioactivity when screening the library. Accordingly, it is preferable that the method of the invention additionally comprises selecting amino acid sequences and/or peptides having distinct structures.

It is also preferred for the method of the invention to additionally comprise identifying redundant sequences and removing or deleting redundant sequences to thereby leave a "non-redundant" or "normalized" plurality of amino acid sequences.

By "redundant" means that two or more secondary and/or tertiary structure are the same or substantially the same, or alternatively, that two or more primary amino acid sequences are sufficiently related so as to form or be predicted to form the same or substantially the same secondary and/or tertiary structures.

"Non-redundant" in this context means that only a limited number of secondary and/or tertiary structures are the same or substantially the same, or alternatively, that only a limited number of primary amino acid sequences are sufficiently homologous so as to form or be predicted to form the same or substantially the same secondary and/or tertiary structures. A "limited number" in this context shall be taken to mean one or two or three or four or five occurrences of each sequence or each structure in the library, preferably one or two or three occurrences, more preferably one or two occurrences and most preferably a single occurrence.

By "normalized" means that the structures are represented in the pool of structures contained within the library at approximately the same frequency independent of the number of occurrences.

Both non-redundant and normalized libraries are sufficient for the purpose of reducing bias in the structure libraries that has been introduced by a bias in the source data employed and/or a natural bias in representation of folds. For ease of downstream processing of primary screening "hits", it is preferred that the libraries are non-redundant, as this eliminates the need for sorting to identify identical or highly-related structures.

Such removal or deletion can be performed at the stage of obtaining amino acid sequences capable of forming secondary structures and/or assemblies of secondary structures and/or folds, or alternatively at the peptide production stage. Removal of redundant sequences at an earlier stage in the inventive method is preferred, to reduce costs.

In one example, a computational method is employed that removes redundant sequences from the pool of sequences obtained i.e., from the source data, or from a data set of independent folds produced as described herein, or from a size-selected data set of independent folds produced as described herein. In accordance with this example, the PISCES server (Wang and Dunbrack. Bioinformatics 19, 1589-1591, 2003; Wang and Dunbrack, Nucl. Acids. Res. 33, W94-W98, 2005; available from Fox Chase Cancer Center, Pa., USA) can be employed to remove sequences such that no two proteins in the set share more than 30% identity with one another. PISCES uses structure alignments to determine sequence alignments and sequence identities. This is a far more accurate procedure for removing sequence-redundant proteins than previous methods. Peptides comprising diverse protein structures are thus produced, and subsequently arrayed or combined to form a combinatorial structural library e.g., a protein fold library.

It is also preferred for the method of the invention to additionally comprise identifying related sequences to the obtained plurality of amino acid sequences and adding those sequences to the plurality of amino acid sequences.

Preferably, the related sequences are identified from a data source that is independent i.e., different to the source from the which the plurality of sequences was originally identified, to maximize the probability that a related sequence is different to one contained in the original data set and, more preferably, using a data source compiled using different criteria to the criteria employed by the original source database. By performing this step, the data set is expanded and made more diverse. This process can be performed for several iteration, theoretically encompassing all available sets of source data referred to herein, thereby capturing the diversity of protein structures in nature. Another advantage of this process step is that is counters the low representation of sequences and structures in any particular database.

The identification of related sequences can be performed at any stage in the process of the invention. For example, related sequences can be identified at the stage of obtaining amino acid sequences capable of forming secondary structures e.g., by collating data from several databases simultaneously. Alternatively, the related sequences can be identified following size selection, or alternatively, using non-redundant data sets. Expansion at the at the stage of obtaining amino acid sequences capable of forming secondary structures, or alternatively, using non-redundant data sets, is preferred. Of these two preferred embodiments, the identification of related sequences using non-redundant data sets is more preferred, because it reduces the size of the query term. Again, it is clearly preferred to perform such steps before peptide synthesis, to reduce costs.

Computational methods can be used to find sequences having high sequence identity and/or homology to the obtained sequences or peptides having those sequences. Preferably, a database that identifies and eliminates sequences having high sequence identity e.g., more than about 30% or about 40% or about 50% or about 60% sequence identity to the query sequences, is utilized.

In a particularly preferred embodiment, the algorithm PSI-BLAST (Altschul et al., Nucl. Acids Res. 25, 3389-3402, 1997) is used to search the UniRef$_{50}$ database (a subset of the UniProt database of all publicly available protein sequences; Bairoch et al., Nucl. Acids Res. 33, D154-D159, 2005), and aligned sequences to the query sequence are identified and/or isolated. Such methods may enhance diversity by about 10-fold or 20-fold or 30-fold or 40-fold or 50-fold.

Alternatively, or in addition, the diversity of the library is enhanced by mutagenesis of peptides that are predicted to form a secondary structure or assembly of secondary structures or fold, using any means known to the skilled artisan. The production of synthetic peptides containing mutations at each position relative to the sequence of the "base" peptide is preferred.

By "base peptide" is meant a peptide that is subjected to mutation including affinity maturation.

Mutations that maintain structure e.g., conservative amino acid substitutions at each position in the peptide are preferred. Such an approach may be saturated i.e. throughout the peptide, or targeted. In one example of a targeted approach, alanine-scanning mutagenesis can be used to determine empirically those residues that are important for structure formation and then mutations can be introduced at those positions.

It is also possible to expand diversity of a recombinant peptide expression library (as opposed to a library of synthetic peptides) by introducing mutations into nucleic acid encoding the peptides, e.g., by random mutagenesis of peptides by mutagenesis of nucleic acid encoding the peptides e.g., by random mutagenesis, expression in cells having error-prone mismatch-repair systems, use of error-prone polymerases and/or replicases such as Qβ-replicase, inducing translational slippage, expressing nucleic acid in the six different reading frames, etc. Such methods for mutating nucleic acid are described in the scientific literature.

Preferably, a mutational approach such as that explained in the preceding paragraph produces peptides having different affinities for particular ligands and more preferably, produces one or more peptides having higher affinities for one or more ligands. This embodiment includes the affinity maturation of a peptide capable of forming a naturally-occurring structure to thereby enhance or improve the binding affinity of that structure for a ligand, which may be the same or a different ligand to the ligand in respect of which the structure evolved. For example, affinity maturation may be performed to enhance the affinity of the peptide for a peptide or small molecule agonist, antagonist, partial agonist or inverse agonist that mimics the structure of the natural ligand of the base peptide.

Because mutational process and the identification of related sequences may introduce or reintroduce redundancy into a data set of peptide structures, the present invention clearly encompasses combinations of these processes i.e., a combination of mutation with removal of redundant sequences, and a combination of related sequence identification with removal of redundant sequences, and a combination of mutation with removal of redundant sequences and related sequence identification. Such combinations may be iterative i.e., repeated one or two or three or as man) times as necessary to produce a non-redundant yet highly diverse data set.

Having determined the capability of a protein fragment to form a secondary structure or association of secondary structures or protein fold, the amino acid sequence producing that structure is determined, and a peptide having the sequence is produced (e.g., by synthetic or recombinant means), and the produced peptide displayed (e.g., by direct display on a physical medium or by phage display or recombinant expression) by means described herein.

For example, the peptides are produced by any synthetic or recombinant means and introduced to or maintained in, conditions sufficient for the peptide to attain a secondary structure, or to assemble or form a fold that it forms in nature. As will be apparent from the preceding description, this may be autonomous or induced e.g., by contacting a ligand with the peptide or incubating the peptide under suitable buffering conditions or physiological conditions.

Suitable display methods will be apparent to the skilled artisan and include, for example, producing the peptides by synthetic means and maintaining the peptides under suitable conditions such that they associate or fold. Such synthetic peptides may be arrayed on a solid surface, e.g., a microarray, or on a plurality of solid surfaces, e.g., a plurality of beads or in microwells.

In this respect, the peptides may be synthesized directly onto a solid surface or immobilized on a solid surface, e.g., using a method known in the art and/or described herein. For example, a parallel array or pool of peptides is produced, e.g., synthetically, and arrayed in a multi-well plate, e.g., using robotic technology. Such arrays are useful for, for example, high-throughput screening of peptides, including phenotype driven screens.

Alternatively, the peptides are displayed using recombinant means. For example, the peptides are expressed on the surface of a phage or a cell or by ribosome display or by in vitro display or the peptides are expressed within a cell or a plurality of cells.

In the case of peptides produced by a recombinant method, the method of the invention preferably additionally comprises determining or identifying nucleotide sequences of nucleic acids capable of encoding the peptides. The skilled artisan will be aware of methods for determining such nucleotide sequences. For example, the nucleotide sequence is obtained from a database, such as, for example, the database of the National Center for Biotechnology Information at the National Library of Medicine at the National Institutes of Health of the Government of the United States of America. Bethesda, Md., 20894. Alternatively, the amino acid sequence is reverse translated by in silico analysis to provide a suitable nucleotide sequence, e.g., using the Reverse Translate software available from Colorado State University.

Preferably, the method of the invention additionally comprises producing or providing nucleic acids comprising the nucleotide sequences capable of encoding the peptides and/or expressing the peptides from the nucleic acids. For example, the method of the invention additionally comprises providing or producing an expression construct comprising the nucleic acid capable of encoding the peptides.

However, it is to be understood that a particularly preferred embodiment of the present invention does not comprise the use or production of recombinant peptides or DNA expression libraries. Synthetic peptide libraries are particularly preferred because they are relatively, easy to produce and maintain. For example, synthetic libraries do not require intermediate steps of cloning and/or host cell production or maintenance, and they can be stored for long periods.

Preferably, the method of the invention additionally comprises confirming that the peptides or a subset thereof are displayed such that they fold to produce the requisite or desired structures. Suitable methods for determining a peptide that has attained a desired or requisite structure will be apparent to the skilled artisan and/or described herein, however empirical means are clearly preferred. For example, a sample of the peptides displayed in a library can be assayed using a thermal denaturation assay or circular dichroism. Alternatively or in addition, a displayed peptide can be contacted with a ligand of the structure in nature labelled with a suitable reporter molecule and binding of the ligand to the peptide determined.

By producing libraries comprising combinations of peptides having requisite or desired secondary structure and/or assembly of secondary structures and/or folds, the present invention also facilitates the production of peptide libraries having a relatively low structure redundancy.

In one example, the present invention provides a method for producing a peptide library having a relatively low structure redundancy, said method comprising:

(i) obtaining a plurality of amino acid sequences capable of independently-forming secondary structures and/or assemblies of secondary structures and/or folds;

(ii) identifying redundant structures from the plurality at (i) and removing or deleting redundant sequences capable of forming the redundant structures to thereby leave a non-redundant plurality of amino acid sequences;

(iii) producing peptides having the amino acid sequences of the non-redundant plurality at (ii); and (iv) displaying the peptides at (iii) such that said peptides form secondary structures and/or assemblies of secondary structures and/or folds.

Non-redundancy i.e., "distinctness" in a non-redundant library produced in accordance with this embodiment means that the structures are not iterative of the same assembly of secondary structures or fold. Preferably, the non-redundant i.e., "distinct" structures are selected according to the compactness of an assembly of secondary structures or a fold, and/or the surface area of an assembly of secondary structures or a fold, and/or the hydrophobic surface area of a fold, and/or the degree of independence. More preferably, the non-redundant structures differ in at least one of these attributes, even more preferably in at least two of these attributes, still more preferably in three attributes and in a most preferred embodiment all four attributes.

It is to be understood that the non-redundant i.e., "distinct" structures may have permissible similarities. It is also clearly permissible for a structure that forms autonomously to be distinct from a structure that needs to be induced e.g., by ligand binding, since such differences indicate subtle distinctions. Other permissible similarities in such non-redundant i.e., "distinct" structures include, for example, the type/class of secondary structures constituting the assembly of secondary structures or folds, and/or the ligand to which the assemblies of secondary structures or folds bind, and/or the binding affinity and/or dissociation constant of an assembly of secondary structures or fold for a ligand and/or their chemical modification e.g., incorporation of one or more labels and/or reporter molecules and/or tags and/or protein transduction domains and/or D-amino acids and/or phosphorylated moieties and/or glycosylated moieties such as sugars. For example, α-helices and/or β-sheets may occur in a variety of distinct assemblies of secondary structures or folds. Similarly, the same ligand may bind to different assemblies of secondary structures or folds, and at different affinities. Rather, the secondary structure may vary in a minor feature, such as, for example, in the size of a turn in the protein domain or the length of a helix or a sheet. Chemical modifications e.g., incorporation of D-amino acids, phosphorylation or glycosylation of amino acids may also modify secondary structures. Such structural variations may control the affinity or specificity with which a protein domain interacts with a target molecule.

The degree of redundancy in a peptide library produced according to this embodiment is low unless, of course, the library is subjected subsequently to mutagenesis such as for the purpose of affinity maturation, which subsequent processes would be understood by a skilled artisan to produce a large number of closely-related sequences and similar structures of different affinities for a particular ligand. Preferably, the degree of redundancy in a primary peptide library i.e., without subsequent mutation or affinity maturation, is such that there are no more than about five peptides in the library capable of forming the same assembly of secondary structures or folds. More preferably, the degree of redundancy in a primary peptide library i.e., without subsequent mutation or affinity maturation, is such that there are no more than four or five peptides in the library capable of forming the same assembly of secondary structures or folds. Even more preferably, the degree of redundancy in a primary peptide library i.e., without subsequent mutation or affinity maturation, is such that there are no more than three peptides in the library capable of forming the same assembly of secondary structures or folds. Still even more preferably, the degree of redundancy in a primary peptide library i.e., without subsequent mutation or affinity maturation, is such that there are no more than two peptides in the library capable of forming the same assembly of secondary structures or folds. In a most particularly preferred embodiment, the degree of redundancy in a primary peptide library i.e. without subsequent mutation or affinity maturation, is such that there is no more than one peptide in the library capable of forming the same assembly of secondary structures or folds.

In a preferred embodiment, the method comprises determining non-redundant i.e., "distinct" structures using a computational methods, such as, for example, employing PISCES. Alternatively, or in addition, such non-redundant sequences are identified by manual searching in silico, such as, for example using SCOP or PDB.

In another example, the present invention provides a method for producing a peptide library having low structure redundancy, said method comprising:
(i) obtaining a plurality of amino acid sequences capable of forming independent-secondary structures and/or assemblies of secondary structures and/or folds;
(ii) producing peptides having the amino acid sequences obtained at (i);
(iii) identifying redundant sequences from the peptides produced at (ii) and removing or deleting peptides having the redundant sequences to thereby leave a non-redundant plurality of amino acid sequences; and
(iv) displaying the peptides at (iii) such that said peptides form secondary structures and/or assemblies of secondary structures and/or folds.

Non-redundancy i.e., "distinctness" in a non-redundant library produced in accordance with this embodiment means that the sequences are sufficiently different to ensure that the displayed peptides form distinct structures as described herein above e.g., with reference to their compactness, surface area, hydrophobic surface area and independence. Preferably, the sequences are not more than about 60% identical, more preferably not more than about 50% identical, still more preferably not more than about 50% identical or not more than about 40% identical at the level of the primary amino acid sequence. In a particularly preferred embodiment, amino acid sequences are not more than about 30% identical to ensure non-redundant structures in the displayed peptide library. Standard sequence alignment and comparison tools can be utilized for this purpose.

It is to be understood that the non-redundant i.e., "distinct" sequences may have permissible sequence similarities that result in the permissible structural similarities discussed herein above, including e.g., incorporation of one or more labels and/or reporter molecules and/or tags and/or protein transduction domains and/or D-amino acids and/or phosphorylated moieties and/or glycosylated moieties such as sugars.

As with other embodiments for producing non-redundant libraries described herein, the degree of redundancy in a peptide library produced according to this embodiment is low unless the library is subjected subsequently to mutagenesis such as for the purpose of affinity maturation. Preferably, the degree of redundancy in a primary peptide library i.e., without subsequent mutation or affinity maturation, is such that there are no more than about two or about three peptides in the library having the a primary amino acid sequence that is more than about 30% identical. This includes allowances for related sequences that form the same structure wherein one sequence forms that structure autonomously and the other sequence requires induction to form the structure, however does not allow for sequences arising by subsequent mutation and/or affinity maturation.

In one example, a computational method is used to find sequences having high sequence identity and/or homology to the obtained sequences or peptides having those sequences. Preferably, a database is searched that identifies and eliminates sequences having high sequence identity e.g., more than 30% or 40% or 50% or 60% sequence identity/similarity to a query sequence.

In an even more preferred embodiment, the present invention provides a method for producing a peptide library, said method comprising:
(i) identifying a plurality of amino acid sequences capable of folding independently from other parts of the proteins in which they are contained in their native contexts:
(ii) size-selecting those sequences at (i) to thereby identify a sub-set of sequences having the average length of an independent protein fold;
(iii) identifying redundant sequences from the sequences selected at (ii) and removing or deleting redundant sequences to thereby leave a non-redundant plurality of amino acid sequences;
(iv) producing peptides from the non-redundant plurality of amino acid sequences at (iii); and
(v) displaying the peptides at (iv) such that said peptides form secondary structures and/or assemblies of secondary structures and/or folds.

Preferably, the displayed peptides form structural folds e.g., in solution or when bound to their target(s).

As with other embodiments described herein, it is entirely permissible to enhance the diversity of the non-redundant plurality of amino acid sequences or the peptides produced there from obtained amino acid sequences, either before or after the peptides are displayed.

In an even more preferred embodiment, the present invention provides a method for producing a peptide library, said method comprising:
(i) identifying a plurality of amino acid sequences capable of folding independently from other parts of the proteins in which they are contained in their native contexts:
(ii) size-selecting those sequences at (i) to thereby identify a sub-set of sequences having the average length of an independent protein fold;
(iii) identifying redundant sequences from the sequences selected at (ii) and removing or deleting redundant sequences to thereby leave a non-redundant plurality of amino acid sequences;

(iv) producing a diverse pool of sequence by a process comprising identifying related sequences to the non-redundant plurality of amino acid sequences at (iii) and adding those sequences to the non-redundant plurality of amino acid sequences at (iii);
(v) producing peptides from the diverse pool of sequences at (iv); and
(vi) displaying the peptides at (v) such that said peptides form secondary structures and/or assemblies of secondary structures and/or folds.

Preferably, the displayed peptides form structural folds e.g., in solution or when bound to their target(s).

Preferably, the identification and elimination of redundant sequences and the production of a diverse pool of sequences are performed using computational methods and by database searching, respectively. In both stages, a percentage limit will be applied to determine the constitution of redundant sequences at (iii) and to the search for related sequences at (iv). It will be understood by a skilled artisan that it is not absolutely necessary for these limits to be the same and such limits at each stage should be determined empirically. In the exemplified embodiment, a percentage limit of 30% was applied to identify and remove redundant sequences, and a percentage limit of 50% was applied for the identification of related sequences. Conveniently, a sequence identity not exceeding about 60% should be used for determining redundancy and for determining relatedness such that no sequences are present in the library having a sequence identity greater than 60% to any other sequence. Preferably, a sequence identity not exceeding about 50% is used for determining redundancy and for determining relatedness such that no sequences are present in the library having a sequence identity greater than 50% to any other sequence. More preferably, a sequence identity not exceeding about 40% should be used for determining redundancy and for determining relatedness such that no sequences are present in the library having a sequence identity greater than 40% to any other sequence. Still more preferably, a sequence identity not exceeding about 30% should be used for determining redundancy and for determining relatedness such that no sequences are present in the library having a sequence identity greater than 30% to any other sequence. As will be known to the skilled artisan, iteration of steps (iii) and (iv) will produce a cut-off value in the peptide library that is the lower of the two levels applied to either step.

In another embodiment, the method additionally comprises providing the amino acid sequences of the secondary structures and/or assemblies of secondary structures and/or folds produced as described herein according to any embodiment e.g., to a person or entity for sale or for screening purposes.

The present invention clearly encompasses the use in drug screening applications of a data set comprising a plurality of non-redundant amino acid sequences capable of forming independent folds or a subset of said plurality selected e.g., on the basis of amino acid content or composition, pI, or a combination thereof.

Accordingly, the present invention also provides a computer-readable medium for use in screening applications said computer-readable medium comprising a database of non-redundant amino acid sequences capable of forming independent folds or a subset of said plurality selected e.g., on the basis of amino acid content or composition, pI, or a combination thereof.

Preferably, each sequence in said plurality of the database corresponds on average to the length of a protein fold. For example, each sequence in said plurality can comprise an upper length of about 50 amino acid residues, more preferably about 40 amino acid residues, still more preferably about 30 amino acid residues. In a particularly preferred embodiment, the data set comprises SEQ ID NOs: 1-30000 or a subset thereof selected e.g., on the basis of amino acid content, amino acid composition, pI, or immunogenicity.

Selection of subsets of sequences from the plurality is particularly useful for particular applications e.g., searching for intrinsic or extrinsic membrane structures, cross-linking structures, etc., and is readily achievable from sequence data or using standard algorithms known to the skilled artisan. For example, preferred amino acid content for selecting a subset of sequences is the presence of a proline, cysteine, arginine, lysine, histidine, aspartate, glutamate, tryptophan, tyrosine, etc. The absence of proline is also preferred, since proline residues disrupt structure. Preferred amino acid compositions for selecting a subset of sequences includes the percentages of sulphur-containing, hydrophobic, hydrophilic, charged, or polar amino acids.

A database can be divided into multiple parts, wherein each part comprises information that is different in nature e.g., one part for structure data and another part for storing information regarding the sequences. A database may also contain additional information e.g., ligands to which the structures bind in nature.

A database of the present invention can be a flat file database or a relational database or an object-oriented database. The database can be internal i.e., a private database not accessible to external users, and typically maintained behind a firewall, by an enterprise. Alternatively, the database can be external i.e., accessible to external users by virtue of being located outside an internal database, and typically maintained by a different entity than an internal database.

A number of external public biological sequence databases, particularly chemical libraries and/or less-refined protein structure data sources referred to herein, are available and can be used with the current invention.

In a further example, the database comprises a population of information that can be modified by users to include new information. The population of information is topically included within a database, and can be identified using the methods of the current invention.

The present invention also provides a computer system for use in screening applications said computer system comprising a computer-readable medium comprising a database of non-redundant amino acid sequences capable of forming independent folds or a subset of said plurality selected e.g., on the basis of amino acid content or composition, pI, or a combination thereof and a user interface allowing a user to input protein structure data and/or ligand structure data e.g., for querying the database and displaying results of a database query. The interface may also permit population of one or more fields of data in the database where a user has authority to populate information.

The interface can be a graphic user interface where entries and selections are made e.g., using a series of menus, dialog boxes, and/or selectable buttons. The interface typically takes a user through a series of screens beginning with a main menu. The user interface can include links to access additional information, including information from other external or internal databases.

A computer system of the present invention that processes input data and displays the results of a database query will typically comprise a processing unit that executes a computer program, such as, for example, a computer program comprising a computer-readable program code embodied on a computer-usable medium and present in a memory function connected to the processing unit. The memory function can be ROM or RAM. The computer program is typically read and executed by the processing unit. The computer-readable program code relates to a plurality of data files stored in a database.

For example, the computer program can also comprise a computer-readable program code for providing a user interface capable of allowing a user to input structure and/or sequence data for proteins, locating data corresponding to the entered query information, and displaying the data corresponding to the entered query.

Data corresponding to the entered query information is typically located by querying a database as described above.

In another example, the computer system and computer program are used to perform a method of the present invention, such as for refining protein structure data.

A computer system of the present invention can be a standalone computer, a conventional network system including a client/server environment and one or more database servers, and/or a handheld device. A number of conventional network systems, including a local area network (LAN) or a wide area network (WAN), are known in the art. Additionally, client/server environments, database servers, and networks are well documented in the technical, trade, and patent literature. For example, the database server can run on an operating system such as UNIX, running a relational database management system, a World Wide Web application, and a World Wide Web Server. When the computer system is a handheld device it can be a personal digital assistant (PDA) or another type of handheld device, of which many are known.

The present invention also provides a peptide library comprising a plurality of non-redundant amino acid sequences capable of forming independent folds or a subset of said plurality selected e.g., on the basis of amino acid content or composition, pI, or a combination thereof.

Preferably, each sequence in said plurality of the library corresponds on average to the length of a protein fold. For example, each sequence in said plurality can comprise an upper length of about 50 amino acid residues, more preferably about 40 amino acid residues, still more preferably about 30 amino acid residues.

In a particularly preferred embodiment, the library comprises a plurality of peptides having sequences comprising SEQ ID NOs: 1-30000 or a subset thereof selected e.g., on the basis of amino acid content, amino acid composition, pI, or immunogenicity.

The present invention also provides a peptide library produced by a method described herein according to any embodiment. In a particularly preferred embodiment, the peptide library is a synthetic peptide library.

The present invention also provides a high-throughput system for drug screening comprising a solid support consisting essentially of or having a plurality of peptides bound directly or indirectly thereto, wherein said plurality of peptides comprises non-redundant amino acid sequences capable of forming independent folds or a subset of said plurality selected e.g., on the basis of amino acid content or composition, pI, or a combination thereof. Preferably, the high-throughput system comprises sufficient sequences to be representative of the diversity of fold structures in nature. The peptides may be arrayed in subsets e.g., on the basis of amino acid content or composition, pI, or a combination thereof. It will be apparent from the foregoing description that the arrayed peptides contained in the high throughput system can be obtained by an intermediate step in a method of the present invention. In use, the high-throughput system of the present invention is used for drug screening to identify one or more ligands of a protein structure, especially a fold structure. Preferably, a peptide library or subset thereof is immobilized on a solid surface, such as, for example, a glass slide or a bead.

Alternatively, the peptide library is displayed, for example, on the surface of a cell or viral particle. For example, the peptide library is a phage display library. Additional suitable libraries include a library of peptides expressed within a cell or within a population of cells, for example within a population of yeast cells.

The libraries of the present invention are suitable for screening to identify a peptide having a desired bioactivity, such as, for example, a peptide that binds to a target molecule and/or inhibits a target interaction. In one example, the present invention additionally provides a process comprising:
(i) performing a method for producing a peptide library, according to any embodiment described herein; and
(ii) screening the peptide library so produced.

In another example, the present invention additionally provides a process comprising:
(i) obtaining a peptide library that has been produced according to any embodiment described herein; and
(ii) screening the peptide library.

These embodiments clearly encompass performing one or more iterations of a screening procedure e.g., a second round of screening employing a peptide library or expression library wherein the members of said library comprise or express peptides having a related structure to the identified peptide. Such "panning" is useful for identifying peptides that bind to a target at higher affinity or lower affinity compared to the peptide identified in primary screens, or have a modified bioactivity compared to the peptide identified in primary screens.

The skilled artisan will also be aware of suitable methods for screening a peptide library, for example, affinity purification or N-hybrid screening, FRET, BRET, protein fragment complementation assay, Fluorescence polarization assays, time resolved capture assay, probing of arrays of the synthetic peptides.

Preferably, these processes further result in the identification and more preferably, the subsequent isolation, of a peptide from the screened peptide library. In such embodiments, the present invention clearly extends to such identified and/or isolated products.

These processes for utilizing the library of the present invention may also comprise determining the secondary structure of a peptide. Alternatively, or in addition, the amino acid sequence of an identified peptide is determined. Alternatively, or in addition, an identified peptide is synthesized, e.g., by recombinant or synthetic means. Alternatively, or in addition, an identified peptide is subjected to mutation or affinity maturation.

In another example, the processes additionally comprise identifying a chemical compound, e.g., a small molecule mimetic of the structure formed by an identified peptide. For example, such a small molecule is a putative drug lead for clinical trial. Methods for predicting the structure of a small molecule and/or identifying a small molecule having a desired structure are described herein and/or known in the art e.g., QASR.

The present invention additionally provides a process comprising:
(i) performing a method for producing a peptide library according to any embodiment described herein:
(ii) screening the peptide library so produced to thereby identify a peptide having a desired structure; and (iii) optionally, providing the peptide or the structure of the peptide to a person such as, for example, in a paper form, machine-readable form, or computer-readable form.

In a preferred embodiment, the peptide or the structure of the peptide is provided with an indication as to its use e.g., as determined by a screen used for its isolation.

In another example, this process further comprises identifying one or more chemical compounds having the secondary structure of the peptide and, preferably, identifying one or more chemical compounds having the same activity as the peptide e.g., as determined by the screen used for its isolation.

BRIEF DESCRIPTION OF THE DRAWINGS

FIG. 1 is a schematic representation of an example of the method for producing a peptide library according to the present invention. Solid boxes and arrows indicate core process steps. Boxes delineated by broken lines, and broken lines indicate optional process steps. In this example, structures are secondary structures and/or assemblies of secondary structures. Also in this example, structures are optionally determined in silico, structure data are pooled, sequences of protein fragments predicted to form the structures are obtained, peptides having those sequences are produced and displayed to produce the structures. Optionally, redundant sequences are removed prior to peptide synthesis and/or the synthesized peptides are mutated to enhance diversity and redundant sequences removed at that stage. Iterations of mutation and removal of redundancies may be performed.

DETAILED DESCRIPTION OF THE PREFERRED EMBODIMENTS

The present invention is further described with regard to the following non-limiting examples.

Example 1

Identifying Non-Redundant Data Sets of Protein Folds

Source Data for Protein Structures

Numerous databases comprising structures of protein folds in their native contexts i.e. in the proteins in which they are found, are known in the art.

An example of one such database is the Structural Classification of Protein database (SCOP) available from the Medical Research Council Laboratory of Molecular Biology and/or originally described in Murzin et al., *J. Mol. Biol.* 247, 536-540, 1995. Version 1.69 released July 2005 of the SCOP database comprises the amino acid sequences of approximately 945 protein folds in their native contexts.

Alternatively, as at Feb. 14, 2006, the Protein Data Bank (PDB) comprises the amino acid sequence of approximately 700 protein folds in their native contexts The amino acid sequences contained within the PDB are available from, for example, Research Collaborator, for Structural Bioinformatics, N.J., USA. The PDB is also described in Berman et al., *Nucleic Acids Research,* 28: 235-242, 2000.

The Class, Architecture, Topology, Homologous superfamily (CATH) database version 2.6.0 (released April, 2005) comprises the amino acid sequences of a large number of distinct protein folds in their native contexts and, in total, approximately 40,000 folds i.e., including redundancies. Information from the CATH database may be accessed from University College London, Department of Biochemistry and Molecular Biology, London UK. The CATH database is also described in Orengo et al. *Structure.* 5: 1093-1108, 1997 and/or Pearl et al., *Nucleic Acids Research.* 33. D247-D25112005.

The Fold classification based on Structure-Structure alignment of Proteins (FSSP) database also provides amino acid sequences of protein folds in their native contexts. The FSSP database is available from the European Bioinformatics Institute.

Alternatively, or in addition, the structure of a protein fold or other structure is predicted using an in silico method, such as, for example, a method described supra or threading (Jones. *Curr. Opin. Struct. Biol.* 7:377-87, 1997; Sippl et al., *Structure* 4:15-19, 1996), "profile analysis" (Bowie et al. *Science,* 253:164-70, 1991; Gribskov et al., *Methods Enzymol.* 183:146-59, 1990; Gribskov et al., *Proc. Nat. Acad. Sci. U.S.A.* 84:4355-58, 1989), and "evolutionary linkage"

For example, conventional threading of an amino acid sequence is used to predict the 3 dimensional structure of a peptide or protein comprising said amino acid sequence. Typically, threading is a process of assigning the fold or other structure of the protein by threading (or comparing) its sequence to a library of potential structural templates by using a scoring function that incorporates the sequence as well as the local parameters such as structure and solvent exposure (Rost et al. 270: 471-480, 1997; Xu and Xu Proteins: *Structure, Function, and Genetics* 40: 343-354, 2000); and Panchenko et al. *J. Mol. Biol.* 296: 1319-1331, 2000). For example, the threading process starts from prediction of the structure of the amino acid sequence and solvent accessibility for each residue of the query sequence. The resulting one-dimensional (1D) profile of the predicted structure is threaded into each member of a library of known 3 dimensional structures. The optimal threading for each sequence-structure pair is obtained using dynamic programming. The overall best sequence-structure pair constitutes the predicted 3 dimensional structure for the query sequence.

Alternatively, the amino acid sequence of a protein fold or other structure is determined by determining or predicting the structure of a peptide comprising a specific amino acid sequence. Methods for predicting the structure of a peptide comprising a specific amino acid sequence are known in the art and include, for example, methods described in US Patent Application No 20020150906, or using a computer program or algorithm, such as, for example, MODELLER, (Sali and Blundell. *J. Mol. Biol.* 234, 779-815, 1993). These techniques rely upon aligning the sequence of a peptide with the sequences of a protein fold or other structure having a previously characterized structure. Such alignment algorithms are known in the art and are accessed through software packages such as, for example BLAST at NCBI. Structural information, i.e. three-dimensional structure, of a query peptide is then be predicted based upon structural information corresponding to the sequence or subsequence aligned in the protein fold or other structures that have previously been characterized.

Obtaining Independent Structures

Computational methods are used to predict the likelihood that any sequence constitutes an independent fold.

For example, the algorithm developed by Tsai et al., Proc. Natl. Acad. Sci, (USA) 97, 12038-12043 (2000) for the purpose of studying the dynamics of protein folding is employed. Because Tsai et al. required a procedure for progressively dissecting native protein structures to reveal their anatomy, they were interested in producing a hierarchy of protein domains independent of fragment size, by cutting the protein into building blocks and measuring the relative conformational stabilities of all candidate building blocks. In the criteria used, hydrophobicity was considered by Tsai et al. to be the dominant driving force for protein folding.

In a particular example of the present invention, fragments of proteins that are computationally predicted to fold independently are predicted by "cutting" proteins into hydrophobic folding units, i.e., single segments of a protein that achieve a positive score for attributes including e.g., compactness, non-polar buried surface area, and a propensity to be associated with other part of the protein in nature. Compactness evaluates the overall surface area of a peptide fragment when removed from the full protein structure. Non-polar buried surface area evaluates the amount of non-polar surface area buried within the fragment. A propensity to be associated with other parts of a protein reflects the degree of contact the fragment has with the rest of the protein in its native context which is highly relevant to the likelihood that a predicted fold will have at least some folded stability when isolated from its native context i.e., when expressed as a peptide. Preferably, this propensity is the dominant attribute and weighted accordingly, since the purpose in this context is to determine independence. The predicted folds should preferably be compact when folded, bury some hydrophobic surface area, and have low contact in the context of a full protein structure in the native context, and thereby be less likely to require extensive contacts with the remainder of the native protein or a heterologous scaffold in order to fold. Implementation of this preferred approach for identifying protein folds to proteins in the Protein Data Bank produces a data file for each of about 45,000 proteins containing residue numbers and scores for each segment in each protein predicted to be independently folding. Of these about 45,000 proteins in an initial data set, approximately 17,500 proteins are predicted to contain at least one segment of 30 amino acid residues or less in length having a positive fragment folding score.

Reducing Redundancy in Amino Acid Sequence and/or Structure

As will be apparent to the skilled artisan from the foregoing description, a preferred peptide library of the present invention preferably has reduced structural redundancy. Accordingly, in some embodiments of the invention it is preferred to produce a library in which peptides identical in structure, albeit not identical in amino acid sequence are not present or are present in limited amounts.

Any one of a number of computational methods are used to identify an remove redundant amino acid sequences from a data set. Such computational methods may select amino acid sequences of protein folds or other structures from one or more databases, compare the sequences to other sequences in the data set and delete the redundant sequences.

In a particularly preferred example, many of the approximately 17,500 proteins referred to in the preceding section that are predicted to contain at least one segment of 30 amino acid residues or less in length having a positive fragment folding score actually comprised similar or identical sequences. To remove the redundancy in this data set, the PISCES server was employed to remove sequences such that no two proteins in the set shared more than 30% identity with one another. PISCES uses structure alignments to determine sequence alignments and sequence identities. This is a far more accurate procedure for removing sequence-redundant proteins than methods described before PISCES was developed. By utilizing the PISCES software, a non-redundant data set comprising a total of 2,011 sequences of 30 amino acid residues or less in length and having a positive fragment folding score were identified. Thus, from an initial data set of about 45,000 proteins were reduced to about 2,000 sequences of folds. This means that less than 5% of protein sequences in the initial data set comprised distinct protein folds.

Enhancing Diversity of the Protein Fold Data Set

In one embodiment, the amino acid sequence diversity in the data set is enhanced to improve the complexity of the peptide libraries. Standard mutational approaches can be applied for this purpose, however the approaches taken for achieving enhanced diversity may differ depending upon whether the peptides are to be produced synthetically or as recombinant peptides in an expression library.

For libraries of synthetic peptides, it is preferred to generate diverse amino acid sequences and then produce synthetic peptides by standard peptide synthesis. In contrast, for enhancing the diversity of recombinant expression libraries, it is necessary to mutate nucleic acids encoding a diverse set of amino acid sequences by site-directed or random mutagenesis approaches.

For example, the amino acid sequences of a plurality of peptide folds can be used as probes in silico to identify related sequences from public databases of protein sequences, and the related sequences included in the data set of protein folds. Accordingly, by aligning a plurality of amino acid sequences capable of forming diverse protein folds can be derived.

In accordance with this example, the inventors have used PSI-BLAST to identify those proteins in the UniRef50 database having homology to 2,011 sequences of protein folds referred to in the preceding section as a non-redundant data set comprising a total of 2,011 sequences of 30 amino acid residues or less in length and having a positive fragment folding score. The UniRef50 database is a subset of the UniProt database of all publicly available protein sequences, such that no two proteins in the set have more than 50% sequence identity to any other sequence i.e., it is a non-redundant database. From these PSI-BLAST searches, the inventors identified regions aligned to the independently-folding segments of the queries, and isolated those sequences from their native contexts as described herein above. To reduce the possibility that the homologous sequences are from well-conserved regions of proteins, subsets of the homologs were selected such that they also had less than 50% identity to one another. Up to a maximum of 20 fragments were selected for each of the 2,011 folds. This procedure resulted in 23,548 non-redundant sequences.

As an alternative to selecting sub-sets of homologues having less than 50% identity to each other, it is possible to simply add all homologous sequences to the dataset of 2,011 sequences and then perform one or more iterations of PISCES to thereby remove redundancies from the data set. For example, using PISCES at 30% cut-off value as described herein above would result in a more stringent selection than selecting homologs such that they also had less than 50% identity to one another and, as a consequence, a smaller data set.

Alternatively, PISCES can be combined with selection of homologs having less than 50% identity to one another.

Because many small, naturally-occurring proteins are likely have binding properties to other proteins, and many such proteins are enzyme inhibitors, protein hormones, or small components of larger complexes, it may indeed be necessary to remove redundancy from such proteins to attain a desirable non-redundant data set of protein folds. For example, 6,480 proteins with lengths from 10 to 30 amino acids in the Uniref50 database were identified by the present inventors and those proteins having undetermined or non-standard amino acids e.g., designated as X in Uniref50, were removed. The amino acid content of each peptide was calculated, and those peptides with one amino acid type covering more than 25% of the peptide length were also removed. This procedure resulted in 6,452 additional protein folds, which were then combined with the 23,548 non-redundant sequences referred to herein above, thereby producing the 30,000 sequences set forth in SEQ ID NOs: 1-30000.

For peptides to be expressed from a nucleic acid, the foregoing procedures may also be employed and nucleic acids encoding the diverse protein folds synthesized and expressed by convention methods for expressing recombinant proteins. However, this approach is likely to be more cumbersome than producing and cloning a smaller set of nucleic acids and then enhancing diversity in the nucleic acids by mutagenesis, as explained in the following paragraphs.

For example, nucleic acid may be amplified using mutagenic PCR such as by (i) performing the PCR reaction in the presence of manganese; and/or (ii) performing the PCR in the presence of a concentration of dNTPs sufficient to result in misincorporation of nucleotides. Methods of inducing random mutations using PCR are known in the art and are described, for example, in Dieffenbach (ed) and Dveksler (ed) (In: PCR Primer: A Laboratory Manual, Cold Spring Harbour Laboratories, N.Y., 1995). Furthermore, commercially available kits for use in mutagenic PCR are obtainable, such as, for example, the Diversify PCR Random Mutagenesis Kit (Clontech) or the GeneMorph Random Mutagenesis Kit (Stratagene).

For example, a PCR reaction is performed in the presence of at least about 200 µM manganese or a salt thereof, more preferably at least about 300 µM manganese or a salt thereof, or even more preferably at least about 500 µM or at least about 600 µM manganese or a salt thereof. Such concentrations manganese ion or a manganese salt induce from about 2 mutations per 1000 base pairs (bp) to about 10 mutations every 1000 bp of amplified nucleic acid (Leung et al *Technique* 1, 11-15, 1989).

Alternatively, nucleic acid is mutated by inserting said nucleic acid into a host cell that is capable of mutating nucleic acid. Such host cells are deficient in one or more enzymes, such as, for example, one or more recombination or DNA repair enzymes, thereby enhancing the rate of mutation to a rate that is rate approximately 5,000 to 10,000 times higher than for non-mutant cells. Strains particularly useful for the mutation of nucleic acids carry alleles that modify, or inactivate components of the mismatch repair pathway. Examples of such alleles include alleles selected from the group consisting of mutY, mutM, mutD, mutT, mutA, mutC and mutS. Bacterial cells that carry alleles that modify or inactivate components of the mismatch repair pathway are known in the art, such as, for example the XL-1Red, XL-mutS and XL-mutS-Kan$^r$ bacterial cells (Stratagene).

Example 2

Production of Peptides Capable of Forming Folds or Other Structures

Peptide Synthesis

Preferably, a peptide is produced using a synthetic means or method For example, synthetic peptides are prepared using known techniques of solid phase, liquid phase, or peptide condensation, or any combination thereof, and can include natural and/or unnatural amino acids. Amino acids used for peptide synthesis may be standard Boc (Nα-amino protected Nα-t-butyloxycarbonyl) amino acid resin with the deprotecting, neutralization, coupling and wash protocols of the original solid phase procedure of Merrifield, *J. Am. Chem. Soc.*, 85:2149-2154, 1963, or the base-labile Nα-amino protected 9-fluorenylmethoxycarbonyl (Fmoc) amino acids described by Carpino and Han, *J. Org. Chem.*, 37:3403-3409, 1972. Both Fmoc and Boc Nα-amino protected amino acids can be obtained from various commercial sources, such as, for example, Fluka, Bachem, Advanced Chemtech, Sigma, Cambridge Research Biochemical. Bachem, or Peninsula Labs. Furthermore, phospho-amino acids or glycol-amino acids may also be used to generate a phosphorylated synthetic polypeptide. Methods for producing glycopeptides and/or phosphorpeptides will be apparent to the skilled artisan and/or described in Fmoc Solid Phase Peptide Synthesis: A Practical Approach (Chan and White Eds.) Dec. 16, 1999, Oxford University Press.

Generally, chemical synthesis methods comprise the sequential addition of one or more amino acids to a growing peptide chain. Normally, either the amino or carboxyl group of the first amino acid is protected by a suitable protecting group. The protected or derivatized amino acid can then be either attached to an inert solid support or utilized in solution by adding the next amino acid in the sequence having the complementary (amino or carboxyl) group suitably, protected, under conditions that allow for the formation of an amide linkage. The protecting group is then removed from the newly added amino acid residue and the next amino acid (suitably protected) is then added, and so forth. After the desired amino acids have been linked in the proper sequence, any remaining protecting groups (and any solid support, if solid phase synthesis techniques are used) are removed sequentially or concurrently, to render the final peptide. Alternatively, the peptide is retained on the solid support to thereby produce, for example, an array of peptides. By simple modification of this general procedure, it is possible to add more than one amino acid at a time to a growing chain, for example, by coupling a protected tripeptide with a properly protected dipeptide to form, after deprotection, a pentapeptide. See, e.g., J. M. Stewart and J. D. Young, Solid Phase Peptide Synthesis (Pierce Chemical Co., Rockford, Ill. 1984) and G. Barany and R. B. Merrifield, The Peptides: Analysis, Synthesis, Biology, editors E. Gross and J. Meienhofer, Vol. 2, (Academic Press, New York, 1980), pp. 3-254, for solid phase peptide synthesis techniques; and M. Bodanshk, Principles of Peptide Synthesis, (Springer-Verlag, Berlin 1984) and E. Gross and J. Meienhofer, Eds., The Peptides Analysis. Synthesis. Biology, Vol. 1, for classical solution synthesis. These methods are suitable for synthesis of a peptide.

Typical protecting groups include t-butyloxycarbonyl (Boc), 9-fluorenylmethoxycarbonyl (Fmoc) benzyloxycarbonyl (Cbz); p-toluenesulfonyl (Tx); 2,4-dinitrophenyl; benzyl (Bzl); biphenylisopropyloxycarboxy-carbonyl, t-amyloxycarbonyl, isobornyloxycarbonyl, o-bromobenzyloxycarbonyl, cyclohexyl, isopropyl, acetyl, o-nitrophenylsulfonyl and the like.

Typical solid supports are cross-linked polymeric supports. These can include divinylbenzene cross-linked-styrene-based polymers, for example, divinylbenzene-hydroxymethylstyrene copolymers, divinylbenzene-chloromethylstyrene copolymers and divinylbenzene-benzhydrylaminopolystyrene copolymers.

Peptides can be also be produced using alternative synthesis methodologies to enhance the efficient production of long peptides, including microwave enabled synthesis, protein ligation of shorter peptide sequences with a peptidyl bond (or alternatively with other covalent bonds such a through oxidation of cysteine residues to form a disulphide bond or the formation of a thioester bond.

Alternative peptide synthesis methods will be apparent to the skilled artisan, such as, for example, methods of simultaneous multiple peptide synthesis, e.g., as described in Houghten *Proc. Natl. Acad. Sci. USA* 82: 5131-5135, 1985 or U.S. Pat. No. 4,631,211.

As will be apparent to the skilled artisan based on the description herein, a peptide may comprise D-amino acids, a combination of D- and L-amino acids, and various unnatural amino acids (e.g., α-methyl amino acids. Cα-methyl amino acids, and Nα-methyl amino acids, etc) to convey special properties. Synthetic amino acids include ornithine for lysine, fluorophenylalanine for phenylalanine, and norleucine for leucine or isoleucine. Methods for the synthesis of such peptides will be apparent tot eh skilled artisan based on the foregoing.

Peptide Analogues

In another embodiment, the library, comprises one or more peptide analogues and/or peptide derivatives. In this respect, the library may be made up entirely of peptide analogues or peptide derivatives or a mixture of peptide analogues and peptide; a mixture of peptide derivatives and peptides; or a mixture of peptide analogues, peptide derivatives and peptides.

As used herein, the term "analogue" shall be taken to mean a peptide that is modified to comprise one or more naturally-occurring and/or non-naturally-occurring amino acids. For example, the term "analogue" encompasses a peptide capable of forming a fold or other structure and comprising one or more conservative amino acid changes relative to a base peptide. The term "analogue" also encompasses a peptide comprising, for example, one or more D-amino acids. For example, such an analogue has the characteristic of reduced immunogenicity and/or protease resistance.

As used herein the term "derivative" shall be taken to mean a peptide that is derived from a peptide capable of fold or other structuring to produce a structure or a tertiary structure, e.g., a fragment or processed form of the peptide. The term "derivative" also encompasses fusion proteins comprising the peptide. For example, the fusion protein comprises a label, such as, for example, biotin or an epitope, e.g., a FLAG epitope or a V5 epitope or an HA epitope. Such a tag is useful for, for example, purifying the fusion protein.

Suitable peptide analogues include one or more conservative amino acid substitutions. A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), .beta.-branched side chains (e.g., threonine, valine, isoleucine) and aromatic side chains (e.g., tyrosine, phenylalanine, tryptophan, histidine). Those skilled in the art are well aware that the following substitutions are permissible conservative substitutions for maintains structure: (i) substitutions involving arginine, lysine and histidine; (ii) substitutions involving alanine, glycine and serine; and (iii) substitutions involving phenylalanine, tryptophan and tyrosine.

Analogues of the peptide described herein according to any embodiment are intended to include peptides in which one or more amino acids of the peptide structure are substituted with a homologous amino acid such that the properties of the original peptides are maintained. Preferably conservative amino acid substitutions are made at one or more amino acid residues.

The importance of the hydropathic amino acid index in conferring interactive biological function on a protein is generally understood in the art (Kyte & Doolittle, J. Mol. Biol. 157, 105-132, 1982). It is known that certain amino acids may be substituted for other amino acids having a similar hydropathic index or score and still retain a similar biological activity, for example, the ability to fold or other structure to form a structure and/or a tertiary structure. The hydropathic index of amino acids also may be considered in determining a conservative substitution that produces a functionally equivalent molecule. Each amino acid has been assigned a hydropathic index on the basis of their hydrophobicity and charge characteristics, as follows: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5). In making changes based upon the hydropathic index, the substitution of amino acids whose hydropathic indices are within +/−0.2 is preferred. More preferably, the substitution will involve amino acids having hydropathic indices within +/−0.1, and more preferably within about +/−0.05.

It is also understood in the art that the substitution of like amino acids is made effectively on the basis of hydrophilicity. As detailed in U.S. Pat. No. 4,554,101, the following hydrophilicity values have been assigned to amino acid residues: arginine (+3.0); lysine (+3.0); aspartate (−3.0+/−0.1); glutamate (−3.0+/−0.1); serine (0.3); asparagine (+0.2); glutamine (++0.2); glycine (0); threonine (−0.4); proline (−0.5+/−0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). In making changes based upon similar hydrophilicity values, it is preferred to substitute amino acids having hydrophilicity values within about +/−0.2 of each other, more preferably within about −/−0.1, and even more preferably within about −/−0.05

It also is contemplated that other sterically similar compounds may be formulated to mimic the key portions of the peptide structure. Such compounds, which may be termed peptidomimetics, may be used in the same manner as the peptides of the invention and hence are also analogues of a peptide of the invention. The generation of such an analogue may be achieved by the techniques of modeling and chemical design known to those of skill in the art. It will be understood that all such sterically similar antimicrobial peptide analogues fall within the scope of the present invention.

Another method for determining the "equivalence" of modified peptides involves a functional approach. For example, a given peptide analogue is tested or analysed for its ability to fold or other structure to produce a structure and/or a tertiary structure e.g., using any screening method described herein.

Preferred analogues of a peptide of the invention will comprise one or more non-naturally occurring amino acids or amino acid analogues. For example, an antimicrobial peptide of the invention may comprise one or more naturally occurring non-genetically encoded L-amino acids, synthetic L-amino acids or D-enantiomers of an amino acid. For example, the peptide comprises only D-amino acids. More particularly, the analogue may comprise one or more residues selected from the group consisting of: hydroxyproline, β-alanine, 2,3-diaminopropionic acid, α-aminoisobutyric acid, N-methylglycine (sarcosine), ornithine, citrulline, t-butylalanine, t-butylglycine, N-methylisoleucine, phenylglycine, cyclohexylalanine, norleucine, naphthylalanine, pyridylanaine 3-benzothienyl alanine 4-chlorophenylalanine, 2-fluorophenylalanine, 3-fluorophenylalanine, 4-fluorophenylalanine, penicillamine, 1,2,3,4-tetrahydro-tic isoquinoline-3-carboxylic acid β-2-thienylalanine, methionine sulfoxide, homoarginine, N-acetyl lysine, 2,4-diamino butyric acid, ρ-aminophenylalanine, N-methylvaline, homocysteine, homoserine, ε-amino hexanoic acid, δ-amino valeric acid, 2,3-diaminobutyric acid and mixtures thereof.

Commonly-encountered amino acids that are not genetically encoded and which can be present, or substituted for an amino acid in an analogue of an antimicrobial peptide of the invention include, but are not limited to, β-alanine (β-Ala) and other omega-amino acids such as 3-aminopropionic acid (Dap), 2,3-diaminopropionic acid (Dpr), 4-aminobutyric acid and so forth; α-aminoisobutyric acid (Aib); ε-aminohexanoic acid (Aha); δ-aminovaleric acid (Ava); methylglycine (MeGly); ornithine (Orn); citrulline (Cit); t-butylalanine (t-BuA); t-butylglycine (t-BuG); N-methylisoleucine (MeIle); phenylglycine (Phg); cyclohexylalanine (Cha); norleucine (Nle); 2-naphthylalanine (2-Nal); 4-chlorophenylalanine (Phe(4-Cl)); 2-fluorophenylalanine (Phe(2-F)); 3-fluorophenylalanine (Phe(3-F)); 4-fluorophenylalanine (Phe(4-F)); penicillamine (Pen); 1,2,3,4-tetrahydroisoquinoline-3-carboxylic acid (Tic); .beta.-2-thienylalanine (Thi); methionine sulfoxide (MSO); homoarginine (hArg); N-acetyl lysine (AcLys); 2,3-diaminobutyric acid (Dab); 2,3-diaminobutyric acid (Dbu); p-aminophenylalanine (Phe (pNH$_2$)); N-methyl valine (MeVal); homocysteine (hCys) and homoserine (hSer).

Other amino acid residues that are useful for making the peptides and peptide analogues described herein can be found, e.g., in Fasman, 1989, CRC Practical Handbook of Biochemistry and Molecular Biology, CRC Press, Inc., and the references cited therein.

The present invention additionally encompasses an isostere of a peptide described herein. The term "isostere" as used herein is intended to include a chemical structure that can be substituted for a second chemical structure because the steric conformation of the first structure fits a binding site specific for the second structure. The term specifically includes peptide back-bone modifications (i.e., amide bond mimetics) known to those skilled in the art. Such modifications include modifications of the amide nitrogen, the α-carbon, amide carbonyl, complete replacement of the amide bond, extensions, deletions or backbone cross links. Several peptide backbone modifications are known, including ψ[CH$_2$S], ψ[CH$_2$NH], ψ[CSNH$_2$], ψ[NHCO], ψ[COCH$_2$], and ψ[(E) or (Z) CH=CH]. In the nomenclature used above, ψ indicates the absence of an amide bond. The structure that replaces the amide group is specified within the brackets.

Other modifications include, for example, an N-alkyl (or aryl) substitution (ψ[CONTR]), or backbone cross linking to construct lactams and other cyclic structures. Other derivatives of the modulator compounds of the invention include C-terminal hydroxymethyl derivatives. O-modified derivatives (e.g., C-terminal hydroxymethyl benzyl ether). N-terminally modified derivatives including substituted amides such as alkylamides and hydrazides.

In one embodiment, the peptide analogue is a retro peptide analogue (Goodman et al., Accounts of Chemical Research, 12:1-7, 1979). A retro peptide analogue comprises a reversed amino acid sequence of a peptide capable of fold or other structuring to produce the structures and/or tertiary structure.

In a preferred embodiment, a peptide analogue is a retro-inverso peptide (Sela and Zisman, FASEB J. 11:449, 1997). Evolution has ensured the almost exclusive occurrence of L-amino acids in naturally occurring proteins. As a consequence, virtually all proteases cleave peptide bonds between adjacent L-amino acids. Accordingly, artificial proteins or peptides composed of D-amino acids are preferably resistant to proteolytic breakdown. Retro-inverso peptide analogues are isomers of linear peptides in which the direction of the amino acid sequence is reversed (retro) and the chirality, D- or L-, of one or more amino acids therein is inverted (inverso) e.g. using D-amino acids rather than L-amino acids, e.g., Jameson et al., Nature, 368, 744-746 (1994); Brady et al., Nature, 368, 692-693 (1994). The net result of combining D-enantiomers and reverse synthesis is that the positions of carbonyl and amino groups in each amide bond are exchanged, while the position of the side-chain groups at each alpha carbon is preserved.

An advantage of retro-inverso peptides is their enhanced activity in vivo due to improved resistance to proteolytic degradation, i.e., the peptide has enhanced stability. (e.g., Chorev et al., Trends Biotech. 131, 438-445, 1995).

Retro-inverso peptide analogues may be complete or partial. Complete retro-inverso peptides are those in which a complete sequence of an antimicrobial peptide of the invention is reversed and the chirality of each amino acid in a sequence is inverted. Partial retro-inverso peptide analogues are those in which only some of the peptide bonds are reversed and the chirality of only those amino acid residues in the reversed portion is inverted. For example, one or two or three or four or five or six or seven or eight or nine or ten or eleven or twelve or thirteen or fourteen or fifteen or sixteen or seventeen or eighteen or nineteen or twenty or twenty one or twenty two or twenty three or twenty four or twenty five or twenty six or twenty seven or twenty eight or twenty nine or thirty or thirty one or thirty two or thirty three or thirty four or thirty five or thirty six or thirty seven or thirty eight amino acid residues are D-amino acids. Alternatively, 10% or 15% or 20% or 25% or 30% or 35% or 40% or 45% or 50% or 55% or 60% or 65% or 70% or 75% or 80% or 85% or 90% or 95% of the amino acids in a peptide are D-amino acids. The present invention clearly encompasses both partial and complete retro-inverso peptide analogues.

Preferred retro-inverso analogues are partial analogues wherein the complete amino acid sequence of a peptide is reversed and an amino acid residue in said sequence other than glycine is inverted (i.e., substituted with a corresponding D-amino acid residue). Preferably, all amino acid residues other than glycine are inverted.

In another embodiment, a peptide analogue is modified to reduce the immunogenicity of said analogue. Such reduced immunogenicity is useful for a peptide that is to be, for example, injected into a subject. Methods for reducing the immunogenicity of a peptide will be apparent to the skilled artisan. For example, an antigenic region of a peptide is predicted using a method known in the art and described, for example, in Kolaskar and Tongaonkar FEBS Letters, 276: 172-174, 1990. Any identified antigenic region may then be modified to reduce the immunogenicity of a peptide analogue, provided that said analogue is capable of fold or other structuring to produce a secondary and/or tertiary structure.

Alternatively, or in addition, Tangri et al. The Journal of Immunology, 74: 3187-3196, 2005, describe a process for identifying an antigenic site in a peptide and modifying said site to thereby reduce the immunogenicity of the protein without significantly reducing the activity of said protein. The approach is based on 1) the identification of immune-dominant epitopes, e.g., by determining binding to purified HLA molecules; and 2) reducing their binding affinity to HLA-DR molecules to levels below those associated with naturally occurring helper T lymphocyte epitopes. Generally, the approach is based on quantitative determination of HLA-DR binding affinity coupled with confirmation of these epitopes by in vitro immunogenicity testing.

Peptide Derivatives

Peptide derivatives encompass a peptide or an analogue thereof as described herein in any embodiment that is modified to contain one or more-chemical moieties other than an amino acid. The chemical moiety may be linked covalently to the peptide or analogue e.g., via an amino terminal amino acid residue, a carboxyl terminal amino acid residue, or at an internal amino acid residue. Such modifications include the addition of a protective or capping group on a reactive moiety in the peptide, addition of a detectable label, and other changes that do not adversely destroy the activity of the peptide compound (e.g., its ability to form a fold or other structure).

An "amino terminal capping group" of a peptide described herein is any chemical compound or moiety that is covalently linked or conjugated to the amino terminal amino acid residue of a peptide or analogue. An amino-terminal capping group may be useful to inhibit or prevent intramolecular cyclization or intermolecular polymerization, to protect the amino terminus from an undesirable reaction with other molecules, or to provide a combination of these properties. A peptide of this invention that possesses an amino terminal capping group may possess other beneficial activities as compared with the uncapped peptide, such as enhanced efficacy or reduced side effects. Examples of amino terminal capping groups that are useful in preparing peptide derivatives according to the invention include, but are not limited to, 1 to 6 naturally occurring L-amino acid residues, preferably, 1-6 lysine residues, 1-6 arginine residues, or a combination of lysine and arginine residues; urethanes; urea compounds; lipoic acid ("Lip"); glucose-3-O-glycolic acid moiety ("Gga"); or an acyl group that is covalently linked to the amino terminal amino acid residue of a peptide, wherein such acyl groups useful in the compositions of the invention may have a carbonyl group and a hydrocarbon chain that ranges from one carbon atom (e.g., as in an acetyl moiety) to up to 25 carbons (e.g., palmitoyl group, "Palm" (16:0) and docosahexaenoyl group, "DHA" (C22:6-3)). Furthermore, the carbon chain of the acyl group may be saturated, as in Palm, or unsaturated, as in DHA. It is understood that when an acid, such as docosahexaenoic acid, palmitic acid, or lipoic acid is designated as an amino terminal capping group, the resultant peptide is the condensed product of the uncapped peptide and the acid.

A "carboxyl terminal capping group" of a peptide described herein is any chemical compound or moiety that is covalently linked or conjugated to the carboxyl terminal amino acid residue of the peptide. The primary purpose of such a carboxyl terminal capping group is to inhibit or prevent intramolecular cyclization or intermolecular polymerization, to promote transport of the peptide compound across the blood-brain barrier, and to provide a combination of these properties. A peptide of this invention possessing a carboxyl terminal capping group may also possess other beneficial activities as compared with the uncapped peptide, such as enhanced efficacy, reduced side effects, enhanced hydrophilicity, enhanced hydrophobicity. Carboxyl terminal capping groups that are particularly useful in the peptide compounds described herein include primary or secondary amines that are linked by an amide bond to the α-carboxyl group of the carboxyl terminal amino acid of the peptide. Other carboxyl terminal capping groups useful in the invention include aliphatic primary and secondary alcohols and aromatic phenolic derivatives, including flavenoids, with 1 to 26 carbon atoms, which form esters when linked to the carboxylic acid group of the carboxy-terminal amino acid residue of a peptide described herein.

Other chemical modifications of a peptide or analogue, include, for example, glycosylation, acetylation (including N-terminal acetylation), carboxylation, carbonylation, phosphorylation, PEGylation, amidation, addition of trans olefin, substitution of α-hydrogens with methyl groups, derivatization by known protecting/blocking groups, circularization, inhibition of proteolytic cleavage (e.g., using D amino acids), linkage to an antibody molecule or other cellular ligand, etc. Any of numerous chemical modifications may be carried out by known techniques, including but not limited to specific chemical cleavage by cyanogen bromide, trypsin, chymotrypsin, papain, V8 protease, $NaBH_4$, acetylation, formylation, oxidation, reduction, etc.

Other peptide derivatives include, for example, a tag to facilitate isolation of the peptide and/or immobilization of the peptide on a solid surface and/or detection of the peptide. For example, the peptide comprises a biotin tag. Such a biotinylated peptide may be synthesized using known methods. Such a peptide is useful, for example, for immobilizing on a streptavidin coated chip.

Alternatively, or in addition peptide or analogue is fused to a tag or label, such as, for example, influenza virus hemagglutinin (HA) (SEQ ID NO: 30001), Simian Virus 5 (V5) (SEQ ID NO: 30002), polyhistidine (SEQ ID NO: 30003), c-myc (SEQ ID NO: 30004) or FLAG (SEQ ID NO: 30005).

In yet another embodiment the peptide is artificially cyclized by a means, for example, of oxidation of flanking cysteine residues or alternatively by the formation of a thioester linkage. Such constraint should not be required for independent folds, however may be required in some circumstances for assemblies of secondary structures.

In another embodiment, a peptide comprises a linker that facilitates the independent fold or other structuring the peptide to form a structure and/or tertiary structure. A suitable linker will be apparent to the skilled artisan. For example, it is often unfavourable to have a linker sequence with high propensity to adopt α-helix or β-strand structures, which could limit the flexibility of the peptide and consequently its functional activity. Rather, a more desirable linker is a sequence with a preference to adopt extended conformation. In practice, most currently designed linker sequences have a high content of glycine residues that force the linker to adopt loop conformation. Glycine is generally used in designed linkers because the absence of a β-carbon permits the polypeptide backbone to access dihedral angles that are energetically forbidden for other amino acids.

Preferably, the linker is hydrophilic, i.e., the residues in the linker are hydrophilic.

Linkers comprising glycine and/or serine have a high freedom degree for linking of two proteins or peptides, i.e., they enable the fused proteins or peptides to fold or other structure. Robinson and Sauer *Proc. Crate. Acad. Sci.* 95: 5929-5934, 1998 found that it is the composition of a linker peptide that is important for stability and fold or other structuring of a fusion protein rather than a specific sequence. For example, the authors found that a fusion protein comprising a linker consisting almost entirely of glycine was unstable. Accordingly, the use of amino acid residues other than glycine, such as, for example, alanine, cysteine, or serine, is also useful for the production of a linker.

In one embodiment, the linker is a glycine rich linker. Preferably, the linker is a glycine linker that additionally comprises alanine and/or serine.

Exemplary linkers comprise from one to about six glycine and/or serine and/or alanine residues, or an amino acid sequence selected from any one of SEQ ID NOs: 30006 to 30031.

In a particularly preferred embodiment, the linker is a single amino acid residue, preferably a single glycine residue, e.g., conveniently added to the C-terminus or N-terminus of either constituent peptidyl moiety tht it links together.

In another embodiment, the peptide derivative of the invention additionally comprises, for example a sequence of amino acids that facilitate uptake of the peptide into a cell, e.g., a protein transduction domain. For example, the amino acid sequence capable of enhancing, increasing or assisting uptake is the $Drosophila$ penetratin targeting sequence. This peptide sequence at least comprises the amino acid sequence CysArg-GlnIleLysIleTrpPheGlnAsnArgArgMetLysTrpLysLys (SEQ ID NO. 30032) further comprising (Xaa)n after the final Lys residue and followed by Cys wherein Xaa is any amino acid and n has a value greater than or equal to 1. Alternatively, a homologue, derivative or analogue of said sequence is used.

Alternative protein transduction domains are known in the art, and include, for example, a protein transduction domain from the HIV-1 TAT protein, such as, for example the TAT fragment 48-60 (SEQ ID NO: 30036) or a retroinverted analog thereof wherein each residue other than glycine is a D-amino acid residue, or a homolog, derivative or analog of the $TAT_{48-60}$ fragment e.g., any one of SEQ ID NOs: 30033-30035 or any one of SEQ ID NOs: 30037-30040, or a retroinvented analog thereof e.g., any one of SEQ ID NOs: 30041-30048, especially SEQ ID NO: 30048.

Alternate protein transduction domains include non-inverted and retroinverted forms of a Kaposi fibroblast growth factor (FGF) hydrophobic peptide, optionally with a glycine spacer added (e.g., SEQ ID NOs: 30049-30052); a non-inverted form of the signal sequence based peptide 1 (SEQ ID NO: 30053) and a retroinverted form thereof; a non-inverted form of the signal sequence based peptide 2 (SEQ ID NO: 30054) and a retroinverted form thereof, a non-inverted form of transportan protein transduction domain (SEQ ID NO: 30055) and a retroinverted form thereof; a non-inverted form of the an amphiphilic model peptide (SEQ ID NO: 30056) and a retroinverted form thereof; and a non-inverted form of a polyarginine peptide (SEQ ID NO: 30057) and a retroinverted form thereof.

Other protein transduction domains are known in the art, and are clearly useful in the present invention. For example, amino acids 43-58 of $Drosophila$ antennapedia, poly-arginine. PTD-5, Transportan and KALA (reviewed in Kabouridis, $TRENDS$ in Biotechnology, 21: 498-503, 2003).

As explained herein, the protein transduction domain peptide may be produced with a glycine spacer residue that is endogenous to the peptide sequence and/or added to the C-terminus or N-terminus of the endogenous peptide sequence. Preferably, if the peptide is not a retroinverted peptide, the spacer occurs in the native sequence or is added to the C-terminus of the peptide's native sequence during synthesis. Preferably, if the peptide is a retroinverted peptide comprising D-amino acids other than glycine, the spacer is occurs at the C-terminus of the corresponding native sequence such that it is introduced at the N-terminus of the retroinverted sequence or is added to the N-terminus of the retroinverted peptide sequence during synthesis. This preferred embodiment produces a configuration such that the protein transduction domain is positioned at the N-terminus of a non-inverted peptide and at the C-terminus of a retroinverted peptide.

Recombinant Peptide Production

In one embodiment, a peptide is produced by recombinant means or methods. To facilitate the production of a recombinant peptide or fusion protein nucleic acid encoding same is preferably isolated or synthesized. In this respect, the nucleotide sequence of a nucleic acid encoding the peptide is identified using a method known in the art and/or described herein, e.g., reverse translation. Such a nucleic acid is then produced by synthetic means or recombinant means. For example, the nucleic acid is isolated using a known method, such as, for example, amplification (e.g., using PCR or splice overlap extension). Methods for such isolation will be apparent to the ordinary skilled artisan and/or described in Ausubel et al (In: Current Protocols in Molecular Biology. Wiley Interscience, ISBN 047 150338, 1987), Sambrook et al (In: Molecular Cloning: Molecular Cloning: A Laboratory Manual, Cold Spring Harbor Laboratories, New York, Third Edition 2001).

For example, nucleic acid encoding a peptide is isolated using polymerase chain reaction (PCR). Methods of PCR are known in the art and described, for example, in Dieffenbach (ed) and Dveksler (ed) (In: PCR Primer: A Laboratory Manual, Cold Spring Harbour Laboratories, N.Y., 1995). Generally, for PCR two non-complementary, nucleic acid primer molecules comprising at least about 20 nucleotides in length, and more preferably at least 25 nucleotides in length are hybridized to different strands of a nucleic acid template molecule, and specific nucleic acid molecule copies of the template are amplified enzymatically. Preferably, the primers hybridize to nucleic acid adjacent to a nucleic acid encoding the peptide, thereby facilitating amplification of the nucleic acid that encodes the subunit. Following amplification, the amplified nucleic acid is isolated using a method known in the art and, preferably cloned into a suitable vector.

Other methods for the production of a nucleic acid of the invention will be apparent to the skilled artisan and are encompassed by the present invention. For example, the nucleic acid is produced by synthetic means. Methods for synthesizing a nucleic acid are described, in Gait (Ed) (In: Oligonucleotide Synthesis: A Practical Approach, IRL Press, Oxford, 1984). Methods for oligonucleotide synthesis include, for example, phosphotriester and phosphodiester methods (Narang, et al. $Meth. Enzymol$ 68: 90, 1979) and synthesis on a support (Beaucage, et al $Tetrahedron Letters$ 22: 1859-1862, 1981) as well as phosphoramidate technique, Caruthers, M. H., et al., "Methods in Enzymology," Vol. 154, pp. 287-314 (1988), and others described in "Synthesis and Applications of DNA and RNA," S. A. Narang, editor, Academic Press, New York, 1987, and the references contained therein.

For expressing protein by recombinant means, the peptide encoding nucleic acid is placed in operable connection with a promoter or other regulatory sequence capable of regulating expression in a cell-free system or cellular system to thereby produce an expression construct. For example, nucleic acid comprising a sequence that encodes a peptide placed in operable connection with a suitable promoter is expressed in a suitable cell for a time and under conditions sufficient for expression to occur.

As used herein, the term "promoter" is to be taken in its broadest context and includes the transcriptional regulator-sequences of a genomic gene, including the TATA box or initiator element, which is required for accurate transcription initiation, with or without additional regulatory elements (e.g., upstream activating sequences, transcription factor binding sites, enhancers and silencers) that alter expression of a nucleic acid, e.g., in response to a developmental and/or external stimulus, or in a tissue specific manner. In the present context, the term "promoter" is also used to describe a recombinant, synthetic or fusion nucleic acid, or derivative which confers, activates or enhances the expression of a nucleic acid to which it is operably linked. Preferred promoters can contain additional copies of one or more specific regulatory elements to further enhance expression and/or alter the spatial expression and/or temporal expression of said nucleic acid.

As used herein, the term "in operable connection with" "in connection with" or "operably linked to" means positioning a promoter relative to a nucleic acid such that expression of the nucleic acid is controlled by the promoter. For example, a promoter is generally positioned 5' (upstream) to the nucleic acid, the expression of which it controls. To construct heterologous promoter/nucleic acid combinations, it is generally preferred to position the promoter at a distance from the gene transcription start site that is approximately the same as the distance between that promoter and the nucleic acid it controls in its natural setting, i.e., the gene from which the promoter is derived. As is known in the art, some variation in this distance can be accommodated without loss of promoter function.

Should it be preferred that a peptide or fusion protein of the invention is expressed in vitro a suitable promoter includes, but is not limited to a T3 or a T7 bacteriophage promoter (Hanes and Plückthun *Proc. Natl. Acad. Sci. USA*, 94 4937-4942 1997).

Typical expression vectors for in vitro expression or cell-free expression have been described and include, but are not limited to the TNT T7 and TNT T3 systems (Promega), the pEXP1-DEST and pEXP2-DEST vectors (Invitrogen).

Typical promoters suitable for expression in bacterial cells include, but are not limited to, the lacz promoter, the Ipp promoter, temperature-sensitive λL or λR promoters, T7 promoter, T3 promoter, SP6 promoter or semi-artificial promoters such as the IPTG-inducible tac promoter or lacUV5 promoter. A number of other gene construct systems for expressing the nucleic acid fragment of the invention in bacterial cells are well-known in the art and are described for example, in Ausubel et al (In: Current Protocols in Molecular Biology. Wiley Interscience, ISBN 047 150338, 1987), U.S. Pat. No. 5,763,239 (Diversa Corporation) and Sambrook et al (In: Molecular Cloning: Molecular Cloning: A Laboratory Manual, Cold Spring Harbor Laboratories, New York, Third Edition 2001).

Numerous expression vectors for expression of recombinant polypeptides in bacterial cells and efficient ribosome binding sites have been described, and include, for example, PKC30 (Shimatake and Rosenberg, Nature 292, 128, 1981); pKK173-3 (Amann and Brosius, Gene 40, 183, 1985), pET-3 (Studier and Moffat. J. Mol. Biol. 189, 113, 1986); the pCR vector suite (Invitrogen), pGEM-T Easy vectors (Promega), the pL expression vector suite (Invitrogen) the pBAD/TOPO or pBAD/thio—TOPO series of vectors containing an arabinose-inducible promoter (Invitrogen, Carlsbad, Calif.), the latter of which is designed to also produce fusion proteins with a Trx loop for conformational constraint of the expressed protein; the pFLEX series of expression vectors (Pfizer nc., CT, USA); the pQE series of expression vectors (QIAGEN, CA, USA), or the pL series of expression vectors (Invitrogen), amongst others.

Typical promoters suitable for expression in yeast cells such as for example a yeast cell selected from the group comprising *Pichia pastoris, S. cerevisiae* and *S. pombe*, include, but are not limited to, the ADH1 promoter, the GAL1 promoter, the GAL4 promoter, the CUP1 promoter, the PH05 promoter, the nmt promoter, the RPR1 promoter, or the TEF1 promoter.

Expression vectors for expression in yeast cells are preferred and include, but are not limited to, the pACT vector (Clontech), the pDBleu-X vector, the pPIC vector suite (Invitrogen), the pGAPZ vector suite (Invitrogen), the pHYB vector (Invitrogen), the pYD 1 vector (Invitrogen), and the pNMT 1, pNMT41, pNMT81 TOPO vectors (Invitrogen), the pPC86-Y vector (Invitrogen), the pRH series of vectors (Invitrogen), pYESTrp series of vectors (Invitrogen).

Typical promoters suitable for expression in viruses of eukaryotic cells and eukaryotic cells include the SV40 late promoter, SV40 early promoter and cytomegalovirus (CMV) promoter, CMV IE (cytomegalovirus immediate early) promoter amongst others. Preferred vectors for expression in mammalian cells (e.g., 293, COS, CHO, TOT cells, 293T cells) include, but are not limited to, the pcDNA vector suite supplied by Invitrogen, in particular pcDNA 3.1 myc-His-tag comprising the CMV promoter and encoding a C-terminal 6xHis and MYC tag; and the retrovirus vector pSRαtkneo (Muller et al., *Mol. Cell. Biol.*, 11, 1785, 1991).

A wide range of additional host/vector systems suitable for expressing an antimicrobial peptide or fusion protein of the present invention are available publicly, and described, for example, in Sambrook et al (In: Molecular cloning, A laboratory manual, second edition, Cold Spring Harbor Laboratory, Cold Spring Harbor, N.Y., 1989).

Means for introducing the isolated nucleic acid molecule or a gene construct comprising same into a cell for expression are well-known to those skilled in the art. The technique used for a given organism depends on the known successful techniques. Means for introducing recombinant DNA into cells include microinjection, transfection mediated by DEAE-dextran, transfection mediated by liposomes such as by using lipofectamine (Gibco, Md., USA) and/or cellfectin (Gibco, Md., USA), PEG-mediated DNA uptake, electroporation and microparticle bombardment such as by using DNA-coated tungsten or gold particles (Agracetus Inc., ANTI, USA) amongst others.

Peptide Isolation

In one embodiment, the peptide is isolated or purified following synthesis or expression. Standard methods of peptide purification are employed to obtain an isolated peptide, including but not limited to various high-pressure (or performance) liquid chromatography (HPLC) and non-HPLC peptide isolation protocols, such as size exclusion chromatography, ion exchange chromatography, phase separation methods, electrophoretic separations, precipitation methods, salting in/out methods, immunochromatography, and/or other methods.

Alternatively, affinity purification is useful for isolating a fusion protein comprising a label. Methods for isolating a protein using affinity chromatography are known in the art and described, for example, in Scopes (In: Protein purification: principles and practice, Third Edition, Springer Verlag, 1994). For example, an antibody or compound that binds to the label (in the case of a polyhistidine tag this may be, for example, nickel-NTA) is preferable immobilized on a solid support. A sample comprising a fusion protein is then contacted to the immobilized antibody or compound for a time and under conditions sufficient for binding to occur. Following washing to remove any unbound or non-specifically bound protein, the fusion protein is eluted.

Example 3

Peptide Display Methods

Solid Supports

Peptides capable of forming folds or other structures can be synthesized directly onto a solid support, such as, for example, a microchip or immobilized on the solid support to thereby produce an array of peptides. Suitable methods for immobilizing a peptide on a solid support are known in the art and include, for example, either direct linkage (e.g. by covalent linkage, such as, for example, Schiff's base formation, disulfide linkage, or amide or urea bond formation) or indirect linkage. Methods of generating such a protein chip are known in the art and are described in for example U.S. Patent Application Nos. 20020136821, 20020192654, 20020102617 and U.S. Pat. No. 6,391,625 or Lee et al. *Proteomics*, 3: 2289-2304, 2003.

In one embodiment, the peptides are pooled or a parallel array is produced. For example, each candidate peptide is produced individually (i.e., in isolation from other peptides), a number or a plurality of different peptides are then pooled. Two or more of these pools of peptides are then pooled, and if necessary, this process is repeated. Accordingly, pools of several thousands or millions of peptides may be produced. The largest of these pools may then be screened to determine whether or not it comprises a peptide having a bioactivity of interest. Should the pool comprise such a peptide, one or more groups of smaller pools (i.e., sub-pools) of peptides are screened to determine which comprise the peptide of interest. This process can be iteratively repeated with pools of descending size until the individual peptide of interest is isolated (i.e., the pool of peptides is deconvoluted). Alternatively, a pool of a smaller number of peptides (e.g., 10 or 100) may be directly screened to determine which, if any, of the peptides are capable of modulating a phenotype of interest.

It is also possible to discriminate individual peptides from mixtures of up to about 100 peptides by mass spectrometry during the screening process. The individual peptides can then be readily synthesized using standard methods from the mass spectrometry data and their efficacy validated. Methods for validating a peptide will be apparent to the skilled person, e.g., using a method described herein. For example, the peptide is administered to a cell, tissue or organism and its effect on the phenotype of interest determined. Alternatively, or in addition, the peptide is administered to an animal (e.g., an animal model of a disease) and its effect on the phenotype of interest (e.g., the disease phenotype) is determined along with an other phenotypes that the peptide may modulate (e.g., toxicology screening).

As will be apparent to the skilled artisan the present invention clearly encompasses the production of multiple different libraries. Accordingly, the present invention also includes pooled libraries. For example, the present invention encompasses the pooling of two or more libraries. In one embodiment, the libraries are derived from the same organism/s. In another embodiment, the libraries are derived from different organisms (e.g., a library derived from eukaryotes comprising a compact genome, and another library derived from bacteria).

Peptides that are displayed on the surface of a solid support or maintained in a solution are preferably maintained in a neutral buffer to facilitate fold or other structuring of the peptides into protein fold or other structures or subfold or other structures. Preferably, such a buffer does not comprise significant levels of a detergent or a reducing agent (e.g., dithiothreitol) or a denaturing reagent, e.g., urea.

In Vitro Display

In an alternative embodiment, the peptide library is an in vitro display library (i.e., the peptides are displayed using in vitro display wherein the expressed peptide is linked to the nucleic acid from which it was expressed such that said peptide is presented in the absence of a host cell). For example, the peptide library is a ribosome display library. The skilled artisan will be aware that a ribosome display library directly links mRNA encoded by an expression construct to the peptide that it encodes. To display a nascent polypeptide, nucleic acid encoding it is cloned downstream of an appropriate promoter (e.g., bacteriophage T3 or T7 promoter) and a ribosome binding sequence, optionally including a translatable spacer nucleic acid (e.g., encoding amino acids 211-299 of gene III of filamentous phage M13 mp 19) that stabilizes the expressed fusion protein within the ribosomal tunnel. Ribosome complexes are stabilized against dissociation from the peptide and/or its encoding mRNA by the addition of reagents such as, for example, magnesium acetate or chloroamphenicol.

Ribosome Inactivation Display

Alternatively, the library is a ribosome inactivation display library, e.g., as described in Tabuchi, *Biochem Biophys Res Commun.* 305:1-5, 2003 or a covalent display library

Phage Display

In yet another embodiment, the peptide library is a phage display library wherein the expressed peptides or protein fold or other structures are displayed on the surface of a bacteriophage, as described, for example, in U.S. Pat. No. 5,821,047 and U.S. Pat. No. 6,190,908. The basic principle described relates to the fusion of a first nucleic acid comprising a sequence encoding a peptide or protein to a second nucleic acid comprising a sequence encoding a phage coat protein, such as, for example a phage coat proteins selected from the group, M13 protein-3, M13 protein-7, or M13, protein-8. These sequences are then inserted into an appropriate vector, e.g., a vector capable of replicating in bacterial cells. Suitable host cells, such as, for example *E, coli*, are then transformed with the recombinant vector. Said host cells are also infected with a helper phage particle encoding an unmodified form of the coat protein to which a nucleic acid fragment is operably linked. Transformed, infected host cells are cultured under conditions suitable for forming recombinant phagemid particles comprising more than one copy of the fusion protein on the surface of the particle. This system has been shown to be effective in the generation of virus particles such as, for example, a virus particle selected from the group comprising λ phage, T4 phage, M13 phage, T7 phage and baculovirus. Such phage display particles are then screened to identify, a displayed protein having a conformation sufficient for binding to a target protein or nucleic acid.

Cell-Based Display

In yet another embodiment, the peptide library is a bacterial display library wherein the expressed peptides or protein fold or other structures are displayed on the surface of a bacterial cell. The cells displaying the expressed peptides or protein fold or other structures are then used for biopanning as described, for example, in U.S. Pat. No. 5,516,637. Alternatively, the library is a yeast display library, e.g., as described in U.S. Pat. No. 6,423,538 or a mammalian display library, as described in Strenglin et al *EMBO J.* 7, 1053-1059, 1988.

Alternatively, the library of peptides is displayed by expressing the peptides in a cell or in a population of cells using a method known in the art and/or described herein. For example, the each of the peptides in the library is expressed in a separate cell.

Example 4

Confirming Structural Integrity of Displayed Peptides

Preferably, the correct folding of the peptides is confirmed by any one of a veriety of methods. Naturally, such procedures are generally be peformed by way of sampling a structure library, to assess its structural integrity.

Circular Dichroism

For example, a random sample of the peptides in the library is analyzed using circular dichroism. Circular dichroism spectroscopy is performed by passing plane polarized light through a birefringent plate, which splits the light into two plane-polarized beams oscillating along different axes (e.g., fast and slow). When one of the beams is retarded by 90° (using a quarter-wave retarder) then the two beams which are now 90° out of phase are added together, the result is circularly polarized light of one direction. By inverting the two axes such that the alternate beam is retarded than circularly polarized light of the other direction is generated. The result of adding the right and left circularly polarized that passes through the optically active sample is elliptically polarized light, thus circular dichroism is equivalent to ellipticity. By determining the absorption of a purified peptide in solution at various wavelengths and comparing the absorption to expected absorptions for proteins and/or peptides having the predicted structures, it is possible to confirm that the peptides of the library have the correct structure.

Thermal Denaturation

Alternatively, or in addition, correct folding or structural integrity of the library is confirmed using a thermal denaturation assay. In adapting such an assay to the present invention, the fluorescence of a peptide from the library is monitored at about 340 nm, with excitation at about 295 nm, e.g., using a spectrophotometer. Fluorescence data is acquired at a variety of temperatures, e.g., between about 4° C. and 90° C. Optionally, the melting curve for free tryptophan is subtracted from the results obtained for the peptide to account for the intrinsic temperature dependence of tryptophan fluorescence. A significant reduction in the fluorescence of a peptide as the temperature increases indicates that the peptide is capable of achieving a structure and has denatured. Thermal denaturation assays are known in the art and described, for example, in Socolich et al., Nature, 437: 512-518, 2005. In one example, the thermal denaturation profile obtained for a peptide from the library is compared to the thermal denaturation profile of the protein fold or other structure as it occurs in nature to thereby determine whether or not the peptide has assumed the correct conformation.

Ligand Binding

Alternatively, or in addition, correct folding or structural integrity of the library is confirmed by contacting the library of peptides with one or more ligands, e.g., a known antibody that is known to bind to a conformational epitope as opposed to a linear epitope. Binding of the ligand(s) to the library indicates that the library comprises peptides capable of forming a structure. For example, the library is assayed using an ELISA or FLISA assay. In adapting such an assay to the present embodiment of the invention, the peptide library or cells displaying same are immobilised onto a solid surface, e.g., a microplate well or a pin. An antibody that is known to bind to a conformational is epitope is brought into direct contact with the immobilized library of peptides for a time and under conditions sufficient for an antibody-antigen complex to form. The antibody is preferably labelled with an enzymatic label, e.g., horse-radish peroxidase in the case of an ELISA or a fluorescent label in the case of a FLISA. Following washing to remove unbound or non-specifically bound antibody, a substrate of the enzyme is added and metabolisation of said substrate detected. Alternatively, the fluorescent marker is detected by fluorescent means. Presence of a metabolite of the substrate or fluorescence is indicative of a structure (i.e., a conformational epitope) to which the antibody is capable of binding.

Example 5

Screening Procedures

It will be apparent from the disclosure herein that the libraries produced in accordance with the present invention are particularly useful for identifying novel drug leads for therapeutic purposes. Several screening methods can be employted, as described below.

Affinity Purification of Peptides

In one embodiment, the peptide library of the present invention is screened using affinity purification. Affinity purification techniques are known in the art and are described in, for example, Scopes (In: Protein purification: principles and practice, Third Edition, Springer Verlag, 1994). Methods of affinity purification typically involve contacting the peptides in the library with a specific target molecule, e.g., a target protein or nucleic acid, and, following washing to remove unbound or non-specifically bound peptides, eluting those peptides that remain bound to the target protein or nucleic acid. By performing increasingly stringent washes, peptides having higher affinity for the target molecule are identified.

In one example, a protein chip or series of pins having immobilized thereon a peptide library of the invention is contacted with a target, e.g., a target protein or nucleic acid. Preferably, the target is labelled with a detectable marker, e.g., a fluorescent marker. It is also preferred that each of the peptides is immobilized at a predetermined site, thereby facilitating identification of the peptide. Following washing to remove any unbound target, the location of bound label is detected. The location of bound label is indicative of a peptide capable of binding to the target molecule. The identity of the peptide may then be conformed, e.g., using a method described herein, e.g., MALD-TOF.

Surface Plasmon Resonance

Alternatively the library is screened using a surface-plasmon resonance assay, such as, for example, Biacore sensor chip technology (Biacore AB, UK). The Biacore sensor chip is a glass surface coated with a thin layer of gold modified with carboxymethylated dextran, to which a target molecule, e.g., protein or nucleic acid is covalently attached. The peptide library of the invention is then brought into contact with the target molecule. Essentially, a surface plasmon resonance assay detects changes in the mass of the aqueous layer close to the chip surface, through measuring changes in the refractive index. Accordingly, when a peptide from a library of the present invention binds to the target protein or nucleic acid the refractive index increases.

As will be apparent to the skilled artisan another biosensor, such as, for example, an evanescent biosensor, a membrane based biosensor (as described in AU 623,747, U.S. Pat. No. 5,234,566 and USSN 20030143726) or a microcantilever biosensor (as described in USSN 20030010097) is useful for screening the peptides of the present invention.

Biosensor Detection

Alternatively, a biosensor based on the detection of diffractive optics technology (light-scattering) is used to determine a peptide having a bioactivity of interest. Such biosensors are available commercially, e.g., from Axela Biosensors Inc., Toronto, Canada. Alternatively a biosensor may be used which is based on acoustic resonance, such as that produced by Akubio, Cambridge UK.

Other Ligand Binding Assays

Alternatively, the peptide library is screened to identify a peptide capable of binding to a receptor, e.g., a G-protein coupled receptor (GPCR). For example, a GPCR chip is used to screen a library of the invention essentially as described in Fang et al., *Chembiochem.*, 3: 987-991, 2002).

Alternatively, the peptide is identified using a screen, such as, for example, a radioimmunoassay, (RIA), an enzyme immunoassay, fluorescence resonance energy transfer (FRET), matrix-assisted laser desorption/ionization time of flight (MALDI-TOF), electrospray ionization (ESI), mass spectrometry (including tandem mass spectrometry, eg LC MS/MS), biosensor technology, evanescent fiber-optics technology or protein chip technology. Such methods are known in the art and/or described herein.

Forward and Reverse Hybrid Assays

A preferred form of screening identifies a peptide capable binding to a protein and/or a peptide capable of reducing, preventing or inhibiting the interaction of a protein with another molecule, e.g., another protein, a peptide, an antibody or a nucleic acid.

For example, a peptide is identified that is capable of binding to a target protein or peptide using the two-hybrid assay described in U.S. Pat. No. 6,316,223 and Bartel and Fields, The Yeast Two-Hybrid System, New York, N.Y., 1997. The basic mechanism described requires that the binding partners are expressed as two distinct fusion proteins in an appropriate host cell, such as for example bacterial cells, yeast cells, or mammalian cells. In adapting the standard two-hybrid screen to the present purpose, a first fusion protein consists of a DNA-binding fold or other structure fused to the target protein, and a second fusion protein consists of a transcriptional activation fold or other structure fused to a peptide from the library of the present invention. The DNA-binding fold or other structure binds to an operator sequence which controls expression of one or more reporter genes. The transcriptional activation fold or other structure is recruited to the promoter through the functional interaction between the peptide from the library of the present invention and the target protein. Subsequently, the transcriptional activation fold or other structure interacts with the basal transcription machinery of the cell, thereby activating expression of the reporter gene(s), the expression of which can be determined.

As used herein, the term "reporter gene" shall be taken to mean a nucleic acid that encodes a peptide, polypeptide or protein that displays a physically measurable property that alters in a way that can be measured and correlated with changes in the biological activity or a target protein or nucleic acid. Reporter molecules are known in the art, and include, but are not limited to, proteins that fluoresce, for example green fluorescence protein, proteins that induce a colour change in the presence of a substrate, for example *E. coli* β-galactosidase, molecules that confer growth characteristics on the host cells, such as for example HIS1, and molecules that induce the death or reduced growth ability of the host cells, such as for example URA3 and CYH2CYH3.

Other modifications of the N-hybrid screens are known in the art, such as for example the PolIII two hybrid system, the Tribrid system, the ubiquitin based split protein sensor system and the Sos recruitment system as described in Vidal and Legrain *Nucl. Acid Res.* 27(4), 919-929 (1999) or the three hybrid assay as described in Zhang et al (In: Bartel and Fields, The Yeast Two-Hybrid System, New York, N.Y. pp 289-297, 1997). All of these systems are contemplated by the present invention.

A preferred screening assay identifies one or more peptides in a library of the invention that antagonize or inhibit the interaction between a target protein and another molecule, e.g., a protein or nucleic acid. Accordingly, reverse 'n'-hybrid screens are employed to identify agonist molecules. Reverse hybrid screens differ from the forward hybrid screens supra in that they use a counter selectable reporter marker(s), such as for example the URA3 gene, the CYH2 gene or the LYS2 gene, to select against interactions between the target protein or nucleic acid and another protein or nucleic acid. Cell survival or cell growth is reduced or prevented in the presence of a drug or a toxigenic substrate of the counter selectable reporter gene product, which is converted by the counter selectable marker to a toxic compound, such as for example the URA3 gene product which confers lethality, in the presence of the drug 5-FOA. Accordingly, cells in which the interaction between the target protein and another molecule is blocked or inhibited survive in the presence of the substance. This is because the counter selectable reporter molecule will not be expressed, and accordingly, the substrate will not be converted to a toxic product or the drug (in the case of cycloheximide) will not be active against the essential target encoded by the reporter gene. Such a result indicates that the peptide is an inhibitor of the interaction between the target protein or nucleic acid and another molecule.

Suitable reverse N-hybrid, e.g., reverse two-hybrid systems are known in the art and described, for example, by Watt et al. (U.S. Ser. No. 09/227,652). For example, wherein a protein-protein interaction is being assayed, the binding of the two protein binding partners reconstitutes a functional transcriptional regulatory protein, such as, for example, by virtue of the binding partners being expressed as fusion proteins wherein each fusion protein comprises a portion of a transcriptional regulators protein that does not modulate transcription without the other portion (eg., a fusion protein comprising a transcriptional activator fold or other structure and a fusion protein comprising a DNA-binding fold or other structure, as described supra). A cell in which the fusion proteins are expressed also comprises a counter selectable reporter gene operably under the control of the reconstitution of the transcription factor. Accordingly, in the absence of inhibition of the protein interaction, the counter selectable reporter gene is expressed, thereby killing the cell when cultured in the presence of a suitable substrate (e.g., 5-FOA for an URA3 counter-selectable reporter gene). A cell that displays a peptide from a library of the invention, wherein said peptide antagonizes or inhibits the protein interaction, survives even in the presence of the substrate, as the counter-selectable reporter gene is not expressed.

As will be known to the skilled artisan, the reverse 'n'-hybrid technique briefly described above is readily modified for use in 1-hybrid, 2-hybrid or 3-hybrid assays.

Screens for Modified Phenotype

In another embodiment, nucleic acid encoding the peptide library of the present invention is introduced into a plurality of suitable host cells using the methods of introducing recombinant expression vectors described herein. Cells are then monitored for a change in phenotype, such as, for example, as described in Xu et al. (*In: Nature Genetics* 27, 23-29, 2001). Examples of phenotypic changes include, but a not limited to a phenotypic change selected from the group consisting of modulation of cellular proliferation, morphological changes, resistance to toxins, susceptibility to toxins and gene expression changes. In adapting the described technique to the present invention, appropriate host cells are transformed or transfected with nucleic acid encoding a peptide library of the invention. Alternatively, synthetic or recombinant peptides isolated from the expression libraries of the present invention is incubated with the host cells, in the presence of a polypeptide that facilitates the uptake of peptides into host cells, i.e., a protein transduction domain. Said host cells are then monitored for specific phenotype changes, such as, for example, gene expression changes monitored using DNA microarrays. The nucleic acid encoding the peptide that induces the phenotypic change is then isolated. Further testing of the peptide that induces the desired change in phenotype is clearly envisaged, such as, for example, two-hybrid analysis to determine which proteins the peptides interacts with, and which cellular pathways it is affect.

Screens for Antimicrobial Activities

Alternatively, or in addition, a peptide library is screened to determine an antimicrobial peptide. For example, the peptide library of peptides are brought into direct contact with a population of microorganisms (e.g., bacteria) for a time and under conditions sufficient for the microorganisms to grow. By determining a peptide that prevents or reduces microbial growth, an anti-microbial peptide is determined. Suitable screening methods are known in the art and described, for example, in Steinberg and Lehrer, *Methods Mol. Biol.,* 78: 169-88, 1997.

Further Peptide Characterization

Following screening a peptide library of the present invention, a peptide is further characterized ed using any of a number of known methods. For example, the peptide is identified using a method selected from the group consisting of Edman sequencing, mixed peptide sequencing, mass spectrometry including MALDI-TOF, ESI and ion trap analysis amongst others.

For example, the identity of a peptide is identified using Edman sequencing (essentially as described by Edman, *Arch. Biochem. Biophys.,* 22, 475-483, 1949) to determine the N-terminal sequence of the peptide and comparing this sequence to a known sequence Preferably, the peptide is separated from a contaminating molecule, such as, for example another protein, prior to Edman sequencing. Following isolation of a peptide, the amino terminus of said protein is derivatized with phenylisothiocyanate under basic conditions. For example, the base used in this step is a non-nucleophile such as, for example, a triethylamine or diisoproylethylamine. This coupling step produces a phenylthiocarbamyl peptide or protein. The thiocarbonyl function of the phenylthiocarbamyl peptide or protein is a moderately strong nucleophile, and under acidic conditions it will cleave the carbonyl carbon of the adjacent peptide bond. This cleavage step results in the production of an anilothiazolinone of the terminal amino acid and leaves the original peptide or protein shortened by one amino acid residue. The anilothiazolinone of the terminal amino acid has different solubility properties from the peptide or protein. As such, it can be extracted and subjected to further analysis. The shortened peptide or protein again has a bare amino terminus, and, as a consequence, can be subjected to additional cycles of coupling, cleavage, and extraction.

The extracted anilothiazolinone of the terminal amino acid, however, is not stable. Under acidic aqueous conditions, anilothiazolinones rearrange rapidly to form more stable phenylthiohydantoins, which are amenable to analysis. A stable phenylthiohydantoin is then analyzed by, for example, UV absorption detection reverse phase high performance liquid chromatography, to determine the identity of the terminal amino acid.

Following determining the N-terminal sequence of a peptide, this sequence is compared to a database of amino acid sequences to thereby determine whether or not the derived sequence is identical to or substantially identical to a known sequence. Such a database is available, for example, at NCBI.

Alternatively a peptide is identified using mixed-peptide sequencing, as described in Damer et al, *J. Biol. Chem.* 273, 24396-24405, 1998.

Preferably, a peptide is identified using mass spectrometry. For example a peptide isolated in a screening method described herein is ionised using a method, such as, for example, electrospray ionisation (ESI; Fenn et al, *Science,* 246, 64-71, 1989 or Wilm et al, *Nature,* 379, 466-469, 1996), matrix assisted laser desorption/ionisation (MALDI; Karas and Hillenkamp, *Anal. Chem.* 60, 2299-2301, 1988) or atmospheric pressure chemical ionization. Following ionization, the mass of the molecular ions produced is analysed using, for example, a quadrupole mass analyser (Burlingame et al, *Anal. Chem.* 70, 674R-716R), ion trap mass analysis (Cooks et al, *Chem. Eng. News,* 69, 26, 1991), time of flight (TOF) analysis (Yates, *J. Mass Spectrom.* 33, 1-19, 1998), fourier transform ion cyclotron mass spectrometry (U.S. Pat. No. 3,937,955).

Following determining the sequence of the peptide identified in the screen or a fragment thereof, the determined sequence is compared to a database of sequences to determine whether or not the determined sequence is identical to or substantially identical to a known sequence. Such a database is available, for example at NCBI or ExPASY or Swiss-Prot. Furthermore, as a mass spectrometer also determines the mass of a peptide, polypeptide or protein, this information is also useful in identifying an immunogenic protein, such as, by comparison to a protein mass library, such as, for example, that provided by the UK Human Genome Mapping Project Resource Centre.

As used herein the term "ExPASY" shall be taken to mean the Expert Protein Analysis System at the Swiss Institute of Bioinformatics at Basel University 4056, Basel, Switzerland.

As used herein the term "Swiss-Prot" shall be taken to mean the protein sequence database of the Swiss Institute of Bioinformatics at Basel University 4056. Basel, Switzerland.

Biomolecular interaction analysis-mass spectrometry (BIA-MS) is also useful for detecting and/or characterise and/or identify a peptide from a peptide library of the invention having a desired bioactivity (Nelson et al. *Electrophoresis* 21: 1155-1163, 2000).

In the case of a peptide produced using recombinant techniques, the identity of the peptide may be determined, for example, by determining the nucleotide sequence of the nucleic acid encoding said peptide using standard methods in the art and performing an in silico translation to thereby identify the peptide.

Affinity Maturation of Identified Peptides

In one embodiment, a peptide identified in a screen is mutated to thereby improve the bioactivity of the peptide, e.g., the affinity with which the peptide binds to a target molecule and/or the specificity with which a peptide binds to a target molecule. Methods for mutating a peptide will be apparent to the skilled artisan and/or are described herein.

In another embodiment the peptide is cyclized to enhance affinity and/or stability.

Diagnostic and Therapeutic Applications

As will be apparent to the skilled artisan, the libraries of the present invention are suitable as reagents for the therapeutic or prophylactic treatment of a subject. For example, a peptide capable of mimicking a structure of an infectious organism or an allergen is useful as a vaccine to prevent or treat an infection or an allergic reaction. Alternatively, a peptide capable of binding to a target protein or for preventing a target interaction is useful for the treatment of a disease or disorder.

Accordingly, in one embodiment, the present invention provides a composition, preferably, a pharmaceutical composition comprising a peptide identified in a screen described herein according to any embodiment.

Formulation of a pharmaceutical compound will vary according to the route of administration selected (e.g., solution, emulsion, capsule). An appropriate composition comprising the identified modulator to be administered can be prepared in a physiologically acceptable vehicle or carrier. For solutions or emulsions, suitable carriers include, for example, aqueous or alcoholic/aqueous solutions, emulsions or suspensions, including saline and buffered media. Parenteral vehicles can include sodium chloride solution, Ringer's dextrose, dextrose and sodium chloride, lactated Ringer's or fixed oils, for instance. Intravenous vehicles can include various additives, preservatives, or fluid, nutrient or electrolyte replenishers and the like (See, generally, Remington's Pharmaceutical Sciences, 17th Edition, Mack Publishing Co., Pa., 1985). For inhalation, the agent can be solubilized and loaded into a suitable dispenser for administration (e.g., an atomizer, nebulizer or pressurized aerosol dispenser).

Furthermore, where the agent is a protein or peptide, the agent can be administered via in vivo expression of the recombinant protein. In vivo expression can be accomplished via somatic cell expression according to suitable methods (see, e.g., U.S. Pat. No. 5,399,346). In this embodiment, nucleic acid encoding the protein can be incorporated into a retroviral, adenoviral or other suitable vector (preferably, a replication deficient infectious vector) for delivery, or can be introduced into a transfected or transformed host cell capable of expressing the protein for delivery. In the latter embodiment, the cells can be implanted (alone or in a barrier device), injected or otherwise introduced in an amount effective to express the protein in a therapeutically effective amount.

As will be apparent to a skilled artisan, a compound that is active in vivo is particular preferred. A compound that is active in a human subject is even more preferred. Accordingly, when manufacturing a compound that is useful for the treatment of a disease it is preferable to ensure that any components added to the peptide does not inhibit or modify the activity of said peptide.

The peptide libraries of the present invention are also useful for identifying and/or producing a peptide useful for the diagnosis and/or prognosis of a disease or disorder. Accordingly, such a peptide may be provided in a form suitable for diagnosing a disease or disorder. For example, the peptide is immobilized on a solid substrate. Alternatively, the peptide is labelled with a detectable marker, e.g., a fluorescent marker. Alternatively, a kit is provided for the diagnosis of a disease or disorder.

For example, a peptide capable of binding to a target is immobilised on a solid substrate. A second peptide capable of binding to a distinct site on the target is labelled with a detectable marker. Such peptides are then useful for the detection of the target in a biological sample using a sandwich-type assay.

SEQUENCE LISTING (30057 sequences)

SEQ ID NO: 1 - protein, 24 aa, artificial
  independent peptide structure
AAAAIERDRAAGVALDGPPARSLA

SEQ ID NO: 2 - protein, 21 aa, artificial
  peptide fold or domain or sub-domain
AAAALYVSGIVGSIRQAIPIA

SEQ ID NO: 3 - protein, 23 aa, artificial
  peptide fold or domain or sub-domain
AAAELIRGKSTEEIRKIYGIRSD

SEQ ID NO: 4 - protein, 28 aa, artificial
  peptide fold or domain or sub-domain
AAAFDTDPAKYGHEVGGTTVRSLDDLEE

SEQ ID NO: 5 - protein, 30 aa, artificial
  peptide fold or domain or sub-domain
AAAGLDLDTEKVNSLQQEADAAHTIEATTD

SEQ ID NO: 6 - protein, 21 aa, artificial
  peptide fold or domain or sub-domain
AAAGTPPLYTQTLAEARAADL

SEQ ID NO: 7 - protein, 20 aa, artificial
  peptide fold or domain or sub-domain
AAALDAELDLIDSTSLLGEM

SEQ ID NO: 8 - protein, 20 aa, artificial
  peptide fold or domain or sub-domain
AAALPWMAEMLGLSHVEDLI

SEQ ID NO: 9 - protein, 27 aa, artificial
  peptide fold or domain or sub-domain
AAAMDDIAERAGVSKPVLYQHFPGKLD

SEQ ID NO: 10 - protein, 23 aa, artificial
  peptide fold or domain or sub-domain
AAANPNSTGESKLRVNTHTGLVQ

SEQ ID NO: 11 - protein, 24 aa, artificial
  peptide fold or domain or sub-domain
AAARAQGLRIAAGLAAELDKYAAR

SEQ ID NO: 12 - protein, 23 aa, artificial
  peptide fold or domain or sub-domain
AAARGLKHLRLEDVATSERDVKA

SEQ ID NO: 13 - protein, 28 aa, artificial
  peptide fold or domain or sub-domain
AAAVFTRDLDKAMYFTQALQAGTVWVNT

SEQ ID NO: 14 - protein, 30 aa, artificial
  peptide fold or domain or sub-domain
AAAVFTRDLDKAMYFTQALQAGTVWVNTYN

SEQ ID NO: 15 - protein, 30 aa, artificial
  peptide fold or domain or sub-domain
AAAVMSKDEDRCDRVSRAFRAGIVWVNCSQ

SEQ ID NO: 16 - protein, 20 aa, artificial
  peptide fold or domain or sub-domain
AACAQIVRNIQSYHMDNLNY

SEQ ID NO: 17 - protein, 25 aa, artificial
  peptide fold or domain or sub-domain
AACGGSWIATKDAVTGRRWEEITTK

SEQ ID NO: 18 - protein, 24 aa, artificial
  peptide fold or domain or sub-domain
AACQTLAARAVAEGDLVDTIDPPT

SEQ ID NO: 19 - protein, 20 aa, artificial
  peptide fold or domain or sub-domain
AADCRLIWMDGYGHQLLLGE

SEQ ID NO: 20 - protein, 27 aa, artificial
  peptide fold or domain or sub-domain
AADFRLNKASNYLKWYKQKHRSVKNIK

SEQ ID NO: 21 - protein, 21 aa, artificial
  peptide fold or domain or sub-domain
AADITDVIIRHLNSKDSSISI

SEQ ID NO: 22 - protein, 21 aa, artificial
  peptide fold or domain or sub-domain
AADLLTALGLDLTDENLTETP

SEQ ID NO: 23 - protein, 30 aa, artificial
  peptide fold or domain or sub-domain
AADRFAANYNKFPGQFDGGMDEDISRLKTT

SEQ ID NO: 24 - protein, 25 aa, artificial
  peptide fold or domain or sub-domain
AADRVQGRAAGVEGRAAIIHHSDVK

SEQ ID NO: 25 - protein, 30 aa, artificial
  peptide fold or domain or sub-domain
AADSAFAEKISLEWIQSNQERVASAGWATL

SEQ ID NO: 26 - protein, 24 aa, artificial
  peptide fold or domain or sub-domain
AADTKIVCYYGSWAAYRPGLGKFE

SEQ ID NO: 27 - protein, 28 aa, artificial
  peptide fold or domain or sub-domain
AADVEQRLAAYEDLSIAAVNGPRSTVVS

SEQ ID NO: 28 - protein, 26 aa, artificial
  peptide fold or domain or sub-domain
AADVHSQRFVEYFKTNATAAREQVVR

SEQ ID NO: 29 - protein, 27 aa, artificial
  peptide fold or domain or sub-domain
AAEDGFAKEHGGNGNVGAAITQIEMLA

SEQ ID NO: 30 - protein, 26 aa, artificial
  peptide fold or domain or sub-domain
AAEEYVSYLKAGKSKEVAMEMCSQSR

SEQ ID NO: 31 - protein, 29 aa, artificial
  peptide fold or domain or sub-domain
AAEHVIKALTELGFSDYTQKVSDVYDKHK

SEQ ID NO: 32 - protein, 21 aa, artificial
  peptide fold or domain or sub-domain
AAEIFTTLGLNLNTAATKETP

SEQ ID NO: 33 - protein, 22 aa, artificial
  peptide fold or domain or sub-domain
AAEKVYTVLRQEGTQKNVIDIM

SEQ ID NO: 34 - protein, 26 aa, artificial
  peptide fold or domain or sub-domain
AAELAHSMAKLGHALTVAELTGMIKE

SEQ ID NO: 35 - protein, 25 aa, artificial
  peptide fold or domain or sub-domain
AAELFERLDEGSGSADFVTDFAAIL

SEQ ID NO: 36 - protein, 25 aa, artificial
  peptide fold or domain or sub-domain
AAEQIEVMRAKGAPADVVMDFAKPL

SEQ ID NO: 37 - protein, 24 aa, artificial
  peptide fold or domain or sub-domain
AAERFEPDADRANYEIDDNGLKVE

SEQ ID NO: 38 - protein, 27 aa, artificial
  peptide fold or domain or sub-domain
AAERIEEAGRENRVQDSPELLADLQHE

SEQ ID NO: 39 - protein, 25 aa, artificial
  peptide fold or domain or sub-domain
AAERIQGIPLERKEGDTIHHHPDVM

SEQ ID NO: 40 - protein, 30 aa, artificial
  peptide fold or domain or sub-domain
AAESKYGLELAREWIESEKESISSSGWSTF

SEQ ID NO: 41 - protein, 29 aa, artificial
  peptide fold or domain or sub-domain
AAEVRLHDLQGERPYVTFERDGERLRLDC

SEQ ID NO: 42 - protein, 25 aa, artificial
  peptide fold or domain or sub-domain
AAFENWEKAIEIYKNNFSHPIYNID

SEQ ID NO: 43 - protein, 22 aa, artificial
  peptide fold or domain or sub-domain
AAFGKTSWETAMILELSERTIE

SEQ ID NO: 44 - protein, 21 aa, artificial
  peptide fold or domain or sub-domain
AAFGLVAAGKAVDPAEGVRIA

SEQ ID NO: 45 - protein, 30 aa, artificial
  peptide fold or domain or sub-domain
AAFLAPLPVGRLWGVGEVTEAALRRIGVAT

SEQ ID NO: 46 - protein, 23 aa, artificial
  peptide fold or domain or sub-domain
AAFVAVRSSATAEDLPDASFAGQ

SEQ ID NO: 47 - protein, 21 aa, artificial
  peptide fold or domain or sub-domain
AAFVEIREKIKATDGNLSIHM

SEQ ID NO: 48 - protein, 30 aa, artificial
  peptide fold or domain or sub-domain
AAGDLEKLGLGAASDTTKTTTAVIDYDDVS

SEQ ID NO: 49 - protein, 28 aa, artificial
  peptide fold or domain or sub-domain
AAGEIEVLRESNSMQWSAEDFESRLQEA

SEQ ID NO: 50 - protein, 28 aa, artificial
  peptide fold or domain or sub-domain
AAGELEQFRASGGPVDVEDYLEHIKLKT

SEQ ID NO: 51 - protein, 25 aa, artificial
  peptide fold or domain or sub-domain
AAGFFRFGTTFDLVAYLRSLSAYRL

SEQ ID NO: 52 - protein, 23 aa, artificial
  peptide fold or domain or sub-domain
AAGFYYVHEGKPFFDDLKGFMSS

SEQ ID NO: 53 - protein, 22 aa, artificial
  peptide fold or domain or sub-domain
AAGGAEKASLWNLAALLAQGRS

SEQ ID NO: 54 - protein, 29 aa, artificial
  peptide fold or domain or sub-domain
AAGGGAGIDPDEVTEADRQALLEHGLRRY

SEQ ID NO: 55 - protein, 23 aa, artificial
  peptide fold or domain or sub-domain
AAGGKFHSTLIVDGEFEETSEED

SEQ ID NO: 56 - protein, 21 aa, artificial
  peptide fold or domain or sub-domain
AAGGLIAAGVVENWPDAMALA

SEQ ID NO: 57 - protein, 30 aa, artificial
  peptide fold or domain or sub-domain
AAGIHTSNINTALKVADRVNAGTVWINTYN

SEQ ID NO: 58 - protein, 30 aa, artificial
  peptide fold or domain or sub-domain
AAGITVGAGITTASAASGSTASTLGSLDIS

SEQ ID NO: 59 - protein, 20 aa, artificial
  peptide fold or domain or sub-domain
AAGLKLTPVSYEEDVKSALN

SEQ ID NO: 60 - protein, 21 aa, artificial
  peptide fold or domain or sub-domain
AAGMDADLGCATPAEALAECA

SEQ ID NO: 61 - protein, 25 aa, artificial
  peptide fold or domain or sub-domain
AAGMGSKLITQEMLDAKDYAGISKK

SEQ ID NO: 62 - protein, 27 aa, artificial
  peptide fold or domain or sub-domain
AAGPKQRGSNATGAMSYAEVQWLAATA

SEQ ID NO: 63 - protein, 24 aa, artificial
  peptide fold or domain or sub-domain
AAGSPPPVFERHGLPADTGAKFGE

SEQ ID NO: 64 - protein, 28 aa, artificial
  peptide fold or domain or sub-domain
AAGSTAEQLSKYIENKNTPKDDKDDNND

SEQ ID NO: 65 - protein, 28 aa, artificial
  peptide fold or domain or sub-domain
AAGWIDTEQALVRFSPHLAWRNEPLRDR

SEQ ID NO: 66 - protein, 28 aa, artificial
  peptide fold or domain or sub-domain
AAGYVNRQRSTVYFAPNIDWRQEPLKEK

SEQ ID NO: 67 - protein, 24 aa, artificial
  peptide fold or domain or sub-domain
AAHASEAIRKGTTTEDEFISAPAR

SEQ ID NO: 68 - protein, 23 aa, artificial
  peptide fold or domain or sub-domain
AAHHAYALVAQGQAFRDAYKQVG

SEQ ID NO: 69 - protein, 28 aa, artificial
  peptide fold or domain or sub-domain
AAHHFAREEAMMDVCRYPLLSRHHGTHA

SEQ ID NO: 70 - protein, 27 aa, artificial
  peptide fold or domain or sub-domain
AAHIIKGRRFDFEGMIRVCNFCKRMLE

SEQ ID NO: 71 - protein, 23 aa, artificial
  peptide fold or domain or sub-domain
AAHIRNALIAAHPVSSSQFEKNY

SEQ ID NO: 72 - protein, 25 aa, artificial
  peptide fold or domain or sub-domain
AAHLFETLAAQPQPADLRRHLSFPL

SEQ ID NO: 73 - protein, 27 aa, artificial
  peptide fold or domain or sub-domain
AAHPLWAERAEIRAAHEAEGRTYGTGL

SEQ ID NO: 74 - protein, 29 aa, artificial
  peptide fold or domain or sub-domain
AAIAAATAGATFNGYVRHFIEAIRPAVEM

SEQ ID NO: 75 - protein, 29 aa, artificial
  peptide fold or domain or sub-domain
AAIDQVSGDVIPSAPQRGVLDRVMVSAMR

SEQ ID NO: 76 - protein, 30 aa, artificial
  peptide fold or domain or sub-domain
AAIERVLVVRRALRIGFTLPELADVLKERD

SEQ ID NO: 77 - protein, 23 aa, artificial
  peptide fold or domain or sub-domain
AAIIPASQALTEANYGEGDIRVQ

SEQ ID NO: 78 - protein, 26 aa, artificial
  peptide fold or domain or sub-domain
AAITDDIENYPGSVEEATGPKIVKRM

SEQ ID NO: 79 - protein, 28 aa, artificial
  peptide fold or domain or sub-domain
AAIVYTNNMNIAKRCAQEIQAGNVAINN

SEQ ID NO: 80 - protein, 24 aa, artificial
  peptide fold or domain or sub-domain
AAKAENGVPIDDVVLADMQALGRE

SEQ ID NO: 81 - protein, 26 aa, artificial
  peptide fold or domain or sub-domain
AAKAISYFRSLINKGLNPDMENEKVL

SEQ ID NO: 82 - protein, 20 aa, artificial
  peptide fold or domain or sub-domain
AAKALLRNTDLSAREIVEKA

SEQ ID NO: 83 - protein, 26 aa, artificial
  peptide fold or domain or sub-domain
AAKAVTLLVTNPDSTLAEMSETSVLQ

SEQ ID NO: 84 - protein, 22 aa, artificial
  peptide fold or domain or sub-domain
AAKGKTAPETAILTGINPRTVQ

SEQ ID NO: 85 - protein, 26 aa, artificial
  peptide fold or domain or sub-domain
AAKILFALHEMPDLSPFDISPINSIK

SEQ ID NO: 86 - protein, 20 aa, artificial
  peptide fold or domain or sub-domain
AAKINPNMSVDDLVREYRGC

SEQ ID NO: 87 - protein, 29 aa, artificial
  peptide fold or domain or sub-domain
AAKINPNMSVDDLVREYRGCAFGAGRLAE

SEQ ID NO: 88 - protein, 25 aa, artificial
  peptide fold or domain or sub-domain
AAKLAVELGYEANIWTGQELESALF

SEQ ID NO: 89 - protein, 27 aa, artificial
  peptide fold or domain or sub-domain
AAKLGGQMVKGETPFDAAAAGVALRTL

SEQ ID NO: 90 - protein, 21 aa, artificial
  peptide fold or domain or sub-domain
AAKLKEYGSGLYTADPAKTIS

SEQ ID NO: 91 - protein, 26 aa, artificial
  peptide fold or domain or sub-domain
AAKNLQTHVSHRKSKEVAWNLTSVDL

SEQ ID NO: 92 - protein, 29 aa, artificial
  peptide fold or domain or sub-domain
AAKQISGEQEVHARHILVETEDEAKAVAE

SEQ ID NO: 93 - protein, 26 aa, artificial
  peptide fold or domain or sub-domain
AAKSIAFSAKNPGDISEYIFGIKQGS

SEQ ID NO: 94 - protein, 26 aa, artificial
  peptide fold or domain or sub-domain
AAKVIALAGSCQSSLQQLAEPGFGGR

SEQ ID NO: 95 - protein, 27 aa, artificial
  peptide fold or domain or sub-domain
AAKVKCKGNQYFKAGWHFQAVIQYQRI

SEQ ID NO: 96 - protein, 25 aa, artificial
  peptide fold or domain or sub-domain
AALAGAALVHAATGERANDRDLGGS

SEQ ID NO: 97 - protein, 26 aa, artificial
  peptide fold or domain or sub-domain
AALAQVIQKAHQAGEDIGNIRVLKRY

SEQ ID NO: 98 - protein, 21 aa, artificial
  peptide fold or domain or sub-domain
AALDFIAKEKIDVKEFVQQIS

SEQ ID NO: 99 - protein, 30 aa, artificial
  peptide fold or domain or sub-domain
AALDQQTALLADRTQPLDVRRQALKFVVHF

SEQ ID NO: 100 - protein, 29 aa, artificial
  peptide fold or domain or sub-domain
AALEGVSNNEKLKGFIEPLENVVANALEN

SEQ ID NO: 101 - protein, 30 aa, artificial
  peptide fold or domain or sub-domain
AALGDQLGAVASQAAEAAVGTNDVAAGANV

SEQ ID NO: 102 - protein, 24 aa, artificial
  peptide fold or domain or sub-domain
AALIAQGLAVEDAYWELAAADVVD

SEQ ID NO: 103 - protein, 28 aa, artificial
  peptide fold or domain or sub-domain
AALIDADPAMAGKPVAGIPVQHTDELEK

SEQ ID NO: 104 - protein, 23 aa, artificial
  peptide fold or domain or sub-domain
AALKVTDLAVDGHDVMAAFGRGP

SEQ ID NO: 105 - protein, 25 aa, artificial
  peptide fold or domain or sub-domain
AALLDSLQRLEVWNEEEIKKAMVSI

SEQ ID NO: 106 - protein, 30 aa, artificial
  peptide fold or domain or sub-domain
AALLPYVMRFNLPERVEEFAEIGRIFGVAD

SEQ ID NO: 107 - protein, 29 aa, artificial
  peptide fold or domain or sub-domain
AALMPDDKIAEEPPHLQSLIGRIRPSVEN

SEQ ID NO: 108 - protein, 30 aa, artificial
  peptide fold or domain or sub-domain
AALNGLLLRKPGDKATAIKQLAACSGESVT

SEQ ID NO: 109 - protein, 25 aa, artificial
  peptide fold or domain or sub-domain
AALQGLYQWQLMGQDVDKIDIEFIV

SEQ ID NO: 110 - protein, 25 aa, artificial
  peptide fold or domain or sub-domain
AALRQAFAACADFDGHTAHEVLQRY

SEQ ID NO: 111 - protein, 28 aa, artificial
  peptide fold or domain or sub-domain
AALSGISSPADVAHYSSQGVSAVLVGES

SEQ ID NO: 112 - protein, 23 aa, artificial
  peptide fold or domain or sub-domain
AALSLAPRGTAPVVIDRTRLEQA

SEQ ID NO: 113 - protein, 30 aa, artificial
  peptide fold or domain or sub-domain
AALTPIIVEKSWESNLEKYSNISKLLGGTD

SEQ ID NO: 114 - protein, 26 aa, artificial
  peptide fold or domain or sub-domain
AAMARELATRLDLDEPEETRLYDAFA

SEQ ID NO: 115 - protein, 26 aa, artificial
  peptide fold or domain or sub-domain
AAMASSCKGGRIAIEEFAHFLKLPVS

SEQ ID NO: 116 - protein, 24 aa, artificial
  peptide fold or domain or sub-domain
AAMDVVGERFERNEIYVTDLIITA

SEQ ID NO: 117 - protein, 30 aa, artificial
  peptide fold or domain or sub-domain
AAMMGPVMEYNWKGYPEKFARIAKAFGIDT

SEQ ID NO: 118 - protein, 26 aa, artificial
  peptide fold or domain or sub-domain
AAMMTDTHNVIGVTEDVSGNEFLETA

SEQ ID NO: 119 - protein, 24 aa, artificial
  peptide fold or domain or sub-domain
AAMNIIGVKFKNNEVYVPEVLVAA

SEQ ID NO: 120 - protein, 25 aa, artificial
  peptide fold or domain or sub-domain
AAMREAMEKLKADGIPGLSKELTPQ

SEQ ID NO: 121 - protein, 29 aa, artificial
  peptide fold or domain or sub-domain
AAMTHSGIQPVDLWLDQIRFIYQRHKDEL

SEQ ID NO: 122 - protein, 23 aa, artificial
  peptide fold or domain or sub-domain
AAMVEDDTSGDYKNVLIGIINAD

SEQ ID NO: 123 - protein, 28 aa, artificial
  peptide fold or domain or sub-domain
AANELDRFGLAESLLENKEGCQKILSVL

SEQ ID NO: 124 - protein, 28 aa, artificial
  peptide fold or domain or sub-domain
AANIVQVKLGSPDYVNRDSDEATEDFMR

SEQ ID NO: 125 - protein, 26 aa, artificial
  peptide fold or domain or sub-domain
AANYAGNDERAKAFEQESGIPVYKWD

SEQ ID NO: 126 - protein, 27 aa, artificial
  peptide fold or domain or sub-domain
AAPEIAKNIREMSDFAKADEELFNKLF

SEQ ID NO: 127 - protein, 22 aa, artificial
  peptide fold or domain or sub-domain
AAPYLDALARSKKWSALLQFQT

SEQ ID NO: 128 - protein, 30 aa, artificial
  peptide fold or domain or sub-domain
AAQFATADPEPPLEELGYHIYSSDPPFEVR

SEQ ID NO: 129 - protein, 24 aa, artificial
  peptide fold or domain or sub-domain
AAQHIREEQATGQIQKDIDIDETA

SEQ ID NO: 130 - protein, 25 aa, artificial
  peptide fold or domain or sub-domain
AAQRDAYADTLHALRKNKGMTADAA

SEQ ID NO: 131 - protein, 24 aa, artificial
  peptide fold or domain or sub-domain
AAQVHPDRYAASSDADKRSALMLA

SEQ ID NO: 132 - protein, 28 aa, artificial
  peptide fold or domain or sub-domain
AARAEQVDSFSYTFGAVESVFDVPGLCT

SEQ ID NO: 133 - protein, 20 aa, artificial
  peptide fold or domain or sub-domain
AARALDHFAHLEPRKLVEES

SEQ ID NO: 134 - protein, 20 aa, artificial
  peptide fold or domain or sub-domain
AARALIDVDGYDAERIARKA

SEQ ID NO: 135 - protein, 25 aa, artificial
  peptide fold or domain or sub-domain
AARAMNSAHEHASEAARLDALVRHN

SEQ ID NO: 136 - protein, 22 aa, artificial
  peptide fold or domain or sub-domain
AARGFAPKQIAADLRVSTTAVR

SEQ ID NO: 137 - protein, 22 aa, artificial
  peptide fold or domain or sub-domain
AARGKSALDTAEIINVSRRTVV

SEQ ID NO: 138 - protein, 29 aa, artificial
  peptide fold or domain or sub-domain
AARIMVKSAMKRTKNKKLKRILDARQLAL

SEQ ID NO: 139 - protein, 23 aa, artificial
  peptide fold or domain or sub-domain
AARIRDALTDLDPAGADAYEANY

SEQ ID NO: 140 - protein, 26 aa, artificial
  peptide fold or domain or sub-domain
AARIYDPRRAEVYQRLGIPTVATVRW

SEQ ID NO: 141 - protein, 29 aa, artificial
  peptide fold or domain or sub-domain
AARLDKLKHSSPKDLPPQFRYLQLRTPFY

SEQ ID NO: 142 - protein, 22 aa, artificial
  peptide fold or domain or sub-domain
AARLKLDVRYLAETIGERHMHR

SEQ ID NO: 143 - protein, 27 aa, artificial
  peptide fold or domain or sub-domain
AARRIELAARTGTIERPSVMVALVIAE

SEQ ID NO: 144 - protein, 26 aa, artificial
  peptide fold or domain or sub-domain
AARRIKKLVDGGLEAYDAFNVVQHQM

SEQ ID NO: 145 - protein, 26 aa, artificial
  peptide fold or domain or sub-domain
AARRLGEELKKGHSQPIAWNNCHMYL

SEQ ID NO: 146 - protein, 26 aa, artificial
  peptide fold or domain or sub-domain
AARRLQGAQKREENPFDAFNFVQDHV

SEQ ID NO: 147 - protein, 26 aa, artificial
  peptide fold or domain or sub-domain
AARRLRKRLGSGMDSFQAFNECQDHL

SEQ ID NO: 148 - protein, 29 aa, artificial
  peptide fold or domain or sub-domain
AARSADATGVPGAGHLRAVVEAVLPSVRR

SEQ ID NO: 149 - protein, 29 aa, artificial
  peptide fold or domain or sub-domain
AASAEAKARRILAGLGFTPEMQDRETRRF

SEQ ID NO: 150 - protein, 23 aa, artificial
  peptide fold or domain or sub-domain
AASGAGREISSRPSAAGEFASLK

SEQ ID NO: 151 - protein, 21 aa, artificial
  peptide fold or domain or sub-domain
AASGLRAGDDALDWAAALELA

SEQ ID NO: 152 - protein, 23 aa, artificial
  peptide fold or domain or sub-domain
AASHGRASGHARSADGALDLDLR

SEQ ID NO: 153 - protein, 30 aa, artificial
  peptide fold or domain or sub-domain
AASIMCADQLHLGEELRRLESAGVELLHCD

SEQ ID NO: 154 - protein, 28 aa, artificial
  peptide fold or domain or sub-domain
AASIWTNDLKLAHGLAGRIRAGTVWVNA

SEQ ID NO: 155 - protein, 30 aa, artificial
  peptide fold or domain or sub-domain
AASIWTNDLKLAHGLAGRIRAGTVWVNAHN

SEQ ID NO: 156 - protein, 29 aa, artificial
  peptide fold or domain or sub-domain
AASSKVTEALIAKYKTFDYPDDDITRNYI

SEQ ID NO: 157 - protein, 30 aa, artificial
  peptide fold or domain or sub-domain
AASSTQGIAMARMVRRIYNMTEALLFLSHF

SEQ ID NO: 158 - protein, 28 aa, artificial
  peptide fold or domain or sub-domain
AASVFTSQFSAAHQFVQESEVGMVHVNH

SEQ ID NO: 159 - protein, 23 aa, artificial
  peptide fold or domain or sub-domain
AATAPSTLQRWLWRADPRHWLAA

SEQ ID NO: 160 - protein, 29 aa, artificial
  peptide fold or domain or sub-domain
AATDGKRVVFESAGELWVLPDLGSEAVKL

SEQ ID NO: 161 - protein, 27 aa, artificial
  peptide fold or domain or sub-domain
AATEREFGNYLFRQNRFYDAKVRYKRA

SEQ ID NO: 162 - protein, 22 aa, artificial
  peptide fold or domain or sub-domain
AATFAREQGFETKDIKEIAKKT

SEQ ID NO: 163 - protein, 27 aa, artificial
  peptide fold or domain or sub-domain
AATKTVIPRYYSNETVPVCQRCYQVVE

SEQ ID NO: 164 - protein, 27 aa, artificial
  peptide fold or domain or sub-domain
AATMKAIGEAANVQAAAIYYWYPSKEA

SEQ ID NO: 165 - protein, 24 aa, artificial
  peptide fold or domain or sub-domain
AATTRLLAQARLAGHVNEGIRPAR

SEQ ID NO: 166 - protein, 21 aa, artificial
  peptide fold or domain or sub-domain
AATVAEEISKTTGLKLDKRWF

SEQ ID NO: 167 - protein, 30 aa, artificial
  peptide fold or domain or sub-domain
AATVWSSNVGRVHRVAKKLQSGLVWTNCWL

SEQ ID NO: 168 - protein, 29 aa, artificial
  peptide fold or domain or sub-domain
AAVANAHEAVLAAVPRVVAHHDEDGVGQF

SEQ ID NO: 169 - protein, 30 aa, artificial
  peptide fold or domain or sub-domain
AAVAPIGIDYNYMSNPEKYAVVADILSHVV

SEQ ID NO: 170 - protein, 25 aa, artificial
  peptide fold or domain or sub-domain
AAVDVLDFLPQDHQSRETILAIFKQ

SEQ ID NO: 171 - protein, 30 aa, artificial
  peptide fold or domain or sub-domain
AAVIITDVQREEGEAVAADILAQGGKALFI

SEQ ID NO: 172 - protein, 27 aa, artificial
  peptide fold or domain or sub-domain
AAVMKLKRHGDLTRVCTSQGDFLCRKV

SEQ ID NO: 173 - protein, 29 aa, artificial
  peptide fold or domain or sub-domain
AAVNGGDNGYNLNHLLSHISPALAKSDDN

SEQ ID NO: 174 - protein, 24 aa, artificial
  peptide fold or domain or sub-domain
AAVRSVAARVRGDVPRALEYATHA

SEQ ID NO: 175 - protein, 22 aa, artificial
  peptide fold or domain or sub-domain
AAVSWKKDGHSLTSQNYYQLTQ

SEQ ID NO: 176 - protein, 21 aa, artificial
  peptide fold or domain or sub-domain
AAVTRAIAPPPSESAGGREVA

SEQ ID NO: 177 - protein, 23 aa, artificial
  peptide fold or domain or sub-domain
AAWHRYVPQSSGEDVIAALGIAE

SEQ ID NO: 178 - protein, 26 aa, artificial
  peptide fold or domain or sub-domain
AAWIPTTHNHPGFPDGVSGKALLDLQ

SEQ ID NO: 179 - protein, 28 aa, artificial
  peptide fold or domain or sub-domain
AAYAYTRDLGRAFRIAEGLEYGIVGIND

SEQ ID NO: 180 - protein, 30 aa, artificial
  peptide fold or domain or sub-domain
AAYFYARDLSRVFRVGEALEYGIVGINTGI

SEQ ID NO: 181 - protein, 26 aa, artificial
  peptide fold or domain or sub-domain
AAYWLDPANKAHAPAFLASFFDAAAA

SEQ ID NO: 182 - protein, 20 aa, artificial
  peptide fold or domain or sub-domain
ACAGAGVTPAECKGKGCCFN

SEQ ID NO: 183 - protein, 24 aa, artificial
  peptide fold or domain or sub-domain
ACANLIQIGYDYWNNRTVLAEAQQ

SEQ ID NO: 184 - protein, 22 aa, artificial
  peptide fold or domain or sub-domain
ACAQAVVARSPLPEAERPAALS

SEQ ID NO: 185 - protein, 28 aa, artificial
  peptide fold or domain or sub-domain
ACCSTQTEIVETLGFNLTDTPMVEIQHG

SEQ ID NO: 186 - protein, 29 aa, artificial
  peptide fold or domain or sub-domain
ACDHITQALERLGFADYVPAVLEAAAEHK

SEQ ID NO: 187 - protein, 22 aa, artificial
  peptide fold or domain or sub-domain
ACEACPPGCAQCVDSRGCVRCQ

SEQ ID NO: 188 - protein, 20 aa, artificial
  peptide fold or domain or sub-domain
ACGAVFSELGEPAFRELEAI

SEQ ID NO: 189 - protein, 20 aa, artificial
  peptide fold or domain or sub-domain
ACGCCTPCRTGWETLCGSQQ

SEQ ID NO: 190 - protein, 26 aa, artificial
  peptide fold or domain or sub-domain
ACGECFFCKNQLESQCDQSNDNGEMG

SEQ ID NO: 191 - protein, 20 aa, artificial
  peptide fold or domain or sub-domain
ACGHCYFCNHDMQPNCEHSN

SEQ ID NO: 192 - protein, 26 aa, artificial
  peptide fold or domain or sub-domain
ACGRCRPCHAGWHYQCHRVGLFGYDT

SEQ ID NO: 193 - protein, 26 aa, artificial
  peptide fold or domain or sub-domain
ACGRCRSCKEMHTGVCLTVNPARAGG

SEQ ID NO: 194 - protein, 26 aa, artificial
  peptide fold or domain or sub-domain
ACGSCLNCIRGLTNMCLTMNPDAAIA

SEQ ID NO: 195 - protein, 26 aa, artificial
  peptide fold or domain or sub-domain
ACGSCWQCRSGAPWCCDNGNPAPEAS

SEQ ID NO: 196 - protein, 20 aa, artificial
  peptide fold or domain or sub-domain
ACGTCWWCVNGMSNHCELGG

SEQ ID NO: 197 - protein, 26 aa, artificial
  peptide fold or domain or sub-domain
ACGTCWWCVNGMSNHCELGGPVKAAP

SEQ ID NO: 198 - protein, 25 aa, artificial
  peptide fold or domain or sub-domain
ACGVGGSLLKQSFIENGQWGELTAL

SEQ ID NO: 199 - protein, 30 aa, artificial
  peptide fold or domain or sub-domain
ACHTMEQESADFLASGYINGQQFHLLGSKV

SEQ ID NO: 200 - protein, 27 aa, artificial
  peptide fold or domain or sub-domain
ACIIEQALLRSDVEASRAHRLSCMAMA

SEQ ID NO: 201 - protein, 25 aa, artificial
  peptide fold or domain or sub-domain
ACIRRQFSTTPGQPETKIIDYPYHQ

SEQ ID NO: 202 - protein, 22 aa, artificial
  peptide fold or domain or sub-domain
ACKYGYYMSELSQQCEPCTMCP

SEQ ID NO: 203 - protein, 22 aa, artificial
  peptide fold or domain or sub-domain
ACLPCISNCELCTDGSICAKCR

SEQ ID NO: 204 - protein, 20 aa, artificial
  peptide fold or domain or sub-domain
ACNTCSHCRAGRYNLCREMR

SEQ ID NO: 205 - protein, 27 aa, artificial
  peptide fold or domain or sub-domain
ACNWLAGLVTRGLVDEEEGYDMARALA

SEQ ID NO: 206 - protein, 25 aa, artificial
  peptide fold or domain or sub-domain
ACPICQASMHLEQSSLVCQNRHTFN

SEQ ID NO: 207 - protein, 25 aa, artificial
  peptide fold or domain or sub-domain
ACPQCRSRVELDEGTILCDQGHAFD

SEQ ID NO: 208 - protein, 25 aa, artificial
  peptide fold or domain or sub-domain
ACPVCGQPLQVTAGSLVCVNGHVRD

SEQ ID NO: 209 - protein, 27 aa, artificial
  peptide fold or domain or sub-domain
ACSQHVYRVAARVAGEQDAADVTQQVF

SEQ ID NO: 210 - protein, 30 aa, artificial
  peptide fold or domain or sub-domain
ACSTLGDGVILATKVMADSGFFGDREIVVV

SEQ ID NO: 211 - protein, 23 aa, artificial
  peptide fold or domain or sub-domain
ACVDGIFDTSLTAEQAQANYGEM

SEQ ID NO: 212 - protein, 25 aa, artificial
  peptide fold or domain or sub-domain
ACVGGSWIVPEEAIKNHNWSLITEL

SEQ ID NO: 213 - protein, 25 aa, artificial
  peptide fold or domain or sub-domain
ACVGGTWVAPASLIRARAWDQITQL

SEQ ID NO: 214 - protein, 22 aa, artificial
  peptide fold or domain or sub-domain
ADAEKKQQCSFKGKDPQRDCQN

SEQ ID NO: 215 - protein, 20 aa, artificial
  peptide fold or domain or sub-domain
ADAIKPGSSQTLKTKALQLV

SEQ ID NO: 216 - protein, 30 aa, artificial
  peptide fold or domain or sub-domain
ADAKAAYAAGLEVEPTNEQLKQALQEAEEQ

SEQ ID NO: 217 - protein, 23 aa, artificial
  peptide fold or domain or sub-domain
ADAKFILMRHHSINETEAYKIIR

SEQ ID NO: 218 - protein, 30 aa, artificial
  peptide fold or domain or sub-domain
ADATGELGGVWASLPSSNYAQPKRSWEDIQ

SEQ ID NO: 219 - protein, 30 aa, artificial
  peptide fold or domain or sub-domain
ADAVRAYESSLKYDPHNASYQTNLTLARER

SEQ ID NO: 220 - protein, 21 aa, artificial
  peptide fold or domain or sub-domain
ADDAEVYKSSGNILIRVAKDE

SEQ ID NO: 221 - protein, 29 aa, artificial
  peptide fold or domain or sub-domain
ADDALMQPESRAAYRRMLNDGWTDAILSR

SEQ ID NO: 222 - protein, 26 aa, artificial
  peptide fold or domain or sub-domain
ADDAVQIHGAYGYSNEYPVERYLRNS

SEQ ID NO: 223 - protein, 30 aa, artificial
  peptide fold or domain or sub-domain
ADDILFGQTDSKNKQGSVGLLTGGVIDRAA

SEQ ID NO: 224 - protein, 21 aa, artificial
  peptide fold or domain or sub-domain
ADDTVYRRNGHPHNKLRNRIW

SEQ ID NO: 225 - protein, 29 aa, artificial
  peptide fold or domain or sub-domain
ADDYKAQSIEPYEGILPEDVLAEMKEQLS

SEQ ID NO: 226 - protein, 21 aa, artificial
  peptide fold or domain or sub-domain
ADEFDGLSLYNSKTGTGTWRT

SEQ ID NO: 227 - protein, 29 aa, artificial
  peptide fold or domain or sub-domain
ADEFKNLLSSQLPTLIKSEQVGEVMKQMG

SEQ ID NO: 228 - protein, 21 aa, artificial
  peptide fold or domain or sub-domain
ADEFNSGTRPNPKDWTYETKF

SEQ ID NO: 229 - protein, 24 aa, artificial
  peptide fold or domain or sub-domain
ADEKELLVLLAGSEYREAKGPRLI

SEQ ID NO: 230 - protein, 27 aa, artificial
  peptide fold or domain or sub-domain
ADELEAIARRHYSSTPSLEKMLEINRK

SEQ ID NO: 231 - protein, 25 aa, artificial
  peptide fold or domain or sub-domain
ADELLDAMLAGPRSTDLLTAYAFPL

SEQ ID NO: 232 - protein, 20 aa, artificial
  peptide fold or domain or sub-domain
ADENGGLMRERKCAASNGAT

SEQ ID NO: 233 - protein, 21 aa, artificial
  peptide fold or domain or sub-domain
ADFKTVRDRLELTDSALSRTL

SEQ ID NO: 234 - protein, 21 aa, artificial
  peptide fold or domain or sub-domain
ADFLFLQRETGLSKGNLSIHL

SEQ ID NO: 235 - protein, 21 aa, artificial
  peptide fold or domain or sub-domain
ADFRMYEKQQRDEKAVKTRIF

SEQ ID NO: 236 - protein, 21 aa, artificial
  peptide fold or domain or sub-domain
ADFTKRESPPGKLPFWTWLDK

SEQ ID NO: 237 - protein, 23 aa, artificial
  peptide fold or domain or sub-domain
ADFVRHVDGDTTVLKIDGKEQKV

SEQ ID NO: 238 - protein, 26 aa, artificial
  peptide fold or domain or sub-domain
ADFWLSQTNLDKAPDDESKGFFKGAM

SEQ ID NO: 239 - protein, 22 aa, artificial
  peptide fold or domain or sub-domain
ADGAVLLPIGGGAYLRVKVLDA

SEQ ID NO: 240 - protein, 25 aa, artificial
  peptide fold or domain or sub-domain
ADGLLDAMEEMGPPADLVEDFSLPF

SEQ ID NO: 241 - protein, 29 aa, artificial
  peptide fold or domain or sub-domain
ADGLLDDVMAGLERRSVLVDERRPNVIRV

SEQ ID NO: 242 - protein, 23 aa, artificial
  peptide fold or domain or sub-domain
ADGMYLYYSGNEVVPAYGNPQLV

SEQ ID NO: 243 - protein, 28 aa, artificial
  peptide fold or domain or sub-domain
ADGNDAAKAFTKLYVAKYHSQPDVFGGW

SEQ ID NO: 244 - protein, 24 aa, artificial
  peptide fold or domain or sub-domain
ADHASAAPSAGPGTPPAAGGGTRP

SEQ ID NO: 245 - protein, 20 aa, artificial
  peptide fold or domain or sub-domain
ADHIIDLGPEGGKEGGYIVA

SEQ ID NO: 246 - protein, 23 aa, artificial
  peptide fold or domain or sub-domain
ADHLRSLLVIKNPVTIQLMHASD

SEQ ID NO: 247 - protein, 21 aa, artificial
  peptide fold or domain or sub-domain
ADHRFYRYMGRGEESTTTNYL

SEQ ID NO: 248 - protein, 20 aa, artificial
  peptide fold or domain or sub-domain
ADHVIRISLENGSSKVEVVS

SEQ ID NO: 249 - protein, 24 aa, artificial
  peptide fold or domain or sub-domain
ADIGEVETVVAPLGCGPTRAARLV

SEQ ID NO: 250 - protein, 26 aa, artificial
  peptide fold or domain or sub-domain
ADIGMQIMAGAGYSMEYDMQMFFRDS

SEQ ID NO: 251 - protein, 26 aa, artificial
  peptide fold or domain or sub-domain
ADIPVVIITAKASEEERLAGFALGAD

SEQ ID NO: 252 - protein, 24 aa, artificial
  peptide fold or domain or sub-domain
ADIRELEIDIYSTGFYKNKAKNIK

SEQ ID NO: 253 - protein, 25 aa, artificial
  peptide fold or domain or sub-domain
ADIRELEIDIYSTGFYKNKAKNIKA

SEQ ID NO: 254 - protein, 23 aa, artificial
  peptide fold or domain or sub-domain
ADITAIDESPVRSFGKEAEASMI

SEQ ID NO: 255 - protein, 21 aa, artificial
  peptide fold or domain or sub-domain
ADKAEFDKHGSNLEKTKLKLL

SEQ ID NO: 256 - protein, 26 aa, artificial
  peptide fold or domain or sub-domain
ADKALQIFGGAGYIKGMVVERVYREL

SEQ ID NO: 257 - protein, 28 aa, artificial
  peptide fold or domain or sub-domain
ADKKALTAQLLMVGLQESEADALAGKIM

SEQ ID NO: 258 - protein, 30 aa, artificial
  peptide fold or domain or sub-domain
ADKNRLEFILTSKSVGFSLKEIADLLSINL

SEQ ID NO: 259 - protein, 28 aa, artificial
  peptide fold or domain or sub-domain
ADKYAYKLLSSFGYTLEGYHEIKEWLEQ

SEQ ID NO: 260 - protein, 24 aa, artificial
  peptide fold or domain or sub-domain
ADLAAATPGYAGLTLEGLGDAGAV

SEQ ID NO: 261 - protein, 21 aa, artificial
  peptide fold or domain or sub-domain
ADLFTKVITENTENPDEAVSV

SEQ ID NO: 262 - protein, 25 aa, artificial
  peptide fold or domain or sub-domain
ADLLVAQGVLRREDLSDVDEAANDS

SEQ ID NO: 263 - protein, 30 aa, artificial
  peptide fold or domain or sub-domain
ADLNGLPLGKPGTHERAVAQLRQMRGQTVV

SEQ ID NO: 264 - protein, 26 aa, artificial
  peptide fold or domain or sub-domain
ADLRALYELAREAQDASLEPELSSLF

SEQ ID NO: 265 - protein, 28 aa, artificial
  peptide fold or domain or sub-domain
ADLTQWLGLDPLDDVRNVNDAVYADTRG

SEQ ID NO: 266 - protein, 25 aa, artificial
  peptide fold or domain or sub-domain
ADNCPLEHNPDQLDSDSDRIGDTCD

SEQ ID NO: 267 - protein, 24 aa, artificial
  peptide fold or domain or sub-domain
ADNFARTFDIKYEAPNGEHYYAHQ

SEQ ID NO: 268 - protein, 21 aa, artificial
  peptide fold or domain or sub-domain
ADNREFQRQGKDLEKVKQRLI

SEQ ID NO: 269 - protein, 21 aa, artificial
  peptide fold or domain or sub-domain
ADNREYKLLHGDMKGLHIRML

SEQ ID NO: 270 - protein, 21 aa, artificial
  peptide fold or domain or sub-domain
ADNRMVSYHGENLQHYILTLM

SEQ ID NO: 271 - protein, 21 aa, artificial
  peptide fold or domain or sub-domain
ADNSMFNKYSRSTENVRRRIF

SEQ ID NO: 272 - protein, 21 aa, artificial
  peptide fold or domain or sub-domain
ADNTMYKKYNKDVNTVRQRVF

SEQ ID NO: 273 - protein, 24 aa, artificial
  peptide fold or domain or sub-domain
ADPEEVAACIKSLGLYRTKAAHLV

SEQ ID NO: 274 - protein, 25 aa, artificial
  peptide fold or domain or sub-domain
ADPEEVAACIKSLGLYRTKAAHLVA

SEQ ID NO: 275 - protein, 27 aa, artificial
  peptide fold or domain or sub-domain
ADPELILRRRQNDPTRARDEDSVESIR

SEQ ID NO: 276 - protein, 26 aa, artificial
  peptide fold or domain or sub-domain
ADPNHAKPMIQFMKGDPTEFGHEHCK

SEQ ID NO: 277 - protein, 20 aa, artificial
  peptide fold or domain or sub-domain
ADPQALKALGMPLKRAEALI

SEQ ID NO: 278 - protein, 30 aa, artificial
  peptide fold or domain or sub-domain
ADPRELNIEDIPVLAKAVGVSRQTLAVRAE

SEQ ID NO: 279 - protein, 27 aa, artificial
  peptide fold or domain or sub-domain
ADPRMGPFEKGEECQTCRGTRTECPGH

SEQ ID NO: 280 - protein, 27 aa, artificial
  peptide fold or domain or sub-domain
ADPYQVAKRRRADVGRERPYRDVATLQ

SEQ ID NO: 281 - protein, 27 aa, artificial
  peptide fold or domain or sub-domain
ADQLKDEGNNHMKEENYAAAVDCYTQA

SEQ ID NO: 282 - protein, 28 aa, artificial
  peptide fold or domain or sub-domain
ADQPDHRGVMNLVRRLNELYRERPDWHT

SEQ ID NO: 283 - protein, 23 aa, artificial
  peptide fold or domain or sub-domain
ADRATLERLKQKEEGSSPSPSAA

SEQ ID NO: 284 - protein, 29 aa, artificial
  peptide fold or domain or sub-domain
ADRDDVKKRMKEAKSEDERLFYDGIQNAI

SEQ ID NO: 285 - protein, 20 aa, artificial
  peptide fold or domain or sub-domain
ADRIEQVLPGVCDTRLADQG

SEQ ID NO: 286 - protein, 21 aa, artificial
  peptide fold or domain or sub-domain
ADRLAATMMDVLGLDSSAVSV

SEQ ID NO: 287 - protein, 27 aa, artificial
  peptide fold or domain or sub-domain
ADRRKAMHYLRIHDYQGFNWLVADYGL

SEQ ID NO: 288 - protein, 27 aa, artificial
  peptide fold or domain or sub-domain
ADRRKMDGNSLFKEEKLEEAMQQYEMA

SEQ ID NO: 289 - protein, 21 aa, artificial
  peptide fold or domain or sub-domain
ADRSPVCTTFLDTSSNINSIL

SEQ ID NO: 290 - protein, 22 aa, artificial
  peptide fold or domain or sub-domain
ADRVFEEWVDAGRFDADTGAEL

SEQ ID NO: 291 - protein, 20 aa, artificial
  peptide fold or domain or sub-domain
ADRVLEMGPGAGARGGQVVA

SEQ ID NO: 292 - protein, 20 aa, artificial
  peptide fold or domain or sub-domain
ADRVRAVEEWNTREPILKRG

SEQ ID NO: 293 - protein, 21 aa, artificial
  peptide fold or domain or sub-domain
ADSYLASLPSKQSSAGWGSGP

SEQ ID NO: 294 - protein, 24 aa, artificial
  peptide fold or domain or sub-domain
ADTAALEEDLKPTGFFKQKTKSVQ

SEQ ID NO: 295 - protein, 25 aa, artificial
  peptide fold or domain or sub-domain
ADTAALEEDLKPTGFFKQKTKSVQA

SEQ ID NO: 296 - protein, 30 aa, artificial
  peptide fold or domain or sub-domain
ADTDHAIVERAGTNISAIFKYSGEPEFRRL

SEQ ID NO: 297 - protein, 28 aa, artificial
  peptide fold or domain or sub-domain
ADTETIFGAVRFALPDVSRQAVYDVLHA

SEQ ID NO: 298 - protein, 21 aa, artificial
  peptide fold or domain or sub-domain
ADTLGLWAQFTDGEDKMYHIR

SEQ ID NO: 299 - protein, 20 aa, artificial
  peptide fold or domain or sub-domain
ADTTALRAAGLSMQKSGYLR

SEQ ID NO: 300 - protein, 23 aa, artificial
  peptide fold or domain or sub-domain
ADTVKGDTSGAYRDALLSIINGN

SEQ ID NO: 301 - protein, 26 aa, artificial
  peptide fold or domain or sub-domain
ADTYVILVTARSEEVDKLVGLGVGAD

SEQ ID NO: 302 - protein, 30 aa, artificial
  peptide fold or domain or sub-domain
ADVERLRFALRLRQLGFALAEVRELLTMTE

SEQ ID NO: 303 - protein, 26 aa, artificial
  peptide fold or domain or sub-domain
ADVISGRRGYDPQSGRLLRLMSRKAR

SEQ ID NO: 304 - protein, 30 aa, artificial
  peptide fold or domain or sub-domain
ADVLDSFDNKLHVETSTGKKLFRRDPDDEE

SEQ ID NO: 305 - protein, 24 aa, artificial
  peptide fold or domain or sub-domain
ADVSDVGSIISKVGFWRVKAKKII

SEQ ID NO: 306 - protein, 25 aa, artificial
  peptide fold or domain or sub-domain
ADVSDVGSIISKVGFWRVKAKKIIM

SEQ ID NO: 307 - protein, 30 aa, artificial
  peptide fold or domain or sub-domain
ADVTRVRFVKSAQRLGFSLDEIAELLRLED

SEQ ID NO: 308 - protein, 30 aa, artificial
  peptide fold or domain or sub-domain
ADVVLAARRLPELEDAAREVASLGVRALPV

SEQ ID NO: 309 - protein, 27 aa, artificial
  peptide fold or domain or sub-domain
ADWYIAPTGNDGNPGTRAAPFASVMAA

SEQ ID NO: 310 - protein, 28 aa, artificial
  peptide fold or domain or sub-domain
ADYATLIALAQPDGDAEAPNLDAAVSHL

SEQ ID NO: 311 - protein, 24 aa, artificial
  peptide fold or domain or sub-domain
ADYLAKLSPTWKAKYGVKTSVDWP

SEQ ID NO: 312 - protein, 21 aa, artificial
  peptide fold or domain or sub-domain
ADYLEFQKNRRDQDATKHKLI

SEQ ID NO: 313 - protein, 21 aa, artificial
  peptide fold or domain or sub-domain
ADYQSLREELGVSYSLLSKHA

SEQ ID NO: 314 - protein, 21 aa, artificial
  peptide fold or domain or sub-domain
ADYRFYQSMGQSNMQISMNYL

SEQ ID NO: 315 - protein, 21 aa, artificial
  peptide fold or domain or sub-domain
ADYSFYSIFGKNNTGIVTKFL

SEQ ID NO: 316 - protein, 21 aa, artificial
  peptide fold or domain or sub-domain
ADYSMFMKQNRNLGSTKQRVL

SEQ ID NO: 317 - protein, 21 aa, artificial
  peptide fold or domain or sub-domain
ADYSVYTKYDSDEKKVNDYIQ

SEQ ID NO: 318 - protein, 27 aa, artificial
  peptide fold or domain or sub-domain
ADYVLYNNDGLAENGIFHVKNMVDAGD

SEQ ID NO: 319 - protein, 29 aa, artificial
  peptide fold or domain or sub-domain
AEAAKEMKNSTWNHQTPNRSNRVISVIET

SEQ ID NO: 320 - protein, 23 aa, artificial
  peptide fold or domain or sub-domain
AEAIILLMQHQGGDAETAYKLLQ

SEQ ID NO: 321 - protein, 21 aa, artificial
  peptide fold or domain or sub-domain
AEAITRNVMDILGYGEESVSV

SEQ ID NO: 322 - protein, 20 aa, artificial
  peptide fold or domain or sub-domain
AEALERDLNLTSAEAQELLT

SEQ ID NO: 323 - protein, 23 aa, artificial
  peptide fold or domain or sub-domain
AEALKDEITELVLAGREYSEALS

SEQ ID NO: 324 - protein, 28 aa, artificial
  peptide fold or domain or sub-domain
AEALKEILQQYTTLTIAAENTPSNTVVS

SEQ ID NO: 325 - protein, 30 aa, artificial
  peptide fold or domain or sub-domain
AEALMRHKQVKKSTTKVDVINNPEVTSTLG

SEQ ID NO: 326 - protein, 21 aa, artificial
  peptide fold or domain or sub-domain
AEAMGFDDEPLKDSDEEMIRQ

SEQ ID NO: 327 - protein, 21 aa, artificial
  peptide fold or domain or sub-domain
AEANLRKAEGKRQKIEANLAL

SEQ ID NO: 328 - protein, 27 aa, artificial
  peptide fold or domain or sub-domain
AEAQLERLDTDPLWQSLGAVQKNRVYS

SEQ ID NO: 329 - protein, 23 aa, artificial
  peptide fold or domain or sub-domain
AEATALLMLRKNCGASEAYQHLR

SEQ ID NO: 330 - protein, 27 aa, artificial
  peptide fold or domain or sub-domain
AEATGLDVDGDIKTVHTSRGDLKTFGI

SEQ ID NO: 331 - protein, 20 aa, artificial
  peptide fold or domain or sub-domain
AEATGTLASIIGKSELSSDI

SEQ ID NO: 332 - protein, 21 aa, artificial
  peptide fold or domain or sub-domain
AEAVAQAVMASAGSSEAAVSV

SEQ ID NO: 333 - protein, 29 aa, artificial
  peptide fold or domain or sub-domain
AEAVWEGNLVQGSGRFTVGSGAFGEMPVT

SEQ ID NO: 334 - protein, 20 aa, artificial
  peptide fold or domain or sub-domain
AECTFRVRLLQNWHIESNGY

SEQ ID NO: 335 - protein, 21 aa, artificial
  peptide fold or domain or sub-domain
AEDLAAVLKKHFGSSNDSLSV

SEQ ID NO: 336 - protein, 20 aa, artificial
  peptide fold or domain or sub-domain
AEDLTVHRYDGLYHEVFNEP

SEQ ID NO: 337 - protein, 22 aa, artificial
  peptide fold or domain or sub-domain
AEDTAHPGLGDAGRTQQRATFD

SEQ ID NO: 338 - protein, 29 aa, artificial
  peptide fold or domain or sub-domain
AEEAKEAVKSLKNSAELKYADYYLRVLDK

SEQ ID NO: 339 - protein, 21 aa, artificial
  peptide fold or domain or sub-domain
AEEALRNAKDKADIAVVEAEL

SEQ ID NO: 340 - protein, 21 aa, artificial
  peptide fold or domain or sub-domain
AEEITRAITQALQCDAGVVSI

SEQ ID NO: 341 - protein, 22 aa, artificial
  peptide fold or domain or sub-domain
AEEKLQQEYGYPGYEKHRAEHE

SEQ ID NO: 342 - protein, 21 aa, artificial
  peptide fold or domain or sub-domain
AEEKLRQKKSKQEYIAAEAAL

SEQ ID NO: 343 - protein, 27 aa, artificial
  peptide fold or domain or sub-domain
AEEMMSTEFPTAAKSSEAASFIMKVLE

SEQ ID NO: 344 - protein, 27 aa, artificial
  peptide fold or domain or sub-domain
AEENFQTYQNSPLWQTLNVVKNNHVYT

SEQ ID NO: 345 - protein, 21 aa, artificial
  peptide fold or domain or sub-domain
AEERLKNKTDELDEKRAKLAL

SEQ ID NO: 346 - protein, 29 aa, artificial
  peptide fold or domain or sub-domain
AEEYRQETIEPMRALLGDEEIQTVEEQLN

SEQ ID NO: 347 - protein, 24 aa, artificial
  peptide fold or domain or sub-domain
AEFDLGAILRRETGTETPKSMRFL

SEQ ID NO: 348 - protein, 28 aa, artificial
  peptide fold or domain or sub-domain
AEFFLGEKVSITKVRGKWYEWHGIKVFP

SEQ ID NO: 349 - protein, 23 aa, artificial
  peptide fold or domain or sub-domain
AEFIIMCDKIDDSKKAFLMLRIS

SEQ ID NO: 350 - protein, 23 aa, artificial
  peptide fold or domain or sub-domain
AEFVLEALVKKGVPRMRAYRDIQ

SEQ ID NO: 351 - protein, 23 aa, artificial
  peptide fold or domain or sub-domain
AEFVNFVTRVKIVPAIADNVAFG

SEQ ID NO: 352 - protein, 21 aa, artificial
  peptide fold or domain or sub-domain
AEFVYLKEKTQSTAGNLSVQL

SEQ ID NO: 353 - protein, 28 aa, artificial
  peptide fold or domain or sub-domain
AEGETIDIKSTSEDFAEMNYFDCIDKKT

SEQ ID NO: 354 - protein, 24 aa, artificial
  peptide fold or domain or sub-domain
AEGHSRNDWCKRTGEPIANREFIQ

SEQ ID NO: 355 - protein, 27 aa, artificial
  peptide fold or domain or sub-domain
AEGMPYSPSRVMMMPRDPLYGELRRIM

SEQ ID NO: 356 - protein, 20 aa, artificial
  peptide fold or domain or sub-domain
AEGMVPKLEDMELIELFNDI

SEQ ID NO: 357 - protein, 28 aa, artificial
  peptide fold or domain or sub-domain
AEGQVLEISKVGDIISEEEYFQIIDGKT

SEQ ID NO: 358 - protein, 28 aa, artificial
  peptide fold or domain or sub-domain
AEHHFRREEALLAASGYPDIEIHRAEHR

SEQ ID NO: 359 - protein, 27 aa, artificial
  peptide fold or domain or sub-domain
AEIDTIRRSGSGFVVVCSKGTFAAECL

SEQ ID NO: 360 - protein, 24 aa, artificial
  peptide fold or domain or sub-domain
AEIFGVLGMMVGVIGCLQSTEVIK

SEQ ID NO: 361 - protein, 26 aa, artificial
  peptide fold or domain or sub-domain
AEILEVNEKNVEVLVREPVNKNVLRI

SEQ ID NO: 362 - protein, 23 aa, artificial
  peptide fold or domain or sub-domain
AEKHYEDLSSKSFFSGLVDYIVS

SEQ ID NO: 363 - protein, 23 aa, artificial
  peptide fold or domain or sub-domain
AEKIKNALVALQPDHKQEFEKNF

SEQ ID NO: 364 - protein, 29 aa, artificial
  peptide fold or domain or sub-domain
AEKITPAVRDAMLIPGEDAEKKTEELIEL

SEQ ID NO: 365 - protein, 24 aa, artificial
  peptide fold or domain or sub-domain
AEKKEAEGKNWKTDLSGGIQRVAI

SEQ ID NO: 366 - protein, 21 aa, artificial
  peptide fold or domain or sub-domain
AEKKLQQKLPPDEFERYQAAL

SEQ ID NO: 367 - protein, 23 aa, artificial
  peptide fold or domain or sub-domain
AEKLYEEHRDKPFFEDLIEYVTS

SEQ ID NO: 368 - protein, 21 aa, artificial
  peptide fold or domain or sub-domain
AEKQLKAETSRTEFDLAERQL

SEQ ID NO: 369 - protein, 21 aa, artificial
  peptide fold or domain or sub-domain
AEKRLEVRSEEINHARAKMAL

SEQ ID NO: 370 - protein, 28 aa, artificial
  peptide fold or domain or sub-domain
AEKYFNKPDVQKAFHANANGMLPGKWKV

SEQ ID NO: 371 - protein, 20 aa, artificial
  peptide fold or domain or sub-domain
AELAAEFEKDLDDYNSIMIK

SEQ ID NO: 372 - protein, 26 aa, artificial
  peptide fold or domain or sub-domain
AELAAERSAAQKSDNARQQLERQNKE

SEQ ID NO: 373 - protein, 21 aa, artificial
  peptide fold or domain or sub-domain
AELAASVGERRVVFSDTQERP

SEQ ID NO: 374 - protein, 28 aa, artificial
  peptide fold or domain or sub-domain
AELAYVTNEKDDDISVIDLASQKVIKRI

SEQ ID NO: 375 - protein, 26 aa, artificial
  peptide fold or domain or sub-domain
AELIAELKRLHRQGKDIGQYIYLRRY

SEQ ID NO: 376 - protein, 29 aa, artificial
  peptide fold or domain or sub-domain
AELKAWSVLNDWFKNDDPTAFQTAHEKNY

SEQ ID NO: 377 - protein, 24 aa, artificial
  peptide fold or domain or sub-domain
AELKDIRDSIHSIGFYNIKAKRIK

SEQ ID NO: 378 - protein, 25 aa, artificial
  peptide fold or domain or sub-domain
AELKDIRDSIHSIGFYNIKAKRIKQ

SEQ ID NO: 379 - protein, 30 aa, artificial
  peptide fold or domain or sub-domain
AELKGSKSVEEIEEIKKAMLELPEKVEEIL

SEQ ID NO: 380 - protein, 23 aa, artificial
  peptide fold or domain or sub-domain
AELPAAMTHEPLSPAARDELGIS

SEQ ID NO: 381 - protein, 29 aa, artificial
  peptide fold or domain or sub-domain
AELQQKHTENMQTVDEARSKALRGEIDEL

SEQ ID NO: 382 - protein, 24 aa, artificial
  peptide fold or domain or sub-domain
AELSDVENALRTIGLYKNKAKNII

SEQ ID NO: 383 - protein, 25 aa, artificial
  peptide fold or domain or sub-domain
AELSDVENALRTIGLYKNKAKNIIK

SEQ ID NO: 384 - protein, 23 aa, artificial
  peptide fold or domain or sub-domain
AELVAPFFGGSDGSPTRLGLSSY

SEQ ID NO: 385 - protein, 23 aa, artificial
  peptide fold or domain or sub-domain
AELVECIDGDTAKFRVNGHVYTT

SEQ ID NO: 386 - protein, 29 aa, artificial
  peptide fold or domain or sub-domain
AELYALPGSAAAVDQAAAWPALDLIRPCC

SEQ ID NO: 387 - protein, 28 aa, artificial
  peptide fold or domain or sub-domain
AEPRPEVQAFVQRYRAKFHADPDSFVAR

SEQ ID NO: 388 - protein, 23 aa, artificial
  peptide fold or domain or sub-domain
AEPTLAARSSAVGEDSDFSFAGQ

SEQ ID NO: 389 - protein, 23 aa, artificial
  peptide fold or domain or sub-domain
AEQFYKDHRGKFFYERLISFMTR

SEQ ID NO: 390 - protein, 26 aa, artificial
  peptide fold or domain or sub-domain
AEQGMQFHGGRSNFTDRRIARVYRDV

SEQ ID NO: 391 - protein, 27 aa, artificial
  peptide fold or domain or sub-domain
AEQKCMNKRFVDPNTQEKVTYQELQER

SEQ ID NO: 392 - protein, 21 aa, artificial
  peptide fold or domain or sub-domain
AEQRLQTSGPELDYQRALNAV

SEQ ID NO: 393 - protein, 23 aa, artificial
  peptide fold or domain or sub-domain
AEQRNMAEVAGRPPAPSYLGDAD

SEQ ID NO: 394 - protein, 23 aa, artificial
  peptide fold or domain or sub-domain
AEREADRLNTLSPGFNITADDIP

SEQ ID NO: 395 - protein, 23 aa, artificial
  peptide fold or domain or sub-domain
AERIMIELAKRGMGRQTAHEIVR

SEQ ID NO: 396 - protein, 29 aa, artificial
  peptide fold or domain or sub-domain
AERKAKEVLEGREGDADVALAQSQLAITV

SEQ ID NO: 397 - protein, 21 aa, artificial
  peptide fold or domain or sub-domain
AERLGKGAEFTEGRDEMGWIS

SEQ ID NO: 398 - protein, 26 aa, artificial
  peptide fold or domain or sub-domain
AERLVEWGLVEGPVERVLELGLQRRW

SEQ ID NO: 399 - protein, 29 aa, artificial
  peptide fold or domain or sub-domain
AERMKALQELVPNANKLMQTDKASMLDEI

SEQ ID NO: 400 - protein, 20 aa, artificial
  peptide fold or domain or sub-domain
AERQAEIAAFNATHRHTKRG

SEQ ID NO: 401 - protein, 24 aa, artificial
  peptide fold or domain or sub-domain
AERRENGIPIAGGNWDQLVKAAAK

SEQ ID NO: 402 - protein, 21 aa, artificial
  peptide fold or domain or sub-domain
AERRLAKQKAGIEYSKAMTEL

SEQ ID NO: 403 - protein, 29 aa, artificial
  peptide fold or domain or sub-domain
AERRPDGRGAGRNARLFRAAERLPVQQLS

SEQ ID NO: 404 - protein, 20 aa, artificial
  peptide fold or domain or sub-domain
AESAARMRGYHNYHANTLGW

SEQ ID NO: 405 - protein, 23 aa, artificial
  peptide fold or domain or sub-domain
AESFYSEHKDTDYFEPLVKQMTC

SEQ ID NO: 406 - protein, 26 aa, artificial
  peptide fold or domain or sub-domain
AESGDESKFEEYFKTTDQQTRTTVAE

SEQ ID NO: 407 - protein, 23 aa, artificial
  peptide fold or domain or sub-domain
AESHYAEHKERPFFGGLVSFITS

SEQ ID NO: 408 - protein, 23 aa, artificial
  peptide fold or domain or sub-domain
AESLMINLTLKGMKRHEAHQYVN

SEQ ID NO: 409 - protein, 28 aa, artificial
  peptide fold or domain or sub-domain
AESYLGRKVVMGEEHGKPFKHEDRTVVI

SEQ ID NO: 410 - protein, 23 aa, artificial
  peptide fold or domain or sub-domain
AETASFVLARNGVSRAEAKDLVA

SEQ ID NO: 411 - protein, 22 aa, artificial
  peptide fold or domain or sub-domain
AETIAGFHQDPPLMFTEEYQKS

SEQ ID NO: 412 - protein, 29 aa, artificial
  peptide fold or domain or sub-domain
AETMLTNLQLVFLGDMTPEEFAEAMEATQ

SEQ ID NO: 413 - protein, 28 aa, artificial
  peptide fold or domain or sub-domain
AETREQDPSWFEGLESRFRNKSGYLRYS

SEQ ID NO: 414 - protein, 20 aa, artificial
  peptide fold or domain or sub-domain
AETTEEEFRVAPGETVQVQM

SEQ ID NO: 415 - protein, 24 aa, artificial
  peptide fold or domain or sub-domain
AETVWDTGIEYGTVSALVKGQILE

SEQ ID NO: 416 - protein, 29 aa, artificial
  peptide fold or domain or sub-domain
AETYPLQKKSHSFEFLRAHAHLRARTSTF

SEQ ID NO: 417 - protein, 28 aa, artificial
  peptide fold or domain or sub-domain
AEVAAAVAPHAASVSIAAVNGPEQVVIA

SEQ ID NO: 418 - protein, 27 aa, artificial
  peptide fold or domain or sub-domain
AEVIRVMGEWADIRIGKLETRLPKKEW

SEQ ID NO: 419 - protein, 27 aa, artificial
  peptide fold or domain or sub-domain
AEVKQIRRIGTTWLVETPSQQYEALKL

SEQ ID NO: 420 - protein, 30 aa, artificial
  peptide fold or domain or sub-domain
AEVLKEGKDEWVVRTEEGQTLTVKMDFISP

SEQ ID NO: 421 - protein, 27 aa, artificial
  peptide fold or domain or sub-domain
AEVNAIHKTKDHFEVVTETGGLSGRCI

SEQ ID NO: 422 - protein, 23 aa, artificial
  peptide fold or domain or sub-domain
AEVNLISDGDTLTVQQDGESVKI

SEQ ID NO: 423 - protein, 23 aa, artificial
  peptide fold or domain or sub-domain
AEVPSVMTHASVPPEHRALLGIT

SEQ ID NO: 424 - protein, 22 aa, artificial
  peptide fold or domain or sub-domain
AEVSSSGLKARVARGEDVSAFC

SEQ ID NO: 425 - protein, 27 aa, artificial
  peptide fold or domain or sub-domain
AEVTPYPGPMPAGPAPSPGASRPSPAV

SEQ ID NO: 426 - protein, 30 aa, artificial
  peptide fold or domain or sub-domain
AEVVEVKDRAVFVLTSQRKKITVLAEKLLP

SEQ ID NO: 427 - protein, 23 aa, artificial
  peptide fold or domain or sub-domain
AEVYNAKKWAQVRQSVNKERNFL

SEQ ID NO: 428 - protein, 27 aa, artificial
  peptide fold or domain or sub-domain
AEWIACLDKRPLERSSEDVDIIFTRLK

SEQ ID NO: 429 - protein, 25 aa, artificial
  peptide fold or domain or sub-domain
AEYVPVTEEAEMVAHLWNIHYESAD

SEQ ID NO: 430 - protein, 30 aa, artificial
  peptide fold or domain or sub-domain
AFAEAEKELKPCWKELFTDVYHTMPNHIWK

SEQ ID NO: 431 - protein, 29 aa, artificial
  peptide fold or domain or sub-domain
AFAPGGATLASASADHAVRLWDGASGRCT

SEQ ID NO: 432 - protein, 27 aa, artificial
  peptide fold or domain or sub-domain
AFAPKVKAYAIKQGMLEHAEELVQEVM

SEQ ID NO: 433 - protein, 26 aa, artificial
  peptide fold or domain or sub-domain
AFAYYIEPQHRDVLQLYAPEAFNYMD

SEQ ID NO: 434 - protein, 24 aa, artificial
  peptide fold or domain or sub-domain
AFCKDIGQNGELICVQEGREIKIQ

SEQ ID NO: 435 - protein, 27 aa, artificial
  peptide fold or domain or sub-domain
AFDKVYTAADKYDVSLRIAAYVVGIRR

SEQ ID NO: 436 - protein, 27 aa, artificial
  peptide fold or domain or sub-domain
AFDQMVRRAKKDNIPHRTAAMALGVEK

SEQ ID NO: 437 - protein, 21 aa, artificial
  peptide fold or domain or sub-domain
AFDRALFGGTPEEVPERYREA

SEQ ID NO: 438 - protein, 20 aa, artificial
  peptide fold or domain or sub-domain
AFDVAKKEALEKGISLENHV

SEQ ID NO: 439 - protein, 27 aa, artificial
  peptide fold or domain or sub-domain
AFEMVTADGEILHVDQDHHADLFYAVR

SEQ ID NO: 440 - protein, 26 aa, artificial
  peptide fold or domain or sub-domain
AFENLANRMASGQSQGVAANNTGIEL

SEQ ID NO: 441 - protein, 30 aa, artificial
  peptide fold or domain or sub-domain
AFEQAERKPKPNPNLLFSDVYQEMPAQLRK

SEQ ID NO: 442 - protein, 24 aa, artificial
  peptide fold or domain or sub-domain
AFERMLLENKAWAKDQLLKDPGYF

SEQ ID NO: 443 - protein, 21 aa, artificial
  peptide fold or domain or sub-domain
AFETFYANSASSHLMGSIVQK

SEQ ID NO: 444 - protein, 28 aa, artificial
  peptide fold or domain or sub-domain
AFEYVNQTDIASLEAGVIEISEGLKLIV

SEQ ID NO: 445 - protein, 23 aa, artificial
  peptide fold or domain or sub-domain
AFGCKNCKYCKFKEYQFCEKVKV

SEQ ID NO: 446 - protein, 30 aa, artificial
  peptide fold or domain or sub-domain
AFGCKNCKYCKFKEYQFCEKVKVIGVNLNG

SEQ ID NO: 447 - protein, 22 aa, artificial
  peptide fold or domain or sub-domain
AFGLPAENAAIERGIDPAEWTK

SEQ ID NO: 448 - protein, 24 aa, artificial
  peptide fold or domain or sub-domain
AFGWSRRGWKTAEGGEVANAIYWK

SEQ ID NO: 449 - protein, 27 aa, artificial
  peptide fold or domain or sub-domain
AFHNIKTMCHTHSCNLRMGAFTLGVNR

SEQ ID NO: 450 - protein, 21 aa, artificial
  peptide fold or domain or sub-domain
AFHWFQVYGLPVNSIRIFNAY

SEQ ID NO: 451 - protein, 27 aa, artificial
  peptide fold or domain or sub-domain
AFIAVSELSRQSSLYMRDAAYVISINR

SEQ ID NO: 452 - protein, 26 aa, artificial
  peptide fold or domain or sub-domain
AFICEFCGNGYSQRSYLVSHKRVMHG

SEQ ID NO: 453 - protein, 22 aa, artificial
  peptide fold or domain or sub-domain
AFISSSVVRSIIEHNGAFSHLV

SEQ ID NO: 454 - protein, 29 aa, artificial
  peptide fold or domain or sub-domain
AFKEASGDVSFMGELMTALPDGFAVFCGN

SEQ ID NO: 455 - protein, 30 aa, artificial
  peptide fold or domain or sub-domain
AFLALPLLERLKRRVVEGRKQGLEADLEEA

SEQ ID NO: 456 - protein, 22 aa, artificial
  peptide fold or domain or sub-domain
AFLSFENTIEQNSDSADAYCHR

SEQ ID NO: 457 - protein, 27 aa, artificial
  peptide fold or domain or sub-domain
AFLSNVLEQGGRRSALESFIAFRGREP

SEQ ID NO: 458 - protein, 22 aa, artificial
  peptide fold or domain or sub-domain
AFLSSTIVREVAIHGGSIEQFV

SEQ ID NO: 459 - protein, 24 aa, artificial
  peptide fold or domain or sub-domain
AFMAEQLALAKEQGETVPHTVPEE

SEQ ID NO: 460 - protein, 27 aa, artificial
  peptide fold or domain or sub-domain
AFNDVMKVKEKYNVDMRTAAYILAIDR

SEQ ID NO: 461 - protein, 25 aa, artificial
  peptide fold or domain or sub-domain
AFNGSHPFSGSELLTDLNTPEPEKQ

SEQ ID NO: 462 - protein, 24 aa, artificial
  peptide fold or domain or sub-domain
AFNKFLRGKDHQEQEQGRKEFTEA

SEQ ID NO: 463 - protein, 28 aa, artificial
  peptide fold or domain or sub-domain
AFNQVVEVNVKVEKPGDNNVHNNAFYAE

SEQ ID NO: 464 - protein, 22 aa, artificial
  peptide fold or domain or sub-domain
AFQDGEPWKRRETDPEYAEALM

SEQ ID NO: 465 - protein, 27 aa, artificial
  peptide fold or domain or sub-domain
AFQSMWDSSQEHGVPLRTGAFTVSLRR

SEQ ID NO: 466 - protein, 27 aa, artificial
  peptide fold or domain or sub-domain
AFRKEILSKGSSKDPMQQYIDWRGQEP

SEQ ID NO: 467 - protein, 29 aa, artificial
  peptide fold or domain or sub-domain
AFRLFQAVRMTWQENLYAPADWQPGSPCV

SEQ ID NO: 468 - protein, 26 aa, artificial
  peptide fold or domain or sub-domain
AFRLGKETILLRTGWPQFDEEKAELI

SEQ ID NO: 469 - protein, 26 aa, artificial
  peptide fold or domain or sub-domain
AFRPEVLGVWQQYFHGSTSLQLCLRE

SEQ ID NO: 470 - protein, 20 aa, artificial
  peptide fold or domain or sub-domain
AFSGFDPNIIAEAFKINIET

SEQ ID NO: 471 - protein, 30 aa, artificial
  peptide fold or domain or sub-domain
AFSLLPLLHQFDRKLLEQFFADGLRLIHYD

SEQ ID NO: 472 - protein, 29 aa, artificial
  peptide fold or domain or sub-domain
AFSPEGQLLATCDTDCHVRVWEVKSGKLL

SEQ ID NO: 473 - protein, 26 aa, artificial
  peptide fold or domain or sub-domain
AFVGVNSRGIHLINAISKMMILSVGY

SEQ ID NO: 474 - protein, 29 aa, artificial
  peptide fold or domain or sub-domain
AFVGYSNNKTHGIGRWVNASHVEEENKEF

SEQ ID NO: 475 - protein, 30 aa, artificial
  peptide fold or domain or sub-domain
AFVLGTKAGVDPKALYEIISNATGHSAQIA

SEQ ID NO: 476 - protein, 24 aa, artificial
  peptide fold or domain or sub-domain
AFYCKKTLQMATTKTSPSGPEDRI

SEQ ID NO: 477 - protein, 27 aa, artificial
  peptide fold or domain or sub-domain
AFYDVYNTAKEKNIHMRDAAYVVAVQR

SEQ ID NO: 478 - protein, 21 aa, artificial
  peptide fold or domain or sub-domain
AGAALYAADHAMTLAQGVELA

SEQ ID NO: 479 - protein, 29 aa, artificial
  peptide fold or domain or sub-domain
AGAASNMQGSAWCGQVKNRCTRDVNIVKN

SEQ ID NO: 480 - protein, 27 aa, artificial
  peptide fold or domain or sub-domain
AGAEYKEAVFEYVRKEDWPKDLGGECE

SEQ ID NO: 481 - protein, 21 aa, artificial
  peptide fold or domain or sub-domain
AGAGIYVSGLATSYKQGVALA

SEQ ID NO: 482 - protein, 26 aa, artificial
  peptide fold or domain or sub-domain
AGAITLLQKAATIDVDDKLIQSELSK

SEQ ID NO: 483 - protein, 28 aa, artificial
  peptide fold or domain or sub-domain
AGAKGATKEFIDKYNTKYGYVPDDVAAL

SEQ ID NO: 484 - protein, 28 aa, artificial
  peptide fold or domain or sub-domain
AGANKVAVIKAVRGATGLGLKEAKDLVE

SEQ ID NO: 485 - protein, 28 aa, artificial
  peptide fold or domain or sub-domain
AGAVWSKDIEKCERVAARLRMGTVWIND

SEQ ID NO: 486 - protein, 27 aa, artificial
  peptide fold or domain or sub-domain
AGCIAQDLFRFPGAETVYSSDLKLTKL

SEQ ID NO: 487 - protein, 21 aa, artificial
  peptide fold or domain or sub-domain
AGCRFGDCSHVAEVGCAVQQA

SEQ ID NO: 488 - protein, 25 aa, artificial
  peptide fold or domain or sub-domain
AGDAVRDGRVRIEPAELAKRYFAWV

SEQ ID NO: 489 - protein, 22 aa, artificial
  peptide fold or domain or sub-domain
AGDEKIGQIVGAGKERGKELKK

SEQ ID NO: 490 - protein, 28 aa, artificial
  peptide fold or domain or sub-domain
AGDLAVQEAMRIGLNLDARPTAKQMMPL

SEQ ID NO: 491 - protein, 30 aa, artificial
  peptide fold or domain or sub-domain
AGEAGRLTSGETRELTGVLEGAPDAARRAI

SEQ ID NO: 492 - protein, 24 aa, artificial
  peptide fold or domain or sub-domain
AGEALNEHIVGRYWPEAPTRLRIL

SEQ ID NO: 493 - protein, 24 aa, artificial
  peptide fold or domain or sub-domain
AGECRQTMHDLGWDYEPFEVPDEV

SEQ ID NO: 494 - protein, 21 aa, artificial
  peptide fold or domain or sub-domain
AGEIIAFDPRVDSPEHGMQIA

SEQ ID NO: 495 - protein, 26 aa, artificial
  peptide fold or domain or sub-domain
AGEQLAQKMGQGLSQQQAWNKSSIDL

SEQ ID NO: 496 - protein, 28 aa, artificial
  peptide fold or domain or sub-domain
AGEVIKFSDFEKYKSVDACKSVGKCKTK

SEQ ID NO: 497 - protein, 26 aa, artificial
  peptide fold or domain or sub-domain
AGFAGDDPAWGDTLHKPFIGSTSLRD

SEQ ID NO: 498 - protein, 29 aa, artificial
  peptide fold or domain or sub-domain
AGFANYRQWLSGTQLEQNMSIEEYSVSNR

SEQ ID NO: 499 - protein, 23 aa, artificial
  peptide fold or domain or sub-domain
AGFGKQFFGVDDGSDAVSSAYLD

SEQ ID NO: 500 - protein, 26 aa, artificial
  peptide fold or domain or sub-domain
AGFPDGFPAWEEVPWREFAPNSCLPN

SEQ ID NO: 501 - protein, 26 aa, artificial
  peptide fold or domain or sub-domain
AGFPPEHRAWREEPWIHHAPPGCGNA

SEQ ID NO: 502 - protein, 28 aa, artificial
  peptide fold or domain or sub-domain
AGGDTKQQLLSGIGYNSTIFSTEEMHQL

SEQ ID NO: 503 - protein, 26 aa, artificial
  peptide fold or domain or sub-domain
AGGERLRDGVHMLLAKHSPETVSWVN

SEQ ID NO: 504 - protein, 22 aa, artificial
  peptide fold or domain or sub-domain
AGGILFEYAYLKNELDGYIRHL

SEQ ID NO: 505 - protein, 27 aa, artificial
  peptide fold or domain or sub-domain
AGGILFEYAYLKNELDGYIRHLKKLGM

SEQ ID NO: 506 - protein, 22 aa, artificial
  peptide fold or domain or sub-domain
AGGLLTGRYKYQDWKEEHFNGI

SEQ ID NO: 507 - protein, 21 aa, artificial
  peptide fold or domain or sub-domain
AGGMMANTHTEDSVTGAQMTQ

SEQ ID NO: 508 - protein, 27 aa, artificial
  peptide fold or domain or sub-domain
AGGNPGKCSASAGSLMFSEIQEIIDAG

SEQ ID NO: 509 - protein, 28 aa, artificial
  peptide fold or domain or sub-domain
AGGQALDVLSQTEGVTPEKLDHVHTWKT

SEQ ID NO: 510 - protein, 28 aa, artificial
  peptide fold or domain or sub-domain
AGGQAMDLSLVGKHVELDRIVAMHRMKS

SEQ ID NO: 511 - protein, 30 aa, artificial
  peptide fold or domain or sub-domain
AGGQKDEKYYFIQEVAKQTKDRKRIRDELI

SEQ ID NO: 512 - protein, 28 aa, artificial
  peptide fold or domain or sub-domain
AGGQMMDLAAETSDFDLPTVTRLQQLKT

SEQ ID NO: 513 - protein, 28 aa, artificial
  peptide fold or domain or sub-domain
AGGQQLDLEFKNKEATPEQIEIVHRLKT

SEQ ID NO: 514 - protein, 28 aa, artificial
  peptide fold or domain or sub-domain
AGGQYLDLSFEKKKVSKSKIIDMEIKKT

SEQ ID NO: 515 - protein, 28 aa, artificial
  peptide fold or domain or sub-domain
AGGVFTVDGAKAMRVIRKLRAGITWINS

SEQ ID NO: 516 - protein, 30 aa, artificial
  peptide fold or domain or sub-domain
AGGVFTVDGAKAMRVIRKLRAGITWINSYH

SEQ ID NO: 517 - protein, 29 aa, artificial
  peptide fold or domain or sub-domain
AGGYHGDTLGAMTVGQSSPWWQPFQPLLP

SEQ ID NO: 518 - protein, 28 aa, artificial
  peptide fold or domain or sub-domain
AGHAALAPASDLEVELLQELRRTRTHVC

SEQ ID NO: 519 - protein, 28 aa, artificial
  peptide fold or domain or sub-domain
AGHATLPAENEREERVIASLRRRFGHVS

SEQ ID NO: 520 - protein, 28 aa, artificial
  peptide fold or domain or sub-domain
AGHIDFAPTSAIQIELLRYLMVRYHRVS

SEQ ID NO: 521 - protein, 28 aa, artificial
  peptide fold or domain or sub-domain
AGHMRLGAVTTDEARIVAHLVRDLGPVA

SEQ ID NO: 522 - protein, 25 aa, artificial
  peptide fold or domain or sub-domain
AGIATRLWGRLAGGAGDVVAIACLD

SEQ ID NO: 523 - protein, 25 aa, artificial
  peptide fold or domain or sub-domain
AGIDNDPSCKYAYEQNNRTRFIEKS

SEQ ID NO: 524 - protein, 30 aa, artificial
  peptide fold or domain or sub-domain
AGIELEEEVGVNDGIFRGERYFVCPSKRAI

SEQ ID NO: 525 - protein, 20 aa, artificial
  peptide fold or domain or sub-domain
AGIGAKSELDALGIGCKIDL

SEQ ID NO: 526 - protein, 27 aa, artificial
  peptide fold or domain or sub-domain
AGILAQEFVHLPDPRYANPLATEALNQ

SEQ ID NO: 527 - protein, 27 aa, artificial
  peptide fold or domain or sub-domain
AGILIPEGLQANGANIKGGTWFETGAE

SEQ ID NO: 528 - protein, 22 aa, artificial
  peptide fold or domain or sub-domain
AGKERLAACLGVPIQEAAQFLE

SEQ ID NO: 529 - protein, 26 aa, artificial
  peptide fold or domain or sub-domain
AGKIGRLIYEYDARGEADLSDDASLK

SEQ ID NO: 530 - protein, 27 aa, artificial
  peptide fold or domain or sub-domain
AGKWVSEELQWIEQAVVTGKLSNQKKH

SEQ ID NO: 531 - protein, 24 aa, artificial
  peptide fold or domain or sub-domain
AGLDITYAMASLQKVAYSPFPPPS

SEQ ID NO: 532 - protein, 27 aa, artificial
  peptide fold or domain or sub-domain
AGLDREGIDLERNMSQLGTEHRAYVCD

SEQ ID NO: 533 - protein, 30 aa, artificial
  peptide fold or domain or sub-domain
AGLEVVTGSGVCDGKYKGKQYFDCDPKSGL

SEQ ID NO: 534 - protein, 28 aa, artificial
  peptide fold or domain or sub-domain
AGLFDSNPSKIGTVIDGMTVQSIEEADR

SEQ ID NO: 535 - protein, 21 aa, artificial
  peptide fold or domain or sub-domain
AGLGFYANGKVDSIKEGIDLA

SEQ ID NO: 536 - protein, 21 aa, artificial
  peptide fold or domain or sub-domain
AGLTLTDLGIFDKLEDAITDC

SEQ ID NO: 537 - protein, 20 aa, artificial
  peptide fold or domain or sub-domain
AGMDGSYGASHGNGQINYGT

SEQ ID NO: 538 - protein, 23 aa, artificial
  peptide fold or domain or sub-domain
AGMFYFLKDQNEIPRNNPQLRSH

SEQ ID NO: 539 - protein, 24 aa, artificial
  peptide fold or domain or sub-domain
AGMSLIGKKYEEGEAFVPQLLIAS

SEQ ID NO: 540 - protein, 28 aa, artificial
  peptide fold or domain or sub-domain
AGNACERVWREARPLGDFALVEGPLGQL

SEQ ID NO: 541 - protein, 24 aa, artificial
  peptide fold or domain or sub-domain
AGNIMLGLTKVRGKGQAEARQIAE

SEQ ID NO: 542 - protein, 22 aa, artificial
  peptide fold or domain or sub-domain
AGNNQITIVEQNKYLAADMEKK

SEQ ID NO: 543 - protein, 20 aa, artificial
  peptide fold or domain or sub-domain
AGPALVQAAIGAKYSAEELG

SEQ ID NO: 544 - protein, 23 aa, artificial
  peptide fold or domain or sub-domain
AGPITARVNANLPGANLTDADTV

SEQ ID NO: 545 - protein, 22 aa, artificial
  peptide fold or domain or sub-domain
AGPLDDALAQLTGAVEKLGYGP

SEQ ID NO: 546 - protein, 20 aa, artificial
  peptide fold or domain or sub-domain
AGPRVVAAVTGEAPPAGASH

SEQ ID NO: 547 - protein, 27 aa, artificial
  peptide fold or domain or sub-domain
AGPTNGRLAAPGTIRGDYSMSFQENIV

SEQ ID NO: 548 - protein, 27 aa, artificial
  peptide fold or domain or sub-domain
AGPWVKEALDAIWRAVVNGEVENEKER

SEQ ID NO: 549 - protein, 28 aa, artificial
  peptide fold or domain or sub-domain
AGQAALPSTTELEMQLVRHMLNNRTHVP

SEQ ID NO: 550 - protein, 20 aa, artificial
  peptide fold or domain or sub-domain
AGQDGFRDGCRVPIPWTREG

SEQ ID NO: 551 - protein, 23 aa, artificial
  peptide fold or domain or sub-domain
AGQGTLAALEDTISDTAWLSSGT

SEQ ID NO: 552 - protein, 30 aa, artificial
  peptide fold or domain or sub-domain
AGQQQRLDGEQRRSLLLRMEKTFNHLPALV

SEQ ID NO: 553 - protein, 20 aa, artificial
  peptide fold or domain or sub-domain
AGQVGLWEDIVGRGGDITTL

SEQ ID NO: 554 - protein, 20 aa, artificial
  peptide fold or domain or sub-domain
AGQVGLYEDMALKSAKRENL

SEQ ID NO: 555 - protein, 20 aa, artificial
  peptide fold or domain or sub-domain
AGQYAEEVFENLDILAQLQS

SEQ ID NO: 556 - protein, 20 aa, artificial
  peptide fold or domain or sub-domain
AGQYGKQVFNSLKAYDKLTP

SEQ ID NO: 557 - protein, 25 aa, artificial
  peptide fold or domain or sub-domain
AGRHATTHWKSLGWMRESFPDVMVE

SEQ ID NO: 558 - protein, 30 aa, artificial
  peptide fold or domain or sub-domain
AGRPCFGCRNCRRGDLTNCLNIQLMAFAYD

SEQ ID NO: 559 - protein, 25 aa, artificial
  peptide fold or domain or sub-domain
AGRRLTSYPSFREKLQADGYRWEEP

SEQ ID NO: 560 - protein, 25 aa, artificial
  peptide fold or domain or sub-domain
AGRRVTSHWRYINQLKTQFPDLTVD

SEQ ID NO: 561 - protein, 22 aa, artificial
  peptide fold or domain or sub-domain
AGSEGIKMLSYPTGAVPSGAVV

SEQ ID NO: 562 - protein, 26 aa, artificial
  peptide fold or domain or sub-domain
AGSEGLTVEDDNGDHVTDLLHVTNSI

SEQ ID NO: 563 - protein, 26 aa, artificial
  peptide fold or domain or sub-domain
AGSEKASESTISAIRNKEGSYINKSL

SEQ ID NO: 564 - protein, 26 aa, artificial
  peptide fold or domain or sub-domain
AGSEKVGKTGASGQTLEEAKKINKSL

SEQ ID NO: 565 - protein, 26 aa, artificial
  peptide fold or domain or sub-domain
AGSERALATDQRTLRSLEGANINRSL

SEQ ID NO: 566 - protein, 26 aa, artificial
  peptide fold or domain or sub-domain
AGSERINVSQVVGDRLRETQNINKSL

SEQ ID NO: 567 - protein, 26 aa, artificial
  peptide fold or domain or sub-domain
AGSERLKRTGATGERAKEGISINCGL

SEQ ID NO: 568 - protein, 26 aa, artificial
  peptide fold or domain or sub-domain
AGSERLVGSHNSDEKIRQGVSINKSL

SEQ ID NO: 569 - protein, 28 aa, artificial
  peptide fold or domain or sub-domain
AGSKCEHAWRSQRKNNDWTGFEKNWAEV

SEQ ID NO: 570 - protein, 28 aa, artificial
  peptide fold or domain or sub-domain
AGSSTKMQILEGLGLNLQKSSEKELHRG

SEQ ID NO: 571 - protein, 27 aa, artificial
  peptide fold or domain or sub-domain
AGSVGTFAGTFWEKPTINSFESGMELF

SEQ ID NO: 572 - protein, 22 aa, artificial
  peptide fold or domain or sub-domain
AGTGMIASILGCNNRQANEAMA

SEQ ID NO: 573 - protein, 29 aa, artificial
  peptide fold or domain or sub-domain
AGTIWALEKYAAHEEWNEIQAPGTGTERA

SEQ ID NO: 574 - protein, 26 aa, artificial
  peptide fold or domain or sub-domain
AGTSSKIENYLGFPTGISGQELADRA

SEQ ID NO: 575 - protein, 25 aa, artificial
  peptide fold or domain or sub-domain
AGVCEEMTYEEIQDNYPLEFALRDQ

SEQ ID NO: 576 - protein, 30 aa, artificial
  peptide fold or domain or sub-domain
AGVCEEMTYEEIQDNYPLEFALRDQDKYRY

SEQ ID NO: 577 - protein, 30 aa, artificial
  peptide fold or domain or sub-domain
AGVEFKNQIGAGTGVFNKEQLFHSKDGHAG

SEQ ID NO: 578 - protein, 30 aa, artificial
  peptide fold or domain or sub-domain
AGVELVGCEGRNDGTVKGVFYFTCAAGQGL

SEQ ID NO: 579 - protein, 28 aa, artificial
  peptide fold or domain or sub-domain
AGVSPGHGGELIGDLPVFDLVDLAVKTV

SEQ ID NO: 580 - protein, 28 aa, artificial
  peptide fold or domain or sub-domain
AGVTLREGAKDFEGIPLYGNIGEAVEAT

SEQ ID NO: 581 - protein, 28 aa, artificial
  peptide fold or domain or sub-domain
AGVTPGKGGMEVLGVPVYDTVKEAVAHH

SEQ ID NO: 582 - protein, 30 aa, artificial
  peptide fold or domain or sub-domain
AGVVWTNDLRRAQRVVSQIDSGLLWINCWY

SEQ ID NO: 583 - protein, 28 aa, artificial
  peptide fold or domain or sub-domain
AGYAFTTSAANAYKLGEELEVGNLAINH

SEQ ID NO: 584 - protein, 22 aa, artificial
  peptide fold or domain or sub-domain
AGYEGGSGLNTPGTKVPTGALC

SEQ ID NO: 585 - protein, 20 aa, artificial
  peptide fold or domain or sub-domain
AGYFAWSCQPDGTKNSWGPA

SEQ ID NO: 586 - protein, 30 aa, artificial
  peptide fold or domain or sub-domain
AGYFYSQNISTIFDAAEKLNVGMVGVNTGE

SEQ ID NO: 587 - protein, 24 aa, artificial
  peptide fold or domain or sub-domain
AGYGREDYFNSILTDADGNSISMI

SEQ ID NO: 588 - protein, 27 aa, artificial
  peptide fold or domain or sub-domain
AGYLLSYIYKLISINPIIILPWIMLLI

SEQ ID NO: 589 - protein, 25 aa, artificial
  peptide fold or domain or sub-domain
AGYLNMIFELEHNVREGKPGEERLN

SEQ ID NO: 590 - protein, 28 aa, artificial
  peptide fold or domain or sub-domain
AGYVIGKDKETLHKVARSIEAGTVEINE

SEQ ID NO: 591 - protein, 25 aa, artificial
  peptide fold or domain or sub-domain
AHANLAAAYKDTGLLEASIISYKQA

SEQ ID NO: 592 - protein, 25 aa, artificial
  peptide fold or domain or sub-domain
AHCNLGVTLYHQGKLSEAIAAYQRA

SEQ ID NO: 593 - protein, 29 aa, artificial
  peptide fold or domain or sub-domain
AHCSLLQDKLEHLHGEESRAWLRKRLARL

SEQ ID NO: 594 - protein, 29 aa, artificial
  peptide fold or domain or sub-domain
AHDAESRAQALILGLGFKVSELDHPVNSF

SEQ ID NO: 595 - protein, 21 aa, artificial
  peptide fold or domain or sub-domain
AHEAGIGQYFNFTLEQFSDQM

SEQ ID NO: 596 - protein, 26 aa, artificial
  peptide fold or domain or sub-domain
AHFSPDNPAWADAGHRPFVTPFQQDG

SEQ ID NO: 597 - protein, 28 aa, artificial
  peptide fold or domain or sub-domain
AHFYAQPQWDEHKNRETFGRCYTQYGHG

SEQ ID NO: 598 - protein, 24 aa, artificial
  peptide fold or domain or sub-domain
AHGKLDHKGLSYMHGTQQVYYVDF

SEQ ID NO: 599 - protein, 25 aa, artificial
  peptide fold or domain or sub-domain
AHGTPIMLKAQQLGITPEQMIGEMS

SEQ ID NO: 600 - protein, 24 aa, artificial
  peptide fold or domain or sub-domain
AHHDVYNTKFEGSVGYVPEKPRFF

SEQ ID NO: 601 - protein, 29 aa, artificial
  peptide fold or domain or sub-domain
AHHIIWGSSDINLRGSSLMEYLSSTDLGL

SEQ ID NO: 602 - protein, 29 aa, artificial
  peptide fold or domain or sub-domain
AHHTQWGSSDTNVRGESLFSFILNSNLFI

SEQ ID NO: 603 - protein, 28 aa, artificial
  peptide fold or domain or sub-domain
AHIGNVLDQPVGDKIAAVAGIDNLYAVK

SEQ ID NO: 604 - protein, 22 aa, artificial
  peptide fold or domain or sub-domain
AHIHWIFNNDTLLITEKMTTSQ

SEQ ID NO: 605 - protein, 29 aa, artificial
  peptide fold or domain or sub-domain
AHIKTLPKTEGLVPIYISPQTGDFVGENI

SEQ ID NO: 606 - protein, 20 aa, artificial
  peptide fold or domain or sub-domain
AHKPIEEISPQERQAAKAVN

SEQ ID NO: 607 - protein, 20 aa, artificial
  peptide fold or domain or sub-domain
AHLATCIDERNRVIGEGGRI

SEQ ID NO: 608 - protein, 25 aa, artificial
  peptide fold or domain or sub-domain
AHLEDIKILIQSVSFFNNKAKHLIT

SEQ ID NO: 609 - protein, 23 aa, artificial
  peptide fold or domain or sub-domain
AHLMTQQMDLHANLNGMDPMVAT

SEQ ID NO: 610 - protein, 25 aa, artificial
  peptide fold or domain or sub-domain
AHLNLGNLYKVTGMRQDAIVCFQNA

SEQ ID NO: 611 - protein, 27 aa, artificial
  peptide fold or domain or sub-domain
AHNIAMSLLRKEMRKSGITKENEFEYR

SEQ ID NO: 612 - protein, 28 aa, artificial
  peptide fold or domain or sub-domain
AHNTTLTEILKGLKFNLTETSEAEIHQS

SEQ ID NO: 613 - protein, 30 aa, artificial
  peptide fold or domain or sub-domain
AHPRLFGKRTPEEIATALAPLLRRPVEQLA

SEQ ID NO: 614 - protein, 29 aa, artificial
  peptide fold or domain or sub-domain
AHPVMEWLSGRDLHGNPVALEAEELWRAL

SEQ ID NO: 615 - protein, 29 aa, artificial
  peptide fold or domain or sub-domain
AHPVRALLAQKDIAYHPIEIDCIDFVDWL

SEQ ID NO: 616 - protein, 26 aa, artificial
  peptide fold or domain or sub-domain
AHQAVQIHGGNGIMTEYAVSRAFGDA

SEQ ID NO: 617 - protein, 26 aa, artificial
  peptide fold or domain or sub-domain
AHQSIQVLGGMGYVSDMPAERHYRDA

SEQ ID NO: 618 - protein, 30 aa, artificial
  peptide fold or domain or sub-domain
AHRESAAALAALLAPIEPTITPESIQAQFD

SEQ ID NO: 619 - protein, 29 aa, artificial
  peptide fold or domain or sub-domain
AHRLDSVYSEPDTYKPGRFREPNAEDKAA

SEQ ID NO: 620 - protein, 30 aa, artificial
  peptide fold or domain or sub-domain
AHRSLVQAQQVPDPSGPPTFRLSLLSNHQG

SEQ ID NO: 621 - protein, 29 aa, artificial
  peptide fold or domain or sub-domain
AHSAEARAATILHGLSFTQDMMTSPTKQL

SEQ ID NO: 622 - protein, 29 aa, artificial
  peptide fold or domain or sub-domain
AHSAEARAGAILSGLGFDAQAQRQPASAF

SEQ ID NO: 623 - protein, 25 aa, artificial
  peptide fold or domain or sub-domain
AHSEVDLNPAKTYEIFFNDSRNLGD

SEQ ID NO: 624 - protein, 28 aa, artificial
  peptide fold or domain or sub-domain
AHSLLKTKLSIGRLRQRFHQYHESKVLV

SEQ ID NO: 625 - protein, 24 aa, artificial
  peptide fold or domain or sub-domain
AHTLKQLVAAKLKLNEEQVEDYFF

SEQ ID NO: 626 - protein, 29 aa, artificial
  peptide fold or domain or sub-domain
AHTVWNGDLFEGSGNTTLDSSGLGTYAVT

SEQ ID NO: 627 - protein, 30 aa, artificial
  peptide fold or domain or sub-domain
AHVERLTFIRNCRTLDMTLDEIRSLLRLRD

SEQ ID NO: 628 - protein, 30 aa, artificial
  peptide fold or domain or sub-domain
AHVLAEKSGLGSGNLEALIEQQYGPLPFSM

SEQ ID NO: 629 - protein, 27 aa, artificial
  peptide fold or domain or sub-domain
AHVLCTQRAFDSLKAHYSHIDFNYTIV

SEQ ID NO: 630 - protein, 22 aa, artificial
  peptide fold or domain or sub-domain
AHVNHDQSKHGLLNPDGPDEGD

SEQ ID NO: 631 - protein, 20 aa, artificial
  peptide fold or domain or sub-domain
AHWKGTQMYEKGSYANGRSR

SEQ ID NO: 632 - protein, 28 aa, artificial
  peptide fold or domain or sub-domain
AHYRDYGFDDEKLHQEGIGRIGDVYTRS

SEQ ID NO: 633 - protein, 20 aa, artificial
  peptide fold or domain or sub-domain
AIAALNTAGVYDKISAKLVF

SEQ ID NO: 634 - protein, 23 aa, artificial
  peptide fold or domain or sub-domain
AIADYTADKTVNEIRELFNIEND

SEQ ID NO: 635 - protein, 29 aa, artificial
  peptide fold or domain or sub-domain
AIAEAESEGETVKAVTLARWLHVSAPAVT

SEQ ID NO: 636 - protein, 23 aa, artificial
  peptide fold or domain or sub-domain
AIAEGGRSGHVSVDDGPIDLDLS

SEQ ID NO: 637 - protein, 30 aa, artificial
  peptide fold or domain or sub-domain
AIAKINEKPHGLIESGFINPSQISLLKQAQ

SEQ ID NO: 638 - protein, 30 aa, artificial
  peptide fold or domain or sub-domain
AIALPYAMEYNMGHCMEKLARIAVAMGQNT

SEQ ID NO: 639 - protein, 25 aa, artificial
  peptide fold or domain or sub-domain
AIANDREQAKVLLTESEYNRYKENL

SEQ ID NO: 640 - protein, 24 aa, artificial
  peptide fold or domain or sub-domain
AIAQLFRNNREWVDRVNAEDPTFF

SEQ ID NO: 641 - protein, 27 aa, artificial
  peptide fold or domain or sub-domain
AIASFDKALQLKPDEEIYINNRNEALK

SEQ ID NO: 642 - protein, 22 aa, artificial
  peptide fold or domain or sub-domain
AIASYYKALQLKPDYYEAWHNR

SEQ ID NO: 643 - protein, 25 aa, artificial
  peptide fold or domain or sub-domain
AIATEDPRVVEAAAAFGAEAILTSA

SEQ ID NO: 644 - protein, 25 aa, artificial
  peptide fold or domain or sub-domain
AIAVGGELVDAKTIKEGRFDVIEDR

SEQ ID NO: 645 - protein, 23 aa, artificial
  peptide fold or domain or sub-domain
AIAVQPLINALKDQDEEVRMNAA

SEQ ID NO: 646 - protein, 30 aa, artificial
  peptide fold or domain or sub-domain
AICGISNDDILHCMGNGTSVGQGGTATSQA

SEQ ID NO: 647 - protein, 20 aa, artificial
  peptide fold or domain or sub-domain
AICHEVLDGKRIRLQKLGAP

SEQ ID NO: 648 - protein, 30 aa, artificial
  peptide fold or domain or sub-domain
AICTEAGMMAIREDRDIVTMDDFLKAVDRV

SEQ ID NO: 649 - protein, 27 aa, artificial
  peptide fold or domain or sub-domain
AICTKNNHKIDPTDMGEEGIGRYVVSF

SEQ ID NO: 650 - protein, 25 aa, artificial
  peptide fold or domain or sub-domain
AIDAARAFVTDEWEVDADAVARGFE

SEQ ID NO: 651 - protein, 26 aa, artificial
  peptide fold or domain or sub-domain
AIDAIKKSVKTDGTPEDVAKDAEAEM

SEQ ID NO: 652 - protein, 28 aa, artificial
  peptide fold or domain or sub-domain
AIDDPRQVAYTTPGCASLSRRKTLASVL

SEQ ID NO: 653 - protein, 26 aa, artificial
  peptide fold or domain or sub-domain
AIDFAYRGFEAQVVPSFEEKLENTEC

SEQ ID NO: 654 - protein, 26 aa, artificial
  peptide fold or domain or sub-domain
AIDFAYRGHDTRISTFMDRAITESSC

SEQ ID NO: 655 - protein, 27 aa, artificial
  peptide fold or domain or sub-domain
AIDFTTHRRTTLQDPYAVAKDKRDFSH

SEQ ID NO: 656 - protein, 26 aa, artificial
  peptide fold or domain or sub-domain
AIDHIKKAGKAGELTEDEVKDLQEKV

SEQ ID NO: 657 - protein, 28 aa, artificial
  peptide fold or domain or sub-domain
AIDSQIAGKRSILRALPVDVVAKAYLLS

SEQ ID NO: 658 - protein, 30 aa, artificial
  peptide fold or domain or sub-domain
AIDTFTKYLDIDEDFATVLVEEGFSTLEEL

SEQ ID NO: 659 - protein, 24 aa, artificial
  peptide fold or domain or sub-domain
AIDTMKQTLSSSTLIHTTINRETL

SEQ ID NO: 660 - protein, 28 aa, artificial
  peptide fold or domain or sub-domain
AIDYLLSHDLRNLDIGTYHISPEVILMV

SEQ ID NO: 661 - protein, 30 aa, artificial
  peptide fold or domain or sub-domain
AIEAAEETPRPDPASMFENVYAEMPQRLEQ

SEQ ID NO: 662 - protein, 22 aa, artificial
  peptide fold or domain or sub-domain
AIECLSQALKLQPGHTDAEYYR

SEQ ID NO: 663 - protein, 27 aa, artificial
  peptide fold or domain or sub-domain
AIECYDKAMAVNPKYDGAWHNKGFALH

SEQ ID NO: 664 - protein, 22 aa, artificial
  peptide fold or domain or sub-domain
AIECYDRVVALEPKNANAWYAR

SEQ ID NO: 665 - protein, 25 aa, artificial
  peptide fold or domain or sub-domain
AIENNIEDFELSRKLVELNTNVEIK

SEQ ID NO: 666 - protein, 21 aa, artificial
  peptide fold or domain or sub-domain
AIESLVAPLDMARTVPMDARA

SEQ ID NO: 667 - protein, 30 aa, artificial
  peptide fold or domain or sub-domain
AIFGISQNKGDLLQDGYMNGEQLNMLERQL

SEQ ID NO: 668 - protein, 26 aa, artificial
  peptide fold or domain or sub-domain
AIGARREASVEAFRDSLANTELASAT

SEQ ID NO: 669 - protein, 26 aa, artificial
  peptide fold or domain or sub-domain
AIGFINKGPDTMVATSMDRGMGNVAC

SEQ ID NO: 670 - protein, 26 aa, artificial
  peptide fold or domain or sub-domain
AIGMVNRGFKTMVAPSFGRSLKDSPC

SEQ ID NO: 671 - protein, 22 aa, artificial
  peptide fold or domain or sub-domain
AIGSCGQAVKLAPDSANAWFIR

SEQ ID NO: 672 - protein, 23 aa, artificial
  peptide fold or domain or sub-domain
AIGTIEKFPGRYVLAPGELDRRK

SEQ ID NO: 673 - protein, 25 aa, artificial
  peptide fold or domain or sub-domain
AIGWDGQGGESGALRFLRRAKPEDI

SEQ ID NO: 674 - protein, 30 aa, artificial
  peptide fold or domain or sub-domain
AIHGILTNSGDFLHDAFLSGAQVDMARTAY

SEQ ID NO: 675 - protein, 27 aa, artificial
  peptide fold or domain or sub-domain
AIIDYLALKQQQHYASASICRALIAIK

SEQ ID NO: 676 - protein, 26 aa, artificial
  peptide fold or domain or sub-domain
AIIFGNRAKKMRIQPTFGVTLQETSC

SEQ ID NO: 677 - protein, 21 aa, artificial
  peptide fold or domain or sub-domain
AIIFQPNTLAARVYGKLETHE

SEQ ID NO: 678 - protein, 30 aa, artificial
  peptide fold or domain or sub-domain
AIIYPQFTRYTYAWAIEKFAKVGRIFNPAL

SEQ ID NO: 679 - protein, 30 aa, artificial
  peptide fold or domain or sub-domain
AIKCGKCENCVRGNYNLCEHNGFVGLQSDG

SEQ ID NO: 680 - protein, 22 aa, artificial
  peptide fold or domain or sub-domain
AIKCYDKAIYMNPKYDSAWHKM

SEQ ID NO: 681 - protein, 22 aa, artificial
  peptide fold or domain or sub-domain
AIKCYNEAISINPNQEDVWNCK

SEQ ID NO: 682 - protein, 29 aa, artificial
  peptide fold or domain or sub-domain
AIKEATGSLQQASEILALCGDQIDVLSGD

SEQ ID NO: 683 - protein, 29 aa, artificial
  peptide fold or domain or sub-domain
AIKESTTDTRRLTELQSRFGDRFNILCGV

SEQ ID NO: 684 - protein, 28 aa, artificial
  peptide fold or domain or sub-domain
AIKFIQEHDLKSLKDGINVINDKLFYNK

SEQ ID NO: 685 - protein, 27 aa, artificial
  peptide fold or domain or sub-domain
AIKFYNKAIEIDPQNSEALSNKGFALY

SEQ ID NO: 686 - protein, 27 aa, artificial
  peptide fold or domain or sub-domain
AIKGVFAVADEYNVTLREAVYMYAIKS

SEQ ID NO: 687 - protein, 30 aa, artificial
  peptide fold or domain or sub-domain
AIKKADETPKQKVTDLISIMFEELPFNLKE

SEQ ID NO: 688 - protein, 22 aa, artificial
  peptide fold or domain or sub-domain
AIKSYDKAIEFNSDAYESFYNK

SEQ ID NO: 689 - protein, 27 aa, artificial
  peptide fold or domain or sub-domain
AIKTASVPAKEAAAAKPVETASIKPEP

SEQ ID NO: 690 - protein, 24 aa, artificial
  peptide fold or domain or sub-domain
AIKYHPDKHAQSPEHVRHNATVRF

SEQ ID NO: 691 - protein, 27 aa, artificial
  peptide fold or domain or sub-domain
AILDLDEEQARDAAASLGPEHIGLACN

SEQ ID NO: 692 - protein, 27 aa, artificial
  peptide fold or domain or sub-domain
AILDYLAKLGRDGMKPTTIQRRRSALS

SEQ ID NO: 693 - protein, 30 aa, artificial
  peptide fold or domain or sub-domain
AILLAPVMRYNMAACEERLAILADTVSPGG

SEQ ID NO: 694 - protein, 30 aa, artificial
  peptide fold or domain or sub-domain
AILLEAVIDYTKPVIISELAGIAKYLNPEK

SEQ ID NO: 695 - protein, 30 aa, artificial
  peptide fold or domain or sub-domain
AILLPHVMRYNADFTGEKYRDIARVMGVKV

SEQ ID NO: 696 - protein, 30 aa, artificial
  peptide fold or domain or sub-domain
AILLPIVENFNRPNAVARFARIAQAMGVET

SEQ ID NO: 697 - protein, 30 aa, artificial
  peptide fold or domain or sub-domain
AILLPTVLEYTKGSAVKRLAEIGRCLNKDL

SEQ ID NO: 698 - protein, 30 aa, artificial
  peptide fold or domain or sub-domain
AILLPYVMDFNFIATPKRFLDIATCLGIDT

SEQ ID NO: 699 - protein, 28 aa, artificial
  peptide fold or domain or sub-domain
AILLSNPKPSLVRDTVQKFKSYLIYVES

SEQ ID NO: 700 - protein, 30 aa, artificial
  peptide fold or domain or sub-domain
AILNEALILAIRNNKDQIDKHFLEQAIKRI

SEQ ID NO: 701 - protein, 29 aa, artificial
  peptide fold or domain or sub-domain
AILTNNGDKNFVTNKILSQFLNIKPPSVS

SEQ ID NO: 702 - protein, 28 aa, artificial
  peptide fold or domain or sub-domain
AIMPWYGYNIEDAIVINKKTASKFRSRK

SEQ ID NO: 703 - protein, 20 aa, artificial
  peptide fold or domain or sub-domain
AINANGEPGQFEEYGLPVIA

SEQ ID NO: 704 - protein, 20 aa, artificial
  peptide fold or domain or sub-domain
AINGNDMTEAHHDAAVACLT

SEQ ID NO: 705 - protein, 30 aa, artificial
  peptide fold or domain or sub-domain
AINKVRELFGSDKNVKELWWFRSLLVKGVY

SEQ ID NO: 706 - protein, 21 aa, artificial
  peptide fold or domain or sub-domain
AINSYLRNNRVPNNDELNKKI

SEQ ID NO: 707 - protein, 26 aa, artificial
  peptide fold or domain or sub-domain
AINSYLRNNRVPNNDELNKKIELISS

SEQ ID NO: 708 - protein, 20 aa, artificial
  peptide fold or domain or sub-domain
AINVRLIRDMQCFHIESRGW

SEQ ID NO: 709 - protein, 27 aa, artificial
  peptide fold or domain or sub-domain
AINYNRDKDAAEALKEKLHGSEIFKAD

SEQ ID NO: 710 - protein, 29 aa, artificial
  peptide fold or domain or sub-domain
AINYPEDVYKNMNEWCIKHHNESGLIDRC

SEQ ID NO: 711 - protein, 21 aa, artificial
  peptide fold or domain or sub-domain
AIPELLHRRRLLSDDLVEQLF

SEQ ID NO: 712 - protein, 25 aa, artificial
  peptide fold or domain or sub-domain
AIPRLLARMPEDYTGRQRYLDLFTD

SEQ ID NO: 713 - protein, 23 aa, artificial
  peptide fold or domain or sub-domain
AIPSDFITVASTESCPFAIMANE

SEQ ID NO: 714 - protein, 30 aa, artificial
  peptide fold or domain or sub-domain
AIQAAEKWEKQPLTELFNDVYDVKPKNLEE

SEQ ID NO: 715 - protein, 26 aa, artificial
  peptide fold or domain or sub-domain
AIQDLVIDDNHISFAATFDSEPMSIN

SEQ ID NO: 716 - protein, 27 aa, artificial
  peptide fold or domain or sub-domain
AIQFHAFIVYLHAVDSGWLIPGFLVTA

SEQ ID NO: 717 - protein, 20 aa, artificial
  peptide fold or domain or sub-domain
AIRAMPEEVVMTAYQVSRDE

SEQ ID NO: 718 - protein, 25 aa, artificial
  peptide fold or domain or sub-domain
AIRAVESGQIKIVPERFTKVYLHWM

SEQ ID NO: 719 - protein, 23 aa, artificial
  peptide fold or domain or sub-domain
AIRNNNSKMYELVGENTGFDSIV

SEQ ID NO: 720 - protein, 29 aa, artificial
  peptide fold or domain or sub-domain
AIRSDNGSEFKNSAFESFCDSSGVEHQFS

SEQ ID NO: 721 - protein, 20 aa, artificial
  peptide fold or domain or sub-domain
AIRSMKINRDVFNEWYDEGQ

SEQ ID NO: 722 - protein, 27 aa, artificial
  peptide fold or domain or sub-domain
AISFTGSTAVGLSIQERAAGKKVQLEM

SEQ ID NO: 723 - protein, 30 aa, artificial
  peptide fold or domain or sub-domain
AISGSRVPDGFENRSLPHFEKHSKLPAAKG

SEQ ID NO: 724 - protein, 30 aa, artificial
  peptide fold or domain or sub-domain
AISLGKKLGIDPKVLSSIMNTASGRCWSSE

SEQ ID NO: 725 - protein, 30 aa, artificial
  peptide fold or domain or sub-domain
AISNKDIADGLKSQHGYSIDKKKIVLKEPI

SEQ ID NO: 726 - protein, 20 aa, artificial
  peptide fold or domain or sub-domain
AISPDYGGEGEYDKAQKLLE

SEQ ID NO: 727 - protein, 26 aa, artificial
  peptide fold or domain or sub-domain
AISRIKVLEKAKEISENDMHALLKKI

SEQ ID NO: 728 - protein, 28 aa, artificial
  peptide fold or domain or sub-domain
AISRSELRRLIRSGAVRVDKSKEDDEIK

SEQ ID NO: 729 - protein, 20 aa, artificial
  peptide fold or domain or sub-domain
AISSTDIRWRVKNNKPIKYL

SEQ ID NO: 730 - protein, 26 aa, artificial
  peptide fold or domain or sub-domain
AISVVGRGFDARIAVEHDAPLTDSAC

SEQ ID NO: 731 - protein, 27 aa, artificial
  peptide fold or domain or sub-domain
AITDYSEVITLEPTNAMALNDRGFVLN

SEQ ID NO: 732 - protein, 22 aa, artificial
  peptide fold or domain or sub-domain
AITEVLRLGGDIYDGNLVMSHI

SEQ ID NO: 733 - protein, 25 aa, artificial
  peptide fold or domain or sub-domain
AITINLKDNEITLTNADKKKIKADI

SEQ ID NO: 734 - protein, 30 aa, artificial
  peptide fold or domain or sub-domain
AITKEDLSAALMAQKGIEVDKKSFELKTPI

SEQ ID NO: 735 - protein, 22 aa, artificial
  peptide fold or domain or sub-domain
AITNLYNQDPAYLNDIDKINGA

SEQ ID NO: 736 - protein, 23 aa, artificial
  peptide fold or domain or sub-domain
AITVAAKDPSWYGIDEAELEKRR

SEQ ID NO: 737 - protein, 30 aa, artificial
  peptide fold or domain or sub-domain
AIVAVDLDDARLAAARTYGATHVVNGAADV

SEQ ID NO: 738 - protein, 27 aa, artificial
  peptide fold or domain or sub-domain
AIVAYNKIISLRPGNHETWLKRGLILE

SEQ ID NO: 739 - protein, 28 aa, artificial
  peptide fold or domain or sub-domain
AIVDITSAADCLVFARVTETEQTLIALN

SEQ ID NO: 740 - protein, 28 aa, artificial
  peptide fold or domain or sub-domain
AIVGKLVLDGLKKQRPLQDIPLKEYQSI

SEQ ID NO: 741 - protein, 23 aa, artificial
  peptide fold or domain or sub-domain
AIVLSVIDSDTLRVRYKSNEERF

SEQ ID NO: 742 - protein, 26 aa, artificial
  peptide fold or domain or sub-domain
AIVNKNEVYSAHNQKVIDFRGKVVPL

SEQ ID NO: 743 - protein, 21 aa, artificial
  peptide fold or domain or sub-domain
AIVQNASSDNQGIQLSAVQAA

SEQ ID NO: 744 - protein, 26 aa, artificial
  peptide fold or domain or sub-domain
AIVQSVGVSGGRLLIKLKDGRKVETD

SEQ ID NO: 745 - protein, 24 aa, artificial
  peptide fold or domain or sub-domain
AIVSADAFENLKPAPDIFLAASKT

SEQ ID NO: 746 - protein, 22 aa, artificial
  peptide fold or domain or sub-domain
AIVVTRPDQPAGLLHWAAESAP

SEQ ID NO: 747 - protein, 30 aa, artificial
  peptide fold or domain or sub-domain
AIYHIEQNSGEFIADGYMSNEQLSWLHNHY

SEQ ID NO: 748 - protein, 29 aa, artificial
  peptide fold or domain or sub-domain
AIYLLQQQVGAVTTTLLGEQRGSRPASVT

SEQ ID NO: 749 - protein, 29 aa, artificial
  peptide fold or domain or sub-domain
AIYLLSRESIDVSITELSKKMNVSKPTSN

SEQ ID NO: 750 - protein, 21 aa, artificial
  peptide fold or domain or sub-domain
AIYNASHPIYKCMNCDVQADI

SEQ ID NO: 751 - protein, 29 aa, artificial
  peptide fold or domain or sub-domain
AIYSLEEDGLPVNADRLAALTGLKISNQQ

SEQ ID NO: 752 - protein, 29 aa, artificial
  peptide fold or domain or sub-domain
AIYSLSKEKGYAKVMELSEVLNVKPATVS

SEQ ID NO: 753 - protein, 20 aa, artificial
  peptide fold or domain or sub-domain
AIYTILRSVHINKKSREQFE

SEQ ID NO: 754 - protein, 28 aa, artificial
  peptide fold or domain or sub-domain
AKADGYNNWQQARVESDFGLFAPSLRTM

SEQ ID NO: 755 - protein, 20 aa, artificial
  peptide fold or domain or sub-domain
AKAFLDELSESQPALTKKLS

SEQ ID NO: 756 - protein, 30 aa, artificial
  peptide fold or domain or sub-domain
AKAIQNLANQVEFSKEPYMEAINPFIVINK

SEQ ID NO: 757 - protein, 23 aa, artificial
  peptide fold or domain or sub-domain
AKAISIVDGDSISVVINQELVRV

SEQ ID NO: 758 - protein, 23 aa, artificial
  peptide fold or domain or sub-domain
AKAKLPELDDTFAKKLDIKEETM

SEQ ID NO: 759 - protein, 25 aa, artificial
  peptide fold or domain or sub-domain
AKAKVKAQHGDAPFAELCTHCEKEA

SEQ ID NO: 760 - protein, 21 aa, artificial
  peptide fold or domain or sub-domain
AKAMGYSPEDTLFEVLFANSE

SEQ ID NO: 761 - protein, 29 aa, artificial
  peptide fold or domain or sub-domain
AKARAESHLENDDDNTDIHRAERALERAN

SEQ ID NO: 762 - protein, 28 aa, artificial
  peptide fold or domain or sub-domain
AKARIMQLMTHENAEVKYYALHTVAKLV

SEQ ID NO: 763 - protein, 21 aa, artificial
  peptide fold or domain or sub-domain
AKASGRPNAHLLPVPTARENF

SEQ ID NO: 764 - protein, 30 aa, artificial
  peptide fold or domain or sub-domain
AKAVECYRKGLELDPNNENCQQNLSIAEEK

SEQ ID NO: 765 - protein, 26 aa, artificial
  peptide fold or domain or sub-domain
AKDAIDKLIKDGEVGEDEGRRAEKEL

SEQ ID NO: 766 - protein, 24 aa, artificial
  peptide fold or domain or sub-domain
AKDGSLHSADGRNKNIFLQGQLQE

SEQ ID NO: 767 - protein, 29 aa, artificial
  peptide fold or domain or sub-domain
AKEEAERILANRGETIDVAKAQQQLVEAV

SEQ ID NO: 768 - protein, 30 aa, artificial
  peptide fold or domain or sub-domain
AKEEIDEDETLLDHLVKYTNDPKILHDEVL

SEQ ID NO: 769 - protein, 23 aa, artificial
  peptide fold or domain or sub-domain
AKEFYKEQEGTPHFEDLIREMTS

SEQ ID NO: 770 - protein, 24 aa, artificial
  peptide fold or domain or sub-domain
AKEHHPDRFVNSSDSEKKYHENKM

SEQ ID NO: 771 - protein, 30 aa, artificial
  peptide fold or domain or sub-domain
AKEIMRQRQLEIKTTKVPLDEIDKTSDILG

SEQ ID NO: 772 - protein, 25 aa, artificial
  peptide fold or domain or sub-domain
AKEKDWLSIVSGRTKPMSAFMTNKL

SEQ ID NO: 773 - protein, 28 aa, artificial
  peptide fold or domain or sub-domain
AKEKIRGLIEYFGFSNPEDYAYFTEHEE

SEQ ID NO: 774 - protein, 26 aa, artificial
  peptide fold or domain or sub-domain
AKELIEVAEKDGDISGDDAEKALEKM

SEQ ID NO: 775 - protein, 29 aa, artificial
  peptide fold or domain or sub-domain
AKERAEQRLAQAKEKLDSARAQAALQRAM

SEQ ID NO: 776 - protein, 28 aa, artificial
  peptide fold or domain or sub-domain
AKERVMKLINHENAEVTKNAILCIQRLL

SEQ ID NO: 777 - protein, 21 aa, artificial
  peptide fold or domain or sub-domain
AKETLVKLKEDKDIAVTQKSL

SEQ ID NO: 778 - protein, 27 aa, artificial
  peptide fold or domain or sub-domain
AKFAELTKSLASTKGSGDNVEDSALAS

SEQ ID NO: 779 - protein, 21 aa, artificial
  peptide fold or domain or sub-domain
AKFCKENMAGKGFSFWVWLDN

SEQ ID NO: 780 - protein, 25 aa, artificial
  peptide fold or domain or sub-domain
AKFDTFVDFYQGKLNAMSAVMTGKI

SEQ ID NO: 781 - protein, 20 aa, artificial
  peptide fold or domain or sub-domain
AKFESAGEAERETGIWGSHI

SEQ ID NO: 782 - protein, 29 aa, artificial
  peptide fold or domain or sub-domain
AKFIGIIECGGINLKLEELEWKLAEVGAI

SEQ ID NO: 783 - protein, 26 aa, artificial
  peptide fold or domain or sub-domain
AKFWLSADNANAATGIVKQQFAEADQ

SEQ ID NO: 784 - protein, 29 aa, artificial
  peptide fold or domain or sub-domain
AKGGVWSYLTEAIQEGGASAWERANEALI

SEQ ID NO: 785 - protein, 23 aa, artificial
  peptide fold or domain or sub-domain
AKGLLQTKHGMTEPDAFKWIQRA

SEQ ID NO: 786 - protein, 28 aa, artificial
  peptide fold or domain or sub-domain
AKGNTAAQMSQALSFSKIGGEDGDIHQG

SEQ ID NO: 787 - protein, 28 aa, artificial
  peptide fold or domain or sub-domain
AKGSTHHQILKGLRLSLIDMTEREVHKC

SEQ ID NO: 788 - protein, 24 aa, artificial
  peptide fold or domain or sub-domain
AKGWKAKGWTRGKGEEIKNLALIQ

SEQ ID NO: 789 - protein, 21 aa, artificial
  peptide fold or domain or sub-domain
AKGYEYGRTAVHISESEHNIT

SEQ ID NO: 790 - protein, 29 aa, artificial
  peptide fold or domain or sub-domain
AKHAWWGNPRSCPRGKMLQEVIAHGQYQV

SEQ ID NO: 791 - protein, 23 aa, artificial
  peptide fold or domain or sub-domain
AKHDVKVLHEVDNHDTGEKFEFY

SEQ ID NO: 792 - protein, 29 aa, artificial
  peptide fold or domain or sub-domain
AKHINWGSRRSNRNGNILNGFTDQHLDIS

SEQ ID NO: 793 - protein, 20 aa, artificial
  peptide fold or domain or sub-domain
AKHKELFYLDKSGHLICCDL

SEQ ID NO: 794 - protein, 29 aa, artificial
  peptide fold or domain or sub-domain
AKHLERALAEVVLGDHPDVLERTAYTQAA

SEQ ID NO: 795 - protein, 21 aa, artificial
  peptide fold or domain or sub-domain
AKIAAIPVDTITKGEYLAYAG

SEQ ID NO: 796 - protein, 28 aa, artificial
  peptide fold or domain or sub-domain
AKIDLNRFNELPELKNANMAKIEYGKFL

SEQ ID NO: 797 - protein, 30 aa, artificial
  peptide fold or domain or sub-domain
AKIEDFEKVLVNPAATPVQRKEALMFIVHF

SEQ ID NO: 798 - protein, 30 aa, artificial
  peptide fold or domain or sub-domain
AKIIQSVANGTSSTKTHLDVSFQPMLKEYE

SEQ ID NO: 799 - protein, 23 aa, artificial
  peptide fold or domain or sub-domain
AKIIRIVDGDTAELLYGELPITL

SEQ ID NO: 800 - protein, 24 aa, artificial
  peptide fold or domain or sub-domain
AKIKEHKDTWDPTVTRDYIDAFFE

SEQ ID NO: 801 - protein, 25 aa, artificial
  peptide fold or domain or sub-domain
AKILAEKKFPNAPFEVRQKACEQFS

SEQ ID NO: 802 - protein, 28 aa, artificial
  peptide fold or domain or sub-domain
AKISTKGLQYSLTDEDLMFGKRIGTRNK

SEQ ID NO: 803 - protein, 27 aa, artificial
  peptide fold or domain or sub-domain
AKIYISGLWTRFLPHFGVYDQRRVVAL

SEQ ID NO: 804 - protein, 27 aa, artificial
  peptide fold or domain or sub-domain
AKKAKIEKSLDSTFEMTVADVFYDKLI

SEQ ID NO: 805 - protein, 27 aa, artificial
  peptide fold or domain or sub-domain
AKKFKELGTTAFKEKNYPEAIKQYLEA

SEQ ID NO: 806 - protein, 23 aa, artificial
  peptide fold or domain or sub-domain
AKKFYEVHAERPFYGELVGQMTA

SEQ ID NO: 807 - protein, 25 aa, artificial
  peptide fold or domain or sub-domain
AKKKVQTECASMPFDDQCTVLEKEA

SEQ ID NO: 808 - protein, 27 aa, artificial
  peptide fold or domain or sub-domain
AKKNKDEGNELFRDGNTEMAVQRYIKA

SEQ ID NO: 809 - protein, 29 aa, artificial
  peptide fold or domain or sub-domain
AKKRAEENIRTRHGDANYEMLASKLSKEL

SEQ ID NO: 810 - protein, 27 aa, artificial
  peptide fold or domain or sub-domain
AKKRLQQLQQDPLWGQLRAVKAGKVYE

SEQ ID NO: 811 - protein, 24 aa, artificial
  peptide fold or domain or sub-domain
AKKWVQNGFVLSTNEPVQNQDLWR

SEQ ID NO: 812 - protein, 27 aa, artificial
  peptide fold or domain or sub-domain
AKLICSRPAAKVLKATFPHWEERFQTV

SEQ ID NO: 813 - protein, 23 aa, artificial
  peptide fold or domain or sub-domain
AKLKLQRLNLNRQSRVNEVITKL

SEQ ID NO: 814 - protein, 25 aa, artificial
  peptide fold or domain or sub-domain
AKLKVLEKDPHGDLDTHCRDCEKES

SEQ ID NO: 815 - protein, 27 aa, artificial
  peptide fold or domain or sub-domain
AKLLRRLVDKHGWDIDDYKMAETLVDD

SEQ ID NO: 816 - protein, 29 aa, artificial
  peptide fold or domain or sub-domain
AKLRAERRLKGAEGNINEARAEMALRRSL

SEQ ID NO: 817 - protein, 25 aa, artificial
  peptide fold or domain or sub-domain
AKLRTQLASSHLSFDEQCRNCEKES

SEQ ID NO: 818 - protein, 20 aa, artificial
  peptide fold or domain or sub-domain
AKLSELTVDLAEERSTAHIA

SEQ ID NO: 819 - protein, 27 aa, artificial
  peptide fold or domain or sub-domain
AKLWISKEDMPYACGKLKRKGVKRIIQ

SEQ ID NO: 820 - protein, 24 aa, artificial
  peptide fold or domain or sub-domain
AKMKAADEKKFKATVSPMRTDGGW

SEQ ID NO: 821 - protein, 26 aa, artificial
  peptide fold or domain or sub-domain
AKNEIQNVVEAENFSEDVLYGAEEDL

SEQ ID NO: 822 - protein, 23 aa, artificial
  peptide fold or domain or sub-domain
AKNIEQQLSKKDPVNKDFYKHNL

SEQ ID NO: 823 - protein, 23 aa, artificial
  peptide fold or domain or sub-domain
AKNINDALKQTFPEYKDYFEQNY

SEQ ID NO: 824 - protein, 30 aa, artificial
  peptide fold or domain or sub-domain
AKNLREAIGYADSVHDYVSRDMMIEILRDE

SEQ ID NO: 825 - protein, 26 aa, artificial
  peptide fold or domain or sub-domain
AKNMKKLGLMKGEVEDIVSLGAHAFF

SEQ ID NO: 826 - protein, 30 aa, artificial
  peptide fold or domain or sub-domain
AKPAAIRNFVNVKDQMMAVCSHTIEKDLGL

SEQ ID NO: 827 - protein, 24 aa, artificial
  peptide fold or domain or sub-domain
AKPEDLYDLIKESGMYRQKAERIV

SEQ ID NO: 828 - protein, 25 aa, artificial
  peptide fold or domain or sub-domain
AKPEDLYDLIKESGMYRQKAERIVE

SEQ ID NO: 829 - protein, 23 aa, artificial
  peptide fold or domain or sub-domain
AKPIVERFNALASDFNFTINDIF

SEQ ID NO: 830 - protein, 29 aa, artificial
  peptide fold or domain or sub-domain
AKQAAEARMAGHTDQMEYAAAQAELLEQI

SEQ ID NO: 831 - protein, 28 aa, artificial
  peptide fold or domain or sub-domain
AKQEIMKQARNDDQMIRENALLSLQKIM

SEQ ID NO: 832 - protein, 29 aa, artificial
  peptide fold or domain or sub-domain
AKQFYDDVKDNTYESKGWAKSAYGISKLC

SEQ ID NO: 833 - protein, 24 aa, artificial
  peptide fold or domain or sub-domain
AKQHLGKAIAERSGEPFPAYDIYH

SEQ ID NO: 834 - protein, 20 aa, artificial
  peptide fold or domain or sub-domain
AKQYLEDQGLYGEVKDNLVY

SEQ ID NO: 835 - protein, 22 aa, artificial
  peptide fold or domain or sub-domain
AKRGKLTRDARAYLARHLPAEA

SEQ ID NO: 836 - protein, 29 aa, artificial
  peptide fold or domain or sub-domain
AKRKAEEHISSSHGDVDYAQASAELAKAI

SEQ ID NO: 837 - protein, 29 aa, artificial
  peptide fold or domain or sub-domain
AKRKAEEIMKNKISEIEYARAQAELIEAT

SEQ ID NO: 838 - protein, 29 aa, artificial
  peptide fold or domain or sub-domain
AKRKAIKKLLAACEDPRQRTILDKQQLAI

SEQ ID NO: 839 - protein, 26 aa, artificial
  peptide fold or domain or sub-domain
AKRKIVDYLKIRNMQLSDEEIENAVS

SEQ ID NO: 840 - protein, 21 aa, artificial
  peptide fold or domain or sub-domain
AKRLGVEQQFTEGRTQEEWMR

SEQ ID NO: 841 - protein, 30 aa, artificial
  peptide fold or domain or sub-domain
AKRVYALIQTADQGSVWRSDDGGVNWAVVN

SEQ ID NO: 842 - protein, 28 aa, artificial
  peptide fold or domain or sub-domain
AKSESHQQILSGLSLNQTQVPEEDMHEA

SEQ ID NO: 843 - protein, 23 aa, artificial
  peptide fold or domain or sub-domain
AKSIMAKGDGIYVTDTNNKEYID

SEQ ID NO: 844 - protein, 25 aa, artificial
  peptide fold or domain or sub-domain
AKSKFYEEAVKRYAPFTGTSYEAGV

SEQ ID NO: 845 - protein, 28 aa, artificial
  peptide fold or domain or sub-domain
AKSKSEARTFIQSGAVSVNGIKVDSLEH

SEQ ID NO: 846 - protein, 25 aa, artificial
  peptide fold or domain or sub-domain
AKSKVISELGDSAFEDQCGRCEREA

SEQ ID NO: 847 - protein, 28 aa, artificial
  peptide fold or domain or sub-domain
AKSLAFAFAPFISDDIYATAIMKQSEIE

SEQ ID NO: 848 - protein, 29 aa, artificial
  peptide fold or domain or sub-domain
AKSLWWGSSSEGHRGEAYRSFLDATGLQI

SEQ ID NO: 849 - protein, 27 aa, artificial
  peptide fold or domain or sub-domain
AKSNHCVRTDHRKKTADIYPFPIEGHS

SEQ ID NO: 850 - protein, 29 aa, artificial
  peptide fold or domain or sub-domain
AKSPEWGGETQDERGRLLSEWLATLNCVV

SEQ ID NO: 851 - protein, 28 aa, artificial
  peptide fold or domain or sub-domain
AKSQAQQAWTQARQHDDFSRFAPHLERL

SEQ ID NO: 852 - protein, 29 aa, artificial
  peptide fold or domain or sub-domain
AKSQGLPVNLDKLTADDKQYMLSMAYDRY

SEQ ID NO: 853 - protein, 29 aa, artificial
  peptide fold or domain or sub-domain
AKSSAWGSTSTNARGAVLEEWALTSGLCL

SEQ ID NO: 854 - protein, 29 aa, artificial
  peptide fold or domain or sub-domain
AKSTEWGMPYSDRRGSLLADWIAQHDLTA

SEQ ID NO: 855 - protein, 29 aa, artificial
  peptide fold or domain or sub-domain
AKSTWWGSKEDDARGDQLMGTLGELGLHI

SEQ ID NO: 856 - protein, 29 aa, artificial
  peptide fold or domain or sub-domain
AKSYLWGNVSEDKRGKELADLIGELEMWV

SEQ ID NO: 857 - protein, 27 aa, artificial
  peptide fold or domain or sub-domain
AKTLDLWSAALQANKGQAIALQSEEVY

SEQ ID NO: 858 - protein, 20 aa, artificial
  peptide fold or domain or sub-domain
AKTRASTFQVTANKSVPVQM

SEQ ID NO: 859 - protein, 25 aa, artificial
  peptide fold or domain or sub-domain
AKTVVLENRCSCNGRDTLEVLTEEN

SEQ ID NO: 860 - protein, 29 aa, artificial
  peptide fold or domain or sub-domain
AKVRIDDGGDTTMLPGELIELRQVEQVNE

SEQ ID NO: 861 - protein, 27 aa, artificial
  peptide fold or domain or sub-domain
AKVSISYRDAALLSGDESLREGETTPL

SEQ ID NO: 862 - protein, 23 aa, artificial
  peptide fold or domain or sub-domain
AKVSRVVDGDTIEAKFEDEELKI

SEQ ID NO: 863 - protein, 27 aa, artificial
  peptide fold or domain or sub-domain
AKVVCTPKAKTFLIDLLPIPEDKFITV

SEQ ID NO: 864 - protein, 27 aa, artificial
  peptide fold or domain or sub-domain
AKVYKEKGTNYFKKENWALAIKMYTKC

SEQ ID NO: 865 - protein, 25 aa, artificial
  peptide fold or domain or sub-domain
AKYHIDVYTMTENKPVTIYRSSQIF

SEQ ID NO: 866 - protein, 25 aa, artificial
  peptide fold or domain or sub-domain
AKYLKTSADGTIFRGRKDKSGFVAR

SEQ ID NO: 867 - protein, 25 aa, artificial
  peptide fold or domain or sub-domain
AKYRHKVFIQELGWTLPTDNGIEFD

SEQ ID NO: 868 - protein, 22 aa, artificial
  peptide fold or domain or sub-domain
AKYSPLRSTGRGGFHASPPAPL

SEQ ID NO: 869 - protein, 20 aa, artificial
  peptide fold or domain or sub-domain
ALAALVALGFSSKEVNKINP

SEQ ID NO: 870 - protein, 27 aa, artificial
  peptide fold or domain or sub-domain
ALADFNKAIELKKDYAIAYWNKSLVLL

SEQ ID NO: 871 - protein, 29 aa, artificial
  peptide fold or domain or sub-domain
ALADLAEHDEPVFADQLVRCLHIEPEQLL

SEQ ID NO: 872 - protein, 21 aa, artificial
  peptide fold or domain or sub-domain
ALADLIKGYGFTEIDPIPTYQ

SEQ ID NO: 873 - protein, 26 aa, artificial
  peptide fold or domain or sub-domain
ALAIEGSGLERMVALRDADGYPNSVC

SEQ ID NO: 874 - protein, 25 aa, artificial
  peptide fold or domain or sub-domain
ALAKVLTIIPENAPHREQYVKDLKA

SEQ ID NO: 875 - protein, 26 aa, artificial
  peptide fold or domain or sub-domain
ALAKYHFTPTQATKENLLKENIDPSK

SEQ ID NO: 876 - protein, 22 aa, artificial
  peptide fold or domain or sub-domain
ALALFDQALAIKPDHARSLNNR

SEQ ID NO: 877 - protein, 23 aa, artificial
  peptide fold or domain or sub-domain
ALARIIEGKNPEEIREIFHLPDD

SEQ ID NO: 878 - protein, 28 aa, artificial
  peptide fold or domain or sub-domain
ALARTAVSEGFPHAPTGDPMKDGVGPAS

SEQ ID NO: 879 - protein, 27 aa, artificial
  peptide fold or domain or sub-domain
ALASYDKAIGLNPDCIEAYCGQGNALL

SEQ ID NO: 880 - protein, 22 aa, artificial
  peptide fold or domain or sub-domain
ALASYEKAIALNPCFADAYYNK

SEQ ID NO: 881 - protein, 22 aa, artificial
  peptide fold or domain or sub-domain
ALATYERVLELRRDDPVVYNNR

SEQ ID NO: 882 - protein, 23 aa, artificial
  peptide fold or domain or sub-domain
ALAVGIVMHRHSLGRTQALDRLR

SEQ ID NO: 883 - protein, 30 aa, artificial
  peptide fold or domain or sub-domain
ALAVRKVRKIWASMPGAGYGQPEVALERLQ

SEQ ID NO: 884 - protein, 27 aa, artificial
  peptide fold or domain or sub-domain
ALAWRHAQDLEAILDPATRTNRLCELN

SEQ ID NO: 885 - protein, 26 aa, artificial
  peptide fold or domain or sub-domain
ALAYQTLLQAAKLEPETKAIQMELAI

SEQ ID NO: 886 - protein, 30 aa, artificial
  peptide fold or domain or sub-domain
ALCSRAGLIASKREAEKITFDDFKAALKHV

SEQ ID NO: 887 - protein, 30 aa, artificial
  peptide fold or domain or sub-domain
ALDAFQEQHNRLPNIGCLQDAEVLLKLTEE

SEQ ID NO: 888 - protein, 30 aa, artificial
  peptide fold or domain or sub-domain
ALDAPVTRWLPEFRPRLADGSEPLVTIHHL

SEQ ID NO: 889 - protein, 29 aa, artificial
  peptide fold or domain or sub-domain
ALDATLRRAGADVARQLDFQALRDLAHIY

SEQ ID NO: 890 - protein, 22 aa, artificial
  peptide fold or domain or sub-domain
ALDCYERAFRINPDYPGIWNHK

SEQ ID NO: 891 - protein, 30 aa, artificial
  peptide fold or domain or sub-domain
ALDDPVALYMPELDPGVFSKNGEHATIRHL

SEQ ID NO: 892 - protein, 27 aa, artificial
  peptide fold or domain or sub-domain
ALDESHAAEVNATWPHRFAGSEEYYCS

SEQ ID NO: 893 - protein, 29 aa, artificial
  peptide fold or domain or sub-domain
ALDEWHRSNPGPVKDKAAYKSFLRELGYL

SEQ ID NO: 894 - protein, 23 aa, artificial
  peptide fold or domain or sub-domain
ALDFHVDHQSRPFFNELIQFITT

SEQ ID NO: 895 - protein, 30 aa, artificial
  peptide fold or domain or sub-domain
ALDHWRSQHDGQVPITYADKKKFRLYVKSL

SEQ ID NO: 896 - protein, 21 aa, artificial
  peptide fold or domain or sub-domain
ALDILIDTKFAKNKEDAQSKI

SEQ ID NO: 897 - protein, 30 aa, artificial
  peptide fold or domain or sub-domain
ALDRIWKDIGTYRNVDYVAPNKAKAIHKLT

SEQ ID NO: 898 - protein, 27 aa, artificial
  peptide fold or domain or sub-domain
ALDSLAQSLEKEPENYGLWLQQGLILL

SEQ ID NO: 899 - protein, 21 aa, artificial
  peptide fold or domain or sub-domain
ALDVTDLAKIKQYNLNKAFKH

SEQ ID NO: 900 - protein, 27 aa, artificial
  peptide fold or domain or sub-domain
ALDVVTANGDLVHCNSQQNSDLYWAAR

SEQ ID NO: 901 - protein, 21 aa, artificial
  peptide fold or domain or sub-domain
ALDYEAYMLRYDHGTQVIADI

SEQ ID NO: 902 - protein, 30 aa, artificial
  peptide fold or domain or sub-domain
ALEAARAAGCEGWLWGNIVSELAGADEALA

SEQ ID NO: 903 - protein, 27 aa, artificial
  peptide fold or domain or sub-domain
ALEAFDSVLEIYPETKEIWYNRALALV

SEQ ID NO: 904 - protein, 27 aa, artificial
  peptide fold or domain or sub-domain
ALEAKKKKVFNRSFSMEVEESFYDELI

SEQ ID NO: 905 - protein, 22 aa, artificial
  peptide fold or domain or sub-domain
ALECFDQVVRIDPTCGRFWLAR

SEQ ID NO: 906 - protein, 27 aa, artificial
  peptide fold or domain or sub-domain
ALECFDRVLRIDPGNASALKSRAWSLY

SEQ ID NO: 907 - protein, 27 aa, artificial
  peptide fold or domain or sub-domain
ALECYDSVLETESGHAVVWYMKALDLD

SEQ ID NO: 908 - protein, 22 aa, artificial
  peptide fold or domain or sub-domain
ALECYEKALEINLENDETWANK

SEQ ID NO: 909 - protein, 27 aa, artificial
  peptide fold or domain or sub-domain
ALECYEKALEINLENDETWANKGVLLR

SEQ ID NO: 910 - protein, 22 aa, artificial
  peptide fold or domain or sub-domain
ALEETLAAGEDPFDGEAIVSHA

SEQ ID NO: 911 - protein, 27 aa, artificial
  peptide fold or domain or sub-domain
ALEFAVNGDEWTMNSNSTFKNYTLKWK

SEQ ID NO: 912 - protein, 29 aa, artificial
  peptide fold or domain or sub-domain
ALERARERLARRTPDIDVLRAELAMRRAL

SEQ ID NO: 913 - protein, 22 aa, artificial
  peptide fold or domain or sub-domain
ALESFNQVIKFNPNNYQAWYGR

SEQ ID NO: 914 - protein, 25 aa, artificial
  peptide fold or domain or sub-domain
ALFNLGIAYMNLGEYQTAAQSILDA

SEQ ID NO: 915 - protein, 29 aa, artificial
  peptide fold or domain or sub-domain
ALFRAEEWDEEPTTGKLAEVIGVTASTVS

SEQ ID NO: 916 - protein, 23 aa, artificial
  peptide fold or domain or sub-domain
ALFSRPDLYQQLKNDFSTLQDPF

SEQ ID NO: 917 - protein, 27 aa, artificial
  peptide fold or domain or sub-domain
ALFVTTKKGVKMAKLYHELPEARIKIV

SEQ ID NO: 918 - protein, 27 aa, artificial
  peptide fold or domain or sub-domain
ALGADYVPVWDYRAPQQPNDIKDASAG

SEQ ID NO: 919 - protein, 28 aa, artificial
  peptide fold or domain or sub-domain
ALGCSANPINNQSPGNWTPDRAGWCPGM

SEQ ID NO: 920 - protein, 25 aa, artificial
  peptide fold or domain or sub-domain
ALGWNGKGGEAELLKVLRATPAEEI

SEQ ID NO: 921 - protein, 27 aa, artificial
  peptide fold or domain or sub-domain
ALHCLNDSREALSIADDDGLTRSAAGI

SEQ ID NO: 922 - protein, 23 aa, artificial
  peptide fold or domain or sub-domain
ALHEHPKYKEWLRSGNSREREMF

SEQ ID NO: 923 - protein, 23 aa, artificial
  peptide fold or domain or sub-domain
ALHEHPPLRSRLRAGEPGLLQNT

SEQ ID NO: 924 - protein, 22 aa, artificial
  peptide fold or domain or sub-domain
ALHEVLRAGYSKKDGGKIIQQT

SEQ ID NO: 925 - protein, 27 aa, artificial
  peptide fold or domain or sub-domain
ALHLVTSQGCGDDGPTDVPNNVYGWGR

SEQ ID NO: 926 - protein, 24 aa, artificial
  peptide fold or domain or sub-domain
ALHPFREAMRASLAQALDTHVTRV

SEQ ID NO: 927 - protein, 24 aa, artificial
  peptide fold or domain or sub-domain
ALHPQTIKDNARFFNDCIENVPTH

SEQ ID NO: 928 - protein, 30 aa, artificial
  peptide fold or domain or sub-domain
ALHQFCAQHGRPPRPRNEEDAAELVALAQA

SEQ ID NO: 929 - protein, 23 aa, artificial
  peptide fold or domain or sub-domain
ALHRETTWRELFRSGNLELAGDF

SEQ ID NO: 930 - protein, 23 aa, artificial
  peptide fold or domain or sub-domain
ALHTHPQVREKLQAGDEDYAECF

SEQ ID NO: 931 - protein, 25 aa, artificial
  peptide fold or domain or sub-domain
ALIFGELAIDRDCCEVTREGKPISL

SEQ ID NO: 932 - protein, 30 aa, artificial
  peptide fold or domain or sub-domain
ALIFSTIVFTNFNLFYNIVREIGNNRVIVS

SEQ ID NO: 933 - protein, 29 aa, artificial
  peptide fold or domain or sub-domain
ALKAAEKALQGKGAEFDYSAAAARLAEAA

SEQ ID NO: 934 - protein, 23 aa, artificial
  peptide fold or domain or sub-domain
ALKAYKTDNNPKVGRGNAIMAGM

SEQ ID NO: 935 - protein, 29 aa, artificial
  peptide fold or domain or sub-domain
ALKDCGVDLERPLRIRATVKKDFNILTGN

SEQ ID NO: 936 - protein, 27 aa, artificial
  peptide fold or domain or sub-domain
ALKDYDKAIQINPEYSNAYLNRALLLC

SEQ ID NO: 937 - protein, 24 aa, artificial
  peptide fold or domain or sub-domain
ALKNIVDGFHRFRTEVFPQQKEFY

SEQ ID NO: 938 - protein, 20 aa, artificial
  peptide fold or domain or sub-domain
ALKQDLLSLQNQNSDALKVF

SEQ ID NO: 939 - protein, 27 aa, artificial
  peptide fold or domain or sub-domain
ALKSTSVVERPGERTTASEQAIERAME

SEQ ID NO: 940 - protein, 26 aa, artificial
  peptide fold or domain or sub-domain
ALKSYDKLEKEKKLSEDNVKDLSSDL

SEQ ID NO: 941 - protein, 20 aa, artificial
  peptide fold or domain or sub-domain
ALKVYRNNKELFDRWYREGA

SEQ ID NO: 942 - protein, 20 aa, artificial
  peptide fold or domain or sub-domain
ALLALAGLGFRRAEAWPVLS

SEQ ID NO: 943 - protein, 30 aa, artificial
  peptide fold or domain or sub-domain
ALLDSTHKKINYLEELGHRLGLANLAYLVA

SEQ ID NO: 944 - protein, 27 aa, artificial
  peptide fold or domain or sub-domain
ALLDYLTWRTQQHYSPLSNARLLSVLR

SEQ ID NO: 945 - protein, 23 aa, artificial
  peptide fold or domain or sub-domain
ALLEDPIIHEIADRHRASPAQVL

SEQ ID NO: 946 - protein, 30 aa, artificial
  peptide fold or domain or sub-domain
ALLESQNKKVAFLKKAVATLGLQGIECLWG

SEQ ID NO: 947 - protein, 30 aa, artificial
  peptide fold or domain or sub-domain
ALLGRLGPLRRVVIPKAAGSDVRDPEMRAA

SEQ ID NO: 948 - protein, 25 aa, artificial
  peptide fold or domain or sub-domain
ALLITADKIVQEDVSTDEIDLMKAG

SEQ ID NO: 949 - protein, 30 aa, artificial
  peptide fold or domain or sub-domain
ALLLESVIDYNFEVCPERYETIAQTMNVDC

SEQ ID NO: 950 - protein, 24 aa, artificial
  peptide fold or domain or sub-domain
ALLNHPDRVGKDPVAQEQARQQMS

SEQ ID NO: 951 - protein, 30 aa, artificial
  peptide fold or domain or sub-domain
ALLQEKILEEEYQAEIAELKKITAHLPQVI

SEQ ID NO: 952 - protein, 25 aa, artificial
  peptide fold or domain or sub-domain
ALLQVRSILQQLGLEGTCDDSIIVK

SEQ ID NO: 953 - protein, 29 aa, artificial
  peptide fold or domain or sub-domain
ALLQVWMNFKEAVVDEDIDLFKNVHGVTK

SEQ ID NO: 954 - protein, 25 aa, artificial
  peptide fold or domain or sub-domain
ALLRALLEPTAELRKLEAPGDYTAR

SEQ ID NO: 955 - protein, 30 aa, artificial
  peptide fold or domain or sub-domain
ALLRFFDKHGRLPELHNLSEANEVVSLAKA

SEQ ID NO: 956 - protein, 27 aa, artificial
  peptide fold or domain or sub-domain
ALLSKRKIKKLIENKVIKSIDDPSLPT

SEQ ID NO: 957 - protein, 30 aa, artificial
  peptide fold or domain or sub-domain
ALLSRFNQQRFVCFHPAIRNASQWRNIAFE

SEQ ID NO: 958 - protein, 27 aa, artificial
  peptide fold or domain or sub-domain
ALLSYERAIAIKQDYAEAYRNRGVVLK

SEQ ID NO: 959 - protein, 23 aa, artificial
  peptide fold or domain or sub-domain
ALLTEPQLVELAEKHKRSAAQVI

SEQ ID NO: 960 - protein, 27 aa, artificial
  peptide fold or domain or sub-domain
ALMCYDRAIAIKPNDSESQLKRRKLLS

SEQ ID NO: 961 - protein, 22 aa, artificial
  peptide fold or domain or sub-domain
ALMEVLDSGGRPRNGSAIVAAI

SEQ ID NO: 962 - protein, 23 aa, artificial
  peptide fold or domain or sub-domain
ALMGQKGGMEEGIAEREGLTFYG

SEQ ID NO: 963 - protein, 22 aa, artificial
  peptide fold or domain or sub-domain
ALMILTPWPQYAKIAPGDIAAR

SEQ ID NO: 964 - protein, 30 aa, artificial
  peptide fold or domain or sub-domain
ALMLGPVLRFNAKAAASLYAELADVLGVPG

SEQ ID NO: 965 - protein, 29 aa, artificial
  peptide fold or domain or sub-domain
ALMRAWPLVHTAVVEPETEPYVKANGEAA

SEQ ID NO: 966 - protein, 25 aa, artificial
  peptide fold or domain or sub-domain
ALNDKAEGSSALVTGTNPSGNWADN

SEQ ID NO: 967 - protein, 22 aa, artificial
  peptide fold or domain or sub-domain
ALNESLTEGANPRNGTDLSHRM

SEQ ID NO: 968 - protein, 22 aa, artificial
  peptide fold or domain or sub-domain
ALNQTLSEGGSITNGTDIISNI

SEQ ID NO: 969 - protein, 22 aa, artificial
  peptide fold or domain or sub-domain
ALNRSIATGNPNPTGTEFCEVA

SEQ ID NO: 970 - protein, 23 aa, artificial
  peptide fold or domain or sub-domain
ALPDFAITAVATDDGEIMAIENE

SEQ ID NO: 971 - protein, 23 aa, artificial
  peptide fold or domain or sub-domain
ALPEGFEVVATSSNAPFAFIADE

SEQ ID NO: 972 - protein, 20 aa, artificial
  peptide fold or domain or sub-domain
ALPEVSQAYQQAGQAGHQVV

SEQ ID NO: 973 - protein, 27 aa, artificial
  peptide fold or domain or sub-domain
ALPGYSEVPEFKSSAVKIWYDKGLAFD

SEQ ID NO: 974 - protein, 25 aa, artificial
  peptide fold or domain or sub-domain
ALPLIINDLPDDHPSRPRYIELYKK

SEQ ID NO: 975 - protein, 23 aa, artificial
  peptide fold or domain or sub-domain
ALPNGYETIGRTKNSPFAVIAHV

SEQ ID NO: 976 - protein, 20 aa, artificial
  peptide fold or domain or sub-domain
ALPRDEIARCAAEHPQYRIG

SEQ ID NO: 977 - protein, 29 aa, artificial
  peptide fold or domain or sub-domain
ALQDYAKSKGYKLDSDWGAQDWEKLTVTY

SEQ ID NO: 978 - protein, 30 aa, artificial
  peptide fold or domain or sub-domain
ALQEFIQINFRYPHPWNQKDAQTMLEISKS

SEQ ID NO: 979 - protein, 24 aa, artificial
  peptide fold or domain or sub-domain
ALQLHPDRNPDDPQAQEKFQDLGA

SEQ ID NO: 980 - protein, 27 aa, artificial
  peptide fold or domain or sub-domain
ALQLNEDALAALMTLGFPKPAAQKAIS

SEQ ID NO: 981 - protein, 21 aa, artificial
  peptide fold or domain or sub-domain
ALQMYLVSGLESDELKGFEAV

SEQ ID NO: 982 - protein, 23 aa, artificial
  peptide fold or domain or sub-domain
ALQQHPEWKDILNAGQDADLDCF

SEQ ID NO: 983 - protein, 25 aa, artificial
  peptide fold or domain or sub-domain
ALQRRQFNAPQAEDEVLLMDYLVHQ

SEQ ID NO: 984 - protein, 30 aa, artificial
  peptide fold or domain or sub-domain
ALQSWHPAVSIDEVCERTGFTFDTRGAEPT

SEQ ID NO: 985 - protein, 30 aa, artificial
  peptide fold or domain or sub-domain
ALQSWKASHNDIPPKNYQEKNQFRKHVEAM

SEQ ID NO: 986 - protein, 30 aa, artificial
  peptide fold or domain or sub-domain
ALQVADRFPEPTPAEIVDHVFAEPTPQLVR

SEQ ID NO: 987 - protein, 22 aa, artificial
  peptide fold or domain or sub-domain
ALQWVLRFKLIDSESLYQRFSK

SEQ ID NO: 988 - protein, 23 aa, artificial
  peptide fold or domain or sub-domain
ALRDYRDSLFKTLGPDSGGDIST

SEQ ID NO: 989 - protein, 30 aa, artificial
  peptide fold or domain or sub-domain
ALREVAPGVTVDEVVAATGTPLEIRESELV

SEQ ID NO: 990 - protein, 21 aa, artificial
  peptide fold or domain or sub-domain
ALRIGGNETEQKFTESKSYME

SEQ ID NO: 991 - protein, 25 aa, artificial
  peptide fold or domain or sub-domain
ALRIVNDRSWFDAQSAEVQQTIMAG

SEQ ID NO: 992 - protein, 30 aa, artificial
  peptide fold or domain or sub-domain
ALRLGHAVRGHMVNLVADNEKLRQRAYRIL

SEQ ID NO: 993 - protein, 29 aa, artificial
  peptide fold or domain or sub-domain
ALRLVQAFQYTDEHGEVCPAGWKPGSDTI

SEQ ID NO: 994 - protein, 23 aa, artificial
  peptide fold or domain or sub-domain
ALRNNHSTIFEKLGADVGVDSLG

SEQ ID NO: 995 - protein, 20 aa, artificial
  peptide fold or domain or sub-domain
ALSAAGDPARFARFGIPVLE

SEQ ID NO: 996 - protein, 27 aa, artificial
  peptide fold or domain or sub-domain
ALSADDASTANDVWPNRHQGSLFFLQR

SEQ ID NO: 997 - protein, 30 aa, artificial
  peptide fold or domain or sub-domain
ALSDYKNDNGFLPKPWCENDSHSFVDYVQK

SEQ ID NO: 998 - protein, 27 aa, artificial
  peptide fold or domain or sub-domain
ALSFTGSRSVGEHLREISPIPRITLEL

SEQ ID NO: 999 - protein, 29 aa, artificial
  peptide fold or domain or sub-domain
ALSQARSANEVRFDSELPAEALKKLCDEY

SEQ ID NO: 1000 - protein, 21 aa, artificial
  peptide fold or domain or sub-domain
ALSQGIMSQEFTTQFEATQGL

SEQ ID NO: 1001 - protein, 30 aa, artificial
  peptide fold or domain or sub-domain
ALSQIEKNKAWYLEDGYMEAVKTKAVRKIV

SEQ ID NO: 1002 - protein, 24 aa, artificial
  peptide fold or domain or sub-domain
ALSVAKGLPGGVTPGNIATAMGML

SEQ ID NO: 1003 - protein, 20 aa, artificial
  peptide fold or domain or sub-domain
ALSVHAPDPALAVLGLPQVG

SEQ ID NO: 1004 - protein, 20 aa, artificial
  peptide fold or domain or sub-domain
ALSVWPELTVDQIEKLITGS

SEQ ID NO: 1005 - protein, 21 aa, artificial
  peptide fold or domain or sub-domain
ALSYRQSFFAPEKYNKHKIAI

SEQ ID NO: 1006 - protein, 26 aa, artificial
  peptide fold or domain or sub-domain
ALTAQGHVTKLDGSIFGQFAEQSSIA

SEQ ID NO: 1007 - protein, 26 aa, artificial
  peptide fold or domain or sub-domain
ALTDCTPWLNGVGIGTRFEGTSPYTN

SEQ ID NO: 1008 - protein, 25 aa, artificial
  peptide fold or domain or sub-domain
ALTDVLEVIPEVTPGRGFLVKVLEN

SEQ ID NO: 1009 - protein, 22 aa, artificial
  peptide fold or domain or sub-domain
ALTHTNSTDPAVYGDVDVLVHQ

SEQ ID NO: 1010 - protein, 26 aa, artificial
  peptide fold or domain or sub-domain
ALTIASRGFESRVAASAGEAFMDSEC

SEQ ID NO: 1011 - protein, 30 aa, artificial
  peptide fold or domain or sub-domain
ALTKIVERPDALYEGGHINGEQLKLMREAR

SEQ ID NO: 1012 - protein, 27 aa, artificial
  peptide fold or domain or sub-domain
ALTLMKADGTVLECSESSKADVFQAAR

SEQ ID NO: 1013 - protein, 22 aa, artificial
  peptide fold or domain or sub-domain
ALTQAEIDDLLDRGFPLPEWHT

SEQ ID NO: 1014 - protein, 28 aa, artificial
  peptide fold or domain or sub-domain
ALTSEQNLSEIKKRSEGANEASVKMFEE

SEQ ID NO: 1015 - protein, 28 aa, artificial
  peptide fold or domain or sub-domain
ALVAEGDGIHFDYVYFDHTDVRAYGYLI

SEQ ID NO: 1016 - protein, 27 aa, artificial
  peptide fold or domain or sub-domain
ALVCYDKVLVIKPGDAEACSNRGITLK

SEQ ID NO: 1017 - protein, 22 aa, artificial
  peptide fold or domain or sub-domain
ALVCYDQELLAHPENADAWYNK

SEQ ID NO: 1018 - protein, 25 aa, artificial
  peptide fold or domain or sub-domain
ALVDALVILPDDSATAELRERTRRL

SEQ ID NO: 1019 - protein, 25 aa, artificial
  peptide fold or domain or sub-domain
ALVDIIEDLPEGHPSRHELTKVVTD

SEQ ID NO: 1020 - protein, 26 aa, artificial
  peptide fold or domain or sub-domain
ALVDRDAAGLQETLGLVREATVHVGD

SEQ ID NO: 1021 - protein, 25 aa, artificial
  peptide fold or domain or sub-domain
ALVDVLDYFPKDHPKRPELIKYLNN

SEQ ID NO: 1022 - protein, 25 aa, artificial
  peptide fold or domain or sub-domain
ALVDVLDYLPQETTGRDSVMQILQG

SEQ ID NO: 1023 - protein, 25 aa, artificial
  peptide fold or domain or sub-domain
ALVDVLEYLPKDHPRYAQVLTLFQR

SEQ ID NO: 1024 - protein, 23 aa, artificial
  peptide fold or domain or sub-domain
ALVEHPEWVEKIREGGQPVAFAF

SEQ ID NO: 1025 - protein, 21 aa, artificial
  peptide fold or domain or sub-domain
ALVEKRLTEIMYHVGRPGHDG

SEQ ID NO: 1026 - protein, 30 aa, artificial
  peptide fold or domain or sub-domain
ALVISSDGKIITIKLESGGQIQCKPTQVLE

SEQ ID NO: 1027 - protein, 23 aa, artificial
  peptide fold or domain or sub-domain
ALVLHAPGAVEDGADAERTRAAA

SEQ ID NO: 1028 - protein, 30 aa, artificial
  peptide fold or domain or sub-domain
ALVMYSNLDLKTQEAYEMAVRGLIRPMNKS

SEQ ID NO: 1029 - protein, 24 aa, artificial
  peptide fold or domain or sub-domain
ALVQLVESFQQGKISEAKKIHYDF

SEQ ID NO: 1030 - protein, 26 aa, artificial
  peptide fold or domain or sub-domain
ALVQLVESFQQGKISEAKKIHYDFIE

SEQ ID NO: 1031 - protein, 30 aa, artificial
  peptide fold or domain or sub-domain
ALVRGKLSPDYVKSFITEIRKVPGEIQQIL

SEQ ID NO: 1032 - protein, 30 aa, artificial
  peptide fold or domain or sub-domain
ALVSIEEDLGWFVSNHLISPNVAQSIPFLI

SEQ ID NO: 1033 - protein, 28 aa, artificial
  peptide fold or domain or sub-domain
ALVVGRGAEDVRSAVEKIAGPVSAFEQK

SEQ ID NO: 1034 - protein, 30 aa, artificial
  peptide fold or domain or sub-domain
ALWEFMQLQNGRVPSNREDLKMFTQIATQK

SEQ ID NO: 1035 - protein, 27 aa, artificial
  peptide fold or domain or sub-domain
ALWHKVMFPVFLGEPVSPQTLAATLAE

SEQ ID NO: 1036 - protein, 30 aa, artificial
  peptide fold or domain or sub-domain
ALWSIEEDSGLFLREGFLEPKDIDTVTELV

SEQ ID NO: 1037 - protein, 26 aa, artificial
  peptide fold or domain or sub-domain
ALWVGGVVKDPKGLFYASPESLRGEG

SEQ ID NO: 1038 - protein, 30 aa, artificial
  peptide fold or domain or sub-domain
ALYLLHKHLGDFLSTNCITPKQASLANDQL

SEQ ID NO: 1039 - protein, 29 aa, artificial
  peptide fold or domain or sub-domain
ALYVFSNNEKVIKKMIAETSSGGVTANDV

SEQ ID NO: 1040 - protein, 29 aa, artificial
  peptide fold or domain or sub-domain
AMAAAEMLDSLWATQVGARATRLAKMMRE

SEQ ID NO: 1041 - protein, 26 aa, artificial
  peptide fold or domain or sub-domain
AMDDIAEHAGVSKPVLYQHFPGKLEL

SEQ ID NO: 1042 - protein, 26 aa, artificial
  peptide fold or domain or sub-domain
AMEALKKGHKDGQFTDDQLHQLEDQA

SEQ ID NO: 1043 - protein, 25 aa, artificial
  peptide fold or domain or sub-domain
AMEAPAPEGTARFRLDSRAWRFMVT

SEQ ID NO: 1044 - protein, 22 aa, artificial
  peptide fold or domain or sub-domain
AMEARTRRLRAAGDTAAARAYR

SEQ ID NO: 1045 - protein, 21 aa, artificial
  peptide fold or domain or sub-domain
AMEIAAAAHVYTIRQYGPDRI

SEQ ID NO: 1046 - protein, 22 aa, artificial
  peptide fold or domain or sub-domain
AMELRHNKLIKSGDKTGANAYL

SEQ ID NO: 1047 - protein, 22 aa, artificial
  peptide fold or domain or sub-domain
AMEQRFNHYAALNQFELANQYR

SEQ ID NO: 1048 - protein, 20 aa, artificial
  peptide fold or domain or sub-domain
AMHAVYDRPDLDAGEIARIG

SEQ ID NO: 1049 - protein, 23 aa, artificial
  peptide fold or domain or sub-domain
AMHLKEAIAKDEVLDFLADIISK

SEQ ID NO: 1050 - protein, 23 aa, artificial
  peptide fold or domain or sub-domain
AMISNFSSIRRSVLHKRVSVSSH

SEQ ID NO: 1051 - protein, 30 aa, artificial
  peptide fold or domain or sub-domain
AMKATGKNPLLEIQNAKDFEDVMSRYVFVD

SEQ ID NO: 1052 - protein, 26 aa, artificial
  peptide fold or domain or sub-domain
AMKAYEKLEKDNALGEDEIAKLKKSM

SEQ ID NO: 1053 - protein, 26 aa, artificial
  peptide fold or domain or sub-domain
AMKFLNKNGKTIIGAEDEKCFDDTNC

SEQ ID NO: 1054 - protein, 22 aa, artificial
  peptide fold or domain or sub-domain
AMKGSVNTTTDPALKIPFETCV

SEQ ID NO: 1055 - protein, 22 aa, artificial
  peptide fold or domain or sub-domain
AMKSFDKALEIDSQNSLIWSNK

SEQ ID NO: 1056 - protein, 26 aa, artificial
  peptide fold or domain or sub-domain
AMKSLVNAALNGNFKKARIIHNQLYS

SEQ ID NO: 1057 - protein, 27 aa, artificial
  peptide fold or domain or sub-domain
AMKVMGGMAKEPDTFDADVFKEQAAFL

SEQ ID NO: 1058 - protein, 20 aa, artificial
  peptide fold or domain or sub-domain
AMLALINLGYNQTTAQKAIK

SEQ ID NO: 1059 - protein, 25 aa, artificial
  peptide fold or domain or sub-domain
AMLKNAREGIEPDQPGVVGPIKQIE

SEQ ID NO: 1060 - protein, 30 aa, artificial
  peptide fold or domain or sub-domain
AMLLPAVTAWSAPAALPRYADCARAMGVAD

SEQ ID NO: 1061 - protein, 30 aa, artificial
  peptide fold or domain or sub-domain
AMLLPHVCKYNLISNPQKFADIAEFMGENI

SEQ ID NO: 1062 - protein, 30 aa, artificial
  peptide fold or domain or sub-domain
AMLLPTVMEFNRMVCRERFSQIGRALRTKK

SEQ ID NO: 1063 - protein, 30 aa, artificial
  peptide fold or domain or sub-domain
AMLLPVIERENAKRVPEAFRNVAKALGLHV

SEQ ID NO: 1064 - protein, 24 aa, artificial
  peptide fold or domain or sub-domain
AMMKKTSGLFHRAGFEYVKMDFMT

SEQ ID NO: 1065 - protein, 30 aa, artificial
  peptide fold or domain or sub-domain
AMNAWKQSHNGNAPSSIQEKNEFKKTIETQ

SEQ ID NO: 1066 - protein, 21 aa, artificial
  peptide fold or domain or sub-domain
AMNDHTFVDVKRHGSQIKYKA

SEQ ID NO: 1067 - protein, 30 aa, artificial
  peptide fold or domain or sub-domain
AMNLAVRQGLDAKVFAEIINSSTGRCWASE

SEQ ID NO: 1068 - protein, 22 aa, artificial
  peptide fold or domain or sub-domain
AMNVRYDRLVKAGQQAEAEKYL

SEQ ID NO: 1069 - protein, 24 aa, artificial
  peptide fold or domain or sub-domain
AMQYHPDRHKGEGETVQKQNEEKF

SEQ ID NO: 1070 - protein, 28 aa, artificial
  peptide fold or domain or sub-domain
AMRLAGNGPVLLLTGAQPEEAVRAAFAR

SEQ ID NO: 1071 - protein, 23 aa, artificial
  peptide fold or domain or sub-domain
AMSDFREERRPMEKKMASKLREL

SEQ ID NO: 1072 - protein, 24 aa, artificial
  peptide fold or domain or sub-domain
AMSELCATALQGQKEQAKVLNDQV

SEQ ID NO: 1073 - protein, 26 aa, artificial
  peptide fold or domain or sub-domain
AMSELCATALQGQKEQAKVLNDQVAN

SEQ ID NO: 1074 - protein, 24 aa, artificial
  peptide fold or domain or sub-domain
AMSIVLSGIQPHQNLAVIRYIEEK

SEQ ID NO: 1075 - protein, 27 aa, artificial
  peptide fold or domain or sub-domain
AMSMRQLAAEVGVQAAALYRYFPTKED

SEQ ID NO: 1076 - protein, 25 aa, artificial
  peptide fold or domain or sub-domain
AMTIDECATWIAQTGNSESWRQWEN

SEQ ID NO: 1077 - protein, 20 aa, artificial
  peptide fold or domain or sub-domain
AMTLKEANPKLFKAWQMQGQ

SEQ ID NO: 1078 - protein, 20 aa, artificial
  peptide fold or domain or sub-domain
AMTRGRAGAMLGPEGAKVDY

SEQ ID NO: 1079 - protein, 28 aa, artificial
  peptide fold or domain or sub-domain
AMTRGRAGAMLGPEGAKVDYAEALLGVR

SEQ ID NO: 1080 - protein, 27 aa, artificial
  peptide fold or domain or sub-domain
AMTTAAIAEAAGMSESNIYRHFGGKLE

SEQ ID NO: 1081 - protein, 26 aa, artificial
  peptide fold or domain or sub-domain
AMVALELDRLATEGQLNEPLQSIIAS

SEQ ID NO: 1082 - protein, 25 aa, artificial
  peptide fold or domain or sub-domain
AMVDTLEVIGEGTPYFLGIQEMLKE

SEQ ID NO: 1083 - protein, 26 aa, artificial
  peptide fold or domain or sub-domain
AMVGIDAASDGLARAQRMGVTTTYAG

SEQ ID NO: 1084 - protein, 27 aa, artificial
  peptide fold or domain or sub-domain
ANAEKERGNEAFKKGGYAEAAAAYREG

SEQ ID NO: 1085 - protein, 29 aa, artificial
  peptide fold or domain or sub-domain
ANAFGSDIVFEKGGAIFLLDTLTGNSKQL

SEQ ID NO: 1086 - protein, 21 aa, artificial
  peptide fold or domain or sub-domain
ANALRDMYQKDGKAEMAAQFE

SEQ ID NO: 1087 - protein, 29 aa, artificial
  peptide fold or domain or sub-domain
ANAVWQGTGKEGSGTLTSPSTVLNNTPYS

SEQ ID NO: 1088 - protein, 27 aa, artificial
  peptide fold or domain or sub-domain
ANDAKAEGNKFFGAGEYERALSQYETA

SEQ ID NO: 1089 - protein, 25 aa, artificial
  peptide fold or domain or sub-domain
ANDRLQRSKNSRKSSELLENYRELL

SEQ ID NO: 1090 - protein, 30 aa, artificial
  peptide fold or domain or sub-domain
ANEAELDSILARRLAGETLSEHEVAQFKTA

SEQ ID NO: 1091 - protein, 29 aa, artificial
  peptide fold or domain or sub-domain
ANEFSTNIFNDVLRQQTHTPEEALKKAQE

SEQ ID NO: 1092 - protein, 26 aa, artificial
  peptide fold or domain or sub-domain
ANEGVQIHGGYGFIKDYPAEKFYRDV

SEQ ID NO: 1093 - protein, 26 aa, artificial
  peptide fold or domain or sub-domain
ANELARKQKSEGIIAEDVLKKLEKNI

SEQ ID NO: 1094 - protein, 25 aa, artificial
  peptide fold or domain or sub-domain
ANERKQGRAGKDGGPDFIAKHGDVR

SEQ ID NO: 1095 - protein, 25 aa, artificial
  peptide fold or domain or sub-domain
ANEVNLVDWLKMMVASRRSEEVVDP

SEQ ID NO: 1096 - protein, 24 aa, artificial
  peptide fold or domain or sub-domain
ANFFGDFKGKSIADIRASPKLRSV

SEQ ID NO: 1097 - protein, 23 aa, artificial
  peptide fold or domain or sub-domain
ANGDFVLSLEAAHAKARVARVGG

SEQ ID NO: 1098 - protein, 28 aa, artificial
  peptide fold or domain or sub-domain
ANGDTKDEMTNALQPENIDLQTLNEHNG

SEQ ID NO: 1099 - protein, 26 aa, artificial
  peptide fold or domain or sub-domain
ANGHTVQRIVTQFAALRSKDLGKWIA

SEQ ID NO: 1100 - protein, 28 aa, artificial
  peptide fold or domain or sub-domain
ANGSTAEQLSKYVEKEENMDKVSAQNIS

SEQ ID NO: 1101 - protein, 28 aa, artificial
  peptide fold or domain or sub-domain
ANGTTASQISQVLSLDKCSNGGADVQQG

SEQ ID NO: 1102 - protein, 26 aa, artificial
  peptide fold or domain or sub-domain
ANHPKHVIHNCAASPPYKALDETYLD

SEQ ID NO: 1103 - protein, 27 aa, artificial
  peptide fold or domain or sub-domain
ANIGKSENGFSDPQTKEPLNYSQLMSK

SEQ ID NO: 1104 - protein, 27 aa, artificial
  peptide fold or domain or sub-domain
ANIIKESGTLLFKKKDYSNAFFKYRKS

SEQ ID NO: 1105 - protein, 30 aa, artificial
  peptide fold or domain or sub-domain
ANIINEGLAKNCTGLKETLVQGGWSGLSTA

SEQ ID NO: 1106 - protein, 26 aa, artificial
  peptide fold or domain or sub-domain
ANIPPERYVQVNGTPGPDETTLTTGD

SEQ ID NO: 1107 - protein, 25 aa, artificial
  peptide fold or domain or sub-domain
ANISLETLEHNGAPHHAIEEAESLL

SEQ ID NO: 1108 - protein, 29 aa, artificial
  peptide fold or domain or sub-domain
ANIVITRDADFRAEGAEVVGSLEDALALA

SEQ ID NO: 1109 - protein, 26 aa, artificial
  peptide fold or domain or sub-domain
ANKAAETAEKDKEMTEDDRDKTKDQV

SEQ ID NO: 1110 - protein, 27 aa, artificial
  peptide fold or domain or sub-domain
ANKDLSEVSWEQRETEGEPRFEASQRV

SEQ ID NO: 1111 - protein, 30 aa, artificial
  peptide fold or domain or sub-domain
ANKKARDVYLKGRSQMHPITAEMIAKDLHI

SEQ ID NO: 1112 - protein, 27 aa, artificial
  peptide fold or domain or sub-domain
ANKPLVAISRGRADFDLTTVMNSANTI

SEQ ID NO: 1113 - protein, 30 aa, artificial
  peptide fold or domain or sub-domain
ANLKWLISDEEQKILIEEIKLLPAKIDRIL

SEQ ID NO: 1114 - protein, 21 aa, artificial
  peptide fold or domain or sub-domain
ANLSALVQGSSGGQGTFASSA

SEQ ID NO: 1115 - protein, 23 aa, artificial
  peptide fold or domain or sub-domain
ANLSESQLDDLIEDHTDSLIEFS

SEQ ID NO: 1116 - protein, 28 aa, artificial
  peptide fold or domain or sub-domain
ANLTESLGFSAELPQTIYGAMKGEYDLP

SEQ ID NO: 1117 - protein, 27 aa, artificial
  peptide fold or domain or sub-domain
ANLTQDTKGFFHPSSQEKLSYAELLAR

SEQ ID NO: 1118 - protein, 28 aa, artificial
  peptide fold or domain or sub-domain
ANLTTCFGIEEPNSIETNIAHLMIAKMN

SEQ ID NO: 1119 - protein, 26 aa, artificial
  peptide fold or domain or sub-domain
ANNDLKALLKDKEISEDEDRKAQEEI

SEQ ID NO: 1120 - protein, 25 aa, artificial
  peptide fold or domain or sub-domain
ANNILLQKLNYEYRNKNKPTNVLSF

SEQ ID NO: 1121 - protein, 28 aa, artificial
  peptide fold or domain or sub-domain
ANNLIDNINPFITSPEINLCLVRQAYEE

SEQ ID NO: 1122 - protein, 22 aa, artificial
  peptide fold or domain or sub-domain
ANPDRIQDCTMAGKTLEMDCAN

SEQ ID NO: 1123 - protein, 30 aa, artificial
  peptide fold or domain or sub-domain
ANPRGEVPALIHGDVEIFDSTIILEYIEDV

SEQ ID NO: 1124 - protein, 22 aa, artificial
  peptide fold or domain or sub-domain
ANPSPVYDPADGGTPGVNPIAV

SEQ ID NO: 1125 - protein, 27 aa, artificial
  peptide fold or domain or sub-domain
ANQLLDRFIFEDQIRPQDREELLRALL

SEQ ID NO: 1126 - protein, 27 aa, artificial
  peptide fold or domain or sub-domain
ANRKKEEGNLLYKTQKYERAAKKYNKA

SEQ ID NO: 1127 - protein, 27 aa, artificial
  peptide fold or domain or sub-domain
ANRKRECGNAHYQRADFVLAANSYDLA

SEQ ID NO: 1128 - protein, 21 aa, artificial
  peptide fold or domain or sub-domain
ANRLGAGWNYRHPSEIMQEVS

SEQ ID NO: 1129 - protein, 20 aa, artificial
  peptide fold or domain or sub-domain
ANRQKAKAEFEAANPGKRYG

SEQ ID NO: 1130 - protein, 26 aa, artificial
  peptide fold or domain or sub-domain
ANRTAADKYGFKDISDLSDPKKTEAL

SEQ ID NO: 1131 - protein, 29 aa, artificial
  peptide fold or domain or sub-domain
ANSDGKRIVFQAAGDIWLYDPATERLEKL

SEQ ID NO: 1132 - protein, 27 aa, artificial
  peptide fold or domain or sub-domain
ANSIFNESVDALLALGYKQKDAEKMAR

SEQ ID NO: 1133 - protein, 21 aa, artificial
  peptide fold or domain or sub-domain
ANSVCPGYVQTDMTEGSAPRT

SEQ ID NO: 1134 - protein, 28 aa, artificial
  peptide fold or domain or sub-domain
ANTILENTQSMGLMRGRIIKWKGFDCVV

SEQ ID NO: 1135 - protein, 29 aa, artificial
  peptide fold or domain or sub-domain
ANTLDFDILETMFTDEEGKLGETENTQPA

SEQ ID NO: 1136 - protein, 21 aa, artificial
  peptide fold or domain or sub-domain
ANTLKAMYEAEGKPEMVKRFS

SEQ ID NO: 1137 - protein, 21 aa, artificial
  peptide fold or domain or sub-domain
ANTMERVLTEMGDAAYAGQFK

SEQ ID NO: 1138 - protein, 23 aa, artificial
  peptide fold or domain or sub-domain
ANVFENSDVLKPLLRRMPAELIQ

SEQ ID NO: 1139 - protein, 23 aa, artificial
  peptide fold or domain or sub-domain
ANVMDGSKWEVLKGNVDPERDFT

SEQ ID NO: 1140 - protein, 23 aa, artificial
  peptide fold or domain or sub-domain
ANWPGNRNDVGTIESGNLITSIS

SEQ ID NO: 1141 - protein, 23 aa, artificial
  peptide fold or domain or sub-domain
ANYLMAVLIDDKAGPLDVRSSAG

SEQ ID NO: 1142 - protein, 30 aa, artificial
  peptide fold or domain or sub-domain
ANYRDHVVAMAKAVNMDLTTDPKADGVPPW

SEQ ID NO: 1143 - protein, 27 aa, artificial
  peptide fold or domain or sub-domain
ANYSAAANKSIKDLAQNGVKVAAGVPV

SEQ ID NO: 1144 - protein, 21 aa, artificial
  peptide fold or domain or sub-domain
APAFDIGTLNDPNINEMRNWY

SEQ ID NO: 1145 - protein, 22 aa, artificial
  peptide fold or domain or sub-domain
APAQRKGECQLTGKGRHGECAN

SEQ ID NO: 1146 - protein, 20 aa, artificial
  peptide fold or domain or sub-domain
APAVLENEAKEQNKELNDHW

SEQ ID NO: 1147 - protein, 29 aa, artificial
  peptide fold or domain or sub-domain
APDEIDAAVERRSSDRVFLFKDRQVWAFR

SEQ ID NO: 1148 - protein, 27 aa, artificial
  peptide fold or domain or sub-domain
APDKAIIASHDLKTPHRICKNCKDDSK

SEQ ID NO: 1149 - protein, 29 aa, artificial
  peptide fold or domain or sub-domain
APDSDKILSSVGKAELAKGGNLVDISKVK

SEQ ID NO: 1150 - protein, 29 aa, artificial
  peptide fold or domain or sub-domain
APEDYLGSFGDLGFDRYVDPMDAYIHGYR

SEQ ID NO: 1151 - protein, 29 aa, artificial
  peptide fold or domain or sub-domain
APEHVIKALEELEYNEFIPFLEEILLNFK

SEQ ID NO: 1152 - protein, 30 aa, artificial
  peptide fold or domain or sub-domain
APELAKKTFMEHAGFYHPIARKMIAKDLGL

SEQ ID NO: 1153 - protein, 25 aa, artificial
  peptide fold or domain or sub-domain
APELALEGPLQYDAAIDADVARTKM

SEQ ID NO: 1154 - protein, 25 aa, artificial
  peptide fold or domain or sub-domain
APELMIDGEMHGDAALVEAIRNDRM

SEQ ID NO: 1155 - protein, 26 aa, artificial
  peptide fold or domain or sub-domain
APENAGPHFLPNLWPQRPAGMEAAWT

SEQ ID NO: 1156 - protein, 24 aa, artificial
  peptide fold or domain or sub-domain
APEPEALRAQLSAGLPEYMVPSVF

SEQ ID NO: 1157 - protein, 23 aa, artificial
  peptide fold or domain or sub-domain
APFENEVVKAIAKKHNKKAAQIC

SEQ ID NO: 1158 - protein, 30 aa, artificial
  peptide fold or domain or sub-domain
APFILRGIATQAELMQADGIHPRAEAQTLM

SEQ ID NO: 1159 - protein, 21 aa, artificial
  peptide fold or domain or sub-domain
APFSQIQKVLDLTPGNLDSHI

SEQ ID NO: 1160 - protein, 28 aa, artificial
  peptide fold or domain or sub-domain
APGAVSHSGVIHGTSAIPYIHGPNIKAL

SEQ ID NO: 1161 - protein, 27 aa, artificial
  peptide fold or domain or sub-domain
APGFGDYEAGVFDYKCLINPVNDPVNG

SEQ ID NO: 1162 - protein, 28 aa, artificial
  peptide fold or domain or sub-domain
APGFIEMDTGFIYHAVNIGWRDFPLKDK

SEQ ID NO: 1163 - protein, 21 aa, artificial
  peptide fold or domain or sub-domain
APGFNVHAKQSQGISEFYADD

SEQ ID NO: 1164 - protein, 28 aa, artificial
  peptide fold or domain or sub-domain
APGTVDHRTGTLITAPNLPWQNYPLKIN

SEQ ID NO: 1165 - protein, 28 aa, artificial
  peptide fold or domain or sub-domain
APIDTIAQKAGLHANEYESHGQHKAKVS

SEQ ID NO: 1166 - protein, 22 aa, artificial
  peptide fold or domain or sub-domain
APIFTATGCGLARPAISDNVLL

SEQ ID NO: 1167 - protein, 21 aa, artificial
  peptide fold or domain or sub-domain
APIKNSVTGSPQDNPRTAVEQ

SEQ ID NO: 1168 - protein, 23 aa, artificial
  peptide fold or domain or sub-domain
APKAANIIVKDEKMGPEPIIKSL

SEQ ID NO: 1169 - protein, 23 aa, artificial
  peptide fold or domain or sub-domain
APKAIALWIRGKRLPDKFIIAGH

SEQ ID NO: 1170 - protein, 23 aa, artificial
  peptide fold or domain or sub-domain
APKAMRIFRGEDLVPEKPIVIAQ

SEQ ID NO: 1171 - protein, 20 aa, artificial
  peptide fold or domain or sub-domain
APKELLDEIRAEQEANKEMP

SEQ ID NO: 1172 - protein, 29 aa, artificial
  peptide fold or domain or sub-domain
APKFKVSTEMLDNLRGGIFAEDRELKCYT

SEQ ID NO: 1173 - protein, 24 aa, artificial
  peptide fold or domain or sub-domain
APKLDVEGRLDPGKASEQELRGEK

SEQ ID NO: 1174 - protein, 24 aa, artificial
  peptide fold or domain or sub-domain
APLEEIEALIRKAGFYHVKARRVR

SEQ ID NO: 1175 - protein, 25 aa, artificial
  peptide fold or domain or sub-domain
APLEEIEALIRKAGFYHVKARRVRE

SEQ ID NO: 1176 - protein, 25 aa, artificial
  peptide fold or domain or sub-domain
APLEVLEAREARRADRLPGLARWQY

SEQ ID NO: 1177 - protein, 26 aa, artificial
  peptide fold or domain or sub-domain
APLFVTEWGTTTFTGDGFVDEAQTRT

SEQ ID NO: 1178 - protein, 27 aa, artificial
  peptide fold or domain or sub-domain
APLITGDSEVSQSQNNLDLFKMIRRWQ

SEQ ID NO: 1179 - protein, 20 aa, artificial
  peptide fold or domain or sub-domain
APLLYTSTRTFVRHPEHEEA

SEQ ID NO: 1180 - protein, 21 aa, artificial
  peptide fold or domain or sub-domain
APLPWRAAAPHGWAGEPAWLP

SEQ ID NO: 1181 - protein, 23 aa, artificial
  peptide fold or domain or sub-domain
APLREISKITGLAESTIHERIRK

SEQ ID NO: 1182 - protein, 29 aa, artificial
  peptide fold or domain or sub-domain
APLTSKGQPLGCRPEITLGGKQARILLDQ

SEQ ID NO: 1183 - protein, 29 aa, artificial
  peptide fold or domain or sub-domain
APLTSTPRGWPFRPVVQGSKVKSEVAIDQ

SEQ ID NO: 1184 - protein, 23 aa, artificial
  peptide fold or domain or sub-domain
APLVTYEEVAQGQLKGPGPFRLQ

SEQ ID NO: 1185 - protein, 29 aa, artificial
  peptide fold or domain or sub-domain
APMTTKGRDYPTRVQCTFKGKGGQVVLDQ

SEQ ID NO: 1186 - protein, 28 aa, artificial
  peptide fold or domain or sub-domain
APPEAFIAVLNGIGMSDSEAHQIAGRIS

SEQ ID NO: 1187 - protein, 23 aa, artificial
  peptide fold or domain or sub-domain
APQLQVEKVRTNDRKELGEVRVQ

SEQ ID NO: 1188 - protein, 30 aa, artificial
  peptide fold or domain or sub-domain
APQLTHKDGTIDHSLFRDGLHPNAEGYKRI

SEQ ID NO: 1189 - protein, 27 aa, artificial
  peptide fold or domain or sub-domain
APQPIADAISALINLGYGQPQAAAAIA

SEQ ID NO: 1190 - protein, 28 aa, artificial
  peptide fold or domain or sub-domain
APRAGFWLGRWAATLGKQQEAQTAYEYV

SEQ ID NO: 1191 - protein, 22 aa, artificial
  peptide fold or domain or sub-domain
APRAQVEHCRLAGKDVETECAN

SEQ ID NO: 1192 - protein, 21 aa, artificial
  peptide fold or domain or sub-domain
APRATIEKFGHEWVKPGNIVS

SEQ ID NO: 1193 - protein, 26 aa, artificial
  peptide fold or domain or sub-domain
APSANISKRPSSTNFEMALKELNGLV

SEQ ID NO: 1194 - protein, 26 aa, artificial
  peptide fold or domain or sub-domain
APSANITTKVSAVNAKDVKEEFGKKI

SEQ ID NO: 1195 - protein, 26 aa, artificial
  peptide fold or domain or sub-domain
APSANPYNRISPTSSYHVEGYFGNAL

SEQ ID NO: 1196 - protein, 26 aa, artificial
  peptide fold or domain or sub-domain
APSANRSGKPSPTTAEHVIEDLDGEI

SEQ ID NO: 1197 - protein, 22 aa, artificial
  peptide fold or domain or sub-domain
APSDQLINIFESCVRNPVENIM

SEQ ID NO: 1198 - protein, 22 aa, artificial
  peptide fold or domain or sub-domain
APSEKLEQILRTCSRDPTQAIA

SEQ ID NO: 1199 - protein, 25 aa, artificial
  peptide fold or domain or sub-domain
APSERYEMPAWLMVHDLTKSNKTIA

SEQ ID NO: 1200 - protein, 28 aa, artificial
  peptide fold or domain or sub-domain
APSFIVAHTVKGRGVSYMENNPKYHGAP

SEQ ID NO: 1201 - protein, 27 aa, artificial
  peptide fold or domain or sub-domain
APSIFDEPLERVKNNDPEMTEVNVNNS

SEQ ID NO: 1202 - protein, 30 aa, artificial
  peptide fold or domain or sub-domain
APSILAADYANFEREIKRLEATGAEYAHID

SEQ ID NO: 1203 - protein, 30 aa, artificial
  peptide fold or domain or sub-domain
APSILAGDFGHLADEAKKAEQAGADSLHLD

SEQ ID NO: 1204 - protein, 30 aa, artificial
  peptide fold or domain or sub-domain
APSILAGDWWCIGEQIQATIRGGADILHYD

SEQ ID NO: 1205 - protein, 30 aa, artificial
  peptide fold or domain or sub-domain
APSILNADNMHLSRDIKAAIESGIDRFHID

SEQ ID NO: 1206 - protein, 30 aa, artificial
  peptide fold or domain or sub-domain
APSLLSADFAISRPRCPSDGRTGADILHFD

SEQ ID NO: 1207 - protein, 28 aa, artificial
  peptide fold or domain or sub-domain
APSNSEAMRKLKERAVRVDGIVVDDAHL

SEQ ID NO: 1208 - protein, 24 aa, artificial
  peptide fold or domain or sub-domain
APSSLFDLNFQAGFLMKKEVQDEE

SEQ ID NO: 1209 - protein, 30 aa, artificial
  peptide fold or domain or sub-domain
APSVLSANFMDLKNELELCKKNNINWIHYD

SEQ ID NO: 1210 - protein, 20 aa, artificial
  peptide fold or domain or sub-domain
APSVRVLSLRQGYHVIPRDT

SEQ ID NO: 1211 - protein, 29 aa, artificial
  peptide fold or domain or sub-domain
APTPVNAALWNPISGSMLLFSSNRVYSYY

SEQ ID NO: 1212 - protein, 20 aa, artificial
  peptide fold or domain or sub-domain
APVATNNPDREVQAETQGRF

SEQ ID NO: 1213 - protein, 27 aa, artificial
  peptide fold or domain or sub-domain
APVRRIEQRGTRWFAVTPHGTFSASQL

SEQ ID NO: 1214 - protein, 23 aa, artificial
  peptide fold or domain or sub-domain
APYAKDFSFGKVRVRNGLKKEVS

SEQ ID NO: 1215 - protein, 28 aa, artificial
  peptide fold or domain or sub-domain
APYPEYILGSDILTKTPVEVMAHTYCLD

SEQ ID NO: 1216 - protein, 23 aa, artificial
  peptide fold or domain or sub-domain
AQALCKEYENEDYFNKLIENMTS

SEQ ID NO: 1217 - protein, 30 aa, artificial
  peptide fold or domain or sub-domain
AQALGYYIEVSSEFAPQLPKDFIRRQSRLH

SEQ ID NO: 1218 - protein, 27 aa, artificial
  peptide fold or domain or sub-domain
AQANWGPIGETLQKDPATGLLTQIPAA

SEQ ID NO: 1219 - protein, 30 aa, artificial
  peptide fold or domain or sub-domain
AQARGTKYPDEVAREYRELEAMPDLIKRVL

SEQ ID NO: 1220 - protein, 23 aa, artificial
  peptide fold or domain or sub-domain
AQAVTNASDVDEETRAEHAGRHQ

SEQ ID NO: 1221 - protein, 29 aa, artificial
  peptide fold or domain or sub-domain
AQAYRERMVGPYRGVLPAAAIRNMEEQFS

SEQ ID NO: 1222 - protein, 25 aa, artificial
  peptide fold or domain or sub-domain
AQCEIDSFCRAVLRRHWPQTKLFED

SEQ ID NO: 1223 - protein, 20 aa, artificial
  peptide fold or domain or sub-domain
AQCHEDRAGLKLGGSPIPQG

SEQ ID NO: 1224 - protein, 20 aa, artificial
  peptide fold or domain or sub-domain
AQCNAVLQSVQNYHMDSLGW

SEQ ID NO: 1225 - protein, 30 aa, artificial
  peptide fold or domain or sub-domain
AQCRGVLTSEKLKASVAELEKTANLMGQTL

SEQ ID NO: 1226 - protein, 28 aa, artificial
  peptide fold or domain or sub-domain
AQDEEIQYLFLYGNLPTEQELRKYKETV

SEQ ID NO: 1227 - protein, 21 aa, artificial
  peptide fold or domain or sub-domain
AQDLVDIIKSQLQKDIDKRLV

SEQ ID NO: 1228 - protein, 24 aa, artificial
  peptide fold or domain or sub-domain
AQEEHRRKLEEKFKEEQRKLQKQK

SEQ ID NO: 1229 - protein, 21 aa, artificial
  peptide fold or domain or sub-domain
AQEKLGMAVDVNGSNAAGNNI

SEQ ID NO: 1230 - protein, 26 aa, artificial
  peptide fold or domain or sub-domain
AQELGAALKATGKNLSEAQLRKLISE

SEQ ID NO: 1231 - protein, 23 aa, artificial
  peptide fold or domain or sub-domain
AQEYSSISWDDTLKVNGITKHEF

SEQ ID NO: 1232 - protein, 30 aa, artificial
  peptide fold or domain or sub-domain
AQFIDTLPVKRFHGIGQRTAERMLQLGIET

SEQ ID NO: 1233 - protein, 23 aa, artificial
  peptide fold or domain or sub-domain
AQFLDDFSPLFYGTNHGTKVSQG

SEQ ID NO: 1234 - protein, 21 aa, artificial
  peptide fold or domain or sub-domain
AQHIAEAFGKDAGAAEVQTLK

SEQ ID NO: 1235 - protein, 23 aa, artificial
  peptide fold or domain or sub-domain
AQHLKQVIESDDQWDFLREIVGR

SEQ ID NO: 1236 - protein, 28 aa, artificial
  peptide fold or domain or sub-domain
AQHMLQTTDGIGKLRGRFFTYQGIPLLA

SEQ ID NO: 1237 - protein, 24 aa, artificial
  peptide fold or domain or sub-domain
AQIISVTGNVAQLMDLETYETFEL

SEQ ID NO: 1238 - protein, 21 aa, artificial
  peptide fold or domain or sub-domain
AQIKGINTCLRCSKLNLSPLL

SEQ ID NO: 1239 - protein, 29 aa, artificial
  peptide fold or domain or sub-domain
AQIKNLMSQLGTKQDSSKLQENLQQLQHS

SEQ ID NO: 1240 - protein, 20 aa, artificial
  peptide fold or domain or sub-domain
AQISALRKKHQDAANEMADQ

SEQ ID NO: 1241 - protein, 27 aa, artificial
  peptide fold or domain or sub-domain
AQISKIAREANVAEGTIYLYFKNKQDL

SEQ ID NO: 1242 - protein, 28 aa, artificial
  peptide fold or domain or sub-domain
AQISTKGLKWELHLSNLAFPGKNSCFNR

SEQ ID NO: 1243 - protein, 21 aa, artificial
  peptide fold or domain or sub-domain
AQKGAFTKEDGEKVVDEAGKR

SEQ ID NO: 1244 - protein, 26 aa, artificial
  peptide fold or domain or sub-domain
AQKQIKSDIDRKVVGKSEGDRESKKV

SEQ ID NO: 1245 - protein, 29 aa, artificial
  peptide fold or domain or sub-domain
AQKQSVQKELRNQSSPFMVSQINDRISRL

SEQ ID NO: 1246 - protein, 30 aa, artificial
  peptide fold or domain or sub-domain
AQKRALSVLQGINPDLAAREDAAEIARRIG

SEQ ID NO: 1247 - protein, 27 aa, artificial
  peptide fold or domain or sub-domain
AQKRREQGQGLFREECWAEAQTRFVQA

SEQ ID NO: 1248 - protein, 27 aa, artificial
  peptide fold or domain or sub-domain
AQLYKEEGNQRYREGKYRDAVSRYHRA

SEQ ID NO: 1249 - protein, 27 aa, artificial
  peptide fold or domain or sub-domain
AQMAYFRPKWFKGQEPTADLKEAYDKA

SEQ ID NO: 1250 - protein, 24 aa, artificial
  peptide fold or domain or sub-domain
AQMFPFGENLSYSQLVQNPTLRAH

SEQ ID NO: 1251 - protein, 29 aa, artificial
  peptide fold or domain or sub-domain
AQMKDILHSLTLEQPKEKTKTHQALLKHL

SEQ ID NO: 1252 - protein, 24 aa, artificial
  peptide fold or domain or sub-domain
AQNAHKLKDWEAKVGAGIIPVDRG

SEQ ID NO: 1253 - protein, 24 aa, artificial
  peptide fold or domain or sub-domain
AQNAPATGAHLARIRDGRFSTTRG

SEQ ID NO: 1254 - protein, 24 aa, artificial
  peptide fold or domain or sub-domain
AQNERTDDRYMEEVNKGRFPIMRG

SEQ ID NO: 1255 - protein, 24 aa, artificial
  peptide fold or domain or sub-domain
AQNFSEAYDVNFKDSENKKQFVYQ

SEQ ID NO: 1256 - protein, 24 aa, artificial
  peptide fold or domain or sub-domain
AQNHKTLKAFYNALDREVMPIEKG

SEQ ID NO: 1257 - protein, 21 aa, artificial
  peptide fold or domain or sub-domain
AQNIAKLRGWAPGSPAYDILQ

SEQ ID NO: 1258 - protein, 24 aa, artificial
  peptide fold or domain or sub-domain
AQNKFPQMAGMSASQLRSSRQMQA

SEQ ID NO: 1259 - protein, 24 aa, artificial
  peptide fold or domain or sub-domain
AQNQKELKQYYQQVDEQGNALWRG

SEQ ID NO: 1260 - protein, 24 aa, artificial
  peptide fold or domain or sub-domain
AQNTKDIPHYIKTISKGELSITKG

SEQ ID NO: 1261 - protein, 24 aa, artificial
  peptide fold or domain or sub-domain
AQNTKNLRTYYDQIDQDELTVYRG

SEQ ID NO: 1262 - protein, 27 aa, artificial
  peptide fold or domain or sub-domain
AQPVFQDAYSALLNLGYPPVRARSALE

SEQ ID NO: 1263 - protein, 29 aa, artificial
  peptide fold or domain or sub-domain
AQPYVRSRAYLCRYRGADAGTLSGRQIIE

SEQ ID NO: 1264 - protein, 27 aa, artificial
  peptide fold or domain or sub-domain
AQQMLAKDRDAALFRLGISEELADILL

SEQ ID NO: 1265 - protein, 22 aa, artificial
  peptide fold or domain or sub-domain
AQQWLYTLAIKQKWDEYLHYYQ

SEQ ID NO: 1266 - protein, 29 aa, artificial
  peptide fold or domain or sub-domain
AQQYRARIVDPIIGLLPDDVVNSISEQLS

SEQ ID NO: 1267 - protein, 21 aa, artificial
  peptide fold or domain or sub-domain
AQRIKALAQADGNADIAQRFS

SEQ ID NO: 1268 - protein, 27 aa, artificial
  peptide fold or domain or sub-domain
AQRLIVQDKASAMFRLGINEEMATTLA

SEQ ID NO: 1269 - protein, 27 aa, artificial
  peptide fold or domain or sub-domain
AQRMILSHDAEAMFRLGVSQEVAEIIG

SEQ ID NO: 1270 - protein, 27 aa, artificial
  peptide fold or domain or sub-domain
AQRMLRGDYEQGKRQLGISDDIAASIV

SEQ ID NO: 1271 - protein, 24 aa, artificial
  peptide fold or domain or sub-domain
AQRWKANGWKRNAREKALNPDLWE

SEQ ID NO: 1272 - protein, 22 aa, artificial
  peptide fold or domain or sub-domain
AQSLASLDRIYGPEGRESLENG

SEQ ID NO: 1273 - protein, 28 aa, artificial
  peptide fold or domain or sub-domain
AQSLLKSSRNLLQLRGRFHDCQGIALMP

SEQ ID NO: 1274 - protein, 23 aa, artificial
  peptide fold or domain or sub-domain
AQSYINHMNENHVKIASQEVRIL

SEQ ID NO: 1275 - protein, 22 aa, artificial
  peptide fold or domain or sub-domain
AQTIALFREAYGHDATQTILAT

SEQ ID NO: 1276 - protein, 28 aa, artificial
  peptide fold or domain or sub-domain
AQTLLRDTTPITRLRGGWREYEGIRLMP

SEQ ID NO: 1277 - protein, 28 aa, artificial
  peptide fold or domain or sub-domain
AQTLVGTGSSISRLRGSVHYWRGIPLIC

SEQ ID NO: 1278 - protein, 22 aa, artificial
  peptide fold or domain or sub-domain
AQTQSGVGQFSVTRCENSFTGT

SEQ ID NO: 1279 - protein, 30 aa, artificial
  peptide fold or domain or sub-domain
AQTRGTLATEKIRKIITALRRLPAQAQEIL

SEQ ID NO: 1280 - protein, 28 aa, artificial
  peptide fold or domain or sub-domain
AQTVLGTDATLGALRGAWHEYHGIPVWV

SEQ ID NO: 1281 - protein, 27 aa, artificial
  peptide fold or domain or sub-domain
AQVICHQSGIKHMISPEKLWQGSLQVL

SEQ ID NO: 1282 - protein, 27 aa, artificial
  peptide fold or domain or sub-domain
AQVICSMAASVYLKNILNKEFNHQVAP

SEQ ID NO: 1283 - protein, 27 aa, artificial
  peptide fold or domain or sub-domain
AQVSKIAKQAGVADGTIYLYFKNKEDI

SEQ ID NO: 1284 - protein, 27 aa, artificial
  peptide fold or domain or sub-domain
AQVVATGAAHSNLEHIAHRKYNKVPVT

SEQ ID NO: 1285 - protein, 30 aa, artificial
  peptide fold or domain or sub-domain
AQYDMNYNVITSYASIKEAGEKTGIDKSSI

SEQ ID NO: 1286 - protein, 20 aa, artificial
  peptide fold or domain or sub-domain
AQYDRIAEEQGKDAANKAQS

SEQ ID NO: 1287 - protein, 22 aa, artificial
  peptide fold or domain or sub-domain
AQYFWLINEKPHASSQELFIPN

SEQ ID NO: 1288 - protein, 27 aa, artificial
  peptide fold or domain or sub-domain
AQYTFLHHSKTQAVQAQHFQVSHLDAD

SEQ ID NO: 1289 - protein, 29 aa, artificial
  peptide fold or domain or sub-domain
ARAAEVGKEFESRLPGWRKEKLQERLGWL

SEQ ID NO: 1290 - protein, 25 aa, artificial
  peptide fold or domain or sub-domain
ARAEVHAHHGDADSETLCDALELNS

SEQ ID NO: 1291 - protein, 28 aa, artificial
  peptide fold or domain or sub-domain
ARALLGVDVAIGAARGQVFRCRGMPVVV

SEQ ID NO: 1292 - protein, 21 aa, artificial
  peptide fold or domain or sub-domain
ARAMGYTEPWLHEDAEEAIRG

SEQ ID NO: 1293 - protein, 23 aa, artificial
  peptide fold or domain or sub-domain
ARATGGRNGQAQVAESGLDLVLA

SEQ ID NO: 1294 - protein, 23 aa, artificial
  peptide fold or domain or sub-domain
ARAVARIMVSSDLDEAQAFERLR

SEQ ID NO: 1295 - protein, 25 aa, artificial
  peptide fold or domain or sub-domain
ARAWLQQDDGPEASAPIDQMPAAEL

SEQ ID NO: 1296 - protein, 23 aa, artificial
  peptide fold or domain or sub-domain
ARDFYKNKEEEEYFDQLIDYVTS

SEQ ID NO: 1297 - protein, 27 aa, artificial
  peptide fold or domain or sub-domain
ARDGWFNTAASCVCGTQDCDWEAKRLT

SEQ ID NO: 1298 - protein, 30 aa, artificial
  peptide fold or domain or sub-domain
ARDKALQIMENNKMKISQVDNPQRVADLIG

SEQ ID NO: 1299 - protein, 25 aa, artificial
  peptide fold or domain or sub-domain
ARDMVHEHHGDLEGDHYTQALVEQN

SEQ ID NO: 1300 - protein, 27 aa, artificial
  peptide fold or domain or sub-domain
AREERARGTELFRAGNPEGAARCYGRA

SEQ ID NO: 1301 - protein, 23 aa, artificial
  peptide fold or domain or sub-domain
AREFYKQHQEEDHFEELVTFMAS

SEQ ID NO: 1302 - protein, 25 aa, artificial
  peptide fold or domain or sub-domain
AREIMQDTKEAVFGNRMDIAAMAIG

SEQ ID NO: 1303 - protein, 25 aa, artificial
  peptide fold or domain or sub-domain
ARERVLAELPEKDTALQQRAAEQAA

SEQ ID NO: 1304 - protein, 20 aa, artificial
  peptide fold or domain or sub-domain
ARETVEREAKEEGKPIENHL

SEQ ID NO: 1305 - protein, 20 aa, artificial
  peptide fold or domain or sub-domain
AREWLEATGQWDAIAPHLAE

SEQ ID NO: 1306 - protein, 26 aa, artificial
  peptide fold or domain or sub-domain
ARFPMNSPAWQEPAYKPFSRPVMQNG

SEQ ID NO: 1307 - protein, 27 aa, artificial
  peptide fold or domain or sub-domain
ARFYESLIKPPHLRTPDDIRNVYEQLR

SEQ ID NO: 1308 - protein, 28 aa, artificial
  peptide fold or domain or sub-domain
ARGDTLEQLTLNFGYAADELNEGKVLAL

SEQ ID NO: 1309 - protein, 28 aa, artificial
  peptide fold or domain or sub-domain
ARGDTQEELSEQLGYTAAGLSQDDVFNA

SEQ ID NO: 1310 - protein, 28 aa, artificial
  peptide fold or domain or sub-domain
ARGGSEAELNSVFGHTDVGLTDRSRVLA

SEQ ID NO: 1311 - protein, 26 aa, artificial
  peptide fold or domain or sub-domain
ARGLVALGILRGDPEELVVDGVTALF

SEQ ID NO: 1312 - protein, 28 aa, artificial
  peptide fold or domain or sub-domain
ARGNTAIEMRSGLGFREAGLAQEDVPDS

SEQ ID NO: 1313 - protein, 28 aa, artificial
  peptide fold or domain or sub-domain
ARGNTEAEMAETLHFSLPQARLHPAANA

SEQ ID NO: 1314 - protein, 28 aa, artificial
  peptide fold or domain or sub-domain
ARGQTQQELSQGLGFSDVDLTDAGVLDA

SEQ ID NO: 1315 - protein, 28 aa, artificial
  peptide fold or domain or sub-domain
ARGVTKNEMDLTLGYNSVNLNSEDLVLG

SEQ ID NO: 1316 - protein, 26 aa, artificial
  peptide fold or domain or sub-domain
ARHLLDPSRLITGARQVYGSHFDALF

SEQ ID NO: 1317 - protein, 24 aa, artificial
  peptide fold or domain or sub-domain
ARHRDVERIVKPIGFYRVKSRRIM

SEQ ID NO: 1318 - protein, 25 aa, artificial
  peptide fold or domain or sub-domain
ARHRDVERIVKPIGFYRVKSRRIME

SEQ ID NO: 1319 - protein, 29 aa, artificial
  peptide fold or domain or sub-domain
ARHTDFGDTLTNRNGHILIDAISNLPLYR

SEQ ID NO: 1320 - protein, 25 aa, artificial
  peptide fold or domain or sub-domain
ARIADVRVDKRWVELPSTRGRVRSA

SEQ ID NO: 1321 - protein, 24 aa, artificial
  peptide fold or domain or sub-domain
ARIASLIDEAREDGSLPAGKPSPA

SEQ ID NO: 1322 - protein, 26 aa, artificial
  peptide fold or domain or sub-domain
ARIAVDVHGSYGLMRDYTIERVYRDA

SEQ ID NO: 1323 - protein, 29 aa, artificial
  peptide fold or domain or sub-domain
ARIEQYHEESKGVHKAESVKSLRNKISNE

SEQ ID NO: 1324 - protein, 28 aa, artificial
  peptide fold or domain or sub-domain
ARIGDDDFGRMGMTLWHAEGVATDHVEH

SEQ ID NO: 1325 - protein, 23 aa, artificial
  peptide fold or domain or sub-domain
ARIRPGTNIKSACNIGNFVEIKN

SEQ ID NO: 1326 - protein, 22 aa, artificial
  peptide fold or domain or sub-domain
ARISFLQNGEFVSFHPYNVSYS

SEQ ID NO: 1327 - protein, 21 aa, artificial
  peptide fold or domain or sub-domain
ARISREVLRWAADPTYRIQPQ

SEQ ID NO: 1328 - protein, 23 aa, artificial
  peptide fold or domain or sub-domain
ARITRIKDGDTFVAVWKHRSYTC

SEQ ID NO: 1329 - protein, 28 aa, artificial
  peptide fold or domain or sub-domain
ARITTRGFQWDVEDWLTEIGGQLSTSNH

SEQ ID NO: 1330 - protein, 30 aa, artificial
  peptide fold or domain or sub-domain
ARIVRTEKTQTLVCDDRKKQFWVPAGDVLK

SEQ ID NO: 1331 - protein, 20 aa, artificial
  peptide fold or domain or sub-domain
ARKINAATASVRSLFQSLRD

SEQ ID NO: 1332 - protein, 29 aa, artificial
  peptide fold or domain or sub-domain
ARKKAEQMLVNQSDTVQINAALASLAESV

SEQ ID NO: 1333 - protein, 29 aa, artificial
  peptide fold or domain or sub-domain
ARKQELCLAIAGSTSESECQELEERLAIF

SEQ ID NO: 1334 - protein, 26 aa, artificial
  peptide fold or domain or sub-domain
ARLARDMLGGNGISDEFGVARHLVNL

SEQ ID NO: 1335 - protein, 20 aa, artificial
  peptide fold or domain or sub-domain
ARLDAIRSCGLSARKAEALR

SEQ ID NO: 1336 - protein, 27 aa, artificial
  peptide fold or domain or sub-domain
ARLDDIVEVAHISKGSIYFYFPNKERL

SEQ ID NO: 1337 - protein, 27 aa, artificial
  peptide fold or domain or sub-domain
ARLEAAAPDLLLETIADLPGALALTGN

SEQ ID NO: 1338 - protein, 28 aa, artificial
  peptide fold or domain or sub-domain
ARLEALGEGEGWGARVPPEHQPELLYRA

SEQ ID NO: 1339 - protein, 27 aa, artificial
  peptide fold or domain or sub-domain
ARLITTFAGVGIMSCARPVPMDRVYLL

SEQ ID NO: 1340 - protein, 21 aa, artificial
  peptide fold or domain or sub-domain
ARLLLEAAGRDPDSAGLSDTW

SEQ ID NO: 1341 - protein, 23 aa, artificial
  peptide fold or domain or sub-domain
ARLRPGADLAEKSKVGNFCEVKN

SEQ ID NO: 1342 - protein, 28 aa, artificial
  peptide fold or domain or sub-domain
ARLVVGDLTMDEESREVQRAGQPVHLTA

SEQ ID NO: 1343 - protein, 22 aa, artificial
  peptide fold or domain or sub-domain
ARMALHERFGPQRGEEVWRAFR

SEQ ID NO: 1344 - protein, 29 aa, artificial
  peptide fold or domain or sub-domain
ARMDQGNVVFQLGADIHVFDIASAKDSLL

SEQ ID NO: 1345 - protein, 28 aa, artificial
  peptide fold or domain or sub-domain
ARMRCEQLWRDLRAKNDWAGFQPALEGV

SEQ ID NO: 1346 - protein, 26 aa, artificial
  peptide fold or domain or sub-domain
ARNGTSSLFQKYFMTNDQESRNSVAD

SEQ ID NO: 1347 - protein, 23 aa, artificial
  peptide fold or domain or sub-domain
ARNIETALIKIDPGQAADFHQRA

SEQ ID NO: 1348 - protein, 28 aa, artificial
  peptide fold or domain or sub-domain
ARPAVTRLLRTEDATEEKACAAAFRLMD

SEQ ID NO: 1349 - protein, 27 aa, artificial
  peptide fold or domain or sub-domain
ARPEDIYNRRLQDDTRSRDKVTLDGIK

SEQ ID NO: 1350 - protein, 27 aa, artificial
  peptide fold or domain or sub-domain
ARPGEAIALDTATLEYSLVTLPDSHSM

SEQ ID NO: 1351 - protein, 20 aa, artificial
  peptide fold or domain or sub-domain
ARPYAGDWPGRDVNYNPVPN

SEQ ID NO: 1352 - protein, 24 aa, artificial
  peptide fold or domain or sub-domain
ARQAVFAAAGWDVERDGLIGAPPL

SEQ ID NO: 1353 - protein, 26 aa, artificial
  peptide fold or domain or sub-domain
ARQLKELGIVPSHASDTDAMKAARQF

SEQ ID NO: 1354 - protein, 21 aa, artificial
  peptide fold or domain or sub-domain
ARQQLSDEQAPLRQKLLADLL

SEQ ID NO: 1355 - protein, 23 aa, artificial
  peptide fold or domain or sub-domain
ARQTGPLNWVNDDNTQLVQIEDS

SEQ ID NO: 1356 - protein, 27 aa, artificial
  peptide fold or domain or sub-domain
ARQVHGTSVRYVTPKTPKRAPADGLFT

SEQ ID NO: 1357 - protein, 28 aa, artificial
  peptide fold or domain or sub-domain
ARRLVTLDLRSEGFSRERVLAGAFRMLD

SEQ ID NO: 1358 - protein, 29 aa, artificial
  peptide fold or domain or sub-domain
ARRNNVIVCERGDGQLWRIDPISGESVPV

SEQ ID NO: 1359 - protein, 27 aa, artificial
  peptide fold or domain or sub-domain
ARRQKLMKYLYKTDFELYKHTCDLLKI

SEQ ID NO: 1360 - protein, 29 aa, artificial
  peptide fold or domain or sub-domain
ARRQQVAKQHDLAPPNIEQDKLKERLAKL

SEQ ID NO: 1361 - protein, 25 aa, artificial
  peptide fold or domain or sub-domain
ARRRQDGIPKLVDKFKINLARQFPT

SEQ ID NO: 1362 - protein, 26 aa, artificial
  peptide fold or domain or sub-domain
ARRTMELMGGYGVITDYPVSRYLRDA

SEQ ID NO: 1363 - protein, 28 aa, artificial
  peptide fold or domain or sub-domain
ARSEGETAWEALRPRDDWQGFLPYLKRL

SEQ ID NO: 1364 - protein, 25 aa, artificial
  peptide fold or domain or sub-domain
ARSNLGISYLSLNMFQESATTFLGA

SEQ ID NO: 1365 - protein, 28 aa, artificial
  peptide fold or domain or sub-domain
ARSNTLNQIIEGLKFNRSELTEEEMHKG

SEQ ID NO: 1366 - protein, 23 aa, artificial
  peptide fold or domain or sub-domain
ARTATEALIRTAPQHAQLYRANL

SEQ ID NO: 1367 - protein, 21 aa, artificial
  peptide fold or domain or sub-domain
ARTMEFDEESMAYWNRTDREM

SEQ ID NO: 1368 - protein, 30 aa, artificial
  peptide fold or domain or sub-domain
ARVDHIAFDEDVEKWRVSTEAGHQVTAKYV

SEQ ID NO: 1369 - protein, 27 aa, artificial
  peptide fold or domain or sub-domain
ARVDKIAETSGVNKRMIYHYFGGKELL

SEQ ID NO: 1370 - protein, 29 aa, artificial
  peptide fold or domain or sub-domain
ARVEKLKREVEMTESEYDQDKINERIAKL

SEQ ID NO: 1371 - protein, 28 aa, artificial
  peptide fold or domain or sub-domain
ARVGDDVWGERYIANLKNQKVETKYVKQ

SEQ ID NO: 1372 - protein, 29 aa, artificial
  peptide fold or domain or sub-domain
ARVKQINRLLESTEADYEKEKLRERAARL

SEQ ID NO: 1373 - protein, 30 aa, artificial
  peptide fold or domain or sub-domain
ARVLEAHPIPGTRLKRLVLDAGRTVEVVSG

SEQ ID NO: 1374 - protein, 29 aa, artificial
  peptide fold or domain or sub-domain
ARVRLLQSRLERLMTEESREAIRERISKL

SEQ ID NO: 1375 - protein, 30 aa, artificial
  peptide fold or domain or sub-domain
ARVRVTAGDRLGGWGTAGCADDVELSLRDL

SEQ ID NO: 1376 - protein, 29 aa, artificial
  peptide fold or domain or sub-domain
ARVTLDGNPEMGHLRTLANDGPTLDERNI

SEQ ID NO: 1377 - protein, 23 aa, artificial
  peptide fold or domain or sub-domain
ARVVRVIDGDTLILAMGNQQKRV

SEQ ID NO: 1378 - protein, 26 aa, artificial
  peptide fold or domain or sub-domain
ARYCMQLHGGYGYVDEHPLTMHYVDA

SEQ ID NO: 1379 - protein, 24 aa, artificial
  peptide fold or domain or sub-domain
ARYFERMGKLDANNAGSNRELIGH

SEQ ID NO: 1380 - protein, 29 aa, artificial
  peptide fold or domain or sub-domain
ARYGLRDNRLTTRLADGRIDRRYLTADEI

SEQ ID NO: 1381 - protein, 25 aa, artificial
  peptide fold or domain or sub-domain
ARYNLAVSSMNIGCFKEAAGYLLSV

SEQ ID NO: 1382 - protein, 29 aa, artificial
  peptide fold or domain or sub-domain
ARYNLRGRNLAVHRSGATEHIRFDSAAQV

SEQ ID NO: 1383 - protein, 30 aa, artificial
  peptide fold or domain or sub-domain
ASAAFYWSKKENSTIQPGASVKETQLARYR

SEQ ID NO: 1384 - protein, 26 aa, artificial
  peptide fold or domain or sub-domain
ASAAILKEILSGEATEVVVEKIHELL

SEQ ID NO: 1385 - protein, 25 aa, artificial
  peptide fold or domain or sub-domain
ASADVFRQILEGDLNPTMAFMSGRL

SEQ ID NO: 1386 - protein, 25 aa, artificial
  peptide fold or domain or sub-domain
ASADYSDLASGIGANLIDPEGYWVS

SEQ ID NO: 1387 - protein, 20 aa, artificial
  peptide fold or domain or sub-domain
ASAEGGPSADNGESDIQHEN

SEQ ID NO: 1388 - protein, 24 aa, artificial
  peptide fold or domain or sub-domain
ASAFCGTCRWCMRGELQHCAHKRR

SEQ ID NO: 1389 - protein, 27 aa, artificial
  peptide fold or domain or sub-domain
ASAGADYNDTRPASKPQSPSELEQKFP

SEQ ID NO: 1390 - protein, 28 aa, artificial
  peptide fold or domain or sub-domain
ASAKAIHAELNAREHSVGLTTVYRTLQS

SEQ ID NO: 1391 - protein, 27 aa, artificial
  peptide fold or domain or sub-domain
ASAKLTLGDFNMGDLGNVGIGNDTISS

SEQ ID NO: 1392 - protein, 23 aa, artificial
  peptide fold or domain or sub-domain
ASANHIDKSEVDDQKMLATLNNP

SEQ ID NO: 1393 - protein, 24 aa, artificial
  peptide fold or domain or sub-domain
ASAQDLIAFMDGKVSAIKRITGGV

SEQ ID NO: 1394 - protein, 29 aa, artificial
  peptide fold or domain or sub-domain
ASAQWRGDLRSGQGTIRTESGVLKDAQYS

SEQ ID NO: 1395 - protein, 25 aa, artificial
  peptide fold or domain or sub-domain
ASATNNEGILLSPNYPLNYENNHEC

SEQ ID NO: 1396 - protein, 26 aa, artificial
  peptide fold or domain or sub-domain
ASATSEEGQDPASSAIDGNINTMWHT

SEQ ID NO: 1397 - protein, 28 aa, artificial
  peptide fold or domain or sub-domain
ASAYYTQYLPFFKLPEVTMMMGGFAGRE

SEQ ID NO: 1398 - protein, 20 aa, artificial
  peptide fold or domain or sub-domain
ASCHEQYFDHYIRADHLSQG

SEQ ID NO: 1399 - protein, 20 aa, artificial
  peptide fold or domain or sub-domain
ASCHGAEGEGLRRESKDGKP

SEQ ID NO: 1400 - protein, 20 aa, artificial
  peptide fold or domain or sub-domain
ASCHKENGEGGATLTALEGK

SEQ ID NO: 1401 - protein, 20 aa, artificial
  peptide fold or domain or sub-domain
ASCHLNAGTVADGSPYVGIS

SEQ ID NO: 1402 - protein, 20 aa, artificial
  peptide fold or domain or sub-domain
ASCLRWVCKLTGTDEPALLA

SEQ ID NO: 1403 - protein, 25 aa, artificial
  peptide fold or domain or sub-domain
ASDEVRAGHSDLDSRDAGRAMEMAA

SEQ ID NO: 1404 - protein, 27 aa, artificial
  peptide fold or domain or sub-domain
ASDILQPPGDDVARIAWYLRDLISRYQ

SEQ ID NO: 1405 - protein, 27 aa, artificial
  peptide fold or domain or sub-domain
ASDLEIISKNTPEYAERITGVPVRDIE

SEQ ID NO: 1406 - protein, 27 aa, artificial
  peptide fold or domain or sub-domain
ASDLKGIANKQFAQQNLDTAVAKWQKA

SEQ ID NO: 1407 - protein, 26 aa, artificial
  peptide fold or domain or sub-domain
ASDRREMFADASMTGAEKRALMRFLK

SEQ ID NO: 1408 - protein, 24 aa, artificial
  peptide fold or domain or sub-domain
ASEEQLAEDIYGITFHNNKGGYLQ

SEQ ID NO: 1409 - protein, 23 aa, artificial
  peptide fold or domain or sub-domain
ASEFYRSKQTHPNYHALIVALSE

SEQ ID NO: 1410 - protein, 29 aa, artificial
  peptide fold or domain or sub-domain
ASEMALLGKKVIRHQGKVTTEDGTLAGSD

SEQ ID NO: 1411 - protein, 20 aa, artificial
  peptide fold or domain or sub-domain
ASENGWETLLEFVPIPQVAE

SEQ ID NO: 1412 - protein, 24 aa, artificial
  peptide fold or domain or sub-domain
ASERIKTGFLHFKKEKYDKNPALY

SEQ ID NO: 1413 - protein, 28 aa, artificial
  peptide fold or domain or sub-domain
ASFEETLYLLWNGVLPDAGRLEGLRGDL

SEQ ID NO: 1414 - protein, 21 aa, artificial
  peptide fold or domain or sub-domain
ASFGILVSERAGDIKEAFEMA

SEQ ID NO: 1415 - protein, 21 aa, artificial
  peptide fold or domain or sub-domain
ASFLLKYFTLLIKTPENLKDF

SEQ ID NO: 1416 - protein, 20 aa, artificial
  peptide fold or domain or sub-domain
ASFRDIKSELNLGISDVTIR

SEQ ID NO: 1417 - protein, 30 aa, artificial
  peptide fold or domain or sub-domain
ASFRHANVDLESSEAFELARRGTPRAQLPG

SEQ ID NO: 1418 - protein, 23 aa, artificial
  peptide fold or domain or sub-domain
ASFSESRALRLLQESGNGFVRHN

SEQ ID NO: 1419 - protein, 28 aa, artificial
  peptide fold or domain or sub-domain
ASFTCRSAYAAAGKARDFSLVKEEFKRL

SEQ ID NO: 1420 - protein, 28 aa, artificial
  peptide fold or domain or sub-domain
ASFYEAAHLILFGRLPCDEELKEIKSKI

SEQ ID NO: 1421 - protein, 20 aa, artificial
  peptide fold or domain or sub-domain
ASGDALGQLGIVRQRQAAIV

SEQ ID NO: 1422 - protein, 20 aa, artificial
  peptide fold or domain or sub-domain
ASGERVKVLAQRFGVSVSTV

SEQ ID NO: 1423 - protein, 28 aa, artificial
  peptide fold or domain or sub-domain
ASGETQTAMAEVLEAQDLSLNELNWSNA

SEQ ID NO: 1424 - protein, 24 aa, artificial
  peptide fold or domain or sub-domain
ASGIPGDWALYDVDGKNGEHREMT

SEQ ID NO: 1425 - protein, 30 aa, artificial
  peptide fold or domain or sub-domain
ASGIWSDKGSKLFSISQALKSGVVWGNTYN

SEQ ID NO: 1426 - protein, 20 aa, artificial
  peptide fold or domain or sub-domain
ASGNELKMHFESVDAHQLYN

SEQ ID NO: 1427 - protein, 20 aa, artificial
  peptide fold or domain or sub-domain
ASGRVTSKAIRQEIDSEELG

SEQ ID NO: 1428 - protein, 29 aa, artificial
  peptide fold or domain or sub-domain
ASHWLWGAGRSNQRGIALANLVLNSEVDS

SEQ ID NO: 1429 - protein, 27 aa, artificial
  peptide fold or domain or sub-domain
ASIADITRKGGVALGTFYVYFPDKQSI

SEQ ID NO: 1430 - protein, 21 aa, artificial
  peptide fold or domain or sub-domain
ASIASSSKGGRIGIEEFAKYL

SEQ ID NO: 1431 - protein, 29 aa, artificial
  peptide fold or domain or sub-domain
ASISGDHIVMRKGADLFDFNLASGETTPI

SEQ ID NO: 1432 - protein, 29 aa, artificial
  peptide fold or domain or sub-domain
ASITNPKLGLINNWILHIRDLYLKHQEYL

SEQ ID NO: 1433 - protein, 26 aa, artificial
  peptide fold or domain or sub-domain
ASIYLAISDKTQNESTAIFGETITPA

SEQ ID NO: 1434 - protein, 30 aa, artificial
  peptide fold or domain or sub-domain
ASKAESVAASQRLASQAGIMVGISSGAALH

SEQ ID NO: 1435 - protein, 23 aa, artificial
  peptide fold or domain or sub-domain
ASKAIATEYNLNVSPATVRNTML

SEQ ID NO: 1436 - protein, 26 aa, artificial
  peptide fold or domain or sub-domain
ASKAMQVMGAYSYTTEFPIERIFRDA

SEQ ID NO: 1437 - protein, 30 aa, artificial
  peptide fold or domain or sub-domain
ASKEEVNTIFAKALKGEKVSFEEETKFRTF

SEQ ID NO: 1438 - protein, 29 aa, artificial
  peptide fold or domain or sub-domain
ASKESTPNMDRISEIVKRLGESFSVLSGD

SEQ ID NO: 1439 - protein, 28 aa, artificial
  peptide fold or domain or sub-domain
ASKFDDSIKQHAKMWESVQNPDGTFNSN

SEQ ID NO: 1440 - protein, 29 aa, artificial
  peptide fold or domain or sub-domain
ASKKEQLNWNRFIGGLDSKNGRTGEYFYF

SEQ ID NO: 1441 - protein, 22 aa, artificial
  peptide fold or domain or sub-domain
ASKQGKKLVLSVGYSHPVEIEP

SEQ ID NO: 1442 - protein, 30 aa, artificial
  peptide fold or domain or sub-domain
ASKQGKKLVLSVGYSHPVEIEPEEGLEIEV

SEQ ID NO: 1443 - protein, 29 aa, artificial
  peptide fold or domain or sub-domain
ASKVTLEGYQNYSGGLDTHTNVTGKESYA

SEQ ID NO: 1444 - protein, 28 aa, artificial
  peptide fold or domain or sub-domain
ASKYVMKDVDVEYPWAPGTVYNTKQIAR

SEQ ID NO: 1445 - protein, 25 aa, artificial
  peptide fold or domain or sub-domain
ASLAEKLDACADFSHSGLEAAFKEF

SEQ ID NO: 1446 - protein, 26 aa, artificial
  peptide fold or domain or sub-domain
ASLASKLIKARRSGVDIGSDKILEDY

SEQ ID NO: 1447 - protein, 27 aa, artificial
  peptide fold or domain or sub-domain
ASLEDIKEASGVSQGSMYFHFKSKEQI

SEQ ID NO: 1448 - protein, 27 aa, artificial
  peptide fold or domain or sub-domain
ASLERILAKTSVSKGALYHHFGTKQEL

SEQ ID NO: 1449 - protein, 27 aa, artificial
  peptide fold or domain or sub-domain
ASLIERQVSALGLPEAKTQYLVAAIGL

SEQ ID NO: 1450 - protein, 26 aa, artificial
  peptide fold or domain or sub-domain
ASLKRIEECLKKKGSNKELLDACNQF

SEQ ID NO: 1451 - protein, 20 aa, artificial
  peptide fold or domain or sub-domain
ASLLCLLDLVEAGQRDLGNG

SEQ ID NO: 1452 - protein, 22 aa, artificial
  peptide fold or domain or sub-domain
ASLPELLSTVPIHPNKLPYLPR

SEQ ID NO: 1453 - protein, 23 aa, artificial
  peptide fold or domain or sub-domain
ASLQDIGQAVGLSPSPCWARIRR

SEQ ID NO: 1454 - protein, 20 aa, artificial
  peptide fold or domain or sub-domain
ASLQNEAIKLKKDSLTEDEE

SEQ ID NO: 1455 - protein, 22 aa, artificial
  peptide fold or domain or sub-domain
ASLSELVISIPVPETRKPHLPR

SEQ ID NO: 1456 - protein, 22 aa, artificial
  peptide fold or domain or sub-domain
ASLSQILSKVHLHPSRVSSLRR

SEQ ID NO: 1457 - protein, 29 aa, artificial
  peptide fold or domain or sub-domain
ASLTWSTNPNPQFTPGSGGAAAYRSSKAA

SEQ ID NO: 1458 - protein, 20 aa, artificial
  peptide fold or domain or sub-domain
ASMDGFDGVDHAAKLEKNLK

SEQ ID NO: 1459 - protein, 22 aa, artificial
  peptide fold or domain or sub-domain
ASMGKTYQEIALILGITTSTVK

SEQ ID NO: 1460 - protein, 30 aa, artificial
  peptide fold or domain or sub-domain
ASMKEEKGDQVLVELSNGQKMTVNKEDIQK

SEQ ID NO: 1461 - protein, 28 aa, artificial
  peptide fold or domain or sub-domain
ASMVFTKNISVANWFARDIKSGTVWINS

SEQ ID NO: 1462 - protein, 29 aa, artificial
  peptide fold or domain or sub-domain
ASNIQPVIDQIMDENRDVDVADALGELAD

SEQ ID NO: 1463 - protein, 20 aa, artificial
  peptide fold or domain or sub-domain
ASNLYESECMNETEWTIYQD

SEQ ID NO: 1464 - protein, 28 aa, artificial
  peptide fold or domain or sub-domain
ASNLYESECMNETEWTIYQDWHDWMNNQ

SEQ ID NO: 1465 - protein, 30 aa, artificial
  peptide fold or domain or sub-domain
ASPFHMEARNFARVAESLAPLLGQDAFELE

SEQ ID NO: 1466 - protein, 20 aa, artificial
  peptide fold or domain or sub-domain
ASPLTLKYGERVRLKFVNDS

SEQ ID NO: 1467 - protein, 20 aa, artificial
  peptide fold or domain or sub-domain
ASPRIVEAMTGEETDMSSLG

SEQ ID NO: 1468 - protein, 27 aa, artificial
  peptide fold or domain or sub-domain
ASQAEEDVISALVNLGYQRAAAEQAVT

SEQ ID NO: 1469 - protein, 24 aa, artificial
  peptide fold or domain or sub-domain
ASQAQVDKSDYDMVDYLNELRESC

SEQ ID NO: 1470 - protein, 20 aa, artificial
  peptide fold or domain or sub-domain
ASQDGSYLMASGQCGCHGYK

SEQ ID NO: 1471 - protein, 21 aa, artificial
  peptide fold or domain or sub-domain
ASQEFVKNTSPLSDVDSRYKY

SEQ ID NO: 1472 - protein, 23 aa, artificial
  peptide fold or domain or sub-domain
ASQPLLSRHELEWSPATVRSVMA

SEQ ID NO: 1473 - protein, 28 aa, artificial
  peptide fold or domain or sub-domain
ASQWKQSKTIQAFMQQHQLADIHALQAY

SEQ ID NO: 1474 - protein, 23 aa, artificial
  peptide fold or domain or sub-domain
ASRDNFQPWKDPYGKIVTVMSEI

SEQ ID NO: 1475 - protein, 21 aa, artificial
  peptide fold or domain or sub-domain
ASREFFANSESLHDAGTKSAA

SEQ ID NO: 1476 - protein, 30 aa, artificial
  peptide fold or domain or sub-domain
ASRFGEVPVLVADGVPLCQSNAILQWLADS

SEQ ID NO: 1477 - protein, 24 aa, artificial
  peptide fold or domain or sub-domain
ASRGFFQFNDLLEHGEASAYRDWF

SEQ ID NO: 1478 - protein, 22 aa, artificial
  peptide fold or domain or sub-domain
ASRGFYFFNDILENGPHSPWLD

SEQ ID NO: 1479 - protein, 22 aa, artificial
  peptide fold or domain or sub-domain
ASRGKDSKDIGKILGLSEHTTR

SEQ ID NO: 1480 - protein, 28 aa, artificial
  peptide fold or domain or sub-domain
ASRGYYWMGRTAEILGEHKNAQHYFHRA

SEQ ID NO: 1481 - protein, 26 aa, artificial
  peptide fold or domain or sub-domain
ASRKVAEYFRKQNIEVTDRQIDHALE

SEQ ID NO: 1482 - protein, 20 aa, artificial
  peptide fold or domain or sub-domain
ASRPPVTLRLVVPASQCGSL

SEQ ID NO: 1483 - protein, 28 aa, artificial
  peptide fold or domain or sub-domain
ASRPPVTLRLVVPASQCGSLIGKGGCKI

SEQ ID NO: 1484 - protein, 26 aa, artificial
  peptide fold or domain or sub-domain
ASRQEEVEIAEELEDESLGSEIAGGI

SEQ ID NO: 1485 - protein, 21 aa, artificial
  peptide fold or domain or sub-domain
ASRWGRLPRVRADGELAARVE

SEQ ID NO: 1486 - protein, 24 aa, artificial
  peptide fold or domain or sub-domain
ASSACRECNRCKSDNEQYCAKAAS

SEQ ID NO: 1487 - protein, 26 aa, artificial
  peptide fold or domain or sub-domain
ASSAVEWMGGMGFVREGIAEKMFRDS

SEQ ID NO: 1488 - protein, 24 aa, artificial
  peptide fold or domain or sub-domain
ASSDAVEFQDVLRYGKESKFFDWF

SEQ ID NO: 1489 - protein, 26 aa, artificial
  peptide fold or domain or sub-domain
ASSGSSALFAEYFKSTSGNIRSAVAA

SEQ ID NO: 1490 - protein, 28 aa, artificial
  peptide fold or domain or sub-domain
ASSKREAREFINAKAISFNDVAVQDENM

SEQ ID NO: 1491 - protein, 28 aa, artificial
  peptide fold or domain or sub-domain
ASSKSEAKRLVSQGGVYIDGERIEDIKF

SEQ ID NO: 1492 - protein, 30 aa, artificial
  peptide fold or domain or sub-domain
ASSWLKENRGSHEAFITTDESVEKFCQRVI

SEQ ID NO: 1493 - protein, 30 aa, artificial
  peptide fold or domain or sub-domain
ASSYLKGHRETYSAFVTGGTGVDGYCLEVL

SEQ ID NO: 1494 - protein, 23 aa, artificial
  peptide fold or domain or sub-domain
ASTFHQFDFDSFGKYDYSRSSNP

SEQ ID NO: 1495 - protein, 22 aa, artificial
  peptide fold or domain or sub-domain
ASTIKVEECKMAGKDPTHGCGN

SEQ ID NO: 1496 - protein, 28 aa, artificial
  peptide fold or domain or sub-domain
ASTKIAGLKEFYGINSEAALSFFKVHEK

SEQ ID NO: 1497 - protein, 20 aa, artificial
  peptide fold or domain or sub-domain
ASTLIEKMEETGLRELFDSV

SEQ ID NO: 1498 - protein, 28 aa, artificial
  peptide fold or domain or sub-domain
ASTNPAAKEAVEAFKADGKGDADNFAYY

SEQ ID NO: 1499 - protein, 26 aa, artificial
  peptide fold or domain or sub-domain
ASTSVASSMRALAPGAAEADVQAALG

SEQ ID NO: 1500 - protein, 27 aa, artificial
  peptide fold or domain or sub-domain
ASTTDICAAAKISPGHLYHYFGSKEAI

SEQ ID NO: 1501 - protein, 21 aa, artificial
  peptide fold or domain or sub-domain
ASVAKMQGGAEWKKRYDAKFP

SEQ ID NO: 1502 - protein, 24 aa, artificial
  peptide fold or domain or sub-domain
ASVAKRYDLKFTKQDISSLWFLCK

SEQ ID NO: 1503 - protein, 27 aa, artificial
  peptide fold or domain or sub-domain
ASVALSAGEAAFARAQWHSDSRAHEIT

SEQ ID NO: 1504 - protein, 30 aa, artificial
  peptide fold or domain or sub-domain
ASVEDVEDHRIKIHFDGWSHGYDFWIDADH

SEQ ID NO: 1505 - protein, 24 aa, artificial
  peptide fold or domain or sub-domain
ASVEEIKAIIQPLGMEHVRATLLK

SEQ ID NO: 1506 - protein, 25 aa, artificial
  peptide fold or domain or sub-domain
ASVKNDADFGNYCDSNETLSTVFET

SEQ ID NO: 1507 - protein, 29 aa, artificial
  peptide fold or domain or sub-domain
ASVRAIAKRLGTGAMTLYRYLPTKEDLYT

SEQ ID NO: 1508 - protein, 29 aa, artificial
  peptide fold or domain or sub-domain
ASVSKGIIVYQMAADLWQHNLASNASKKI

SEQ ID NO: 1509 - protein, 23 aa, artificial
  peptide fold or domain or sub-domain
ASVTESTCLRLMHTYATEFGQAT

SEQ ID NO: 1510 - protein, 23 aa, artificial
  peptide fold or domain or sub-domain
ASVTGGRAGKASVQDSDLTINMV

SEQ ID NO: 1511 - protein, 27 aa, artificial
  peptide fold or domain or sub-domain
ASVTLPIDVRVKSRVKVTLNDGRDAGL

SEQ ID NO: 1512 - protein, 25 aa, artificial
  peptide fold or domain or sub-domain
ASVWDDGGSFEVYKRGENSWREAKD

SEQ ID NO: 1513 - protein, 27 aa, artificial
  peptide fold or domain or sub-domain
ASVYEEKLRQTGCSESRAKEASTVVNA

SEQ ID NO: 1514 - protein, 23 aa, artificial
  peptide fold or domain or sub-domain
ASVYLSESLGFNVLPNHLNIIDP

SEQ ID NO: 1515 - protein, 29 aa, artificial
  peptide fold or domain or sub-domain
ASWCLTCLEALEAAEDSTSLRTSLADLAA

SEQ ID NO: 1516 - protein, 29 aa, artificial
  peptide fold or domain or sub-domain
ASWLLECLGTLRDTRDMPGLLAAFQDFSK

SEQ ID NO: 1517 - protein, 28 aa, artificial
  peptide fold or domain or sub-domain
ASYFYTEDISRMYRVSEALESGMVGCRV

SEQ ID NO: 1518 - protein, 28 aa, artificial
  peptide fold or domain or sub-domain
ASYIWTQDVSKVLRLARGIEAGMVFVNT

SEQ ID NO: 1519 - protein, 30 aa, artificial
  peptide fold or domain or sub-domain
ASYIWTQDVSKVLRLARGIEAGMVFVNTQN

SEQ ID NO: 1520 - protein, 24 aa, artificial
  peptide fold or domain or sub-domain
ASYTLPQDVDYSLYPAPFNTSSAF

SEQ ID NO: 1521 - protein, 30 aa, artificial
  peptide fold or domain or sub-domain
ASYYYEWEDETKQVLNRIDLHSTFFCCFTF

SEQ ID NO: 1522 - protein, 29 aa, artificial
  peptide fold or domain or sub-domain
ATAAALEGGALPGGYQRVLVEKVAPSILE

SEQ ID NO: 1523 - protein, 25 aa, artificial
  peptide fold or domain or sub-domain
ATADDIEPYIRSIGLYRGKAKNLAA

SEQ ID NO: 1524 - protein, 26 aa, artificial
  peptide fold or domain or sub-domain
ATADSFETGNEPAGVLDGNASTLWHS

SEQ ID NO: 1525 - protein, 30 aa, artificial
  peptide fold or domain or sub-domain
ATAFAKSDAELGVSHLWTDVYSNNLEPKLR

SEQ ID NO: 1526 - protein, 30 aa, artificial
  peptide fold or domain or sub-domain
ATAKIDERNIVVWSPVMDKLAGQSTRIEHA

SEQ ID NO: 1527 - protein, 24 aa, artificial
  peptide fold or domain or sub-domain
ATAKLISGYQRFRNEYYPKNKEYL

SEQ ID NO: 1528 - protein, 27 aa, artificial
  peptide fold or domain or sub-domain
ATAREQEWMQDPLFNSLNAVQNNKVYK

SEQ ID NO: 1529 - protein, 23 aa, artificial
  peptide fold or domain or sub-domain
ATASAGRNGVVSTEDKLLELNLS

SEQ ID NO: 1530 - protein, 26 aa, artificial
  peptide fold or domain or sub-domain
ATASTEDSGKPASNATDGNPDSRWSS

SEQ ID NO: 1531 - protein, 23 aa, artificial
  peptide fold or domain or sub-domain
ATATGGRDGRAVSSDGVLDVKLS

SEQ ID NO: 1532 - protein, 29 aa, artificial
  peptide fold or domain or sub-domain
ATAVAWRAFGRRNANLAEADPDVGIKTFL

SEQ ID NO: 1533 - protein, 24 aa, artificial
  peptide fold or domain or sub-domain
ATAYETGLIDGVTTNPSLMLRAGE

SEQ ID NO: 1534 - protein, 29 aa, artificial
  peptide fold or domain or sub-domain
ATDAEERARRILRGLQFDAKQMHRPVNAL

SEQ ID NO: 1535 - protein, 26 aa, artificial
  peptide fold or domain or sub-domain
ATDLLVVMRCLGASPTPGEVQRHLQS

SEQ ID NO: 1536 - protein, 23 aa, artificial
  peptide fold or domain or sub-domain
ATDMADYLVKKGMPFREAHEVVG

SEQ ID NO: 1537 - protein, 26 aa, artificial
  peptide fold or domain or sub-domain
ATDQYEKLIGEGLNADQAFEVLSQQR

SEQ ID NO: 1538 - protein, 25 aa, artificial
  peptide fold or domain or sub-domain
ATDRKQGRSLIENGTGTILDHADVR

SEQ ID NO: 1539 - protein, 30 aa, artificial
  peptide fold or domain or sub-domain
ATDSELDAIVNKGVNNEDLTPKELDQYITM

SEQ ID NO: 1540 - protein, 24 aa, artificial
  peptide fold or domain or sub-domain
ATEAELRAFVADRLAAFKVPVKVV

SEQ ID NO: 1541 - protein, 24 aa, artificial
  peptide fold or domain or sub-domain
ATEKELIEHCRSRIAGYKCPRSVE

SEQ ID NO: 1542 - protein, 26 aa, artificial
  peptide fold or domain or sub-domain
ATEKFQKLRNSGMSNEKAWNQASVEL

SEQ ID NO: 1543 - protein, 29 aa, artificial
  peptide fold or domain or sub-domain
ATELTALEQDAEGVTATLLHAGQPQQVRA

SEQ ID NO: 1544 - protein, 25 aa, artificial
  peptide fold or domain or sub-domain
ATERCATCRTLAEAQAAVPSGFARV

SEQ ID NO: 1545 - protein, 25 aa, artificial
  peptide fold or domain or sub-domain
ATESEIASHISRLGLYRNKAKFLKK

SEQ ID NO: 1546 - protein, 21 aa, artificial
  peptide fold or domain or sub-domain
ATFKDIKSLLELTDGHMSTHM

SEQ ID NO: 1547 - protein, 26 aa, artificial
  peptide fold or domain or sub-domain
ATFSRRESPAVTELSERADFHWQALD

SEQ ID NO: 1548 - protein, 27 aa, artificial
  peptide fold or domain or sub-domain
ATFVCTKKCQEHLKILYGMEKATWLIV

SEQ ID NO: 1549 - protein, 27 aa, artificial
  peptide fold or domain or sub-domain
ATGALGAIAKGEKPYDAEIVKASLTTI

SEQ ID NO: 1550 - protein, 20 aa, artificial
  peptide fold or domain or sub-domain
ATGDEVYEPDGEVFPGGVRD

SEQ ID NO: 1551 - protein, 26 aa, artificial
  peptide fold or domain or sub-domain
ATGFAQALCKGEFHKLADAKIFLSDC

SEQ ID NO: 1552 - protein, 26 aa, artificial
  peptide fold or domain or sub-domain
ATGNLQLTNDFIQFNARFKGVSRELY

SEQ ID NO: 1553 - protein, 28 aa, artificial
  peptide fold or domain or sub-domain
ATGPTETQIKRGLHLQALKPTKPGLLPS

SEQ ID NO: 1554 - protein, 25 aa, artificial
  peptide fold or domain or sub-domain
ATGRDFSEVMAELGLDDEAAIARLA

SEQ ID NO: 1555 - protein, 20 aa, artificial
  peptide fold or domain or sub-domain
ATGSELAAPGESRAATQIFE

SEQ ID NO: 1556 - protein, 20 aa, artificial
  peptide fold or domain or sub-domain
ATGSELGGSGEPLHRGKIPD

SEQ ID NO: 1557 - protein, 24 aa, artificial
  peptide fold or domain or sub-domain
ATGTDRPAIHAQTQAAYRLLDELR

SEQ ID NO: 1558 - protein, 24 aa, artificial
  peptide fold or domain or sub-domain
ATGYGRIVRGEGGAVERIVEQKDA

SEQ ID NO: 1559 - protein, 28 aa, artificial
  peptide fold or domain or sub-domain
ATHCGVIKDSRLYKYGGRAGATDPALDP

SEQ ID NO: 1560 - protein, 29 aa, artificial
  peptide fold or domain or sub-domain
ATHGDKGKANEFSKWLAKTLGGELHLFSG

SEQ ID NO: 1561 - protein, 29 aa, artificial
  peptide fold or domain or sub-domain
ATHGVKGTRTTSNNTYEVEKTLGIEAART

SEQ ID NO: 1562 - protein, 20 aa, artificial
  peptide fold or domain or sub-domain
ATHPDMMFAVSNDDLRDRYL

SEQ ID NO: 1563 - protein, 23 aa, artificial
  peptide fold or domain or sub-domain
ATHPPTTTHRSVPEAERPSLGVT

SEQ ID NO: 1564 - protein, 23 aa, artificial
  peptide fold or domain or sub-domain
ATHQKLAQDIPLSASQIGRRIQR

SEQ ID NO: 1565 - protein, 29 aa, artificial
  peptide fold or domain or sub-domain
ATHVFCCGPKPLMDEIKAVSGHWPEGRVH

SEQ ID NO: 1566 - protein, 30 aa, artificial
  peptide fold or domain or sub-domain
ATIGDVKGDEVHITFDGWSGAFDYWCKYDS

SEQ ID NO: 1567 - protein, 27 aa, artificial
  peptide fold or domain or sub-domain
ATIITNEKGKEHLSLYYDTKDWDFIIV

SEQ ID NO: 1568 - protein, 30 aa, artificial
  peptide fold or domain or sub-domain
ATILRREEQGFVARVEDGLEVKITSEHAEK

SEQ ID NO: 1569 - protein, 27 aa, artificial
  peptide fold or domain or sub-domain
ATIVCTDKAVDQLKAMYKLYNRNFLVV

SEQ ID NO: 1570 - protein, 28 aa, artificial
  peptide fold or domain or sub-domain
ATIVDLLVATGLAESRGAARRTVNEGGA

SEQ ID NO: 1571 - protein, 20 aa, artificial
  peptide fold or domain or sub-domain
ATIVSGVVTRRHGAATGRRP

SEQ ID NO: 1572 - protein, 27 aa, artificial
  peptide fold or domain or sub-domain
ATIYCTQKAVPLLEAFASVPPERAVAI

SEQ ID NO: 1573 - protein, 27 aa, artificial
  peptide fold or domain or sub-domain
ATIYISDKGRKGIERFFDLSNWNVKSV

SEQ ID NO: 1574 - protein, 23 aa, artificial
  peptide fold or domain or sub-domain
ATKLNYKKVIDSSTAYNLIITHD

SEQ ID NO: 1575 - protein, 27 aa, artificial
  peptide fold or domain or sub-domain
ATKPIAAMLKGEAKFDQAVVQKSLAAI

SEQ ID NO: 1576 - protein, 26 aa, artificial
  peptide fold or domain or sub-domain
ATLAEVLIAAQRRKKDLGSLAVLRRF

SEQ ID NO: 1577 - protein, 26 aa, artificial
  peptide fold or domain or sub-domain
ATLAKLMLNAIAEGEDFASEELLKAY

SEQ ID NO: 1578 - protein, 22 aa, artificial
  peptide fold or domain or sub-domain
ATLANIAADTGVHASRLTDLRC

SEQ ID NO: 1579 - protein, 22 aa, artificial
  peptide fold or domain or sub-domain
ATLDEIASYCELERGAAATLIK

SEQ ID NO: 1580 - protein, 23 aa, artificial
  peptide fold or domain or sub-domain
ATLIKAIDGDTVKLMYKGQPMTF

SEQ ID NO: 1581 - protein, 25 aa, artificial
  peptide fold or domain or sub-domain
ATLMVEKGILTQDELESLAGGPFPL

SEQ ID NO: 1582 - protein, 25 aa, artificial
  peptide fold or domain or sub-domain
ATLPLSISPPTWISKHSLVDTQKVA

SEQ ID NO: 1583 - protein, 27 aa, artificial
  peptide fold or domain or sub-domain
ATLRDQLFRLELSATIASCGLEPAAVR

SEQ ID NO: 1584 - protein, 30 aa, artificial
  peptide fold or domain or sub-domain
ATLVSAANLDLVAQYRQSGTGDLVESISAT

SEQ ID NO: 1585 - protein, 27 aa, artificial
  peptide fold or domain or sub-domain
ATMDEIAEAAGVAKGTLYYHFKSKDDI

SEQ ID NO: 1586 - protein, 23 aa, artificial
  peptide fold or domain or sub-domain
ATMNAWNAFFKGTRWKEAYARIG

SEQ ID NO: 1587 - protein, 26 aa, artificial
  peptide fold or domain or sub-domain
ATNGMQALGGYATLPEYDMERYFREA

SEQ ID NO: 1588 - protein, 26 aa, artificial
  peptide fold or domain or sub-domain
ATNGSLATFETFFKKTDLRTRRPVAS

SEQ ID NO: 1589 - protein, 20 aa, artificial
  peptide fold or domain or sub-domain
ATNPRDFKNYDNERVREDFL

SEQ ID NO: 1590 - protein, 23 aa, artificial
  peptide fold or domain or sub-domain
ATNTGGRNGHVQTDDKAIDVAIV

SEQ ID NO: 1591 - protein, 24 aa, artificial
  peptide fold or domain or sub-domain
ATPDDIHPYIQSITFPNNKAGYLA

SEQ ID NO: 1592 - protein, 21 aa, artificial
  peptide fold or domain or sub-domain
ATPDRITDSTAAFARDMRTSY

SEQ ID NO: 1593 - protein, 22 aa, artificial
  peptide fold or domain or sub-domain
ATPEKLATGTGIRAEYVTSLLG

SEQ ID NO: 1594 - protein, 27 aa, artificial
  peptide fold or domain or sub-domain
ATPFTGELAKNPVWKSLPFVKAGDVHR

SEQ ID NO: 1595 - protein, 23 aa, artificial
  peptide fold or domain or sub-domain
ATPLHGSDAALKAHNMDADVRIQ

SEQ ID NO: 1596 - protein, 27 aa, artificial
  peptide fold or domain or sub-domain
ATPSEILGRRLRDLKRDRDVETEEQIQ

SEQ ID NO: 1597 - protein, 23 aa, artificial
  peptide fold or domain or sub-domain
ATQLELSRAVGLSQPAVAERIRK

SEQ ID NO: 1598 - protein, 23 aa, artificial
  peptide fold or domain or sub-domain
ATQRALERVAEGVPFRSAYQQAA

SEQ ID NO: 1599 - protein, 24 aa, artificial
  peptide fold or domain or sub-domain
ATRDMTASIAKQGITLDKQVSIVE

SEQ ID NO: 1600 - protein, 21 aa, artificial
  peptide fold or domain or sub-domain
ATRMGYPMHYNNTQEIWDELR

SEQ ID NO: 1601 - protein, 25 aa, artificial
  peptide fold or domain or sub-domain
ATRTVQNTLPWMRIKNLSHLEWLQV

SEQ ID NO: 1602 - protein, 28 aa, artificial
  peptide fold or domain or sub-domain
ATSALEMQQNASRDSWSFEYTDERLHRI

SEQ ID NO: 1603 - protein, 26 aa, artificial
  peptide fold or domain or sub-domain
ATSANFSGQKESTTAHEVARTLGSLI

SEQ ID NO: 1604 - protein, 26 aa, artificial
  peptide fold or domain or sub-domain
ATSANISGKPPSPRLEEIVRDLDAVD

SEQ ID NO: 1605 - protein, 26 aa, artificial
  peptide fold or domain or sub-domain
ATSANLSGFPSAVSADEVKQDFPEED

SEQ ID NO: 1606 - protein, 26 aa, artificial
  peptide fold or domain or sub-domain
ATSANLSGQAECTTARALKQQMEERL

SEQ ID NO: 1607 - protein, 26 aa, artificial
  peptide fold or domain or sub-domain
ATSANVSGEPSVTNPAALDPAFRARV

SEQ ID NO: 1608 - protein, 23 aa, artificial
  peptide fold or domain or sub-domain
ATSERFVKMKEDIIHLMNNMEGM

SEQ ID NO: 1609 - protein, 26 aa, artificial
  peptide fold or domain or sub-domain
ATSHHLGQNFSKMFEIKFEDDKRQKA

SEQ ID NO: 1610 - protein, 28 aa, artificial
  peptide fold or domain or sub-domain
ATSKSEAREFIKDNTIKLFNQKIKSLDF

SEQ ID NO: 1611 - protein, 20 aa, artificial
  peptide fold or domain or sub-domain
ATSLATFQSCNITGVPKSTR

SEQ ID NO: 1612 - protein, 27 aa, artificial
  peptide fold or domain or sub-domain
ATSLDDIADRIGFTKPAIYYYFKSKED

SEQ ID NO: 1613 - protein, 27 aa, artificial
  peptide fold or domain or sub-domain
ATSMGILAENLGISKSAIYHHVPSKGD

SEQ ID NO: 1614 - protein, 27 aa, artificial
  peptide fold or domain or sub-domain
ATSMRDLAGQLGMQGGSLYAHISGKEE

SEQ ID NO: 1615 - protein, 20 aa, artificial
  peptide fold or domain or sub-domain
ATSPEQVPGMDTAELRRRYL

SEQ ID NO: 1616 - protein, 26 aa, artificial
  peptide fold or domain or sub-domain
ATSQLQMGNEWVEFSARFSGKSHKIE

SEQ ID NO: 1617 - protein, 26 aa, artificial
  peptide fold or domain or sub-domain
ATSSGYVQSYQPSNVTDGNAGTYWES

SEQ ID NO: 1618 - protein, 25 aa, artificial
  peptide fold or domain or sub-domain
ATSTYRSVAYFANYAIYGRKFFPED

SEQ ID NO: 1619 - protein, 27 aa, artificial
  peptide fold or domain or sub-domain
ATSYDDVKAYTPAWAEQITGVSRSQII

SEQ ID NO: 1620 - protein, 29 aa, artificial
  peptide fold or domain or sub-domain
ATTDGTRIVWHSRGEIRILDSLDAAIRTL

SEQ ID NO: 1621 - protein, 29 aa, artificial
  peptide fold or domain or sub-domain
ATTGIEGEDTVTGLGCRDRDVLPVEMVVV

SEQ ID NO: 1622 - protein, 28 aa, artificial
  peptide fold or domain or sub-domain
ATTHFAREERMMAEIGYSALPSQKAEHE

SEQ ID NO: 1623 - protein, 23 aa, artificial
  peptide fold or domain or sub-domain
ATTIAKELAELDPDNRDQYEANL

SEQ ID NO: 1624 - protein, 26 aa, artificial
  peptide fold or domain or sub-domain
ATTISSPAKAQFTEALGATLAINYTT

SEQ ID NO: 1625 - protein, 28 aa, artificial
  peptide fold or domain or sub-domain
ATTKAALVWREARKHNDYNLFKSHLQKV

SEQ ID NO: 1626 - protein, 23 aa, artificial
  peptide fold or domain or sub-domain
ATTKGGRNGRAILDDGGLGLAMA

SEQ ID NO: 1627 - protein, 20 aa, artificial
  peptide fold or domain or sub-domain
ATTLKSQLQTVQGEKVYQEL

SEQ ID NO: 1628 - protein, 23 aa, artificial
  peptide fold or domain or sub-domain
ATTLMEWMIARGMPQRTAHHLVG

SEQ ID NO: 1629 - protein, 20 aa, artificial
  peptide fold or domain or sub-domain
ATTMKDTRFIDAIGSDIKKP

SEQ ID NO: 1630 - protein, 30 aa, artificial
  peptide fold or domain or sub-domain
ATTQGLASQSAISSANLANVPPRVADINIS

SEQ ID NO: 1631 - protein, 22 aa, artificial
  peptide fold or domain or sub-domain
ATTRLMKGEITLSQWIPLMEEN

SEQ ID NO: 1632 - protein, 23 aa, artificial
  peptide fold or domain or sub-domain
ATTTASKDLARYGLTREELEERW

SEQ ID NO: 1633 - protein, 29 aa, artificial
  peptide fold or domain or sub-domain
ATTTWQGGLARGNGRIQPDSGAFDTLPVT

SEQ ID NO: 1634 - protein, 27 aa, artificial
  peptide fold or domain or sub-domain
ATTVREIAQAVGILPGSLYAHMASKED

SEQ ID NO: 1635 - protein, 23 aa, artificial
  peptide fold or domain or sub-domain
ATVEHECQIGEFSHVAPNAVLTG

SEQ ID NO: 1636 - protein, 27 aa, artificial
  peptide fold or domain or sub-domain
ATVELTHEQRERGRLKLISTDGQEVRL

SEQ ID NO: 1637 - protein, 28 aa, artificial
  peptide fold or domain or sub-domain
ATVGAVAMIDDAVTPHEEAVLTNMAFME

SEQ ID NO: 1638 - protein, 29 aa, artificial
  peptide fold or domain or sub-domain
ATVIVDGKIVPQPDAELSSAIAHMHLGER

SEQ ID NO: 1639 - protein, 30 aa, artificial
  peptide fold or domain or sub-domain
ATVKSVHGRLINVNFDGWDEEFDELYDVDS

SEQ ID NO: 1640 - protein, 30 aa, artificial
  peptide fold or domain or sub-domain
ATVMGLTGVRLRLRLDGSDNSNDFWRLVDS

SEQ ID NO: 1641 - protein, 23 aa, artificial
  peptide fold or domain or sub-domain
ATVNYVHDGDTLYLDTGREELKV

SEQ ID NO: 1642 - protein, 23 aa, artificial
  peptide fold or domain or sub-domain
ATVQRVVDGDTVDVLVDGREERV

SEQ ID NO: 1643 - protein, 27 aa, artificial
  peptide fold or domain or sub-domain
ATVSELQEKIDSGLLSGGMIPKIEACV

SEQ ID NO: 1644 - protein, 30 aa, artificial
  peptide fold or domain or sub-domain
ATVTDMVDNRFLVHFDNWDESYDYWCEASS

SEQ ID NO: 1645 - protein, 30 aa, artificial
  peptide fold or domain or sub-domain
ATVTRIIHRLLRIHFDGWEEEYDQWVDCES

SEQ ID NO: 1646 - protein, 27 aa, artificial
  peptide fold or domain or sub-domain
ATVTTNGYALGLHAPGESQLLKALPTV

SEQ ID NO: 1647 - protein, 27 aa, artificial
  peptide fold or domain or sub-domain
ATVVCTQRAKDGICKYYDCDGWNIQVV

SEQ ID NO: 1648 - protein, 30 aa, artificial
  peptide fold or domain or sub-domain
ATVVKLDGDAITARTVNGDLVETTMANALP

SEQ ID NO: 1649 - protein, 23 aa, artificial
  peptide fold or domain or sub-domain
ATVVSVGDGDTLRVRKAGQTITI

SEQ ID NO: 1650 - protein, 30 aa, artificial
  peptide fold or domain or sub-domain
ATVVTRKGYRVQLHLDCWPTEYYFWLEDDS

SEQ ID NO: 1651 - protein, 28 aa, artificial
  peptide fold or domain or sub-domain
ATVWRYWQARAMEKLGQRERAKRLYRTI

SEQ ID NO: 1652 - protein, 30 aa, artificial
  peptide fold or domain or sub-domain
ATVYQIGVEDVKEIPKKYAKTFYSSNCYIV

SEQ ID NO: 1653 - protein, 28 aa, artificial
  peptide fold or domain or sub-domain
ATWVSDKTQRLLTANKLSTASHTFRTKQ

SEQ ID NO: 1654 - protein, 29 aa, artificial
  peptide fold or domain or sub-domain
ATYDAHVAGTKVEGNIGSLVQAIDPAVTT

SEQ ID NO: 1655 - protein, 26 aa, artificial
  peptide fold or domain or sub-domain
ATYFIQQSEWDDANSNTLELSGGYHG

SEQ ID NO: 1656 - protein, 23 aa, artificial
  peptide fold or domain or sub-domain
ATYNSKLNFKNNGNWKESYKMTG

SEQ ID NO: 1657 - protein, 24 aa, artificial
  peptide fold or domain or sub-domain
ATYSFAAAALGGKILGNGMTDDLL

SEQ ID NO: 1658 - protein, 20 aa, artificial
  peptide fold or domain or sub-domain
ATYSKGRCVYNDGEKVTEID

SEQ ID NO: 1659 - protein, 29 aa, artificial
  peptide fold or domain or sub-domain
ATYVFSGSHYWRLDTNRDGWHSWPIAHQW

SEQ ID NO: 1660 - protein, 27 aa, artificial
  peptide fold or domain or sub-domain
AVAAFEKALEIKPDFHEAWNNKGIALE

SEQ ID NO: 1661 - protein, 20 aa, artificial
  peptide fold or domain or sub-domain
AVAALTMLGFAAAPSQKVVL

SEQ ID NO: 1662 - protein, 22 aa, artificial
  peptide fold or domain or sub-domain
AVAAYEKALEIKPDDEYSIINL

SEQ ID NO: 1663 - protein, 24 aa, artificial
  peptide fold or domain or sub-domain
AVADLTDAFFAGDLETARRLHLNT

SEQ ID NO: 1664 - protein, 26 aa, artificial
  peptide fold or domain or sub-domain
AVADLTDAFFAGDLETARRLHLNTLK

SEQ ID NO: 1665 - protein, 30 aa, artificial
  peptide fold or domain or sub-domain
AVAEAEAMPRPSVDDLFDYLYAEPTPNLVR

SEQ ID NO: 1666 - protein, 24 aa, artificial
  peptide fold or domain or sub-domain
AVAEGVDDTGNLRVNVDGQARLLA

SEQ ID NO: 1667 - protein, 30 aa, artificial
  peptide fold or domain or sub-domain
AVAFDEIAEVALINKDFGTYNFVGFFIENQ

SEQ ID NO: 1668 - protein, 30 aa, artificial
  peptide fold or domain or sub-domain
AVAHYLSLPPQAPESAFDYLYASLPVELHA

SEQ ID NO: 1669 - protein, 20 aa, artificial
  peptide fold or domain or sub-domain
AVALDWASQTIFAEERQQAI

SEQ ID NO: 1670 - protein, 30 aa, artificial
  peptide fold or domain or sub-domain
AVALNHRSQLDAWQEAFQQSPYKAPPKTAV

SEQ ID NO: 1671 - protein, 21 aa, artificial
  peptide fold or domain or sub-domain
AVANHKACTFQCSCCKDKTHI

SEQ ID NO: 1672 - protein, 30 aa, artificial
  peptide fold or domain or sub-domain
AVAQAKESPIPDASELFTNMYVKDCGVESF

SEQ ID NO: 1673 - protein, 20 aa, artificial
  peptide fold or domain or sub-domain
AVASADLRRLAAAGYPLRYL

SEQ ID NO: 1674 - protein, 25 aa, artificial
  peptide fold or domain or sub-domain
AVATDTPEIAAVVAAHGGEAVMTRT

SEQ ID NO: 1675 - protein, 22 aa, artificial
  peptide fold or domain or sub-domain
AVAWAIKAGDAGLLAESLDYGS

SEQ ID NO: 1676 - protein, 30 aa, artificial
  peptide fold or domain or sub-domain
AVAWAIKAGDAGLLAESLDYGSPDDARALL

SEQ ID NO: 1677 - protein, 30 aa, artificial
  peptide fold or domain or sub-domain
AVCAVDSNTVLLNPQWVEPQVFAEYQVIEV

SEQ ID NO: 1678 - protein, 20 aa, artificial
  peptide fold or domain or sub-domain
AVCHGKEGQGRLDETPQRYP

SEQ ID NO: 1679 - protein, 30 aa, artificial
  peptide fold or domain or sub-domain
AVCVEAGMIALRRGATELTHEDYMEGILEV

SEQ ID NO: 1680 - protein, 20 aa, artificial
  peptide fold or domain or sub-domain
AVDDEIVVGYPIEKFISLLK

SEQ ID NO: 1681 - protein, 22 aa, artificial
  peptide fold or domain or sub-domain
AVDDEIVVGYPIEKFISLLKTA

SEQ ID NO: 1682 - protein, 23 aa, artificial
  peptide fold or domain or sub-domain
AVDFCQRNLGGNPGRGSSREALK

SEQ ID NO: 1683 - protein, 29 aa, artificial
  peptide fold or domain or sub-domain
AVDGIEGDVKAQKVVFKDGDSVDCDMVVF

SEQ ID NO: 1684 - protein, 20 aa, artificial
  peptide fold or domain or sub-domain
AVDGPRIRAVIAAKAESLGK

SEQ ID NO: 1685 - protein, 22 aa, artificial
  peptide fold or domain or sub-domain
AVDGTNLQGFTNQQAVEVLRHT

SEQ ID NO: 1686 - protein, 20 aa, artificial
  peptide fold or domain or sub-domain
AVDPAAAARMDTDALRANFH

SEQ ID NO: 1687 - protein, 23 aa, artificial
  peptide fold or domain or sub-domain
AVDRASENPQRFNLTPEELSSRR

SEQ ID NO: 1688 - protein, 30 aa, artificial
  peptide fold or domain or sub-domain
AVDRFHKQQGRYPGVSNYQVEEDIGKLKSC

SEQ ID NO: 1689 - protein, 30 aa, artificial
  peptide fold or domain or sub-domain
AVDRHFGTRNVGEGEGFVGLLTRGVVVRED

SEQ ID NO: 1690 - protein, 23 aa, artificial
  peptide fold or domain or sub-domain
AVDRSVALRRGLPLHTFQVLGNA

SEQ ID NO: 1691 - protein, 24 aa, artificial
  peptide fold or domain or sub-domain
AVDTIVHVNNDTQEIIKIPKRAEY

SEQ ID NO: 1692 - protein, 22 aa, artificial
  peptide fold or domain or sub-domain
AVDVRPALDGPVVVTHTEPTGP

SEQ ID NO: 1693 - protein, 30 aa, artificial
  peptide fold or domain or sub-domain
AVDWFMITGSNRYGFDKCSLADRVQWCHDN

SEQ ID NO: 1694 - protein, 28 aa, artificial
  peptide fold or domain or sub-domain
AVDWLVDNGCCTEAKWIEMDKMGYRSFM

SEQ ID NO: 1695 - protein, 27 aa, artificial
  peptide fold or domain or sub-domain
AVEAVLADGRIVRASESENEDVFFAVR

SEQ ID NO: 1696 - protein, 26 aa, artificial
  peptide fold or domain or sub-domain
AVEHFFRPRRGVLESFERGELAALVG

SEQ ID NO: 1697 - protein, 28 aa, artificial
  peptide fold or domain or sub-domain
AVEHFGYEERLFADYAYPEATRHKEIHR

SEQ ID NO: 1698 - protein, 21 aa, artificial
  peptide fold or domain or sub-domain
AVEHTDPEAIKANDVEGPFAE

SEQ ID NO: 1699 - protein, 27 aa, artificial
  peptide fold or domain or sub-domain
AVEIFNAILDSGALDLEILYKKALALF

SEQ ID NO: 1700 - protein, 30 aa, artificial
  peptide fold or domain or sub-domain
AVEQALKDPLPDDHELCTDVYINNDKYYIR

SEQ ID NO: 1701 - protein, 30 aa, artificial
  peptide fold or domain or sub-domain
AVFIWGTDKPGSDIGLYRSDDNGSTWTRVN

SEQ ID NO: 1702 - protein, 25 aa, artificial
  peptide fold or domain or sub-domain
AVFKALFQHEFRRDEDLEQILEEIL

SEQ ID NO: 1703 - protein, 24 aa, artificial
  peptide fold or domain or sub-domain
AVFSNKADAFGLERARQAGIATHT

SEQ ID NO: 1704 - protein, 29 aa, artificial
  peptide fold or domain or sub-domain
AVFVVINPADRALYDEAMSGLGLPEPVAG

SEQ ID NO: 1705 - protein, 27 aa, artificial
  peptide fold or domain or sub-domain
AVGFIGSVETGRRVAARAAGKALLLEM

SEQ ID NO: 1706 - protein, 20 aa, artificial
  peptide fold or domain or sub-domain
AVGGELVDISRTPGNGQVYD

SEQ ID NO: 1707 - protein, 25 aa, artificial
  peptide fold or domain or sub-domain
AVGLGGELFPQQLVKEENWPAIAQL

SEQ ID NO: 1708 - protein, 30 aa, artificial
  peptide fold or domain or sub-domain
AVGRFQKEKGRYPGTNGVPVSIDAQDLKKR

SEQ ID NO: 1709 - protein, 23 aa, artificial
  peptide fold or domain or sub-domain
AVGSELKVIARSSAGIISAVQHR

SEQ ID NO: 1710 - protein, 26 aa, artificial
  peptide fold or domain or sub-domain
AVGTIALGDKAIEFSARFGGKLEHIT

SEQ ID NO: 1711 - protein, 25 aa, artificial
  peptide fold or domain or sub-domain
AVGVGQALAPQGEVREGRWGTVAGR

SEQ ID NO: 1712 - protein, 25 aa, artificial
  peptide fold or domain or sub-domain
AVGVGSALLDKRAIEEERFDVIRET

SEQ ID NO: 1713 - protein, 27 aa, artificial
  peptide fold or domain or sub-domain
AVHESFGSYVAQVAEVSQDNLAIRVHR

SEQ ID NO: 1714 - protein, 27 aa, artificial
  peptide fold or domain or sub-domain
AVHPRLLGYVRTLVGDPDAEDVTSEAW

SEQ ID NO: 1715 - protein, 29 aa, artificial
  peptide fold or domain or sub-domain
AVHQSDELLNKMNDWCQKTHSENGLIERI

SEQ ID NO: 1716 - protein, 21 aa, artificial
  peptide fold or domain or sub-domain
AVHRAPGDYPSGKEGDVLTVE

SEQ ID NO: 1717 - protein, 27 aa, artificial
  peptide fold or domain or sub-domain
AVHTVFGHVLGDHAPGLKDAALLGPVT

SEQ ID NO: 1718 - protein, 21 aa, artificial
  peptide fold or domain or sub-domain
AVHYTEALDLDPSHVVALCNR

SEQ ID NO: 1719 - protein, 27 aa, artificial
  peptide fold or domain or sub-domain
AVIARNLEGAKAAAGDLGGDHLAFSCD

SEQ ID NO: 1720 - protein, 28 aa, artificial
  peptide fold or domain or sub-domain
AVIDELDELYGDGRSVSFHALRQIPQLE

SEQ ID NO: 1721 - protein, 26 aa, artificial
  peptide fold or domain or sub-domain
AVIDRKDILQTHDREVIDFRGHIVPV

SEQ ID NO: 1722 - protein, 22 aa, artificial
  peptide fold or domain or sub-domain
AVIFGASHDEFGDLDPEAIGSK

SEQ ID NO: 1723 - protein, 25 aa, artificial
  peptide fold or domain or sub-domain
AVIGMLYAYDLGNESIIEIARSMLE

SEQ ID NO: 1724 - protein, 23 aa, artificial
  peptide fold or domain or sub-domain
AVIGSDGFGFAPDFVGEGDARTG

SEQ ID NO: 1725 - protein, 30 aa, artificial
  peptide fold or domain or sub-domain
AVINTNYFRKNVLIKVQDKEEEVSLDKLHQ

SEQ ID NO: 1726 - protein, 29 aa, artificial
  peptide fold or domain or sub-domain
AVIQEILQKQPAARVSTIARKMGVSLPSV

SEQ ID NO: 1727 - protein, 22 aa, artificial
  peptide fold or domain or sub-domain
AVKACNKTIELDPQNPRVWANK

SEQ ID NO: 1728 - protein, 29 aa, artificial
  peptide fold or domain or sub-domain
AVKAIEPDKVIYEDLNGNTHEVPAKFTMF

SEQ ID NO: 1729 - protein, 30 aa, artificial
  peptide fold or domain or sub-domain
AVKDLETMPPADVNDIYDYMFEKPTWTIEQ

SEQ ID NO: 1730 - protein, 29 aa, artificial
  peptide fold or domain or sub-domain
AVKEASDNFEQIMTLIDERPENFSVMTGE

SEQ ID NO: 1731 - protein, 27 aa, artificial
  peptide fold or domain or sub-domain
AVKKRHWRRMLTELPTRNHLNALCELN

SEQ ID NO: 1732 - protein, 29 aa, artificial
  peptide fold or domain or sub-domain
AVKNFQPQEEVHARHILAETEEGARSIIA

SEQ ID NO: 1733 - protein, 23 aa, artificial
  peptide fold or domain or sub-domain
AVLDHPVIRAIAETRGCSPAQVV

SEQ ID NO: 1734 - protein, 27 aa, artificial
  peptide fold or domain or sub-domain
AVLDKSAERLAELETDHGDNVLGIVGD

SEQ ID NO: 1735 - protein, 26 aa, artificial
  peptide fold or domain or sub-domain
AVLDVDRDSGETFARSLRGAVFIECD

SEQ ID NO: 1736 - protein, 25 aa, artificial
  peptide fold or domain or sub-domain
AVLFGKSWLLHVTDVLRIKPEDNLE

SEQ ID NO: 1737 - protein, 22 aa, artificial
  peptide fold or domain or sub-domain
AVLFRHLQKAYNPQAASERYAS

SEQ ID NO: 1738 - protein, 23 aa, artificial
  peptide fold or domain or sub-domain
AVLGKPPKPAKTSTVKLSGELPP

SEQ ID NO: 1739 - protein, 20 aa, artificial
  peptide fold or domain or sub-domain
AVLINGQLAIDKQQYTGALA

SEQ ID NO: 1740 - protein, 29 aa, artificial
  peptide fold or domain or sub-domain
AVLIRPTENPWPELTDWQVRDCFELLAQL

SEQ ID NO: 1741 - protein, 30 aa, artificial
  peptide fold or domain or sub-domain
AVLLPEVIKYDIPVVTEKLPELAWGLGHRT

SEQ ID NO: 1742 - protein, 30 aa, artificial
  peptide fold or domain or sub-domain
AVLLPHVLAYNASVVAGRLKDVGVAMGLDI

SEQ ID NO: 1743 - protein, 30 aa, artificial
  peptide fold or domain or sub-domain
AVLLPKCLEFAIQGEEKRFADIAKAIEICK

SEQ ID NO: 1744 - protein, 30 aa, artificial
  peptide fold or domain or sub-domain
AVLLPYVMGYIRQSCTKRMADILNALGGNS

SEQ ID NO: 1745 - protein, 26 aa, artificial
  peptide fold or domain or sub-domain
AVLSEVLIDARRQLKPLGDIRFLQEY

SEQ ID NO: 1746 - protein, 30 aa, artificial
  peptide fold or domain or sub-domain
AVLVEHVVAFNYSSAPERFKVIAEVFGIDC

SEQ ID NO: 1747 - protein, 23 aa, artificial
  peptide fold or domain or sub-domain
AVMENQILQDIATAKGKTIAQVA

SEQ ID NO: 1748 - protein, 29 aa, artificial
  peptide fold or domain or sub-domain
AVMVALGANDEFWPELPCSREPRVLATTG

SEQ ID NO: 1749 - protein, 30 aa, artificial
  peptide fold or domain or sub-domain
AVNDCANQVNGAYPDRCDLIKNFTDCVRNS

SEQ ID NO: 1750 - protein, 22 aa, artificial
  peptide fold or domain or sub-domain
AVNDRPLVDLSYDSALEVLRGI

SEQ ID NO: 1751 - protein, 20 aa, artificial
  peptide fold or domain or sub-domain
AVNGEALEGVTHEQAVAILK

SEQ ID NO: 1752 - protein, 22 aa, artificial
  peptide fold or domain or sub-domain
AVNGQDTESLSYQEATKVIGDI

SEQ ID NO: 1753 - protein, 20 aa, artificial
  peptide fold or domain or sub-domain
AVNHVDITNVCHKDIVNLIK

SEQ ID NO: 1754 - protein, 20 aa, artificial
  peptide fold or domain or sub-domain
AVNLNSDPALVPATDLEILP

SEQ ID NO: 1755 - protein, 22 aa, artificial
  peptide fold or domain or sub-domain
AVNNTNLQDVRHEEAVASLKNT

SEQ ID NO: 1756 - protein, 22 aa, artificial
  peptide fold or domain or sub-domain
AVNVSLATKDPPLDGAVLGRLM

SEQ ID NO: 1757 - protein, 22 aa, artificial
  peptide fold or domain or sub-domain
AVPHTTRSPKSYEMDGREYHYV

SEQ ID NO: 1758 - protein, 29 aa, artificial
  peptide fold or domain or sub-domain
AVPTIARKLHTLLDVGLSYIKLGQAATTL

SEQ ID NO: 1759 - protein, 26 aa, artificial
  peptide fold or domain or sub-domain
AVQATRILGPYGDLAVLGVERCLRDA

SEQ ID NO: 1760 - protein, 25 aa, artificial
  peptide fold or domain or sub-domain
AVQAVQSGQVEFIPKMWEKTFFEWM

SEQ ID NO: 1761 - protein, 26 aa, artificial
  peptide fold or domain or sub-domain
AVQGLQLAHHEVRFNARFGGQPMQVI

SEQ ID NO: 1762 - protein, 29 aa, artificial
  peptide fold or domain or sub-domain
AVQPVVNPDDSAMFTAAVAGLKHEPPTNG

SEQ ID NO: 1763 - protein, 24 aa, artificial
  peptide fold or domain or sub-domain
AVQRRVGVEWADNRLTVAAEHAAT

SEQ ID NO: 1764 - protein, 26 aa, artificial
  peptide fold or domain or sub-domain
AVREIQFANDWFFFKARFQGIEREIG

SEQ ID NO: 1765 - protein, 30 aa, artificial
  peptide fold or domain or sub-domain
AVRFAVESAYPDPEEALMHLFYDERPRLQQ

SEQ ID NO: 1766 - protein, 26 aa, artificial
  peptide fold or domain or sub-domain
AVRHLHMDNEAVSFEGRFGGVPHTLY

SEQ ID NO: 1767 - protein, 27 aa, artificial
  peptide fold or domain or sub-domain
AVRRSWLQKREGSDRTLRGREDFVEVD

SEQ ID NO: 1768 - protein, 25 aa, artificial
  peptide fold or domain or sub-domain
AVRRYLVTQGSVKVNQLHKGAVRYV

SEQ ID NO: 1769 - protein, 26 aa, artificial
  peptide fold or domain or sub-domain
AVRSRRSAPETRAPTGEAVKVTLSDC

SEQ ID NO: 1770 - protein, 25 aa, artificial
  peptide fold or domain or sub-domain
AVRTRLAIQGKRRLKDLHLDAVATV

SEQ ID NO: 1771 - protein, 20 aa, artificial
  peptide fold or domain or sub-domain
AVSALSNLGYSRDQAANAVA

SEQ ID NO: 1772 - protein, 27 aa, artificial
  peptide fold or domain or sub-domain
AVSAYLRALNLSGNHAVVHGNLACVYY

SEQ ID NO: 1773 - protein, 27 aa, artificial
  peptide fold or domain or sub-domain
AVSFTGGTATGRNIMKNAGLKKYSMEL

SEQ ID NO: 1774 - protein, 22 aa, artificial
  peptide fold or domain or sub-domain
AVSFTLVGDRDIALSAPPDLAR

SEQ ID NO: 1775 - protein, 22 aa, artificial
  peptide fold or domain or sub-domain
AVSGKSLLGLMHYDAWNIIKSV

SEQ ID NO: 1776 - protein, 30 aa, artificial
  peptide fold or domain or sub-domain
AVSIYVFNFLEIGKKIDELIEAGMEWIHVD

SEQ ID NO: 1777 - protein, 26 aa, artificial
  peptide fold or domain or sub-domain
AVSNFILDLEILAFSTRFGGMPIDIQ

SEQ ID NO: 1778 - protein, 30 aa, artificial
  peptide fold or domain or sub-domain
AVSRITQKPYLLIENNYLEPKHFTFLTQLR

SEQ ID NO: 1779 - protein, 25 aa, artificial
  peptide fold or domain or sub-domain
AVSSDSDKILQAAEAAGAVGVRRPD

SEQ ID NO: 1780 - protein, 20 aa, artificial
  peptide fold or domain or sub-domain
AVSTPMRASVFPEENPKSHL

SEQ ID NO: 1781 - protein, 27 aa, artificial
  peptide fold or domain or sub-domain
AVSYDDPEPFTPAWQEQMTGIKKEAVV

SEQ ID NO: 1782 - protein, 22 aa, artificial
  peptide fold or domain or sub-domain
AVTCYAHVLEIDPARAEVWNTM

SEQ ID NO: 1783 - protein, 23 aa, artificial
  peptide fold or domain or sub-domain
AVTDGTCLACRAGEDMHCENLEF

SEQ ID NO: 1784 - protein, 30 aa, artificial
  peptide fold or domain or sub-domain
AVTDGTCLACRAGEDMHCENLEFPGLNIDG

SEQ ID NO: 1785 - protein, 26 aa, artificial
  peptide fold or domain or sub-domain
AVTDLHFCPTAQARENLLAEGHAPGA

SEQ ID NO: 1786 - protein, 22 aa, artificial
  peptide fold or domain or sub-domain
AVTETLAQGGTVTDGENITQRM

SEQ ID NO: 1787 - protein, 30 aa, artificial
  peptide fold or domain or sub-domain
AVTKEVGEFDTLALCQTLNVEPEYVRKRFQ

SEQ ID NO: 1788 - protein, 30 aa, artificial
  peptide fold or domain or sub-domain
AVTPALVAEALHTATGHDFDRRQVALPAHV

SEQ ID NO: 1789 - protein, 30 aa, artificial
  peptide fold or domain or sub-domain
AVTSREISEILQQELGIVIDKKKIELPQPI

SEQ ID NO: 1790 - protein, 27 aa, artificial
  peptide fold or domain or sub-domain
AVTVDRIVQESGTSKGGFYHNFKSKDE

SEQ ID NO: 1791 - protein, 21 aa, artificial
  peptide fold or domain or sub-domain
AVVDFFAKRKISASRFNTMIT

SEQ ID NO: 1792 - protein, 30 aa, artificial
  peptide fold or domain or sub-domain
AVVDTVIGGRLRLLYEDGDSDDDFWCHMWS

SEQ ID NO: 1793 - protein, 25 aa, artificial
  peptide fold or domain or sub-domain
AVVERDEGGRALVRLDGRPFRIRLD

SEQ ID NO: 1794 - protein, 29 aa, artificial
  peptide fold or domain or sub-domain
AVVESFYNIKDVVLEEGVIPFDRTHGMDF

SEQ ID NO: 1795 - protein, 28 aa, artificial
  peptide fold or domain or sub-domain
AVVGFYMQVLLERFLSERHPDVVFFKSR

SEQ ID NO: 1796 - protein, 26 aa, artificial
  peptide fold or domain or sub-domain
AVVGGHWRSATRLATLAMTEQCEGFN

SEQ ID NO: 1797 - protein, 24 aa, artificial
  peptide fold or domain or sub-domain
AVVRPGPTVIATTPIPLPPEAPFD

SEQ ID NO: 1798 - protein, 24 aa, artificial
  peptide fold or domain or sub-domain
AVVTGDAVTEQKPAPEPMLKAVRL

SEQ ID NO: 1799 - protein, 30 aa, artificial
  peptide fold or domain or sub-domain
AVVTIEDLGTNFFLRPDDVGKARGAAVAQA

SEQ ID NO: 1800 - protein, 28 aa, artificial
  peptide fold or domain or sub-domain
AVVTSSNNEAALREATRDEGPLTFLRQE

SEQ ID NO: 1801 - protein, 28 aa, artificial
  peptide fold or domain or sub-domain
AVVVEPGREDVVREIERLAPGAGIHPQA

SEQ ID NO: 1802 - protein, 28 aa, artificial
  peptide fold or domain or sub-domain
AVVVHFQAERVAEAARSYDEQVTIVNQD

SEQ ID NO: 1803 - protein, 22 aa, artificial
  peptide fold or domain or sub-domain
AVVVLTEWPQFRSLDWRAVAQD

SEQ ID NO: 1804 - protein, 20 aa, artificial
  peptide fold or domain or sub-domain
AVWVNGRQVWDGERTGAERP

SEQ ID NO: 1805 - protein, 20 aa, artificial
  peptide fold or domain or sub-domain
AVWVNGVLTYENGQPTGERA

SEQ ID NO: 1806 - protein, 29 aa, artificial
  peptide fold or domain or sub-domain
AVYELSEKGSGARLSDIAERLSVTKASTN

SEQ ID NO: 1807 - protein, 20 aa, artificial
  peptide fold or domain or sub-domain
AVYVNGRRAYDGETNEGSAC

SEQ ID NO: 1808 - protein, 23 aa, artificial
  peptide fold or domain or sub-domain
AWADRVSAPGTQPQEAMAALRSL

SEQ ID NO: 1809 - protein, 25 aa, artificial
  peptide fold or domain or sub-domain
AWANMGISYANQGMYKESIPYYVRA

SEQ ID NO: 1810 - protein, 29 aa, artificial
  peptide fold or domain or sub-domain
AWATEWGSKSTNARGNAVLEHFSRLNLVL

SEQ ID NO: 1811 - protein, 30 aa, artificial
  peptide fold or domain or sub-domain
AWCDGRQWGKPMNLANAQKMLMHLSGREIE

SEQ ID NO: 1812 - protein, 27 aa, artificial
  peptide fold or domain or sub-domain
AWDNVRKKAEEDSLSYREAAYVIATGR

SEQ ID NO: 1813 - protein, 29 aa, artificial
  peptide fold or domain or sub-domain
AWEEIKRKYGVKDDPDVQLEGLKEAVERF

SEQ ID NO: 1814 - protein, 26 aa, artificial
  peptide fold or domain or sub-domain
AWFDDVDTFHDAKRCAETRRFCVVCE

SEQ ID NO: 1815 - protein, 21 aa, artificial
  peptide fold or domain or sub-domain
AWFKDLIESTRLNKAELYQHL

SEQ ID NO: 1816 - protein, 25 aa, artificial
  peptide fold or domain or sub-domain
AWFLKGNALIKLERYEEAVAAYEKA

SEQ ID NO: 1817 - protein, 24 aa, artificial
  peptide fold or domain or sub-domain
AWFQLYVGRSQEIVDDLIDRAAAA

SEQ ID NO: 1818 - protein, 20 aa, artificial
  peptide fold or domain or sub-domain
AWGATQLADGGDEAKTRDWM

SEQ ID NO: 1819 - protein, 24 aa, artificial
  peptide fold or domain or sub-domain
AWGDHSLEWIMVRDEKMEELNIVK

SEQ ID NO: 1820 - protein, 20 aa, artificial
  peptide fold or domain or sub-domain
AWGYALHHNNNDQAKAEDFV

SEQ ID NO: 1821 - protein, 20 aa, artificial
  peptide fold or domain or sub-domain
AWGYAVRRSGGSEQAAREFV

SEQ ID NO: 1822 - protein, 29 aa, artificial
  peptide fold or domain or sub-domain
AWHTAWGSERTKPKGIALLQLVNGLGLEV

SEQ ID NO: 1823 - protein, 20 aa, artificial
  peptide fold or domain or sub-domain
AWHYTSVTYEGDDNKTKDFV

SEQ ID NO: 1824 - protein, 23 aa, artificial
  peptide fold or domain or sub-domain
AWIGTRRGLEARVVPDADIQFLP

SEQ ID NO: 1825 - protein, 30 aa, artificial
  peptide fold or domain or sub-domain
AWKHVDPSEVASLHNFLRNPRAFYDWFRPL

SEQ ID NO: 1826 - protein, 20 aa, artificial
  peptide fold or domain or sub-domain
AWKLKLNQNGFVYKVDEGPA

SEQ ID NO: 1827 - protein, 26 aa, artificial
  peptide fold or domain or sub-domain
AWLAINKKGVSIFDPHTKESKNFWTF

SEQ ID NO: 1828 - protein, 25 aa, artificial
  peptide fold or domain or sub-domain
AWLSRGNVLIILRRYPEALESFNQV

SEQ ID NO: 1829 - protein, 20 aa, artificial
  peptide fold or domain or sub-domain
AWLWGRDGSGAWRVLDANTA

SEQ ID NO: 1830 - protein, 20 aa, artificial
  peptide fold or domain or sub-domain
AWLWGVNKNNVGNILDSNPA

SEQ ID NO: 1831 - protein, 29 aa, artificial
  peptide fold or domain or sub-domain
AWQFGHHRQCWQKGGRKNCSKNDQQFRLM

SEQ ID NO: 1832 - protein, 26 aa, artificial
  peptide fold or domain or sub-domain
AWQTQKMHQSGKVSPEMASNLAGRQL

SEQ ID NO: 1833 - protein, 27 aa, artificial
  peptide fold or domain or sub-domain
AWRAVKDEYENRDVTWRDAAYIVALSR

SEQ ID NO: 1834 - protein, 23 aa, artificial
  peptide fold or domain or sub-domain
AWRDWLLWSRAGAEHLPEGRAAH

SEQ ID NO: 1835 - protein, 24 aa, artificial
  peptide fold or domain or sub-domain
AWSDDSSEWRYVSSDDRARLTNRS

SEQ ID NO: 1836 - protein, 24 aa, artificial
  peptide fold or domain or sub-domain
AWSDKSPEWKYIPEETKREIGLIF

SEQ ID NO: 1837 - protein, 24 aa, artificial
  peptide fold or domain or sub-domain
AWSDNASEWDKVDVDTIEQQLNEK

SEQ ID NO: 1838 - protein, 24 aa, artificial
  peptide fold or domain or sub-domain
AWSDRSQEWQAIPKAQRKQLGLTI

SEQ ID NO: 1839 - protein, 24 aa, artificial
  peptide fold or domain or sub-domain
AWSDSAPEWNYIDPQKKGELDKRA

SEQ ID NO: 1840 - protein, 24 aa, artificial
  peptide fold or domain or sub-domain
AWSDSAREWEEVASDIQMQLLHKT

SEQ ID NO: 1841 - protein, 24 aa, artificial
  peptide fold or domain or sub-domain
AWSDSCPRWDTLPTECRDALLVKK

SEQ ID NO: 1842 - protein, 24 aa, artificial
  peptide fold or domain or sub-domain
AWSDSSSEWNNVDPYERDQLRVKM

SEQ ID NO: 1843 - protein, 24 aa, artificial
  peptide fold or domain or sub-domain
AWSGSPEALERLRSVAGDEVADAH

SEQ ID NO: 1844 - protein, 23 aa, artificial
  peptide fold or domain or sub-domain
AWSNALLGDWQQVVEKEAATVSL

SEQ ID NO: 1845 - protein, 25 aa, artificial
  peptide fold or domain or sub-domain
AWSSASIGTTPLRLALGDELTDEFK

SEQ ID NO: 1846 - protein, 29 aa, artificial
  peptide fold or domain or sub-domain
AWSSWWGSRRENDRGEEITGWITEEGYHV

SEQ ID NO: 1847 - protein, 25 aa, artificial
  peptide fold or domain or sub-domain
AWTEDASRDPRSALCGREGLPPTAL

SEQ ID NO: 1848 - protein, 29 aa, artificial
  peptide fold or domain or sub-domain
AWTLASGDTARDIAEARHMLEIRRHRVFK

SEQ ID NO: 1849 - protein, 29 aa, artificial
  peptide fold or domain or sub-domain
AWVIGHQRRCWQNGGRSNCARHDSTYQRA

SEQ ID NO: 1850 - protein, 30 aa, artificial
  peptide fold or domain or sub-domain
AWVIKEEGDQSLCALQDGSNRTVPTFELSK

SEQ ID NO: 1851 - protein, 25 aa, artificial
  peptide fold or domain or sub-domain
AWYNKALIFEELKRYDEALECYGRA

SEQ ID NO: 1852 - protein, 25 aa, artificial
  peptide fold or domain or sub-domain
AWYNKGATLDNLNQYEEAIECYDEI

SEQ ID NO: 1853 - protein, 25 aa, artificial
  peptide fold or domain or sub-domain
AWYNRGVALENLGRRAEAIASYKQA

SEQ ID NO: 1854 - protein, 22 aa, artificial
  peptide fold or domain or sub-domain
AYAQIGDPSASIPTPQPVMGRR

SEQ ID NO: 1855 - protein, 27 aa, artificial
  peptide fold or domain or sub-domain
AYARVLQQATQFRLPLRPAAYTLAVGR

SEQ ID NO: 1856 - protein, 25 aa, artificial
  peptide fold or domain or sub-domain
AYCNLGDVLKAQGLYREAYSHYLDA

SEQ ID NO: 1857 - protein, 30 aa, artificial
  peptide fold or domain or sub-domain
AYCVATDPICAQGKNVQTHLNYFDVYTDQA

SEQ ID NO: 1858 - protein, 27 aa, artificial
  peptide fold or domain or sub-domain
AYDEIRAIREKKGVDMRTAAFVSAIDK

SEQ ID NO: 1859 - protein, 30 aa, artificial
  peptide fold or domain or sub-domain
AYDIITSSIGAFLEDGYMSSNQMNEVKEGI

SEQ ID NO: 1860 - protein, 23 aa, artificial
  peptide fold or domain or sub-domain
AYDRTVNEVNASHILIRVNQNAT

SEQ ID NO: 1861 - protein, 30 aa, artificial
  peptide fold or domain or sub-domain
AYEAAIASKSGSIVDAFDCVYSEAPKLLAE

SEQ ID NO: 1862 - protein, 30 aa, artificial
  peptide fold or domain or sub-domain
AYEEDAIAVIRTCAAREGIPLGVSSGAIVW

SEQ ID NO: 1863 - protein, 26 aa, artificial
  peptide fold or domain or sub-domain
AYEQIELRRKQGYGTEVAANLCGTFL

SEQ ID NO: 1864 - protein, 20 aa, artificial
  peptide fold or domain or sub-domain
AYETVAAEAADLGIEFSDHL

SEQ ID NO: 1865 - protein, 29 aa, artificial
  peptide fold or domain or sub-domain
AYFDEMQSAEQTRKIKVRHILVDTEEKAN

SEQ ID NO: 1866 - protein, 24 aa, artificial
  peptide fold or domain or sub-domain
AYFDSTLPRRLGRRVPRDMGVPSP

SEQ ID NO: 1867 - protein, 26 aa, artificial
  peptide fold or domain or sub-domain
AYFESMDKTWLPAAGGKGANLCELTR

SEQ ID NO: 1868 - protein, 27 aa, artificial
  peptide fold or domain or sub-domain
AYFGQFTLAELKLQDTPLGLAAVVVPV

SEQ ID NO: 1869 - protein, 25 aa, artificial
  peptide fold or domain or sub-domain
AYFNRGVIQQKLKLYEDAVLSYDNA

SEQ ID NO: 1870 - protein, 29 aa, artificial
  peptide fold or domain or sub-domain
AYGPCAARLVTVFGADFRTDEVIARAHRI

SEQ ID NO: 1871 - protein, 20 aa, artificial
  peptide fold or domain or sub-domain
AYGVCAREAEARAFPLDRHL

SEQ ID NO: 1872 - protein, 22 aa, artificial
  peptide fold or domain or sub-domain
AYGVVGDPNAATDTCEPLVLGP

SEQ ID NO: 1873 - protein, 29 aa, artificial
  peptide fold or domain or sub-domain
AYHDPWCPTAPDGQGSALESLEDPSEWDA

SEQ ID NO: 1874 - protein, 24 aa, artificial
  peptide fold or domain or sub-domain
AYIDQTRSRSNGRIISRKNAVKEP

SEQ ID NO: 1875 - protein, 27 aa, artificial
  peptide fold or domain or sub-domain
AYIHHLDVTNQHITIQLSSDTIKAKQL

SEQ ID NO: 1876 - protein, 24 aa, artificial
  peptide fold or domain or sub-domain
AYLNNKKTIAEGRRIPISKAVENP

SEQ ID NO: 1877 - protein, 26 aa, artificial
  peptide fold or domain or sub-domain
AYLSSALIEFYTQGSEQGIDQYSEKC

SEQ ID NO: 1878 - protein, 29 aa, artificial
  peptide fold or domain or sub-domain
AYLTEEGFAGVKETVTTLADYEDFPAHAL

SEQ ID NO: 1879 - protein, 29 aa, artificial
  peptide fold or domain or sub-domain
AYNEIENVLKSKQIAPEYKNYFQYLKERI

SEQ ID NO: 1880 - protein, 25 aa, artificial
  peptide fold or domain or sub-domain
AYNNLGNALKDAGRNEEAISCYQTC

SEQ ID NO: 1881 - protein, 22 aa, artificial
  peptide fold or domain or sub-domain
AYPQLGTAPPDASKMGDWGIFP

SEQ ID NO: 1882 - protein, 25 aa, artificial
  peptide fold or domain or sub-domain
AYQLMCYFNNWPQHQPDVRDIKHED

SEQ ID NO: 1883 - protein, 25 aa, artificial
  peptide fold or domain or sub-domain
AYQLTCYFTNWAQYRPGLGRFMPDN

SEQ ID NO: 1884 - protein, 24 aa, artificial
  peptide fold or domain or sub-domain
AYQQALVRNSEWASKTVEEQPLLF

SEQ ID NO: 1885 - protein, 24 aa, artificial
  peptide fold or domain or sub-domain
AYRDWFHIHSFPVRQNENGNIEGE

SEQ ID NO: 1886 - protein, 26 aa, artificial
  peptide fold or domain or sub-domain
AYRQMIEEEKQGIERDYAFANHSVDW

SEQ ID NO: 1887 - protein, 24 aa, artificial
  peptide fold or domain or sub-domain
AYSAKKYKGERLYKLAREGKIINL

SEQ ID NO: 1888 - protein, 27 aa, artificial
  peptide fold or domain or sub-domain
AYSAVSQVAKEHKVTLRTAAFIVACTR

SEQ ID NO: 1889 - protein, 30 aa, artificial
  peptide fold or domain or sub-domain
AYSGYLNVQEIDQSEGIIGKISEGKLRRID

SEQ ID NO: 1890 - protein, 29 aa, artificial
  peptide fold or domain or sub-domain
AYSMSQLKTKFGTSFEKIAVPLDINFDAV

SEQ ID NO: 1891 - protein, 26 aa, artificial
  peptide fold or domain or sub-domain
AYSVYFAFVRDTQHKTEALELKAKVD

SEQ ID NO: 1892 - protein, 26 aa, artificial
  peptide fold or domain or sub-domain
AYSWYQHQRAHDDPVALKYTFHEVIT

SEQ ID NO: 1893 - protein, 24 aa, artificial
  peptide fold or domain or sub-domain
AYYCRRCGGMVNEKVCPHGDEYRV

SEQ ID NO: 1894 - protein, 24 aa, artificial
  peptide fold or domain or sub-domain
AYYDFDLTKFGHKIGQVPNLPQKF

SEQ ID NO: 1895 - protein, 28 aa, artificial
  peptide fold or domain or sub-domain
CAAFDSDKRKIGKEIHELPVFGMDELET

SEQ ID NO: 1896 - protein, 27 aa, artificial
  peptide fold or domain or sub-domain
CAALDIARNGDSYTVHTSTGTIECERL

SEQ ID NO: 1897 - protein, 28 aa, artificial
  peptide fold or domain or sub-domain
CAEVYKYTDLVEFKSEGEVKANGKYLQK

SEQ ID NO: 1898 - protein, 20 aa, artificial
  peptide fold or domain or sub-domain
CAFDDPFCSPGFNLPAHFAY

SEQ ID NO: 1899 - protein, 25 aa, artificial
  peptide fold or domain or sub-domain
CAGMDLADIVAQQGGTLEEVVDRLT

SEQ ID NO: 1900 - protein, 30 aa, artificial
  peptide fold or domain or sub-domain
CAHRGARSLAPENTMLAAHKALACGAHCWE

SEQ ID NO: 1901 - protein, 22 aa, artificial
  peptide fold or domain or sub-domain
CAIGKTSWEISVICNCSEANVN

SEQ ID NO: 1902 - protein, 26 aa, artificial
  peptide fold or domain or sub-domain
CAKAIAVGARYDGDMWDIVTRKAEAT

SEQ ID NO: 1903 - protein, 26 aa, artificial
  peptide fold or domain or sub-domain
CAKNFYISDEYISFNVTVNGVGVSIK

SEQ ID NO: 1904 - protein, 26 aa, artificial
  peptide fold or domain or sub-domain
CAKVIAAACEYDGNPWDIVLDGSKIK

SEQ ID NO: 1905 - protein, 26 aa, artificial
  peptide fold or domain or sub-domain
CAKVTGARIVKPKKSVSQMAGLMKIR

SEQ ID NO: 1906 - protein, 28 aa, artificial
  peptide fold or domain or sub-domain
CALGNDTDGNMARDIATKDGFTLIGESS

SEQ ID NO: 1907 - protein, 26 aa, artificial
  peptide fold or domain or sub-domain
CANEVIRILMERQGADNVVKYVDSVL

SEQ ID NO: 1908 - protein, 25 aa, artificial
  peptide fold or domain or sub-domain
CANEYDKSIWKTYESNHSAKLIKGD

SEQ ID NO: 1909 - protein, 20 aa, artificial
  peptide fold or domain or sub-domain
CANLKEQIINLEMEKLYYEV

SEQ ID NO: 1910 - protein, 20 aa, artificial
  peptide fold or domain or sub-domain
CAPVIAREAAEQGKSLSAHY

SEQ ID NO: 1911 - protein, 22 aa, artificial
  peptide fold or domain or sub-domain
CAQEGLAKLRTAQELASFIRKE

SEQ ID NO: 1912 - protein, 29 aa, artificial
  peptide fold or domain or sub-domain
CARLELPLKDVLFGGDADRLNETAYTQPA

SEQ ID NO: 1913 - protein, 23 aa, artificial
  peptide fold or domain or sub-domain
CARVGQHVKDHAGAIVTCTAEDI

SEQ ID NO: 1914 - protein, 26 aa, artificial
  peptide fold or domain or sub-domain
CATAGCHDNMDKKDKSAKGYYHAMHD

SEQ ID NO: 1915 - protein, 20 aa, artificial
  peptide fold or domain or sub-domain
CATGDPVCFPGGLDRAAHSS

SEQ ID NO: 1916 - protein, 22 aa, artificial
  peptide fold or domain or sub-domain
CATQALEKYNIEKDIAAHIKKE

SEQ ID NO: 1917 - protein, 22 aa, artificial
  peptide fold or domain or sub-domain
CCAAACERFKEERDIAKYIKNE

SEQ ID NO: 1918 - protein, 28 aa, artificial
  peptide fold or domain or sub-domain
CCVRGQGQWDAARKADDYSMFQPVLDEM

SEQ ID NO: 1919 - protein, 20 aa, artificial
  peptide fold or domain or sub-domain
CDAEKIKEDRGMGKGNPIPC

SEQ ID NO: 1920 - protein, 25 aa, artificial
  peptide fold or domain or sub-domain
CDAGLPNGSVCCTSKCKLRAWAQCD

SEQ ID NO: 1921 - protein, 24 aa, artificial
  peptide fold or domain or sub-domain
CDALKAVFQKEGGMSENQAQEMLD

SEQ ID NO: 1922 - protein, 25 aa, artificial
  peptide fold or domain or sub-domain
CDCGSPSNPCCDAATCKLRPGAQCA

SEQ ID NO: 1923 - protein, 21 aa, artificial
  peptide fold or domain or sub-domain
CDCNGHADTCDITTDPYICNC

SEQ ID NO: 1924 - protein, 21 aa, artificial
  peptide fold or domain or sub-domain
CDCNILGSRRDMPCDEESGRC

SEQ ID NO: 1925 - protein, 21 aa, artificial
  peptide fold or domain or sub-domain
CDCSPLGSDTDPICESYGGQC

SEQ ID NO: 1926 - protein, 21 aa, artificial
  peptide fold or domain or sub-domain
CDCSVEGSRSSSCDPVSGQCV

SEQ ID NO: 1927 - protein, 25 aa, artificial
  peptide fold or domain or sub-domain
CDDARITALNAEFREKPSPTNVLSW

SEQ ID NO: 1928 - protein, 21 aa, artificial
  peptide fold or domain or sub-domain
CDDELYSELNRHFSARSIVME

SEQ ID NO: 1929 - protein, 24 aa, artificial
  peptide fold or domain or sub-domain
CDDWMKNNWKTSQGKPVSNKDIIS

SEQ ID NO: 1930 - protein, 28 aa, artificial
  peptide fold or domain or sub-domain
CDFEEVAYLILNKELPNKKQLKEFKKVL

SEQ ID NO: 1931 - protein, 22 aa, artificial
  peptide fold or domain or sub-domain
CDFGQPSCERCLKTPWPERCTY

SEQ ID NO: 1932 - protein, 28 aa, artificial
  peptide fold or domain or sub-domain
CDFTEVCYILLHGDAPSPEAYAKFADNI

SEQ ID NO: 1933 - protein, 25 aa, artificial
  peptide fold or domain or sub-domain
CDGAVAEGRETARGDRVAGMAAKQA

SEQ ID NO: 1934 - protein, 22 aa, artificial
  peptide fold or domain or sub-domain
CDGGVPFCGRCITHSRTKSCAY

SEQ ID NO: 1935 - protein, 22 aa, artificial
  peptide fold or domain or sub-domain
CDGKLPACTACEKAGRENECSS

SEQ ID NO: 1936 - protein, 20 aa, artificial
  peptide fold or domain or sub-domain
CDHAAIIGSNGSYNGITSNV

SEQ ID NO: 1937 - protein, 22 aa, artificial
  peptide fold or domain or sub-domain
CDHMMPNCGRCVKRNKQDQCVY

SEQ ID NO: 1938 - protein, 22 aa, artificial
  peptide fold or domain or sub-domain
CDHSLPICQRCTARRRAPECTY

SEQ ID NO: 1939 - protein, 20 aa, artificial
  peptide fold or domain or sub-domain
CDIADAVCYGTLFILPAHFL

SEQ ID NO: 1940 - protein, 26 aa, artificial
  peptide fold or domain or sub-domain
CDISALSIGDAEEAGGKGANMGELVA

SEQ ID NO: 1941 - protein, 30 aa, artificial
  peptide fold or domain or sub-domain
CDIVSESSCMLAKHRKASTVDRKDIQLSWE

SEQ ID NO: 1942 - protein, 22 aa, artificial
  peptide fold or domain or sub-domain
CDKGCSTCIVSSDNCTSCQNNY

SEQ ID NO: 1943 - protein, 20 aa, artificial
  peptide fold or domain or sub-domain
CDKGDPFCEAGGKDLSVHLG

SEQ ID NO: 1944 - protein, 22 aa, artificial
  peptide fold or domain or sub-domain
CDKKRPTCSNCLLKDGENSCKY

SEQ ID NO: 1945 - protein, 22 aa, artificial
  peptide fold or domain or sub-domain
CDKLRPHCQQCTKTGVAHLCHY

SEQ ID NO: 1946 - protein, 22 aa, artificial
  peptide fold or domain or sub-domain
CDLESLAERLDIDDEDLPRLKE

SEQ ID NO: 1947 - protein, 24 aa, artificial
  peptide fold or domain or sub-domain
CDLLSILHDSSSKKLKETQYAQPA

SEQ ID NO: 1948 - protein, 26 aa, artificial
  peptide fold or domain or sub-domain
CDLSELSLADLRQFSEVIEQDVFEVL

SEQ ID NO: 1949 - protein, 29 aa, artificial
  peptide fold or domain or sub-domain
CDMNSSKVKYIEKIKVNSLRLKKLSELCQ

SEQ ID NO: 1950 - protein, 27 aa, artificial
  peptide fold or domain or sub-domain
CDNWTTYPPMGYETKIRICNDCNARMK

SEQ ID NO: 1951 - protein, 20 aa, artificial
  peptide fold or domain or sub-domain
CDPDEFRRLRDVGRACPCRS

SEQ ID NO: 1952 - protein, 22 aa, artificial
  peptide fold or domain or sub-domain
CDREKPSCSACQKRGDPNACFY

SEQ ID NO: 1953 - protein, 22 aa, artificial
  peptide fold or domain or sub-domain
CDRGKPACGNCIRLGNRETCHY

SEQ ID NO: 1954 - protein, 22 aa, artificial
  peptide fold or domain or sub-domain
CDRKTPFCGSCSENNTGHLCKY

SEQ ID NO: 1955 - protein, 21 aa, artificial
  peptide fold or domain or sub-domain
CDRLAAAFQLAPEAPALTHMR

SEQ ID NO: 1956 - protein, 22 aa, artificial
  peptide fold or domain or sub-domain
CDRSRPSCGQCRALDLTSACLY

SEQ ID NO: 1957 - protein, 22 aa, artificial
  peptide fold or domain or sub-domain
CDSACLGGCTGHGPKNCIACSK

SEQ ID NO: 1958 - protein, 22 aa, artificial
  peptide fold or domain or sub-domain
CDSECLSTCNGPTSYNCTSGCQ

SEQ ID NO: 1959 - protein, 22 aa, artificial
  peptide fold or domain or sub-domain
CDSNCVACIKAKNNCTKCNPKM

SEQ ID NO: 1960 - protein, 21 aa, artificial
  peptide fold or domain or sub-domain
CECDKSGSRLEQCNLYDGQCD

SEQ ID NO: 1961 - protein, 21 aa, artificial
  peptide fold or domain or sub-domain
CECDSLGTLPGTICDPISGQC

SEQ ID NO: 1962 - protein, 21 aa, artificial
  peptide fold or domain or sub-domain
CECHVKGSHSAVCHLETGLCD

SEQ ID NO: 1963 - protein, 21 aa, artificial
  peptide fold or domain or sub-domain
CECNLNGTNGYHCEAESGQQC

SEQ ID NO: 1964 - protein, 21 aa, artificial
  peptide fold or domain or sub-domain
CECNPTGSKSKKCAESGGFCT

SEQ ID NO: 1965 - protein, 20 aa, artificial
  peptide fold or domain or sub-domain
CECNTCYTGPDCSEKIQGCS

SEQ ID NO: 1966 - protein, 30 aa, artificial
  peptide fold or domain or sub-domain
CEEAIATPPEADSEKAALLGTSKQTQKGLA

SEQ ID NO: 1967 - protein, 24 aa, artificial
  peptide fold or domain or sub-domain
CEEKIPPLEEAFGLRNDGFFPIFS

SEQ ID NO: 1968 - protein, 29 aa, artificial
  peptide fold or domain or sub-domain
CEEKIPPLEEAFGLRNDGFFPIFSCACES

SEQ ID NO: 1969 - protein, 28 aa, artificial
  peptide fold or domain or sub-domain
CEFEEIAHLLVHGKLPNVAELAGYKAKL

SEQ ID NO: 1970 - protein, 21 aa, artificial
  peptide fold or domain or sub-domain
CEGIDYAPGLLQGLDGGEHND

SEQ ID NO: 1971 - protein, 26 aa, artificial
  peptide fold or domain or sub-domain
CEGLIKLKILKGSLKKAIKEKKHKKY

SEQ ID NO: 1972 - protein, 28 aa, artificial
  peptide fold or domain or sub-domain
CEGQAMDMEFENYYPTMEEYLDMIRKKT

SEQ ID NO: 1973 - protein, 26 aa, artificial
  peptide fold or domain or sub-domain
CEHLVRAGILLGDVDTIMRKRVMGLF

SEQ ID NO: 1974 - protein, 27 aa, artificial
  peptide fold or domain or sub-domain
CEKAKKKNAIFHQLKMPEQESFYDELI

SEQ ID NO: 1975 - protein, 20 aa, artificial
  peptide fold or domain or sub-domain
CEKQEIFKIEQRKEQLLNLL

SEQ ID NO: 1976 - protein, 23 aa, artificial
  peptide fold or domain or sub-domain
CEKTRLMCEKHHIEPEVALKVMK

SEQ ID NO: 1977 - protein, 22 aa, artificial
  peptide fold or domain or sub-domain
CELPCPAGSHGVQCAHSCGRCK

SEQ ID NO: 1978 - protein, 26 aa, artificial
  peptide fold or domain or sub-domain
CELQNLSLEEMKKLSPVFEEDVFGFL

SEQ ID NO: 1979 - protein, 25 aa, artificial
  peptide fold or domain or sub-domain
CENFLRGWVGGLAQQEATNKMREWL

SEQ ID NO: 1980 - protein, 24 aa, artificial
  peptide fold or domain or sub-domain
CEPLVPNPNLARRVQIWKDASGKD

SEQ ID NO: 1981 - protein, 27 aa, artificial
  peptide fold or domain or sub-domain
CERRRQQGNDAFRAGKLEAAMRKYRRA

SEQ ID NO: 1982 - protein, 24 aa, artificial
  peptide fold or domain or sub-domain
CETIQRILVEHGGMSRARAEDFIN

SEQ ID NO: 1983 - protein, 25 aa, artificial
  peptide fold or domain or sub-domain
CETKVVNAMDEEIPKYREALADRSV

SEQ ID NO: 1984 - protein, 27 aa, artificial
  peptide fold or domain or sub-domain
CEVQSQVDQKNFLSYDCGSDKVLSMGH

SEQ ID NO: 1985 - protein, 27 aa, artificial
  peptide fold or domain or sub-domain
CEVTGIRTSDDGFEVRTSRGTLRTKRI

SEQ ID NO: 1986 - protein, 30 aa, artificial
  peptide fold or domain or sub-domain
CFCPLSEGYLLYYPPAFDAYSNRLIEMRVP

SEQ ID NO: 1987 - protein, 22 aa, artificial
  peptide fold or domain or sub-domain
CFDKLVEEGTDPAYAEKLIQFG

SEQ ID NO: 1988 - protein, 24 aa, artificial
  peptide fold or domain or sub-domain
CFEKCRSLRKDGIKIEVLQFEEYC

SEQ ID NO: 1989 - protein, 21 aa, artificial
  peptide fold or domain or sub-domain
CFKSNRKINLSDQKCCNDAKY

SEQ ID NO: 1990 - protein, 25 aa, artificial
  peptide fold or domain or sub-domain
CFNANSGDTGGLVGYDFTTWDEKKY

SEQ ID NO: 1991 - protein, 24 aa, artificial
  peptide fold or domain or sub-domain
CFNRCLQWLHSRTEDEAFDFEQEC

SEQ ID NO: 1992 - protein, 25 aa, artificial
  peptide fold or domain or sub-domain
CFNSIANAWREKGDVDNAIQFYVHA

SEQ ID NO: 1993 - protein, 21 aa, artificial
  peptide fold or domain or sub-domain
CFQPDGYEQTYAEMPKAEKNA

SEQ ID NO: 1994 - protein, 27 aa, artificial
  peptide fold or domain or sub-domain
CFVLFAMPTVIKRQDPNHDMLEKLLVC

SEQ ID NO: 1995 - protein, 28 aa, artificial
  peptide fold or domain or sub-domain
CFYFPEKDLLNNFSIKKSGNRISIATYY

SEQ ID NO: 1996 - protein, 27 aa, artificial
  peptide fold or domain or sub-domain
CGADVVSGGELYIAKLSNVPSKKIVFN

SEQ ID NO: 1997 - protein, 21 aa, artificial
  peptide fold or domain or sub-domain
CGCHEVGAESDTCESFGGQCR

SEQ ID NO: 1998 - protein, 21 aa, artificial
  peptide fold or domain or sub-domain
CGCHPRNSYSLQCNQATGQCL

SEQ ID NO: 1999 - protein, 25 aa, artificial
  peptide fold or domain or sub-domain
CGDWAGILYSDLSRLWPKEHAAWLG

SEQ ID NO: 2000 - protein, 27 aa, artificial
  peptide fold or domain or sub-domain
CGEAYEGHNITWTKNKDKHLEAQGNRI

SEQ ID NO: 2001 - protein, 29 aa, artificial
  peptide fold or domain or sub-domain
CGFPLAEANNHAILLHSHEQSGQPLGRSP

SEQ ID NO: 2002 - protein, 24 aa, artificial
  peptide fold or domain or sub-domain
CGGNGINDSLKEIEGSFQALQRSC

SEQ ID NO: 2003 - protein, 25 aa, artificial
  peptide fold or domain or sub-domain
CGGQSLAEIAARWGCDAVTAARRLC

SEQ ID NO: 2004 - protein, 28 aa, artificial
  peptide fold or domain or sub-domain
CGHATLPVETEDELRLWTYLALNRGRAS

SEQ ID NO: 2005 - protein, 30 aa, artificial
  peptide fold or domain or sub-domain
CGIELLEPNGKHDGTFQGVSYFIATPYHGI

SEQ ID NO: 2006 - protein, 28 aa, artificial
  peptide fold or domain or sub-domain
CGINNSKNGGIVFHIPIYSSAIKAVKSN

SEQ ID NO: 2007 - protein, 28 aa, artificial
  peptide fold or domain or sub-domain
CGITTRGLFYALDDATLHFERARGVSNI

SEQ ID NO: 2008 - protein, 26 aa, artificial
  peptide fold or domain or sub-domain
CGKAIGIVVAHGRSILEFEGVDMIRV

SEQ ID NO: 2009 - protein, 26 aa, artificial
  peptide fold or domain or sub-domain
CGKGIGIAATHEGDLYSYAGIETLTN

SEQ ID NO: 2010 - protein, 30 aa, artificial
  peptide fold or domain or sub-domain
CGKNNDAPAGTNITCTGNACPEVEKADATF

SEQ ID NO: 2011 - protein, 25 aa, artificial
  peptide fold or domain or sub-domain
CGNRLSRRINCEFLQHDYPTDTITF

SEQ ID NO: 2012 - protein, 26 aa, artificial
  peptide fold or domain or sub-domain
CGNSLSGVEPQSSQDAQIHLDDSTRG

SEQ ID NO: 2013 - protein, 24 aa, artificial
  peptide fold or domain or sub-domain
CGPPIGRKNSKQIFIYVAGNKQSN

SEQ ID NO: 2014 - protein, 29 aa, artificial
  peptide fold or domain or sub-domain
CGRVGPGVREVVFGSDAGELDRTVWAQAG

SEQ ID NO: 2015 - protein, 28 aa, artificial
  peptide fold or domain or sub-domain
CGSPGPMGLMGHKSMATVDFEEQLYMLQ

SEQ ID NO: 2016 - protein, 27 aa, artificial
  peptide fold or domain or sub-domain
CGSTRVEHAQPGTIRGDFALRTTTNIV

SEQ ID NO: 2017 - protein, 22 aa, artificial
  peptide fold or domain or sub-domain
CGTNATYHCKKDNCPSLPNSGQ

SEQ ID NO: 2018 - protein, 22 aa, artificial
  peptide fold or domain or sub-domain
CGYDFFAFQDVIKNGKKSKYWD

SEQ ID NO: 2019 - protein, 24 aa, artificial
  peptide fold or domain or sub-domain
CGYEFAPFQDVWKNGESSKYKDWF

SEQ ID NO: 2020 - protein, 20 aa, artificial
  peptide fold or domain or sub-domain
CHAGDTICNNSVVILPPHLT

SEQ ID NO: 2021 - protein, 28 aa, artificial
  peptide fold or domain or sub-domain
CHAGFFLRENECVSCSNCKKSLECTKLC

SEQ ID NO: 2022 - protein, 22 aa, artificial
  peptide fold or domain or sub-domain
CHEQCAAGCTGPKHSDCLACLH

SEQ ID NO: 2023 - protein, 25 aa, artificial
  peptide fold or domain or sub-domain
CHFNLSISCLNLKMYQDAAEHIYTA

SEQ ID NO: 2024 - protein, 25 aa, artificial
  peptide fold or domain or sub-domain
CHGSPILNKAKEINKSPEELINKYH

SEQ ID NO: 2025 - protein, 25 aa, artificial
  peptide fold or domain or sub-domain
CHGTPITIAAEREGITPQDVIRRYH

SEQ ID NO: 2026 - protein, 27 aa, artificial
  peptide fold or domain or sub-domain
CHHLCQHCAADLHNTGSICLRCQNAHY

SEQ ID NO: 2027 - protein, 27 aa, artificial
  peptide fold or domain or sub-domain
CHLKLPIPDQQLYDPVLVCNSCYEHIQ

SEQ ID NO: 2028 - protein, 22 aa, artificial
  peptide fold or domain or sub-domain
CHPDCLTCSQSPDHCDLCQDPT

SEQ ID NO: 2029 - protein, 27 aa, artificial
  peptide fold or domain or sub-domain
CHPECKPQTGRVSCTGPGADKCVECTN

SEQ ID NO: 2030 - protein, 22 aa, artificial
  peptide fold or domain or sub-domain
CHPECLGSCSAPDNDTACVACR

SEQ ID NO: 2031 - protein, 27 aa, artificial
  peptide fold or domain or sub-domain
CHPECQPQNSSETCFGSEADQCAACAH

SEQ ID NO: 2032 - protein, 30 aa, artificial
  peptide fold or domain or sub-domain
CHPEDLPFSIQDLPDLFTKFRKDIEKKKIS

SEQ ID NO: 2033 - protein, 20 aa, artificial
  peptide fold or domain or sub-domain
CHPGHNICDGRDLVLVEHLT

SEQ ID NO: 2034 - protein, 22 aa, artificial
  peptide fold or domain or sub-domain
CHPLCELCTNYGYHEQVCSKCT

SEQ ID NO: 2035 - protein, 22 aa, artificial
  peptide fold or domain or sub-domain
CHPQCLGGCTGTSATECKVCRG

SEQ ID NO: 2036 - protein, 20 aa, artificial
  peptide fold or domain or sub-domain
CHQTYIEAATRKCSIERAES

SEQ ID NO: 2037 - protein, 22 aa, artificial
  peptide fold or domain or sub-domain
CHSSCLGTCSGPTNRDCTVCKD

SEQ ID NO: 2038 - protein, 20 aa, artificial
  peptide fold or domain or sub-domain
CHSSYANEQNQAGRKDVESN

SEQ ID NO: 2039 - protein, 21 aa, artificial
  peptide fold or domain or sub-domain
CIADINKNAYECTVCNSKTNI

SEQ ID NO: 2040 - protein, 21 aa, artificial
  peptide fold or domain or sub-domain
CICYGHARACPLDPATNKSRC

SEQ ID NO: 2041 - protein, 25 aa, artificial
  peptide fold or domain or sub-domain
CIDIRGVSGGMPSDLDSDGIPDEDD

SEQ ID NO: 2042 - protein, 25 aa, artificial
  peptide fold or domain or sub-domain
CIDLPEVPYISWERNVLSLKNQEIF

SEQ ID NO: 2043 - protein, 27 aa, artificial
  peptide fold or domain or sub-domain
CIFVYYSPVVLERATPVETDRQKLIEA

SEQ ID NO: 2044 - protein, 29 aa, artificial
  peptide fold or domain or sub-domain
CIITDIQDSSTRKFAFQIQSGNRSFVVFA

SEQ ID NO: 2045 - protein, 22 aa, artificial
  peptide fold or domain or sub-domain
CIIVMIDTPEYRNINPSKIEKI

SEQ ID NO: 2046 - protein, 26 aa, artificial
  peptide fold or domain or sub-domain
CILAINHNGLNFLSTETHELMVKFPL

SEQ ID NO: 2047 - protein, 20 aa, artificial
  peptide fold or domain or sub-domain
CIPDDPVCTADGANLFAHSQ

SEQ ID NO: 2048 - protein, 26 aa, artificial
  peptide fold or domain or sub-domain
CIPSKALINAGHRYENAKHSDDMGIT

SEQ ID NO: 2049 - protein, 26 aa, artificial
  peptide fold or domain or sub-domain
CIPTKALLHTADLLDELREAKRFGVI

SEQ ID NO: 2050 - protein, 24 aa, artificial
  peptide fold or domain or sub-domain
CIQWLTKRLEASGRTAPRYHAVSR

SEQ ID NO: 2051 - protein, 22 aa, artificial
  peptide fold or domain or sub-domain
CISPCAECIDQATKCTKCNNPT

SEQ ID NO: 2052 - protein, 30 aa, artificial
  peptide fold or domain or sub-domain
CITSCGECYYCKRDLQSHCNRTEGTSGWIL

SEQ ID NO: 2053 - protein, 29 aa, artificial
  peptide fold or domain or sub-domain
CIVAESGDASPLATHHFDQNKVSFRRGDS

SEQ ID NO: 2054 - protein, 30 aa, artificial
  peptide fold or domain or sub-domain
CIYGIEYSSSCAYQLFHLSSYRTNVIPIIE

SEQ ID NO: 2055 - protein, 26 aa, artificial
  peptide fold or domain or sub-domain
CKAQIRRQLHIVNEETTDEELEQMLD

SEQ ID NO: 2056 - protein, 21 aa, artificial
  peptide fold or domain or sub-domain
CKCNGHASECGPDVAGQLACR

SEQ ID NO: 2057 - protein, 30 aa, artificial
  peptide fold or domain or sub-domain
CKDTLARNCYNTCRFAGGSRPVCAGACRCK

SEQ ID NO: 2058 - protein, 29 aa, artificial
  peptide fold or domain or sub-domain
CKGILEYLTVAEVVETMEDLVTYTKNLGP

SEQ ID NO: 2059 - protein, 23 aa, artificial
  peptide fold or domain or sub-domain
CKGLNCSPFIALDEAFDLVVESI

SEQ ID NO: 2060 - protein, 29 aa, artificial
  peptide fold or domain or sub-domain
CKHIRWNSHTTTPNGRRLDALVDDLAFDI

SEQ ID NO: 2061 - protein, 24 aa, artificial
  peptide fold or domain or sub-domain
CKHTIPSFSYDHGVFNTNLFTLSH

SEQ ID NO: 2062 - protein, 29 aa, artificial
  peptide fold or domain or sub-domain
CKHTIPSFSYDHGVFNTNLFTLSHCDCDN

SEQ ID NO: 2063 - protein, 20 aa, artificial
  peptide fold or domain or sub-domain
CKKIIEKESLKYQKTLESRW

SEQ ID NO: 2064 - protein, 27 aa, artificial
  peptide fold or domain or sub-domain
CKKNTALLLDCKTHQTINEPVVLGDCL

SEQ ID NO: 2065 - protein, 28 aa, artificial
  peptide fold or domain or sub-domain
CKLIGSQFQMNWSNKLPHINHMTFARYF

SEQ ID NO: 2066 - protein, 20 aa, artificial
  peptide fold or domain or sub-domain
CKLLNIQDKVSQRDVESEKR

SEQ ID NO: 2067 - protein, 24 aa, artificial
  peptide fold or domain or sub-domain
CKMWIDGMSNRYDLFNYRPYTLSH

SEQ ID NO: 2068 - protein, 29 aa, artificial
  peptide fold or domain or sub-domain
CKMWIDGMSNRYDLFNYRPYTLSHCSCDL

SEQ ID NO: 2069 - protein, 22 aa, artificial
  peptide fold or domain or sub-domain
CKNNCLTCSDEITCKSCNQNSS

SEQ ID NO: 2070 - protein, 27 aa, artificial
  peptide fold or domain or sub-domain
CKPGTYKDNSTPANPVCSLCDGSCLTC

SEQ ID NO: 2071 - protein, 21 aa, artificial
  peptide fold or domain or sub-domain
CKQFNQNFALHTCSLRIFSAY

SEQ ID NO: 2072 - protein, 20 aa, artificial
  peptide fold or domain or sub-domain
CKQIIEYENRKNNIFSDVHW

SEQ ID NO: 2073 - protein, 28 aa, artificial
  peptide fold or domain or sub-domain
CKVADDEAGMFYRQDLEKIGIETSLHQQ

SEQ ID NO: 2074 - protein, 21 aa, artificial
  peptide fold or domain or sub-domain
CKVYQIGDDCLDLPDDLENLI

SEQ ID NO: 2075 - protein, 23 aa, artificial
  peptide fold or domain or sub-domain
CKYKKIDNSLLRCYNEEVEKSFV

SEQ ID NO: 2076 - protein, 27 aa, artificial
  peptide fold or domain or sub-domain
CLAENYDYWCAELGVDRSEWDWCHWGE

SEQ ID NO: 2077 - protein, 22 aa, artificial
  peptide fold or domain or sub-domain
CLALGGVERDAAGLSVTFAHFA

SEQ ID NO: 2078 - protein, 27 aa, artificial
  peptide fold or domain or sub-domain
CLCMCPLFSCQWEGRLEVVVPHLRQIH

SEQ ID NO: 2079 - protein, 21 aa, artificial
  peptide fold or domain or sub-domain
CLCSGHAGRCRYSVQHGHQEC

SEQ ID NO: 2080 - protein, 30 aa, artificial
  peptide fold or domain or sub-domain
CLESIKDKPWHICASDAIKGEGLQEGVDWL

SEQ ID NO: 2081 - protein, 22 aa, artificial
  peptide fold or domain or sub-domain
CLEWSASFGAFDPETQRLIHDY

SEQ ID NO: 2082 - protein, 28 aa, artificial
  peptide fold or domain or sub-domain
CLGQSLDLENQGSLISIKQLEEIYKYKT

SEQ ID NO: 2083 - protein, 22 aa, artificial
  peptide fold or domain or sub-domain
CLGSCVPCDTCRKRGVASSCRF

SEQ ID NO: 2084 - protein, 30 aa, artificial
  peptide fold or domain or sub-domain
CLIQYKTQYDKLPEIFNEEAYEQIFQIAQA

SEQ ID NO: 2085 - protein, 24 aa, artificial
  peptide fold or domain or sub-domain
CLISGDQLANRKPHPEPLLFACKT

SEQ ID NO: 2086 - protein, 30 aa, artificial
  peptide fold or domain or sub-domain
CLITGPNLPKDEFDVIACDATPGLSIFRFR

SEQ ID NO: 2087 - protein, 27 aa, artificial
  peptide fold or domain or sub-domain
CLKKLKKLIHWNGESVKKIDENTVSAT

SEQ ID NO: 2088 - protein, 26 aa, artificial
  peptide fold or domain or sub-domain
CLPRNELDNPHKQKAWKIYPPEFAVE

SEQ ID NO: 2089 - protein, 22 aa, artificial
  peptide fold or domain or sub-domain
CLPYCPYQHFYNFFSTKCEYCD

SEQ ID NO: 2090 - protein, 22 aa, artificial
  peptide fold or domain or sub-domain
CLRTFLSDNDYSDCAWDLVLLQ

SEQ ID NO: 2091 - protein, 28 aa, artificial
  peptide fold or domain or sub-domain
CLSRNYTLGRNMAVQAGVVQIFDRILSE

SEQ ID NO: 2092 - protein, 21 aa, artificial
  peptide fold or domain or sub-domain
CLSYAKLYDLEAVCLRYFNVY

SEQ ID NO: 2093 - protein, 26 aa, artificial
  peptide fold or domain or sub-domain
CLVGRSRAKLEETGRLIRDAGGRCVE

SEQ ID NO: 2094 - protein, 29 aa, artificial
  peptide fold or domain or sub-domain
CLVSDHSPCPPEMKAGNIMKAWGGIAGLQ

SEQ ID NO: 2095 - protein, 25 aa, artificial
  peptide fold or domain or sub-domain
CLVVSADVQDVKRRFEPNKNLYFVE

SEQ ID NO: 2096 - protein, 22 aa, artificial
  peptide fold or domain or sub-domain
CMHGCSDCVSRLNCTSCASTLR

SEQ ID NO: 2097 - protein, 20 aa, artificial
  peptide fold or domain or sub-domain
CMHTEMMEKSFAEIAQSEGI

SEQ ID NO: 2098 - protein, 22 aa, artificial
  peptide fold or domain or sub-domain
CMNICYTCTNANQCTSCPSPLY

SEQ ID NO: 2099 - protein, 22 aa, artificial
  peptide fold or domain or sub-domain
CMNNCDKCSSSNSCDQCVQNFY

SEQ ID NO: 2100 - protein, 22 aa, artificial
  peptide fold or domain or sub-domain
CMNNCQTCLSTSKCNLCQPGWY

SEQ ID NO: 2101 - protein, 20 aa, artificial
  peptide fold or domain or sub-domain
CMRAASAGGKMLDAWLRQGQ

SEQ ID NO: 2102 - protein, 26 aa, artificial
  peptide fold or domain or sub-domain
CMRACIPKALSYDVDSKKAVIDDSKC

SEQ ID NO: 2103 - protein, 29 aa, artificial
  peptide fold or domain or sub-domain
CMYRQATSRDYSGSNPVLGLRGIRLLLRS

SEQ ID NO: 2104 - protein, 21 aa, artificial
  peptide fold or domain or sub-domain
CNCDPMGTEGGVCDQTTGQCL

SEQ ID NO: 2105 - protein, 21 aa, artificial
  peptide fold or domain or sub-domain
CNCNQHGRYCAPSPLNGNVVC

SEQ ID NO: 2106 - protein, 21 aa, artificial
  peptide fold or domain or sub-domain
CNCTLEGAVPNSVCNETNGQC

SEQ ID NO: 2107 - protein, 25 aa, artificial
  peptide fold or domain or sub-domain
CNDDFICKLNKEWRGEDHATDVLSM

SEQ ID NO: 2108 - protein, 22 aa, artificial
  peptide fold or domain or sub-domain
CNEDALALMAQTSVKLVYEQIN

SEQ ID NO: 2109 - protein, 22 aa, artificial
  peptide fold or domain or sub-domain
CNENCNTCVDQSTKCTSCGETN

SEQ ID NO: 2110 - protein, 29 aa, artificial
  peptide fold or domain or sub-domain
CNEVHCRIRCKYGLKKDENGCEYPCSCAK

SEQ ID NO: 2111 - protein, 21 aa, artificial
  peptide fold or domain or sub-domain
CNGNLDTSSPGSCDTYTGACL

SEQ ID NO: 2112 - protein, 25 aa, artificial
  peptide fold or domain or sub-domain
CNGTPIAIRAKQEGVTAKEIANKYH

SEQ ID NO: 2113 - protein, 22 aa, artificial
  peptide fold or domain or sub-domain
CNIKEPSAHKYIDRKKYEAWKS

SEQ ID NO: 2114 - protein, 23 aa, artificial
  peptide fold or domain or sub-domain
CNMALKKMREHGRMISTHATASF

SEQ ID NO: 2115 - protein, 21 aa, artificial
  peptide fold or domain or sub-domain
CNNVCTNPHNDDSTFAHQAHI

SEQ ID NO: 2116 - protein, 26 aa, artificial
  peptide fold or domain or sub-domain
CNQALQMHGGYGYLKDYAVQQYVRDS

SEQ ID NO: 2117 - protein, 22 aa, artificial
  peptide fold or domain or sub-domain
CNSSCLTCASPGDNKSCLSCAP

SEQ ID NO: 2118 - protein, 20 aa, artificial
  peptide fold or domain or sub-domain
CNTGDLVCTGSGIVAAPHLA

SEQ ID NO: 2119 - protein, 25 aa, artificial
  peptide fold or domain or sub-domain
CNTITSRYYKDGREILIDQSHLGLN

SEQ ID NO: 2120 - protein, 28 aa, artificial
  peptide fold or domain or sub-domain
CNVHFAAEEALMQSHGYPYYRQHKEIHE

SEQ ID NO: 2121 - protein, 28 aa, artificial
  peptide fold or domain or sub-domain
CNVQAIPLEKKKYDATNLKDELKLIISH

SEQ ID NO: 2122 - protein, 28 aa, artificial
  peptide fold or domain or sub-domain
CPAPTRGDRDADGVEDALDHCPETPFGT

SEQ ID NO: 2123 - protein, 21 aa, artificial
  peptide fold or domain or sub-domain
CPCPGGSSCAIVPKTKEVVCT

SEQ ID NO: 2124 - protein, 21 aa, artificial
  peptide fold or domain or sub-domain
CPCSAGIGCSLSPETQEPVCD

SEQ ID NO: 2125 - protein, 27 aa, artificial
  peptide fold or domain or sub-domain
CPDGQYNDIPTNTCKNCDPTCNTCYGG

SEQ ID NO: 2126 - protein, 27 aa, artificial
  peptide fold or domain or sub-domain
CPDGSYQDTKKNLCRKCSENCKTCTEF

SEQ ID NO: 2127 - protein, 27 aa, artificial
  peptide fold or domain or sub-domain
CPDNQFIDNSTGTAAKCTNCDAACKTC

SEQ ID NO: 2128 - protein, 27 aa, artificial
  peptide fold or domain or sub-domain
CPDNYFKDPNAYNCIKCDSSCYNCSDS

SEQ ID NO: 2129 - protein, 27 aa, artificial
  peptide fold or domain or sub-domain
CPDQFYANTANQQCNNCDQHCGNCVNS

SEQ ID NO: 2130 - protein, 27 aa, artificial
  peptide fold or domain or sub-domain
CPDQTYPDISTHECAPCDSTCYKCSSA

SEQ ID NO: 2131 - protein, 29 aa, artificial
  peptide fold or domain or sub-domain
CPDRFKMANTFAGIQARLHALYPNKFPKP

SEQ ID NO: 2132 - protein, 24 aa, artificial
  peptide fold or domain or sub-domain
CPDVLNVGECRRGLCNRGTFTRSH

SEQ ID NO: 2133 - protein, 24 aa, artificial
  peptide fold or domain or sub-domain
CPDVMSAGESKHGLTNTASHTRLS

SEQ ID NO: 2134 - protein, 29 aa, artificial
  peptide fold or domain or sub-domain
CPDVMSAGESKHGLTNTASHTRLSCDCDD

SEQ ID NO: 2135 - protein, 20 aa, artificial
  peptide fold or domain or sub-domain
CPEFAEKQATKAGHDLSHEL

SEQ ID NO: 2136 - protein, 20 aa, artificial
  peptide fold or domain or sub-domain
CPEVLLAESAQFNKSLHAHW

SEQ ID NO: 2137 - protein, 24 aa, artificial
  peptide fold or domain or sub-domain
CPFWILGFETKYGVFNWRVNTLMH

SEQ ID NO: 2138 - protein, 20 aa, artificial
  peptide fold or domain or sub-domain
CPGAEFSDLKNSGEACPHRD

SEQ ID NO: 2139 - protein, 27 aa, artificial
  peptide fold or domain or sub-domain
CPGSQERIIEKKEAAAPSEAKPSVQEV

SEQ ID NO: 2140 - protein, 29 aa, artificial
  peptide fold or domain or sub-domain
CPHNYRPASMHTQVKSRLHQVTKGGSPRP

SEQ ID NO: 2141 - protein, 24 aa, artificial
  peptide fold or domain or sub-domain
CPINIDAGATKYDLVNTGLFTRSH

SEQ ID NO: 2142 - protein, 29 aa, artificial
  peptide fold or domain or sub-domain
CPINIDAGATKYDLVNTGLFTRSHCDCDK

SEQ ID NO: 2143 - protein, 29 aa, artificial
  peptide fold or domain or sub-domain
CPITSHGNHFPTYLDLLGYHVHGRVNAAQ

SEQ ID NO: 2144 - protein, 27 aa, artificial
  peptide fold or domain or sub-domain
CPKGYYGNMQTGLCSLCDPSCLACQGS

SEQ ID NO: 2145 - protein, 29 aa, artificial
  peptide fold or domain or sub-domain
CPLTSKRKPYPFALPVTVDGVEGAVLVDQ

SEQ ID NO: 2146 - protein, 24 aa, artificial
  peptide fold or domain or sub-domain
CPMKVRAYQKRYNLSNNSIYTKSH

SEQ ID NO: 2147 - protein, 29 aa, artificial
  peptide fold or domain or sub-domain
CPMKVRAYQKRYNLSNNSIYTKSHCKCDD

SEQ ID NO: 2148 - protein, 22 aa, artificial
  peptide fold or domain or sub-domain
CPPQCAECLNQTYCTSCLDNSQ

SEQ ID NO: 2149 - protein, 29 aa, artificial
  peptide fold or domain or sub-domain
CPPRHNPAHHHALLQSLIWQEDHKRAPRP

SEQ ID NO: 2150 - protein, 27 aa, artificial
  peptide fold or domain or sub-domain
CPQGYGPISTATNNTCKPCTNNDCKSC

SEQ ID NO: 2151 - protein, 24 aa, artificial
  peptide fold or domain or sub-domain
CPQNISPLQYNYGIRNYRFHTISH

SEQ ID NO: 2152 - protein, 29 aa, artificial
  peptide fold or domain or sub-domain
CPQNISPLQYNYGIRNYRFHTISHCDCDT

SEQ ID NO: 2153 - protein, 20 aa, artificial
  peptide fold or domain or sub-domain
CPQVAAEQAKASGHATADEV

SEQ ID NO: 2154 - protein, 30 aa, artificial
  peptide fold or domain or sub-domain
CPRTIDRNIYNACRLTGASMTNCANLSGCK

SEQ ID NO: 2155 - protein, 27 aa, artificial
  peptide fold or domain or sub-domain
CPSGKYQNTNNNTCSSCNSSCTTCSGP

SEQ ID NO: 2156 - protein, 27 aa, artificial
  peptide fold or domain or sub-domain
CPSGVKPDLSYMPIWKYPDEEGICQPC

SEQ ID NO: 2157 - protein, 30 aa, artificial
  peptide fold or domain or sub-domain
CPSIVARSNFNVCRLPGTPEALCATYTGCI

SEQ ID NO: 2158 - protein, 29 aa, artificial
  peptide fold or domain or sub-domain
CPSKFNPASHHALIQSLLHEHYKYDVPKP

SEQ ID NO: 2159 - protein, 30 aa, artificial
  peptide fold or domain or sub-domain
CPSMMCADFSGLEREVEELDKAGSDVFHVD

SEQ ID NO: 2160 - protein, 29 aa, artificial
  peptide fold or domain or sub-domain
CPSQFRAANMHAQIKTSLHRLKPDTVPAP

SEQ ID NO: 2161 - protein, 27 aa, artificial
  peptide fold or domain or sub-domain
CPTGYFGSDLKGKCLQCDPTCATCDKT

SEQ ID NO: 2162 - protein, 27 aa, artificial
  peptide fold or domain or sub-domain
CPVEAIRQTRGRWRIDTAKGPVESLHV

SEQ ID NO: 2163 - protein, 24 aa, artificial
  peptide fold or domain or sub-domain
CPVQTVGQWLESIGLPQYENHLMA

SEQ ID NO: 2164 - protein, 27 aa, artificial
  peptide fold or domain or sub-domain
CPVTAIRHDDDGVTIETADGEYQAKKA

SEQ ID NO: 2165 - protein, 29 aa, artificial
  peptide fold or domain or sub-domain
CPYLWSSDTQHSRVLSLYNTINPEASASP

SEQ ID NO: 2166 - protein, 21 aa, artificial
  peptide fold or domain or sub-domain
CQCSSPGVADDRCDPDTGQCR

SEQ ID NO: 2167 - protein, 21 aa, artificial
  peptide fold or domain or sub-domain
CQCYGHAGRCLKNPVDNTYHC

SEQ ID NO: 2168 - protein, 23 aa, artificial
  peptide fold or domain or sub-domain
CQHCGTCYYCRHGLYNICENLAF

SEQ ID NO: 2169 - protein, 30 aa, artificial
  peptide fold or domain or sub-domain
CQHCGTCYYCRHGLYNICENLAFTGLMNNG

SEQ ID NO: 2170 - protein, 26 aa, artificial
  peptide fold or domain or sub-domain
CQKSCPFDAILVDKNTKTSHIQKDLC

SEQ ID NO: 2171 - protein, 23 aa, artificial
  peptide fold or domain or sub-domain
CQLGERVTLHAGTVVGAHGFGYK

SEQ ID NO: 2172 - protein, 22 aa, artificial
  peptide fold or domain or sub-domain
CQNNCSLNCIFCDSPTVCTKCK

SEQ ID NO: 2173 - protein, 22 aa, artificial
  peptide fold or domain or sub-domain
CQNNSCDTCDSSDSTKCITCPP

SEQ ID NO: 2174 - protein, 27 aa, artificial
  peptide fold or domain or sub-domain
CQNYITLPHFGINVPVRVCNGCFKNLK

SEQ ID NO: 2175 - protein, 20 aa, artificial
  peptide fold or domain or sub-domain
CQRELYENSLQNGHKRLQPP

SEQ ID NO: 2176 - protein, 23 aa, artificial
  peptide fold or domain or sub-domain
CQRFYREHEGRFFYQRLVEFMAS

SEQ ID NO: 2177 - protein, 22 aa, artificial
  peptide fold or domain or sub-domain
CQSPCQTCVSTATNCVTCVTNY

SEQ ID NO: 2178 - protein, 22 aa, artificial
  peptide fold or domain or sub-domain
CQSSCATCVNGLECKTCPVSSP

SEQ ID NO: 2179 - protein, 22 aa, artificial
  peptide fold or domain or sub-domain
CQTLTQLQSLYGKEKAESILGN

SEQ ID NO: 2180 - protein, 26 aa, artificial
  peptide fold or domain or sub-domain
CQTPILFLTARGSIDDKLAGFASGGD

SEQ ID NO: 2181 - protein, 20 aa, artificial
  peptide fold or domain or sub-domain
CQVAHRYAPQKLRAWLSQGQ

SEQ ID NO: 2182 - protein, 26 aa, artificial
  peptide fold or domain or sub-domain
CRAFKTLDKDNNGSIELDIKEPLTLA

SEQ ID NO: 2183 - protein, 22 aa, artificial
  peptide fold or domain or sub-domain
CRAPCLLCGTSPDNCLSCVSTT

SEQ ID NO: 2184 - protein, 25 aa, artificial
  peptide fold or domain or sub-domain
CRDRDFVDLATGKVQAQRLYNEGRM

SEQ ID NO: 2185 - protein, 26 aa, artificial
  peptide fold or domain or sub-domain
CRGRIKRQASILGTEISDEQLDVVVS

SEQ ID NO: 2186 - protein, 29 aa, artificial
  peptide fold or domain or sub-domain
CRIQDIRELIDEAFTDVELDRLKTRLGRL

SEQ ID NO: 2187 - protein, 29 aa, artificial
  peptide fold or domain or sub-domain
CRKANDYVAVSEVIESMADLQQFVKDISP

SEQ ID NO: 2188 - protein, 25 aa, artificial
  peptide fold or domain or sub-domain
CRLDVCIARELARGDRAIGLAESEY

SEQ ID NO: 2189 - protein, 26 aa, artificial
  peptide fold or domain or sub-domain
CRNEVKRQIDLMSLDLSDAQIDDYLA

SEQ ID NO: 2190 - protein, 20 aa, artificial
  peptide fold or domain or sub-domain
CRQVVEQEAIDQDKPLMAHW

SEQ ID NO: 2191 - protein, 21 aa, artificial
  peptide fold or domain or sub-domain
CRRFNREEAFTEGLDEMGWLK

SEQ ID NO: 2192 - protein, 28 aa, artificial
  peptide fold or domain or sub-domain
CRSLSEARRLISQGGIYVNNIKVTCPDA

SEQ ID NO: 2193 - protein, 30 aa, artificial
  peptide fold or domain or sub-domain
CRSMVQADLEEEDEEVSHVDSSERSVDILG

SEQ ID NO: 2194 - protein, 20 aa, artificial
  peptide fold or domain or sub-domain
CRSRKNRNNFKFSEFNYDVL

SEQ ID NO: 2195 - protein, 21 aa, artificial
  peptide fold or domain or sub-domain
CRTVYGDKVDFRQLLDKGFVT

SEQ ID NO: 2196 - protein, 21 aa, artificial
  peptide fold or domain or sub-domain
CRVNFSTTHTLNIDTQKYRGK

SEQ ID NO: 2197 - protein, 30 aa, artificial
  peptide fold or domain or sub-domain
CRVQRAEWDESSSQWVVSLSNGDTYRTRYL

SEQ ID NO: 2198 - protein, 23 aa, artificial
  peptide fold or domain or sub-domain
CSAIISKTDYNDVQTYEMENMVT

SEQ ID NO: 2199 - protein, 21 aa, artificial
  peptide fold or domain or sub-domain
CSCDLRGSVSEKTCNPVTGQC

SEQ ID NO: 2200 - protein, 21 aa, artificial
  peptide fold or domain or sub-domain
CSCEEVGSLPQTVCSTYGGSC

SEQ ID NO: 2201 - protein, 25 aa, artificial
  peptide fold or domain or sub-domain
CSDEKILEVNRQYLQHDYYTDIITF

SEQ ID NO: 2202 - protein, 22 aa, artificial
  peptide fold or domain or sub-domain
CSDKHEWFKKALDDPEGEYADY

SEQ ID NO: 2203 - protein, 25 aa, artificial
  peptide fold or domain or sub-domain
CSDQVLGDIITGKLNAFSAFMSGKV

SEQ ID NO: 2204 - protein, 20 aa, artificial
  peptide fold or domain or sub-domain
CSEDDIAAEKLRHENEGKHY

SEQ ID NO: 2205 - protein, 28 aa, artificial
  peptide fold or domain or sub-domain
CSFEEVIYLLWFGELPTTEQLRTFNTTG

SEQ ID NO: 2206 - protein, 23 aa, artificial
  peptide fold or domain or sub-domain
CSFNEVLASKYANENPGDFVNYN

SEQ ID NO: 2207 - protein, 22 aa, artificial
  peptide fold or domain or sub-domain
CSGGTDYGSFQSDGATYNVRRC

SEQ ID NO: 2208 - protein, 27 aa, artificial
  peptide fold or domain or sub-domain
CSGVRCRVHCPHGFQRSRYGCEFCKCR

SEQ ID NO: 2209 - protein, 27 aa, artificial
  peptide fold or domain or sub-domain
CSIAVVDSSSAKTLPIDIEGSKLAVII

SEQ ID NO: 2210 - protein, 22 aa, artificial
  peptide fold or domain or sub-domain
CSIEHEWFQKALAGDKYYQDFF

SEQ ID NO: 2211 - protein, 26 aa, artificial
  peptide fold or domain or sub-domain
CSKAVSAGVNYAGSAWDLITGKAEIK

SEQ ID NO: 2212 - protein, 20 aa, artificial
  peptide fold or domain or sub-domain
CSKDFDLGPDGVGNDERICS

SEQ ID NO: 2213 - protein, 20 aa, artificial
  peptide fold or domain or sub-domain
CSKEFLESKRLEAKEQKKPF

SEQ ID NO: 2214 - protein, 21 aa, artificial
  peptide fold or domain or sub-domain
CSKTLVASKLGLAPATLSRVL

SEQ ID NO: 2215 - protein, 23 aa, artificial
  peptide fold or domain or sub-domain
CSLGEGEAGRLASESPEELVSFT

SEQ ID NO: 2216 - protein, 25 aa, artificial
  peptide fold or domain or sub-domain
CSMKVYIHIVEQQGRGAEEAAENRN

SEQ ID NO: 2217 - protein, 23 aa, artificial
  peptide fold or domain or sub-domain
CSNFYVEKYGKMFFPNLTAYMSS

SEQ ID NO: 2218 - protein, 24 aa, artificial
  peptide fold or domain or sub-domain
CSNRGITLKELQRYDEAVLSYEKA

SEQ ID NO: 2219 - protein, 22 aa, artificial
  peptide fold or domain or sub-domain
CSSATSLGTVYSDGSTYQVCTD

SEQ ID NO: 2220 - protein, 22 aa, artificial
  peptide fold or domain or sub-domain
CSSEHPWFSQALDSAPGSAARA

SEQ ID NO: 2221 - protein, 27 aa, artificial
  peptide fold or domain or sub-domain
CSSHIDGAALGYMGELRLCDYCARKVQ

SEQ ID NO: 2222 - protein, 22 aa, artificial
  peptide fold or domain or sub-domain
CSSRSRWFDNFKQCKEPGKNYF

SEQ ID NO: 2223 - protein, 24 aa, artificial
  peptide fold or domain or sub-domain
CSTEHEWFQKAQTGNLDYLQRFFF

SEQ ID NO: 2224 - protein, 20 aa, artificial
  peptide fold or domain or sub-domain
CSVEYVASQLDLTEDTVKQR

SEQ ID NO: 2225 - protein, 27 aa, artificial
  peptide fold or domain or sub-domain
CSVTGRSLAGKKLSDAFPYLHSLDLPI

SEQ ID NO: 2226 - protein, 29 aa, artificial
  peptide fold or domain or sub-domain
CSYSDPEIQYIVTHYKGKNRFLKLFEKIA

SEQ ID NO: 2227 - protein, 28 aa, artificial
  peptide fold or domain or sub-domain
CSYVCTNSMETAHLASEKLETGSVAVNT

SEQ ID NO: 2228 - protein, 24 aa, artificial
  peptide fold or domain or sub-domain
CSYVDLANNGEILIKNSEGNYSFS

SEQ ID NO: 2229 - protein, 27 aa, artificial
  peptide fold or domain or sub-domain
CTALTRAFVNDGFDDADAASLAVMSIA

SEQ ID NO: 2230 - protein, 28 aa, artificial
  peptide fold or domain or sub-domain
CTLGDIAQIPNSLTDHEQFVYANFSFMV

SEQ ID NO: 2231 - protein, 25 aa, artificial
  peptide fold or domain or sub-domain
CTLQALYSWQVSKNDVKEIERYVVT

SEQ ID NO: 2232 - protein, 27 aa, artificial
  peptide fold or domain or sub-domain
CTLYASPEGSEGASGSIEDPFPSVQRL

SEQ ID NO: 2233 - protein, 25 aa, artificial
  peptide fold or domain or sub-domain
CTNIPDISYASWEGYKFPLRNFEVF

SEQ ID NO: 2234 - protein, 20 aa, artificial
  peptide fold or domain or sub-domain
CTREELDAQRKQAEAEKRQF

SEQ ID NO: 2235 - protein, 23 aa, artificial
  peptide fold or domain or sub-domain
CTSDAVHGLIRATGRPRLAWDCR

SEQ ID NO: 2236 - protein, 27 aa, artificial
  peptide fold or domain or sub-domain
CTSDYKSELLKWINPNQLEKKYHGTAS

SEQ ID NO: 2237 - protein, 28 aa, artificial
  peptide fold or domain or sub-domain
CTTKSDARRLIAQGGAFVGLQRVADIGA

SEQ ID NO: 2238 - protein, 29 aa, artificial
  peptide fold or domain or sub-domain
CTYIWNTENKYSQVLALYKHHNPGASAQP

SEQ ID NO: 2239 - protein, 27 aa, artificial
  peptide fold or domain or sub-domain
CVAFVGSHQTAERIVRSAGLRRTLIEA

SEQ ID NO: 2240 - protein, 30 aa, artificial
  peptide fold or domain or sub-domain
CVALNDADQFEAMQAEFNEAPYKSAPTQPV

SEQ ID NO: 2241 - protein, 21 aa, artificial
  peptide fold or domain or sub-domain
CVALSPGRCVTKMAKWRGLMD

SEQ ID NO: 2242 - protein, 20 aa, artificial
  peptide fold or domain or sub-domain
CVARMNALYCDLPYFWKGDG

SEQ ID NO: 2243 - protein, 21 aa, artificial
  peptide fold or domain or sub-domain
CVCNGHAEVCNINNPEKLFRC

SEQ ID NO: 2244 - protein, 21 aa, artificial
  peptide fold or domain or sub-domain
CVCNYLGTVREDCDDAENCRC

SEQ ID NO: 2245 - protein, 27 aa, artificial
  peptide fold or domain or sub-domain
CVDSVLMKDLGFDRPERVCKSCFKLIQ

SEQ ID NO: 2246 - protein, 21 aa, artificial
  peptide fold or domain or sub-domain
CVEMLISGKLAKDDAEARAKL

SEQ ID NO: 2247 - protein, 20 aa, artificial
  peptide fold or domain or sub-domain
CVENDLVCDPKGSSFAVHNQ

SEQ ID NO: 2248 - protein, 25 aa, artificial
  peptide fold or domain or sub-domain
CVGDTESVDGTPLLIVENELQLLDK

SEQ ID NO: 2249 - protein, 30 aa, artificial
  peptide fold or domain or sub-domain
CVGKNYLEHVGEVDSTMPGISRMDVPEAPI

SEQ ID NO: 2250 - protein, 25 aa, artificial
  peptide fold or domain or sub-domain
CVGLGSQLISKDILDKKDFDGLTAK

SEQ ID NO: 2251 - protein, 25 aa, artificial
  peptide fold or domain or sub-domain
CVGLSLAQIGQQRSLDPGDALLDLL

SEQ ID NO: 2252 - protein, 26 aa, artificial
  peptide fold or domain or sub-domain
CVIAGGWRGTPRLGKLAIEEKIEAHC

SEQ ID NO: 2253 - protein, 30 aa, artificial
  peptide fold or domain or sub-domain
CVINGNIVGKPHNRQNAIAQLTAQSGQSIV

SEQ ID NO: 2254 - protein, 30 aa, artificial
  peptide fold or domain or sub-domain
CVLDGEITGKPLTEENARLQLRKASGNIVT

SEQ ID NO: 2255 - protein, 25 aa, artificial
  peptide fold or domain or sub-domain
CVPFFGDTPEELFGQVISDEINWPE

SEQ ID NO: 2256 - protein, 29 aa, artificial
  peptide fold or domain or sub-domain
CVPNKTEIAAITGCSVETQADCAAAAEQL

SEQ ID NO: 2257 - protein, 22 aa, artificial
  peptide fold or domain or sub-domain
CVPRKSAPRGLRDRRARHNFVA

SEQ ID NO: 2258 - protein, 26 aa, artificial
  peptide fold or domain or sub-domain
CVPSKSLIHAAKIAHTTATAARYGIS

SEQ ID NO: 2259 - protein, 27 aa, artificial
  peptide fold or domain or sub-domain
CVRESYLKKGYKADPSLRGKEKFVEIT

SEQ ID NO: 2260 - protein, 22 aa, artificial
  peptide fold or domain or sub-domain
CVRWIGEQSLAPAGSPPADLRA

SEQ ID NO: 2261 - protein, 21 aa, artificial
  peptide fold or domain or sub-domain
CVSLHPGWVKTDMGGSSAPLD

SEQ ID NO: 2262 - protein, 25 aa, artificial
  peptide fold or domain or sub-domain
CVVAAHHSQADAARELVGASVDVVP

SEQ ID NO: 2263 - protein, 22 aa, artificial
  peptide fold or domain or sub-domain
CVVLMTDHTEYLEITPEMIPGG

SEQ ID NO: 2264 - protein, 29 aa, artificial
  peptide fold or domain or sub-domain
CVVVDDSHPSPSSHLDIRSNDKDNLLLLT

SEQ ID NO: 2265 - protein, 23 aa, artificial
  peptide fold or domain or sub-domain
CVWAPAADAVTLALGGGPSLPLS

SEQ ID NO: 2266 - protein, 29 aa, artificial
  peptide fold or domain or sub-domain
CWVKDIPDTQRFNNLFQIISTKKTYFLSA

SEQ ID NO: 2267 - protein, 29 aa, artificial
  peptide fold or domain or sub-domain
CWYDLMKEGFNEGYIAADNEHIKFPKIQL

SEQ ID NO: 2268 - protein, 20 aa, artificial
  peptide fold or domain or sub-domain
CYEVIYNESCEQQKTFENHF

SEQ ID NO: 2269 - protein, 24 aa, artificial
  peptide fold or domain or sub-domain
CYFDINRSHKQGRRVSIDRAVENP

SEQ ID NO: 2270 - protein, 29 aa, artificial
  peptide fold or domain or sub-domain
CYGHILPVYHHTEVIQKVALLRKQRELSP

SEQ ID NO: 2271 - protein, 20 aa, artificial
  peptide fold or domain or sub-domain
CYQKVVDQASQFAHSFEREL

SEQ ID NO: 2272 - protein, 25 aa, artificial
  peptide fold or domain or sub-domain
CYVTTDPAFADKGTKDKFYIDYQNL

SEQ ID NO: 2273 - protein, 28 aa, artificial
  peptide fold or domain or sub-domain
DAAAFQALRLHGLAEAPEAFASSLEEEQ

SEQ ID NO: 2274 - protein, 26 aa, artificial
  peptide fold or domain or sub-domain
DAAAPADVDAFCARLDAPPHVRETVK

SEQ ID NO: 2275 - protein, 24 aa, artificial
  peptide fold or domain or sub-domain
DAAFFNYSAETASALDPQYRIQLE

SEQ ID NO: 2276 - protein, 28 aa, artificial
  peptide fold or domain or sub-domain
DAAGVFEIEREAFISVSGNCPLNLDEVQ

SEQ ID NO: 2277 - protein, 27 aa, artificial
  peptide fold or domain or sub-domain
DAAHLAELVVLGRLDLDEAVEIAHRLV

SEQ ID NO: 2278 - protein, 27 aa, artificial
  peptide fold or domain or sub-domain
DAAIILECDSVHRTRIEGLERHYLINI

SEQ ID NO: 2279 - protein, 23 aa, artificial
  peptide fold or domain or sub-domain
DAAIMANCPDAQTRRKWVQRILD

SEQ ID NO: 2280 - protein, 29 aa, artificial
  peptide fold or domain or sub-domain
DAALGYRLSQLCWEGPEDQLKMTEITQPA

SEQ ID NO: 2281 - protein, 28 aa, artificial
  peptide fold or domain or sub-domain
DAALSAAAAKEGVTWSDYQKDLKKAGRW

SEQ ID NO: 2282 - protein, 26 aa, artificial
  peptide fold or domain or sub-domain
DAAQAALCTKVDVSNAVGAVKYSKIV

SEQ ID NO: 2283 - protein, 28 aa, artificial
  peptide fold or domain or sub-domain
DAASMIELEHLVWTPGTTPGDIHFDSEA

SEQ ID NO: 2284 - protein, 24 aa, artificial
  peptide fold or domain or sub-domain
DAAVEYGRKHGKTDHEKIENAMDK

SEQ ID NO: 2285 - protein, 28 aa, artificial
  peptide fold or domain or sub-domain
DAAVKTELPGLDVIPADADLSGVEIELG

SEQ ID NO: 2286 - protein, 24 aa, artificial
  peptide fold or domain or sub-domain
DAAYDGDPDDDYVDTKGNDTAIND

SEQ ID NO: 2287 - protein, 20 aa, artificial
  peptide fold or domain or sub-domain
DACIKAVKDVQDLHMDGRGW

SEQ ID NO: 2288 - protein, 26 aa, artificial
  peptide fold or domain or sub-domain
DACVAVESGRQIDRFFRNNPHLAVQY

SEQ ID NO: 2289 - protein, 20 aa, artificial
  peptide fold or domain or sub-domain
DADGNPFVYPYFIHDSYDSS

SEQ ID NO: 2290 - protein, 22 aa, artificial
  peptide fold or domain or sub-domain
DADMYGEEIEDFTMDATQLDTW

SEQ ID NO: 2291 - protein, 28 aa, artificial
  peptide fold or domain or sub-domain
DADMYGEEIEDFTMDATQLDTWVFNKVK

SEQ ID NO: 2292 - protein, 22 aa, artificial
  peptide fold or domain or sub-domain
DADNDGIEDSQDFCPNTPAGEA

SEQ ID NO: 2293 - protein, 22 aa, artificial
  peptide fold or domain or sub-domain
DADNDGVDDRWDQCMDEAETPN

SEQ ID NO: 2294 - protein, 25 aa, artificial
  peptide fold or domain or sub-domain
DADRLRDYARQKFGWSQTKTNDILL

SEQ ID NO: 2295 - protein, 27 aa, artificial
  peptide fold or domain or sub-domain
DADSIDAFTRDLVGFHKADSAHYDALL

SEQ ID NO: 2296 - protein, 21 aa, artificial
  peptide fold or domain or sub-domain
DADYATGIYTPVEARTPRQAE

SEQ ID NO: 2297 - protein, 27 aa, artificial
  peptide fold or domain or sub-domain
DAEAVVQQKCISCHGGDLTGASAPAID

SEQ ID NO: 2298 - protein, 22 aa, artificial
  peptide fold or domain or sub-domain
DAEIEKRQKEIVRERGFELVDH

SEQ ID NO: 2299 - protein, 27 aa, artificial
  peptide fold or domain or sub-domain
DAEKFYSELATKLGGLLKEFFTQLSTA

SEQ ID NO: 2300 - protein, 27 aa, artificial
  peptide fold or domain or sub-domain
DAEKIFANNCASCHGNNLEGNVGPNLT

SEQ ID NO: 2301 - protein, 22 aa, artificial
  peptide fold or domain or sub-domain
DAESCLGGCNLPNTSSCSVCRH

SEQ ID NO: 2302 - protein, 21 aa, artificial
  peptide fold or domain or sub-domain
DAETAGALFTPADARSDAQRA

SEQ ID NO: 2303 - protein, 30 aa, artificial
  peptide fold or domain or sub-domain
DAETRAKRRLKQNTFLNLETDFQEILKAIE

SEQ ID NO: 2304 - protein, 23 aa, artificial
  peptide fold or domain or sub-domain
DAFFEQFMTDVFSADGELQVTEQ

SEQ ID NO: 2305 - protein, 30 aa, artificial
  peptide fold or domain or sub-domain
DAFISALPIERFHGIGKATAKRLHAMGVSN

SEQ ID NO: 2306 - protein, 29 aa, artificial
  peptide fold or domain or sub-domain
DAFSRAAVSADSSGSFIGGGELASLKSFI

SEQ ID NO: 2307 - protein, 24 aa, artificial
  peptide fold or domain or sub-domain
DAGDYALMRGVDATKLRDGLGVNQ

SEQ ID NO: 2308 - protein, 29 aa, artificial
  peptide fold or domain or sub-domain
DAGLDFGFQGSTVGWLLGRGRTIAYERYL

SEQ ID NO: 2309 - protein, 25 aa, artificial
  peptide fold or domain or sub-domain
DAGLENAIATAIENARRIWQRCSGN

SEQ ID NO: 2310 - protein, 24 aa, artificial
  peptide fold or domain or sub-domain
DAGLMDSTFPRLGAAVEQLRRHSE

SEQ ID NO: 2311 - protein, 23 aa, artificial
  peptide fold or domain or sub-domain
DAIAHPPQLVRGADLVEVFHVSP

SEQ ID NO: 2312 - protein, 29 aa, artificial
  peptide fold or domain or sub-domain
DAIGGLIGRYDQLGRYLDRSAIDSIEKYL

SEQ ID NO: 2313 - protein, 30 aa, artificial
  peptide fold or domain or sub-domain
DAIGLAEALAAELNGTVRSHAAFGTATLTL

SEQ ID NO: 2314 - protein, 22 aa, artificial
  peptide fold or domain or sub-domain
DAIHGGLVSAGWPARLATMIGA

SEQ ID NO: 2315 - protein, 26 aa, artificial
  peptide fold or domain or sub-domain
DAIKQGNVYKLYDYRDGRVLDVDVVD

SEQ ID NO: 2316 - protein, 21 aa, artificial
  peptide fold or domain or sub-domain
DAIKVTRGQDGNHHLDMLRAM

SEQ ID NO: 2317 - protein, 21 aa, artificial
  peptide fold or domain or sub-domain
DAILHDTVYHKEMGRSMQSDV

SEQ ID NO: 2318 - protein, 28 aa, artificial
  peptide fold or domain or sub-domain
DAILTTSSPFLSLLPATTDLVAIELELV

SEQ ID NO: 2319 - protein, 30 aa, artificial
  peptide fold or domain or sub-domain
DAIMLAEIWATVWPDQLHIHPPFGTATLSW

SEQ ID NO: 2320 - protein, 24 aa, artificial
  peptide fold or domain or sub-domain
DAISAQLHRAAAEGDLREGLDPGA

SEQ ID NO: 2321 - protein, 29 aa, artificial
  peptide fold or domain or sub-domain
DAITAVINSADVQGKYLDTAALEKLKAYF

SEQ ID NO: 2322 - protein, 22 aa, artificial
  peptide fold or domain or sub-domain
DAKAKLQAAKAGGEREALERCA

SEQ ID NO: 2323 - protein, 29 aa, artificial
  peptide fold or domain or sub-domain
DAKILGIARKYRSAKLEEKKQIIEEVGDQ

SEQ ID NO: 2324 - protein, 27 aa, artificial
  peptide fold or domain or sub-domain
DAKKAFDYLVLHDKLAEKNQGFSWDLI

SEQ ID NO: 2325 - protein, 27 aa, artificial
  peptide fold or domain or sub-domain
DAKLIGGSTETQIEIKFKQMRYGASVY

SEQ ID NO: 2326 - protein, 26 aa, artificial
  peptide fold or domain or sub-domain
DAKRVDGEFMVFTYSGKKNTGILLRD

SEQ ID NO: 2327 - protein, 27 aa, artificial
  peptide fold or domain or sub-domain
DAKVMAGGQSLIPLLKLRFTTIPYIID

SEQ ID NO: 2328 - protein, 29 aa, artificial
  peptide fold or domain or sub-domain
DALEKAEKPNGLYSNYINPDTGKFTGSHM

SEQ ID NO: 2329 - protein, 24 aa, artificial
  peptide fold or domain or sub-domain
DALELANLQGKDLDYVSKQVKVKT

SEQ ID NO: 2330 - protein, 29 aa, artificial
  peptide fold or domain or sub-domain
DALELLDRWLSGAPTVAGNERFPFRAVPV

SEQ ID NO: 2331 - protein, 27 aa, artificial
  peptide fold or domain or sub-domain
DALIEMIEKYPPERVAEITGVPASAII

SEQ ID NO: 2332 - protein, 29 aa, artificial
  peptide fold or domain or sub-domain
DALLKLADTKTANNKSNLLVYIISELEQK

SEQ ID NO: 2333 - protein, 30 aa, artificial
  peptide fold or domain or sub-domain
DALMFSEKLAQHYQAHLTKHDRFGTAVVVL

SEQ ID NO: 2334 - protein, 29 aa, artificial
  peptide fold or domain or sub-domain
DALPLVRRAFSLKQYTLRAVSKELLSREK

SEQ ID NO: 2335 - protein, 22 aa, artificial
  peptide fold or domain or sub-domain
DALSAHIEKRYPYHTTSQRMTR

SEQ ID NO: 2336 - protein, 26 aa, artificial
  peptide fold or domain or sub-domain
DALVTMLNSDLGRRDPGQGIILQGYA

SEQ ID NO: 2337 - protein, 23 aa, artificial
  peptide fold or domain or sub-domain
DALYAFMIRELNDATIKPDLEKL

SEQ ID NO: 2338 - protein, 27 aa, artificial
  peptide fold or domain or sub-domain
DANEVRVIFLVVDDPRKYHKKAVASLS

SEQ ID NO: 2339 - protein, 24 aa, artificial
  peptide fold or domain or sub-domain
DAPFDCYLQGQQSALTRVQKEGLR

SEQ ID NO: 2340 - protein, 30 aa, artificial
  peptide fold or domain or sub-domain
DAPPFAPPFLKAGALLIGQVANILQYLGPR

SEQ ID NO: 2341 - protein, 27 aa, artificial
  peptide fold or domain or sub-domain
DAQIKVVDGVLSMTVNGQTKTVDFVAK

SEQ ID NO: 2342 - protein, 22 aa, artificial
  peptide fold or domain or sub-domain
DAQKSGNYPRNSPVKYRGDSGL

SEQ ID NO: 2343 - protein, 22 aa, artificial
  peptide fold or domain or sub-domain
DAQLRFLCEAGFSAGDAVNALM

SEQ ID NO: 2344 - protein, 27 aa, artificial
  peptide fold or domain or sub-domain
DAQVIMSILKELNVQEYEPRVVNQLLE

SEQ ID NO: 2345 - protein, 24 aa, artificial
  peptide fold or domain or sub-domain
DAQVTGPAVNHFQQVPLPFWFAIG

SEQ ID NO: 2346 - protein, 27 aa, artificial
  peptide fold or domain or sub-domain
DARIIAGGSALMLAMRQRMLAPTHLIS

SEQ ID NO: 2347 - protein, 27 aa, artificial
  peptide fold or domain or sub-domain
DARKCKFKGSGATRPTKVCVRCVMDLR

SEQ ID NO: 2348 - protein, 29 aa, artificial
  peptide fold or domain or sub-domain
DARLGTSLRDIVWDQDRTRLDDTRHTQPA

SEQ ID NO: 2349 - protein, 29 aa, artificial
  peptide fold or domain or sub-domain
DARLHHIMLDIHHACVEHGGEGEQTNYVQ

SEQ ID NO: 2350 - protein, 27 aa, artificial
  peptide fold or domain or sub-domain
DARLIALILSSMGVSDVEPAVLLQLLE

SEQ ID NO: 2351 - protein, 27 aa, artificial
  peptide fold or domain or sub-domain
DARLLAGGTDLLVDLKTGRVNFGHLVS

SEQ ID NO: 2352 - protein, 24 aa, artificial
  peptide fold or domain or sub-domain
DARLLQLAQQSRDPALMAAAEEIS

SEQ ID NO: 2353 - protein, 27 aa, artificial
  peptide fold or domain or sub-domain
DARPLAGGHSLIPIMKTRLATPEHLVD

SEQ ID NO: 2354 - protein, 20 aa, artificial
  peptide fold or domain or sub-domain
DARPMIELYKWVKKVNPKEK

SEQ ID NO: 2355 - protein, 26 aa, artificial
  peptide fold or domain or sub-domain
DARQIENGYEVMTQGGRTATGRDPVS

SEQ ID NO: 2356 - protein, 20 aa, artificial
  peptide fold or domain or sub-domain
DARQQGASLATYAEGFMQRK

SEQ ID NO: 2357 - protein, 27 aa, artificial
  peptide fold or domain or sub-domain
DARTIELLLTAQGVTAFEQRVPLLLLD

SEQ ID NO: 2358 - protein, 29 aa, artificial
  peptide fold or domain or sub-domain
DASEAAQEVAIENGAEDIQESDEGLEIST

SEQ ID NO: 2359 - protein, 24 aa, artificial
  peptide fold or domain or sub-domain
DATARMLELGQERGEVFPQIDPMV

SEQ ID NO: 2360 - protein, 21 aa, artificial
  peptide fold or domain or sub-domain
DATFIYQALTKPAERRPVTER

SEQ ID NO: 2361 - protein, 25 aa, artificial
  peptide fold or domain or sub-domain
DATKGYFHHNGDISNWDDRYEAQWK

SEQ ID NO: 2362 - protein, 27 aa, artificial
  peptide fold or domain or sub-domain
DATLWAGGTDLGLELTQAYKQFDHIIC

SEQ ID NO: 2363 - protein, 30 aa, artificial
  peptide fold or domain or sub-domain
DATPKEIDASDFFPGSVKSTEVEGTTYGVP

SEQ ID NO: 2364 - protein, 29 aa, artificial
  peptide fold or domain or sub-domain
DATQRLPHYQGVLPIFLDPMTGHFYNGEV

SEQ ID NO: 2365 - protein, 30 aa, artificial
  peptide fold or domain or sub-domain
DAVAEHYGMIVSVHDLKTDLPGDAAMARDR

SEQ ID NO: 2366 - protein, 27 aa, artificial
  peptide fold or domain or sub-domain
DAVALVDHSGPGVNDQLAPDTDVDIVI

SEQ ID NO: 2367 - protein, 22 aa, artificial
  peptide fold or domain or sub-domain
DAVLGILRAAGFSIESAAHAFS

SEQ ID NO: 2368 - protein, 21 aa, artificial
  peptide fold or domain or sub-domain
DAVLTAGSKIAEIYGATEISE

SEQ ID NO: 2369 - protein, 30 aa, artificial
  peptide fold or domain or sub-domain
DAVSHLGASELLYTAIGFYLKTHPDQLNDF

SEQ ID NO: 2370 - protein, 23 aa, artificial
  peptide fold or domain or sub-domain
DAVVISRFRDRATRLEWRHRIED

SEQ ID NO: 2371 - protein, 29 aa, artificial
  peptide fold or domain or sub-domain
DAWLSVKKELRPKREGLGYVSQQLFGDTK

SEQ ID NO: 2372 - protein, 20 aa, artificial
  peptide fold or domain or sub-domain
DCAIKHAVETGEIYYTRFQS

SEQ ID NO: 2373 - protein, 20 aa, artificial
  peptide fold or domain or sub-domain
DCAIQAALADGKLNADHYRN

SEQ ID NO: 2374 - protein, 20 aa, artificial
  peptide fold or domain or sub-domain
DCAVTEAVDEGIIDRQRYIS

SEQ ID NO: 2375 - protein, 21 aa, artificial
  peptide fold or domain or sub-domain
DCEQKYISGWGPGGQKVNTAQ

SEQ ID NO: 2376 - protein, 20 aa, artificial
  peptide fold or domain or sub-domain
DCFVTTSVMKNRYPSWLYEK

SEQ ID NO: 2377 - protein, 20 aa, artificial
  peptide fold or domain or sub-domain
DCGFFGINEDECEAKECCWD

SEQ ID NO: 2378 - protein, 20 aa, artificial
  peptide fold or domain or sub-domain
DCGYLGVDKDGCDQRQCCWA

SEQ ID NO: 2379 - protein, 25 aa, artificial
  peptide fold or domain or sub-domain
DCHKASEIAHQWHKHPYNCSQGDLA

SEQ ID NO: 2380 - protein, 25 aa, artificial
  peptide fold or domain or sub-domain
DCIGGSWIAPTDAMEQGDWARITQL

SEQ ID NO: 2381 - protein, 27 aa, artificial
  peptide fold or domain or sub-domain
DCIITCDGKNLTIKTESTLKTTQFSCT

SEQ ID NO: 2382 - protein, 29 aa, artificial
  peptide fold or domain or sub-domain
DCKIDINCRKTCPNGLKRDKLGCEYCECR

SEQ ID NO: 2383 - protein, 24 aa, artificial
  peptide fold or domain or sub-domain
DCKNGVFNKDYDFGFGKVRQAKDL

SEQ ID NO: 2384 - protein, 22 aa, artificial
  peptide fold or domain or sub-domain
DCLFSIVKEVRLSPTPNVCYGH

SEQ ID NO: 2385 - protein, 21 aa, artificial
  peptide fold or domain or sub-domain
DCMYWSYDRATRKKTLLFNKS

SEQ ID NO: 2386 - protein, 20 aa, artificial
  peptide fold or domain or sub-domain
DCRLEEGLSVEGLVECYRDI

SEQ ID NO: 2387 - protein, 30 aa, artificial
  peptide fold or domain or sub-domain
DCSLLDDETILSTDRLARSGVFGEFRQMII

SEQ ID NO: 2388 - protein, 28 aa, artificial
  peptide fold or domain or sub-domain
DCVVPHIPNELDNLNYVAGKTYSQINQK

SEQ ID NO: 2389 - protein, 30 aa, artificial
  peptide fold or domain or sub-domain
DDAAGVTAIKTALSKVELPKLGDTIKPTTN

SEQ ID NO: 2390 - protein, 25 aa, artificial
  peptide fold or domain or sub-domain
DDAENLAQLKYYLPDAWQALGGNAI

SEQ ID NO: 2391 - protein, 26 aa, artificial
  peptide fold or domain or sub-domain
DDAIPILQKVLTLAPGSQMASVELAR

SEQ ID NO: 2392 - protein, 27 aa, artificial
  peptide fold or domain or sub-domain
DDAQRKAIFSTPLWKAMRFSRENNVIA

SEQ ID NO: 2393 - protein, 20 aa, artificial
  peptide fold or domain or sub-domain
DDATTSHSIEQFGDVAPWTK

SEQ ID NO: 2394 - protein, 24 aa, artificial
  peptide fold or domain or sub-domain
DDAVAWAKQQSNDRAQQIVDATDK

SEQ ID NO: 2395 - protein, 21 aa, artificial
  peptide fold or domain or sub-domain
DDAWVGANSTDPEARDSAQRW

SEQ ID NO: 2396 - protein, 21 aa, artificial
  peptide fold or domain or sub-domain
DDAYQYEDFSRPMNERGIHIE

SEQ ID NO: 2397 - protein, 21 aa, artificial
  peptide fold or domain or sub-domain
DDCKYRGCLHLNEPGCAVKQA

SEQ ID NO: 2398 - protein, 22 aa, artificial
  peptide fold or domain or sub-domain
DDDADGVPNEKDQCPNSPAAAK

SEQ ID NO: 2399 - protein, 28 aa, artificial
  peptide fold or domain or sub-domain
DDDAWIALNARAFADHPEQGSWTLEDLH

SEQ ID NO: 2400 - protein, 22 aa, artificial
  peptide fold or domain or sub-domain
DDDELIPAQIKSVDEYADSKTR

SEQ ID NO: 2401 - protein, 22 aa, artificial
  peptide fold or domain or sub-domain
DDDNDGIPDDKDNCRLVPNPDQ

SEQ ID NO: 2402 - protein, 22 aa, artificial
  peptide fold or domain or sub-domain
DDDNDGVEDTGDACLTADYHLS

SEQ ID NO: 2403 - protein, 22 aa, artificial
  peptide fold or domain or sub-domain
DDDNDGVLDANDAYPLIALGER

SEQ ID NO: 2404 - protein, 27 aa, artificial
  peptide fold or domain or sub-domain
DDESINYIGRQGYTLESVPENGEQVYL

SEQ ID NO: 2405 - protein, 24 aa, artificial
  peptide fold or domain or sub-domain
DDETIAKAQAAFARTDSVGQQRMA

SEQ ID NO: 2406 - protein, 21 aa, artificial
  peptide fold or domain or sub-domain
DDETPVYKAVGNILVKEKKED

SEQ ID NO: 2407 - protein, 29 aa, artificial
  peptide fold or domain or sub-domain
DDFDAATASVLPGLIRRFDEAVRMRRDSV

SEQ ID NO: 2408 - protein, 29 aa, artificial
  peptide fold or domain or sub-domain
DDFDLHSAHVIPAIIRKCIEARERGDDSI

SEQ ID NO: 2409 - protein, 24 aa, artificial
  peptide fold or domain or sub-domain
DDFIQGDADWQALDTHGNDYIDGG

SEQ ID NO: 2410 - protein, 30 aa, artificial
  peptide fold or domain or sub-domain
DDFIRGQLVTNLPGVGHSMESKLASLGIKT

SEQ ID NO: 2411 - protein, 23 aa, artificial
  peptide fold or domain or sub-domain
DDFKARARIMADDYGWDVTDARK

SEQ ID NO: 2412 - protein, 30 aa, artificial
  peptide fold or domain or sub-domain
DDFLLSLPLKRLWGVGPVLLKSLQKMGLRT

SEQ ID NO: 2413 - protein, 21 aa, artificial
  peptide fold or domain or sub-domain
DDGDIYAMLREGVDTSVLSEV

SEQ ID NO: 2414 - protein, 30 aa, artificial
  peptide fold or domain or sub-domain
DDGDRALLFDPAWVTYDACIRFSGANTVWV

SEQ ID NO: 2415 - protein, 29 aa, artificial
  peptide fold or domain or sub-domain
DDGFELNGRRVYRNGGRLTLEDGTLAGAD

SEQ ID NO: 2416 - protein, 20 aa, artificial
  peptide fold or domain or sub-domain
DDGMDYVSMRQYADIAPVRD

SEQ ID NO: 2417 - protein, 26 aa, artificial
  peptide fold or domain or sub-domain
DDGSFDARDVFCMQQDYNSFPRTLFQ

SEQ ID NO: 2418 - protein, 20 aa, artificial
  peptide fold or domain or sub-domain
DDGYPESAQLQFPDWIGQKR

SEQ ID NO: 2419 - protein, 28 aa, artificial
  peptide fold or domain or sub-domain
DDHYADVSLNQWLAMLPETFVQAHLDLG

SEQ ID NO: 2420 - protein, 28 aa, artificial
  peptide fold or domain or sub-domain
DDIMVSLAAKDGIDWADYKKQLKKGEQW

SEQ ID NO: 2421 - protein, 26 aa, artificial
  peptide fold or domain or sub-domain
DDIRVLIELGEEAQDEATLDEVRALN

SEQ ID NO: 2422 - protein, 22 aa, artificial
  peptide fold or domain or sub-domain
DDIYQSGYKRLAPDKKRPVKWV

SEQ ID NO: 2423 - protein, 21 aa, artificial
  peptide fold or domain or sub-domain
DDKAFHDFLKDPKSDEIRKLE

SEQ ID NO: 2424 - protein, 20 aa, artificial
  peptide fold or domain or sub-domain
DDKAYNEHEIQRVVDVGGYI

SEQ ID NO: 2425 - protein, 29 aa, artificial
  peptide fold or domain or sub-domain
DDKKIVPIERFGLAIMSVGFLIEEESAVI

SEQ ID NO: 2426 - protein, 29 aa, artificial
  peptide fold or domain or sub-domain
DDKLFPYLRAALFGQGEQLQKAVEDSVTN

SEQ ID NO: 2427 - protein, 29 aa, artificial
  peptide fold or domain or sub-domain
DDKLGPAVGAVFASTGEGQEAAVRQVHEN

SEQ ID NO: 2428 - protein, 29 aa, artificial
  peptide fold or domain or sub-domain
DDKLMPAIMNIRRCQGEEQVKAIDEVVEL

SEQ ID NO: 2429 - protein, 29 aa, artificial
  peptide fold or domain or sub-domain
DDKLPWAIRILKGTDDGGMEQAAGQLSAA

SEQ ID NO: 2430 - protein, 24 aa, artificial
  peptide fold or domain or sub-domain
DDKRAVKKRFYNRAKLGEYLKSLS

SEQ ID NO: 2431 - protein, 28 aa, artificial
  peptide fold or domain or sub-domain
DDLFLTLVDSKIISSKREFNEFVRDKSL

SEQ ID NO: 2432 - protein, 22 aa, artificial
  peptide fold or domain or sub-domain
DDLLIALEEAIHRKTGFQITEH

SEQ ID NO: 2433 - protein, 26 aa, artificial
  peptide fold or domain or sub-domain
DDMDATWDLLQEEFDEEMKEDLEQEV

SEQ ID NO: 2434 - protein, 29 aa, artificial
  peptide fold or domain or sub-domain
DDMFSAVIAFFLSNNDEEREKSIEKIWEH

SEQ ID NO: 2435 - protein, 23 aa, artificial
  peptide fold or domain or sub-domain
DDNAKKAILKTNNDKTKGADELE

SEQ ID NO: 2436 - protein, 27 aa, artificial
  peptide fold or domain or sub-domain
DDNVFAAPSVQPLWQGLSFVKAGRAYP

SEQ ID NO: 2437 - protein, 27 aa, artificial
  peptide fold or domain or sub-domain
DDNWLGPVADYANEGKPLLDGAKGVVR

SEQ ID NO: 2438 - protein, 28 aa, artificial
  peptide fold or domain or sub-domain
DDNYADTIDALTNEIENLGVDIGDTFGI

SEQ ID NO: 2439 - protein, 20 aa, artificial
  peptide fold or domain or sub-domain
DDQLISMKELKEILDSNFAG

SEQ ID NO: 2440 - protein, 20 aa, artificial
  peptide fold or domain or sub-domain
DDRLETVSMTNFVDTPLWHR

SEQ ID NO: 2441 - protein, 20 aa, artificial
  peptide fold or domain or sub-domain
DDRNLTPDERLSPTAIWSYE

SEQ ID NO: 2442 - protein, 25 aa, artificial
  peptide fold or domain or sub-domain
DDRRVTTHWQDAQALAARFPKAKVE

SEQ ID NO: 2443 - protein, 21 aa, artificial
  peptide fold or domain or sub-domain
DDSFIYKEIDKPAEERTIPFY

SEQ ID NO: 2444 - protein, 29 aa, artificial
  peptide fold or domain or sub-domain
DDSFMFGTQKVTRVGNKLTTDNGTLAGSH

SEQ ID NO: 2445 - protein, 22 aa, artificial
  peptide fold or domain or sub-domain
DDSIEARQREIAAKHGIRLTNH

SEQ ID NO: 2446 - protein, 20 aa, artificial
  peptide fold or domain or sub-domain
DDSLAKLAEQVGKQAGDLRS

SEQ ID NO: 2447 - protein, 21 aa, artificial
  peptide fold or domain or sub-domain
DDSNIGADMKKPYAKRQVKIA

SEQ ID NO: 2448 - protein, 27 aa, artificial
  peptide fold or domain or sub-domain
DDSQLIKQILSGDTASYALLVRKYQDR

SEQ ID NO: 2449 - protein, 21 aa, artificial
  peptide fold or domain or sub-domain
DDSRIHEDIVKSYAERHLAPQ

SEQ ID NO: 2450 - protein, 24 aa, artificial
  peptide fold or domain or sub-domain
DDSYREFEEQRAEGECEYTPPTAH

SEQ ID NO: 2451 - protein, 27 aa, artificial
  peptide fold or domain or sub-domain
DDVEKIALRRLSDSRRTRPVRSQEELV

SEQ ID NO: 2452 - protein, 30 aa, artificial
  peptide fold or domain or sub-domain
DDVHLSNLQRQILFTTEDIDRPKSQVSQQR

SEQ ID NO: 2453 - protein, 25 aa, artificial
  peptide fold or domain or sub-domain
DDVNDKLFIDDKTGKLFIRDTEQEI

SEQ ID NO: 2454 - protein, 21 aa, artificial
  peptide fold or domain or sub-domain
DDWLYVSGNKIVDKDGRPVWL

SEQ ID NO: 2455 - protein, 29 aa, artificial
  peptide fold or domain or sub-domain
DEAAVNLAKSRWYNQTPNRAKRVITTFRT

SEQ ID NO: 2456 - protein, 26 aa, artificial
  peptide fold or domain or sub-domain
DEAKRDVEQLLAIDAQNTDAKVLLQQ

SEQ ID NO: 2457 - protein, 28 aa, artificial
  peptide fold or domain or sub-domain
DEAMTTAASAKGLDWSELRPKLRKAGRW

SEQ ID NO: 2458 - protein, 26 aa, artificial
  peptide fold or domain or sub-domain
DEARHDFVQAAKLDPKNVEIRRELEK

SEQ ID NO: 2459 - protein, 27 aa, artificial
  peptide fold or domain or sub-domain
DEASIEAYAPEMEGFAKADREFFVGTL

SEQ ID NO: 2460 - protein, 26 aa, artificial
  peptide fold or domain or sub-domain
DEASKCVAHILAIDPGNADAANLKVR

SEQ ID NO: 2461 - protein, 20 aa, artificial
  peptide fold or domain or sub-domain
DECRLLVRDIQSFYIDRLKS

SEQ ID NO: 2462 - protein, 28 aa, artificial
  peptide fold or domain or sub-domain
DEDGLARLDRVTWSTLHAVQPRPQPPYD

SEQ ID NO: 2463 - protein, 24 aa, artificial
  peptide fold or domain or sub-domain
DEDLKNAKSFFGLDPQKKFHISDE

SEQ ID NO: 2464 - protein, 25 aa, artificial
  peptide fold or domain or sub-domain
DEEGLVEFLVKEKQFQEDRVRGVCA

SEQ ID NO: 2465 - protein, 22 aa, artificial
  peptide fold or domain or sub-domain
DEEPVRLLAQLAQRLGFDLVSH

SEQ ID NO: 2466 - protein, 21 aa, artificial
  peptide fold or domain or sub-domain
DEFARQYYNTLQNAPENLYKL

SEQ ID NO: 2467 - protein, 23 aa, artificial
  peptide fold or domain or sub-domain
DEFEMIKRNTSEIISEEELREVL

SEQ ID NO: 2468 - protein, 28 aa, artificial
  peptide fold or domain or sub-domain
DEFEMIKRNTSEIISEEELREVLKKDEK

SEQ ID NO: 2469 - protein, 29 aa, artificial
  peptide fold or domain or sub-domain
DEFEVAHILIRAPEESTPEELQKLKAKAE

SEQ ID NO: 2470 - protein, 21 aa, artificial
  peptide fold or domain or sub-domain
DEFQEHVKNNTYKQNGWPSWG

SEQ ID NO: 2471 - protein, 30 aa, artificial
  peptide fold or domain or sub-domain
DEFYISIETVGNNIVERYIDENGKERTREV

SEQ ID NO: 2472 - protein, 27 aa, artificial
  peptide fold or domain or sub-domain
DEGAAKNPDSPYFDWFKFENYPFEYKS

SEQ ID NO: 2473 - protein, 20 aa, artificial
  peptide fold or domain or sub-domain
DEGKYHLDDVLEAFRNNFVS

SEQ ID NO: 2474 - protein, 28 aa, artificial
  peptide fold or domain or sub-domain
DEGWVPVYTSAEKRLAVMSIGFLLKNRS

SEQ ID NO: 2475 - protein, 27 aa, artificial
  peptide fold or domain or sub-domain
DEHSPYRNGNDKYLESASSLEQFRSYA

SEQ ID NO: 2476 - protein, 26 aa, artificial
  peptide fold or domain or sub-domain
DEIHQCVAMVADAEDVDEREMAESEM

SEQ ID NO: 2477 - protein, 27 aa, artificial
  peptide fold or domain or sub-domain
DEIIDVDFSQTIKTVQSASQTYQAYAV

SEQ ID NO: 2478 - protein, 22 aa, artificial
  peptide fold or domain or sub-domain
DEIIEQRQKAIAERAHFKMTDH

SEQ ID NO: 2479 - protein, 29 aa, artificial
  peptide fold or domain or sub-domain
DEISCLKNKINISITVEQENELSIELNKL

SEQ ID NO: 2480 - protein, 24 aa, artificial
  peptide fold or domain or sub-domain
DEITRMAPTFWYPVLLAIAVAELG

SEQ ID NO: 2481 - protein, 24 aa, artificial
  peptide fold or domain or sub-domain
DEIYRDAERERRSEDREYNPPTAY

SEQ ID NO: 2482 - protein, 20 aa, artificial
  peptide fold or domain or sub-domain
DEKAPENMSDKEIEQVKEKE

SEQ ID NO: 2483 - protein, 29 aa, artificial
  peptide fold or domain or sub-domain
DEKCVLAVWGATVAQGEEKEKAVGAALES

SEQ ID NO: 2484 - protein, 20 aa, artificial
  peptide fold or domain or sub-domain
DEKIEEYFRKGEDLLAFFID

SEQ ID NO: 2485 - protein, 22 aa, artificial
  peptide fold or domain or sub-domain
DEKLESLQEELARRHDFRLTGH

SEQ ID NO: 2486 - protein, 20 aa, artificial
  peptide fold or domain or sub-domain
DEKRISKEELLKALQNNFEG

SEQ ID NO: 2487 - protein, 22 aa, artificial
  peptide fold or domain or sub-domain
DEKRTSEEREWMGQEFTIHYFN

SEQ ID NO: 2488 - protein, 21 aa, artificial
  peptide fold or domain or sub-domain
DEKSVIYRAVGELLIKAERGV

SEQ ID NO: 2489 - protein, 20 aa, artificial
  peptide fold or domain or sub-domain
DELIRDLFAREEFALATIVD

SEQ ID NO: 2490 - protein, 29 aa, artificial
  peptide fold or domain or sub-domain
DELIVSDRDNHRLQIFDTDGDYLLEVTPS

SEQ ID NO: 2491 - protein, 28 aa, artificial
  peptide fold or domain or sub-domain
DELKVKCGAEGCGTVLQRGLLLAHLKTC

SEQ ID NO: 2492 - protein, 20 aa, artificial
  peptide fold or domain or sub-domain
DELQAALEEAEAALEQEENK

SEQ ID NO: 2493 - protein, 30 aa, artificial
  peptide fold or domain or sub-domain
DELREGFKRLKDALPITNQRSSKSSLLDRS

SEQ ID NO: 2494 - protein, 24 aa, artificial
  peptide fold or domain or sub-domain
DELSDTDAHMFERLASRIREDGAW

SEQ ID NO: 2495 - protein, 23 aa, artificial
  peptide fold or domain or sub-domain
DEMQRYVEENQTRNKHINPNEWW

SEQ ID NO: 2496 - protein, 26 aa, artificial
  peptide fold or domain or sub-domain
DEMRVLVTLLENEHDAGLLDEGSRKA

SEQ ID NO: 2497 - protein, 28 aa, artificial
  peptide fold or domain or sub-domain
DENITDMCQHSPYFKSFPFEESKNKILD

SEQ ID NO: 2498 - protein, 24 aa, artificial
  peptide fold or domain or sub-domain
DENSWHYAPGGYKGMPQEKIDEGL

SEQ ID NO: 2499 - protein, 29 aa, artificial
  peptide fold or domain or sub-domain
DEPRPGSGWRHLSGTTWFYLAHFWERMPD

SEQ ID NO: 2500 - protein, 21 aa, artificial
  peptide fold or domain or sub-domain
DEPWIAAAFSSPESHTPELKT

SEQ ID NO: 2501 - protein, 29 aa, artificial
  peptide fold or domain or sub-domain
DEQIYVTAMKVVGKTGKERDAVVEATRDL

SEQ ID NO: 2502 - protein, 28 aa, artificial
  peptide fold or domain or sub-domain
DEQRLQARLAGSALSIAAVNEKDTCVVS

SEQ ID NO: 2503 - protein, 27 aa, artificial
  peptide fold or domain or sub-domain
DEQRLVKALAKGDEEAYKYLYRNYASK

SEQ ID NO: 2504 - protein, 27 aa, artificial
  peptide fold or domain or sub-domain
DEQRTPGLSDMADLDDPAIAAVRDTGG

SEQ ID NO: 2505 - protein, 29 aa, artificial
  peptide fold or domain or sub-domain
DERRPDGFGFAHNTFVNLRSSSAAGTTGG

SEQ ID NO: 2506 - protein, 20 aa, artificial
  peptide fold or domain or sub-domain
DERVKEYTHQGKTLEAFIMD

SEQ ID NO: 2507 - protein, 20 aa, artificial
  peptide fold or domain or sub-domain
DESLMFMAKDAQVPFELLKI

SEQ ID NO: 2508 - protein, 20 aa, artificial
  peptide fold or domain or sub-domain
DESLQRLARQRGLDPAKLKA

SEQ ID NO: 2509 - protein, 20 aa, artificial
  peptide fold or domain or sub-domain
DESLQRLCEVSGKSLQEIKS

SEQ ID NO: 2510 - protein, 26 aa, artificial
  peptide fold or domain or sub-domain
DESRRCLKKILEVDEAHAEAQRMMNR

SEQ ID NO: 2511 - protein, 20 aa, artificial
  peptide fold or domain or sub-domain
DESVQQVAQSMGTVVMEYKD

SEQ ID NO: 2512 - protein, 27 aa, artificial
  peptide fold or domain or sub-domain
DESWKTLCYQFLNDGHAFSQQPLNRLA

SEQ ID NO: 2513 - protein, 28 aa, artificial
  peptide fold or domain or sub-domain
DETDEMVRRYDGRVTVAATNGSSSTVVS

SEQ ID NO: 2514 - protein, 28 aa, artificial
  peptide fold or domain or sub-domain
DETFTAEAEKRGLNWEEMRRSMKKEHRW

SEQ ID NO: 2515 - protein, 20 aa, artificial
  peptide fold or domain or sub-domain
DETFTASSWSEFADAPMLSA

SEQ ID NO: 2516 - protein, 29 aa, artificial
  peptide fold or domain or sub-domain
DETLETKLSSLIFEGDAEELTLTYNAQPA

SEQ ID NO: 2517 - protein, 26 aa, artificial
  peptide fold or domain or sub-domain
DETPLILEDEHGKIAISALPYGEIYS

SEQ ID NO: 2518 - protein, 27 aa, artificial
  peptide fold or domain or sub-domain
DEVEEINLEGKVKVVKTSSGEHKAKAV

SEQ ID NO: 2519 - protein, 30 aa, artificial
  peptide fold or domain or sub-domain
DEVELTNLHRQLLHTECSVGLTKVESVRSY

SEQ ID NO: 2520 - protein, 24 aa, artificial
  peptide fold or domain or sub-domain
DEVGGSSMWVDADSMFTPEQLEKV

SEQ ID NO: 2521 - protein, 30 aa, artificial
  peptide fold or domain or sub-domain
DEVIISEKAWRMEGSKMFLLVGDKAKFGEI

SEQ ID NO: 2522 - protein, 27 aa, artificial
  peptide fold or domain or sub-domain
DEVKKCAPTCKTCLPSRSRPSRRVCID

SEQ ID NO: 2523 - protein, 27 aa, artificial
  peptide fold or domain or sub-domain
DEVLKISKEGDKFFLKTAGKEYSSMSL

SEQ ID NO: 2524 - protein, 23 aa, artificial
  peptide fold or domain or sub-domain
DEVMEHKAENDPKKSAKDLKAYY

SEQ ID NO: 2525 - protein, 27 aa, artificial
  peptide fold or domain or sub-domain
DEVQIAWYDTKKKIARLNSQNGQVIAM

SEQ ID NO: 2526 - protein, 30 aa, artificial
  peptide fold or domain or sub-domain
DEVVVGKKPPLADGSKIFIHEGEKLKVKDL

SEQ ID NO: 2527 - protein, 27 aa, artificial
  peptide fold or domain or sub-domain
DEWNIKGTGPLATNGVEAGVKIRPTEK

SEQ ID NO: 2528 - protein, 25 aa, artificial
  peptide fold or domain or sub-domain
DEYASEHVQIFTKRPRDALDNMTAY

SEQ ID NO: 2529 - protein, 30 aa, artificial
  peptide fold or domain or sub-domain
DEYWLAWHVCTTYGNDKLSHNDRVAWTQEN

SEQ ID NO: 2530 - protein, 26 aa, artificial
  peptide fold or domain or sub-domain
DFAHKFCRFLRDNPAYDTPDAGASFS

SEQ ID NO: 2531 - protein, 26 aa, artificial
  peptide fold or domain or sub-domain
DFARRFRLYLASHPQYAGPGAEAAFS

SEQ ID NO: 2532 - protein, 20 aa, artificial
  peptide fold or domain or sub-domain
DFATPHADKPEPDKWRARYP

SEQ ID NO: 2533 - protein, 29 aa, artificial
  peptide fold or domain or sub-domain
DFAYFLSILNHGKLPETHGEFATEVVKVF

SEQ ID NO: 2534 - protein, 29 aa, artificial
  peptide fold or domain or sub-domain
DFAYLIKMLSAKPLPEDEDSYRKLVEVFF

SEQ ID NO: 2535 - protein, 29 aa, artificial
  peptide fold or domain or sub-domain
DFAYLLKAMTQIPLPAEYEEFYKILCIYF

SEQ ID NO: 2536 - protein, 29 aa, artificial
  peptide fold or domain or sub-domain
DFAYLLKLLTCTNLPSNQSLFFELLHDFF

SEQ ID NO: 2537 - protein, 29 aa, artificial
  peptide fold or domain or sub-domain
DFAYLLQMLYGSPIPDSSSSFYNLLKSFF

SEQ ID NO: 2538 - protein, 29 aa, artificial
  peptide fold or domain or sub-domain
DFAYLVKLLMGRKLPRSMAEFLNLVRVFF

SEQ ID NO: 2539 - protein, 25 aa, artificial
  peptide fold or domain or sub-domain
DFDGIIDFLCGKHNFSESRVNETLE

SEQ ID NO: 2540 - protein, 27 aa, artificial
  peptide fold or domain or sub-domain
DFDGIKLINFKVKSLRVRTLEEDKNDR

SEQ ID NO: 2541 - protein, 24 aa, artificial
  peptide fold or domain or sub-domain
DFDKTVEESTTVVMAYYVPEKEYA

SEQ ID NO: 2542 - protein, 29 aa, artificial
  peptide fold or domain or sub-domain
DFELLGSINEQNNNIFDSGNFMDKLNQGG

SEQ ID NO: 2543 - protein, 28 aa, artificial
  peptide fold or domain or sub-domain
DFEQVLAIEMEAFTEHNPFVYMNFYEMK

SEQ ID NO: 2544 - protein, 28 aa, artificial
  peptide fold or domain or sub-domain
DFEYEVPAHTIVVDPATGTTANVGPGVE

SEQ ID NO: 2545 - protein, 28 aa, artificial
  peptide fold or domain or sub-domain
DFFVTWSPTHVNTSNDGRSRTLKLDQES

SEQ ID NO: 2546 - protein, 29 aa, artificial
  peptide fold or domain or sub-domain
DFGLRNTIENALLQHNGTGMYAINNYMKL

SEQ ID NO: 2547 - protein, 29 aa, artificial
  peptide fold or domain or sub-domain
DFGYLINLITNKELPLSKKDFIEHLNFYF

SEQ ID NO: 2548 - protein, 29 aa, artificial
  peptide fold or domain or sub-domain
DFGYLLHLFHHSGIPDTQDEFYKMMKLYF

SEQ ID NO: 2549 - protein, 29 aa, artificial
  peptide fold or domain or sub-domain
DFGYLLKSITLGDLPKEESTFFMCHKTLF

SEQ ID NO: 2550 - protein, 29 aa, artificial
  peptide fold or domain or sub-domain
DFGYLMKILTRRELPGALGEFKRVMRVLF

SEQ ID NO: 2551 - protein, 29 aa, artificial
  peptide fold or domain or sub-domain
DFGYLMKIMLCKPLPENEEDFHTLLKIFF

SEQ ID NO: 2552 - protein, 29 aa, artificial
  peptide fold or domain or sub-domain
DFGYLVKAVTMHDLPDSNREFNTLLKVLF

SEQ ID NO: 2553 - protein, 29 aa, artificial
  peptide fold or domain or sub-domain
DFGYMVKLLTDSRLPEEEHEFFHILNLFF

SEQ ID NO: 2554 - protein, 29 aa, artificial
  peptide fold or domain or sub-domain
DFHHKLGNLERLKQNIRLRKYPLDCDNLI

SEQ ID NO: 2555 - protein, 26 aa, artificial
  peptide fold or domain or sub-domain
DFHPGCATDYSDANSVWSCDLSGMPD

SEQ ID NO: 2556 - protein, 26 aa, artificial
  peptide fold or domain or sub-domain
DFIISGAGISRDMYTWGKNAGIPVIS

SEQ ID NO: 2557 - protein, 23 aa, artificial
  peptide fold or domain or sub-domain
DFIVNFTSAKSKLEYMKWGWLDL

SEQ ID NO: 2558 - protein, 26 aa, artificial
  peptide fold or domain or sub-domain
DFKHDHGDFKFFIDNGLIEVQYNIQE

SEQ ID NO: 2559 - protein, 26 aa, artificial
  peptide fold or domain or sub-domain
DFKLPYLLAARHNCSLQEAIDLAADI

SEQ ID NO: 2560 - protein, 20 aa, artificial
  peptide fold or domain or sub-domain
DFKMNDYMENCNMMAGLALD

SEQ ID NO: 2561 - protein, 20 aa, artificial
  peptide fold or domain or sub-domain
DFKSRHPSFYAYKDGLVLTG

SEQ ID NO: 2562 - protein, 29 aa, artificial
  peptide fold or domain or sub-domain
DFKWIRENTDAVAANIRDRNSAANLDLVL

SEQ ID NO: 2563 - protein, 22 aa, artificial
  peptide fold or domain or sub-domain
DFLFKLKKISISYKYFKLFSLF

SEQ ID NO: 2564 - protein, 29 aa, artificial
  peptide fold or domain or sub-domain
DFMAPWHYLKDGLSGESGTAFEKALGTNI

SEQ ID NO: 2565 - protein, 30 aa, artificial
  peptide fold or domain or sub-domain
DFMHPEFKALLETVGPNGEFIDTNATRTIN

SEQ ID NO: 2566 - protein, 29 aa, artificial
  peptide fold or domain or sub-domain
DFNKTFGERQFLEQSISSRGLDIRLETVL

SEQ ID NO: 2567 - protein, 29 aa, artificial
  peptide fold or domain or sub-domain
DFQFIKDNENQIKENIIKRKSPVELEKLI

SEQ ID NO: 2568 - protein, 27 aa, artificial
  peptide fold or domain or sub-domain
DFRRKHAAFSMVNAVRKAHDTHAWRGI

SEQ ID NO: 2569 - protein, 28 aa, artificial
  peptide fold or domain or sub-domain
DFRSSSDSFTAQGNPTYGKDGVSFTVAK

SEQ ID NO: 2570 - protein, 29 aa, artificial
  peptide fold or domain or sub-domain
DFRSWTNVLVDGSQPEAQAQASVAMVEYL

SEQ ID NO: 2571 - protein, 23 aa, artificial
  peptide fold or domain or sub-domain
DFSEALVSSSLGPAEVQRATEDF

SEQ ID NO: 2572 - protein, 30 aa, artificial
  peptide fold or domain or sub-domain
DFTFQGYSCGKEYYDAQGLVKPKNWKKFRE

SEQ ID NO: 2573 - protein, 25 aa, artificial
  peptide fold or domain or sub-domain
DFTQARISGKPAAEVIGDRDWLENI

SEQ ID NO: 2574 - protein, 29 aa, artificial
  peptide fold or domain or sub-domain
DFTRFWNNFGANALPGWVDLTTGARSPYN

SEQ ID NO: 2575 - protein, 24 aa, artificial
  peptide fold or domain or sub-domain
DFVARMTEAASRIFGDSEQAMPLI

SEQ ID NO: 2576 - protein, 29 aa, artificial
  peptide fold or domain or sub-domain
DFVARMTEAASRIFGDSEQAMPLIEQLVY

SEQ ID NO: 2577 - protein, 27 aa, artificial
  peptide fold or domain or sub-domain
DFYRKFYAYRLMNKGRKNRYDGNWRGI

SEQ ID NO: 2578 - protein, 21 aa, artificial
  peptide fold or domain or sub-domain
DGAIAAGFRATGADGFDAVTL

SEQ ID NO: 2579 - protein, 26 aa, artificial
  peptide fold or domain or sub-domain
DGAIEDLNNLLKLDPDNVDGQNYLKL

SEQ ID NO: 2580 - protein, 29 aa, artificial
  peptide fold or domain or sub-domain
DGARPGIWGTAPVMIEGGSRTEIAIAGER

SEQ ID NO: 2581 - protein, 27 aa, artificial
  peptide fold or domain or sub-domain
DGDDVVVAGILQHIEEAGIHSGDSACS

SEQ ID NO: 2582 - protein, 22 aa, artificial
  peptide fold or domain or sub-domain
DGDMDGVLNEQDACLDTPKGLP

SEQ ID NO: 2583 - protein, 28 aa, artificial
  peptide fold or domain or sub-domain
DGDYQSIDLSTWLASNPSSVLGNTFQIS

SEQ ID NO: 2584 - protein, 30 aa, artificial
  peptide fold or domain or sub-domain
DGEELARKMAQHLGGKARIHQRFRTAALML

SEQ ID NO: 2585 - protein, 21 aa, artificial
  peptide fold or domain or sub-domain
DGEEVAKKTGNEKVGIKGGIS

SEQ ID NO: 2586 - protein, 21 aa, artificial
  peptide fold or domain or sub-domain
DGELVGALRPSDAPLTPRQQE

SEQ ID NO: 2587 - protein, 25 aa, artificial
  peptide fold or domain or sub-domain
DGETIPERIYTVNADIMSDHDSVSL

SEQ ID NO: 2588 - protein, 30 aa, artificial
  peptide fold or domain or sub-domain
DGEVTEKVDKIDKDSHLFEFTGDNLVSQPA

SEQ ID NO: 2589 - protein, 29 aa, artificial
  peptide fold or domain or sub-domain
DGEYQLGAQTITVAKGEARTKCGSLAGST

SEQ ID NO: 2590 - protein, 29 aa, artificial
  peptide fold or domain or sub-domain
DGEYSLGSLRVKVENGICRLTDGTIAGST

SEQ ID NO: 2591 - protein, 27 aa, artificial
  peptide fold or domain or sub-domain
DGFEFYQEQADRVDDDLKKLFLKLAND

SEQ ID NO: 2592 - protein, 29 aa, artificial
  peptide fold or domain or sub-domain
DGGYHGRTFFTMAMNGKAAPYQTSFGPMP

SEQ ID NO: 2593 - protein, 25 aa, artificial
  peptide fold or domain or sub-domain
DGHRSQVTVTVHDGSSTHNIVAGTI

SEQ ID NO: 2594 - protein, 30 aa, artificial
  peptide fold or domain or sub-domain
DGIAFAHSLARALGGRVQEVPRFGTAHIYL

SEQ ID NO: 2595 - protein, 30 aa, artificial
  peptide fold or domain or sub-domain
DGILFAETVANRVGCRVKSHAKFGTAVIVF

SEQ ID NO: 2596 - protein, 25 aa, artificial
  peptide fold or domain or sub-domain
DGIPTMVERALAHANNKQVSLTLAI

SEQ ID NO: 2597 - protein, 29 aa, artificial
  peptide fold or domain or sub-domain
DGIRINKQRALLTTSSSKDEEISENLAKI

SEQ ID NO: 2598 - protein, 25 aa, artificial
  peptide fold or domain or sub-domain
DGKRATIHWENSDSFAEEFEDVDLT

SEQ ID NO: 2599 - protein, 29 aa, artificial
  peptide fold or domain or sub-domain
DGKYTLGKFNVNVKNSVARLNSGSLAGSV

SEQ ID NO: 2600 - protein, 24 aa, artificial
  peptide fold or domain or sub-domain
DGLAQDVRRWAPKAILLGNLGGTQ

SEQ ID NO: 2601 - protein, 29 aa, artificial
  peptide fold or domain or sub-domain
DGLRKVPEGMPSSLEEHIARPVSAIPDPY

SEQ ID NO: 2602 - protein, 25 aa, artificial
  peptide fold or domain or sub-domain
DGLRVATHWLMADMFERLFPRVELD

SEQ ID NO: 2603 - protein, 26 aa, artificial
  peptide fold or domain or sub-domain
DGLVRLCFNRKNKTLGAIFKQKRVLE

SEQ ID NO: 2604 - protein, 23 aa, artificial
  peptide fold or domain or sub-domain
DGLYIYMMKRLAEANIDSDPRIL

SEQ ID NO: 2605 - protein, 24 aa, artificial
  peptide fold or domain or sub-domain
DGMNVVGDLFGEGKMFLPQVVKSA

SEQ ID NO: 2606 - protein, 20 aa, artificial
  peptide fold or domain or sub-domain
DGNLLPSTGAAKLRKSRSYN

SEQ ID NO: 2607 - protein, 27 aa, artificial
  peptide fold or domain or sub-domain
DGNQLFRMNCVGCHGISAQGLVGPELN

SEQ ID NO: 2608 - protein, 21 aa, artificial
  peptide fold or domain or sub-domain
DGRFHVVGNKIVDPDGNDFVI

SEQ ID NO: 2609 - protein, 25 aa, artificial
  peptide fold or domain or sub-domain
DGRKATGYTSIRVDMENAGADVVDK

SEQ ID NO: 2610 - protein, 25 aa, artificial
  peptide fold or domain or sub-domain
DGRPAATHWALASAFAARYPQVQLQ

SEQ ID NO: 2611 - protein, 25 aa, artificial
  peptide fold or domain or sub-domain
DGRRATSHWMAVPLLKPFGVTPVGD

SEQ ID NO: 2612 - protein, 25 aa, artificial
  peptide fold or domain or sub-domain
DGRRATTHWAYCDQLARDHPAVEVD

SEQ ID NO: 2613 - protein, 25 aa, artificial
  peptide fold or domain or sub-domain
DGRSATTHWRWAQCFRNLHTNVFVD

SEQ ID NO: 2614 - protein, 27 aa, artificial
  peptide fold or domain or sub-domain
DGRSVYEARCAACHGLQGEGGVGPRLK

SEQ ID NO: 2615 - protein, 29 aa, artificial
  peptide fold or domain or sub-domain
DGRYDWHGLAITVRAGQVTLEDGRLAGSA

SEQ ID NO: 2616 - protein, 29 aa, artificial
  peptide fold or domain or sub-domain
DGRYTLCGEEVQMHGGVVRTASGGLAGST

SEQ ID NO: 2617 - protein, 22 aa, artificial
  peptide fold or domain or sub-domain
DGSAQYKGQTTIDGSVFKVYTT

SEQ ID NO: 2618 - protein, 29 aa, artificial
  peptide fold or domain or sub-domain
DGSCKQRDSEGNPTMKPHWEISQQEADAC

SEQ ID NO: 2619 - protein, 30 aa, artificial
  peptide fold or domain or sub-domain
DGSESIAAATDGTAAQASVATITVTDADAA

SEQ ID NO: 2620 - protein, 22 aa, artificial
  peptide fold or domain or sub-domain
DGSETLVPVGAGSFIKAELKDT

SEQ ID NO: 2621 - protein, 24 aa, artificial
  peptide fold or domain or sub-domain
DGSLAVQANDAGTLTYLKSFEVDA

SEQ ID NO: 2622 - protein, 20 aa, artificial
  peptide fold or domain or sub-domain
DGSLTSASVREFTDTPVLNR

SEQ ID NO: 2623 - protein, 30 aa, artificial
  peptide fold or domain or sub-domain
DGTDNNKIKINIEAMTAKSLGVNGLKVSGS

SEQ ID NO: 2624 - protein, 24 aa, artificial
  peptide fold or domain or sub-domain
DGVGQLLGKLDRDGMLNSDIPVDR

SEQ ID NO: 2625 - protein, 22 aa, artificial
  peptide fold or domain or sub-domain
DGVKRFIHFENWYQYTQNLPGR

SEQ ID NO: 2626 - protein, 28 aa, artificial
  peptide fold or domain or sub-domain
DGVWVNSPKCQALMAEEGYTDAKELQGH

SEQ ID NO: 2627 - protein, 29 aa, artificial
  peptide fold or domain or sub-domain
DGVYEFGGQSVTVRGRTALLSDGTLAGSI

SEQ ID NO: 2628 - protein, 29 aa, artificial
  peptide fold or domain or sub-domain
DGVYPWDSRQIEVQGGTARLPDGTLSGTT

SEQ ID NO: 2629 - protein, 25 aa, artificial
  peptide fold or domain or sub-domain
DHAKNLHNLSQVLPEIHSAITGPDK

SEQ ID NO: 2630 - protein, 25 aa, artificial
  peptide fold or domain or sub-domain
DHARNLDEFTATLPAFAEALRAAGV

SEQ ID NO: 2631 - protein, 30 aa, artificial
  peptide fold or domain or sub-domain
DHEQMLAAPLIAVSQAAQALGLRTGMTGAE

SEQ ID NO: 2632 - protein, 27 aa, artificial
  peptide fold or domain or sub-domain
DHIALDYEARFLRRKRLVAASGAEFLV

SEQ ID NO: 2633 - protein, 30 aa, artificial
  peptide fold or domain or sub-domain
DHIEISNVHRQILYRVVDKGKNKADVAKFR

SEQ ID NO: 2634 - protein, 29 aa, artificial
  peptide fold or domain or sub-domain
DHIGVLHSRTLGSTDGSANHELEQYVSQT

SEQ ID NO: 2635 - protein, 27 aa, artificial
  peptide fold or domain or sub-domain
DHINKVDLQNRPFRLNGDNGEYTCDAL

SEQ ID NO: 2636 - protein, 30 aa, artificial
  peptide fold or domain or sub-domain
DHISLDNLHRQVAYKEDQVGKSKAQALADN

SEQ ID NO: 2637 - protein, 20 aa, artificial
  peptide fold or domain or sub-domain
DHKGSDANESRRVTQLGGLM

SEQ ID NO: 2638 - protein, 20 aa, artificial
  peptide fold or domain or sub-domain
DHKPNCTSERLRIEKLGGVI

SEQ ID NO: 2639 - protein, 20 aa, artificial
  peptide fold or domain or sub-domain
DHKPNVPAEYARIKKKRVEV

SEQ ID NO: 2640 - protein, 20 aa, artificial
  peptide fold or domain or sub-domain
DHKPSNPLEKERIQNAGGSV

SEQ ID NO: 2641 - protein, 29 aa, artificial
  peptide fold or domain or sub-domain
DHLFPWHHIAEAVTAGGPSAFERTQKWPY

SEQ ID NO: 2642 - protein, 27 aa, artificial
  peptide fold or domain or sub-domain
DHLLELLFHITESYGLPVGIVSAMISM

SEQ ID NO: 2643 - protein, 26 aa, artificial
  peptide fold or domain or sub-domain
DHNLMSLLMQRDNLSAQQAVDVIGDM

SEQ ID NO: 2644 - protein, 20 aa, artificial
  peptide fold or domain or sub-domain
DHNPMAHDERMRIQKTGATV

SEQ ID NO: 2645 - protein, 22 aa, artificial
  peptide fold or domain or sub-domain
DHNSENPYMVYDLAQKNGYLTL

SEQ ID NO: 2646 - protein, 29 aa, artificial
  peptide fold or domain or sub-domain
DHPDFREMTAQLWARDVIPDFRAPHGIRI

SEQ ID NO: 2647 - protein, 24 aa, artificial
  peptide fold or domain or sub-domain
DHQAAWDMFAGHPGGTEADMIEGG

SEQ ID NO: 2648 - protein, 25 aa, artificial
  peptide fold or domain or sub-domain
DHQTNLAQIAATDAGLAAVLGNPTN

SEQ ID NO: 2649 - protein, 20 aa, artificial
  peptide fold or domain or sub-domain
DHRATDPEEIQRIKNDGITL

SEQ ID NO: 2650 - protein, 20 aa, artificial
  peptide fold or domain or sub-domain
DHRGVTVSSRQEDGPSTWNR

SEQ ID NO: 2651 - protein, 20 aa, artificial
  peptide fold or domain or sub-domain
DHRIYDEDIDEVIEKFKGRT

SEQ ID NO: 2652 - protein, 20 aa, artificial
  peptide fold or domain or sub-domain
DHRVASVTERARIARAGQAL

SEQ ID NO: 2653 - protein, 24 aa, artificial
  peptide fold or domain or sub-domain
DHSLGLFSEARKNGEVLPHADLDS

SEQ ID NO: 2654 - protein, 27 aa, artificial
  peptide fold or domain or sub-domain
DHVDLEWFETRKKIARFKTRQGKDIAI

SEQ ID NO: 2655 - protein, 30 aa, artificial
  peptide fold or domain or sub-domain
DHVLKDSYGNLNKMYTYDGLHFNSNGYTVL

SEQ ID NO: 2656 - protein, 20 aa, artificial
  peptide fold or domain or sub-domain
DHVPDDENERKRIDRGNPNL

SEQ ID NO: 2657 - protein, 30 aa, artificial
  peptide fold or domain or sub-domain
DHVVLKALKLTGVEGNLEALAEYACKLSEQ

SEQ ID NO: 2658 - protein, 23 aa, artificial
  peptide fold or domain or sub-domain
DIAEAMMRVDQDAAATEAAGMRL

SEQ ID NO: 2659 - protein, 30 aa, artificial
  peptide fold or domain or sub-domain
DIAIQLLNQVINLNPGFTKAYSNLAKLMKK

SEQ ID NO: 2660 - protein, 28 aa, artificial
  peptide fold or domain or sub-domain
DIALAGEFPDEKEYSYFTGHTLGEQLHI

SEQ ID NO: 2661 - protein, 23 aa, artificial
  peptide fold or domain or sub-domain
DIALGQWIASTPRQIVADTLKLS

SEQ ID NO: 2662 - protein, 25 aa, artificial
  peptide fold or domain or sub-domain
DIALLVFSESGKLHQFSNPEMNMII

SEQ ID NO: 2663 - protein, 25 aa, artificial
  peptide fold or domain or sub-domain
DIAMVIYNSHEKLYQYSSGEIEDVL

SEQ ID NO: 2664 - protein, 27 aa, artificial
  peptide fold or domain or sub-domain
DIAQANQAELDTIENTQDRLDRLCELS

SEQ ID NO: 2665 - protein, 22 aa, artificial
  peptide fold or domain or sub-domain
DIAQNSEDKQLMRKLAGNSAAL

SEQ ID NO: 2666 - protein, 25 aa, artificial
  peptide fold or domain or sub-domain
DIAVIVFSPTGKLFQYASSSMKEIL

SEQ ID NO: 2667 - protein, 22 aa, artificial
  peptide fold or domain or sub-domain
DIAVSTEVLEEMRTKVASPKAI

SEQ ID NO: 2668 - protein, 29 aa, artificial
  peptide fold or domain or sub-domain
DIAYLLKGFTGEALPVTSERFSKAVARVL

SEQ ID NO: 2669 - protein, 25 aa, artificial
  peptide fold or domain or sub-domain
DICAAVVCRPGRVCQILDNGLASCQ

SEQ ID NO: 2670 - protein, 24 aa, artificial
  peptide fold or domain or sub-domain
DICAQLLAEAQERGEVLPHVNPKK

SEQ ID NO: 2671 - protein, 22 aa, artificial
  peptide fold or domain or sub-domain
DIDDDILRKSAQLGLTWDELGR

SEQ ID NO: 2672 - protein, 22 aa, artificial
  peptide fold or domain or sub-domain
DIDDKIIAASLKNNESYISLSN

SEQ ID NO: 2673 - protein, 22 aa, artificial
  peptide fold or domain or sub-domain
DIDDKIIAKANAQGIEPSTLAE

SEQ ID NO: 2674 - protein, 22 aa, artificial
  peptide fold or domain or sub-domain
DIDDKIIKRANENGESFVAMVD

SEQ ID NO: 2675 - protein, 22 aa, artificial
  peptide fold or domain or sub-domain
DIDDKIINRAKEENTTEKEIAE

SEQ ID NO: 2676 - protein, 22 aa, artificial
  peptide fold or domain or sub-domain
DIDDKIISKSTKEKKKINTFTA

SEQ ID NO: 2677 - protein, 22 aa, artificial
  peptide fold or domain or sub-domain
DIDDKILTKAAENDRPWWEWAA

SEQ ID NO: 2678 - protein, 22 aa, artificial
  peptide fold or domain or sub-domain
DIDDKTIRDSKAAGMSLKDFTD

SEQ ID NO: 2679 - protein, 30 aa, artificial
  peptide fold or domain or sub-domain
DIDENINYSLLTEEERAKVISSIGVERKRV

SEQ ID NO: 2680 - protein, 28 aa, artificial
  peptide fold or domain or sub-domain
DIDEVMEIEKLSFTTPWSREAFVGEVTK

SEQ ID NO: 2681 - protein, 28 aa, artificial
  peptide fold or domain or sub-domain
DIDGAITYVSGEQIRVRGENGQEFAYPL

SEQ ID NO: 2682 - protein, 22 aa, artificial
  peptide fold or domain or sub-domain
DIDGDDVFNERDNCPYVYNTDQ

SEQ ID NO: 2683 - protein, 28 aa, artificial
  peptide fold or domain or sub-domain
DIDNGVLSITAAPATAAVKAQIWNHTYT

SEQ ID NO: 2684 - protein, 30 aa, artificial
  peptide fold or domain or sub-domain
DIDYVKLYLANVFGLNKLNRNNRIKWFNDN

SEQ ID NO: 2685 - protein, 27 aa, artificial
  peptide fold or domain or sub-domain
DIEAYLISCDAEGLSRATRARRLSAIK

SEQ ID NO: 2686 - protein, 24 aa, artificial
  peptide fold or domain or sub-domain
DIEILRNQLADSGNLSPKYHPQSR

SEQ ID NO: 2687 - protein, 29 aa, artificial
  peptide fold or domain or sub-domain
DIELIKKDPELFDRAMISRGFGEQAEKII

SEQ ID NO: 2688 - protein, 21 aa, artificial
  peptide fold or domain or sub-domain
DIEMQVMRSTGSGGQSVNTTD

SEQ ID NO: 2689 - protein, 24 aa, artificial
  peptide fold or domain or sub-domain
DIESSPNYRFAHVDITDAAAIDAT

SEQ ID NO: 2690 - protein, 25 aa, artificial
  peptide fold or domain or sub-domain
DIFKDIESLKKYNTNAFPQEKDISS

SEQ ID NO: 2691 - protein, 22 aa, artificial
  peptide fold or domain or sub-domain
DIFMSSEYQQEIRERMQSDTIN

SEQ ID NO: 2692 - protein, 23 aa, artificial
  peptide fold or domain or sub-domain
DIFVFDTSDLTDALFEARLNNML

SEQ ID NO: 2693 - protein, 20 aa, artificial
  peptide fold or domain or sub-domain
DIGNTQQIIERLLSYQIDVA

SEQ ID NO: 2694 - protein, 21 aa, artificial
  peptide fold or domain or sub-domain
DIGWFFGGEYTGTSPEQMAAQ

SEQ ID NO: 2695 - protein, 29 aa, artificial
  peptide fold or domain or sub-domain
DIHRHYNASMPDSAAVCTRLLEEAQVALV

SEQ ID NO: 2696 - protein, 24 aa, artificial
  peptide fold or domain or sub-domain
DIIDEHKNRNRSSEEREAVEDLVD

SEQ ID NO: 2697 - protein, 29 aa, artificial
  peptide fold or domain or sub-domain
DIIDPWCSTDEAQHEYGLTLCEDPKVNHY

SEQ ID NO: 2698 - protein, 30 aa, artificial
  peptide fold or domain or sub-domain
DIILTDVVKEKLEFAEKRGADLTVDVTETD

SEQ ID NO: 2699 - protein, 30 aa, artificial
  peptide fold or domain or sub-domain
DIITKVANVELYYRAIQFYLEFKPLLLNDL

SEQ ID NO: 2700 - protein, 30 aa, artificial
  peptide fold or domain or sub-domain
DIIVVDKSEASLKLAEKSGADHLVKADGNE

SEQ ID NO: 2701 - protein, 29 aa, artificial
  peptide fold or domain or sub-domain
DIKAIRDNQQAFEAAWSAKGRSGAAAEAV

SEQ ID NO: 2702 - protein, 29 aa, artificial
  peptide fold or domain or sub-domain
DIKFIRSNPDVVRRAIELKGEKADLDRLL

SEQ ID NO: 2703 - protein, 21 aa, artificial
  peptide fold or domain or sub-domain
DIKIDMFRSSGPGGQNVQKVS

SEQ ID NO: 2704 - protein, 29 aa, artificial
  peptide fold or domain or sub-domain
DIKQIRENPQLIQERLNSRNGTYDIQPIL

SEQ ID NO: 2705 - protein, 26 aa, artificial
  peptide fold or domain or sub-domain
DIKRLISARFSGVGRRMTISRAIRIY

SEQ ID NO: 2706 - protein, 25 aa, artificial
  peptide fold or domain or sub-domain
DIKSITKFLHKTTNISEEKVLNVLN

SEQ ID NO: 2707 - protein, 20 aa, artificial
  peptide fold or domain or sub-domain
DIKSVSRRDFLRYTSVAGGA

SEQ ID NO: 2708 - protein, 29 aa, artificial
  peptide fold or domain or sub-domain
DIKWIRENPETLDKALAKRGAAPLSSELI

SEQ ID NO: 2709 - protein, 29 aa, artificial
  peptide fold or domain or sub-domain
DIKWIRQNQAEVQTIADQKGIPISIHQLV

SEQ ID NO: 2710 - protein, 26 aa, artificial
  peptide fold or domain or sub-domain
DILAKLVNEALDNGQDIGAESLLKLY

SEQ ID NO: 2711 - protein, 21 aa, artificial
  peptide fold or domain or sub-domain
DILDYIRDGKIKVNPEIVDLL

SEQ ID NO: 2712 - protein, 27 aa, artificial
  peptide fold or domain or sub-domain
DILGVMRRRVYDINGSVRDINVYLNGK

SEQ ID NO: 2713 - protein, 26 aa, artificial
  peptide fold or domain or sub-domain
DILGVSYNRLIKIDAATGIPVTTWRF

SEQ ID NO: 2714 - protein, 29 aa, artificial
  peptide fold or domain or sub-domain
DILPKLKDVKSSDNSRSLLSYIVSYYLRN

SEQ ID NO: 2715 - protein, 21 aa, artificial
  peptide fold or domain or sub-domain
DILRFYEEDPIYRKYDFNLVT

SEQ ID NO: 2716 - protein, 22 aa, artificial
  peptide fold or domain or sub-domain
DILSATEIRRRMIEGEPWEDLV

SEQ ID NO: 2717 - protein, 27 aa, artificial
  peptide fold or domain or sub-domain
DILSFMLYLRERRYASSTVARRVAAVK

SEQ ID NO: 2718 - protein, 27 aa, artificial
  peptide fold or domain or sub-domain
DIMRFLNEEKDRKISSKTIAREVVAIR

SEQ ID NO: 2719 - protein, 30 aa, artificial
  peptide fold or domain or sub-domain
DINDVLNTSVNACTDKAKELGIKPGDSIMD

SEQ ID NO: 2720 - protein, 22 aa, artificial
  peptide fold or domain or sub-domain
DINLMVWVDDGYGLIAWKQENE

SEQ ID NO: 2721 - protein, 21 aa, artificial
  peptide fold or domain or sub-domain
DINNTLRNKGYNYLNVDDKLI

SEQ ID NO: 2722 - protein, 28 aa, artificial
  peptide fold or domain or sub-domain
DIPAILAVDTRCFSVEWRKDDVQISLAL

SEQ ID NO: 2723 - protein, 20 aa, artificial
  peptide fold or domain or sub-domain
DIPSIFKKYGEYHFRSVETA

SEQ ID NO: 2724 - protein, 20 aa, artificial
  peptide fold or domain or sub-domain
DIQCWVRTHGWKSFRDEESR

SEQ ID NO: 2725 - protein, 29 aa, artificial
  peptide fold or domain or sub-domain
DIQSLRNNEFHHVINGITQTTKITSIKQL

SEQ ID NO: 2726 - protein, 28 aa, artificial
  peptide fold or domain or sub-domain
DIQTLVEIEERIYGKAPWSYAAFRIELQ

SEQ ID NO: 2727 - protein, 21 aa, artificial
  peptide fold or domain or sub-domain
DIRAFVRGDDDTAARFADRWL

SEQ ID NO: 2728 - protein, 27 aa, artificial
  peptide fold or domain or sub-domain
DIRKFIQELHEIGLEASSIARNISAIR

SEQ ID NO: 2729 - protein, 29 aa, artificial
  peptide fold or domain or sub-domain
DIRLIRKEPKECESRLQKKDPAISLERLL

SEQ ID NO: 2730 - protein, 20 aa, artificial
  peptide fold or domain or sub-domain
DISERVKQELMIDASESTLR

SEQ ID NO: 2731 - protein, 25 aa, artificial
  peptide fold or domain or sub-domain
DISHAVVQTPNGPKRVADLVEESWL

SEQ ID NO: 2732 - protein, 20 aa, artificial
  peptide fold or domain or sub-domain
DISIGRGTGIGEIFDGLSRS

SEQ ID NO: 2733 - protein, 27 aa, artificial
  peptide fold or domain or sub-domain
DISNFGVPGVTYDIKNGKAVFKDSVLK

SEQ ID NO: 2734 - protein, 22 aa, artificial
  peptide fold or domain or sub-domain
DISQDNALRDEMRTLAGNPKAT

SEQ ID NO: 2735 - protein, 20 aa, artificial
  peptide fold or domain or sub-domain
DISSRSIRGLARLGRSIRYL

SEQ ID NO: 2736 - protein, 20 aa, artificial
  peptide fold or domain or sub-domain
DISSSEIRRRIINNLPTDDM

SEQ ID NO: 2737 - protein, 20 aa, artificial
  peptide fold or domain or sub-domain
DISSSLVRERVENGQGVEHL

SEQ ID NO: 2738 - protein, 20 aa, artificial
  peptide fold or domain or sub-domain
DISSTQIRSLLAMGEIPQDA

SEQ ID NO: 2739 - protein, 22 aa, artificial
  peptide fold or domain or sub-domain
DISTSNDAKEQMRKKVGNPSAM

SEQ ID NO: 2740 - protein, 24 aa, artificial
  peptide fold or domain or sub-domain
DITEIFDGNKKFIETKKAQDAAYF

SEQ ID NO: 2741 - protein, 22 aa, artificial
  peptide fold or domain or sub-domain
DITEPNLEMIWQNYPPKSITGS

SEQ ID NO: 2742 - protein, 23 aa, artificial
  peptide fold or domain or sub-domain
DITFVVSGNTTTTVHAKALKERM

SEQ ID NO: 2743 - protein, 21 aa, artificial
  peptide fold or domain or sub-domain
DIVEEGVRLMNINFVIEPARA

SEQ ID NO: 2744 - protein, 30 aa, artificial
  peptide fold or domain or sub-domain
DIVEVSNLQRQLFFSHDDIGKYKVDVISYK

SEQ ID NO: 2745 - protein, 27 aa, artificial
  peptide fold or domain or sub-domain
DIVGFMAFARQEGKSPRSVARYIASLR

SEQ ID NO: 2746 - protein, 28 aa, artificial
  peptide fold or domain or sub-domain
DIVGKLVGVCVSKGCELQNLSLEEMKKL

SEQ ID NO: 2747 - protein, 29 aa, artificial
  peptide fold or domain or sub-domain
DIVITDKAPKSAQGFSRGRPSPPEKIIEA

SEQ ID NO: 2748 - protein, 21 aa, artificial
  peptide fold or domain or sub-domain
DIVKGINSSNVENQLQATQAA

SEQ ID NO: 2749 - protein, 28 aa, artificial
  peptide fold or domain or sub-domain
DIVYLGCRRAVEDKTGLFEVLRTMPEVA

SEQ ID NO: 2750 - protein, 25 aa, artificial
  peptide fold or domain or sub-domain
DIVYLGNSEFLITGAFVPQPRRLRF

SEQ ID NO: 2751 - protein, 27 aa, artificial
  peptide fold or domain or sub-domain
DIYIRYKKQLHELHDRELILDKLVELN

SEQ ID NO: 2752 - protein, 29 aa, artificial
  peptide fold or domain or sub-domain
DKAADEALDSLWARQTPNRARRVTDVIRN

SEQ ID NO: 2753 - protein, 22 aa, artificial
  peptide fold or domain or sub-domain
DKAAEYIAQQFQQAGLQPGGES

SEQ ID NO: 2754 - protein, 30 aa, artificial
  peptide fold or domain or sub-domain
DKALETYREGLKHDPNNQELLDGIRRCVEQ

SEQ ID NO: 2755 - protein, 26 aa, artificial
  peptide fold or domain or sub-domain
DKARKDLETAQDFEPDSKDIALQLKI

SEQ ID NO: 2756 - protein, 30 aa, artificial
  peptide fold or domain or sub-domain
DKDCYQTFQNGRINTQNGVGFEASSRYVRL

SEQ ID NO: 2757 - protein, 25 aa, artificial
  peptide fold or domain or sub-domain
DKEGIIKFLVDENDFNYDRVKKHVD

SEQ ID NO: 2758 - protein, 27 aa, artificial
  peptide fold or domain or sub-domain
DKEIEHQGNHMTVRTLSTFRNYTVQFD

SEQ ID NO: 2759 - protein, 27 aa, artificial
  peptide fold or domain or sub-domain
DKEMWIEVNDTFVTYGQNVCLPIKPKC

SEQ ID NO: 2760 - protein, 20 aa, artificial
  peptide fold or domain or sub-domain
DKEVAKLFEKGEATSGIILD

SEQ ID NO: 2761 - protein, 27 aa, artificial
  peptide fold or domain or sub-domain
DKEYLGLLSDVFNDGDSFSNNLKQFFG

SEQ ID NO: 2762 - protein, 29 aa, artificial
  peptide fold or domain or sub-domain
DKFDEHSSHMIPAVINRIHNAKVNNIKLI

SEQ ID NO: 2763 - protein, 29 aa, artificial
  peptide fold or domain or sub-domain
DKFDPINGHVIPSLIDKTYNSLLRGDNQL

SEQ ID NO: 2764 - protein, 29 aa, artificial
  peptide fold or domain or sub-domain
DKFDPRRSHLLPAIIHKIHRARVEGHETV

SEQ ID NO: 2765 - protein, 21 aa, artificial
  peptide fold or domain or sub-domain
DKFETKIDEYPNQLLRSCVEL

SEQ ID NO: 2766 - protein, 27 aa, artificial
  peptide fold or domain or sub-domain
DKIALIEASIPSKNNILPPDTNVHVII

SEQ ID NO: 2767 - protein, 27 aa, artificial
  peptide fold or domain or sub-domain
DKILISSELLLKRVQKLYSESGFEIGV

SEQ ID NO: 2768 - protein, 28 aa, artificial
  peptide fold or domain or sub-domain
DKIRVLAEGDGFMKRIPTSKQGELLAKA

SEQ ID NO: 2769 - protein, 27 aa, artificial
  peptide fold or domain or sub-domain
DKIVDVDLDGKIKVIKGEKAEYKAKSV

SEQ ID NO: 2770 - protein, 29 aa, artificial
  peptide fold or domain or sub-domain
DKKIYDTWKKMWLSKGEEHEEGKKELISI

SEQ ID NO: 2771 - protein, 27 aa, artificial
  peptide fold or domain or sub-domain
DKLEAHPIWRDRALHQRQARPGRLVGT

SEQ ID NO: 2772 - protein, 23 aa, artificial
  peptide fold or domain or sub-domain
DKLFHPSNLIKGNVLKKYLKIQD

SEQ ID NO: 2773 - protein, 20 aa, artificial
  peptide fold or domain or sub-domain
DKLGEGSLSSGTLDLWGSSP

SEQ ID NO: 2774 - protein, 21 aa, artificial
  peptide fold or domain or sub-domain
DKLPAAQQFGKRYKARFNQDV

SEQ ID NO: 2775 - protein, 27 aa, artificial
  peptide fold or domain or sub-domain
DKNNNDCSILNLEKNSIKQHNSCEVVF

SEQ ID NO: 2776 - protein, 28 aa, artificial
  peptide fold or domain or sub-domain
DKPWAKSQVCQTMIKEGKVADMEHLPSY

SEQ ID NO: 2777 - protein, 28 aa, artificial
  peptide fold or domain or sub-domain
DKPWGRSPACLAQIAQGQLSSVDQLPLK

SEQ ID NO: 2778 - protein, 28 aa, artificial
  peptide fold or domain or sub-domain
DKQKKSLMAYVKDYQKQFKAEGDHFGGH

SEQ ID NO: 2779 - protein, 29 aa, artificial
  peptide fold or domain or sub-domain
DKRFNLQGRDIRVVDGVCVDDHGTLAGSD

SEQ ID NO: 2780 - protein, 27 aa, artificial
  peptide fold or domain or sub-domain
DKRKKMLKNLRLTRYDAFEHVCAQLGI

SEQ ID NO: 2781 - protein, 22 aa, artificial
  peptide fold or domain or sub-domain
DKRKRTDRYQHLGQVFWAPAYV

SEQ ID NO: 2782 - protein, 30 aa, artificial
  peptide fold or domain or sub-domain
DKRSMAFLDLLLELRNEGLMNEDDIREEVD

SEQ ID NO: 2783 - protein, 20 aa, artificial
  peptide fold or domain or sub-domain
DKRVNDYFSESNYTKGMILD

SEQ ID NO: 2784 - protein, 29 aa, artificial
  peptide fold or domain or sub-domain
DKTWSLRTGLDLLPMSFHPEKLTPYTPMT

SEQ ID NO: 2785 - protein, 30 aa, artificial
  peptide fold or domain or sub-domain
DKVDITNLQRQVLYVTEDEGKSKAETAAKR

SEQ ID NO: 2786 - protein, 30 aa, artificial
  peptide fold or domain or sub-domain
DKVEIHNLQRQVIYTEADVSQHKVVAALSF

SEQ ID NO: 2787 - protein, 30 aa, artificial
  peptide fold or domain or sub-domain
DKVELSNLQRQVVYRDNNLNQNKAMAMAHQ

SEQ ID NO: 2788 - protein, 21 aa, artificial
  peptide fold or domain or sub-domain
DKVFWRYSGPTQPLKLIRKDM

SEQ ID NO: 2789 - protein, 23 aa, artificial
  peptide fold or domain or sub-domain
DKVKGLLQKHHGLNENQAHDVLR

SEQ ID NO: 2790 - protein, 30 aa, artificial
  peptide fold or domain or sub-domain
DKVKIESSDKVYGTGIIHEFGERDYTVFEL

SEQ ID NO: 2791 - protein, 28 aa, artificial
  peptide fold or domain or sub-domain
DKVQPKAMESWETKTPFRTLIEEDATIT

SEQ ID NO: 2792 - protein, 30 aa, artificial
  peptide fold or domain or sub-domain
DKVRTSEHAASMGGSQIFLEPGEEMTVKEM

SEQ ID NO: 2793 - protein, 25 aa, artificial
  peptide fold or domain or sub-domain
DKYMTIESTDDSLKAKKGKEGIVAY

SEQ ID NO: 2794 - protein, 29 aa, artificial
  peptide fold or domain or sub-domain
DLAELPDGHISRSGTAVDPAETFQELVAD

SEQ ID NO: 2795 - protein, 30 aa, artificial
  peptide fold or domain or sub-domain
DLAEMEFLSSIRANPRNIGARKNLGIIYFQ

SEQ ID NO: 2796 - protein, 29 aa, artificial
  peptide fold or domain or sub-domain
DLAFIYKQLYDIDLPDTLDGFVNNLSDMF

SEQ ID NO: 2797 - protein, 28 aa, artificial
  peptide fold or domain or sub-domain
DLAFQYWLGRTYEQLEAGDLAQQTFNKL

SEQ ID NO: 2798 - protein, 30 aa, artificial
  peptide fold or domain or sub-domain
DLAIADYNQAIQLNPKLAEAYNNRGAVYRK

SEQ ID NO: 2799 - protein, 30 aa, artificial
  peptide fold or domain or sub-domain
DLAIINYKKSRKINPNSSWININLGFVWEK

SEQ ID NO: 2800 - protein, 26 aa, artificial
  peptide fold or domain or sub-domain
DLAPYKNQVVYSPHDYGPGVSDQTWF

SEQ ID NO: 2801 - protein, 21 aa, artificial
  peptide fold or domain or sub-domain
DLARALASGFVYQGEISEFWG

SEQ ID NO: 2802 - protein, 27 aa, artificial
  peptide fold or domain or sub-domain
DLASTVAGTCTGMLGCTVEAAMTFEDA

SEQ ID NO: 2803 - protein, 25 aa, artificial
  peptide fold or domain or sub-domain
DLCDETSCSFGGICRPLSADTYECI

SEQ ID NO: 2804 - protein, 24 aa, artificial
  peptide fold or domain or sub-domain
DLCQDPTIKELESIISKRNIQFSC

SEQ ID NO: 2805 - protein, 30 aa, artificial
  peptide fold or domain or sub-domain
DLDADIDGYLTSWHLADDPAAPGTVTVRTL

SEQ ID NO: 2806 - protein, 30 aa, artificial
  peptide fold or domain or sub-domain
DLDADIRKYLSEFPAKKFAGEDVTLTMRQL

SEQ ID NO: 2807 - protein, 30 aa, artificial
  peptide fold or domain or sub-domain
DLDAPAEKYLTRWQLPKSEFDSDKVTIRRL

SEQ ID NO: 2808 - protein, 30 aa, artificial
  peptide fold or domain or sub-domain
DLDAPLSTYDLPYEPDYGEHAPEAVTVRRL

SEQ ID NO: 2809 - protein, 30 aa, artificial
  peptide fold or domain or sub-domain
DLDAPVETWLSGRDWWPALANHDGMTLRHL

SEQ ID NO: 2810 - protein, 30 aa, artificial
  peptide fold or domain or sub-domain
DLDAYKANLTNIAPAGVAGMSVDGKLYGIP

SEQ ID NO: 2811 - protein, 29 aa, artificial
  peptide fold or domain or sub-domain
DLDFLAQNAEVIADRISHRKGKIDVHEVL

SEQ ID NO: 2812 - protein, 30 aa, artificial
  peptide fold or domain or sub-domain
DLDFPNLPYLLDGKNKITQSNAILRYIARK

SEQ ID NO: 2813 - protein, 22 aa, artificial
  peptide fold or domain or sub-domain
DLDGDGWENANDNCQWDSNYRQ

SEQ ID NO: 2814 - protein, 24 aa, artificial
  peptide fold or domain or sub-domain
DLDGFKLDFIGRFNAGNDTELTKE

SEQ ID NO: 2815 - protein, 21 aa, artificial
  peptide fold or domain or sub-domain
DLDGYKTGYVHGNLSDVGRLK

SEQ ID NO: 2816 - protein, 30 aa, artificial
  peptide fold or domain or sub-domain
DLDIPVQHYVPEFPEKEYEGEKVSVTTRLL

SEQ ID NO: 2817 - protein, 25 aa, artificial
  peptide fold or domain or sub-domain
DLDKIREFCQRYFGWNRTKTDESLF

SEQ ID NO: 2818 - protein, 27 aa, artificial
  peptide fold or domain or sub-domain
DLDKPHLQSYTEKLGHLFPITADFSKI

SEQ ID NO: 2819 - protein, 29 aa, artificial
  peptide fold or domain or sub-domain
DLDLIRNDTEKVKKALLKKIDNVDFTELL

SEQ ID NO: 2820 - protein, 25 aa, artificial
  peptide fold or domain or sub-domain
DLDMLRSFMKTQLGWPHEKSDEILI

SEQ ID NO: 2821 - protein, 24 aa, artificial
  peptide fold or domain or sub-domain
DLDRFIAGFRRFQRNYFCHDHNLF

SEQ ID NO: 2822 - protein, 28 aa, artificial
  peptide fold or domain or sub-domain
DLDRIVELEFENFSVEEAIPPSVFEAHL

SEQ ID NO: 2823 - protein, 25 aa, artificial
  peptide fold or domain or sub-domain
DLDSLRTFLGEYLHWPVTKTDQYLL

SEQ ID NO: 2824 - protein, 30 aa, artificial
  peptide fold or domain or sub-domain
DLDSPVQKIVPHIPFDNPWKENHPVTIRDL

SEQ ID NO: 2825 - protein, 22 aa, artificial
  peptide fold or domain or sub-domain
DLDSRTIGGSLASRMPLSAYTR

SEQ ID NO: 2826 - protein, 30 aa, artificial
  peptide fold or domain or sub-domain
DLDTDINTYLKSWKAESEFTESKKVTIRQL

SEQ ID NO: 2827 - protein, 21 aa, artificial
  peptide fold or domain or sub-domain
DLEETFVRGSGPGGQAVAKTN

SEQ ID NO: 2828 - protein, 28 aa, artificial
  peptide fold or domain or sub-domain
DLEKIIAIQRASFKAVYEKYHDQYDPYV

SEQ ID NO: 2829 - protein, 24 aa, artificial
  peptide fold or domain or sub-domain
DLENFRLVDGWVSAIGQTATSLEV

SEQ ID NO: 2830 - protein, 24 aa, artificial
  peptide fold or domain or sub-domain
DLERFISGVKGFKERFYRRYPEHM

SEQ ID NO: 2831 - protein, 28 aa, artificial
  peptide fold or domain or sub-domain
DLETIKEIERREYPADEAASDAALEFRA

SEQ ID NO: 2832 - protein, 23 aa, artificial
  peptide fold or domain or sub-domain
DLFKKDEVISKADVWLGENKTID

SEQ ID NO: 2833 - protein, 27 aa, artificial
  peptide fold or domain or sub-domain
DLFLFLLQEKNQGRSARTLARYLATLR

SEQ ID NO: 2834 - protein, 29 aa, artificial
  peptide fold or domain or sub-domain
DLFMVMRRSQKLSSYKLNAVCDKFFGGKK

SEQ ID NO: 2835 - protein, 28 aa, artificial
  peptide fold or domain or sub-domain
DLGDVPKTIQCYMKETNASEEEAVEHVK

SEQ ID NO: 2836 - protein, 29 aa, artificial
  peptide fold or domain or sub-domain
DLGFFVSLLSNDDLPVDEPDFYWWCAKYF

SEQ ID NO: 2837 - protein, 29 aa, artificial
  peptide fold or domain or sub-domain
DLGFLINILMNDSMPNNKEDFEWWVHQYM

SEQ ID NO: 2838 - protein, 28 aa, artificial
  peptide fold or domain or sub-domain
DLGIKKLVQFNTKINKLSGKTVSEINFQ

SEQ ID NO: 2839 - protein, 29 aa, artificial
  peptide fold or domain or sub-domain
DLGRQLRKEMKLPSQTLQMVYQKLFHSSL

SEQ ID NO: 2840 - protein, 29 aa, artificial
  peptide fold or domain or sub-domain
DLGYVLGIMLNKELPAEEQQFLAQVRRYF

SEQ ID NO: 2841 - protein, 25 aa, artificial
  peptide fold or domain or sub-domain
DLHGLRNFLMTTIGWSQERTDEVLL

SEQ ID NO: 2842 - protein, 27 aa, artificial
  peptide fold or domain or sub-domain
DLHIITGNGEYIQCSRTQTPELYHAVL

SEQ ID NO: 2843 - protein, 27 aa, artificial
  peptide fold or domain or sub-domain
DLIDIEAEFHVDNNMATVDTELFHEIL

SEQ ID NO: 2844 - protein, 28 aa, artificial
  peptide fold or domain or sub-domain
DLINQVEFSTLINMQSDALIESLKEHTR

SEQ ID NO: 2845 - protein, 26 aa, artificial
  peptide fold or domain or sub-domain
DLIYTLYYSVQAVIPSRTVNRKSTDS

SEQ ID NO: 2846 - protein, 28 aa, artificial
  peptide fold or domain or sub-domain
DLKALIGSNPDTIRRVKGRIIGENGKTK

SEQ ID NO: 2847 - protein, 29 aa, artificial
  peptide fold or domain or sub-domain
DLKFIRENPELVRKAVADRNTDAPIDEIL

SEQ ID NO: 2848 - protein, 29 aa, artificial
  peptide fold or domain or sub-domain
DLKNIINNSEKYKDAIIRRKTPELIQSLE

SEQ ID NO: 2849 - protein, 20 aa, artificial
  peptide fold or domain or sub-domain
DLKPGTPDEADRIRKSNGRV

SEQ ID NO: 2850 - protein, 20 aa, artificial
  peptide fold or domain or sub-domain
DLKQVVGDSQNHLKRIKGRI

SEQ ID NO: 2851 - protein, 28 aa, artificial
  peptide fold or domain or sub-domain
DLKQVVGDSQNHLKRIKGRIIGEGGRAR

SEQ ID NO: 2852 - protein, 29 aa, artificial
  peptide fold or domain or sub-domain
DLKRLRQEPEVFHRAIREKGVALDLEALL

SEQ ID NO: 2853 - protein, 27 aa, artificial
  peptide fold or domain or sub-domain
DLKSAIHKWADEFAVPEGSIPFAEELA

SEQ ID NO: 2854 - protein, 21 aa, artificial
  peptide fold or domain or sub-domain
DLKVVSLWADGPFNHALEHMD

SEQ ID NO: 2855 - protein, 21 aa, artificial
  peptide fold or domain or sub-domain
DLKWEFHRPTGPGGQNLNKST

SEQ ID NO: 2856 - protein, 20 aa, artificial
  peptide fold or domain or sub-domain
DLKWKQNMTVSELVDSYEFI

SEQ ID NO: 2857 - protein, 29 aa, artificial
  peptide fold or domain or sub-domain
DLKWKQNMTVSELVDSYEFIGFQSVELQR

SEQ ID NO: 2858 - protein, 29 aa, artificial
  peptide fold or domain or sub-domain
DLLFFKDEVFWRKSARFPEVETIPISIIW

SEQ ID NO: 2859 - protein, 24 aa, artificial
  peptide fold or domain or sub-domain
DLLHLLDGVEQFSDEVFPATQALF

SEQ ID NO: 2860 - protein, 27 aa, artificial
  peptide fold or domain or sub-domain
DLLIVTHSRMSLLVKHYLIKSNYYEID

SEQ ID NO: 2861 - protein, 29 aa, artificial
  peptide fold or domain or sub-domain
DLLQWFRKNRNLESYSLNNVSKLYLGDQK

SEQ ID NO: 2862 - protein, 20 aa, artificial
  peptide fold or domain or sub-domain
DLLREQFEEEQEAKAELQRG

SEQ ID NO: 2863 - protein, 28 aa, artificial
  peptide fold or domain or sub-domain
DLLYELTMRAFEEDKDLKDILLEDNEIK

SEQ ID NO: 2864 - protein, 23 aa, artificial
  peptide fold or domain or sub-domain
DLMDIPEVKEIAASHGKTPAQVL

SEQ ID NO: 2865 - protein, 21 aa, artificial
  peptide fold or domain or sub-domain
DLMDRVRKGRIPFGRDIADLL

SEQ ID NO: 2866 - protein, 29 aa, artificial
  peptide fold or domain or sub-domain
DLMPIIMMDHKLDSYSLDYVANHFVKAGK

SEQ ID NO: 2867 - protein, 23 aa, artificial
  peptide fold or domain or sub-domain
DLNADQWRERLSPQAYDVLRNEG

SEQ ID NO: 2868 - protein, 24 aa, artificial
  peptide fold or domain or sub-domain
DLNFQFLYEDGEGFHFMNPENYDQ

SEQ ID NO: 2869 - protein, 26 aa, artificial
  peptide fold or domain or sub-domain
DLNNIIKSQMKSGFQTFQLLGNWEFL

SEQ ID NO: 2870 - protein, 26 aa, artificial
  peptide fold or domain or sub-domain
DLNRSTLDEKDNCIQSDKFSQDFSLR

SEQ ID NO: 2871 - protein, 20 aa, artificial
  peptide fold or domain or sub-domain
DLNVNKNTTIEELIKQFSSI

SEQ ID NO: 2872 - protein, 28 aa, artificial
  peptide fold or domain or sub-domain
DLPALQALELACWPAALRMPEATLAARV

SEQ ID NO: 2873 - protein, 24 aa, artificial
  peptide fold or domain or sub-domain
DLPANTPLALGTTTVDQLIGWAGR

SEQ ID NO: 2874 - protein, 28 aa, artificial
  peptide fold or domain or sub-domain
DLPDILDIYNEAIRTLTATFDLEEQSLE

SEQ ID NO: 2875 - protein, 28 aa, artificial
  peptide fold or domain or sub-domain
DLPEIGALQTSSFPAEKQQLSHILEESI

SEQ ID NO: 2876 - protein, 28 aa, artificial
  peptide fold or domain or sub-domain
DLPKLVDLYLRAYKGLEEYAYTHPKDVK

SEQ ID NO: 2877 - protein, 28 aa, artificial
  peptide fold or domain or sub-domain
DLPRVLEIEGKCFQAPWSKKAFLRELQD

SEQ ID NO: 2878 - protein, 27 aa, artificial
  peptide fold or domain or sub-domain
DLQALLAERLEGGYKATSSARLLSAVR

SEQ ID NO: 2879 - protein, 23 aa, artificial
  peptide fold or domain or sub-domain
DLQGFLDAYLQAFYTHQFFSVEY

SEQ ID NO: 2880 - protein, 28 aa, artificial
  peptide fold or domain or sub-domain
DLQQVISIERINFSEAEAASKKAMQERL

SEQ ID NO: 2881 - protein, 20 aa, artificial
  peptide fold or domain or sub-domain
DLREFAGRSPAQIARVKSRI

SEQ ID NO: 2882 - protein, 28 aa, artificial
  peptide fold or domain or sub-domain
DLRGFTALTRDRASLGDEEALINQLNEY

SEQ ID NO: 2883 - protein, 21 aa, artificial
  peptide fold or domain or sub-domain
DLRIDVYRASGAGGQHVNRTE

SEQ ID NO: 2884 - protein, 21 aa, artificial
  peptide fold or domain or sub-domain
DLRLASAAAKLFRGESVDPDD

SEQ ID NO: 2885 - protein, 27 aa, artificial
  peptide fold or domain or sub-domain
DLRSYLSHLAGQGFKASSQARRLSALR

SEQ ID NO: 2886 - protein, 30 aa, artificial
  peptide fold or domain or sub-domain
DLRTLGLSTDDIPDGIVDFGSYKGTYYGAA

SEQ ID NO: 2887 - protein, 23 aa, artificial
  peptide fold or domain or sub-domain
DLSDFSGTARNQADTLYGKAHAS

SEQ ID NO: 2888 - protein, 25 aa, artificial
  peptide fold or domain or sub-domain
DLSGTRKILQSFDLQPTAAELQIIR

SEQ ID NO: 2889 - protein, 22 aa, artificial
  peptide fold or domain or sub-domain
DLSMHAGFKEELHAALGAPGSL

SEQ ID NO: 2890 - protein, 30 aa, artificial
  peptide fold or domain or sub-domain
DLSPKPWNGLNLGLNCGDQPERVERARHHV

SEQ ID NO: 2891 - protein, 20 aa, artificial
  peptide fold or domain or sub-domain
DLSSTHLRQRLAAGQPADDQ

SEQ ID NO: 2892 - protein, 29 aa, artificial
  peptide fold or domain or sub-domain
DLSSYLSKASITSEDLSVKLLDEESVATV

SEQ ID NO: 2893 - protein, 20 aa, artificial
  peptide fold or domain or sub-domain
DLTGAGESVKTRAKADPCLW

SEQ ID NO: 2894 - protein, 29 aa, artificial
  peptide fold or domain or sub-domain
DLTGLLVNERSLGHVDLIDVSNYLGISPS

SEQ ID NO: 2895 - protein, 20 aa, artificial
  peptide fold or domain or sub-domain
DLTLSRWSNSNLADRDFLAE

SEQ ID NO: 2896 - protein, 25 aa, artificial
  peptide fold or domain or sub-domain
DLTVIIVGNNNKVYEYSTVEANEIF

SEQ ID NO: 2897 - protein, 23 aa, artificial
  peptide fold or domain or sub-domain
DLTVTVDGPVVSTQHQEALQTRI

SEQ ID NO: 2898 - protein, 30 aa, artificial
  peptide fold or domain or sub-domain
DLVETSNLNRQFLYSEKNIGELKTEATLNR

SEQ ID NO: 2899 - protein, 28 aa, artificial
  peptide fold or domain or sub-domain
DLVGQIVRTCVAEGILLKDLPLERWKSF

SEQ ID NO: 2900 - protein, 27 aa, artificial
  peptide fold or domain or sub-domain
DLVIAVDCANHERLAGELPTGAFVIKI

SEQ ID NO: 2901 - protein, 22 aa, artificial
  peptide fold or domain or sub-domain
DLVIIIFDDASYGLIEWESNTK

SEQ ID NO: 2902 - protein, 27 aa, artificial
  peptide fold or domain or sub-domain
DLVIIVDVENSEIAKKIGAKVPGKYAI

SEQ ID NO: 2903 - protein, 22 aa, artificial
  peptide fold or domain or sub-domain
DLVILIVRDDAFGMIRWKQENM

SEQ ID NO: 2904 - protein, 30 aa, artificial
  peptide fold or domain or sub-domain
DLVNPKLLWVGTENGLYISIDGGANWAEFN

SEQ ID NO: 2905 - protein, 22 aa, artificial
  peptide fold or domain or sub-domain
DLVQYFEEDDARKKDLKSIQKK

SEQ ID NO: 2906 - protein, 30 aa, artificial
  peptide fold or domain or sub-domain
DLVSLSNLQRQVLFDEDHLDYPKVFAVKDK

SEQ ID NO: 2907 - protein, 23 aa, artificial
  peptide fold or domain or sub-domain
DLVTDDHCMDDGSKLSSEEIWNY

SEQ ID NO: 2908 - protein, 30 aa, artificial
  peptide fold or domain or sub-domain
DLVTVSEHAWRTGGSRMFIKVGSQVSVSDL

SEQ ID NO: 2909 - protein, 28 aa, artificial
  peptide fold or domain or sub-domain
DLVVRATQDKNIELLYQLGAREVVQPEF

SEQ ID NO: 2910 - protein, 28 aa, artificial
  peptide fold or domain or sub-domain
DLVYDICREALKLKRPLIELLAEHPEIN

SEQ ID NO: 2911 - protein, 29 aa, artificial
  peptide fold or domain or sub-domain
DLWIQAKDMIKSNDYSITYLAKEFLKQDC

SEQ ID NO: 2912 - protein, 20 aa, artificial
  peptide fold or domain or sub-domain
DLYELVGRNPKALERQRARI

SEQ ID NO: 2913 - protein, 28 aa, artificial
  peptide fold or domain or sub-domain
DLYELVGRNPKALERQRARIIGREGRTR

SEQ ID NO: 2914 - protein, 29 aa, artificial
  peptide fold or domain or sub-domain
DLYHTARKNLKLERFTLEEAVKDVLGVEK

SEQ ID NO: 2915 - protein, 29 aa, artificial
  peptide fold or domain or sub-domain
DLYPIARKLLNLTKYKLENVVQELFKINK

SEQ ID NO: 2916 - protein, 29 aa, artificial
  peptide fold or domain or sub-domain
DLYPVIRRTINLPTYTLEAVYEAVFGKPK

SEQ ID NO: 2917 - protein, 21 aa, artificial
  peptide fold or domain or sub-domain
DLYVSTYSPDGKLFQVDYANK

SEQ ID NO: 2918 - protein, 23 aa, artificial
  peptide fold or domain or sub-domain
DMAEAGQVVKEIKVEKGMMEKVK

SEQ ID NO: 2919 - protein, 24 aa, artificial
  peptide fold or domain or sub-domain
DMAKLAEARQVDPNKFLIGIGQTE

SEQ ID NO: 2920 - protein, 28 aa, artificial
  peptide fold or domain or sub-domain
DMAKSLEFYRKLGVEIPAEADSAPHTEA

SEQ ID NO: 2921 - protein, 24 aa, artificial
  peptide fold or domain or sub-domain
DMAQMCKLAAEGHFAEARVINQRL

SEQ ID NO: 2922 - protein, 26 aa, artificial
  peptide fold or domain or sub-domain
DMAQMCKLAAEGHFAEARVINQRLMP

SEQ ID NO: 2923 - protein, 26 aa, artificial
  peptide fold or domain or sub-domain
DMASPQAVNSFCDKLDASPDQREILL

SEQ ID NO: 2924 - protein, 20 aa, artificial
  peptide fold or domain or sub-domain
DMEGVGDSMKSKAAADPMVQ

SEQ ID NO: 2925 - protein, 21 aa, artificial
  peptide fold or domain or sub-domain
DMFERILESKKGDLFKSVVDF

SEQ ID NO: 2926 - protein, 29 aa, artificial
  peptide fold or domain or sub-domain
DMFSIIYQKIKLCSYKLNSVAETVLGEKK

SEQ ID NO: 2927 - protein, 30 aa, artificial
  peptide fold or domain or sub-domain
DMHVRAFRRQQELFERKQIIDLDDIIKNIE

SEQ ID NO: 2928 - protein, 25 aa, artificial
  peptide fold or domain or sub-domain
DMIAPEHLELHVDNPWEILPDLRHA

SEQ ID NO: 2929 - protein, 27 aa, artificial
  peptide fold or domain or sub-domain
DMKALAEMLDGKRPFSADDAKARVASL

SEQ ID NO: 2930 - protein, 20 aa, artificial
  peptide fold or domain or sub-domain
DMKINKNTTLMQLMEMFGTS

SEQ ID NO: 2931 - protein, 27 aa, artificial
  peptide fold or domain or sub-domain
DMKPNVPEIIPTYEIRKLEELYHILNI

SEQ ID NO: 2932 - protein, 22 aa, artificial
  peptide fold or domain or sub-domain
DMLFQIVKELHPIYSASSRFGN

SEQ ID NO: 2933 - protein, 29 aa, artificial
  peptide fold or domain or sub-domain
DMLRAIQRDYKLSSYSLNAVSAHFLGEQK

SEQ ID NO: 2934 - protein, 30 aa, artificial
  peptide fold or domain or sub-domain
DMNAEVRSLAPEIPFENQWEATDPVRFIHL

SEQ ID NO: 2935 - protein, 23 aa, artificial
  peptide fold or domain or sub-domain
DMSDEEWRRILTAQEYHILREKG

SEQ ID NO: 2936 - protein, 25 aa, artificial
  peptide fold or domain or sub-domain
DMTIEECTIYITQDNNSATWQRWEA

SEQ ID NO: 2937 - protein, 22 aa, artificial
  peptide fold or domain or sub-domain
DMTLDIMQDDGSIASKHILTEM

SEQ ID NO: 2938 - protein, 23 aa, artificial
  peptide fold or domain or sub-domain
DMTLVQGGNQVSFVHKKPLEDRM

SEQ ID NO: 2939 - protein, 23 aa, artificial
  peptide fold or domain or sub-domain
DMVLRLQALDATPEELGALGARM

SEQ ID NO: 2940 - protein, 29 aa, artificial
  peptide fold or domain or sub-domain
DMWHIYKECSKFSNYETDYIAKQVFNVSL

SEQ ID NO: 2941 - protein, 29 aa, artificial
  peptide fold or domain or sub-domain
DMYAVCRDKLSLSDYKLDTVARHLLGAKK

SEQ ID NO: 2942 - protein, 20 aa, artificial
  peptide fold or domain or sub-domain
DMYNFYEKENVYDAVTGNSA

SEQ ID NO: 2943 - protein, 29 aa, artificial
  peptide fold or domain or sub-domain
DMYPVCMAKTSSPNYKLNTMAELYLKQQK

SEQ ID NO: 2944 - protein, 22 aa, artificial
  peptide fold or domain or sub-domain
DNALKNVQAAEAEGITPAEYVE

SEQ ID NO: 2945 - protein, 25 aa, artificial
  peptide fold or domain or sub-domain
DNALKNVQAAEAEGITPAEYVERVA

SEQ ID NO: 2946 - protein, 22 aa, artificial
  peptide fold or domain or sub-domain
DNCPLDKEVYNSNNCECDQGND

SEQ ID NO: 2947 - protein, 22 aa, artificial
  peptide fold or domain or sub-domain
DNDGDGIPDGEDGCANEKGPKH

SEQ ID NO: 2948 - protein, 27 aa, artificial
  peptide fold or domain or sub-domain
DNDPFQSAAIKPYWDSLEFVKAGQAHT

SEQ ID NO: 2949 - protein, 21 aa, artificial
  peptide fold or domain or sub-domain
DNDVTVWSPQGRIHQIEYAME

SEQ ID NO: 2950 - protein, 27 aa, artificial
  peptide fold or domain or sub-domain
DNDWWSYTLRFAGSVNAIEDNLQAAFK

SEQ ID NO: 2951 - protein, 24 aa, artificial
  peptide fold or domain or sub-domain
DNEFFGITAAEARLMDPAQKQLME

SEQ ID NO: 2952 - protein, 23 aa, artificial
  peptide fold or domain or sub-domain
DNFGKIFFGVNIINKPLSTPLLE

SEQ ID NO: 2953 - protein, 29 aa, artificial
  peptide fold or domain or sub-domain
DNFHPSNSHVIPALLRRFHEATAQSAPDV

SEQ ID NO: 2954 - protein, 29 aa, artificial
  peptide fold or domain or sub-domain
DNFKPESSHVIPALIRKVYEAQRDGVKQL

SEQ ID NO: 2955 - protein, 26 aa, artificial
  peptide fold or domain or sub-domain
DNGKRVHRAAIELARHRDERLAEWIA

SEQ ID NO: 2956 - protein, 20 aa, artificial
  peptide fold or domain or sub-domain
DNGSSPGKNPGALLEEGGKR

SEQ ID NO: 2957 - protein, 20 aa, artificial
  peptide fold or domain or sub-domain
DNGVNPQKASSSTLESGTLR

SEQ ID NO: 2958 - protein, 26 aa, artificial
  peptide fold or domain or sub-domain
DNGWRLKAAVVAYAAKLDESLAAWID

SEQ ID NO: 2959 - protein, 27 aa, artificial
  peptide fold or domain or sub-domain
DNHRLGLVSQFQLMNWETDTACGNKQS

SEQ ID NO: 2960 - protein, 23 aa, artificial
  peptide fold or domain or sub-domain
DNIERQRMYYNVDELNPSEVFSY

SEQ ID NO: 2961 - protein, 29 aa, artificial
  peptide fold or domain or sub-domain
DNIRVTVISPGMAATELRDHIAVEAVQSA

SEQ ID NO: 2962 - protein, 29 aa, artificial
  peptide fold or domain or sub-domain
DNIYTVEAGNQRVQKFTNQGHYVLLWGNP

SEQ ID NO: 2963 - protein, 29 aa, artificial
  peptide fold or domain or sub-domain
DNKCLKPMWLSMWTDGEAQARFVRETKES

SEQ ID NO: 2964 - protein, 29 aa, artificial
  peptide fold or domain or sub-domain
DNKFRQNFKSYKHLLKKLNEINFSRNKNI

SEQ ID NO: 2965 - protein, 24 aa, artificial
  peptide fold or domain or sub-domain
DNKLFNYSPRELEVMDPQLKILHE

SEQ ID NO: 2966 - protein, 22 aa, artificial
  peptide fold or domain or sub-domain
DNKNDHVGDSKDNNKNDHVGDS

SEQ ID NO: 2967 - protein, 28 aa, artificial
  peptide fold or domain or sub-domain
DNLKLSLREKDTKLKNLEDSQAAHKLER

SEQ ID NO: 2968 - protein, 28 aa, artificial
  peptide fold or domain or sub-domain
DNMEYIERDGTEKIFTIDTFSESMRKKV

SEQ ID NO: 2969 - protein, 23 aa, artificial
  peptide fold or domain or sub-domain
DNPKTDTQKGVWPVGTSWDQTPA

SEQ ID NO: 2970 - protein, 24 aa, artificial
  peptide fold or domain or sub-domain
DNPQIAFVKWDCNRAVTNPGSTYL

SEQ ID NO: 2971 - protein, 27 aa, artificial
  peptide fold or domain or sub-domain
DNRALQLVKQWQVYLYKRRIIATEFSP

SEQ ID NO: 2972 - protein, 22 aa, artificial
  peptide fold or domain or sub-domain
DNRDVLVLQDSTNEEVSYQDIN

SEQ ID NO: 2973 - protein, 27 aa, artificial
  peptide fold or domain or sub-domain
DNRTLGLVRQVQDMFQNKRIVGVDYGN

SEQ ID NO: 2974 - protein, 27 aa, artificial
  peptide fold or domain or sub-domain
DNRTLGMVYQWQNLYYGKRQCAVHLGE

SEQ ID NO: 2975 - protein, 27 aa, artificial
  peptide fold or domain or sub-domain
DNSAYGNVRRDQQNSYGNRLLGADLDN

SEQ ID NO: 2976 - protein, 25 aa, artificial
  peptide fold or domain or sub-domain
DNSLKNVRSAEAAGVQVKDFVDANA

SEQ ID NO: 2977 - protein, 27 aa, artificial
  peptide fold or domain or sub-domain
DNSRLGIVSQFQRITFADDPVTGDFCN

SEQ ID NO: 2978 - protein, 20 aa, artificial
  peptide fold or domain or sub-domain
DNTASVETSTTYAEYEHTAA

SEQ ID NO: 2979 - protein, 26 aa, artificial
  peptide fold or domain or sub-domain
DNTQAARTALVSFAALKNPGLARWID

SEQ ID NO: 2980 - protein, 27 aa, artificial
  peptide fold or domain or sub-domain
DNVFEDQLADNPVWTNLNFVQEERTYS

SEQ ID NO: 2981 - protein, 27 aa, artificial
  peptide fold or domain or sub-domain
DNVTSFIHTPGENKLTVGEKDIIGKSI

SEQ ID NO: 2982 - protein, 20 aa, artificial
  peptide fold or domain or sub-domain
DNWQPLSVPVKNSTLFTIQS

SEQ ID NO: 2983 - protein, 24 aa, artificial
  peptide fold or domain or sub-domain
DNYAQGAKFGKDQEFIFGKIGSTF

SEQ ID NO: 2984 - protein, 29 aa, artificial
  peptide fold or domain or sub-domain
DNYDKNNSHFIPALIKKIHKLKLSKKNTV

SEQ ID NO: 2985 - protein, 29 aa, artificial
  peptide fold or domain or sub-domain
DNYDLENGHVVASLISKIHQAKEQKKPNF

SEQ ID NO: 2986 - protein, 29 aa, artificial
  peptide fold or domain or sub-domain
DNYHPQHSHVVAGILRRTHEAKLAGKSEF

SEQ ID NO: 2987 - protein, 27 aa, artificial
  peptide fold or domain or sub-domain
DNYYFNASVTNDGDGSKDNPWKTINQL

SEQ ID NO: 2988 - protein, 30 aa, artificial
  peptide fold or domain or sub-domain
DPAARAGRRHAEYLAKGIRVDYAVLERQIR

SEQ ID NO: 2989 - protein, 30 aa, artificial
  peptide fold or domain or sub-domain
DPADEVLLPEPYFPLYPTDVVICGGEPILY

SEQ ID NO: 2990 - protein, 24 aa, artificial
  peptide fold or domain or sub-domain
DPAFKASNDDIIRELLTTDSPYYK

SEQ ID NO: 2991 - protein, 22 aa, artificial
  peptide fold or domain or sub-domain
DPAIARQAARVARRHGFVLETY

SEQ ID NO: 2992 - protein, 25 aa, artificial
  peptide fold or domain or sub-domain
DPAKAAQEAMKYSATPMAAGEGELR

SEQ ID NO: 2993 - protein, 30 aa, artificial
  peptide fold or domain or sub-domain
DPALGLQRAARRGQPDRLEQADLTFHRRVR

SEQ ID NO: 2994 - protein, 28 aa, artificial
  peptide fold or domain or sub-domain
DPAWVYWQARADQSLGKSEQAQQQFQSI

SEQ ID NO: 2995 - protein, 25 aa, artificial
  peptide fold or domain or sub-domain
DPCAKKRCGAGKECKISDSGEAECR

SEQ ID NO: 2996 - protein, 25 aa, artificial
  peptide fold or domain or sub-domain
DPCANMECRIGRECVLDNQREPFCD

SEQ ID NO: 2997 - protein, 25 aa, artificial
  peptide fold or domain or sub-domain
DPCGNVECVEPEICQLDESRQPGCR

SEQ ID NO: 2998 - protein, 25 aa, artificial
  peptide fold or domain or sub-domain
DPCHGHKCPNGQTCQLGVDRRPECK

SEQ ID NO: 2999 - protein, 25 aa, artificial
  peptide fold or domain or sub-domain
DPCLKVHCSAGRVCEINEHGDAMCN

SEQ ID NO: 3000 - protein, 25 aa, artificial
  peptide fold or domain or sub-domain
DPCQNVKCSRHKVCVAQGYQRAMCV

SEQ ID NO: 3001 - protein, 20 aa, artificial
  peptide fold or domain or sub-domain
DPCSATPSQRAAQGESVECK

SEQ ID NO: 3002 - protein, 22 aa, artificial
  peptide fold or domain or sub-domain
DPDIEKRQYKVAKDNGFVLESH

SEQ ID NO: 3003 - protein, 22 aa, artificial
  peptide fold or domain or sub-domain
DPDKDGFDSLVDQYPTDPKLAG

SEQ ID NO: 3004 - protein, 27 aa, artificial
  peptide fold or domain or sub-domain
DPEELAEIFRASGEHVTDEEIESLMKD

SEQ ID NO: 3005 - protein, 25 aa, artificial
  peptide fold or domain or sub-domain
DPEGLTEFLVQENNFSKERVEKFIE

SEQ ID NO: 3006 - protein, 30 aa, artificial
  peptide fold or domain or sub-domain
DPEIAAKRISERSTMNHLDAYTKERINKIR

SEQ ID NO: 3007 - protein, 24 aa, artificial
  peptide fold or domain or sub-domain
DPETGNLTSSDEWSDTQLNLAKQC

SEQ ID NO: 3008 - protein, 30 aa, artificial
  peptide fold or domain or sub-domain
DPEVSATRMGKRGENNYLDEENQQFHQRVR

SEQ ID NO: 3009 - protein, 28 aa, artificial
  peptide fold or domain or sub-domain
DPEVSVAHLERLGLTPANVNGAGQIVAA

SEQ ID NO: 3010 - protein, 24 aa, artificial
  peptide fold or domain or sub-domain
DPEYFRMEEEKAIQTDPLIRHFLE

SEQ ID NO: 3011 - protein, 22 aa, artificial
  peptide fold or domain or sub-domain
DPFLNVTLDDGSVSRRHFKNEL

SEQ ID NO: 3012 - protein, 30 aa, artificial
  peptide fold or domain or sub-domain
DPGDEIIVPCPGYNPYGQAAEMSDAVVVQV

SEQ ID NO: 3013 - protein, 30 aa, artificial
  peptide fold or domain or sub-domain
DPGDEVIVFSPVWVSYIPQIILAGGTVNVV

SEQ ID NO: 3014 - protein, 30 aa, artificial
  peptide fold or domain or sub-domain
DPGDEVLIPDPGWVSYQEMVHFARGKPVGV

SEQ ID NO: 3015 - protein, 30 aa, artificial
  peptide fold or domain or sub-domain
DPGDYTLIPDPAYPVYRTSTIFAGGEFFAM

SEQ ID NO: 3016 - protein, 27 aa, artificial
  peptide fold or domain or sub-domain
DPGEAFRLMDEGFGELKKYQEFARLLV

SEQ ID NO: 3017 - protein, 30 aa, artificial
  peptide fold or domain or sub-domain
DPGFVHSDGTISHHDMYDYLHLSRLGYTPV

SEQ ID NO: 3018 - protein, 30 aa, artificial
  peptide fold or domain or sub-domain
DPGSEVVVADPSYPCNRQLVETFGGVVAAV

SEQ ID NO: 3019 - protein, 24 aa, artificial
  peptide fold or domain or sub-domain
DPHFFGLSPLEAASMDPQHRLLLE

SEQ ID NO: 3020 - protein, 29 aa, artificial
  peptide fold or domain or sub-domain
DPHILRSRPKDVSDMLQARNVDFDLDALL

SEQ ID NO: 3021 - protein, 29 aa, artificial
  peptide fold or domain or sub-domain
DPHLDRPLRDVMFDAEAEVLDRTRYAQPA

SEQ ID NO: 3022 - protein, 23 aa, artificial
  peptide fold or domain or sub-domain
DPIAHLQPLVSGTDLQVSLGIRG

SEQ ID NO: 3023 - protein, 23 aa, artificial
  peptide fold or domain or sub-domain
DPIIVSSAKGVYFYDVEGKKYLD

SEQ ID NO: 3024 - protein, 23 aa, artificial
  peptide fold or domain or sub-domain
DPIKIVRAQRQYMFDENGEQYLD

SEQ ID NO: 3025 - protein, 28 aa, artificial
  peptide fold or domain or sub-domain
DPIVEVAAGLGLAQEDIIPYGWTKAKVP

SEQ ID NO: 3026 - protein, 24 aa, artificial
  peptide fold or domain or sub-domain
DPKAFFTDPKEVKRNDRYTHFAVA

SEQ ID NO: 3027 - protein, 25 aa, artificial
  peptide fold or domain or sub-domain
DPKKAVEFANKIGSKWKGNTESQFA

SEQ ID NO: 3028 - protein, 27 aa, artificial
  peptide fold or domain or sub-domain
DPKLLNEWKKNPLWNQITAVKKGEVYE

SEQ ID NO: 3029 - protein, 25 aa, artificial
  peptide fold or domain or sub-domain
DPKRTSALQQTVSPAHPLSSPGYFR

SEQ ID NO: 3030 - protein, 28 aa, artificial
  peptide fold or domain or sub-domain
DPKWQYWAIIADRHLDPQNSHKEEIKAL

SEQ ID NO: 3031 - protein, 23 aa, artificial
  peptide fold or domain or sub-domain
DPLAHPRTLIDGNGLMAELDLKP

SEQ ID NO: 3032 - protein, 29 aa, artificial
  peptide fold or domain or sub-domain
DPLDGLPADAAPSLQEYMGHPLCNIPAPA

SEQ ID NO: 3033 - protein, 24 aa, artificial
  peptide fold or domain or sub-domain
DPLEFGLPPDTLEALDSANLLALV

SEQ ID NO: 3034 - protein, 23 aa, artificial
  peptide fold or domain or sub-domain
DPLFHPSSPIDGNTLKDTFDAPE

SEQ ID NO: 3035 - protein, 27 aa, artificial
  peptide fold or domain or sub-domain
DPLGLSINHHADQSLNSFCQWQSGLVG

SEQ ID NO: 3036 - protein, 23 aa, artificial
  peptide fold or domain or sub-domain
DPLLEPIVKQLAAKYHKTAAQIL

SEQ ID NO: 3037 - protein, 29 aa, artificial
  peptide fold or domain or sub-domain
DPLRKVAPGIPESFGRYMGHSLSHIPDPE

SEQ ID NO: 3038 - protein, 29 aa, artificial
  peptide fold or domain or sub-domain
DPLRKVYPFLPESYAEHVGKPISEVPCPC

SEQ ID NO: 3039 - protein, 29 aa, artificial
  peptide fold or domain or sub-domain
DPLTGWSLVEVLRGGGEAVLGRVDVVQPA

SEQ ID NO: 3040 - protein, 20 aa, artificial
  peptide fold or domain or sub-domain
DPLTVRRHAEDYGHSFEREL

SEQ ID NO: 3041 - protein, 23 aa, artificial
  peptide fold or domain or sub-domain
DPLVGDLMTSFQAADSGVREAIL

SEQ ID NO: 3042 - protein, 23 aa, artificial
  peptide fold or domain or sub-domain
DPLVSDLLSMLQSGDDAVKESVL

SEQ ID NO: 3043 - protein, 30 aa, artificial
  peptide fold or domain or sub-domain
DPMVFTHQGHWDPANPLSRVRDLPFPLVAN

SEQ ID NO: 3044 - protein, 27 aa, artificial
  peptide fold or domain or sub-domain
DPNDPKVIEQAIKDGIPLSVIEAAQQS

SEQ ID NO: 3045 - protein, 25 aa, artificial
  peptide fold or domain or sub-domain
DPNKAAKLAASIDTARTGNSEKALK

SEQ ID NO: 3046 - protein, 29 aa, artificial
  peptide fold or domain or sub-domain
DPNLLRNEPDAVAEKLARRGFKLDVDKLG

SEQ ID NO: 3047 - protein, 29 aa, artificial
  peptide fold or domain or sub-domain
DPPAGITLQPASLTTQQVKATLSDGGFRA

SEQ ID NO: 3048 - protein, 30 aa, artificial
  peptide fold or domain or sub-domain
DPRAPLAGILKLVLKSTPAIANDILKPDTD

SEQ ID NO: 3049 - protein, 22 aa, artificial
  peptide fold or domain or sub-domain
DPRDHTHRIDYQGRSWYVPSYR

SEQ ID NO: 3050 - protein, 22 aa, artificial
  peptide fold or domain or sub-domain
DPREHWAKTDISVDAQQLLEKS

SEQ ID NO: 3051 - protein, 28 aa, artificial
  peptide fold or domain or sub-domain
DPRWQYFEARLAEKTGDSVQSQTLYRAA

SEQ ID NO: 3052 - protein, 30 aa, artificial
  peptide fold or domain or sub-domain
DPRYGALLRQASVEPDARRRLALLAAAEAR

SEQ ID NO: 3053 - protein, 25 aa, artificial
  peptide fold or domain or sub-domain
DPRYRDYVDDYFALVGRLGVIPEAA

SEQ ID NO: 3054 - protein, 24 aa, artificial
  peptide fold or domain or sub-domain
DPSHRGTGDEHIHTLMEFSIAMQE

SEQ ID NO: 3055 - protein, 28 aa, artificial
  peptide fold or domain or sub-domain
DPSLDDIHMVIESELIKKLGEDVAGRMH

SEQ ID NO: 3056 - protein, 29 aa, artificial
  peptide fold or domain or sub-domain
DPTEGVKLLGRFAAEPTRENIEKFLRIMV

SEQ ID NO: 3057 - protein, 24 aa, artificial
  peptide fold or domain or sub-domain
DPTSLTCQAGVTKGTSGNPQDPDE

SEQ ID NO: 3058 - protein, 30 aa, artificial
  peptide fold or domain or sub-domain
DPTVRAERRIEQNAAKNDEAAAKALREDLL

SEQ ID NO: 3059 - protein, 25 aa, artificial
  peptide fold or domain or sub-domain
DPVAASKLAFKYSPNPIATGADELT

SEQ ID NO: 3060 - protein, 20 aa, artificial
  peptide fold or domain or sub-domain
DPVAASTNSSQFPDTTNGRF

SEQ ID NO: 3061 - protein, 24 aa, artificial
  peptide fold or domain or sub-domain
DPVCMAAENKKQVDYVPGTPCKPD

SEQ ID NO: 3062 - protein, 23 aa, artificial
  peptide fold or domain or sub-domain
DPVFQKKADADKTKTFAEIKDYY

SEQ ID NO: 3063 - protein, 23 aa, artificial
  peptide fold or domain or sub-domain
DPVLADKAKKNKDKTVEQYREYY

SEQ ID NO: 3064 - protein, 22 aa, artificial
  peptide fold or domain or sub-domain
DPYAVITNPETKEKQGIGYDVL

SEQ ID NO: 3065 - protein, 23 aa, artificial
  peptide fold or domain or sub-domain
DQAKHLLMSQKGVSEQEAYEAMR

SEQ ID NO: 3066 - protein, 24 aa, artificial
  peptide fold or domain or sub-domain
DQARAIDVQNLEYVPFMRFKLADM

SEQ ID NO: 3067 - protein, 25 aa, artificial
  peptide fold or domain or sub-domain
DQDKVREILVERHDFNPERVERALE

SEQ ID NO: 3068 - protein, 23 aa, artificial
  peptide fold or domain or sub-domain
DQEIAAFCRKILGQVEHARFEEE

SEQ ID NO: 3069 - protein, 29 aa, artificial
  peptide fold or domain or sub-domain
DQERDYFMQRYRDVISSFGGKTSYDADNR

SEQ ID NO: 3070 - protein, 22 aa, artificial
  peptide fold or domain or sub-domain
DQFLGDSLGVNYTAEVKDAWEK

SEQ ID NO: 3071 - protein, 30 aa, artificial
  peptide fold or domain or sub-domain
DQFNVLIKELSSMLPGNTRKMDKTTVLEKV

SEQ ID NO: 3072 - protein, 28 aa, artificial
  peptide fold or domain or sub-domain
DQGKLKEICDTCGVEVANVNCAEQTIIT

SEQ ID NO: 3073 - protein, 24 aa, artificial
  peptide fold or domain or sub-domain
DQGTKFINQSAVKRAVQLSLEMME

SEQ ID NO: 3074 - protein, 27 aa, artificial
  peptide fold or domain or sub-domain
DQGYVAMLHDLFNEGDGFPTAVKKALK

SEQ ID NO: 3075 - protein, 29 aa, artificial
  peptide fold or domain or sub-domain
DQHDGVYKFPEEVSLLQQYFGPAHQQAYV

SEQ ID NO: 3076 - protein, 29 aa, artificial
  peptide fold or domain or sub-domain
DQHLDRPVGEVVWGDDAGLVGETVYAQAG

SEQ ID NO: 3077 - protein, 29 aa, artificial
  peptide fold or domain or sub-domain
DQILGYSIRQLCLEDPDGVIAQTDYTQPA

SEQ ID NO: 3078 - protein, 29 aa, artificial
  peptide fold or domain or sub-domain
DQIRTLHQQSLSDTSGRPPPGLEQLQAVT

SEQ ID NO: 3079 - protein, 20 aa, artificial
  peptide fold or domain or sub-domain
DQKPNISPDRERIEAAGAFT

SEQ ID NO: 3080 - protein, 29 aa, artificial
  peptide fold or domain or sub-domain
DQLNAEALIVRLKDQVAIATGSACTSASY

SEQ ID NO: 3081 - protein, 23 aa, artificial
  peptide fold or domain or sub-domain
DQLYDFMVNQITQANHKNDPQML

SEQ ID NO: 3082 - protein, 20 aa, artificial
  peptide fold or domain or sub-domain
DQMWNYFTIEDFRRLDAQGK

SEQ ID NO: 3083 - protein, 29 aa, artificial
  peptide fold or domain or sub-domain
DQPAKRENMASPDLRINNPRFMEPNLSDN

SEQ ID NO: 3084 - protein, 27 aa, artificial
  peptide fold or domain or sub-domain
DQPASKRDLLRLYELLDDRMDPEFLQQ

SEQ ID NO: 3085 - protein, 24 aa, artificial
  peptide fold or domain or sub-domain
DQPNKKYYDPRVWLRAGQTSMIAR

SEQ ID NO: 3086 - protein, 21 aa, artificial
  peptide fold or domain or sub-domain
DQPQLMSPLAKYHRSEPELTE

SEQ ID NO: 3087 - protein, 26 aa, artificial
  peptide fold or domain or sub-domain
DQPRDEELPPWQQMYGAIWDLDELGD

SEQ ID NO: 3088 - protein, 23 aa, artificial
  peptide fold or domain or sub-domain
DQPRVQQRWQETVLHGNAFHEEY

SEQ ID NO: 3089 - protein, 24 aa, artificial
  peptide fold or domain or sub-domain
DQQCTVARPGTSMIASGIAVELLS

SEQ ID NO: 3090 - protein, 23 aa, artificial
  peptide fold or domain or sub-domain
DQQPELEQIRDCLQKGESCHVTL

SEQ ID NO: 3091 - protein, 27 aa, artificial
  peptide fold or domain or sub-domain
DQQVNYPDGGTDKSALNAVTYQQDPAF

SEQ ID NO: 3092 - protein, 22 aa, artificial
  peptide fold or domain or sub-domain
DQRYATDEIRFKGKNLYVPAWE

SEQ ID NO: 3093 - protein, 27 aa, artificial
  peptide fold or domain or sub-domain
DQSDFLYRVAQGGYYGHPNPQRCEWVL

SEQ ID NO: 3094 - protein, 27 aa, artificial
  peptide fold or domain or sub-domain
DQSHIYVSLPIEGFTEHSGPCACFSRK

SEQ ID NO: 3095 - protein, 20 aa, artificial
  peptide fold or domain or sub-domain
DQSIKEIAEKLGAPLADIKG

SEQ ID NO: 3096 - protein, 27 aa, artificial
  peptide fold or domain or sub-domain
DQSWLPLLYQFSNDNHAYPTGLVQPVT

SEQ ID NO: 3097 - protein, 24 aa, artificial
  peptide fold or domain or sub-domain
DQSYFKKFDGKKPDELKGDAQLAT

SEQ ID NO: 3098 - protein, 29 aa, artificial
  peptide fold or domain or sub-domain
DQTGATVRCASVAFTAEGTNAELNVGGES

SEQ ID NO: 3099 - protein, 20 aa, artificial
  peptide fold or domain or sub-domain
DQTPFRKDECERVKACGARV

SEQ ID NO: 3100 - protein, 27 aa, artificial
  peptide fold or domain or sub-domain
DQTWQPILFDYTNDGMGWPTTALAFAQ

SEQ ID NO: 3101 - protein, 23 aa, artificial
  peptide fold or domain or sub-domain
DQVFDYKAKLTGKMTQAEYKAYY

SEQ ID NO: 3102 - protein, 27 aa, artificial
  peptide fold or domain or sub-domain
DQVKQIAEQKHPDLLSYDLTNAAKEVV

SEQ ID NO: 3103 - protein, 20 aa, artificial
  peptide fold or domain or sub-domain
DQVLDLLEDQELKDELVDEF

SEQ ID NO: 3104 - protein, 30 aa, artificial
  peptide fold or domain or sub-domain
DQVLLSSMKACAVSGDIDGVEKYMHKFREH

SEQ ID NO: 3105 - protein, 29 aa, artificial
  peptide fold or domain or sub-domain
DQVVGFEKLGGDSVEPEVLKKRILDSNIF

SEQ ID NO: 3106 - protein, 30 aa, artificial
  peptide fold or domain or sub-domain
DQWMARGDAWRNKRLTEDGLHPNTLGYQSL

SEQ ID NO: 3107 - protein, 28 aa, artificial
  peptide fold or domain or sub-domain
DQWWENGQDKNDWVGPPHDGSFNIISPS

SEQ ID NO: 3108 - protein, 25 aa, artificial
  peptide fold or domain or sub-domain
DQYAAEHLEVHTANAREVSERISNA

SEQ ID NO: 3109 - protein, 24 aa, artificial
  peptide fold or domain or sub-domain
DRAARDGKTGNEIYEEVVIDDIAH

SEQ ID NO: 3110 - protein, 23 aa, artificial
  peptide fold or domain or sub-domain
DRADETKIKAGQGSARGRKYRRP

SEQ ID NO: 3111 - protein, 23 aa, artificial
  peptide fold or domain or sub-domain
DRAKCVLIEYLKMSEAEAHRFIE

SEQ ID NO: 3112 - protein, 23 aa, artificial
  peptide fold or domain or sub-domain
DRAKGILQARFQWTEEEAYLFLR

SEQ ID NO: 3113 - protein, 23 aa, artificial
  peptide fold or domain or sub-domain
DRAKRMLMDSQKMTEHAAYATMR

SEQ ID NO: 3114 - protein, 21 aa, artificial
  peptide fold or domain or sub-domain
DRDANFIEKNEQGVTVNRWLS

SEQ ID NO: 3115 - protein, 22 aa, artificial
  peptide fold or domain or sub-domain
DRDRDGVGDACDSCPEISNPMQ

SEQ ID NO: 3116 - protein, 21 aa, artificial
  peptide fold or domain or sub-domain
DREDALKLVELIDSNYIIMNR

SEQ ID NO: 3117 - protein, 26 aa, artificial
  peptide fold or domain or sub-domain
DREHRFKKIMGGDLSSPKAHAIYKRL

SEQ ID NO: 3118 - protein, 30 aa, artificial
  peptide fold or domain or sub-domain
DREIHDSLEGIIEKREKALKNGETTNDDLL

SEQ ID NO: 3119 - protein, 25 aa, artificial
  peptide fold or domain or sub-domain
DREKLYSLFERITGGRMLYNYLRIG

SEQ ID NO: 3120 - protein, 25 aa, artificial
  peptide fold or domain or sub-domain
DRELVMDILAELGGNRVNYGINTLG

SEQ ID NO: 3121 - protein, 25 aa, artificial
  peptide fold or domain or sub-domain
DREVWVTILEALTGARVTNSYVIPG

SEQ ID NO: 3122 - protein, 24 aa, artificial
  peptide fold or domain or sub-domain
DRFAACLREAQRGGELAPELDAGV

SEQ ID NO: 3123 - protein, 21 aa, artificial
  peptide fold or domain or sub-domain
DRFEAKLREWGGNLTKAAVEL

SEQ ID NO: 3124 - protein, 24 aa, artificial
  peptide fold or domain or sub-domain
DRFRDELGAAEAVGDLLPEVVVAD

SEQ ID NO: 3125 - protein, 29 aa, artificial
  peptide fold or domain or sub-domain
DRFRKVPRNVPQEWKDYLGMPISEVPDPW

SEQ ID NO: 3126 - protein, 22 aa, artificial
  peptide fold or domain or sub-domain
DRGREVTVLDPGTHPGTELAIV

SEQ ID NO: 3127 - protein, 29 aa, artificial
  peptide fold or domain or sub-domain
DRHFYLCGPPPMMDAVQEVLDNLGVKSNS

SEQ ID NO: 3128 - protein, 26 aa, artificial
  peptide fold or domain or sub-domain
DRHGTFCSKWDMMEPIYGVPAQDGLA

SEQ ID NO: 3129 - protein, 21 aa, artificial
  peptide fold or domain or sub-domain
DRHITIFSPEGRLYQVEYAFK

SEQ ID NO: 3130 - protein, 29 aa, artificial
  peptide fold or domain or sub-domain
DRHLRYPLRDVIWGHDQDLLNTTEFAQPA

SEQ ID NO: 3131 - protein, 26 aa, artificial
  peptide fold or domain or sub-domain
DRHNTSSVKWDFLNQYLQLDQSDLLP

SEQ ID NO: 3132 - protein, 24 aa, artificial
  peptide fold or domain or sub-domain
DRIKLLASKHHEQQGTKMPEMHLH

SEQ ID NO: 3133 - protein, 30 aa, artificial
  peptide fold or domain or sub-domain
DRIQESNLNRQFLHAAASVGLQKVYSAEAT

SEQ ID NO: 3134 - protein, 29 aa, artificial
  peptide fold or domain or sub-domain
DRISPYSISNLCFAGPAEQLNQTEFAQPA

SEQ ID NO: 3135 - protein, 21 aa, artificial
  peptide fold or domain or sub-domain
DRITWLYDNTTGKQWKNSVNS

SEQ ID NO: 3136 - protein, 26 aa, artificial
  peptide fold or domain or sub-domain
DRKLAEKDEEIEQIKRNSQRVTDSMQ

SEQ ID NO: 3137 - protein, 25 aa, artificial
  peptide fold or domain or sub-domain
DRKQIYNILSSLGVLPSELDCDIVH

SEQ ID NO: 3138 - protein, 21 aa, artificial
  peptide fold or domain or sub-domain
DRKRFIKYSDGRPLQNVYTDT

SEQ ID NO: 3139 - protein, 25 aa, artificial
  peptide fold or domain or sub-domain
DRLASEHVQVMTRDPDHFLNSMRNY

SEQ ID NO: 3140 - protein, 30 aa, artificial
  peptide fold or domain or sub-domain
DRLHVTNLQRQILYRSSDVSQSKAALAKHQ

SEQ ID NO: 3141 - protein, 30 aa, artificial
  peptide fold or domain or sub-domain
DRLNEQFQELGSTLDPDRPRNDKATILSDA

SEQ ID NO: 3142 - protein, 22 aa, artificial
  peptide fold or domain or sub-domain
DRLQGRVVRELMASGGEWRELV

SEQ ID NO: 3143 - protein, 29 aa, artificial
  peptide fold or domain or sub-domain
DRLRKVPANIDKGYEQYIGMPLCDVPPPA

SEQ ID NO: 3144 - protein, 30 aa, artificial
  peptide fold or domain or sub-domain
DRLYTLLPNFIPDYCLTGIEKAIDRWAALV

SEQ ID NO: 3145 - protein, 21 aa, artificial
  peptide fold or domain or sub-domain
DRMPGGKAFDTQYQARFRAPI

SEQ ID NO: 3146 - protein, 28 aa, artificial
  peptide fold or domain or sub-domain
DRPEAIAHHRILLSNCLAQAQALAHGKN

SEQ ID NO: 3147 - protein, 23 aa, artificial
  peptide fold or domain or sub-domain
DRPHCLEIWQHCVATGEPLDVEF

SEQ ID NO: 3148 - protein, 27 aa, artificial
  peptide fold or domain or sub-domain
DRPSSKKNLQRLEELEERDLEEEFVEQ

SEQ ID NO: 3149 - protein, 27 aa, artificial
  peptide fold or domain or sub-domain
DRPVHRRKLAQLEKLQDEELDPEFVQQ

SEQ ID NO: 3150 - protein, 27 aa, artificial
  peptide fold or domain or sub-domain
DRQRRRYAMSFADDKIDAGRRRFMMSG

SEQ ID NO: 3151 - protein, 24 aa, artificial
  peptide fold or domain or sub-domain
DRQVSMDEWNHLSELVLFALAMQE

SEQ ID NO: 3152 - protein, 27 aa, artificial
  peptide fold or domain or sub-domain
DRRGASFYFQNPIFSSLKAFKNNRVYF

SEQ ID NO: 3153 - protein, 27 aa, artificial
  peptide fold or domain or sub-domain
DRRRKMLKYLRKRNYERFERLLVELNL

SEQ ID NO: 3154 - protein, 30 aa, artificial
  peptide fold or domain or sub-domain
DRRRLMHEAGRWFHQVWTDNHWLDIYEFWG

SEQ ID NO: 3155 - protein, 26 aa, artificial
  peptide fold or domain or sub-domain
DRSNTACEKWDAHYLNARFGMTDLTP

SEQ ID NO: 3156 - protein, 26 aa, artificial
  peptide fold or domain or sub-domain
DRTGTGSLKWDDMERIFGPVPQNAIP

SEQ ID NO: 3157 - protein, 21 aa, artificial
  peptide fold or domain or sub-domain
DRVFWEVNDEGEVTKMVKNDK

SEQ ID NO: 3158 - protein, 26 aa, artificial
  peptide fold or domain or sub-domain
DRVGTDCVKWDFRTNCSTKAQKDGLP

SEQ ID NO: 3159 - protein, 25 aa, artificial
  peptide fold or domain or sub-domain
DRYAPEHLTVMAEDLDWWLDRLSCY

SEQ ID NO: 3160 - protein, 29 aa, artificial
  peptide fold or domain or sub-domain
DRYDLQNGHVFPVLIRKFYEAMINKVPSV

SEQ ID NO: 3161 - protein, 22 aa, artificial
  peptide fold or domain or sub-domain
DRYSGTEVRRRMLDDGDWRSLL

SEQ ID NO: 3162 - protein, 29 aa, artificial
  peptide fold or domain or sub-domain
DSAASATAWSTGVKTYNGALGVDIHEKDH

SEQ ID NO: 3163 - protein, 27 aa, artificial
  peptide fold or domain or sub-domain
DSAFLARMVAEHRMDLVEAEELIVDLT

SEQ ID NO: 3164 - protein, 26 aa, artificial
  peptide fold or domain or sub-domain
DSAKRCLVQAIRLEPNDKLLRDELEN

SEQ ID NO: 3165 - protein, 29 aa, artificial
  peptide fold or domain or sub-domain
DSAVVKVDGGEMMVETAFGDEFKADVINL

SEQ ID NO: 3166 - protein, 24 aa, artificial
  peptide fold or domain or sub-domain
DSCGHNTVQILEDRLKTLGYSVTC

SEQ ID NO: 3167 - protein, 25 aa, artificial
  peptide fold or domain or sub-domain
DSCMSFQCKRGHICKADQQGKPHCV

SEQ ID NO: 3168 - protein, 24 aa, artificial
  peptide fold or domain or sub-domain
DSCSGSSIRKLKSILDGRNVKFRC

SEQ ID NO: 3169 - protein, 26 aa, artificial
  peptide fold or domain or sub-domain
DSCTFTTAAAAKAGKAKCSTITLNNI

SEQ ID NO: 3170 - protein, 23 aa, artificial
  peptide fold or domain or sub-domain
DSDAKNAIDKSDVTGGKVRKSLF

SEQ ID NO: 3171 - protein, 22 aa, artificial
  peptide fold or domain or sub-domain
DSDEDNISDFDEVNKYQTNPLS

SEQ ID NO: 3172 - protein, 24 aa, artificial
  peptide fold or domain or sub-domain
DSDESTIKSTIMYNNLKEDEAPSQ

SEQ ID NO: 3173 - protein, 29 aa, artificial
  peptide fold or domain or sub-domain
DSDFYCCGPAPLMDAFSTTFASLPPERVH

SEQ ID NO: 3174 - protein, 22 aa, artificial
  peptide fold or domain or sub-domain
DSDGDGVPDDIDECPDTAYGVD

SEQ ID NO: 3175 - protein, 22 aa, artificial
  peptide fold or domain or sub-domain
DSDSDTLTDLQESLSSLLSLAE

SEQ ID NO: 3176 - protein, 28 aa, artificial
  peptide fold or domain or sub-domain
DSDWQTNSQIQAYMQTNNLSDSYALHAY

SEQ ID NO: 3177 - protein, 25 aa, artificial
  peptide fold or domain or sub-domain
DSFAPEHLQIETREPESLIAKIRHS

SEQ ID NO: 3178 - protein, 23 aa, artificial
  peptide fold or domain or sub-domain
DSFILARLGTVEMRQEWRERIID

SEQ ID NO: 3179 - protein, 20 aa, artificial
  peptide fold or domain or sub-domain
DSGDELVRPGNTTRLHQLPA

SEQ ID NO: 3180 - protein, 28 aa, artificial
  peptide fold or domain or sub-domain
DSGDWFNVLDHTDATNGFGRGLPPKADN

SEQ ID NO: 3181 - protein, 20 aa, artificial
  peptide fold or domain or sub-domain
DSGHIALPDLVAALDADFAG

SEQ ID NO: 3182 - protein, 29 aa, artificial
  peptide fold or domain or sub-domain
DSIESLHKRSLNEISEEQEAYTREQIESL

SEQ ID NO: 3183 - protein, 25 aa, artificial
  peptide fold or domain or sub-domain
DSIGGHFLHLLHGEKPRESWVRAMH

SEQ ID NO: 3184 - protein, 26 aa, artificial
  peptide fold or domain or sub-domain
DSIIKIAQQLDLAYNQEPGQALFWLR

SEQ ID NO: 3185 - protein, 30 aa, artificial
  peptide fold or domain or sub-domain
DSIILSGIQLFNEKPKKGIEYFFQHKLLEK

SEQ ID NO: 3186 - protein, 29 aa, artificial
  peptide fold or domain or sub-domain
DSILGFSITNIMFNGSEDELKQTRYTQLA

SEQ ID NO: 3187 - protein, 27 aa, artificial
  peptide fold or domain or sub-domain
DSITLDQDTRKKSRIKSVTDKGANIGI

SEQ ID NO: 3188 - protein, 27 aa, artificial
  peptide fold or domain or sub-domain
DSIYVSPTGSSSGSGSITSPLNSIQSA

SEQ ID NO: 3189 - protein, 24 aa, artificial
  peptide fold or domain or sub-domain
DSKFDKNMRGDERSFTSSEQRGMN

SEQ ID NO: 3190 - protein, 29 aa, artificial
  peptide fold or domain or sub-domain
DSKLAAMELVKSRSFDLTELSQQILGTNR

SEQ ID NO: 3191 - protein, 20 aa, artificial
  peptide fold or domain or sub-domain
DSLEDIQKQIVPELSVRTIK

SEQ ID NO: 3192 - protein, 21 aa, artificial
  peptide fold or domain or sub-domain
DSLGYVQHEPVHRRFHHHEMT

SEQ ID NO: 3193 - protein, 29 aa, artificial
  peptide fold or domain or sub-domain
DSLIKLSDTKSSDLSSNLINTFVKYCQEK

SEQ ID NO: 3194 - protein, 29 aa, artificial
  peptide fold or domain or sub-domain
DSLLKLSDTRARNNKMTLMHYLSKVLSEK

SEQ ID NO: 3195 - protein, 24 aa, artificial
  peptide fold or domain or sub-domain
DSLPELSEYFNWYKFSYLESSQRI

SEQ ID NO: 3196 - protein, 28 aa, artificial
  peptide fold or domain or sub-domain
DSLQYIERDGTESYLTVSSHPNSLMKKI

SEQ ID NO: 3197 - protein, 27 aa, artificial
  peptide fold or domain or sub-domain
DSLRTGLIEWSWQAPMVGWLLPIVWAI

SEQ ID NO: 3198 - protein, 29 aa, artificial
  peptide fold or domain or sub-domain
DSLSKLSETKSKDQKHTVVDFIEIYIREN

SEQ ID NO: 3199 - protein, 26 aa, artificial
  peptide fold or domain or sub-domain
DSLTFVKAMDDSSVTEHQKVELLRKA

SEQ ID NO: 3200 - protein, 23 aa, artificial
  peptide fold or domain or sub-domain
DSLYEYMNQRLMLANINNQTAPL

SEQ ID NO: 3201 - protein, 29 aa, artificial
  peptide fold or domain or sub-domain
DSLYLETDENQNIKVTLDGVYERTFTFPS

SEQ ID NO: 3202 - protein, 22 aa, artificial
  peptide fold or domain or sub-domain
DSMKTMINLGSECYVKARVQDT

SEQ ID NO: 3203 - protein, 29 aa, artificial
  peptide fold or domain or sub-domain
DSNYHLLMSVQESLERKFGKHGGTIPIVP

SEQ ID NO: 3204 - protein, 24 aa, artificial
  peptide fold or domain or sub-domain
DSPGDGLLGHCRAWAAWLADLPRR

SEQ ID NO: 3205 - protein, 29 aa, artificial
  peptide fold or domain or sub-domain
DSQDLASFIDIIRGTQDVKNATAAQLQLA

SEQ ID NO: 3206 - protein, 29 aa, artificial
  peptide fold or domain or sub-domain
DSRREIKRMMKSEKDPGNLAMLEIRQLAL

SEQ ID NO: 3207 - protein, 28 aa, artificial
  peptide fold or domain or sub-domain
DSRWLYWRARALESTDRPDQARELYQQA

SEQ ID NO: 3208 - protein, 27 aa, artificial
  peptide fold or domain or sub-domain
DSSKMAEAVSALMVLGYSPAEANKAVS

SEQ ID NO: 3209 - protein, 22 aa, artificial
  peptide fold or domain or sub-domain
DSSRDGIIDSLEVIRNGNTLQA

SEQ ID NO: 3210 - protein, 26 aa, artificial
  peptide fold or domain or sub-domain
DSSVRMLERVPLSRPGRKETRLVHAD

SEQ ID NO: 3211 - protein, 27 aa, artificial
  peptide fold or domain or sub-domain
DSSWLPLLHDLTNEGMAFGHELAQALR

SEQ ID NO: 3212 - protein, 29 aa, artificial
  peptide fold or domain or sub-domain
DSSYVSPDYGNLSLLSSLPAANISSNKLY

SEQ ID NO: 3213 - protein, 22 aa, artificial
  peptide fold or domain or sub-domain
DSTDTSVVISSCSLAEARLLLD

SEQ ID NO: 3214 - protein, 24 aa, artificial
  peptide fold or domain or sub-domain
DSTYDKVGKTHIKALADFAMKLMD

SEQ ID NO: 3215 - protein, 29 aa, artificial
  peptide fold or domain or sub-domain
DSVMGYPFRNNMFSFLKGEINSYELCNRY

SEQ ID NO: 3216 - protein, 29 aa, artificial
  peptide fold or domain or sub-domain
DSVMNYPFRNIWLEYLLGKRDARSTHLRL

SEQ ID NO: 3217 - protein, 29 aa, artificial
  peptide fold or domain or sub-domain
DSVMNYPLREALLDFFLTRGDGVTLQARL

SEQ ID NO: 3218 - protein, 25 aa, artificial
  peptide fold or domain or sub-domain
DSVSNLVTYTWRLWSNGSQLDLVDP

SEQ ID NO: 3219 - protein, 25 aa, artificial
  peptide fold or domain or sub-domain
DSYAESFLNAAFGRKATKEEIDAMN

SEQ ID NO: 3220 - protein, 30 aa, artificial
  peptide fold or domain or sub-domain
DTARQYYINISATEVNTLPEVFINIYRKKN

SEQ ID NO: 3221 - protein, 30 aa, artificial
  peptide fold or domain or sub-domain
DTAVCKVGRVWASLICNSYNQNPKSLEELR

SEQ ID NO: 3222 - protein, 28 aa, artificial
  peptide fold or domain or sub-domain
DTAWIYWRGRALKESGDTLKANQEFERI

SEQ ID NO: 3223 - protein, 29 aa, artificial
  peptide fold or domain or sub-domain
DTCASNGISLLDANAQSGCNGGNGFMCNN

SEQ ID NO: 3224 - protein, 30 aa, artificial
  peptide fold or domain or sub-domain
DTDDTVLLPTHNWGNYKLVFSTRHGAHINT

SEQ ID NO: 3225 - protein, 22 aa, artificial
  peptide fold or domain or sub-domain
DTDGDGISDHVDLCPSQPETFN

SEQ ID NO: 3226 - protein, 22 aa, artificial
  peptide fold or domain or sub-domain
DTDGDGLEDYEEINAYSTSPIR

SEQ ID NO: 3227 - protein, 22 aa, artificial
  peptide fold or domain or sub-domain
DTDKDGVLDKDDACVDVAGPAE

SEQ ID NO: 3228 - protein, 22 aa, artificial
  peptide fold or domain or sub-domain
DTDQNYSQRIDNIRQQLADSQN

SEQ ID NO: 3229 - protein, 28 aa, artificial
  peptide fold or domain or sub-domain
DTDQNYSQRIDNIRQQLADSQNKYKTSN

SEQ ID NO: 3230 - protein, 25 aa, artificial
  peptide fold or domain or sub-domain
DTETKMEEFKDQLPADECNKLKEEI

SEQ ID NO: 3231 - protein, 21 aa, artificial
  peptide fold or domain or sub-domain
DTFDLENLKDVIDPKRQGFLG

SEQ ID NO: 3232 - protein, 21 aa, artificial
  peptide fold or domain or sub-domain
DTFTRLYYASVDNRRQQIGRL

SEQ ID NO: 3233 - protein, 22 aa, artificial
  peptide fold or domain or sub-domain
DTFTWKKDGQMLPPDRSYHLSG

SEQ ID NO: 3234 - protein, 29 aa, artificial
  peptide fold or domain or sub-domain
DTGALQIKQDAEGVSVRVACQGEPRIVHA

SEQ ID NO: 3235 - protein, 23 aa, artificial
  peptide fold or domain or sub-domain
DTGRSINPLDLDPADIGDLAGKV

SEQ ID NO: 3236 - protein, 30 aa, artificial
  peptide fold or domain or sub-domain
DTIDVSNLNRQFLFRPKDIGRPKAEVAAEF

SEQ ID NO: 3237 - protein, 30 aa, artificial
  peptide fold or domain or sub-domain
DTISLSNLQRQTLYSSDGIGLSKAWQAGHS

SEQ ID NO: 3238 - protein, 24 aa, artificial
  peptide fold or domain or sub-domain
DTISNTNGRHLTRSLNTLPLCRLR

SEQ ID NO: 3239 - protein, 29 aa, artificial
  peptide fold or domain or sub-domain
DTITNILNKYDLTGKYLDNNALTQITTYL

SEQ ID NO: 3240 - protein, 27 aa, artificial
  peptide fold or domain or sub-domain
DTKILAGGTDLMVLLRRNIENCAHILD

SEQ ID NO: 3241 - protein, 29 aa, artificial
  peptide fold or domain or sub-domain
DTKLFEPADKIWQTKGEEQETAKKEYIEA

SEQ ID NO: 3242 - protein, 27 aa, artificial
  peptide fold or domain or sub-domain
DTKVRHKAMLDAIEDPKDKCARLVELN

SEQ ID NO: 3243 - protein, 21 aa, artificial
  peptide fold or domain or sub-domain
DTLAYFRTDPLFRRYRHNDIT

SEQ ID NO: 3244 - protein, 25 aa, artificial
  peptide fold or domain or sub-domain
DTLDILKRTSALMPELFHGKGPEGA

SEQ ID NO: 3245 - protein, 21 aa, artificial
  peptide fold or domain or sub-domain
DTLDYMKLDPVYRQYHHDKLT

SEQ ID NO: 3246 - protein, 25 aa, artificial
  peptide fold or domain or sub-domain
DTLFDPQTNSFLTEARYHELMAEDP

SEQ ID NO: 3247 - protein, 25 aa, artificial
  peptide fold or domain or sub-domain
DTLHTLVKEYREKKAKIPLSIEHKT

SEQ ID NO: 3248 - protein, 29 aa, artificial
  peptide fold or domain or sub-domain
DTLILKKGEENFLEITIQGTATRTFRVPL

SEQ ID NO: 3249 - protein, 29 aa, artificial
  peptide fold or domain or sub-domain
DTLIRQEAADKNSFFLIKMKTSQMLELRA

SEQ ID NO: 3250 - protein, 24 aa, artificial
  peptide fold or domain or sub-domain
DTLKEKRFVDLQPSFEEAHYLNGF

SEQ ID NO: 3251 - protein, 29 aa, artificial
  peptide fold or domain or sub-domain
DTLLKLADVKGTDGKTTLLHFVVQEIIRS

SEQ ID NO: 3252 - protein, 29 aa, artificial
  peptide fold or domain or sub-domain
DTLLSSQEFVNCVEYTLEALAQKLFKIEI

SEQ ID NO: 3253 - protein, 21 aa, artificial
  peptide fold or domain or sub-domain
DTLRYIGLDFPERRSFHQLLT

SEQ ID NO: 3254 - protein, 21 aa, artificial
  peptide fold or domain or sub-domain
DTLSYLYTPPDNKSSKHNKLT

SEQ ID NO: 3255 - protein, 27 aa, artificial
  peptide fold or domain or sub-domain
DTLTLPYELRIRGRLKAVSDNERDVGL

SEQ ID NO: 3256 - protein, 24 aa, artificial
  peptide fold or domain or sub-domain
DTLVALAGKAREAGELRASVDPAA

SEQ ID NO: 3257 - protein, 20 aa, artificial
  peptide fold or domain or sub-domain
DTNAVDRKLVDFGQFLFATY

SEQ ID NO: 3258 - protein, 25 aa, artificial
  peptide fold or domain or sub-domain
DTNGFFHHEGNRPDSDTSQFGYRHK

SEQ ID NO: 3259 - protein, 28 aa, artificial
  peptide fold or domain or sub-domain
DTNIAYLHENNVTIWDEWADENGDLGPV

SEQ ID NO: 3260 - protein, 28 aa, artificial
  peptide fold or domain or sub-domain
DTPAQELMAQRYMRPSNEQVLAAHKDTL

SEQ ID NO: 3261 - protein, 24 aa, artificial
  peptide fold or domain or sub-domain
DTPYDRYVKGDKSAFTEQQARGMQ

SEQ ID NO: 3262 - protein, 29 aa, artificial
  peptide fold or domain or sub-domain
DTRVYCCGPTALVEEVLALTAHWRPSRVH

SEQ ID NO: 3263 - protein, 27 aa, artificial
  peptide fold or domain or sub-domain
DTSDELAGHLLRIRDPKKRLDALCEGN

SEQ ID NO: 3264 - protein, 24 aa, artificial
  peptide fold or domain or sub-domain
DTSFFSMTRTEVERADPQQRLMLE

SEQ ID NO: 3265 - protein, 28 aa, artificial
  peptide fold or domain or sub-domain
DTSLGPLQIYGGNDERIDNLTNPVGQDD

SEQ ID NO: 3266 - protein, 25 aa, artificial
  peptide fold or domain or sub-domain
DTTHATVDLPEGTVKVADKLPKEYL

SEQ ID NO: 3267 - protein, 25 aa, artificial
  peptide fold or domain or sub-domain
DTVANITRKYGGAQAAFREEPLMNW

SEQ ID NO: 3268 - protein, 24 aa, artificial
  peptide fold or domain or sub-domain
DTVCFDDKGQFKAKFTPGESCKPD

SEQ ID NO: 3269 - protein, 30 aa, artificial
  peptide fold or domain or sub-domain
DTVEISNLHRQIGHRESSKGISKAVSLSKT

SEQ ID NO: 3270 - protein, 29 aa, artificial
  peptide fold or domain or sub-domain
DTVSISGATKADRIHFKDGSSLKADLIVM

SEQ ID NO: 3271 - protein, 30 aa, artificial
  peptide fold or domain or sub-domain
DTVSLSNLQRQTLHSDATVGQPKVESARDA

SEQ ID NO: 3272 - protein, 27 aa, artificial
  peptide fold or domain or sub-domain
DTVTLDHADRGQAHAHLNTAGGLSVDL

SEQ ID NO: 3273 - protein, 27 aa, artificial
  peptide fold or domain or sub-domain
DTVVLDFDDRHRRRMAMTGTRGLSFLL

SEQ ID NO: 3274 - protein, 22 aa, artificial
  peptide fold or domain or sub-domain
DTWAVINNMDTNEKLIAAHPDM

SEQ ID NO: 3275 - protein, 28 aa, artificial
  peptide fold or domain or sub-domain
DTWNTVTTATYGGQTYEATSLVTGNYSY

SEQ ID NO: 3276 - protein, 29 aa, artificial
  peptide fold or domain or sub-domain
DTWWNVKKILHPKHESLDYIAMKLLGEGK

SEQ ID NO: 3277 - protein, 29 aa, artificial
  peptide fold or domain or sub-domain
DTYLCSRDLLKEVSYSLTQLAETQLKKER

SEQ ID NO: 3278 - protein, 24 aa, artificial
  peptide fold or domain or sub-domain
DTYQANRLKCRYRSGEKKTELCHT

SEQ ID NO: 3279 - protein, 20 aa, artificial
  peptide fold or domain or sub-domain
DVAATDIRAHLRACIARRAQ

SEQ ID NO: 3280 - protein, 27 aa, artificial
  peptide fold or domain or sub-domain
DVADKHEAYLGTLLREDDAHTRLCELN

SEQ ID NO: 3281 - protein, 21 aa, artificial
  peptide fold or domain or sub-domain
DVAFKSIKGFEFILQPKVFDA

SEQ ID NO: 3282 - protein, 20 aa, artificial
  peptide fold or domain or sub-domain
DVAGHYADARENARFPSRAE

SEQ ID NO: 3283 - protein, 27 aa, artificial
  peptide fold or domain or sub-domain
DVASKGVTTATSMSGESVAIDVDVRNA

SEQ ID NO: 3284 - protein, 25 aa, artificial
  peptide fold or domain or sub-domain
DVAVFIFGNNKKLYEYSSADMRELI

SEQ ID NO: 3285 - protein, 29 aa, artificial
  peptide fold or domain or sub-domain
DVAYICSESSSHEDYIRQFLQAGKHVLVE

SEQ ID NO: 3286 - protein, 29 aa, artificial
  peptide fold or domain or sub-domain
DVCDPCADPQQALEHEAVTLCTEPKAGAY

SEQ ID NO: 3287 - protein, 30 aa, artificial
  peptide fold or domain or sub-domain
DVCVKLANADLYYKAIKFYIREHPTEMTNL

SEQ ID NO: 3288 - protein, 22 aa, artificial
  peptide fold or domain or sub-domain
DVDDKIIRNAARDGKTVQEYTA

SEQ ID NO: 3289 - protein, 22 aa, artificial
  peptide fold or domain or sub-domain
DVDDKINTAAQEQGVPISAITE

SEQ ID NO: 3290 - protein, 22 aa, artificial
  peptide fold or domain or sub-domain
DVDDKLIGKSKERGIPMSQIAV

SEQ ID NO: 3291 - protein, 22 aa, artificial
  peptide fold or domain or sub-domain
DVDDKTLAGARKKGCSLEKYCQ

SEQ ID NO: 3292 - protein, 22 aa, artificial
  peptide fold or domain or sub-domain
DVDDPLFERAARDGIPWDELAR

SEQ ID NO: 3293 - protein, 23 aa, artificial
  peptide fold or domain or sub-domain
  misc_feature (14)..(14): Xaa can be any naturally occurring amino acid
DVDECRPCDHYCHXYLGGYYCSC

SEQ ID NO: 3294 - protein, 29 aa, artificial
  peptide fold or domain or sub-domain
DVDENIKNVQEIDEIVKNDILPERFQKIL

SEQ ID NO: 3295 - protein, 25 aa, artificial
  peptide fold or domain or sub-domain
DVDLLRLYCVKNFAWTRDATDQVLE

SEQ ID NO: 3296 - protein, 21 aa, artificial
  peptide fold or domain or sub-domain
DVEALSWLGKDLTPDVSGRPE

SEQ ID NO: 3297 - protein, 30 aa, artificial
  peptide fold or domain or sub-domain
DVEARAQRRCKQLIEKGISANLDDLLRDMR

SEQ ID NO: 3298 - protein, 27 aa, artificial
  peptide fold or domain or sub-domain
DVEDYIAALDQAGESARSKARRLASIH

SEQ ID NO: 3299 - protein, 25 aa, artificial
  peptide fold or domain or sub-domain
DVEELKKFLVEEKGFSEQRVTSQME

SEQ ID NO: 3300 - protein, 29 aa, artificial
  peptide fold or domain or sub-domain
DVEISAKELIRCKSYHLSELVQQILKTER

SEQ ID NO: 3301 - protein, 29 aa, artificial
  peptide fold or domain or sub-domain
DVEKALETFNSAEAPKEKEEAAEFLKYAQ

SEQ ID NO: 3302 - protein, 25 aa, artificial
  peptide fold or domain or sub-domain
DVESIREFTRKSFGWTTSKTDDILM

SEQ ID NO: 3303 - protein, 28 aa, artificial
  peptide fold or domain or sub-domain
DVEVELLTSGEPAATIAAVNGPEAVVVS

SEQ ID NO: 3304 - protein, 21 aa, artificial
  peptide fold or domain or sub-domain
DVEVLAVRTGGPGGQHRNKAS

SEQ ID NO: 3305 - protein, 30 aa, artificial
  peptide fold or domain or sub-domain
DVEYLFMSGANAYGLDKKSHMERINWIKTN

SEQ ID NO: 3306 - protein, 20 aa, artificial
  peptide fold or domain or sub-domain
DVFARFKTELLKDRAQFISD

SEQ ID NO: 3307 - protein, 21 aa, artificial
  peptide fold or domain or sub-domain
DVFNLLRNGDKQVSQELMDSV

SEQ ID NO: 3308 - protein, 28 aa, artificial
  peptide fold or domain or sub-domain
DVFRLRDEHRTERGTGVFGSRRGRSLPY

SEQ ID NO: 3309 - protein, 29 aa, artificial
  peptide fold or domain or sub-domain
DVFTKVVSQADSRGEFLSNEQLDALANVV

SEQ ID NO: 3310 - protein, 20 aa, artificial
  peptide fold or domain or sub-domain
DVFVNGTQVLKDGEHSGATP

SEQ ID NO: 3311 - protein, 30 aa, artificial
  peptide fold or domain or sub-domain
DVGDRVAIASPGYPCYRNILTALGCEVVEI

SEQ ID NO: 3312 - protein, 27 aa, artificial
  peptide fold or domain or sub-domain
DVGETCHSACDSCICALSYPPQCQCFD

SEQ ID NO: 3313 - protein, 28 aa, artificial
  peptide fold or domain or sub-domain
DVGIPGAYEDLEGVGYLSGHTVGELLNV

SEQ ID NO: 3314 - protein, 21 aa, artificial
  peptide fold or domain or sub-domain
DVIANGGTPEIGNLATPINSS

SEQ ID NO: 3315 - protein, 24 aa, artificial
  peptide fold or domain or sub-domain
DVIDVYPYKGEVRNHETGELLATF

SEQ ID NO: 3316 - protein, 27 aa, artificial
  peptide fold or domain or sub-domain
DVIEDNREELDAIEDPQLRRLKLAELN

SEQ ID NO: 3317 - protein, 28 aa, artificial
  peptide fold or domain or sub-domain
DVIEFKHLEIDNDAHRVLADNQEVNLTP

SEQ ID NO: 3318 - protein, 21 aa, artificial
  peptide fold or domain or sub-domain
DVIRDALKGSVFIPKDTGFIS

SEQ ID NO: 3319 - protein, 27 aa, artificial
  peptide fold or domain or sub-domain
DVITPSGGALTGYKGMGLKETIALDQV

SEQ ID NO: 3320 - protein, 27 aa, artificial
  peptide fold or domain or sub-domain
DVKEIERYVVTEQDIQDCNISYFHELY

SEQ ID NO: 3321 - protein, 26 aa, artificial
  peptide fold or domain or sub-domain
DVKPVKEDFYLALNAWQDTSKKKLFE

SEQ ID NO: 3322 - protein, 23 aa, artificial
  peptide fold or domain or sub-domain
DVKQTEWKSVLPNEVYRVARESG

SEQ ID NO: 3323 - protein, 26 aa, artificial
  peptide fold or domain or sub-domain
DVKREDGAYRLYSHCGRHKTERELEE

SEQ ID NO: 3324 - protein, 29 aa, artificial
  peptide fold or domain or sub-domain
DVKRNIADGEASQIENLKWLNIEANESPL

SEQ ID NO: 3325 - protein, 24 aa, artificial
  peptide fold or domain or sub-domain
DVKVKSLYKDKKYWNFIKKENFEQ

SEQ ID NO: 3326 - protein, 25 aa, artificial
  peptide fold or domain or sub-domain
DVLCLGPEDKRTNDYPYIPFDHKAI

SEQ ID NO: 3327 - protein, 30 aa, artificial
  peptide fold or domain or sub-domain
DVLDDAQVYGGHAGRRDVDVEDIKLAIQTR

SEQ ID NO: 3328 - protein, 27 aa, artificial
  peptide fold or domain or sub-domain
DVLDEQLAGLAKAHPSLTLHQDPVYVT

SEQ ID NO: 3329 - protein, 21 aa, artificial
  peptide fold or domain or sub-domain
DVLDRLREGSVSVNAELIAVL

SEQ ID NO: 3330 - protein, 30 aa, artificial
  peptide fold or domain or sub-domain
DVLEDALLFAKHTGRTHITTSDVKLALQTK

SEQ ID NO: 3331 - protein, 21 aa, artificial
  peptide fold or domain or sub-domain
DVLGVQDQASIPELNIYQCGS

SEQ ID NO: 3332 - protein, 25 aa, artificial
  peptide fold or domain or sub-domain
DVLKAKVEAAEVIDEEFGKSVFKEI

SEQ ID NO: 3333 - protein, 20 aa, artificial
  peptide fold or domain or sub-domain
DVLLCQSLFWPLLGNHCRYP

SEQ ID NO: 3334 - protein, 21 aa, artificial
  peptide fold or domain or sub-domain
DVLNRARKGEIKITPDIMDVV

SEQ ID NO: 3335 - protein, 21 aa, artificial
  peptide fold or domain or sub-domain
DVLSEFRDGELKVTENVVTVL

SEQ ID NO: 3336 - protein, 20 aa, artificial
  peptide fold or domain or sub-domain
DVLSHSQDGNNNAYCQDNKT

SEQ ID NO: 3337 - protein, 26 aa, artificial
  peptide fold or domain or sub-domain
DVMKKSNEYVPVSKNGSVKQSWTLRE

SEQ ID NO: 3338 - protein, 26 aa, artificial
  peptide fold or domain or sub-domain
DVNKTATGWAPATHGWLTESEFGLLE

SEQ ID NO: 3339 - protein, 21 aa, artificial
  peptide fold or domain or sub-domain
DVNVEKNTLAFDIYKSTKISE

SEQ ID NO: 3340 - protein, 29 aa, artificial
  peptide fold or domain or sub-domain
DVPDGYQVTQELARRQILVDYRPQAGIRV

SEQ ID NO: 3341 - protein, 20 aa, artificial
  peptide fold or domain or sub-domain
DVPDTGMCSIASLTDKDECL

SEQ ID NO: 3342 - protein, 28 aa, artificial
  peptide fold or domain or sub-domain
DVQQLISERWEGQLWVAALNGPHSTTVS

SEQ ID NO: 3343 - protein, 27 aa, artificial
  peptide fold or domain or sub-domain
DVRDLHETMLAAIEDPLQRINQLCELN

SEQ ID NO: 3344 - protein, 27 aa, artificial
  peptide fold or domain or sub-domain
DVRDYLLYLQARGLAVKTIQQHLGQLN

SEQ ID NO: 3345 - protein, 28 aa, artificial
  peptide fold or domain or sub-domain
DVRGFTQRTTKMSKEGKASQLVQQLNEY

SEQ ID NO: 3346 - protein, 27 aa, artificial
  peptide fold or domain or sub-domain
DVRILSEMIEGQGVVDPQTAARSARSL

SEQ ID NO: 3347 - protein, 27 aa, artificial
  peptide fold or domain or sub-domain
DVRIYLTELKQKSFSRTTVARKISSLR

SEQ ID NO: 3348 - protein, 27 aa, artificial
  peptide fold or domain or sub-domain
DVRLLHLLLASQSIHQYEDQVPLQLMD

SEQ ID NO: 3349 - protein, 26 aa, artificial
  peptide fold or domain or sub-domain
DVRQIGGQYRPALKGWTDMADTTLDD

SEQ ID NO: 3350 - protein, 30 aa, artificial
  peptide fold or domain or sub-domain
DVRRAEAAGYPDWRIMFEDVYSDMPDHLRQ

SEQ ID NO: 3351 - protein, 27 aa, artificial
  peptide fold or domain or sub-domain
DVRRHNQAELSRITDPKDSLNRLIEIN

SEQ ID NO: 3352 - protein, 27 aa, artificial
  peptide fold or domain or sub-domain
DVRRMNAKYLDKCKDGDEELNRLIELN

SEQ ID NO: 3353 - protein, 27 aa, artificial
  peptide fold or domain or sub-domain
DVRTKHAALIEEWPIGEVRHRRLVELN

SEQ ID NO: 3354 - protein, 26 aa, artificial
  peptide fold or domain or sub-domain
DVRVDTKVPLLAINGWQNNSTSSLWE

SEQ ID NO: 3355 - protein, 25 aa, artificial
  peptide fold or domain or sub-domain
DVSIIIFSAAGKAFEFSSKELDSEI

SEQ ID NO: 3356 - protein, 30 aa, artificial
  peptide fold or domain or sub-domain
DVSLVIAATRKSSTALDEIVARDSGRVVFI

SEQ ID NO: 3357 - protein, 22 aa, artificial
  peptide fold or domain or sub-domain
DVSMDAAYLAELRALMRRDRPA

SEQ ID NO: 3358 - protein, 22 aa, artificial
  peptide fold or domain or sub-domain
DVSMDIAYRKELQIAMGEKSVS

SEQ ID NO: 3359 - protein, 22 aa, artificial
  peptide fold or domain or sub-domain
DVSMDSGFKEELRELLKEKMVV

SEQ ID NO: 3360 - protein, 26 aa, artificial
  peptide fold or domain or sub-domain
DVSTLFLDDARQQFAGLPQIEYALLD

SEQ ID NO: 3361 - protein, 25 aa, artificial
  peptide fold or domain or sub-domain
DVTKYINFDYVKLCALLEEHPLSRM

SEQ ID NO: 3362 - protein, 30 aa, artificial
  peptide fold or domain or sub-domain
DVTLTGSGLKEAGLNNIGNGSTTIDKLDIL

SEQ ID NO: 3363 - protein, 25 aa, artificial
  peptide fold or domain or sub-domain
DVTNLTKLIKHNKSPTIEAFDTQNN

SEQ ID NO: 3364 - protein, 30 aa, artificial
  peptide fold or domain or sub-domain
DVTVIGENQLKLDSAEKLGADEVISIKREE

SEQ ID NO: 3365 - protein, 30 aa, artificial
  peptide fold or domain or sub-domain
DVVAITAREDRLFDYKRYLNGAQTGKTWSF

SEQ ID NO: 3366 - protein, 27 aa, artificial
  peptide fold or domain or sub-domain
DVVCMVDSQPGTGNSTLPDDCRVDIIV

SEQ ID NO: 3367 - protein, 30 aa, artificial
  peptide fold or domain or sub-domain
DVVDRSNLQRQIIHTTDEIGIPKVESARRK

SEQ ID NO: 3368 - protein, 30 aa, artificial
  peptide fold or domain or sub-domain
DVVEMSNLARQVLHGEALAGQAKAFSAAAS

SEQ ID NO: 3369 - protein, 30 aa, artificial
  peptide fold or domain or sub-domain
DVVETSNLHRQPAYGPASVGMAKVRELEKV

SEQ ID NO: 3370 - protein, 30 aa, artificial
  peptide fold or domain or sub-domain
DVVFVDLLENKLETARQFGATHIVNSGDLP

SEQ ID NO: 3371 - protein, 24 aa, artificial
  peptide fold or domain or sub-domain
DVVHSFYYSRDQLDRQNPHYVSRT

SEQ ID NO: 3372 - protein, 28 aa, artificial
  peptide fold or domain or sub-domain
DVVINEFLKDEDGLGFLNGKKLDYINKV

SEQ ID NO: 3373 - protein, 21 aa, artificial
  peptide fold or domain or sub-domain
DVYAGVNGQTYTIGKAFSHKF

SEQ ID NO: 3374 - protein, 28 aa, artificial
  peptide fold or domain or sub-domain
DVYIRFNSTLGYFVGYTEHGVYNAQLWK

SEQ ID NO: 3375 - protein, 27 aa, artificial
  peptide fold or domain or sub-domain
DVYRLHEAELDAIPEEEARYDRLVELN

SEQ ID NO: 3376 - protein, 24 aa, artificial
  peptide fold or domain or sub-domain
DVYTDEKLDMLSYQQSMAHINLSR

SEQ ID NO: 3377 - protein, 30 aa, artificial
  peptide fold or domain or sub-domain
DVYVIARNNKKEEEAKKLGVKKLYPSVESV

SEQ ID NO: 3378 - protein, 29 aa, artificial
  peptide fold or domain or sub-domain
DWDLPSRLEHALSQVGLPDISLERPAHSL

SEQ ID NO: 3379 - protein, 20 aa, artificial
  peptide fold or domain or sub-domain
DWERVKEGYALYGRTNSQVT

SEQ ID NO: 3380 - protein, 23 aa, artificial
  peptide fold or domain or sub-domain
DWFSEMRKKDPVYYDGNIWQVFS

SEQ ID NO: 3381 - protein, 29 aa, artificial
  peptide fold or domain or sub-domain
DWHAPNSSNNGHFSENPDFSNSWPIHCVA

SEQ ID NO: 3382 - protein, 29 aa, artificial
  peptide fold or domain or sub-domain
DWHIKPEGHFAPEGEEPDYKDTWPVHCVA

SEQ ID NO: 3383 - protein, 23 aa, artificial
  peptide fold or domain or sub-domain
DWKGSIKHNGRMLRTLMEDKQLD

SEQ ID NO: 3384 - protein, 24 aa, artificial
  peptide fold or domain or sub-domain
DWNGLGTSVMEVSHRGKEFIQVAE

SEQ ID NO: 3385 - protein, 25 aa, artificial
  peptide fold or domain or sub-domain
DWNTADWDQYRPDFAPETLDEIRRD

SEQ ID NO: 3386 - protein, 27 aa, artificial
  peptide fold or domain or sub-domain
DWNTLKYVLMNAGEPLNEVEAEQMMKE

SEQ ID NO: 3387 - protein, 24 aa, artificial
  peptide fold or domain or sub-domain
DWSANDSKWSQYPDIAKACDQGEP

SEQ ID NO: 3388 - protein, 24 aa, artificial
  peptide fold or domain or sub-domain
DWSDSSSMWDLLSPKEKILLLRKD

SEQ ID NO: 3389 - protein, 24 aa, artificial
  peptide fold or domain or sub-domain
DWSNESVLWQQNPQLANQLFQRNA

SEQ ID NO: 3390 - protein, 24 aa, artificial
  peptide fold or domain or sub-domain
DWSPMSKTWERVSQVERARLIRQL

SEQ ID NO: 3391 - protein, 28 aa, artificial
  peptide fold or domain or sub-domain
DWYKDSKGPGMTTMSKGGFYHSMRFTKP

SEQ ID NO: 3392 - protein, 20 aa, artificial
  peptide fold or domain or sub-domain
DYADIELNTSSEEANVADVA

SEQ ID NO: 3393 - protein, 24 aa, artificial
  peptide fold or domain or sub-domain
DYADKTISFEGGRKIWGNKKGEEQ

SEQ ID NO: 3394 - protein, 22 aa, artificial
  peptide fold or domain or sub-domain
DYAFVWEKNRIRYYVNGELVHE

SEQ ID NO: 3395 - protein, 23 aa, artificial
  peptide fold or domain or sub-domain
DYAYRAYKSGDPAGYVKKTLYEI

SEQ ID NO: 3396 - protein, 29 aa, artificial
  peptide fold or domain or sub-domain
DYCYFLKTLIDQKLPNTCKEFYEQQHHYF

SEQ ID NO: 3397 - protein, 28 aa, artificial
  peptide fold or domain or sub-domain
DYDAVYALWMSCIGMGLNTIDDSKEGIT

SEQ ID NO: 3398 - protein, 25 aa, artificial
  peptide fold or domain or sub-domain
DYDGITKYLVGERSFSEDRVAAALN

SEQ ID NO: 3399 - protein, 20 aa, artificial
  peptide fold or domain or sub-domain
DYEDALKWKKEPATPGWKRG

SEQ ID NO: 3400 - protein, 27 aa, artificial
  peptide fold or domain or sub-domain
DYEEFITATMHMNRMDREEHLYTAFQY

SEQ ID NO: 3401 - protein, 24 aa, artificial
  peptide fold or domain or sub-domain
DYELAPLCTFTVFRNRVLKATMGQ

SEQ ID NO: 3402 - protein, 23 aa, artificial
  peptide fold or domain or sub-domain
DYFAQLYYADDILEYVQGHILEL

SEQ ID NO: 3403 - protein, 23 aa, artificial
  peptide fold or domain or sub-domain
DYFLRLYISKDKKKFFKENIIDL

SEQ ID NO: 3404 - protein, 24 aa, artificial
  peptide fold or domain or sub-domain
DYFNKNLTRSKGRRLGRERCVFDP

SEQ ID NO: 3405 - protein, 26 aa, artificial
  peptide fold or domain or sub-domain
DYFSQLSNNAKEAVEHLQKSELTQQL

SEQ ID NO: 3406 - protein, 26 aa, artificial
  peptide fold or domain or sub-domain
DYFVKASQTAQGALKTFGESELAQQL

SEQ ID NO: 3407 - protein, 26 aa, artificial
  peptide fold or domain or sub-domain
DYGPLVFDQKWFQKDFDKASLTADVW

SEQ ID NO: 3408 - protein, 22 aa, artificial
  peptide fold or domain or sub-domain
DYGTPILIQSEKEGKTPEEYVE

SEQ ID NO: 3409 - protein, 20 aa, artificial
  peptide fold or domain or sub-domain
DYGYPKEAAGRIPKYFGQER

SEQ ID NO: 3410 - protein, 26 aa, artificial
  peptide fold or domain or sub-domain
DYKIEEGSFIVYTNQGKKRLDRPLNE

SEQ ID NO: 3411 - protein, 26 aa, artificial
  peptide fold or domain or sub-domain
DYKIINEKLIIFNNFGQDNTNIELID

SEQ ID NO: 3412 - protein, 28 aa, artificial
  peptide fold or domain or sub-domain
DYKKINNYLRGVNDSLDGIDPKIIEDIK

SEQ ID NO: 3413 - protein, 28 aa, artificial
  peptide fold or domain or sub-domain
DYKTMSDIIESVKQMDAEKFKGVIAGYA

SEQ ID NO: 3414 - protein, 27 aa, artificial
  peptide fold or domain or sub-domain
DYLEIEWFESTKRIQRKKSKNGQEVAI

SEQ ID NO: 3415 - protein, 29 aa, artificial
  peptide fold or domain or sub-domain
DYLHDLGAISMMSSDSQAMGRVGETGIRT

SEQ ID NO: 3416 - protein, 22 aa, artificial
  peptide fold or domain or sub-domain
DYLNHPEFCPHGGVIPEDNQPI

SEQ ID NO: 3417 - protein, 26 aa, artificial
  peptide fold or domain or sub-domain
DYLRWVQTLSEQVQEELLSSQVTQEL

SEQ ID NO: 3418 - protein, 29 aa, artificial
  peptide fold or domain or sub-domain
DYLSTWHQLAAAVGGGGAVAFERAHGAPM

SEQ ID NO: 3419 - protein, 29 aa, artificial
  peptide fold or domain or sub-domain
DYLTKASEVKDPVYKHTLTYHLAEYMVEH

SEQ ID NO: 3420 - protein, 28 aa, artificial
  peptide fold or domain or sub-domain
DYPLVYGLWTRCTGFTMRDIDDSEDAIK

SEQ ID NO: 3421 - protein, 30 aa, artificial
  peptide fold or domain or sub-domain
DYQLEYEGRLYHFGSEADRWCFQIDPERYK

SEQ ID NO: 3422 - protein, 21 aa, artificial
  peptide fold or domain or sub-domain
DYQLIEQDGPANERSYEIAVL

SEQ ID NO: 3423 - protein, 24 aa, artificial
  peptide fold or domain or sub-domain
DYQLQPAGLTTARLRSSPSGIAWC

SEQ ID NO: 3424 - protein, 29 aa, artificial
  peptide fold or domain or sub-domain
DYRFIRENVDAVKENVKVRNVHADVDAIV

SEQ ID NO: 3425 - protein, 24 aa, artificial
  peptide fold or domain or sub-domain
DYRLQQVDGDLDLLAKLKKDGSAS

SEQ ID NO: 3426 - protein, 27 aa, artificial
  peptide fold or domain or sub-domain
DYRSCILRPGGSEDASAMLRRFLGRDP

SEQ ID NO: 3427 - protein, 23 aa, artificial
  peptide fold or domain or sub-domain
DYVIRFFKSHGKIKFIFNNKIDL

SEQ ID NO: 3428 - protein, 24 aa, artificial
  peptide fold or domain or sub-domain
DYVMYMYCPALWDGGAHNLHTDVY

SEQ ID NO: 3429 - protein, 26 aa, artificial
  peptide fold or domain or sub-domain
DYVSQLQSSTKDTVVQIQQSDISKQL

SEQ ID NO: 3430 - protein, 28 aa, artificial
  peptide fold or domain or sub-domain
DYYAMMAMAERGISFDGADQGLINMHFR

SEQ ID NO: 3431 - protein, 29 aa, artificial
  peptide fold or domain or sub-domain
EAAGATARLTGFQVEGAGATVSVDLRGEA

SEQ ID NO: 3432 - protein, 23 aa, artificial
  peptide fold or domain or sub-domain
EAAKWLTMRRWLEANPDDDFAAE

SEQ ID NO: 3433 - protein, 28 aa, artificial
  peptide fold or domain or sub-domain
EAAQEALVGYEDKLSAAVSNSPRATVLS

SEQ ID NO: 3434 - protein, 22 aa, artificial
  peptide fold or domain or sub-domain
EAARLATSEAVLSPSIHASILS

SEQ ID NO: 3435 - protein, 30 aa, artificial
  peptide fold or domain or sub-domain
EAAVLKERIFYYGRRYKQLEGKEEQQIESE

SEQ ID NO: 3436 - protein, 27 aa, artificial
  peptide fold or domain or sub-domain
EAAWLLLQCAEVLEEENLIANYKKHAV

SEQ ID NO: 3437 - protein, 20 aa, artificial
  peptide fold or domain or sub-domain
EACIYRLGFIQNFHMDSRDF

SEQ ID NO: 3438 - protein, 25 aa, artificial
  peptide fold or domain or sub-domain
EACKNINCDFEATCELGPDDYPRCS

SEQ ID NO: 3439 - protein, 28 aa, artificial
  peptide fold or domain or sub-domain
EACYNHSKYVQEWYGRNSSLTIKDLMQH

SEQ ID NO: 3440 - protein, 26 aa, artificial
  peptide fold or domain or sub-domain
EADGIITELGLPTICGEWSLGLDLKV

SEQ ID NO: 3441 - protein, 20 aa, artificial
  peptide fold or domain or sub-domain
EADGYRFNPRFRYGNWDGRI

SEQ ID NO: 3442 - protein, 27 aa, artificial
  peptide fold or domain or sub-domain
EADLVLANGTMVTISEHTHPDLLWAIR

SEQ ID NO: 3443 - protein, 26 aa, artificial
  peptide fold or domain or sub-domain
EADQVIENLQRNELTPREIADFIGRE

SEQ ID NO: 3444 - protein, 22 aa, artificial
  peptide fold or domain or sub-domain
EADSVSLRHAALSEAYAILSEC

SEQ ID NO: 3445 - protein, 22 aa, artificial
  peptide fold or domain or sub-domain
EAEADGDAEPLLRKYYADLVLS

SEQ ID NO: 3446 - protein, 22 aa, artificial
  peptide fold or domain or sub-domain
EAEDIVHREPELATFIYSTVLH

SEQ ID NO: 3447 - protein, 22 aa, artificial
  peptide fold or domain or sub-domain
EAEEALAGAPMLRRLFIDNILE

SEQ ID NO: 3448 - protein, 26 aa, artificial
  peptide fold or domain or sub-domain
EAEEHARDVEAQQSDRDAEVADLREQ

SEQ ID NO: 3449 - protein, 29 aa, artificial
  peptide fold or domain or sub-domain
EAEGADLRLTDVMLSDDSTVMRIATDEGG

SEQ ID NO: 3450 - protein, 27 aa, artificial
  peptide fold or domain or sub-domain
EAEHVWNITQELDVNVRTAAYIHALNR

SEQ ID NO: 3451 - protein, 22 aa, artificial
  peptide fold or domain or sub-domain
EAEIVVRSEPFLAPVLQNAVLR

SEQ ID NO: 3452 - protein, 25 aa, artificial
  peptide fold or domain or sub-domain
EAEKLLANFADKLTDELKKRLEAAL

SEQ ID NO: 3453 - protein, 22 aa, artificial
  peptide fold or domain or sub-domain
EAEKQCEVNPWLAKDLARKILS

SEQ ID NO: 3454 - protein, 24 aa, artificial
  peptide fold or domain or sub-domain
EAELKRIVEVEGKMSREAATEYMN

SEQ ID NO: 3455 - protein, 24 aa, artificial
  peptide fold or domain or sub-domain
EAELQLNGQPRQSKRGGIWYDTVN

SEQ ID NO: 3456 - protein, 28 aa, artificial
  peptide fold or domain or sub-domain
EAESLQKLLEAVEESNEEKFEDAVSLLQ

SEQ ID NO: 3457 - protein, 28 aa, artificial
  peptide fold or domain or sub-domain
EAESLRETIRSGKGQKKARALKRLKVVS

SEQ ID NO: 3458 - protein, 27 aa, artificial
  peptide fold or domain or sub-domain
EAETQRQADIMLPALRSRVTVHQLLEA

SEQ ID NO: 3459 - protein, 28 aa, artificial
  peptide fold or domain or sub-domain
EAEVVTLLDEQPAVSLAAVNGPSSVVLA

SEQ ID NO: 3460 - protein, 29 aa, artificial
  peptide fold or domain or sub-domain
EAFDVIHRLLAGETVTQKTDWFTCQDAYL

SEQ ID NO: 3461 - protein, 25 aa, artificial
  peptide fold or domain or sub-domain
EAFKGYLKDKSEITEDDVREWMKKA

SEQ ID NO: 3462 - protein, 30 aa, artificial
  peptide fold or domain or sub-domain
EAFLEQIPVTKFYGVGKVTAEKLHRLGIET

SEQ ID NO: 3463 - protein, 21 aa, artificial
  peptide fold or domain or sub-domain
EAFVKLYYDHVDKKRQHMSRL

SEQ ID NO: 3464 - protein, 29 aa, artificial
  peptide fold or domain or sub-domain
EAGDTSDLRATNLGHVIRGGSPTARDRVL

SEQ ID NO: 3465 - protein, 27 aa, artificial
  peptide fold or domain or sub-domain
EAGEAIELYWAHYEAPMDARPFSSLLI

SEQ ID NO: 3466 - protein, 27 aa, artificial
  peptide fold or domain or sub-domain
EAGWFLLRHSSRSGDAKLRAHVIDTFL

SEQ ID NO: 3467 - protein, 28 aa, artificial
  peptide fold or domain or sub-domain
EAHWQYWLGRALAQRGDRQAAEDAWRLA

SEQ ID NO: 3468 - protein, 25 aa, artificial
  peptide fold or domain or sub-domain
EAIEILGEDPRVQAELETLGVPPSW

SEQ ID NO: 3469 - protein, 29 aa, artificial
  peptide fold or domain or sub-domain
EAILNVTLEKGYARTKDVACELDISPSTV

SEQ ID NO: 3470 - protein, 23 aa, artificial
  peptide fold or domain or sub-domain
EAISEIQRGCAEIIDEPRVEKLL

SEQ ID NO: 3471 - protein, 22 aa, artificial
  peptide fold or domain or sub-domain
EAKELAENEPMLASFFHSTILK

SEQ ID NO: 3472 - protein, 27 aa, artificial
  peptide fold or domain or sub-domain
EAKETTMKIVKPETSEKDLYTVAEQIS

SEQ ID NO: 3473 - protein, 26 aa, artificial
  peptide fold or domain or sub-domain
EAKIVQLEEQIEQEAREKQAATKLLK

SEQ ID NO: 3474 - protein, 23 aa, artificial
  peptide fold or domain or sub-domain
EAKKADGMGTFLISTLKTMWLYA

SEQ ID NO: 3475 - protein, 22 aa, artificial
  peptide fold or domain or sub-domain
EAKSDIAKEPIVSAYYHASIVS

SEQ ID NO: 3476 - protein, 29 aa, artificial
  peptide fold or domain or sub-domain
EALALIQKLLYETDVSFNGQYYQCDRLTV

SEQ ID NO: 3477 - protein, 29 aa, artificial
  peptide fold or domain or sub-domain
EALDIILKLMSGESVSVNGKYFKYENIKI

SEQ ID NO: 3478 - protein, 25 aa, artificial
  peptide fold or domain or sub-domain
EALDNSMLLSKLRGSKPTFSNISKQ

SEQ ID NO: 3479 - protein, 29 aa, artificial
  peptide fold or domain or sub-domain
EALLGLVDIKSSDGRTSILDSVVQKITES

SEQ ID NO: 3480 - protein, 21 aa, artificial
  peptide fold or domain or sub-domain
EALNLLKNLKENVSEQYIKDI

SEQ ID NO: 3481 - protein, 23 aa, artificial
  peptide fold or domain or sub-domain
EALSSSEIPKSLNFADLVAAKQE

SEQ ID NO: 3482 - protein, 22 aa, artificial
  peptide fold or domain or sub-domain
EAMMGALRGAGASHRTASWGSF

SEQ ID NO: 3483 - protein, 23 aa, artificial
  peptide fold or domain or sub-domain
EAMREIARGVNEIIGIEYIQSLV

SEQ ID NO: 3484 - protein, 27 aa, artificial
  peptide fold or domain or sub-domain
EAMWFIMDLGKRLDRPELIQQAMLTTL

SEQ ID NO: 3485 - protein, 29 aa, artificial
  peptide fold or domain or sub-domain
EANRIIQKLLYEEEVYFQGEFFEINNVSI

SEQ ID NO: 3486 - protein, 22 aa, artificial
  peptide fold or domain or sub-domain
EANWCGPDAGNNRLKWRGPCHE

SEQ ID NO: 3487 - protein, 24 aa, artificial
  peptide fold or domain or sub-domain
EAPFDRWALGDESAIGADAKRGFA

SEQ ID NO: 3488 - protein, 28 aa, artificial
  peptide fold or domain or sub-domain
EAPLSNAYPDINELSYLDGKSFSQLLKA

SEQ ID NO: 3489 - protein, 27 aa, artificial
  peptide fold or domain or sub-domain
EAPLVMGNTAVGPGMKFNNEFHPVFIS

SEQ ID NO: 3490 - protein, 23 aa, artificial
  peptide fold or domain or sub-domain
EAPRDGQAYVRKDGEWVLLSTFL

SEQ ID NO: 3491 - protein, 22 aa, artificial
  peptide fold or domain or sub-domain
EAPVLIVCLATPYESKFREKIF

SEQ ID NO: 3492 - protein, 27 aa, artificial
  peptide fold or domain or sub-domain
EAPVLVALACRALKDDQRRLLTEQKLL

SEQ ID NO: 3493 - protein, 28 aa, artificial
  peptide fold or domain or sub-domain
EAQAEVRRVYDSKGYVDETELHQLIYLK

SEQ ID NO: 3494 - protein, 22 aa, artificial
  peptide fold or domain or sub-domain
EAQRAADADPVFGKALAGTILA

SEQ ID NO: 3495 - protein, 25 aa, artificial
  peptide fold or domain or sub-domain
EAQRKLQEDSELAKSEKASQIQSTI

SEQ ID NO: 3496 - protein, 22 aa, artificial
  peptide fold or domain or sub-domain
EAQRSGRLPADQKVTWRKDSAL

SEQ ID NO: 3497 - protein, 23 aa, artificial
  peptide fold or domain or sub-domain
EARDHLRSLLSNSNNQVKVNAIT

SEQ ID NO: 3498 - protein, 27 aa, artificial
  peptide fold or domain or sub-domain
EARFVVGGTDLSLEVTKRFTEPPLLVS

SEQ ID NO: 3499 - protein, 29 aa, artificial
  peptide fold or domain or sub-domain
EARKKVKLLIKNEKNNITKMVLNGRQLAL

SEQ ID NO: 3500 - protein, 22 aa, artificial
  peptide fold or domain or sub-domain
EARRAPQEDSVLGPLIDRSILC

SEQ ID NO: 3501 - protein, 29 aa, artificial
  peptide fold or domain or sub-domain
EARTYSQKWLAVYDEPIPVEVLVQYISDV

SEQ ID NO: 3502 - protein, 29 aa, artificial
  peptide fold or domain or sub-domain
EARVESVTYGEAAAEVELETTQGRRRLAA

SEQ ID NO: 3503 - protein, 20 aa, artificial
  peptide fold or domain or sub-domain
EARVLLMTVDMVNGQPQRRY

SEQ ID NO: 3504 - protein, 24 aa, artificial
  peptide fold or domain or sub-domain
EARYRRAMARLREAAGEAYLLFCG

SEQ ID NO: 3505 - protein, 22 aa, artificial
  peptide fold or domain or sub-domain
EASAECRRDPDISMFLEQHILQ

SEQ ID NO: 3506 - protein, 22 aa, artificial
  peptide fold or domain or sub-domain
EASALILAEPLMGGMVHSSILH

SEQ ID NO: 3507 - protein, 29 aa, artificial
  peptide fold or domain or sub-domain
EASEILINALKGGTLSYQGRHFELNSVPL

SEQ ID NO: 3508 - protein, 22 aa, artificial
  peptide fold or domain or sub-domain
EASELLEGIFKDCSENPAEGIA

SEQ ID NO: 3509 - protein, 27 aa, artificial
  peptide fold or domain or sub-domain
EASGVGNPRVLQPLGINVTVNLPGVGE

SEQ ID NO: 3510 - protein, 20 aa, artificial
  peptide fold or domain or sub-domain
EASLENIAKDFNVSVNEIKA

SEQ ID NO: 3511 - protein, 30 aa, artificial
  peptide fold or domain or sub-domain
EATGYNRNFAKAEEWSDRLGDEGLVAPIES

SEQ ID NO: 3512 - protein, 24 aa, artificial
  peptide fold or domain or sub-domain
EATLMKSYADVHQVSEADARLWLQ

SEQ ID NO: 3513 - protein, 20 aa, artificial
  peptide fold or domain or sub-domain
EATREEDFFVDGKTSVKVDM

SEQ ID NO: 3514 - protein, 20 aa, artificial
  peptide fold or domain or sub-domain
EATSKAPFTLITNEQIKVNM

SEQ ID NO: 3515 - protein, 20 aa, artificial
  peptide fold or domain or sub-domain
EATTNAPFRLNKKDRKTVKM

SEQ ID NO: 3516 - protein, 29 aa, artificial
  peptide fold or domain or sub-domain
EAVAAIFPMFRDAGSEHHGKYFDIPLRNV

SEQ ID NO: 3517 - protein, 20 aa, artificial
  peptide fold or domain or sub-domain
EAVAAMAGWYDQPPPGRARG

SEQ ID NO: 3518 - protein, 28 aa, artificial
  peptide fold or domain or sub-domain
EAVAQAVRFAESKACDLSELSLADLRQF

SEQ ID NO: 3519 - protein, 30 aa, artificial
  peptide fold or domain or sub-domain
EAVEGCPVSSPNVEMIPDWATVLSTNVIRK

SEQ ID NO: 3520 - protein, 27 aa, artificial
  peptide fold or domain or sub-domain
EAVFARKLMENGFAEEEANQLGTLINS

SEQ ID NO: 3521 - protein, 24 aa, artificial
  peptide fold or domain or sub-domain
EAVFVYQNGMEQVGEQLVDFKGRA

SEQ ID NO: 3522 - protein, 27 aa, artificial
  peptide fold or domain or sub-domain
EAVILNGGSDLVVRMKENLAAPKAVID

SEQ ID NO: 3523 - protein, 24 aa, artificial
  peptide fold or domain or sub-domain
EAVLFYRDQEEQKEGQMPGYSQRT

SEQ ID NO: 3524 - protein, 27 aa, artificial
  peptide fold or domain or sub-domain
EAVVPALHPESRIRAEEQGVTRSVAAF

SEQ ID NO: 3525 - protein, 29 aa, artificial
  peptide fold or domain or sub-domain
EAVYELSEKGSGARLSDIAERLSVTKAST

SEQ ID NO: 3526 - protein, 27 aa, artificial
  peptide fold or domain or sub-domain
EAWRARLQDFAHGYGASGLAIAAAASA

SEQ ID NO: 3527 - protein, 23 aa, artificial
  peptide fold or domain or sub-domain
EAYFVPLVKRLASGDWFTSRTSA

SEQ ID NO: 3528 - protein, 23 aa, artificial
  peptide fold or domain or sub-domain
EAYLDFNKSKELIIEKYTNRIVH

SEQ ID NO: 3529 - protein, 22 aa, artificial
  peptide fold or domain or sub-domain
ECDTDYYKKKLGDLGWECSRCK

SEQ ID NO: 3530 - protein, 28 aa, artificial
  peptide fold or domain or sub-domain
ECEFMTQASEALENNDLEAFAEATAKLK

SEQ ID NO: 3531 - protein, 28 aa, artificial
  peptide fold or domain or sub-domain
ECERALGHIAALEGHFEQAVDYHRHALD

SEQ ID NO: 3532 - protein, 20 aa, artificial
  peptide fold or domain or sub-domain
ECGVKEAVENGEIAESRYEN

SEQ ID NO: 3533 - protein, 28 aa, artificial
  peptide fold or domain or sub-domain
ECKFIEKILAACETKNIETFTSAIEEYD

SEQ ID NO: 3534 - protein, 28 aa, artificial
  peptide fold or domain or sub-domain
ECKFLADLASAIDEEDIAKFTDVSKEID

SEQ ID NO: 3535 - protein, 28 aa, artificial
  peptide fold or domain or sub-domain
ECKFVKELLAAIDEKKEETFTECVANFD

SEQ ID NO: 3536 - protein, 29 aa, artificial
  peptide fold or domain or sub-domain
ECLERAIEIYDQVNELEKRKEFVENIDRV

SEQ ID NO: 3537 - protein, 28 aa, artificial
  peptide fold or domain or sub-domain
ECLKESDACTASDPGRTSPKPIRWEYRD

SEQ ID NO: 3538 - protein, 22 aa, artificial
  peptide fold or domain or sub-domain
ECMPCQEGCKTCTSNGVCSECL

SEQ ID NO: 3539 - protein, 26 aa, artificial
  peptide fold or domain or sub-domain
ECNDRIKEMIKRGASPYQYYDSWDQL

SEQ ID NO: 3540 - protein, 22 aa, artificial
  peptide fold or domain or sub-domain
ECQQAGPLPEWNRVEWRGDATM

SEQ ID NO: 3541 - protein, 27 aa, artificial
  peptide fold or domain or sub-domain
ECRCYISDPRVVRAAQTQGITRSMAAV

SEQ ID NO: 3542 - protein, 28 aa, artificial
  peptide fold or domain or sub-domain
ECRLLDGIIQACRNNNVEDFTNEVAEFN

SEQ ID NO: 3543 - protein, 29 aa, artificial
  peptide fold or domain or sub-domain
ECRRDVKALMKTERNESKRKQMDIRQMAL

SEQ ID NO: 3544 - protein, 28 aa, artificial
  peptide fold or domain or sub-domain
ECRRYLRQIYANYPELLKLLVPVLGLSN

SEQ ID NO: 3545 - protein, 21 aa, artificial
  peptide fold or domain or sub-domain
ECVLKKDSKVYEAYKEEHIQE

SEQ ID NO: 3546 - protein, 29 aa, artificial
  peptide fold or domain or sub-domain
ECYEIINDALTTGYCNPDNDFYSFPKISV

SEQ ID NO: 3547 - protein, 28 aa, artificial
  peptide fold or domain or sub-domain
EDAGKELTGYEGRLFRAIEHSADSTVLA

SEQ ID NO: 3548 - protein, 26 aa, artificial
  peptide fold or domain or sub-domain
EDAKLRLEVNMQAMKAQFERDLQARE

SEQ ID NO: 3549 - protein, 28 aa, artificial
  peptide fold or domain or sub-domain
EDAQRELARYSDRLSVGAINDARSVVLS

SEQ ID NO: 3550 - protein, 29 aa, artificial
  peptide fold or domain or sub-domain
EDARVTILGHVQRGGRPSAYDRWASTWLG

SEQ ID NO: 3551 - protein, 30 aa, artificial
  peptide fold or domain or sub-domain
EDAVESYDRAIALNPYSATAYSNRGVALLK

SEQ ID NO: 3552 - protein, 29 aa, artificial
  peptide fold or domain or sub-domain
EDDFFTATTNYLMTKNAKGLADGLNAFFN

SEQ ID NO: 3553 - protein, 24 aa, artificial
  peptide fold or domain or sub-domain
EDDIEYAKTIFDLKNEEFSFGQNI

SEQ ID NO: 3554 - protein, 21 aa, artificial
  peptide fold or domain or sub-domain
EDEFEGTQVDESKWTKRYRTH

SEQ ID NO: 3555 - protein, 21 aa, artificial
  peptide fold or domain or sub-domain
EDEFNQADINTKYWKVGDNFL

SEQ ID NO: 3556 - protein, 29 aa, artificial
  peptide fold or domain or sub-domain
EDEFWNITVEMVKNPNSAELVKKLNAFFD

SEQ ID NO: 3557 - protein, 24 aa, artificial
  peptide fold or domain or sub-domain
EDEIILTKEYYEWEHEPFHVPDEV

SEQ ID NO: 3558 - protein, 29 aa, artificial
  peptide fold or domain or sub-domain
EDELLEYLNSYSSYTSLYGLIASLKRYKW

SEQ ID NO: 3559 - protein, 26 aa, artificial
  peptide fold or domain or sub-domain
EDELQATEDAKLRLEVNMQAMKAQFD

SEQ ID NO: 3560 - protein, 23 aa, artificial
  peptide fold or domain or sub-domain
EDEWNKHGKCSEQTLNQMQYFER

SEQ ID NO: 3561 - protein, 30 aa, artificial
  peptide fold or domain or sub-domain
EDFAMAVSVSKEVKSKGFKISDKINEIKKK

SEQ ID NO: 3562 - protein, 28 aa, artificial
  peptide fold or domain or sub-domain
EDFISLDLKSLTWIARTRQALTTKNKWD

SEQ ID NO: 3563 - protein, 28 aa, artificial
  peptide fold or domain or sub-domain
EDFLILDFKVWRWITPVQQAMITTQKWN

SEQ ID NO: 3564 - protein, 28 aa, artificial
  peptide fold or domain or sub-domain
EDFRDVAKQNGGSTGVKDFMDGMGLGMI

SEQ ID NO: 3565 - protein, 27 aa, artificial
  peptide fold or domain or sub-domain
EDFRLVESLREGSERAYEELLTRFQQP

SEQ ID NO: 3566 - protein, 26 aa, artificial
  peptide fold or domain or sub-domain
EDFTSQNSADRERTERETQLSRSLMQ

SEQ ID NO: 3567 - protein, 29 aa, artificial
  peptide fold or domain or sub-domain
EDGKLIPLTNYGVESMSMGYLIKPENAVV

SEQ ID NO: 3568 - protein, 27 aa, artificial
  peptide fold or domain or sub-domain
EDGSDLSILSEKGSYGWFKRDNGEVVR

SEQ ID NO: 3569 - protein, 25 aa, artificial
  peptide fold or domain or sub-domain
EDGTGIYHWTPSITDHNDPVQEKTW

SEQ ID NO: 3570 - protein, 29 aa, artificial
  peptide fold or domain or sub-domain
EDHFLLQGQMIYRRDGRITDDKNVLAGSL

SEQ ID NO: 3571 - protein, 25 aa, artificial
  peptide fold or domain or sub-domain
EDIDYSLYGETQKVALADFAKKPFG

SEQ ID NO: 3572 - protein, 21 aa, artificial
  peptide fold or domain or sub-domain
EDIGLLDLRLADRLGFRIKLI

SEQ ID NO: 3573 - protein, 22 aa, artificial
  peptide fold or domain or sub-domain
EDIKMLEKFFKEPIPRPFNSAE

SEQ ID NO: 3574 - protein, 29 aa, artificial
  peptide fold or domain or sub-domain
EDKCNAALYPIFTATGEAQRKAVHEAQQC

SEQ ID NO: 3575 - protein, 29 aa, artificial
  peptide fold or domain or sub-domain
EDKIAFSLSRLESTRSFNDFVKVFAVFGG

SEQ ID NO: 3576 - protein, 22 aa, artificial
  peptide fold or domain or sub-domain
EDKLVEDLKTRQTQEQKRNRVR

SEQ ID NO: 3577 - protein, 24 aa, artificial
  peptide fold or domain or sub-domain
EDKSERERWQHLADLADFALAMKD

SEQ ID NO: 3578 - protein, 20 aa, artificial
  peptide fold or domain or sub-domain
EDLDSERAARNKAEKIKRDL

SEQ ID NO: 3579 - protein, 27 aa, artificial
  peptide fold or domain or sub-domain
EDLEQILEEILDETYDKKAKEDARRYI

SEQ ID NO: 3580 - protein, 24 aa, artificial
  peptide fold or domain or sub-domain
EDLGAACGFREVSPEGAGPLEGEG

SEQ ID NO: 3581 - protein, 20 aa, artificial
  peptide fold or domain or sub-domain
EDLGNKSDLLLRSNPVHRKI

SEQ ID NO: 3582 - protein, 22 aa, artificial
  peptide fold or domain or sub-domain
EDLLGEVERKVEHDWSFKVKDH

SEQ ID NO: 3583 - protein, 22 aa, artificial
  peptide fold or domain or sub-domain
EDLLVFFRDVLLYQKAPNLEET

SEQ ID NO: 3584 - protein, 27 aa, artificial
  peptide fold or domain or sub-domain
EDLVLYQSFDRQKVAAWLEEENLATVL

SEQ ID NO: 3585 - protein, 22 aa, artificial
  peptide fold or domain or sub-domain
EDMVKQLEQSIFKTYGFAADFK

SEQ ID NO: 3586 - protein, 20 aa, artificial
  peptide fold or domain or sub-domain
EDNCKDSLQFTDTEYRKRRD

SEQ ID NO: 3587 - protein, 25 aa, artificial
  peptide fold or domain or sub-domain
EDNCKDSLQFTDTEYRKRRDYIAQV

SEQ ID NO: 3588 - protein, 28 aa, artificial
  peptide fold or domain or sub-domain
EDNKQIALANNQTAELTEIEDILQQKID

SEQ ID NO: 3589 - protein, 29 aa, artificial
  peptide fold or domain or sub-domain
EDPRADVHLMISSMNMSEISIKGSIGGEA

SEQ ID NO: 3590 - protein, 24 aa, artificial
  peptide fold or domain or sub-domain
EDQRLIKLVQKYGPKRWSVIAKHL

SEQ ID NO: 3591 - protein, 25 aa, artificial
  peptide fold or domain or sub-domain
EDQTQDTELVETRPAGDGTFQKWAA

SEQ ID NO: 3592 - protein, 28 aa, artificial
  peptide fold or domain or sub-domain
EDRDGERTPMQWTAGRNADFSQGENTWL

SEQ ID NO: 3593 - protein, 28 aa, artificial
  peptide fold or domain or sub-domain
EDRWRYWLARSLEVQGQQKPARDLYLET

SEQ ID NO: 3594 - protein, 25 aa, artificial
  peptide fold or domain or sub-domain
EDSCRACHGEKPVDKRPALDTAAHT

SEQ ID NO: 3595 - protein, 30 aa, artificial
  peptide fold or domain or sub-domain
EDSGAVATANYEARKFGVKAGIPIVEAKKI

SEQ ID NO: 3596 - protein, 22 aa, artificial
  peptide fold or domain or sub-domain
EDSLKILLRAGFPAGDALSSVL

SEQ ID NO: 3597 - protein, 20 aa, artificial
  peptide fold or domain or sub-domain
EDTQLINFTKKNGSTVKIPM

SEQ ID NO: 3598 - protein, 20 aa, artificial
  peptide fold or domain or sub-domain
EDTRQRPFRINTHTTKPVPI

SEQ ID NO: 3599 - protein, 27 aa, artificial
  peptide fold or domain or sub-domain
EDVESLSVTTAPFTVQTSERKVKCHSI

SEQ ID NO: 3600 - protein, 24 aa, artificial
  peptide fold or domain or sub-domain
EDVLTHTRGLVARGKQAHERWQLE

SEQ ID NO: 3601 - protein, 25 aa, artificial
  peptide fold or domain or sub-domain
EDVQVENIYKSLTNLSQEEQITKLL

SEQ ID NO: 3602 - protein, 26 aa, artificial
  peptide fold or domain or sub-domain
EDVSGLLELAVEADDEETFNEAVAEL

SEQ ID NO: 3603 - protein, 28 aa, artificial
  peptide fold or domain or sub-domain
EEAFKDIARAQGIDWTGLRDRMRDEGRY

SEQ ID NO: 3604 - protein, 26 aa, artificial
  peptide fold or domain or sub-domain
EEAGGATSVQIEMNKKREAEFQKMRR

SEQ ID NO: 3605 - protein, 24 aa, artificial
  peptide fold or domain or sub-domain
EEAIAYGRKLGGSQEDQIKNAIDK

SEQ ID NO: 3606 - protein, 26 aa, artificial
  peptide fold or domain or sub-domain
EEAKDFISKLMEKDPFKRYNAEQALK

SEQ ID NO: 3607 - protein, 26 aa, artificial
  peptide fold or domain or sub-domain
EEAKINLYKAASLNPKNLDIRNSYEL

SEQ ID NO: 3608 - protein, 30 aa, artificial
  peptide fold or domain or sub-domain
EEAKRTYEEGLKHEANNPQLKEGLQNMEAR

SEQ ID NO: 3609 - protein, 26 aa, artificial
  peptide fold or domain or sub-domain
EEALADLREAFKMDSTNSAVIEELSR

SEQ ID NO: 3610 - protein, 30 aa, artificial
  peptide fold or domain or sub-domain
EEALSELKKALRLNPDHANAHNNLGALYCR

SEQ ID NO: 3611 - protein, 24 aa, artificial
  peptide fold or domain or sub-domain
EEASQRKWNFDFQNHKPLEGKYEW

SEQ ID NO: 3612 - protein, 26 aa, artificial
  peptide fold or domain or sub-domain
EEAVVYFKRIVTKNPNNASAVKQVQI

SEQ ID NO: 3613 - protein, 20 aa, artificial
  peptide fold or domain or sub-domain
EECLLSVNSLRQHHMRLAGF

SEQ ID NO: 3614 - protein, 22 aa, artificial
  peptide fold or domain or sub-domain
EEDALADAFEAQHDDYNKIMVK

SEQ ID NO: 3615 - protein, 21 aa, artificial
  peptide fold or domain or sub-domain
EEDCTKAITLDKKNVKAYLRR

SEQ ID NO: 3616 - protein, 28 aa, artificial
  peptide fold or domain or sub-domain
EEDGEVAKVDGNRIVVRYEDGRLVEYPL

SEQ ID NO: 3617 - protein, 30 aa, artificial
  peptide fold or domain or sub-domain
EEDIERYYTHIRRGRKPEPEMLQDLKDRYE

SEQ ID NO: 3618 - protein, 24 aa, artificial
  peptide fold or domain or sub-domain
EEDIIVMKKRLGWAYKPFEFPEEI

SEQ ID NO: 3619 - protein, 22 aa, artificial
  peptide fold or domain or sub-domain
EEDKLDVLKSTQTVIHKALEKL

SEQ ID NO: 3620 - protein, 29 aa, artificial
  peptide fold or domain or sub-domain
EEDLQELYERKNTEIQAQHILLENEEDVA

SEQ ID NO: 3621 - protein, 21 aa, artificial
  peptide fold or domain or sub-domain
EEDTKVYKTVGGLLIEADRDE

SEQ ID NO: 3622 - protein, 21 aa, artificial
  peptide fold or domain or sub-domain
EEDTPVYKLTGNVLLPVEQSE

SEQ ID NO: 3623 - protein, 26 aa, artificial
  peptide fold or domain or sub-domain
EEEEAKRTVEKQISTLNAQLSEMKKK

SEQ ID NO: 3624 - protein, 24 aa, artificial
  peptide fold or domain or sub-domain
EEEIDLLKNKLNYHNEKFEISKNA

SEQ ID NO: 3625 - protein, 24 aa, artificial
  peptide fold or domain or sub-domain
EEEILLTREALEWTSPDFTVPHHI

SEQ ID NO: 3626 - protein, 27 aa, artificial
  peptide fold or domain or sub-domain
EEENLKTTHHADNTLKSFCKWQKSINI

SEQ ID NO: 3627 - protein, 25 aa, artificial
  peptide fold or domain or sub-domain
EEFIYLLDWAYVLQEQGSLLELVDP

SEQ ID NO: 3628 - protein, 30 aa, artificial
  peptide fold or domain or sub-domain
EEFKFYKQDGVHVLERKTSQGWFRLMQTDL

SEQ ID NO: 3629 - protein, 25 aa, artificial
  peptide fold or domain or sub-domain
EEFKKQLDLIPRFTAVQIMGAIQAT

SEQ ID NO: 3630 - protein, 22 aa, artificial
  peptide fold or domain or sub-domain
EEFKTQVNIGGNMFMKARAESV

SEQ ID NO: 3631 - protein, 21 aa, artificial
  peptide fold or domain or sub-domain
EEFVNIYYETMDKRRRALTRL

SEQ ID NO: 3632 - protein, 30 aa, artificial
  peptide fold or domain or sub-domain
EEGDELLAPSPAYPLYEQLAHVNHTKMVYI

SEQ ID NO: 3633 - protein, 22 aa, artificial
  peptide fold or domain or sub-domain
EEGDSAVVKRLAKISDDQLISP

SEQ ID NO: 3634 - protein, 23 aa, artificial
  peptide fold or domain or sub-domain
EEGLNRSSADLRIRKTQHSTLSR

SEQ ID NO: 3635 - protein, 22 aa, artificial
  peptide fold or domain or sub-domain
EEGNQVTIIDMLDKPAPNANHT

SEQ ID NO: 3636 - protein, 30 aa, artificial
  peptide fold or domain or sub-domain
EEGSKVVIPSPNFLSYFTYAKMCGGQIVQL

SEQ ID NO: 3637 - protein, 30 aa, artificial
  peptide fold or domain or sub-domain
EEHFEGSAIAVIKDGSRNLLIEIQALATDV

SEQ ID NO: 3638 - protein, 27 aa, artificial
  peptide fold or domain or sub-domain
EEIESSPTSVFEARGKPAGDIQLENPH

SEQ ID NO: 3639 - protein, 24 aa, artificial
  peptide fold or domain or sub-domain
EEIIATAKQKLSFPAESFYIPDDV

SEQ ID NO: 3640 - protein, 29 aa, artificial
  peptide fold or domain or sub-domain
EEILNMPIKKMMFEGPEEILTATENAQPT

SEQ ID NO: 3641 - protein, 29 aa, artificial
  peptide fold or domain or sub-domain
EEISIESDSPERVKITLGGALNRVFIINN

SEQ ID NO: 3642 - protein, 24 aa, artificial
  peptide fold or domain or sub-domain
EEITKHQQDREPSSPRDYIDCYLE

SEQ ID NO: 3643 - protein, 29 aa, artificial
  peptide fold or domain or sub-domain
EEIYRFSAELGFIRITDVANKLNVSLPSV

SEQ ID NO: 3644 - protein, 20 aa, artificial
  peptide fold or domain or sub-domain
EEKKYTLEELSEALKADFVG

SEQ ID NO: 3645 - protein, 22 aa, artificial
  peptide fold or domain or sub-domain
EEKLKKRGLSQEELNKRLQTYK

SEQ ID NO: 3646 - protein, 27 aa, artificial
  peptide fold or domain or sub-domain
EEKLLIQKTIEEGKPKEFAEKIVAGRM

SEQ ID NO: 3647 - protein, 23 aa, artificial
  peptide fold or domain or sub-domain
EEKQENIEIEKNIKTIKINKLSK

SEQ ID NO: 3648 - protein, 27 aa, artificial
  peptide fold or domain or sub-domain
EELHLTYEARSKSRLRCFAASGEEVGL

SEQ ID NO: 3649 - protein, 26 aa, artificial
  peptide fold or domain or sub-domain
EELIDGYTTVLGDKEKAATQVDRILD

SEQ ID NO: 3650 - protein, 27 aa, artificial
  peptide fold or domain or sub-domain
EELIIVDVSTPNRIGKFKELVDKNIKI

SEQ ID NO: 3651 - protein, 26 aa, artificial
  peptide fold or domain or sub-domain
EELLNAYIKLYKGDQLAAQSIVDDLF

SEQ ID NO: 3652 - protein, 22 aa, artificial
  peptide fold or domain or sub-domain
EELMEYLTLQVERETGFVTDSY

SEQ ID NO: 3653 - protein, 26 aa, artificial
  peptide fold or domain or sub-domain
EELQTAMLKIFDVETTEMQTNKICAE

SEQ ID NO: 3654 - protein, 27 aa, artificial
  peptide fold or domain or sub-domain
EELRLVESAQRGDIESFNALVRLYEGR

SEQ ID NO: 3655 - protein, 26 aa, artificial
  peptide fold or domain or sub-domain
EELVMAFQEKLLNKDYFVESLEEQMD

SEQ ID NO: 3656 - protein, 28 aa, artificial
  peptide fold or domain or sub-domain
EELVYGPLRLLPTRREAYLAGKPLPLSR

SEQ ID NO: 3657 - protein, 23 aa, artificial
  peptide fold or domain or sub-domain
EELYTYMQRRLVEANAQNEVQYL

SEQ ID NO: 3658 - protein, 28 aa, artificial
  peptide fold or domain or sub-domain
EEMDEEYIRKIGVEVSLKFPDETFSERE

SEQ ID NO: 3659 - protein, 22 aa, artificial
  peptide fold or domain or sub-domain
EEMELVEGYKAAGDDYNAILLQ

SEQ ID NO: 3660 - protein, 21 aa, artificial
  peptide fold or domain or sub-domain
EENFNQKKGFDPQVWSKIPRG

SEQ ID NO: 3661 - protein, 21 aa, artificial
  peptide fold or domain or sub-domain
EENFSKKNINEKDWNFELGDG

SEQ ID NO: 3662 - protein, 24 aa, artificial
  peptide fold or domain or sub-domain
EENISIALRKVANYSYKAARERAL

SEQ ID NO: 3663 - protein, 24 aa, artificial
  peptide fold or domain or sub-domain
EENLKITREFLKWGHEEEFFVPEE

SEQ ID NO: 3664 - protein, 28 aa, artificial
  peptide fold or domain or sub-domain
EENLRFDSDVGEFRAVTELGRPDAENWN

SEQ ID NO: 3665 - protein, 20 aa, artificial
  peptide fold or domain or sub-domain
EENLTANLETQLRNRVIDAA

SEQ ID NO: 3666 - protein, 24 aa, artificial
  peptide fold or domain or sub-domain
EENVAKTRDFYHWPYQPFEIPKDV

SEQ ID NO: 3667 - protein, 20 aa, artificial
  peptide fold or domain or sub-domain
EENYTHILSKKLQSGELDII

SEQ ID NO: 3668 - protein, 30 aa, artificial
  peptide fold or domain or sub-domain
EEPLRIAMRKFNKNPETGIQFIQENNLLSQ

SEQ ID NO: 3669 - protein, 20 aa, artificial
  peptide fold or domain or sub-domain
EEQSLDYTTLLTAIRSNFKG

SEQ ID NO: 3670 - protein, 23 aa, artificial
  peptide fold or domain or sub-domain
EEQWRKHRICSSNIFTPKEYFTL

SEQ ID NO: 3671 - protein, 22 aa, artificial
  peptide fold or domain or sub-domain
EERAEEYLNNNTNKKVIFDWFS

SEQ ID NO: 3672 - protein, 23 aa, artificial
  peptide fold or domain or sub-domain
EERELPELTAEFIKRFGVEDGSV

SEQ ID NO: 3673 - protein, 29 aa, artificial
  peptide fold or domain or sub-domain
EERKATKKLMKSEKDPFAYSLLDSKQKAQ

SEQ ID NO: 3674 - protein, 24 aa, artificial
  peptide fold or domain or sub-domain
EERLKTGIPYVQAEIDALNREAEK

SEQ ID NO: 3675 - protein, 24 aa, artificial
  peptide fold or domain or sub-domain
EERLREGVPIGKGLRAKLIAVAEA

SEQ ID NO: 3676 - protein, 29 aa, artificial
  peptide fold or domain or sub-domain
EERQKIKRKMKATVDPLEKKLLDYRQRAI

SEQ ID NO: 3677 - protein, 30 aa, artificial
  peptide fold or domain or sub-domain
EESAQFYTNKLLKEFRESDPKQANWATSFI

SEQ ID NO: 3678 - protein, 27 aa, artificial
  peptide fold or domain or sub-domain
EESDCIARAQRGEVAAFSELVARYQDR

SEQ ID NO: 3679 - protein, 22 aa, artificial
  peptide fold or domain or sub-domain
EESIKILRNALILRLGAQNVLL

SEQ ID NO: 3680 - protein, 20 aa, artificial
  peptide fold or domain or sub-domain
EESMYETGTIVDLPNGRRYI

SEQ ID NO: 3681 - protein, 26 aa, artificial
  peptide fold or domain or sub-domain
EESRNKFTDLHKLVGDKSTGVKVDMQ

SEQ ID NO: 3682 - protein, 24 aa, artificial
  peptide fold or domain or sub-domain
EESSRFSRGSRKDFNMIKVAAHAE

SEQ ID NO: 3683 - protein, 21 aa, artificial
  peptide fold or domain or sub-domain
EESTTMYREVGELLVETEYDN

SEQ ID NO: 3684 - protein, 22 aa, artificial
  peptide fold or domain or sub-domain
EETDSEIVARLAQASPQRILPE

SEQ ID NO: 3685 - protein, 26 aa, artificial
  peptide fold or domain or sub-domain
EETRQKLNLSSRIRQLEEEKNSLQEQ

SEQ ID NO: 3686 - protein, 23 aa, artificial
  peptide fold or domain or sub-domain
EETVKFLRLDTSPEEAAQTVASV

SEQ ID NO: 3687 - protein, 28 aa, artificial
  peptide fold or domain or sub-domain
EEVALLLAGRADQVALAAVNAPTSVVVS

SEQ ID NO: 3688 - protein, 27 aa, artificial
  peptide fold or domain or sub-domain
EEVIDIKVDGDIKKVITGVNTYESKVI

SEQ ID NO: 3689 - protein, 28 aa, artificial
  peptide fold or domain or sub-domain
EEVKDPIGRTGWPKEKGRDGERTPMQWS

SEQ ID NO: 3690 - protein, 24 aa, artificial
  peptide fold or domain or sub-domain
EEVKEHSEQSLQYIPYSRFNLADG

SEQ ID NO: 3691 - protein, 27 aa, artificial
  peptide fold or domain or sub-domain
EEVKKVELSEKIKKVITTKGCYEGKTV

SEQ ID NO: 3692 - protein, 22 aa, artificial
  peptide fold or domain or sub-domain
EEVLAEELGSTFTAEARQAWKN

SEQ ID NO: 3693 - protein, 23 aa, artificial
  peptide fold or domain or sub-domain
EEVLCSKYSPVRASKKDLEEKYE

SEQ ID NO: 3694 - protein, 27 aa, artificial
  peptide fold or domain or sub-domain
EEVQAPEGVVPLRSLHGKNSFEGVTAE

SEQ ID NO: 3695 - protein, 23 aa, artificial
  peptide fold or domain or sub-domain
EEWIRSETSGDYQKLLLALIGAE

SEQ ID NO: 3696 - protein, 25 aa, artificial
  peptide fold or domain or sub-domain
EEYAAEHLSIQASDDEALLDRIDSA

SEQ ID NO: 3697 - protein, 24 aa, artificial
  peptide fold or domain or sub-domain
EEYARAAAVSAGLPPSNFTFRRGV

SEQ ID NO: 3698 - protein, 24 aa, artificial
  peptide fold or domain or sub-domain
EEYFKLFPELENRSVEELKNSEGI

SEQ ID NO: 3699 - protein, 21 aa, artificial
  peptide fold or domain or sub-domain
EFAELFMKSAGESSDLVSKEM

SEQ ID NO: 3700 - protein, 23 aa, artificial
  peptide fold or domain or sub-domain
EFCIRLYHADSKMKFMRWGWIDL

SEQ ID NO: 3701 - protein, 23 aa, artificial
  peptide fold or domain or sub-domain
EFDAQPMHLDEEAGKASILGGLS

SEQ ID NO: 3702 - protein, 27 aa, artificial
  peptide fold or domain or sub-domain
EFEAEHAFANPSSERYDAQAAAGAWQQ

SEQ ID NO: 3703 - protein, 29 aa, artificial
  peptide fold or domain or sub-domain
EFEAIKHQAGVAADIGLSAVHLADIGERF

SEQ ID NO: 3704 - protein, 30 aa, artificial
  peptide fold or domain or sub-domain
EFEHQWRLNYVDEQAIADLSALGFNSVRVP

SEQ ID NO: 3705 - protein, 27 aa, artificial
  peptide fold or domain or sub-domain
EFEVTEHFLFQPNTRKPNPNGVLDRRL

SEQ ID NO: 3706 - protein, 30 aa, artificial
  peptide fold or domain or sub-domain
EFGACKENGKMKAYGAGIIGCIGECEHFLS

SEQ ID NO: 3707 - protein, 30 aa, artificial
  peptide fold or domain or sub-domain
EFGDAEREKKPPIRAAFEDVYDELTEEAQE

SEQ ID NO: 3708 - protein, 21 aa, artificial
  peptide fold or domain or sub-domain
EFGFRELNRDGGLSTPTKFRF

SEQ ID NO: 3709 - protein, 30 aa, artificial
  peptide fold or domain or sub-domain
EFGLCKQDGQLRVFGAGLLSSISELKHALS

SEQ ID NO: 3710 - protein, 30 aa, artificial
  peptide fold or domain or sub-domain
EFGLINTPEGRRIYGAGIVSSRTESIFSLE

SEQ ID NO: 3711 - protein, 30 aa, artificial
  peptide fold or domain or sub-domain
EFGLIREGSDVKMYGSGVISSVKEGDNVVH

SEQ ID NO: 3712 - protein, 30 aa, artificial
  peptide fold or domain or sub-domain
EFGLVQEQGQTKIYGGGILSSPGETLYASE

SEQ ID NO: 3713 - protein, 29 aa, artificial
  peptide fold or domain or sub-domain
EFGNLDPEEEFNASHILVATEEEAIAVKE

SEQ ID NO: 3714 - protein, 27 aa, artificial
  peptide fold or domain or sub-domain
EFGPLAAMAKGEMPYDAAAAKAHASDL

SEQ ID NO: 3715 - protein, 24 aa, artificial
  peptide fold or domain or sub-domain
EFGTTLAAARASLGDIRGPDDYKV

SEQ ID NO: 3716 - protein, 22 aa, artificial
  peptide fold or domain or sub-domain
EFHVPTSFPTKQLVDDPLHNMT

SEQ ID NO: 3717 - protein, 26 aa, artificial
  peptide fold or domain or sub-domain
EFIELLREEGENELEIEKYEKELDQL

SEQ ID NO: 3718 - protein, 27 aa, artificial
  peptide fold or domain or sub-domain
EFILSFQSTGAGVEVQTNRGKYSADRL

SEQ ID NO: 3719 - protein, 29 aa, artificial
  peptide fold or domain or sub-domain
EFKENTSALLNQKEPEKAVQAFLATTAYL

SEQ ID NO: 3720 - protein, 23 aa, artificial
  peptide fold or domain or sub-domain
EFKETEKPLLSPLDIILNFDVKD

SEQ ID NO: 3721 - protein, 28 aa, artificial
  peptide fold or domain or sub-domain
EFKFADALMEAVDAGDVGAYTAAVVEFD

SEQ ID NO: 3722 - protein, 29 aa, artificial
  peptide fold or domain or sub-domain
EFLAECVGDADADMSEFYERVECREMYVW

SEQ ID NO: 3723 - protein, 25 aa, artificial
  peptide fold or domain or sub-domain
EFLAENPELIMLNNKSAISTLPTLN

SEQ ID NO: 3724 - protein, 26 aa, artificial
  peptide fold or domain or sub-domain
EFLEQSMVDKSLVSRQEAKIRELETR

SEQ ID NO: 3725 - protein, 30 aa, artificial
  peptide fold or domain or sub-domain
EFLLSINFLPIESKIVGTSFENLISAGLNN

SEQ ID NO: 3726 - protein, 29 aa, artificial
  peptide fold or domain or sub-domain
EFMEWEMNLLHNHDLSKIAEATRSVLAYL

SEQ ID NO: 3727 - protein, 25 aa, artificial
  peptide fold or domain or sub-domain
EFMFYYNCKELTENKTVPSHFTPEC

SEQ ID NO: 3728 - protein, 27 aa, artificial
  peptide fold or domain or sub-domain
EFQPKIHRYISHLSGGSDALDLTQAVF

SEQ ID NO: 3729 - protein, 27 aa, artificial
  peptide fold or domain or sub-domain
EFQVVTAAGKLVTANRSTNPDLFWAIS

SEQ ID NO: 3730 - protein, 27 aa, artificial
  peptide fold or domain or sub-domain
EFRKAILAVGGKDTALDAFVNFRGREP

SEQ ID NO: 3731 - protein, 23 aa, artificial
  peptide fold or domain or sub-domain
EFRRAIDRDPLKCPDPEASERMR

SEQ ID NO: 3732 - protein, 30 aa, artificial
  peptide fold or domain or sub-domain
EFSAAEKRKKAHYHDLFDDVYDELPLRLRR

SEQ ID NO: 3733 - protein, 21 aa, artificial
  peptide fold or domain or sub-domain
EFSDVFHRTLGETSDVVNKET

SEQ ID NO: 3734 - protein, 23 aa, artificial
  peptide fold or domain or sub-domain
EFSEGLAQGKKQRLSKKLRRKLQ

SEQ ID NO: 3735 - protein, 26 aa, artificial
  peptide fold or domain or sub-domain
EFSEMLAVIGSVKSPEDFIKVRRVIR

SEQ ID NO: 3736 - protein, 22 aa, artificial
  peptide fold or domain or sub-domain
EFSHNNREDADRLAELTVNGKK

SEQ ID NO: 3737 - protein, 27 aa, artificial
  peptide fold or domain or sub-domain
EFTKWGVEGTTYTKTDGVRNLVDDVNY

SEQ ID NO: 3738 - protein, 30 aa, artificial
  peptide fold or domain or sub-domain
EFTWSMRDASGKVISTQKYTPQSFFKQFVH

SEQ ID NO: 3739 - protein, 22 aa, artificial
  peptide fold or domain or sub-domain
EFVLGTLGVFDLQVDELLSLIG

SEQ ID NO: 3740 - protein, 27 aa, artificial
  peptide fold or domain or sub-domain
EFVTNDFSLMFNYIKPKQLEQRHGGRA

SEQ ID NO: 3741 - protein, 29 aa, artificial
  peptide fold or domain or sub-domain
EFYDVLHAGMQQRIFSYSGEHLKMPPTAI

SEQ ID NO: 3742 - protein, 23 aa, artificial
  peptide fold or domain or sub-domain
EFYGPGQVVASIPVGKGQVEQVK

SEQ ID NO: 3743 - protein, 29 aa, artificial
  peptide fold or domain or sub-domain
EGAAVIDPYAAEHDREQLTDAWFVPSMPD

SEQ ID NO: 3744 - protein, 22 aa, artificial
  peptide fold or domain or sub-domain
EGALKRDPNEIEFVQSVQESVH

SEQ ID NO: 3745 - protein, 28 aa, artificial
  peptide fold or domain or sub-domain
EGAWEGSPAVADLKAREGLESADDVSGW

SEQ ID NO: 3746 - protein, 29 aa, artificial
  peptide fold or domain or sub-domain
EGCDFLIHLFKNPDAPFSSSFYSVDGVTI

SEQ ID NO: 3747 - protein, 21 aa, artificial
  peptide fold or domain or sub-domain
EGCTYCHDENNLASEAKYPYV

SEQ ID NO: 3748 - protein, 28 aa, artificial
  peptide fold or domain or sub-domain
EGCWDQSSDLKQYMKDNNIQNYDDLQTF

SEQ ID NO: 3749 - protein, 28 aa, artificial
  peptide fold or domain or sub-domain
EGDACDNDVDGDGIPNGLDNCPKVPNPL

SEQ ID NO: 3750 - protein, 30 aa, artificial
  peptide fold or domain or sub-domain
EGDVNEILNQAKKTVDPNEREVLYFEALEM

SEQ ID NO: 3751 - protein, 27 aa, artificial
  peptide fold or domain or sub-domain
EGEELYQQSCVGCHGKDLEGVSGPNLQ

SEQ ID NO: 3752 - protein, 27 aa, artificial
  peptide fold or domain or sub-domain
EGERFYRELSEHFNGEIKKTFLELADQ

SEQ ID NO: 3753 - protein, 21 aa, artificial
  peptide fold or domain or sub-domain
EGFKNQGARVGTDMMDLIADH

SEQ ID NO: 3754 - protein, 23 aa, artificial
  peptide fold or domain or sub-domain
EGFPDYKPELPGGRPGGGRSLSA

SEQ ID NO: 3755 - protein, 29 aa, artificial
  peptide fold or domain or sub-domain
EGFRAAVQEAGASTKDGKGMWADSSFEDL

SEQ ID NO: 3756 - protein, 21 aa, artificial
  peptide fold or domain or sub-domain
EGFVRAKDARLVDGSGRELLL

SEQ ID NO: 3757 - protein, 27 aa, artificial
  peptide fold or domain or sub-domain
EGGGHLFGYDDAEGMEPPLETIRDSGG

SEQ ID NO: 3758 - protein, 25 aa, artificial
  peptide fold or domain or sub-domain
EGGSRWTMYKNSQAGSGWDSSDAPN

SEQ ID NO: 3759 - protein, 24 aa, artificial
  peptide fold or domain or sub-domain
EGGVLRSLPTAAQEATQNWHESGW

SEQ ID NO: 3760 - protein, 25 aa, artificial
  peptide fold or domain or sub-domain
EGHTVTTTYGMIDDLSGPKTKVVYD

SEQ ID NO: 3761 - protein, 29 aa, artificial
  peptide fold or domain or sub-domain
EGIAAILRLWQEEEVVWDGTFHRFGPVTM

SEQ ID NO: 3762 - protein, 21 aa, artificial
  peptide fold or domain or sub-domain
EGIDRITTPAGSDYSYSVKAS

SEQ ID NO: 3763 - protein, 29 aa, artificial
  peptide fold or domain or sub-domain
EGIEIIKRLWAGDRFSYEGKRFRLDDAFL

SEQ ID NO: 3764 - protein, 30 aa, artificial
  peptide fold or domain or sub-domain
EGIHYSIKVLQDEQSSLDAKQFSLRFLVHL

SEQ ID NO: 3765 - protein, 29 aa, artificial
  peptide fold or domain or sub-domain
EGIPSSNQTATWAEEAGIPLTDFSNVKEL

SEQ ID NO: 3766 - protein, 28 aa, artificial
  peptide fold or domain or sub-domain
EGITTEGLYYPLRGEAIEMGSTRGVSNC

SEQ ID NO: 3767 - protein, 22 aa, artificial
  peptide fold or domain or sub-domain
EGIVKILEDYELQNEETRVHLL

SEQ ID NO: 3768 - protein, 27 aa, artificial
  peptide fold or domain or sub-domain
EGKFVVSGGKIKVYYNGVLQTTISHTS

SEQ ID NO: 3769 - protein, 21 aa, artificial
  peptide fold or domain or sub-domain
EGKKIAPKTMNSRLGIIDGIS

SEQ ID NO: 3770 - protein, 29 aa, artificial
  peptide fold or domain or sub-domain
EGKLEFAESMITVKDGAAVFENGVLAGST

SEQ ID NO: 3771 - protein, 28 aa, artificial
  peptide fold or domain or sub-domain
EGKLLSSLIEAFEAGDFSKLQDELNVFE

SEQ ID NO: 3772 - protein, 26 aa, artificial
  peptide fold or domain or sub-domain
EGLGTRFVESEKLDAAKGADLKAKLV

SEQ ID NO: 3773 - protein, 23 aa, artificial
  peptide fold or domain or sub-domain
EGLQWYAAETWASDHQNDPDVET

SEQ ID NO: 3774 - protein, 29 aa, artificial
  peptide fold or domain or sub-domain
EGMALLRKAMREDVFTFEGKYYQVPPRSL

SEQ ID NO: 3775 - protein, 24 aa, artificial
  peptide fold or domain or sub-domain
EGMNSVGKLYEQKDYYIADLIMAG

SEQ ID NO: 3776 - protein, 29 aa, artificial
  peptide fold or domain or sub-domain
EGNEPIDPRYIIEDGVCKMADHSALAGSL

SEQ ID NO: 3777 - protein, 22 aa, artificial
  peptide fold or domain or sub-domain
EGQKLLVPASASLYIPGKIVDN

SEQ ID NO: 3778 - protein, 22 aa, artificial
  peptide fold or domain or sub-domain
EGQSGLCFVNNTKCPDTSRAIT

SEQ ID NO: 3779 - protein, 28 aa, artificial
  peptide fold or domain or sub-domain
EGRFLHSLVQACEEGDLQAFDSRVQEYD

SEQ ID NO: 3780 - protein, 25 aa, artificial
  peptide fold or domain or sub-domain
EGRQAVSHWYREEEFLRKYKAIPAN

SEQ ID NO: 3781 - protein, 21 aa, artificial
  peptide fold or domain or sub-domain
EGRQLAARTSNSAFGIVEGLS

SEQ ID NO: 3782 - protein, 30 aa, artificial
  peptide fold or domain or sub-domain
EGSDFAKNLAAPDIDFGVFHLYTEDWGIKD

SEQ ID NO: 3783 - protein, 27 aa, artificial
  peptide fold or domain or sub-domain
EGSWLLMEAAHVLGDEHLIAKAETLAI

SEQ ID NO: 3784 - protein, 20 aa, artificial
  peptide fold or domain or sub-domain
EGTAMNMMSLLKTAILSGAL

SEQ ID NO: 3785 - protein, 30 aa, artificial
  peptide fold or domain or sub-domain
EGTDILTLLMLAKDEEGKPLSDQELHDELI

SEQ ID NO: 3786 - protein, 22 aa, artificial
  peptide fold or domain or sub-domain
EGTLRLFTAAGLTLAQAVRATT

SEQ ID NO: 3787 - protein, 20 aa, artificial
  peptide fold or domain or sub-domain
EGTNSYLNIEAKYQPSGSFP

SEQ ID NO: 3788 - protein, 27 aa, artificial
  peptide fold or domain or sub-domain
EGTSTAPRPEQKTAEKPRAAEKPKAKP

SEQ ID NO: 3789 - protein, 29 aa, artificial
  peptide fold or domain or sub-domain
EGVRVIRQAWETGRIGFEGRRWRFEDLPF

SEQ ID NO: 3790 - protein, 26 aa, artificial
  peptide fold or domain or sub-domain
EGYGRFLLHDLRFDAGGKEVLKVEQG

SEQ ID NO: 3791 - protein, 24 aa, artificial
  peptide fold or domain or sub-domain
EGYSKLTHPNRPNAKLENSIAKER

SEQ ID NO: 3792 - protein, 25 aa, artificial
  peptide fold or domain or sub-domain
EHGDKIAEAAEKNGISPKAYADRIS

SEQ ID NO: 3793 - protein, 24 aa, artificial
  peptide fold or domain or sub-domain
EHGEASAYRDWFHVTGWPLSAYDE

SEQ ID NO: 3794 - protein, 25 aa, artificial
  peptide fold or domain or sub-domain
EHGEKISKAAAKGGVTPQELVDDLS

SEQ ID NO: 3795 - protein, 22 aa, artificial
  peptide fold or domain or sub-domain
EHGETVYRAAQAAGEDPKAFVD

SEQ ID NO: 3796 - protein, 25 aa, artificial
  peptide fold or domain or sub-domain
EHGETVYRAAQAAGEDPKAFVDRVS

SEQ ID NO: 3797 - protein, 25 aa, artificial
  peptide fold or domain or sub-domain
EHGIKMLQSARKEGITPRELADRNT

SEQ ID NO: 3798 - protein, 22 aa, artificial
  peptide fold or domain or sub-domain
EHGLKIQTAAEKLNLQPKILCD

SEQ ID NO: 3799 - protein, 25 aa, artificial
  peptide fold or domain or sub-domain
EHGLKIQTAAEKLNLQPKILCDQLA

SEQ ID NO: 3800 - protein, 25 aa, artificial
  peptide fold or domain or sub-domain
EHGLKVQTVAQTEGVSPLQLCDRNS

SEQ ID NO: 3801 - protein, 25 aa, artificial
  peptide fold or domain or sub-domain
EHGNKIESKAKSLGLDPQTFVDQNV

SEQ ID NO: 3802 - protein, 22 aa, artificial
  peptide fold or domain or sub-domain
EHGQKIERIANEKGITPKEHVD

SEQ ID NO: 3803 - protein, 25 aa, artificial
  peptide fold or domain or sub-domain
EHGQKIERIANEKGITPKEHVDEIV

SEQ ID NO: 3804 - protein, 22 aa, artificial
  peptide fold or domain or sub-domain
EHGQKIFNKAQELKLETQDYVD

SEQ ID NO: 3805 - protein, 25 aa, artificial
  peptide fold or domain or sub-domain
EHGQKIFNKAQELKLETQDYVDRQA

SEQ ID NO: 3806 - protein, 25 aa, artificial
  peptide fold or domain or sub-domain
EHGQKIQKAAEACNKTPNDFVDMVV

SEQ ID NO: 3807 - protein, 22 aa, artificial
  peptide fold or domain or sub-domain
EHGQKVEKAAINQNIDPQTFTD

SEQ ID NO: 3808 - protein, 25 aa, artificial
  peptide fold or domain or sub-domain
EHGQKVEQAAKQNGFTPQAWTDKMT

SEQ ID NO: 3809 - protein, 25 aa, artificial
  peptide fold or domain or sub-domain
EHGQKVQNTAKKHGKCEIDFVNHVS

SEQ ID NO: 3810 - protein, 22 aa, artificial
  peptide fold or domain or sub-domain
EHGSKVDEAAKKNGLKTIDYCD

SEQ ID NO: 3811 - protein, 22 aa, artificial
  peptide fold or domain or sub-domain
EHGTKIQQAASLHGVPVAKYCD

SEQ ID NO: 3812 - protein, 25 aa, artificial
  peptide fold or domain or sub-domain
EHGTKIQQAASLHGVPVAKYCDDIS

SEQ ID NO: 3813 - protein, 25 aa, artificial
  peptide fold or domain or sub-domain
EHGTKVQKAANKAILSTFEYCTQIS

SEQ ID NO: 3814 - protein, 22 aa, artificial
  peptide fold or domain or sub-domain
EHGTPIAVKAEAEGRTPLEVAT

SEQ ID NO: 3815 - protein, 25 aa, artificial
  peptide fold or domain or sub-domain
EHGTPISFRALNEKRSPREIVDEFH

SEQ ID NO: 3816 - protein, 27 aa, artificial
  peptide fold or domain or sub-domain
EHHRALRALAVCIVGEAWADDAVQEAW

SEQ ID NO: 3817 - protein, 28 aa, artificial
  peptide fold or domain or sub-domain
EHIQKVQDNYVIQKYPIKQIPPSCQNLF

SEQ ID NO: 3818 - protein, 20 aa, artificial
  peptide fold or domain or sub-domain
EHKATNENEAKRIKESGGMI

SEQ ID NO: 3819 - protein, 21 aa, artificial
  peptide fold or domain or sub-domain
EHKHFSGRSSVVDCETASIDA

SEQ ID NO: 3820 - protein, 26 aa, artificial
  peptide fold or domain or sub-domain
EHLKDKLLVDDQIQKLLKPKEIDEIF

SEQ ID NO: 3821 - protein, 27 aa, artificial
  peptide fold or domain or sub-domain
EHLLAQALRAHGADSDQAPGLAALIVA

SEQ ID NO: 3822 - protein, 28 aa, artificial
  peptide fold or domain or sub-domain
EHMLVQGVIEAMEVESVEKMEEAIADYD

SEQ ID NO: 3823 - protein, 26 aa, artificial
  peptide fold or domain or sub-domain
EHNIVTIIMAQFQVGVQDAIDKAGEL

SEQ ID NO: 3824 - protein, 29 aa, artificial
  peptide fold or domain or sub-domain
EHPEGYAVIQALIDRGVIGDYREPRIMRF

SEQ ID NO: 3825 - protein, 26 aa, artificial
  peptide fold or domain or sub-domain
EHPVTGCGERTEGRCLHYTVDKSKPK

SEQ ID NO: 3826 - protein, 29 aa, artificial
  peptide fold or domain or sub-domain
EHQVVRADAAARRLDFSNGASAAYDLLAF

SEQ ID NO: 3827 - protein, 20 aa, artificial
  peptide fold or domain or sub-domain
EHRPVIKSEYKRIRENGGYV

SEQ ID NO: 3828 - protein, 21 aa, artificial
  peptide fold or domain or sub-domain
EHRYRSNVGRGVHRFTRIATQ

SEQ ID NO: 3829 - protein, 29 aa, artificial
  peptide fold or domain or sub-domain
EHSFHGRTIGALSVTHKSMYRDPFMPPVS

SEQ ID NO: 3830 - protein, 20 aa, artificial
  peptide fold or domain or sub-domain
EHTHEQQFRTSRNESKPVQM

SEQ ID NO: 3831 - protein, 29 aa, artificial
  peptide fold or domain or sub-domain
EHTLVDFTQDANGVRANVACSDGPKTIAA

SEQ ID NO: 3832 - protein, 29 aa, artificial
  peptide fold or domain or sub-domain
EHYAIWAHLPDMVREGQQNGFVREFGAMA

SEQ ID NO: 3833 - protein, 21 aa, artificial
  peptide fold or domain or sub-domain
EHYEVISRSVGDTTDIVSKEM

SEQ ID NO: 3834 - protein, 29 aa, artificial
  peptide fold or domain or sub-domain
EIAAMPPQVEVRARHILVKTKEEAEAIIK

SEQ ID NO: 3835 - protein, 28 aa, artificial
  peptide fold or domain or sub-domain
EIAELKEELKTATGQKRVKAIRRLDVLD

SEQ ID NO: 3836 - protein, 22 aa, artificial
  peptide fold or domain or sub-domain
EIAIAQSFQAEVLAIPTSYHLN

SEQ ID NO: 3837 - protein, 22 aa, artificial
  peptide fold or domain or sub-domain
EIAIAQYTQSLACRVEPSVHFN

SEQ ID NO: 3838 - protein, 25 aa, artificial
  peptide fold or domain or sub-domain
EIALIIFNSANRLFQYASTDMDRVL

SEQ ID NO: 3839 - protein, 23 aa, artificial
  peptide fold or domain or sub-domain
EIARLIAEEGIFNQMVHHSTTSQ

SEQ ID NO: 3840 - protein, 28 aa, artificial
  peptide fold or domain or sub-domain
EIARLIAEEGIFNQMVHHSTTSQYGTLT

SEQ ID NO: 3841 - protein, 21 aa, artificial
  peptide fold or domain or sub-domain
EIATGITWEDVPGTTLESCGN

SEQ ID NO: 3842 - protein, 24 aa, artificial
  peptide fold or domain or sub-domain
EIATSRLLDAVRQSDVHQDIDVDS

SEQ ID NO: 3843 - protein, 25 aa, artificial
  peptide fold or domain or sub-domain
EIAVLVISPTNIPYTYGYPCFNDVV

SEQ ID NO: 3844 - protein, 21 aa, artificial
  peptide fold or domain or sub-domain
EICRRSPTHERIPFVELLHLM

SEQ ID NO: 3845 - protein, 26 aa, artificial
  peptide fold or domain or sub-domain
EIEDQVLRLHEKGPKRVKPMTLPKAL

SEQ ID NO: 3846 - protein, 28 aa, artificial
  peptide fold or domain or sub-domain
EIEELVNWIANHKDKKVSRSTVYRTVKL

SEQ ID NO: 3847 - protein, 27 aa, artificial
  peptide fold or domain or sub-domain
EIEIGKEQARAEGKPEAMLEKIALGKL

SEQ ID NO: 3848 - protein, 27 aa, artificial
  peptide fold or domain or sub-domain
EIEMVDANGCVLQVNDQEHPDLFWALR

SEQ ID NO: 3849 - protein, 23 aa, artificial
  peptide fold or domain or sub-domain
EIEPEWAYGKKGQPDAKIPPNAK

SEQ ID NO: 3850 - protein, 23 aa, artificial
  peptide fold or domain or sub-domain
EIFHVDMAKKETVWRLEEFGRFA

SEQ ID NO: 3851 - protein, 23 aa, artificial
  peptide fold or domain or sub-domain
EIFYMDFNLKKEVARIPEFAHLY

SEQ ID NO: 3852 - protein, 27 aa, artificial
  peptide fold or domain or sub-domain
EIGAYHHIESPYRHYYFFEDGSQNYIG

SEQ ID NO: 3853 - protein, 24 aa, artificial
  peptide fold or domain or sub-domain
EIGINLAEHVFVPSLPIEYYSYQQ

SEQ ID NO: 3854 - protein, 22 aa, artificial
  peptide fold or domain or sub-domain
EIGRAQALQAAACYLVPHTDFN

SEQ ID NO: 3855 - protein, 28 aa, artificial
  peptide fold or domain or sub-domain
EIIARAHYDDEVAYITERGANQVVMGER

SEQ ID NO: 3856 - protein, 28 aa, artificial
  peptide fold or domain or sub-domain
EIIARGEAPTTENKLFHAGADKVVMPTH

SEQ ID NO: 3857 - protein, 27 aa, artificial
  peptide fold or domain or sub-domain
EIICVLDEDPDAKIANKYGITRTSAGF

SEQ ID NO: 3858 - protein, 29 aa, artificial
  peptide fold or domain or sub-domain
EIIRAQAIHDGIAPIFISPVNGQFVASEI

SEQ ID NO: 3859 - protein, 29 aa, artificial
  peptide fold or domain or sub-domain
EIITDQGTNFTSRLMQLLHKQLGIHSIRT

SEQ ID NO: 3860 - protein, 28 aa, artificial
  peptide fold or domain or sub-domain
EIIVNEKGNQIEEEVEKLDVSFETIVQK

SEQ ID NO: 3861 - protein, 29 aa, artificial
  peptide fold or domain or sub-domain
EIIYHIVAEKQVARAKEIATRLKVSRSSV

SEQ ID NO: 3862 - protein, 27 aa, artificial
  peptide fold or domain or sub-domain
EIIYLKKNKFNIYSFNVKQDYKKLIRY

SEQ ID NO: 3863 - protein, 23 aa, artificial
  peptide fold or domain or sub-domain
EIKERASQSEISVVNQEHEQEIK

SEQ ID NO: 3864 - protein, 30 aa, artificial
  peptide fold or domain or sub-domain
EIKLSKDELKGFNKQALKAMNYDNKQLALP

SEQ ID NO: 3865 - protein, 29 aa, artificial
  peptide fold or domain or sub-domain
EIKVELYQDGKATGKTAILNESNNWTHTW

SEQ ID NO: 3866 - protein, 27 aa, artificial
  peptide fold or domain or sub-domain
EIKVYISDSDVMEEAKRLNTTRAIISM

SEQ ID NO: 3867 - protein, 29 aa, artificial
  peptide fold or domain or sub-domain
EILAKTTRPNGLYPNAYCTKFGKWENYNC

SEQ ID NO: 3868 - protein, 29 aa, artificial
  peptide fold or domain or sub-domain
EILDSLATSKDVENKTSLLDYVSKISMEK

SEQ ID NO: 3869 - protein, 29 aa, artificial
  peptide fold or domain or sub-domain
EILFFKDSNFWRRIPTITEVYNYPISTFW

SEQ ID NO: 3870 - protein, 29 aa, artificial
  peptide fold or domain or sub-domain
EILGRLKDVKSNVAGVTLLHYIVRARLAQ

SEQ ID NO: 3871 - protein, 25 aa, artificial
  peptide fold or domain or sub-domain
EILIRVGLQEISPFLKEKAMLRNDL

SEQ ID NO: 3872 - protein, 20 aa, artificial
  peptide fold or domain or sub-domain
EILKTKVERLEQERNHLKHD

SEQ ID NO: 3873 - protein, 29 aa, artificial
  peptide fold or domain or sub-domain
EILPALCVLIHHTDVNILVDTVWALSYLT

SEQ ID NO: 3874 - protein, 29 aa, artificial
  peptide fold or domain or sub-domain
EILTDCGTNFLSKLLKQVYSLLGVKGIKT

SEQ ID NO: 3875 - protein, 20 aa, artificial
  peptide fold or domain or sub-domain
EIMNTEKVLERVSDLTLDLG

SEQ ID NO: 3876 - protein, 23 aa, artificial
  peptide fold or domain or sub-domain
EIMQYAESNPVRCADPDAAEEML

SEQ ID NO: 3877 - protein, 22 aa, artificial
  peptide fold or domain or sub-domain
EINDTVVYNMALNDVYTVLSQC

SEQ ID NO: 3878 - protein, 20 aa, artificial
  peptide fold or domain or sub-domain
EINGINTKNMTHTEAIEIIR

SEQ ID NO: 3879 - protein, 22 aa, artificial
  peptide fold or domain or sub-domain
EINGISVANQTVEQLQKMLREM

SEQ ID NO: 3880 - protein, 22 aa, artificial
  peptide fold or domain or sub-domain
EINGQILYGRSHQNASSIIKCA

SEQ ID NO: 3881 - protein, 20 aa, artificial
  peptide fold or domain or sub-domain
EINNEDVSSASHEHVVDLIR

SEQ ID NO: 3882 - protein, 20 aa, artificial
  peptide fold or domain or sub-domain
EINNQILYGRSHQNASAIIK

SEQ ID NO: 3883 - protein, 21 aa, artificial
  peptide fold or domain or sub-domain
EINNYLRNQGGSGNEKLDAQI

SEQ ID NO: 3884 - protein, 26 aa, artificial
  peptide fold or domain or sub-domain
EINNYLRNQGGSGNEKLDAQIKNISD

SEQ ID NO: 3885 - protein, 27 aa, artificial
  peptide fold or domain or sub-domain
EIPANADPIKYEIDKESGALFVNRFMS

SEQ ID NO: 3886 - protein, 22 aa, artificial
  peptide fold or domain or sub-domain
EIPDHIVDRMKRDRTFSEAYSG

SEQ ID NO: 3887 - protein, 23 aa, artificial
  peptide fold or domain or sub-domain
EIPPQFAYQREGLTGIIPSNEKL

SEQ ID NO: 3888 - protein, 24 aa, artificial
  peptide fold or domain or sub-domain
EIQEMCAAFMEGNVEKALEIQLLY

SEQ ID NO: 3889 - protein, 26 aa, artificial
  peptide fold or domain or sub-domain
EIQEMCAAFMEGNVEKALEIQLLYKK

SEQ ID NO: 3890 - protein, 29 aa, artificial
  peptide fold or domain or sub-domain
EIQSVEETQIKERKCLLLKIRGGKQFVLQ

SEQ ID NO: 3891 - protein, 21 aa, artificial
  peptide fold or domain or sub-domain
EIRESFIRGSGPGGQCINRRS

SEQ ID NO: 3892 - protein, 21 aa, artificial
  peptide fold or domain or sub-domain
EIRRFVRGDPGLVGRVASRIA

SEQ ID NO: 3893 - protein, 27 aa, artificial
  peptide fold or domain or sub-domain
EIRSFKGSPYWMAPEVIMNGRGYHLPV

SEQ ID NO: 3894 - protein, 26 aa, artificial
  peptide fold or domain or sub-domain
EISDICFVTEKSGIENLKQIGKAENQ

SEQ ID NO: 3895 - protein, 21 aa, artificial
  peptide fold or domain or sub-domain
EISENIGSFLADDDSNPMSDV

SEQ ID NO: 3896 - protein, 30 aa, artificial
  peptide fold or domain or sub-domain
EISKKDIIREVQNKFSIELKNENVFLEENI

SEQ ID NO: 3897 - protein, 20 aa, artificial
  peptide fold or domain or sub-domain
EISSTFIRQALDEKKDVRYF

SEQ ID NO: 3898 - protein, 20 aa, artificial
  peptide fold or domain or sub-domain
EISSTLIRERVRQSLEVKFF

SEQ ID NO: 3899 - protein, 29 aa, artificial
  peptide fold or domain or sub-domain
EISVDSLDPKLMESLRENAKIWGLYLTVC

SEQ ID NO: 3900 - protein, 26 aa, artificial
  peptide fold or domain or sub-domain
EITDDASGAVGAQKAYDSLVFQKNVD

SEQ ID NO: 3901 - protein, 20 aa, artificial
  peptide fold or domain or sub-domain
EITDVKPLKGDHLSRAIGRI

SEQ ID NO: 3902 - protein, 28 aa, artificial
  peptide fold or domain or sub-domain
EITDVKPLKGDHLSRAIGRIAGKGGKTK

SEQ ID NO: 3903 - protein, 27 aa, artificial
  peptide fold or domain or sub-domain
EITFTLEGNKMTMKTVSALKTTVISFT

SEQ ID NO: 3904 - protein, 27 aa, artificial
  peptide fold or domain or sub-domain
EITFVTAGGNLLRLNEENNVEEFKASL

SEQ ID NO: 3905 - protein, 28 aa, artificial
  peptide fold or domain or sub-domain
EITIPKLHENEPELAYLGGKKLSTLLNS

SEQ ID NO: 3906 - protein, 30 aa, artificial
  peptide fold or domain or sub-domain
EITKDNISYSLKRRRNIVIEPENILVENPI

SEQ ID NO: 3907 - protein, 21 aa, artificial
  peptide fold or domain or sub-domain
EITLGEHGILREAYGKEKISE

SEQ ID NO: 3908 - protein, 30 aa, artificial
  peptide fold or domain or sub-domain
EITPDKAFQDKLYPFTWDAVRYNGKLIAYP

SEQ ID NO: 3909 - protein, 28 aa, artificial
  peptide fold or domain or sub-domain
EIVRQCAMKAYEEKRHLKDILLENEEVM

SEQ ID NO: 3910 - protein, 28 aa, artificial
  peptide fold or domain or sub-domain
EIVSRAENHSAQKKLIRCGANYVVMAAT

SEQ ID NO: 3911 - protein, 28 aa, artificial
  peptide fold or domain or sub-domain
EIVYQAAMTALEENKDFIDLVYSDERVR

SEQ ID NO: 3912 - protein, 28 aa, artificial
  peptide fold or domain or sub-domain
EIVYRICMEVFEREGTLKEALLADPLVG

SEQ ID NO: 3913 - protein, 29 aa, artificial
  peptide fold or domain or sub-domain
EIYELEEMKGHARVTDIINDFNISPGTIS

SEQ ID NO: 3914 - protein, 27 aa, artificial
  peptide fold or domain or sub-domain
EIYFFKGRFLWRRHTQSSIPQQSLIAN

SEQ ID NO: 3915 - protein, 29 aa, artificial
  peptide fold or domain or sub-domain
EIYFFKGRFLWRRHTQSSIPQQSLIANFW

SEQ ID NO: 3916 - protein, 25 aa, artificial
  peptide fold or domain or sub-domain
EKACRHCHYITSEDRCPVCGSRDLS

SEQ ID NO: 3917 - protein, 26 aa, artificial
  peptide fold or domain or sub-domain
EKAESDFNKVLSIDPNNKEVKYEMNG

SEQ ID NO: 3918 - protein, 23 aa, artificial
  peptide fold or domain or sub-domain
EKAKGILMKRRKIDEDEAYRLMR

SEQ ID NO: 3919 - protein, 23 aa, artificial
  peptide fold or domain or sub-domain
EKAKGKIMQKLNISEEDAYTHIR

SEQ ID NO: 3920 - protein, 23 aa, artificial
  peptide fold or domain or sub-domain
EKAKGLVMEARGLSEKEAYKFLQ

SEQ ID NO: 3921 - protein, 23 aa, artificial
  peptide fold or domain or sub-domain
EKAKSVLMTYQGMQEEQAWQALR

SEQ ID NO: 3922 - protein, 26 aa, artificial
  peptide fold or domain or sub-domain
EKALEDFNAVREIEPENKAALNQATI

SEQ ID NO: 3923 - protein, 24 aa, artificial
  peptide fold or domain or sub-domain
EKAQARGITAPKAVVQRISEFAER

SEQ ID NO: 3924 - protein, 26 aa, artificial
  peptide fold or domain or sub-domain
EKAQDYLTLAQAKKPFDPDINTLLIK

SEQ ID NO: 3925 - protein, 26 aa, artificial
  peptide fold or domain or sub-domain
EKATADLKKVLAIDPKNRAAQEELGK

SEQ ID NO: 3926 - protein, 27 aa, artificial
  peptide fold or domain or sub-domain
EKAVFTEQALESGKPAAVVEKMIEGRI

SEQ ID NO: 3927 - protein, 29 aa, artificial
  peptide fold or domain or sub-domain
EKAYKAGRDSLWYQQTKGRASRVTMIILT

SEQ ID NO: 3928 - protein, 24 aa, artificial
  peptide fold or domain or sub-domain
EKCGAGSLLDLEKLVKAKHFAFDC

SEQ ID NO: 3929 - protein, 30 aa, artificial
  peptide fold or domain or sub-domain
EKDCSKENGNCDVNAECSIDKNKDIKCQCK

SEQ ID NO: 3930 - protein, 28 aa, artificial
  peptide fold or domain or sub-domain
EKDGVVTYVSADLIRVMNDDGTTSSYKL

SEQ ID NO: 3931 - protein, 23 aa, artificial
  peptide fold or domain or sub-domain
EKDIRSDTSGHFERLLVSMCQGN

SEQ ID NO: 3932 - protein, 23 aa, artificial
  peptide fold or domain or sub-domain
EKDVQSDLSFETQNLFGMILRAD

SEQ ID NO: 3933 - protein, 29 aa, artificial
  peptide fold or domain or sub-domain
EKDWYTLMNTIINGSASEADAARKQLREE

SEQ ID NO: 3934 - protein, 25 aa, artificial
  peptide fold or domain or sub-domain
EKDYVCEGEIQFDAAFDKKTRDKKF

SEQ ID NO: 3935 - protein, 24 aa, artificial
  peptide fold or domain or sub-domain
EKEAKADYSASEIYEHLIVEDARL

SEQ ID NO: 3936 - protein, 21 aa, artificial
  peptide fold or domain or sub-domain
EKEISQIIKNTTNVDIDKQNI

SEQ ID NO: 3937 - protein, 27 aa, artificial
  peptide fold or domain or sub-domain
EKEIYRAKARETGKPENIIEKIIEGQI

SEQ ID NO: 3938 - protein, 24 aa, artificial
  peptide fold or domain or sub-domain
EKELGNDAYKKKDFDTALKHYDKA

SEQ ID NO: 3939 - protein, 24 aa, artificial
  peptide fold or domain or sub-domain
EKELLKQENHNIIILIEFALALMT

SEQ ID NO: 3940 - protein, 26 aa, artificial
  peptide fold or domain or sub-domain
EKEMVRRAKASAGITPFGEKKQETLI

SEQ ID NO: 3941 - protein, 26 aa, artificial
  peptide fold or domain or sub-domain
EKESIARARAGSRLSAEERQREEQLV

SEQ ID NO: 3942 - protein, 25 aa, artificial
  peptide fold or domain or sub-domain
EKFPDIPELKYIPQEYRDPRGYYVW

SEQ ID NO: 3943 - protein, 29 aa, artificial
  peptide fold or domain or sub-domain
EKFQSQTSMPGLWPMKVDASGCTVAQSPT

SEQ ID NO: 3944 - protein, 20 aa, artificial
  peptide fold or domain or sub-domain
EKGEVVEKIKEQWGSLDEFK

SEQ ID NO: 3945 - protein, 20 aa, artificial
  peptide fold or domain or sub-domain
EKGMKQAEIAARFNTCVTNI

SEQ ID NO: 3946 - protein, 27 aa, artificial
  peptide fold or domain or sub-domain
EKGVQENLNSALALYENTISLAQLYAR

SEQ ID NO: 3947 - protein, 25 aa, artificial
  peptide fold or domain or sub-domain
EKIDYSIYKKEELDGFYDFARDPFG

SEQ ID NO: 3948 - protein, 27 aa, artificial
  peptide fold or domain or sub-domain
EKIFTSSLGQKAMESHFHYKDWPVQVV

SEQ ID NO: 3949 - protein, 25 aa, artificial
  peptide fold or domain or sub-domain
EKIIEYLEKMKHYDMEEIQTSIHNI

SEQ ID NO: 3950 - protein, 29 aa, artificial
  peptide fold or domain or sub-domain
EKIINFKLKVVIKSYDIKIKKFNLFIFDK

SEQ ID NO: 3951 - protein, 28 aa, artificial
  peptide fold or domain or sub-domain
EKIITIGTKINLKDDDLIKYGDYMAKVK

SEQ ID NO: 3952 - protein, 30 aa, artificial
  peptide fold or domain or sub-domain
EKINERMKLLQDLVPGCNKITGKAMMLDEI

SEQ ID NO: 3953 - protein, 27 aa, artificial
  peptide fold or domain or sub-domain
EKKAFAEVKNFEKKPENVRVGILKGMI

SEQ ID NO: 3954 - protein, 20 aa, artificial
  peptide fold or domain or sub-domain
EKKCNGFRCPNGTCIPSSKH

SEQ ID NO: 3955 - protein, 28 aa, artificial
  peptide fold or domain or sub-domain
EKKFLDNIIDAITEQNIEYFEEIVHEYD

SEQ ID NO: 3956 - protein, 23 aa, artificial
  peptide fold or domain or sub-domain
EKKHSDLFDKLTSVAGVGPVNRH

SEQ ID NO: 3957 - protein, 22 aa, artificial
  peptide fold or domain or sub-domain
EKKSFLELELIQKILFPDFFTR

SEQ ID NO: 3958 - protein, 24 aa, artificial
  peptide fold or domain or sub-domain
EKKSPVSNCNKRVVGYYSRSETSK

SEQ ID NO: 3959 - protein, 24 aa, artificial
  peptide fold or domain or sub-domain
EKKYSKNTNFYIQDKKNKKKLLNM

SEQ ID NO: 3960 - protein, 25 aa, artificial
  peptide fold or domain or sub-domain
EKLAEVLESVEEWSEERIKQALVEF

SEQ ID NO: 3961 - protein, 25 aa, artificial
  peptide fold or domain or sub-domain
EKLDWSKIAKKSDLIPESPQVCGVG

SEQ ID NO: 3962 - protein, 29 aa, artificial
  peptide fold or domain or sub-domain
EKLERDAHGNVKLSGSDLPAALERALAEG

SEQ ID NO: 3963 - protein, 22 aa, artificial
  peptide fold or domain or sub-domain
EKLGDPTVDPHGDPIPNADLEP

SEQ ID NO: 3964 - protein, 21 aa, artificial
  peptide fold or domain or sub-domain
EKLHHNKNINHNLGVTAGVMA

SEQ ID NO: 3965 - protein, 27 aa, artificial
  peptide fold or domain or sub-domain
EKLKELFVGHYVGEVGVQASELACTRF

SEQ ID NO: 3966 - protein, 23 aa, artificial
  peptide fold or domain or sub-domain
EKLKICLSLSEECIKPEELLNLL

SEQ ID NO: 3967 - protein, 28 aa, artificial
  peptide fold or domain or sub-domain
EKLLFTTNGNSNDVSVIDVPELKVVKSI

SEQ ID NO: 3968 - protein, 30 aa, artificial
  peptide fold or domain or sub-domain
EKLLWPMSVEEMYGIGEKTAQKLNSIEIKT

SEQ ID NO: 3969 - protein, 30 aa, artificial
  peptide fold or domain or sub-domain
EKLPEEIKILADTHASAQDRLTALKWVVHL

SEQ ID NO: 3970 - protein, 29 aa, artificial
  peptide fold or domain or sub-domain
EKMKDLKRAAVTASNPDEERDASHLLNKL

SEQ ID NO: 3971 - protein, 25 aa, artificial
  peptide fold or domain or sub-domain
EKMQPSPALNDLFPTARFKGDMAAG

SEQ ID NO: 3972 - protein, 20 aa, artificial
  peptide fold or domain or sub-domain
EKNFYVEHPEVKAMTQQEAD

SEQ ID NO: 3973 - protein, 28 aa, artificial
  peptide fold or domain or sub-domain
EKNWTQCTRCQAMMKELGYQKASQLMIP

SEQ ID NO: 3974 - protein, 21 aa, artificial
  peptide fold or domain or sub-domain
EKPVTLFSSEGKLGQCDNALR

SEQ ID NO: 3975 - protein, 25 aa, artificial
  peptide fold or domain or sub-domain
EKQFNQLIDKLVTRRKGKTDPQTAA

SEQ ID NO: 3976 - protein, 29 aa, artificial
  peptide fold or domain or sub-domain
EKQSEKKLTKFCFSGPISKLSNTDVLQVA

SEQ ID NO: 3977 - protein, 29 aa, artificial
  peptide fold or domain or sub-domain
EKRAFIKKLIASEKNKEKKELLLVQSLSI

SEQ ID NO: 3978 - protein, 30 aa, artificial
  peptide fold or domain or sub-domain
EKRDEVIMSNPHYSCYPNFVKHLGGTPVFV

SEQ ID NO: 3979 - protein, 23 aa, artificial
  peptide fold or domain or sub-domain
EKRSWLRARGLKIFPLVGWAERG

SEQ ID NO: 3980 - protein, 27 aa, artificial
  peptide fold or domain or sub-domain
EKRTVNFGVDGPTLSSADLDNWKEFEG

SEQ ID NO: 3981 - protein, 22 aa, artificial
  peptide fold or domain or sub-domain
EKSDRITVVEMLEQVAKDLGQL

SEQ ID NO: 3982 - protein, 24 aa, artificial
  peptide fold or domain or sub-domain
EKSFTCLYAEGDTAYLIEPNTFEQ

SEQ ID NO: 3983 - protein, 23 aa, artificial
  peptide fold or domain or sub-domain
EKSKLPEMDDAFLELFGVKEGGV

SEQ ID NO: 3984 - protein, 20 aa, artificial
  peptide fold or domain or sub-domain
EKSLKQLSERTNKPVSLLKL

SEQ ID NO: 3985 - protein, 27 aa, artificial
  peptide fold or domain or sub-domain
EKTIMRSQLEAEGKKADQIEKILPGKI

SEQ ID NO: 3986 - protein, 28 aa, artificial
  peptide fold or domain or sub-domain
EKTKETRELILRNLQESLGVDKLTKQLE

SEQ ID NO: 3987 - protein, 26 aa, artificial
  peptide fold or domain or sub-domain
EKTRTDIQTALGEDPESRLFLEQKRL

SEQ ID NO: 3988 - protein, 30 aa, artificial
  peptide fold or domain or sub-domain
EKVERIYFGVEGEELRRTYELSMPKKPERL

SEQ ID NO: 3989 - protein, 27 aa, artificial
  peptide fold or domain or sub-domain
EKVERVERNGETFTVIAEGGEYEAKAI

SEQ ID NO: 3990 - protein, 28 aa, artificial
  peptide fold or domain or sub-domain
EKVKVKCYKSGCQDVVKYDERQNHISKC

SEQ ID NO: 3991 - protein, 27 aa, artificial
  peptide fold or domain or sub-domain
EKVLSKQETEDSRGRKKWEYETDPSVT

SEQ ID NO: 3992 - protein, 25 aa, artificial
  peptide fold or domain or sub-domain
EKVSLVPVEIGDRHPGAVGIDYPHL

SEQ ID NO: 3993 - protein, 22 aa, artificial
  peptide fold or domain or sub-domain
EKYEGTRIRRLMAEGGDWAQYV

SEQ ID NO: 3994 - protein, 23 aa, artificial
  peptide fold or domain or sub-domain
EKYELITRNLQEVLGAKMIREIL

SEQ ID NO: 3995 - protein, 28 aa, artificial
  peptide fold or domain or sub-domain
EKYELITRNLQEVLGAKMIREILNERDI

SEQ ID NO: 3996 - protein, 24 aa, artificial
  peptide fold or domain or sub-domain
ELADTFKIVRETNPQGLIMANVGA

SEQ ID NO: 3997 - protein, 27 aa, artificial
  peptide fold or domain or sub-domain
ELAFQSYKRDYARRDGSDAESRYWRER

SEQ ID NO: 3998 - protein, 22 aa, artificial
  peptide fold or domain or sub-domain
ELAFTDSLITRNFSNYSSWHYR

SEQ ID NO: 3999 - protein, 30 aa, artificial
  peptide fold or domain or sub-domain
ELAKLPLFDRLAQRIVDGERNGLDVDLDEA

SEQ ID NO: 4000 - protein, 26 aa, artificial
  peptide fold or domain or sub-domain
ELAQYREVAAFLDAATQQLLSRGVRL

SEQ ID NO: 4001 - protein, 26 aa, artificial
  peptide fold or domain or sub-domain
ELARADFQKVLQLYPNNKAAKTQLAV

SEQ ID NO: 4002 - protein, 22 aa, artificial
  peptide fold or domain or sub-domain
ELAYASDLIETDIYNNSAWTHR

SEQ ID NO: 4003 - protein, 29 aa, artificial
  peptide fold or domain or sub-domain
ELCDIFDKNEGEFKGLNIEKMKEIFVAKL

SEQ ID NO: 4004 - protein, 24 aa, artificial
  peptide fold or domain or sub-domain
ELDEKRTEEHNVVVLVDFAIALMT

SEQ ID NO: 4005 - protein, 30 aa, artificial
  peptide fold or domain or sub-domain
ELDENIGNWLPDFQPRLADGRLARITVRQL

SEQ ID NO: 4006 - protein, 27 aa, artificial
  peptide fold or domain or sub-domain
ELEFCTEKIHNNFSNYSSWHYRSKLLP

SEQ ID NO: 4007 - protein, 30 aa, artificial
  peptide fold or domain or sub-domain
ELEGKRPPLMISGKSLPSFTSFETSPKSGG

SEQ ID NO: 4008 - protein, 30 aa, artificial
  peptide fold or domain or sub-domain
ELEGSCIPKTFTGKTLPGFLFNSLDPISNG

SEQ ID NO: 4009 - protein, 30 aa, artificial
  peptide fold or domain or sub-domain
ELELTPEQLEGYPEGAIDALNYEGAQLGIP

SEQ ID NO: 4010 - protein, 22 aa, artificial
  peptide fold or domain or sub-domain
ELEMPWPARRAARDECACGDVR

SEQ ID NO: 4011 - protein, 27 aa, artificial
  peptide fold or domain or sub-domain
ELEPSHSTLMNELWPHRYPNSEKYIEL

SEQ ID NO: 4012 - protein, 27 aa, artificial
  peptide fold or domain or sub-domain
ELEVIECKLYDEDSYVPTAYGLLDPRL

SEQ ID NO: 4013 - protein, 27 aa, artificial
  peptide fold or domain or sub-domain
ELEVVTASGDLLTCSPVRRPELFDAVR

SEQ ID NO: 4014 - protein, 23 aa, artificial
  peptide fold or domain or sub-domain
ELFHVDLESKSVVWTLPGLEKYT

SEQ ID NO: 4015 - protein, 23 aa, artificial
  peptide fold or domain or sub-domain
ELFYADFNKGVAVDALPDFADPI

SEQ ID NO: 4016 - protein, 29 aa, artificial
  peptide fold or domain or sub-domain
ELFYFKNRFFLCTSASYKIAERTVIADFW

SEQ ID NO: 4017 - protein, 26 aa, artificial
  peptide fold or domain or sub-domain
ELGATGRGEHMEIGTYIEQSLASELA

SEQ ID NO: 4018 - protein, 27 aa, artificial
  peptide fold or domain or sub-domain
ELGAYESKYSKYYKWYRFYDYPNSYEC

SEQ ID NO: 4019 - protein, 23 aa, artificial
  peptide fold or domain or sub-domain
ELGEQIRTLGMPLPELTVFGMML

SEQ ID NO: 4020 - protein, 29 aa, artificial
  peptide fold or domain or sub-domain
ELHFFKDGRYWKISGNGERKGPFMISAKW

SEQ ID NO: 4021 - protein, 22 aa, artificial
  peptide fold or domain or sub-domain
ELHFIEACLKVNPKSYGCWHHR

SEQ ID NO: 4022 - protein, 21 aa, artificial
  peptide fold or domain or sub-domain
ELHGGDLPRDQNALQALPGIG

SEQ ID NO: 4023 - protein, 29 aa, artificial
  peptide fold or domain or sub-domain
ELHGGDLPRDQNALQALPGIGRSTTAAIL

SEQ ID NO: 4024 - protein, 29 aa, artificial
  peptide fold or domain or sub-domain
ELHSDQGRNFEAKVFSEVCRRLGIKKTRT

SEQ ID NO: 4025 - protein, 22 aa, artificial
  peptide fold or domain or sub-domain
ELHYAAFTEAGLPPEEVPGAAA

SEQ ID NO: 4026 - protein, 29 aa, artificial
  peptide fold or domain or sub-domain
ELIADLIEDGNEARQVDIAARLGVAQPTV

SEQ ID NO: 4027 - protein, 27 aa, artificial
  peptide fold or domain or sub-domain
ELIAPRVGGVIASDGSEIAAHQMIDGG

SEQ ID NO: 4028 - protein, 26 aa, artificial
  peptide fold or domain or sub-domain
ELIAVRIAKIAKLSAEKAEETRQEFL

SEQ ID NO: 4029 - protein, 28 aa, artificial
  peptide fold or domain or sub-domain
ELIAYYDYNQRKYIAVKAWMKSNVDRWN

SEQ ID NO: 4030 - protein, 25 aa, artificial
  peptide fold or domain or sub-domain
ELILVTKKQPKANFSEIAKLTRDVK

SEQ ID NO: 4031 - protein, 23 aa, artificial
  peptide fold or domain or sub-domain
ELISPKGKKMRGEDFMRGYRPQL

SEQ ID NO: 4032 - protein, 28 aa, artificial
  peptide fold or domain or sub-domain
ELITAINVFRTAMVGFGQLTDLPPGQIR

SEQ ID NO: 4033 - protein, 30 aa, artificial
  peptide fold or domain or sub-domain
ELKDGEKALEPFIDTAKSAVTFDGKVYGYP

SEQ ID NO: 4034 - protein, 26 aa, artificial
  peptide fold or domain or sub-domain
ELKEERLRTLSQELEELTFGGKTEEE

SEQ ID NO: 4035 - protein, 23 aa, artificial
  peptide fold or domain or sub-domain
ELKERAMMALTDDCLLYTGSEKA

SEQ ID NO: 4036 - protein, 27 aa, artificial
  peptide fold or domain or sub-domain
ELKERFEQFCEIYQVNKKGRTYALNLI

SEQ ID NO: 4037 - protein, 23 aa, artificial
  peptide fold or domain or sub-domain
ELKIDTGEIDSLLEKEEQCLKYI

SEQ ID NO: 4038 - protein, 27 aa, artificial
  peptide fold or domain or sub-domain
ELKIEAGKGHVRVFYNGEEKMNWKVSR

SEQ ID NO: 4039 - protein, 30 aa, artificial
  peptide fold or domain or sub-domain
ELKLDQTFLSSFTKPALEAQTYNGKLYGVP

SEQ ID NO: 4040 - protein, 24 aa, artificial
  peptide fold or domain or sub-domain
ELKNQQLQSQQTFNLTLKDINQKF

SEQ ID NO: 4041 - protein, 23 aa, artificial
  peptide fold or domain or sub-domain
ELKRRRDESVVFCPDPEATKEMV

SEQ ID NO: 4042 - protein, 27 aa, artificial
  peptide fold or domain or sub-domain
ELLAFVDHSIPGANNRVPDDVSVDIVV

SEQ ID NO: 4043 - protein, 27 aa, artificial
  peptide fold or domain or sub-domain
ELLENIISKGSSRDAMDNFVAFMGRKP

SEQ ID NO: 4044 - protein, 26 aa, artificial
  peptide fold or domain or sub-domain
ELLGVANNRIMRMDLNTGDHIKTWRY

SEQ ID NO: 4045 - protein, 28 aa, artificial
  peptide fold or domain or sub-domain
ELLHEITQASQRQGVPFREALLGQPRLR

SEQ ID NO: 4046 - protein, 20 aa, artificial
  peptide fold or domain or sub-domain
ELLLLEASDWPFLMETGQAE

SEQ ID NO: 4047 - protein, 23 aa, artificial
  peptide fold or domain or sub-domain
ELLPDWAARIQTKVAVRGQVARN

SEQ ID NO: 4048 - protein, 23 aa, artificial
  peptide fold or domain or sub-domain
ELLRANQELGRVKVYKGKKDSVP

SEQ ID NO: 4049 - protein, 22 aa, artificial
  peptide fold or domain or sub-domain
ELLSNTLSRAGVADADLNAAIW

SEQ ID NO: 4050 - protein, 30 aa, artificial
  peptide fold or domain or sub-domain
ELLVNVPRIDMIYKAESYYLAEKPEKVNEM

SEQ ID NO: 4051 - protein, 20 aa, artificial
  peptide fold or domain or sub-domain
ELMLAEASDWSFIIKNNTTV

SEQ ID NO: 4052 - protein, 21 aa, artificial
  peptide fold or domain or sub-domain
ELMWDNAVWVHPQTAQEKGIK

SEQ ID NO: 4053 - protein, 29 aa, artificial
  peptide fold or domain or sub-domain
ELNEFLSQNDAEFKLIKRSAQRQYIKNKL

SEQ ID NO: 4054 - protein, 23 aa, artificial
  peptide fold or domain or sub-domain
ELNPTENIEKLSDIQRYVTQERG

SEQ ID NO: 4055 - protein, 23 aa, artificial
  peptide fold or domain or sub-domain
ELPPKFKILARSETCPIEAMKHE

SEQ ID NO: 4056 - protein, 26 aa, artificial
  peptide fold or domain or sub-domain
ELPQALEPIVLNDSATTIDIWCVPFH

SEQ ID NO: 4057 - protein, 26 aa, artificial
  peptide fold or domain or sub-domain
ELPWQNLTLEKREEKFEQIKHLKIET

SEQ ID NO: 4058 - protein, 26 aa, artificial
  peptide fold or domain or sub-domain
ELPWSNVKAADKDDKYEQILQIKMGL

SEQ ID NO: 4059 - protein, 23 aa, artificial
  peptide fold or domain or sub-domain
ELQAVTEESPVRCFDPEAGQKMM

SEQ ID NO: 4060 - protein, 26 aa, artificial
  peptide fold or domain or sub-domain
ELQEDFESEKASRNKAEKQKRDLSEE

SEQ ID NO: 4061 - protein, 27 aa, artificial
  peptide fold or domain or sub-domain
ELQIAREKALEAGKPENLLDRIAQGAL

SEQ ID NO: 4062 - protein, 23 aa, artificial
  peptide fold or domain or sub-domain
ELQPAGKKRMAVGEFLRGAGSRL

SEQ ID NO: 4063 - protein, 23 aa, artificial
  peptide fold or domain or sub-domain
ELQSDNGRERFGAVGGGFGGLGQ

SEQ ID NO: 4064 - protein, 24 aa, artificial
  peptide fold or domain or sub-domain
ELQTALSEPTPGYIVTHPSVAPHA

SEQ ID NO: 4065 - protein, 29 aa, artificial
  peptide fold or domain or sub-domain
ELQTDNGPNFKNQKMEGLLNYMGIKHKLG

SEQ ID NO: 4066 - protein, 22 aa, artificial
  peptide fold or domain or sub-domain
ELQYVDQLLKEDVRNNSVWNQR

SEQ ID NO: 4067 - protein, 23 aa, artificial
  peptide fold or domain or sub-domain
ELRAGAERLDALLADEERCLSCI

SEQ ID NO: 4068 - protein, 29 aa, artificial
  peptide fold or domain or sub-domain
ELRLNIKNIIKGEKNETRRVQLSTRQLAL

SEQ ID NO: 4069 - protein, 27 aa, artificial
  peptide fold or domain or sub-domain
ELRRKHKLELEKLTNDDARASRVAELN

SEQ ID NO: 4070 - protein, 29 aa, artificial
  peptide fold or domain or sub-domain
ELRTLDALIFFETNGLVCPANWHEGERAM

SEQ ID NO: 4071 - protein, 24 aa, artificial
  peptide fold or domain or sub-domain
ELSAGLDDKANAVLIVKPRTASFQ

SEQ ID NO: 4072 - protein, 30 aa, artificial
  peptide fold or domain or sub-domain
ELSDDELVQQMHDDLYDGLKEEIEEGTRIL

SEQ ID NO: 4073 - protein, 23 aa, artificial
  peptide fold or domain or sub-domain
ELSDDEWREILDPEAFRVARKAG

SEQ ID NO: 4074 - protein, 24 aa, artificial
  peptide fold or domain or sub-domain
ELSEMVRAALNNDWATARKLHNHF

SEQ ID NO: 4075 - protein, 26 aa, artificial
  peptide fold or domain or sub-domain
ELSEMVRAALNNDWATARKLHNHFLA

SEQ ID NO: 4076 - protein, 27 aa, artificial
  peptide fold or domain or sub-domain
ELSGIGDPEVLAASGVQCLVENRAVGA

SEQ ID NO: 4077 - protein, 27 aa, artificial
  peptide fold or domain or sub-domain
ELSGIGHPETLKAAGIPVVHALSGVGN

SEQ ID NO: 4078 - protein, 27 aa, artificial
  peptide fold or domain or sub-domain
ELSGVGSPDILQLLDRTGNIFRPALGQ

SEQ ID NO: 4079 - protein, 27 aa, artificial
  peptide fold or domain or sub-domain
ELSIDYTEVIGKKWSKMSAEEFVQVAG

SEQ ID NO: 4080 - protein, 30 aa, artificial
  peptide fold or domain or sub-domain
ELSLDDITEKVLLMGWVKAAKELEVSESTL

SEQ ID NO: 4081 - protein, 30 aa, artificial
  peptide fold or domain or sub-domain
ELSMAEQYPKPSISQMFEHVYENQPWYVKE

SEQ ID NO: 4082 - protein, 24 aa, artificial
  peptide fold or domain or sub-domain
ELSQAIKKDADCFMAMHPQSAVQA

SEQ ID NO: 4083 - protein, 29 aa, artificial
  peptide fold or domain or sub-domain
ELSRMIRESRESRLPRQRTSSGMGVVNYT

SEQ ID NO: 4084 - protein, 29 aa, artificial
  peptide fold or domain or sub-domain
ELSRVLHASRSERSGKRRVAAGNKYWTYM

SEQ ID NO: 4085 - protein, 20 aa, artificial
  peptide fold or domain or sub-domain
ELSSSDVRQRLGAQKSIQYM

SEQ ID NO: 4086 - protein, 22 aa, artificial
  peptide fold or domain or sub-domain
ELTFALHMLLLDNRNNSAYNYR

SEQ ID NO: 4087 - protein, 23 aa, artificial
  peptide fold or domain or sub-domain
ELTHVDNLLSDGFKLSPHALHSW

SEQ ID NO: 4088 - protein, 28 aa, artificial
  peptide fold or domain or sub-domain
ELTIQEDPENIDGLNFLAGKTLDEVNKK

SEQ ID NO: 4089 - protein, 27 aa, artificial
  peptide fold or domain or sub-domain
ELTKDDERYPGHDPRYAKLSEKELPLT

SEQ ID NO: 4090 - protein, 23 aa, artificial
  peptide fold or domain or sub-domain
ELTLNDNMWDDGNSLGPKEIHNY

SEQ ID NO: 4091 - protein, 23 aa, artificial
  peptide fold or domain or sub-domain
ELTTEDFCEDDGTTRDAEEIYQY

SEQ ID NO: 4092 - protein, 21 aa, artificial
  peptide fold or domain or sub-domain
ELVELVFEGFPWENHDVLWRH

SEQ ID NO: 4093 - protein, 29 aa, artificial
  peptide fold or domain or sub-domain
ELVFFKDRFIWRVHPSFDEIRITLITSLW

SEQ ID NO: 4094 - protein, 23 aa, artificial
  peptide fold or domain or sub-domain
ELVKNEDKMTEAVAEANKVLGAV

SEQ ID NO: 4095 - protein, 30 aa, artificial
  peptide fold or domain or sub-domain
ELVMGEDIQSLYTEAAMLSQIVDGKVYGLP

SEQ ID NO: 4096 - protein, 24 aa, artificial
  peptide fold or domain or sub-domain
ELVRGLKETLNPHMCRGFVDSFLV

SEQ ID NO: 4097 - protein, 30 aa, artificial
  peptide fold or domain or sub-domain
ELVSVHEGVTVDDVRAQTGWELKVADDLTV

SEQ ID NO: 4098 - protein, 27 aa, artificial
  peptide fold or domain or sub-domain
ELVVDYAEVTGQSWDAMPAKDFIAMVS

SEQ ID NO: 4099 - protein, 24 aa, artificial
  peptide fold or domain or sub-domain
ELVYLYRNGKDLLGETIYNFVERT

SEQ ID NO: 4100 - protein, 23 aa, artificial
  peptide fold or domain or sub-domain
ELWYADFINKRGVEPQPSFIDHM

SEQ ID NO: 4101 - protein, 26 aa, artificial
  peptide fold or domain or sub-domain
ELYAHTQAGKRFTELYPSIPCDKTFQ

SEQ ID NO: 4102 - protein, 20 aa, artificial
  peptide fold or domain or sub-domain
ELYLDPESEVGVTYMSMKRR

SEQ ID NO: 4103 - protein, 27 aa, artificial
  peptide fold or domain or sub-domain
ELYLHKQEEIDALPTREERLNRLAEIN

SEQ ID NO: 4104 - protein, 27 aa, artificial
  peptide fold or domain or sub-domain
ELYRHHFRLLCDALAQWMGGTISPQGM

SEQ ID NO: 4105 - protein, 29 aa, artificial
  peptide fold or domain or sub-domain
ELYRMGARTITDLRTGRFPLSTGQQIGLA

SEQ ID NO: 4106 - protein, 27 aa, artificial
  peptide fold or domain or sub-domain
ELYYMGVEGETFEIEDGEAVYKDHILN

SEQ ID NO: 4107 - protein, 29 aa, artificial
  peptide fold or domain or sub-domain
EMACRLCLENGYTRINKLAELLNVRPSSA

SEQ ID NO: 4108 - protein, 22 aa, artificial
  peptide fold or domain or sub-domain
EMDNQHNDGPSEKTKRFLSIQE

SEQ ID NO: 4109 - protein, 27 aa, artificial
  peptide fold or domain or sub-domain
EMDVITGHGEMVTCSKQLNADLFDAVL

SEQ ID NO: 4110 - protein, 24 aa, artificial
  peptide fold or domain or sub-domain
EMEEQLVYLRDSFGLKTLLARGAI

SEQ ID NO: 4111 - protein, 30 aa, artificial
  peptide fold or domain or sub-domain
EMFWCGECDACRSVDFNHCLRLNDPADLEF

SEQ ID NO: 4112 - protein, 24 aa, artificial
  peptide fold or domain or sub-domain
EMGAEIAGRLAATGSIDRSANLGV

SEQ ID NO: 4113 - protein, 22 aa, artificial
  peptide fold or domain or sub-domain
EMGRAQVFQAEAAGVFPDVRMN

SEQ ID NO: 4114 - protein, 21 aa, artificial
  peptide fold or domain or sub-domain
EMIQMLFSGRENEQLEATQKF

SEQ ID NO: 4115 - protein, 22 aa, artificial
  peptide fold or domain or sub-domain
EMLDNPHYDPHDKLIPEKPNKK

SEQ ID NO: 4116 - protein, 24 aa, artificial
  peptide fold or domain or sub-domain
EMLKRDEIDIDEKLYNIFVKLEAE

SEQ ID NO: 4117 - protein, 23 aa, artificial
  peptide fold or domain or sub-domain
EMLYIYILSVLNKAHQKNDIALL

SEQ ID NO: 4118 - protein, 24 aa, artificial
  peptide fold or domain or sub-domain
EMMEICSYALKGDFINARSINKRL

SEQ ID NO: 4119 - protein, 26 aa, artificial
  peptide fold or domain or sub-domain
EMMEICSYALKGDFINARSINKRLML

SEQ ID NO: 4120 - protein, 30 aa, artificial
  peptide fold or domain or sub-domain
EMPLGQVPVLEIDGVKISQTTAIARYLGHQ

SEQ ID NO: 4121 - protein, 24 aa, artificial
  peptide fold or domain or sub-domain
EMQEMVQLFLSGQVERAAAIHRKL

SEQ ID NO: 4122 - protein, 26 aa, artificial
  peptide fold or domain or sub-domain
EMQEMVQLFLSGQVERAAAIHRKLLP

SEQ ID NO: 4123 - protein, 27 aa, artificial
  peptide fold or domain or sub-domain
EMQENNSTEMTLKIDSKKAIDKFTIWL

SEQ ID NO: 4124 - protein, 27 aa, artificial
  peptide fold or domain or sub-domain
EMQFVDINGTLRSVTHNSEHDLWWALR

SEQ ID NO: 4125 - protein, 27 aa, artificial
  peptide fold or domain or sub-domain
EMSIDHPDYPGKDSRYKHIPPSSLPKG

SEQ ID NO: 4126 - protein, 23 aa, artificial
  peptide fold or domain or sub-domain
EMTNQTYLNDDKINYTPRDYGNY

SEQ ID NO: 4127 - protein, 27 aa, artificial
  peptide fold or domain or sub-domain
EMTVLTPAGEIKTVTREDSEEWMKYMF

SEQ ID NO: 4128 - protein, 27 aa, artificial
  peptide fold or domain or sub-domain
EMVEKIVHLDDTFRIKTESWEYVCRAL

SEQ ID NO: 4129 - protein, 22 aa, artificial
  peptide fold or domain or sub-domain
EMVHRALADAGVSDADAPAVCL

SEQ ID NO: 4130 - protein, 23 aa, artificial
  peptide fold or domain or sub-domain
EMWHSDFKLKQGVATLPEFADPI

SEQ ID NO: 4131 - protein, 23 aa, artificial
  peptide fold or domain or sub-domain
ENAIEKNCSGPYKEGLLTLIKGN

SEQ ID NO: 4132 - protein, 25 aa, artificial
  peptide fold or domain or sub-domain
ENASVGRVPDDTECNKQGGGGNHLF

SEQ ID NO: 4133 - protein, 28 aa, artificial
  peptide fold or domain or sub-domain
ENDGVVLRATASEVVVQYDDMQVKKYKL

SEQ ID NO: 4134 - protein, 26 aa, artificial
  peptide fold or domain or sub-domain
ENEKKKANIALIEKQTKIIKFGTVFQ

SEQ ID NO: 4135 - protein, 23 aa, artificial
  peptide fold or domain or sub-domain
ENGERHDGAQGLPALKDGGKPVR

SEQ ID NO: 4136 - protein, 26 aa, artificial
  peptide fold or domain or sub-domain
ENGHVAKVAVLGLAQARDPQLAAWIE

SEQ ID NO: 4137 - protein, 26 aa, artificial
  peptide fold or domain or sub-domain
ENGKVLRDLVLGIAALYPSEFSDWLR

SEQ ID NO: 4138 - protein, 27 aa, artificial
  peptide fold or domain or sub-domain
ENGVRENLALVYEIYPQDMNLAQIFAR

SEQ ID NO: 4139 - protein, 21 aa, artificial
  peptide fold or domain or sub-domain
ENGYRYGSEIVYITKEEEEAI

SEQ ID NO: 4140 - protein, 21 aa, artificial
  peptide fold or domain or sub-domain
ENHIHHTFWCYNANSGDTGGL

SEQ ID NO: 4141 - protein, 23 aa, artificial
  peptide fold or domain or sub-domain
ENIDKLLSNIAIMEPPLGLQDKL

SEQ ID NO: 4142 - protein, 27 aa, artificial
  peptide fold or domain or sub-domain
ENIHLTSDDVLKRVIIISSDQNVEYGI

SEQ ID NO: 4143 - protein, 26 aa, artificial
  peptide fold or domain or sub-domain
ENIINVCKQVDIAYDLELGKTLSEIR

SEQ ID NO: 4144 - protein, 28 aa, artificial
  peptide fold or domain or sub-domain
ENIKDILVNSKLSKSKNNAKSVILSSSI

SEQ ID NO: 4145 - protein, 29 aa, artificial
  peptide fold or domain or sub-domain
ENIVITRDPDFHAEGITIWHDLDRLADYA

SEQ ID NO: 4146 - protein, 28 aa, artificial
  peptide fold or domain or sub-domain
ENIYYNGLRYPLSGESLSIDTNTGARNY

SEQ ID NO: 4147 - protein, 20 aa, artificial
  peptide fold or domain or sub-domain
ENKDKINEILREHKEHVREY

SEQ ID NO: 4148 - protein, 27 aa, artificial
  peptide fold or domain or sub-domain
ENKTCDPQCADIGCWGPGPRQCAKCKN

SEQ ID NO: 4149 - protein, 23 aa, artificial
  peptide fold or domain or sub-domain
ENLIFERGEGVYLWDIYGRKYID

SEQ ID NO: 4150 - protein, 29 aa, artificial
  peptide fold or domain or sub-domain
ENLTEKNGLDIQWTEDFQPSSMADLSIQL

SEQ ID NO: 4151 - protein, 20 aa, artificial
  peptide fold or domain or sub-domain
ENLTNFAAIAEGTKNLYAPA

SEQ ID NO: 4152 - protein, 25 aa, artificial
  peptide fold or domain or sub-domain
ENQTRNKHINPNEWWKVYPSSVTEF

SEQ ID NO: 4153 - protein, 28 aa, artificial
  peptide fold or domain or sub-domain
ENRAALWNYGYDTDANYYQTIRTAIALR

SEQ ID NO: 4154 - protein, 24 aa, artificial
  peptide fold or domain or sub-domain
ENREFYVSNINEFIEEPKKYSLSV

SEQ ID NO: 4155 - protein, 28 aa, artificial
  peptide fold or domain or sub-domain
ENRLVRKIIEANDNGSLTAFDTAVYEYR

SEQ ID NO: 4156 - protein, 30 aa, artificial
  peptide fold or domain or sub-domain
ENRLWPLPIRKLYGIGPKTEEHLKALNIAT

SEQ ID NO: 4157 - protein, 22 aa, artificial
  peptide fold or domain or sub-domain
ENRQILVPLTSSMYVPGRVKDL

SEQ ID NO: 4158 - protein, 23 aa, artificial
  peptide fold or domain or sub-domain
ENSSRMLRLDASQEQFEQAQMAM

SEQ ID NO: 4159 - protein, 20 aa, artificial
  peptide fold or domain or sub-domain
ENTKEEKFWMNKSTSKSVQM

SEQ ID NO: 4160 - protein, 20 aa, artificial
  peptide fold or domain or sub-domain
ENTRKEPFYKVDGQSCPVPM

SEQ ID NO: 4161 - protein, 23 aa, artificial
  peptide fold or domain or sub-domain
ENTVILKKNTAEVVTLEECKDLV

SEQ ID NO: 4162 - protein, 28 aa, artificial
  peptide fold or domain or sub-domain
ENTVILKKNTAEVVTLEECKDLVPDNSE

SEQ ID NO: 4163 - protein, 25 aa, artificial
  peptide fold or domain or sub-domain
ENVEDLLSFTWRNWRDGTAVNIVDP

SEQ ID NO: 4164 - protein, 20 aa, artificial
  peptide fold or domain or sub-domain
ENVGNIEEKIISAKQNAEEV

SEQ ID NO: 4165 - protein, 25 aa, artificial
  peptide fold or domain or sub-domain
ENWVAPNDAALQTKRKWDDLQVLKE

SEQ ID NO: 4166 - protein, 21 aa, artificial
  peptide fold or domain or sub-domain
ENYQGRKVTEYIDLGTVAKSG

SEQ ID NO: 4167 - protein, 24 aa, artificial
  peptide fold or domain or sub-domain
ENYVGLVSPIPNEQRADIENLIAP

SEQ ID NO: 4168 - protein, 23 aa, artificial
  peptide fold or domain or sub-domain
EPAIYVKGEGMRITDIDGKTYLD

SEQ ID NO: 4169 - protein, 25 aa, artificial
  peptide fold or domain or sub-domain
EPCEKTYCSWGATCVVSENGKPLCQ

SEQ ID NO: 4170 - protein, 22 aa, artificial
  peptide fold or domain or sub-domain
EPDLRSVEAKAAELSGYLVTGH

SEQ ID NO: 4171 - protein, 30 aa, artificial
  peptide fold or domain or sub-domain
EPDTAIKRVNSRNMSNKFDRRRIDFYKKIY

SEQ ID NO: 4172 - protein, 27 aa, artificial
  peptide fold or domain or sub-domain
EPEELREALVDDGAGDSMEVVNDILQE

SEQ ID NO: 4173 - protein, 21 aa, artificial
  peptide fold or domain or sub-domain
EPFKWYKDTGPGQTTWRPNAF

SEQ ID NO: 4174 - protein, 30 aa, artificial
  peptide fold or domain or sub-domain
EPFRIVEADDHFRLQAAIGGDWRSLYRFDL

SEQ ID NO: 4175 - protein, 30 aa, artificial
  peptide fold or domain or sub-domain
EPFVFTHQGATWTWDAVASMRDIPYPSSPE

SEQ ID NO: 4176 - protein, 30 aa, artificial
  peptide fold or domain or sub-domain
EPFYFTHQSLPWVLDPLRYIAGLSYPWTAG

SEQ ID NO: 4177 - protein, 30 aa, artificial
  peptide fold or domain or sub-domain
EPGDEVILPDPIYPGYEPLIKLNKARPVKV

SEQ ID NO: 4178 - protein, 20 aa, artificial
  peptide fold or domain or sub-domain
EPGNHALVIEARRQDVGGKA

SEQ ID NO: 4179 - protein, 30 aa, artificial
  peptide fold or domain or sub-domain
EPHTFTHQGASWGSAYWLRTQDLPFPATPE

SEQ ID NO: 4180 - protein, 20 aa, artificial
  peptide fold or domain or sub-domain
EPHVKRFEDANDDYSAILLK

SEQ ID NO: 4181 - protein, 23 aa, artificial
  peptide fold or domain or sub-domain
EPIFIKDLAITGNDLITELNFKP

SEQ ID NO: 4182 - protein, 23 aa, artificial
  peptide fold or domain or sub-domain
EPIRIVRGDGCHVYDERGRQLVD

SEQ ID NO: 4183 - protein, 28 aa, artificial
  peptide fold or domain or sub-domain
EPIWELVEPWGLGLDDLQYFGEYTAKVK

SEQ ID NO: 4184 - protein, 23 aa, artificial
  peptide fold or domain or sub-domain
EPKDPQDAVVAEQYMKNYQVFVS

SEQ ID NO: 4185 - protein, 22 aa, artificial
  peptide fold or domain or sub-domain
EPLFERWTASGWKPADADDAID

SEQ ID NO: 4186 - protein, 26 aa, artificial
  peptide fold or domain or sub-domain
EPLIFDLIRKEGSVPEEDMRRTFNLG

SEQ ID NO: 4187 - protein, 22 aa, artificial
  peptide fold or domain or sub-domain
EPLNSTRMRELHAFGQDVSAWV

SEQ ID NO: 4188 - protein, 23 aa, artificial
  peptide fold or domain or sub-domain
EPMIIERAKGSFVYDADGRAILD

SEQ ID NO: 4189 - protein, 27 aa, artificial
  peptide fold or domain or sub-domain
EPMTRWEPYRDGVRVHTAENTYTAGQL

SEQ ID NO: 4190 - protein, 30 aa, artificial
  peptide fold or domain or sub-domain
EPRKVVTCASYEARAYGVRAGMPLRTAARR

SEQ ID NO: 4191 - protein, 28 aa, artificial
  peptide fold or domain or sub-domain
EPSKGAAKRLIQGNGCKINDNVVNNIDH

SEQ ID NO: 4192 - protein, 28 aa, artificial
  peptide fold or domain or sub-domain
EPSKRQAREDVQNGAIYVNGERRQDLAA

SEQ ID NO: 4193 - protein, 22 aa, artificial
  peptide fold or domain or sub-domain
EPSPELERYLRVFERNIASEMK

SEQ ID NO: 4194 - protein, 29 aa, artificial
  peptide fold or domain or sub-domain
EPTTIGFNKSLTEGNTINSDAMAQFKEQF

SEQ ID NO: 4195 - protein, 24 aa, artificial
  peptide fold or domain or sub-domain
EPVCMEGPNLVKKNFKPGDECKPD

SEQ ID NO: 4196 - protein, 30 aa, artificial
  peptide fold or domain or sub-domain
EPVKIRAEDILSYAPVTETRQGSTMTIGEL

SEQ ID NO: 4197 - protein, 27 aa, artificial
  peptide fold or domain or sub-domain
EPVSSIPADQRPINQNWSWDKILRSPY

SEQ ID NO: 4198 - protein, 29 aa, artificial
  peptide fold or domain or sub-domain
EPVTINARYSNILESKTEFAAQNIMQIAG

SEQ ID NO: 4199 - protein, 30 aa, artificial
  peptide fold or domain or sub-domain
EPVTNEQMEQLLSIRKEWLETMIGNRSRHF

SEQ ID NO: 4200 - protein, 30 aa, artificial
  peptide fold or domain or sub-domain
EPYRIEVQADGYMLRARVAGEWRPMYLFDL

SEQ ID NO: 4201 - protein, 30 aa, artificial
  peptide fold or domain or sub-domain
EPYRLTRHGDDHTLAAQVRGEWQPLYTFTT

SEQ ID NO: 4202 - protein, 24 aa, artificial
  peptide fold or domain or sub-domain
EQAEIRLKTLNISEPQDFIEAFLV

SEQ ID NO: 4203 - protein, 23 aa, artificial
  peptide fold or domain or sub-domain
EQAKRLLIEKKGFNEQTAHRYMQ

SEQ ID NO: 4204 - protein, 24 aa, artificial
  peptide fold or domain or sub-domain
EQALLEVIAEFGGMDTEAADEFLS

SEQ ID NO: 4205 - protein, 20 aa, artificial
  peptide fold or domain or sub-domain
EQCKRMIKNIQSDHKGRRNF

SEQ ID NO: 4206 - protein, 28 aa, artificial
  peptide fold or domain or sub-domain
EQCNDIKRPLTPEEAFKVLRGITLEDMK

SEQ ID NO: 4207 - protein, 28 aa, artificial
  peptide fold or domain or sub-domain
EQDGEVVAIDEYGIQVKYADGNVFGYQL

SEQ ID NO: 4208 - protein, 27 aa, artificial
  peptide fold or domain or sub-domain
EQDLVAEELKNSGKPEDIAQKISLGKM

SEQ ID NO: 4209 - protein, 29 aa, artificial
  peptide fold or domain or sub-domain
EQDRDLFQAFRSQAGEELVLQDNVFVEQV

SEQ ID NO: 4210 - protein, 26 aa, artificial
  peptide fold or domain or sub-domain
EQDTSAHLERMKKNMEQTVKDLQLRL

SEQ ID NO: 4211 - protein, 22 aa, artificial
  peptide fold or domain or sub-domain
EQFARWIRRGEMVCYRTGFDFK

SEQ ID NO: 4212 - protein, 23 aa, artificial
  peptide fold or domain or sub-domain
EQFQIITKGVSMLVNAEELKNKL

SEQ ID NO: 4213 - protein, 28 aa, artificial
  peptide fold or domain or sub-domain
EQFQIITKGVSMLVNAEELKNKLAESHK

SEQ ID NO: 4214 - protein, 27 aa, artificial
  peptide fold or domain or sub-domain
EQFVFEKGEYPRWDSWTSSRRTDSLSS

SEQ ID NO: 4215 - protein, 27 aa, artificial
  peptide fold or domain or sub-domain
EQFVLVDISNHLHLDPLVDLDRVVEVI

SEQ ID NO: 4216 - protein, 21 aa, artificial
  peptide fold or domain or sub-domain
EQFVRDVKSGVHEEKGWKMEP

SEQ ID NO: 4217 - protein, 23 aa, artificial
  peptide fold or domain or sub-domain
EQFYVNLDEKEMVWPLPEFIHTF

SEQ ID NO: 4218 - protein, 22 aa, artificial
  peptide fold or domain or sub-domain
EQGIALFLANGFPAELAARAYT

SEQ ID NO: 4219 - protein, 27 aa, artificial
  peptide fold or domain or sub-domain
EQGIREHYKEVMELYGYEISLHKVFAR

SEQ ID NO: 4220 - protein, 21 aa, artificial
  peptide fold or domain or sub-domain
EQGMRANVRRGSHRLAERADE

SEQ ID NO: 4221 - protein, 29 aa, artificial
  peptide fold or domain or sub-domain
EQGRMIPVFYNDKLCVVSMDSFLEKEDTA

SEQ ID NO: 4222 - protein, 28 aa, artificial
  peptide fold or domain or sub-domain
EQIQLLKRGVVDLVSEEDLKRKIEKGEP

SEQ ID NO: 4223 - protein, 29 aa, artificial
  peptide fold or domain or sub-domain
EQIYMLIEEKGYARVSDIAEALAVHPSSV

SEQ ID NO: 4224 - protein, 29 aa, artificial
  peptide fold or domain or sub-domain
EQKDASTIQAALRTRDINTSVSPPSSTRL

SEQ ID NO: 4225 - protein, 27 aa, artificial
  peptide fold or domain or sub-domain
EQKKIDSTMLSADERELIGDVDCLLRK

SEQ ID NO: 4226 - protein, 29 aa, artificial
  peptide fold or domain or sub-domain
EQKLGKAGWVAMSTSGEEQEKAVKEAIEM

SEQ ID NO: 4227 - protein, 23 aa, artificial
  peptide fold or domain or sub-domain
EQLDIIVNNTVEVISTDELERKL

SEQ ID NO: 4228 - protein, 23 aa, artificial
  peptide fold or domain or sub-domain
EQLERIKFGTADFINDEDMLKKL

SEQ ID NO: 4229 - protein, 21 aa, artificial
  peptide fold or domain or sub-domain
EQLLKKEEKRTNDQRTQNLVQ

SEQ ID NO: 4230 - protein, 29 aa, artificial
  peptide fold or domain or sub-domain
EQLRMIQQRTLDDADSSGSSAANRQLDAL

SEQ ID NO: 4231 - protein, 22 aa, artificial
  peptide fold or domain or sub-domain
EQLSERIIYSNELTDKQKALIA

SEQ ID NO: 4232 - protein, 27 aa, artificial
  peptide fold or domain or sub-domain
EQLVGKYTDGTSTVGSFEYSVIEWTDI

SEQ ID NO: 4233 - protein, 29 aa, artificial
  peptide fold or domain or sub-domain
EQLVGPDAVGGNTVTMKQLEWHLAKLGVL

SEQ ID NO: 4234 - protein, 23 aa, artificial
  peptide fold or domain or sub-domain
EQLYIYVIDEYINANINNSPRAL

SEQ ID NO: 4235 - protein, 23 aa, artificial
  peptide fold or domain or sub-domain
EQLYMFMMEQYTKANITGSPEPL

SEQ ID NO: 4236 - protein, 27 aa, artificial
  peptide fold or domain or sub-domain
EQLYVNESGWWCDGGGFNASGAPIQAA

SEQ ID NO: 4237 - protein, 26 aa, artificial
  peptide fold or domain or sub-domain
EQNARNNLLEKKQRKFDAECQSLQDA

SEQ ID NO: 4238 - protein, 25 aa, artificial
  peptide fold or domain or sub-domain
EQNEIELAEYLVELRKGKVSLSEAK

SEQ ID NO: 4239 - protein, 23 aa, artificial
  peptide fold or domain or sub-domain
EQPAAPPPLLSGKEVMALLGLTP

SEQ ID NO: 4240 - protein, 20 aa, artificial
  peptide fold or domain or sub-domain
EQPEIITKTLMLPQQAVGRI

SEQ ID NO: 4241 - protein, 28 aa, artificial
  peptide fold or domain or sub-domain
EQPEIITKTLMLPQQAVGRIIGRQGTNI

SEQ ID NO: 4242 - protein, 29 aa, artificial
  peptide fold or domain or sub-domain
EQRKVVKNQIKGQKDPQVIETLDIKQKAF

SEQ ID NO: 4243 - protein, 21 aa, artificial
  peptide fold or domain or sub-domain
EQSAVAFKGNERIFGVDASNL

SEQ ID NO: 4244 - protein, 27 aa, artificial
  peptide fold or domain or sub-domain
EQSPYRDWYHVKGFPLKAYTAHPNYEA

SEQ ID NO: 4245 - protein, 21 aa, artificial
  peptide fold or domain or sub-domain
EQTPLFKRAIGEVTDVVEKEM

SEQ ID NO: 4246 - protein, 24 aa, artificial
  peptide fold or domain or sub-domain
EQTRLAMPDENLPDFATLQKTRQH

SEQ ID NO: 4247 - protein, 24 aa, artificial
  peptide fold or domain or sub-domain
EQVAEWPVQALEYKSFLRFRVAKI

SEQ ID NO: 4248 - protein, 26 aa, artificial
  peptide fold or domain or sub-domain
EQVLVLRKRTGGPGAVLCAVPYLRAR

SEQ ID NO: 4249 - protein, 29 aa, artificial
  peptide fold or domain or sub-domain
EQVRQLKVILKQTTNPEEGAQLQQRISAL

SEQ ID NO: 4250 - protein, 28 aa, artificial
  peptide fold or domain or sub-domain
EQVSYLTKGCVDVVRPGELRAKLELSQK

SEQ ID NO: 4251 - protein, 28 aa, artificial
  peptide fold or domain or sub-domain
EQVWQYWKARALKEQKQIVAANLILVKL

SEQ ID NO: 4252 - protein, 28 aa, artificial
  peptide fold or domain or sub-domain
EQWRFGPLTIDPKGYRVWRDGREVAMTA

SEQ ID NO: 4253 - protein, 27 aa, artificial
  peptide fold or domain or sub-domain
ERAIEMGKEDLASKPENVREKIVQGRI

SEQ ID NO: 4254 - protein, 23 aa, artificial
  peptide fold or domain or sub-domain
ERAKGLLQANQGMTEPEAFKWIQ

SEQ ID NO: 4255 - protein, 23 aa, artificial
  peptide fold or domain or sub-domain
ERAKSRLMQAHALTEDDAYQWLR

SEQ ID NO: 4256 - protein, 26 aa, artificial
  peptide fold or domain or sub-domain
ERARDFLVRAQKEQPCNHDINNELKK

SEQ ID NO: 4257 - protein, 27 aa, artificial
  peptide fold or domain or sub-domain
ERAYQTLKLILENYDSEHFEKMYWEKK

SEQ ID NO: 4258 - protein, 29 aa, artificial
  peptide fold or domain or sub-domain
ERCVQLRDAMHNSSATFDKEKAQERLSKL

SEQ ID NO: 4259 - protein, 22 aa, artificial
  peptide fold or domain or sub-domain
ERDLAVLAGCGLGMDDTIHVLN

SEQ ID NO: 4260 - protein, 28 aa, artificial
  peptide fold or domain or sub-domain
ERDLLLKCAKAFENGDQDEFSSAVADFD

SEQ ID NO: 4261 - protein, 27 aa, artificial
  peptide fold or domain or sub-domain
ERDLLTEISRGEGKPEEVLPQIVEGRL

SEQ ID NO: 4262 - protein, 29 aa, artificial
  peptide fold or domain or sub-domain
ERDTVSIVPEDDRSVWDWTRLHPGSTGIP

SEQ ID NO: 4263 - protein, 27 aa, artificial
  peptide fold or domain or sub-domain
EREDTQKLWTYYEKRDLVQNTEKAALK

SEQ ID NO: 4264 - protein, 26 aa, artificial
  peptide fold or domain or sub-domain
EREGDYIGNYHPSNYGSGGNKIPLYN

SEQ ID NO: 4265 - protein, 27 aa, artificial
  peptide fold or domain or sub-domain
EREIAAAQAQSENKPKEFIDRIVDGRI

SEQ ID NO: 4266 - protein, 27 aa, artificial
  peptide fold or domain or sub-domain
EREIAEKQAAEMGKPEHITRQIVEGRL

SEQ ID NO: 4267 - protein, 27 aa, artificial
  peptide fold or domain or sub-domain
EREIIVNQLEHEGKPAAFAAKIIDGRL

SEQ ID NO: 4268 - protein, 25 aa, artificial
  peptide fold or domain or sub-domain
EREKIMDIIEGITGARLTISYPRIG

SEQ ID NO: 4269 - protein, 25 aa, artificial
  peptide fold or domain or sub-domain
EREKMFEFYERVSGARMHAAYIRPG

SEQ ID NO: 4270 - protein, 20 aa, artificial
  peptide fold or domain or sub-domain
ERFQQTVKKSGQIVEEFLLD

SEQ ID NO: 4271 - protein, 20 aa, artificial
  peptide fold or domain or sub-domain
ERFTVLISPHVNKDARDQYE

SEQ ID NO: 4272 - protein, 30 aa, artificial
  peptide fold or domain or sub-domain
ERGDEVILPSPNYASHIEQVLLAEGVPVFV

SEQ ID NO: 4273 - protein, 20 aa, artificial
  peptide fold or domain or sub-domain
ERGESVRAIARRIGAHRTTV

SEQ ID NO: 4274 - protein, 23 aa, artificial
  peptide fold or domain or sub-domain
ERGGNYPFPGHDALGILEVAEIP

SEQ ID NO: 4275 - protein, 29 aa, artificial
  peptide fold or domain or sub-domain
ERGYHGVGFGGISVGGISANLKTFSGALL

SEQ ID NO: 4276 - protein, 29 aa, artificial
  peptide fold or domain or sub-domain
ERGYHGVTVAAGSLTSLPANLAHFDAPVE

SEQ ID NO: 4277 - protein, 25 aa, artificial
  peptide fold or domain or sub-domain
ERGYSVARAYQQQGIEGYVQHVQRV

SEQ ID NO: 4278 - protein, 26 aa, artificial
  peptide fold or domain or sub-domain
ERHGSSSAKWHEVVEQMGEDGKDVVP

SEQ ID NO: 4279 - protein, 28 aa, artificial
  peptide fold or domain or sub-domain
ERHITELPEWKSESRTLGKQNRLMHGLS

SEQ ID NO: 4280 - protein, 27 aa, artificial
  peptide fold or domain or sub-domain
ERHPLWLEREHTRAERNTRNLRYGVGL

SEQ ID NO: 4281 - protein, 20 aa, artificial
  peptide fold or domain or sub-domain
ERHTYTLEEVQSILNDNFEN

SEQ ID NO: 4282 - protein, 20 aa, artificial
  peptide fold or domain or sub-domain
ERIGENVTVDKVKALDKKGA

SEQ ID NO: 4283 - protein, 24 aa, artificial
  peptide fold or domain or sub-domain
ERIKEHQESLDMNSARDFIDCFLI

SEQ ID NO: 4284 - protein, 20 aa, artificial
  peptide fold or domain or sub-domain
ERIMVEGFHVDDKTIIRVPM

SEQ ID NO: 4285 - protein, 27 aa, artificial
  peptide fold or domain or sub-domain
ERKEWTLLSHRVIFHGRRVCHARRPAC

SEQ ID NO: 4286 - protein, 24 aa, artificial
  peptide fold or domain or sub-domain
ERKLKKMLGPSAVDIGNGCFETKH

SEQ ID NO: 4287 - protein, 22 aa, artificial
  peptide fold or domain or sub-domain
ERKVALLGDAGFAPDEAVDVMY

SEQ ID NO: 4288 - protein, 26 aa, artificial
  peptide fold or domain or sub-domain
ERKVKELTYQVSSASWPSEILKLEPA

SEQ ID NO: 4289 - protein, 20 aa, artificial
  peptide fold or domain or sub-domain
ERLAGNITAEEVKRLDEEGK

SEQ ID NO: 4290 - protein, 28 aa, artificial
  peptide fold or domain or sub-domain
ERLDLVTRHTTEVVTEDELRTLFEESDP

SEQ ID NO: 4291 - protein, 24 aa, artificial
  peptide fold or domain or sub-domain
ERLEALGFCPKDVKTHKIIKSKKY

SEQ ID NO: 4292 - protein, 21 aa, artificial
  peptide fold or domain or sub-domain
ERLEKKLEQYPDQLMRASVEL

SEQ ID NO: 4293 - protein, 26 aa, artificial
  peptide fold or domain or sub-domain
ERLPVPLKELDAKLGLKPGSNLQYFR

SEQ ID NO: 4294 - protein, 29 aa, artificial
  peptide fold or domain or sub-domain
ERLQQVLQMESHIQSTSDRIQFNDLQSLL

SEQ ID NO: 4295 - protein, 20 aa, artificial
  peptide fold or domain or sub-domain
ERLSAEKPGYYLHNGKWVKM

SEQ ID NO: 4296 - protein, 25 aa, artificial
  peptide fold or domain or sub-domain
ERLVVETGMLNKRDVDTRTNEFLTG

SEQ ID NO: 4297 - protein, 23 aa, artificial
  peptide fold or domain or sub-domain
ERLYDYMTRRIFQANVHNDIDII

SEQ ID NO: 4298 - protein, 27 aa, artificial
  peptide fold or domain or sub-domain
ERMTERKVTVAVRGADGRLANVTRSQW

SEQ ID NO: 4299 - protein, 26 aa, artificial
  peptide fold or domain or sub-domain
ERNLEGLQKEIDQMIKELRRKNLETQ

SEQ ID NO: 4300 - protein, 27 aa, artificial
  peptide fold or domain or sub-domain
ERNRHFQRMLEALAAAWQAGTVTHPEV

SEQ ID NO: 4301 - protein, 28 aa, artificial
  peptide fold or domain or sub-domain
ERNYKDILRYSADYAGMDPVRAEEDLRL

SEQ ID NO: 4302 - protein, 26 aa, artificial
  peptide fold or domain or sub-domain
ERNYKLKKMTTYLDPKQLLINERISL

SEQ ID NO: 4303 - protein, 27 aa, artificial
  peptide fold or domain or sub-domain
ERPAADANLTRLEELREDELQPGFRKQ

SEQ ID NO: 4304 - protein, 27 aa, artificial
  peptide fold or domain or sub-domain
ERPSRWRRRNLAGKPDNIKEKIVAGRL

SEQ ID NO: 4305 - protein, 27 aa, artificial
  peptide fold or domain or sub-domain
ERQIALGSDALKGKPPEVQEKIVAGKL

SEQ ID NO: 4306 - protein, 27 aa, artificial
  peptide fold or domain or sub-domain
ERQIYIQAALNEGKPQQIAEKIAEGRL

SEQ ID NO: 4307 - protein, 21 aa, artificial
  peptide fold or domain or sub-domain
ERRVKRLVRHRGFDSRTLYND

SEQ ID NO: 4308 - protein, 27 aa, artificial
  peptide fold or domain or sub-domain
ERSGIGSKDVLDEHGIKTLVHNSRVGE

SEQ ID NO: 4309 - protein, 27 aa, artificial
  peptide fold or domain or sub-domain
ERSGLGDSKILARAGVPVVEELRVLGW

SEQ ID NO: 4310 - protein, 27 aa, artificial
  peptide fold or domain or sub-domain
ERSIIEEQVKGLNKSEEVTKKIVDGRM

SEQ ID NO: 4311 - protein, 23 aa, artificial
  peptide fold or domain or sub-domain
ERSRVLLTLRSTPEEVRAAQDEL

SEQ ID NO: 4312 - protein, 22 aa, artificial
  peptide fold or domain or sub-domain
ERSYLTYLAQSQQWSQFLRFYP

SEQ ID NO: 4313 - protein, 22 aa, artificial
  peptide fold or domain or sub-domain
ERTMNLLRSGGLHDELAAYGGD

SEQ ID NO: 4314 - protein, 24 aa, artificial
  peptide fold or domain or sub-domain
ERVAELAGARLQRDQPTLRAAPET

SEQ ID NO: 4315 - protein, 22 aa, artificial
  peptide fold or domain or sub-domain
ERVLARIKPMGLTDPELVSVIV

SEQ ID NO: 4316 - protein, 28 aa, artificial
  peptide fold or domain or sub-domain
ERVQDPFELRVPGRGFGRDPQRTPMQWD

SEQ ID NO: 4317 - protein, 29 aa, artificial
  peptide fold or domain or sub-domain
ERVQMIKDMISAEDHEYNRERLVERLAKL

SEQ ID NO: 4318 - protein, 30 aa, artificial
  peptide fold or domain or sub-domain
ERVQSATYDEASATWLVTTDCGEQWRSRFF

SEQ ID NO: 4319 - protein, 28 aa, artificial
  peptide fold or domain or sub-domain
ERVRYFEERGEYAQRLKERTLYDLEMLR

SEQ ID NO: 4320 - protein, 23 aa, artificial
  peptide fold or domain or sub-domain
ERVYEIKRRAGKGKRRGRAYIER

SEQ ID NO: 4321 - protein, 27 aa, artificial
  peptide fold or domain or sub-domain
ERVYMASDDLVKRIQRVVTDHGRELGI

SEQ ID NO: 4322 - protein, 20 aa, artificial
  peptide fold or domain or sub-domain
ERWTVPKSHFIFKKSQENFE

SEQ ID NO: 4323 - protein, 28 aa, artificial
  peptide fold or domain or sub-domain
ERYRQHVLETKGRDLDEAGKRLLEEDLR

SEQ ID NO: 4324 - protein, 29 aa, artificial
  peptide fold or domain or sub-domain
ESAEALLTALRNGHMEFDGDYVKQPRRDI

SEQ ID NO: 4325 - protein, 24 aa, artificial
  peptide fold or domain or sub-domain
ESAEDWEVIENGIKMKHQDGYYTG

SEQ ID NO: 4326 - protein, 23 aa, artificial
  peptide fold or domain or sub-domain
ESAHLPEVGEALARSLGSADGSI

SEQ ID NO: 4327 - protein, 22 aa, artificial
  peptide fold or domain or sub-domain
ESALASAQRQFDIAADILQLEP

SEQ ID NO: 4328 - protein, 24 aa, artificial
  peptide fold or domain or sub-domain
ESANISYVKWDMNRNITNIPEGLA

SEQ ID NO: 4329 - protein, 22 aa, artificial
  peptide fold or domain or sub-domain
ESAVLNDLKNDPRTSDALKDCE

SEQ ID NO: 4330 - protein, 24 aa, artificial
  peptide fold or domain or sub-domain
ESCGEGSMKVLEKRLKDMGFQYSC

SEQ ID NO: 4331 - protein, 24 aa, artificial
  peptide fold or domain or sub-domain
ESCGRGSVVDLIQILRSRGFRWTC

SEQ ID NO: 4332 - protein, 21 aa, artificial
  peptide fold or domain or sub-domain
ESCRFSNCRHRSEPGCSVLRS

SEQ ID NO: 4333 - protein, 27 aa, artificial
  peptide fold or domain or sub-domain
ESDGSPLPKTVIPKSEEQMQRIRGSIG

SEQ ID NO: 4334 - protein, 30 aa, artificial
  peptide fold or domain or sub-domain
ESDKVKLLLNNNSGKNIQLDNLIIDRICRK

SEQ ID NO: 4335 - protein, 25 aa, artificial
  peptide fold or domain or sub-domain
ESDLLIDGELQLDSAIIKDVAEKKC

SEQ ID NO: 4336 - protein, 23 aa, artificial
  peptide fold or domain or sub-domain
ESDVKGDTSGNLKKILVSLLQAN

SEQ ID NO: 4337 - protein, 28 aa, artificial
  peptide fold or domain or sub-domain
ESELAMVERLIDRKTESQEELLVRVATA

SEQ ID NO: 4338 - protein, 29 aa, artificial
  peptide fold or domain or sub-domain
ESELGTSVREVMWGTDEAALNSTAFTQPA

SEQ ID NO: 4339 - protein, 28 aa, artificial
  peptide fold or domain or sub-domain
ESEYLRNPGGDEQVAMIERGTKGAVIVN

SEQ ID NO: 4340 - protein, 22 aa, artificial
  peptide fold or domain or sub-domain
ESFERHVRYVSPYKDMPLRFAN

SEQ ID NO: 4341 - protein, 30 aa, artificial
  peptide fold or domain or sub-domain
ESFLKPLPVGKIPGIGKKSAQVLINAGLQT

SEQ ID NO: 4342 - protein, 29 aa, artificial
  peptide fold or domain or sub-domain
ESFSLDTARVLPANVARFVDAAHSGVEEV

SEQ ID NO: 4343 - protein, 21 aa, artificial
  peptide fold or domain or sub-domain
ESFVMEYYDTMQRDRSSLKLF

SEQ ID NO: 4344 - protein, 23 aa, artificial
  peptide fold or domain or sub-domain
ESGIWQSVISWLGSHPDHPGRDF

SEQ ID NO: 4345 - protein, 30 aa, artificial
  peptide fold or domain or sub-domain
ESGLIENHEGRKAYGAVLISSPQELGHAFI

SEQ ID NO: 4346 - protein, 30 aa, artificial
  peptide fold or domain or sub-domain
ESGNLFAALTRAKDEDGNNFSDQEIADHMI

SEQ ID NO: 4347 - protein, 26 aa, artificial
  peptide fold or domain or sub-domain
ESGSMLRALLVDYARLAAPHLVDHIT

SEQ ID NO: 4348 - protein, 23 aa, artificial
  peptide fold or domain or sub-domain
ESGYQSDVEEWLAAHSDHPLAAE

SEQ ID NO: 4349 - protein, 21 aa, artificial
  peptide fold or domain or sub-domain
ESGYSYGRTIVPISRSDEDVL

SEQ ID NO: 4350 - protein, 24 aa, artificial
  peptide fold or domain or sub-domain
ESHHFHPNASPLVFQLLVRPLLGG

SEQ ID NO: 4351 - protein, 25 aa, artificial
  peptide fold or domain or sub-domain
ESIAAFLLRAAGGGQSRPDSTRIMN

SEQ ID NO: 4352 - protein, 30 aa, artificial
  peptide fold or domain or sub-domain
ESINSGFQALRATLPTSLTTDSKAVILRKA

SEQ ID NO: 4353 - protein, 27 aa, artificial
  peptide fold or domain or sub-domain
ESKVKKTAEVSKHKVSHKNSTKSSTAN

SEQ ID NO: 4354 - protein, 29 aa, artificial
  peptide fold or domain or sub-domain
ESLDLLVRWLREPSVAGTGERFTFREVPV

SEQ ID NO: 4355 - protein, 28 aa, artificial
  peptide fold or domain or sub-domain
ESLICVQAWRELRAKNDWRSFKPYFKKL

SEQ ID NO: 4356 - protein, 22 aa, artificial
  peptide fold or domain or sub-domain
ESLKEHVTKSSVTADRPNYFAK

SEQ ID NO: 4357 - protein, 23 aa, artificial
  peptide fold or domain or sub-domain
ESLKIGSRCNISNRTFIECSYSP

SEQ ID NO: 4358 - protein, 24 aa, artificial
  peptide fold or domain or sub-domain
ESLLEVLYGGKGHLLEQSGVSQPA

SEQ ID NO: 4359 - protein, 22 aa, artificial
  peptide fold or domain or sub-domain
ESLLKDVLEEVSQHTDYKLVEQ

SEQ ID NO: 4360 - protein, 24 aa, artificial
  peptide fold or domain or sub-domain
ESLLKKACQVTQSRTMTTSHLKQC

SEQ ID NO: 4361 - protein, 29 aa, artificial
  peptide fold or domain or sub-domain
ESLQRLTFVKSTDRSHNFLHYLVEAVNRC

SEQ ID NO: 4362 - protein, 23 aa, artificial
  peptide fold or domain or sub-domain
ESLRLIKANLAEILNSEIIDNVV

SEQ ID NO: 4363 - protein, 29 aa, artificial
  peptide fold or domain or sub-domain
ESLSKMIEIKDNSNSGSLLDFAIKTLYQQ

SEQ ID NO: 4364 - protein, 22 aa, artificial
  peptide fold or domain or sub-domain
ESLYRLLRQVGLPEEVITKYGS

SEQ ID NO: 4365 - protein, 26 aa, artificial
  peptide fold or domain or sub-domain
ESMAERFAKESEMKAEHAKVLMDSLT

SEQ ID NO: 4366 - protein, 29 aa, artificial
  peptide fold or domain or sub-domain
ESMNSSDFNLSCSNGDCIILESLSCPNTL

SEQ ID NO: 4367 - protein, 27 aa, artificial
  peptide fold or domain or sub-domain
ESMPEFLAGYPPDRVAAITGLSEADIR

SEQ ID NO: 4368 - protein, 22 aa, artificial
  peptide fold or domain or sub-domain
ESMSATPMREAYYEGKIIESAF

SEQ ID NO: 4369 - protein, 29 aa, artificial
  peptide fold or domain or sub-domain
ESMYLVPKMFVQDEIEHDGKYIKIPKRPI

SEQ ID NO: 4370 - protein, 28 aa, artificial
  peptide fold or domain or sub-domain
ESNFLKSLIDAVNEGDSEQLSEHCKEFD

SEQ ID NO: 4371 - protein, 26 aa, artificial
  peptide fold or domain or sub-domain
ESNNILGNACTNKLDQSKVIFRWRNL

SEQ ID NO: 4372 - protein, 30 aa, artificial
  peptide fold or domain or sub-domain
ESPTYSAKKHKGIPMYEYALNNIQVPSKSS

SEQ ID NO: 4373 - protein, 22 aa, artificial
  peptide fold or domain or sub-domain
ESRDQGKPIGLAKVMDIPRCVQ

SEQ ID NO: 4374 - protein, 20 aa, artificial
  peptide fold or domain or sub-domain
ESRSEIAGAVIGQESATGRP

SEQ ID NO: 4375 - protein, 26 aa, artificial
  peptide fold or domain or sub-domain
ESSVYRVLKKYCRQRPYYVHLLELFL

SEQ ID NO: 4376 - protein, 28 aa, artificial
  peptide fold or domain or sub-domain
ESTDPAVTEFIKKFKAKYNETPDALAAL

SEQ ID NO: 4377 - protein, 22 aa, artificial
  peptide fold or domain or sub-domain
ESVLQLYVETGFSAEEAFGIAI

SEQ ID NO: 4378 - protein, 29 aa, artificial
  peptide fold or domain or sub-domain
ESVLYFARYIVTSSQESTVEVGKILTEKE

SEQ ID NO: 4379 - protein, 21 aa, artificial
  peptide fold or domain or sub-domain
ESVWGQTVCEEFSWRDTWSKS

SEQ ID NO: 4380 - protein, 21 aa, artificial
  peptide fold or domain or sub-domain
ESYLNLLQEDELDEGTALSRL

SEQ ID NO: 4381 - protein, 27 aa, artificial
  peptide fold or domain or sub-domain
ESYLRTSKNLIDPNTAEKIGLLDLMQR

SEQ ID NO: 4382 - protein, 30 aa, artificial
  peptide fold or domain or sub-domain
ESYRIVRQGAEWQVAALVESEWRTLYRIED

SEQ ID NO: 4383 - protein, 25 aa, artificial
  peptide fold or domain or sub-domain
ETAARIQAGAGGVSGAFKQTPIANW

SEQ ID NO: 4384 - protein, 21 aa, artificial
  peptide fold or domain or sub-domain
ETAIEPGTLAHDLYGATSCTE

SEQ ID NO: 4385 - protein, 20 aa, artificial
  peptide fold or domain or sub-domain
ETARVTLQELVKCLICDWGH

SEQ ID NO: 4386 - protein, 25 aa, artificial
  peptide fold or domain or sub-domain
ETCENVDCGPGKKCRMNKKNKPRCV

SEQ ID NO: 4387 - protein, 24 aa, artificial
  peptide fold or domain or sub-domain
ETCSNGTVASLRGVLTDLGLSNTC

SEQ ID NO: 4388 - protein, 24 aa, artificial
  peptide fold or domain or sub-domain
ETCTNGSVLYLQNFLMNMNFNVTC

SEQ ID NO: 4389 - protein, 23 aa, artificial
  peptide fold or domain or sub-domain
ETDIIKETKPPYEQLLVALLKAN

SEQ ID NO: 4390 - protein, 27 aa, artificial
  peptide fold or domain or sub-domain
ETDIQKSIAKKTGKSSKILQAIIKGRL

SEQ ID NO: 4391 - protein, 23 aa, artificial
  peptide fold or domain or sub-domain
ETDIRTETTGYFCKMLLQLLKGD

SEQ ID NO: 4392 - protein, 24 aa, artificial
  peptide fold or domain or sub-domain
ETDLLEFRNRFNLPLTDEQAKHIA

SEQ ID NO: 4393 - protein, 27 aa, artificial
  peptide fold or domain or sub-domain
ETEFKSLKYYISNYDRTNSEYLYWENS

SEQ ID NO: 4394 - protein, 24 aa, artificial
  peptide fold or domain or sub-domain
ETELIYVYRDRDLWFFMNRDSFDQ

SEQ ID NO: 4395 - protein, 29 aa, artificial
  peptide fold or domain or sub-domain
ETELTGFAQFPTFVTASIRKHDVTETVDA

SEQ ID NO: 4396 - protein, 22 aa, artificial
  peptide fold or domain or sub-domain
ETEMFREIEKDPRSKDALDTCK

SEQ ID NO: 4397 - protein, 21 aa, artificial
  peptide fold or domain or sub-domain
ETFLGGEPYELDSVGFSKDQK

SEQ ID NO: 4398 - protein, 24 aa, artificial
  peptide fold or domain or sub-domain
ETFTKHRDQLDIGDQRDLIDAFLV

SEQ ID NO: 4399 - protein, 30 aa, artificial
  peptide fold or domain or sub-domain
ETGKVTAQIDYLTADEEDNYVVAQANMKLA

SEQ ID NO: 4400 - protein, 30 aa, artificial
  peptide fold or domain or sub-domain
ETGLIRTPGGLRALGGAILSSADEIRQCLD

SEQ ID NO: 4401 - protein, 27 aa, artificial
  peptide fold or domain or sub-domain
ETGYFPVTKKAYDEDIMKENLKKSPQF

SEQ ID NO: 4402 - protein, 27 aa, artificial
  peptide fold or domain or sub-domain
ETICYIKDPRLADIAQAKDMTKTCAAV

SEQ ID NO: 4403 - protein, 30 aa, artificial
  peptide fold or domain or sub-domain
ETIDKLMAGELDARLVYSPLDYEHYLTRQL

SEQ ID NO: 4404 - protein, 29 aa, artificial
  peptide fold or domain or sub-domain
ETILYLTRGGARAKTRDIAQAMGIKPPSV

SEQ ID NO: 4405 - protein, 23 aa, artificial
  peptide fold or domain or sub-domain
ETINEEGEPIEDNIVEVDGKEYA

SEQ ID NO: 4406 - protein, 27 aa, artificial
  peptide fold or domain or sub-domain
ETISLSFDDRKRGRLKIKTDSGIDAGI

SEQ ID NO: 4407 - protein, 30 aa, artificial
  peptide fold or domain or sub-domain
ETITYSEEDLVTYSPITEQHVDEGMTLVEI

SEQ ID NO: 4408 - protein, 27 aa, artificial
  peptide fold or domain or sub-domain
ETIYENIAPVPKKKTPNDNTFIITCLK

SEQ ID NO: 4409 - protein, 29 aa, artificial
  peptide fold or domain or sub-domain
ETIYKKSLKDNMAKTTEISKDLNIAPGSV

SEQ ID NO: 4410 - protein, 29 aa, artificial
  peptide fold or domain or sub-domain
ETIYRLSDSRKPVTTTDISREMKIAPASV

SEQ ID NO: 4411 - protein, 26 aa, artificial
  peptide fold or domain or sub-domain
ETKHIPIVICSVYKPTSNHQPSRDFV

SEQ ID NO: 4412 - protein, 29 aa, artificial
  peptide fold or domain or sub-domain
ETKYGVKVVSMGFLLPSQDTPVIWRGSLM

SEQ ID NO: 4413 - protein, 27 aa, artificial
  peptide fold or domain or sub-domain
ETLGEAFSQRFGQAVGPHCVTLGRQRF

SEQ ID NO: 4414 - protein, 25 aa, artificial
  peptide fold or domain or sub-domain
ETLGSIEHTFGGARGAFARGPIMKW

SEQ ID NO: 4415 - protein, 29 aa, artificial
  peptide fold or domain or sub-domain
ETLILTRNPEEKIDGVATFQDVQSVLDWY

SEQ ID NO: 4416 - protein, 26 aa, artificial
  peptide fold or domain or sub-domain
ETLKSRLEKDDRVSKVLTQKDLDDIF

SEQ ID NO: 4417 - protein, 24 aa, artificial
  peptide fold or domain or sub-domain
ETLLKLLNQAKENGELLPHVVTTD

SEQ ID NO: 4418 - protein, 25 aa, artificial
  peptide fold or domain or sub-domain
ETLLTAKNVAAAGQLADLRKAWDKA

SEQ ID NO: 4419 - protein, 20 aa, artificial
  peptide fold or domain or sub-domain
ETLLTVSSDWPFMVSKDSAA

SEQ ID NO: 4420 - protein, 29 aa, artificial
  peptide fold or domain or sub-domain
ETLPKMRDARSNDNKLSLLHFLAKTLQDR

SEQ ID NO: 4421 - protein, 29 aa, artificial
  peptide fold or domain or sub-domain
ETLSSCHEQSKTLHNAKAVKDLRSKMDGD

SEQ ID NO: 4422 - protein, 27 aa, artificial
  peptide fold or domain or sub-domain
ETLYIKKLTSAGIPPDRAQPLGQFIQA

SEQ ID NO: 4423 - protein, 29 aa, artificial
  peptide fold or domain or sub-domain
ETMIFKDRFFWRLHPQQVDAELFLTKSFW

SEQ ID NO: 4424 - protein, 28 aa, artificial
  peptide fold or domain or sub-domain
ETNMIENWKSSPDYEHHSQAEAVNHFRE

SEQ ID NO: 4425 - protein, 20 aa, artificial
  peptide fold or domain or sub-domain
ETPEELEQIRKEKGGYDGRA

SEQ ID NO: 4426 - protein, 25 aa, artificial
  peptide fold or domain or sub-domain
ETPFYAESLVETYGKIMNHEDHLQF

SEQ ID NO: 4427 - protein, 24 aa, artificial
  peptide fold or domain or sub-domain
ETPYDLFRNGRATAMDDQMSRGSS

SEQ ID NO: 4428 - protein, 24 aa, artificial
  peptide fold or domain or sub-domain
ETQALAEALLANDYTTARRIQSDL

SEQ ID NO: 4429 - protein, 27 aa, artificial
  peptide fold or domain or sub-domain
ETQDDVWRLLAHLGGHEIADDLTQETY

SEQ ID NO: 4430 - protein, 22 aa, artificial
  peptide fold or domain or sub-domain
ETQDNGKPYAEALFDVTYSILT

SEQ ID NO: 4431 - protein, 22 aa, artificial
  peptide fold or domain or sub-domain
ETQLRFMTENGFSLRDGLYAIS

SEQ ID NO: 4432 - protein, 21 aa, artificial
  peptide fold or domain or sub-domain
ETQRSLAERLGVSQMTISRIQ

SEQ ID NO: 4433 - protein, 24 aa, artificial
  peptide fold or domain or sub-domain
ETRENVARKLQQSDGPKPPWADRY

SEQ ID NO: 4434 - protein, 28 aa, artificial
  peptide fold or domain or sub-domain
ETRESLLRALEELEGEESGEAERVRERI

SEQ ID NO: 4435 - protein, 21 aa, artificial
  peptide fold or domain or sub-domain
ETRFVLRAFSQKFSFSNFDND

SEQ ID NO: 4436 - protein, 29 aa, artificial
  peptide fold or domain or sub-domain
ETRNMVKRGMKDCDSDYVNKVLNSRQLAL

SEQ ID NO: 4437 - protein, 24 aa, artificial
  peptide fold or domain or sub-domain
ETRRKLLKAGFQDLDTSKTGDRCT

SEQ ID NO: 4438 - protein, 22 aa, artificial
  peptide fold or domain or sub-domain
ETSDNGKPFTQARGFDLEAAVA

SEQ ID NO: 4439 - protein, 20 aa, artificial
  peptide fold or domain or sub-domain
ETSLQRLARDWEIEVDQVEA

SEQ ID NO: 4440 - protein, 25 aa, artificial
  peptide fold or domain or sub-domain
ETTAKIQKSEGGGAFRFQVGSFGQL

SEQ ID NO: 4441 - protein, 25 aa, artificial
  peptide fold or domain or sub-domain
ETTARIHKQEGGGLGALKEDTLKNY

SEQ ID NO: 4442 - protein, 21 aa, artificial
  peptide fold or domain or sub-domain
ETTMKKVASTLRSINPDVVLH

SEQ ID NO: 4443 - protein, 28 aa, artificial
  peptide fold or domain or sub-domain
ETTQRITTTAVDDAGVFTTVVNPRVTNV

SEQ ID NO: 4444 - protein, 27 aa, artificial
  peptide fold or domain or sub-domain
ETVDIIKQFSEEGRLVDTDVALFQEIV

SEQ ID NO: 4445 - protein, 27 aa, artificial
  peptide fold or domain or sub-domain
ETVFSIKRKGNIFYLYTENYIYKSKAV

SEQ ID NO: 4446 - protein, 24 aa, artificial
  peptide fold or domain or sub-domain
ETVKKGDPNGNDISVKSGLVEDKA

SEQ ID NO: 4447 - protein, 25 aa, artificial
  peptide fold or domain or sub-domain
ETVNSIQTKGRGITGVFDDACIYEW

SEQ ID NO: 4448 - protein, 27 aa, artificial
  peptide fold or domain or sub-domain
ETVSDLRKEGECFVVVSEKGERRARAV

SEQ ID NO: 4449 - protein, 27 aa, artificial
  peptide fold or domain or sub-domain
ETVTKVDFSSKPFKLFTDSKAILADAV

SEQ ID NO: 4450 - protein, 27 aa, artificial
  peptide fold or domain or sub-domain
ETVTRLQAHGDQVRITSDQGSIIANKV

SEQ ID NO: 4451 - protein, 30 aa, artificial
  peptide fold or domain or sub-domain
ETVVDVGWDEGSKSWKVRTEKGLLVHAKHV

SEQ ID NO: 4452 - protein, 22 aa, artificial
  peptide fold or domain or sub-domain
ETVYNPLVEQGLMKVEAKERLA

SEQ ID NO: 4453 - protein, 27 aa, artificial
  peptide fold or domain or sub-domain
ETWCGVHDEETRLLAEASGLTRSAAGI

SEQ ID NO: 4454 - protein, 25 aa, artificial
  peptide fold or domain or sub-domain
ETYGKIIADDGRRLAVTKNDVLTLW

SEQ ID NO: 4455 - protein, 24 aa, artificial
  peptide fold or domain or sub-domain
ETYRLLAERAIAQGDLEPDLDPEV

SEQ ID NO: 4456 - protein, 28 aa, artificial
  peptide fold or domain or sub-domain
ETYTYALTNEILKQRNEPQATFTFGSTK

SEQ ID NO: 4457 - protein, 23 aa, artificial
  peptide fold or domain or sub-domain
EVAACMRGRTVEGIRQVFGIAND

SEQ ID NO: 4458 - protein, 23 aa, artificial
  peptide fold or domain or sub-domain
EVAAQCIQDSFKIKPEEIKPKSG

SEQ ID NO: 4459 - protein, 27 aa, artificial
  peptide fold or domain or sub-domain
EVACAIREEAVKRKALENKVTRAYQAM

SEQ ID NO: 4460 - protein, 25 aa, artificial
  peptide fold or domain or sub-domain
EVAFLGYSCSGKPYTFGSPSFQAVA

SEQ ID NO: 4461 - protein, 27 aa, artificial
  peptide fold or domain or sub-domain
EVAIIRESLRGVKKPEGILDSMVNGKM

SEQ ID NO: 4462 - protein, 25 aa, artificial
  peptide fold or domain or sub-domain
EVAIVVFSPGRKVFSFGHPNVDSVI

SEQ ID NO: 4463 - protein, 25 aa, artificial
  peptide fold or domain or sub-domain
EVALIIFSSRGKLYEFGSAGINKTL

SEQ ID NO: 4464 - protein, 30 aa, artificial
  peptide fold or domain or sub-domain
EVALVGRNLSEMDLMEQRRENRPYLPGVVL

SEQ ID NO: 4465 - protein, 20 aa, artificial
  peptide fold or domain or sub-domain
EVANREQILQRLHNNEDDLV

SEQ ID NO: 4466 - protein, 25 aa, artificial
  peptide fold or domain or sub-domain
EVAVTVIDRKGRLHVFCSSDYQRTL

SEQ ID NO: 4467 - protein, 29 aa, artificial
  peptide fold or domain or sub-domain
EVAVVISPQDEWFDDFAWDLPKLSVHRVG

SEQ ID NO: 4468 - protein, 29 aa, artificial
  peptide fold or domain or sub-domain
EVCDPWVDPEAMEQEYGVTPVSEPTTGAY

SEQ ID NO: 4469 - protein, 27 aa, artificial
  peptide fold or domain or sub-domain
EVCLDEPSFYNQTTRAPLNRGPLDLRM

SEQ ID NO: 4470 - protein, 20 aa, artificial
  peptide fold or domain or sub-domain
EVDGMDLRDASHEQAVEAIR

SEQ ID NO: 4471 - protein, 20 aa, artificial
  peptide fold or domain or sub-domain
EVDHHSLINTTHENAVNVLK

SEQ ID NO: 4472 - protein, 26 aa, artificial
  peptide fold or domain or sub-domain
EVDKFRLQYIIAKPDATEKEIEEFIG

SEQ ID NO: 4473 - protein, 23 aa, artificial
  peptide fold or domain or sub-domain
EVDPRFAYGSLGKEPNIPSNATI

SEQ ID NO: 4474 - protein, 29 aa, artificial
  peptide fold or domain or sub-domain
EVEAVAVAQDSVGARVTVVQNGQEKIISA

SEQ ID NO: 4475 - protein, 22 aa, artificial
  peptide fold or domain or sub-domain
EVEILMDQEPELAGFYHAYILQ

SEQ ID NO: 4476 - protein, 24 aa, artificial
  peptide fold or domain or sub-domain
EVELDYLYNDGEFYHFMDNVSFEQ

SEQ ID NO: 4477 - protein, 23 aa, artificial
  peptide fold or domain or sub-domain
EVENGPSSVVTRILKSQHAAMFR

SEQ ID NO: 4478 - protein, 24 aa, artificial
  peptide fold or domain or sub-domain
EVFDLNPNAVAELTALGASSADSV

SEQ ID NO: 4479 - protein, 22 aa, artificial
  peptide fold or domain or sub-domain
EVFEYSEVLEEFGSDEKASQEM

SEQ ID NO: 4480 - protein, 28 aa, artificial
  peptide fold or domain or sub-domain
EVFGISDLTNGSVDNKELILQRAKELGY

SEQ ID NO: 4481 - protein, 20 aa, artificial
  peptide fold or domain or sub-domain
EVFQHTLQQEEDMVKIYIAD

SEQ ID NO: 4482 - protein, 23 aa, artificial
  peptide fold or domain or sub-domain
EVGLFSFLGFEEWEDRIAGDTRR

SEQ ID NO: 4483 - protein, 25 aa, artificial
  peptide fold or domain or sub-domain
EVGLIVYNTAGKLFEFSSTSMKMLV

SEQ ID NO: 4484 - protein, 25 aa, artificial
  peptide fold or domain or sub-domain
EVGVMVFSATGRLSEFASTSMQKVL

SEQ ID NO: 4485 - protein, 25 aa, artificial
  peptide fold or domain or sub-domain
EVGVVILSNTGKVFEYPIGRTKAIL

SEQ ID NO: 4486 - protein, 26 aa, artificial
  peptide fold or domain or sub-domain
EVHDATEMDRVLSIGGFPLIGINNRD

SEQ ID NO: 4487 - protein, 28 aa, artificial
  peptide fold or domain or sub-domain
EVIEMQGLSLDPTSHRVMAGEEPLEMGP

SEQ ID NO: 4488 - protein, 29 aa, artificial
  peptide fold or domain or sub-domain
EVIFSEGLSKIWDNVMEVDGAYSYDKTVQ

SEQ ID NO: 4489 - protein, 21 aa, artificial
  peptide fold or domain or sub-domain
EVIQMLQHQFPSVQSNAAAYL

SEQ ID NO: 4490 - protein, 28 aa, artificial
  peptide fold or domain or sub-domain
EVIRSTYFDGLDLVPGNLELMEFEHTTP

SEQ ID NO: 4491 - protein, 20 aa, artificial
  peptide fold or domain or sub-domain
EVIVNGKLVLHQDKVTAERP

SEQ ID NO: 4492 - protein, 30 aa, artificial
  peptide fold or domain or sub-domain
EVIVSEPNSKKRKLALKLGASKVFDPFNDN

SEQ ID NO: 4493 - protein, 29 aa, artificial
  peptide fold or domain or sub-domain
EVIYYLASRNEPVIAARLARWMKVQPPTV

SEQ ID NO: 4494 - protein, 24 aa, artificial
  peptide fold or domain or sub-domain
EVKELIRAALEGDFRRAREIHYYL

SEQ ID NO: 4495 - protein, 26 aa, artificial
  peptide fold or domain or sub-domain
EVKELIRAALEGDFRRAREIHYYLHD

SEQ ID NO: 4496 - protein, 27 aa, artificial
  peptide fold or domain or sub-domain
EVKELKVAIRALGFEPKKEEIKRMISD

SEQ ID NO: 4497 - protein, 29 aa, artificial
  peptide fold or domain or sub-domain
EVKEVIYQYLEGGPVEYEGKYVKTGTADV

SEQ ID NO: 4498 - protein, 27 aa, artificial
  peptide fold or domain or sub-domain
EVKIFRDKNYDKMTGKNIEHGPLDLRM

SEQ ID NO: 4499 - protein, 27 aa, artificial
  peptide fold or domain or sub-domain
EVLCFMADEEVARIAKINGSTRATASI

SEQ ID NO: 4500 - protein, 20 aa, artificial
  peptide fold or domain or sub-domain
EVLLLQSVYWPLYINDPQLK

SEQ ID NO: 4501 - protein, 29 aa, artificial
  peptide fold or domain or sub-domain
EVLTDRGSQFTSELMKEVSRLFSIRQMTT

SEQ ID NO: 4502 - protein, 29 aa, artificial
  peptide fold or domain or sub-domain
EVMFFKDRFYMRTNPFYPEVELNFISVFW

SEQ ID NO: 4503 - protein, 29 aa, artificial
  peptide fold or domain or sub-domain
EVMFFKGRHLWRVYSDIAGAEFEFIDSFW

SEQ ID NO: 4504 - protein, 29 aa, artificial
  peptide fold or domain or sub-domain
EVNACLKQLDNKDIADYEHNQLMRRLRQL

SEQ ID NO: 4505 - protein, 20 aa, artificial
  peptide fold or domain or sub-domain
EVNETPVAGLTIRDVLAVIK

SEQ ID NO: 4506 - protein, 20 aa, artificial
  peptide fold or domain or sub-domain
EVNGENVEKETHQQVVSRIR

SEQ ID NO: 4507 - protein, 20 aa, artificial
  peptide fold or domain or sub-domain
EVNGISIEGQSHDEVVNMLK

SEQ ID NO: 4508 - protein, 22 aa, artificial
  peptide fold or domain or sub-domain
EVNGISIEGQSHDEVVNMLKSS

SEQ ID NO: 4509 - protein, 22 aa, artificial
  peptide fold or domain or sub-domain
EVNGKDVRGCMQEDVAAMLKTI

SEQ ID NO: 4510 - protein, 22 aa, artificial
  peptide fold or domain or sub-domain
EVNGTSLRGVTHDQSIAYLRRT

SEQ ID NO: 4511 - protein, 22 aa, artificial
  peptide fold or domain or sub-domain
EVNGTTLEHMSHADSVRTLVKS

SEQ ID NO: 4512 - protein, 20 aa, artificial
  peptide fold or domain or sub-domain
EVNGYPVGGQNDLERLQQLP

SEQ ID NO: 4513 - protein, 26 aa, artificial
  peptide fold or domain or sub-domain
EVNNVLRQGLEKGLTINNLMENWDFL

SEQ ID NO: 4514 - protein, 22 aa, artificial
  peptide fold or domain or sub-domain
EVNQDFTNRINKLKNSLFEYQK

SEQ ID NO: 4515 - protein, 28 aa, artificial
  peptide fold or domain or sub-domain
EVNQDFTNRINKLKNSLFEYQKNNKDSH

SEQ ID NO: 4516 - protein, 29 aa, artificial
  peptide fold or domain or sub-domain
EVNTSLLFGVEDDMDFARELIKEESVLVL

SEQ ID NO: 4517 - protein, 30 aa, artificial
  peptide fold or domain or sub-domain
EVPEGVINKDDYVPMSISAVSYDGKMYAVP

SEQ ID NO: 4518 - protein, 25 aa, artificial
  peptide fold or domain or sub-domain
EVPFAGDEEDDPFIIEEAILNGKLE

SEQ ID NO: 4519 - protein, 21 aa, artificial
  peptide fold or domain or sub-domain
EVQAGRYDAISGFTPIPAMSP

SEQ ID NO: 4520 - protein, 25 aa, artificial
  peptide fold or domain or sub-domain
EVQQMWDRAGEFMPSLNHAGFVNHF

SEQ ID NO: 4521 - protein, 23 aa, artificial
  peptide fold or domain or sub-domain
EVQRPGRRVLDFKSFYNGSRQLI

SEQ ID NO: 4522 - protein, 21 aa, artificial
  peptide fold or domain or sub-domain
EVRIVPESRLSRVLGERAEVP

SEQ ID NO: 4523 - protein, 30 aa, artificial
  peptide fold or domain or sub-domain
EVRPEDLGTGLLEALLRGDLAGAEALFRRG

SEQ ID NO: 4524 - protein, 24 aa, artificial
  peptide fold or domain or sub-domain
EVSALKVNGRRRSDLFREGVALVP

SEQ ID NO: 4525 - protein, 29 aa, artificial
  peptide fold or domain or sub-domain
EVSEAERLAAHLKQQHVYTDSRRNEVLRM

SEQ ID NO: 4526 - protein, 30 aa, artificial
  peptide fold or domain or sub-domain
EVSEDVLLQKVVEQLVAGDEAGVEASVELA

SEQ ID NO: 4527 - protein, 20 aa, artificial
  peptide fold or domain or sub-domain
EVSEGTLKITARKVGSGGNA

SEQ ID NO: 4528 - protein, 28 aa, artificial
  peptide fold or domain or sub-domain
EVSINVDHAREVKEKKRIMNDKKLIRML

SEQ ID NO: 4529 - protein, 21 aa, artificial
  peptide fold or domain or sub-domain
EVSLKPGSLAARACGGERIGA

SEQ ID NO: 4530 - protein, 25 aa, artificial
  peptide fold or domain or sub-domain
EVSLLVFSPAGRLYEYASSSIEGTY

SEQ ID NO: 4531 - protein, 23 aa, artificial
  peptide fold or domain or sub-domain
EVSLSDWLAHTPPQLVEAHLNVA

SEQ ID NO: 4532 - protein, 20 aa, artificial
  peptide fold or domain or sub-domain
EVSSRMLRERVKEGQSIRYF

SEQ ID NO: 4533 - protein, 20 aa, artificial
  peptide fold or domain or sub-domain
EVSSSEVRKWLRSGKPVEKY

SEQ ID NO: 4534 - protein, 20 aa, artificial
  peptide fold or domain or sub-domain
EVSSSQIRDALQQHRSIDYL

SEQ ID NO: 4535 - protein, 25 aa, artificial
  peptide fold or domain or sub-domain
EVTLLSQKAPNASFEKVSQLARHFL

SEQ ID NO: 4536 - protein, 30 aa, artificial
  peptide fold or domain or sub-domain
EVTVLSTSPSKEKDAKALGAAHFAATSNKD

SEQ ID NO: 4537 - protein, 27 aa, artificial
  peptide fold or domain or sub-domain
EVVALTWHDRQRSRQRLVSDWGTEIQL

SEQ ID NO: 4538 - protein, 30 aa, artificial
  peptide fold or domain or sub-domain
EVVAVGRTPAHLEVAKELGAARTVDSTDQD

SEQ ID NO: 4539 - protein, 29 aa, artificial
  peptide fold or domain or sub-domain
EVVDNNGAKDGLLPIFIYADRGSFRGNEI

SEQ ID NO: 4540 - protein, 27 aa, artificial
  peptide fold or domain or sub-domain
EVVELLAHPEVVARAKATGGTRAEAAV

SEQ ID NO: 4541 - protein, 27 aa, artificial
  peptide fold or domain or sub-domain
EVVENVDFNNSPYNIKTDGGEYQADSI

SEQ ID NO: 4542 - protein, 27 aa, artificial
  peptide fold or domain or sub-domain
EVVFAPAAESDVYGYVNKAEYLERVQY

SEQ ID NO: 4543 - protein, 28 aa, artificial
  peptide fold or domain or sub-domain
EVVGKAVLYCVERGKFLADLTLEEFKAF

SEQ ID NO: 4544 - protein, 29 aa, artificial
  peptide fold or domain or sub-domain
EVVGLEGDEKGVKAVVTKNGKFEADLVII

SEQ ID NO: 4545 - protein, 24 aa, artificial
  peptide fold or domain or sub-domain
EVVHEVYLGQEKHDHLNSKYINRT

SEQ ID NO: 4546 - protein, 28 aa, artificial
  peptide fold or domain or sub-domain
EVVLDPFPWNESMCVEGQTFWKWPAYNG

SEQ ID NO: 4547 - protein, 20 aa, artificial
  peptide fold or domain or sub-domain
EVVPIMELCAHSHSLNSRGN

SEQ ID NO: 4548 - protein, 25 aa, artificial
  peptide fold or domain or sub-domain
EVVRDKLAAITDWTAENVHHAIQAT

SEQ ID NO: 4549 - protein, 23 aa, artificial
  peptide fold or domain or sub-domain
EVWAPDATSVEIDFGAPGDTPTR

SEQ ID NO: 4550 - protein, 30 aa, artificial
  peptide fold or domain or sub-domain
EVYEETGSITKAHEAVADVVNRRFVERVVY

SEQ ID NO: 4551 - protein, 21 aa, artificial
  peptide fold or domain or sub-domain
EVYEGDVRVMEVNFTLDPRAE

SEQ ID NO: 4552 - protein, 28 aa, artificial
  peptide fold or domain or sub-domain
EVYLHPDDRMLWEESNGDAPFTPIDVED

SEQ ID NO: 4553 - protein, 23 aa, artificial
  peptide fold or domain or sub-domain
EWAGMLVSRSVSIQERAAASDAL

SEQ ID NO: 4554 - protein, 22 aa, artificial
  peptide fold or domain or sub-domain
EWALQKLTSAGFSLRDAVRGYN

SEQ ID NO: 4555 - protein, 27 aa, artificial
  peptide fold or domain or sub-domain
EWAWLLLSWSRLAKTDPLSVPARVAAL

SEQ ID NO: 4556 - protein, 23 aa, artificial
  peptide fold or domain or sub-domain
EWAWTGALAAWALDHPADPDRAQ

SEQ ID NO: 4557 - protein, 22 aa, artificial
  peptide fold or domain or sub-domain
EWERIQYYFEEDIRNNSAWNYR

SEQ ID NO: 4558 - protein, 21 aa, artificial
  peptide fold or domain or sub-domain
EWERRRATLIAKRTMRDGVPV

SEQ ID NO: 4559 - protein, 27 aa, artificial
  peptide fold or domain or sub-domain
EWIGCIYAGSGSTYYASWVNGRFTISS

SEQ ID NO: 4560 - protein, 27 aa, artificial
  peptide fold or domain or sub-domain
EWIGEINPDSSTINYAPSLKDKFIISR

SEQ ID NO: 4561 - protein, 25 aa, artificial
  peptide fold or domain or sub-domain
  misc_feature (11)..(11): Xaa can be any naturally occurring amino acid
  misc_feature (22)..(22): Xaa can be any naturally occurring amino acid
EWIGRIDPANXNSKYGPKFQGXATI

SEQ ID NO: 4562 - protein, 27 aa, artificial
  peptide fold or domain or sub-domain
EWIGRIDPNGGGTKYNEKFKSKATLTV

SEQ ID NO: 4563 - protein, 27 aa, artificial
  peptide fold or domain or sub-domain
EWIGWMDTGSNSASYGSSFKSGYVMTE

SEQ ID NO: 4564 - protein, 28 aa, artificial
  peptide fold or domain or sub-domain
EWIYEASMHGITHKLGFADAMRQHKGLG

SEQ ID NO: 4565 - protein, 27 aa, artificial
  peptide fold or domain or sub-domain
EWLLAYHAPTTTVYFAPGIESRFTPSK

SEQ ID NO: 4566 - protein, 27 aa, artificial
  peptide fold or domain or sub-domain
EWLSYIDSSSYIIRYSPDVEGRATVSR

SEQ ID NO: 4567 - protein, 27 aa, artificial
  peptide fold or domain or sub-domain
EWMAVVHPSDDRTTYGPRSQARFTVTR

SEQ ID NO: 4568 - protein, 27 aa, artificial
  peptide fold or domain or sub-domain
EWMGWIDPNNGDTRFAQRFQGRVTMTR

SEQ ID NO: 4569 - protein, 30 aa, artificial
  peptide fold or domain or sub-domain
EWPQIIENSKQVITEAKEVTLKNSPMFKRY

SEQ ID NO: 4570 - protein, 30 aa, artificial
  peptide fold or domain or sub-domain
EWQRKPPVTHQEFTGNHQARQRFWARNLVG

SEQ ID NO: 4571 - protein, 30 aa, artificial
  peptide fold or domain or sub-domain
EWRSWEVNKRLEYSLVKGITEFIEQDTEEA

SEQ ID NO: 4572 - protein, 20 aa, artificial
  peptide fold or domain or sub-domain
EWTKDGIFHVDENTNVTVPM

SEQ ID NO: 4573 - protein, 27 aa, artificial
  peptide fold or domain or sub-domain
EWVAVIWYDGSNKYYADSVKGRFTISR

SEQ ID NO: 4574 - protein, 22 aa, artificial
  peptide fold or domain or sub-domain
EWVIRTLTRAGISAEEAMETHI

SEQ ID NO: 4575 - protein, 29 aa, artificial
  peptide fold or domain or sub-domain
EWYQKGWRTIEQVRKHKDSFTKQIKVGLE

SEQ ID NO: 4576 - protein, 25 aa, artificial
  peptide fold or domain or sub-domain
EYAGKWRNIRVQGPTTFLPSLTVQV

SEQ ID NO: 4577 - protein, 24 aa, artificial
  peptide fold or domain or sub-domain
EYDGKKLFDPRKFLAPGMKAVQGA

SEQ ID NO: 4578 - protein, 21 aa, artificial
  peptide fold or domain or sub-domain
EYELVATEGPDHQREYTVIVS

SEQ ID NO: 4579 - protein, 25 aa, artificial
  peptide fold or domain or sub-domain
EYGIAITLNAERAGMGYQEYVNMYH

SEQ ID NO: 4580 - protein, 30 aa, artificial
  peptide fold or domain or sub-domain
EYGLIGDIDNPKIYGAGLLSSVGESKHCLT

SEQ ID NO: 4581 - protein, 25 aa, artificial
  peptide fold or domain or sub-domain
EYGTATETKALEEGLTPQEICDKYH

SEQ ID NO: 4582 - protein, 29 aa, artificial
  peptide fold or domain or sub-domain
EYGWIPPKVQQANHDIKVMSVGFLLGTPD

SEQ ID NO: 4583 - protein, 23 aa, artificial
  peptide fold or domain or sub-domain
EYIGSVSGIEKEMIEPLDIPFHG

SEQ ID NO: 4584 - protein, 23 aa, artificial
  peptide fold or domain or sub-domain
EYIGTKDGIERSIIEKENIKYNC

SEQ ID NO: 4585 - protein, 21 aa, artificial
  peptide fold or domain or sub-domain
EYILVRTEKNDGDRIFVVEVR

SEQ ID NO: 4586 - protein, 27 aa, artificial
  peptide fold or domain or sub-domain
EYIYNNKVYTSAEELYEAMQKDDFVTL

SEQ ID NO: 4587 - protein, 27 aa, artificial
  peptide fold or domain or sub-domain
EYKILAGGTDLVLHLRERKVSPKALVD

SEQ ID NO: 4588 - protein, 28 aa, artificial
  peptide fold or domain or sub-domain
EYKLVQDIFESIEQGDVQAFSDKVFEFD

SEQ ID NO: 4589 - protein, 29 aa, artificial
  peptide fold or domain or sub-domain
EYLSREGLASLKDAMVKLAEYEGFPAHGN

SEQ ID NO: 4590 - protein, 29 aa, artificial
  peptide fold or domain or sub-domain
EYLVVYTPTHEGGLEMQFRVPGDQTSTII

SEQ ID NO: 4591 - protein, 30 aa, artificial
  peptide fold or domain or sub-domain
EYMACGVGACLGCARKAKPDNEFYVKICQD

SEQ ID NO: 4592 - protein, 21 aa, artificial
  peptide fold or domain or sub-domain
EYPAEVSPLARRNDDNPFITD

SEQ ID NO: 4593 - protein, 26 aa, artificial
  peptide fold or domain or sub-domain
EYPIIGCLDTKEKKCLQYVTDTRRPK

SEQ ID NO: 4594 - protein, 22 aa, artificial
  peptide fold or domain or sub-domain
EYPKIVAEKVLEGIEGGKIAEE

SEQ ID NO: 4595 - protein, 28 aa, artificial
  peptide fold or domain or sub-domain
EYQLLKDLQDTIEASDANMFADKVFTYD

SEQ ID NO: 4596 - protein, 28 aa, artificial
  peptide fold or domain or sub-domain
EYQLLVDLLEAASNNNLEMFQDKLAAYD

SEQ ID NO: 4597 - protein, 27 aa, artificial
  peptide fold or domain or sub-domain
EYQVQLDIAMQSGKPKEIAEKMVEGRM

SEQ ID NO: 4598 - protein, 23 aa, artificial
  peptide fold or domain or sub-domain
EYRCSQCAYCRSGSYNLCVSMGF

SEQ ID NO: 4599 - protein, 30 aa, artificial
  peptide fold or domain or sub-domain
EYRCSQCAYCRSGSYNLCVSMGFAGLMGDG

SEQ ID NO: 4600 - protein, 21 aa, artificial
  peptide fold or domain or sub-domain
EYRVVKTEGEDHSRLFTMSCK

SEQ ID NO: 4601 - protein, 20 aa, artificial
  peptide fold or domain or sub-domain
EYSRTNKIYEAVRQNQVDIG

SEQ ID NO: 4602 - protein, 24 aa, artificial
  peptide fold or domain or sub-domain
EYTIIYTIKKYDVTFISTINTINE

SEQ ID NO: 4603 - protein, 28 aa, artificial
  peptide fold or domain or sub-domain
EYTLIMKVVESCDTCNLDILVDALREYG

SEQ ID NO: 4604 - protein, 22 aa, artificial
  peptide fold or domain or sub-domain
EYTMEWTPSEIRVFVDGERYFT

SEQ ID NO: 4605 - protein, 21 aa, artificial
  peptide fold or domain or sub-domain
EYTQLYTALESNGKTFNQEKM

SEQ ID NO: 4606 - protein, 21 aa, artificial
  peptide fold or domain or sub-domain
EYTVVKRTGPDHSVRFWVDVT

SEQ ID NO: 4607 - protein, 26 aa, artificial
  peptide fold or domain or sub-domain
EYVKDKDIKTINGNEVIVIRDTILPL

SEQ ID NO: 4608 - protein, 23 aa, artificial
  peptide fold or domain or sub-domain
EYWQRVQASEWKVGDPKGEEALD

SEQ ID NO: 4609 - protein, 23 aa, artificial
  peptide fold or domain or sub-domain
EYYDNYKPKIRASHILVKDEKTA

SEQ ID NO: 4610 - protein, 24 aa, artificial
  peptide fold or domain or sub-domain
EYYGVKEIGNSVVAKSGTDFRDLT

SEQ ID NO: 4611 - protein, 29 aa, artificial
  peptide fold or domain or sub-domain
EYYSLVNKELRHYQNGKETTTTIQTATQL

SEQ ID NO: 4612 - protein, 24 aa, artificial
  peptide fold or domain or sub-domain
FAAAERHDLQQCGAAHRAQRFFEI

SEQ ID NO: 4613 - protein, 28 aa, artificial
  peptide fold or domain or sub-domain
FAAAPADAVPEVLPFVHFTTRNRGGWGA

SEQ ID NO: 4614 - protein, 27 aa, artificial
  peptide fold or domain or sub-domain
FAAIKNSKVDVCGGVENGDFSGVVGWL

SEQ ID NO: 4615 - protein, 28 aa, artificial
  peptide fold or domain or sub-domain
FAANLSMMFTEVPFIERFAAARKAGFDA

SEQ ID NO: 4616 - protein, 25 aa, artificial
  peptide fold or domain or sub-domain
FAARMGCTDPAGVLDCLRARPVEQI

SEQ ID NO: 4617 - protein, 25 aa, artificial
  peptide fold or domain or sub-domain
FAASLRCSTQGKVIEELRKRTDGEL

SEQ ID NO: 4618 - protein, 28 aa, artificial
  peptide fold or domain or sub-domain
FAASVQNAPGYVAQAAHWVSSLAGGSGA

SEQ ID NO: 4619 - protein, 27 aa, artificial
  peptide fold or domain or sub-domain
FAATLQYMGRNPNSTNPADYQAAFEVL

SEQ ID NO: 4620 - protein, 28 aa, artificial
  peptide fold or domain or sub-domain
FACSVKNGVSAVKEMVDYVTDREGGRGA

SEQ ID NO: 4621 - protein, 25 aa, artificial
  peptide fold or domain or sub-domain
FADDAYRNALKDRKKSIVYDNLSTA

SEQ ID NO: 4622 - protein, 24 aa, artificial
  peptide fold or domain or sub-domain
FADDKLGPAVGAVFASTGEGQEAA

SEQ ID NO: 4623 - protein, 28 aa, artificial
  peptide fold or domain or sub-domain
FADFLNLASTQQALGVNINYTSTSSRQV

SEQ ID NO: 4624 - protein, 27 aa, artificial
  peptide fold or domain or sub-domain
FADRLIKAVEGSDLPRAVHGPVILDCL

SEQ ID NO: 4625 - protein, 20 aa, artificial
  peptide fold or domain or sub-domain
FAEASRRTPAVAQIFRTLAV

SEQ ID NO: 4626 - protein, 28 aa, artificial
  peptide fold or domain or sub-domain
FAEFKESVWLDSPDLLGPTTAATLLEIA

SEQ ID NO: 4627 - protein, 26 aa, artificial
  peptide fold or domain or sub-domain
FAEFYRLFTETNRRARLLQHDEAYYR

SEQ ID NO: 4628 - protein, 30 aa, artificial
  peptide fold or domain or sub-domain
FAEKIKKTGISICFPDYTGPSDDYEQSLVF

SEQ ID NO: 4629 - protein, 29 aa, artificial
  peptide fold or domain or sub-domain
FAERILTRSELDQYYELSEKRKNEFLAGR

SEQ ID NO: 4630 - protein, 21 aa, artificial
  peptide fold or domain or sub-domain
FAFLQNYYERMRTDPSKLAYF

SEQ ID NO: 4631 - protein, 22 aa, artificial
  peptide fold or domain or sub-domain
FAFTWVINWPLYEFDKEVNKFQ

SEQ ID NO: 4632 - protein, 28 aa, artificial
  peptide fold or domain or sub-domain
FAGAVKAWFAENPQGNDPRYYMRVGMDA

SEQ ID NO: 4633 - protein, 24 aa, artificial
  peptide fold or domain or sub-domain
FAGMMWQFTLRTGDATWRERAEHY

SEQ ID NO: 4634 - protein, 24 aa, artificial
  peptide fold or domain or sub-domain
FAGNLWQLYRLTGDSKYKEQAQKW

SEQ ID NO: 4635 - protein, 26 aa, artificial
  peptide fold or domain or sub-domain
FAHALKVTHKGPVDYAGAYVKGDFDM

SEQ ID NO: 4636 - protein, 22 aa, artificial
  peptide fold or domain or sub-domain
FAHHELNGVKEDALFKCVDSCS

SEQ ID NO: 4637 - protein, 25 aa, artificial
  peptide fold or domain or sub-domain
FAHNELISRKLGVRCEEDEGNMNNI

SEQ ID NO: 4638 - protein, 30 aa, artificial
  peptide fold or domain or sub-domain
FAHRGGMAMRPEQTQLAFDNAVEYGLDGFE

SEQ ID NO: 4639 - protein, 30 aa, artificial
  peptide fold or domain or sub-domain
FAHRGSKSNNPENTLAAFREAIRVQSDGIE

SEQ ID NO: 4640 - protein, 28 aa, artificial
  peptide fold or domain or sub-domain
FAHSRVKALLKYEGSSSIISKDAISAVS

SEQ ID NO: 4641 - protein, 24 aa, artificial
  peptide fold or domain or sub-domain
FAHTIHTGLKYGTISVLIESQSYE

SEQ ID NO: 4642 - protein, 25 aa, artificial
  peptide fold or domain or sub-domain
FAIERDAMAFRTFATNFIDARGASD

SEQ ID NO: 4643 - protein, 29 aa, artificial
  peptide fold or domain or sub-domain
FAIWELRSDRDLLPMGIDQDTLRITSAMS

SEQ ID NO: 4644 - protein, 22 aa, artificial
  peptide fold or domain or sub-domain
FAKAGVDFDTLKQQAAKPNFKA

SEQ ID NO: 4645 - protein, 27 aa, artificial
  peptide fold or domain or sub-domain
FAKAQEELGPLEPLFARGEFTPFLDWT

SEQ ID NO: 4646 - protein, 26 aa, artificial
  peptide fold or domain or sub-domain
FAKAVAVLLKEKDLSVEDLYDREKVK

SEQ ID NO: 4647 - protein, 27 aa, artificial
  peptide fold or domain or sub-domain
FAKHLESGCSEPVNVDSIARNIAKENL

SEQ ID NO: 4648 - protein, 25 aa, artificial
  peptide fold or domain or sub-domain
FAKKAINLAVDAPLEIGLMYEEAGS

SEQ ID NO: 4649 - protein, 27 aa, artificial
  peptide fold or domain or sub-domain
FAKLKKTKGLNRAFRCDVSEEIYEGLV

SEQ ID NO: 4650 - protein, 20 aa, artificial
  peptide fold or domain or sub-domain
FAKWCRIQSYYAREFIDYKD

SEQ ID NO: 4651 - protein, 23 aa, artificial
  peptide fold or domain or sub-domain
FALGTSEGIESRLVPNSGIDFFT

SEQ ID NO: 4652 - protein, 23 aa, artificial
  peptide fold or domain or sub-domain
FALKEPELTDEVIRRIEPGVSTL

SEQ ID NO: 4653 - protein, 24 aa, artificial
  peptide fold or domain or sub-domain
FALLDVLTSEDPAVLEPVEVVQPA

SEQ ID NO: 4654 - protein, 21 aa, artificial
  peptide fold or domain or sub-domain
FALLHPGYVRTGMTDGKGLID

SEQ ID NO: 4655 - protein, 25 aa, artificial
  peptide fold or domain or sub-domain
FALQALYQHLVGRNDADSIDAFTRD

SEQ ID NO: 4656 - protein, 25 aa, artificial
  peptide fold or domain or sub-domain
FALRYQVFTEAFGAEIESIDGLDQD

SEQ ID NO: 4657 - protein, 23 aa, artificial
  peptide fold or domain or sub-domain
FALYDYMKVRMMDASRDMDIAIV

SEQ ID NO: 4658 - protein, 23 aa, artificial
  peptide fold or domain or sub-domain
FALYEYFYHRLTQANAQKDIVIL

SEQ ID NO: 4659 - protein, 21 aa, artificial
  peptide fold or domain or sub-domain
FANEPDGWFARFADGRELMMK

SEQ ID NO: 4660 - protein, 30 aa, artificial
  peptide fold or domain or sub-domain
FANKLKTSSIATCFPDYKGPNTVDASLKYI

SEQ ID NO: 4661 - protein, 26 aa, artificial
  peptide fold or domain or sub-domain
FANWINGFRSRARAQGISNRTFDAAF

SEQ ID NO: 4662 - protein, 24 aa, artificial
  peptide fold or domain or sub-domain
FAPAEVASLRALPVSGQRERFFDY

SEQ ID NO: 4663 - protein, 24 aa, artificial
  peptide fold or domain or sub-domain
FAPQEVQQLESLEGEKRTKLFYQL

SEQ ID NO: 4664 - protein, 20 aa, artificial
  peptide fold or domain or sub-domain
FAPSDQPVCNQCKGPLGRNC

SEQ ID NO: 4665 - protein, 26 aa, artificial
  peptide fold or domain or sub-domain
FAQCVVDLQGQAKTAGVSKRVTDEVL

SEQ ID NO: 4666 - protein, 25 aa, artificial
  peptide fold or domain or sub-domain
FAQDNLISRVQSGAISHEQAMSELK

SEQ ID NO: 4667 - protein, 27 aa, artificial
  peptide fold or domain or sub-domain
FAQTIVNGALKPESIDRNKIIEQLLEL

SEQ ID NO: 4668 - protein, 29 aa, artificial
  peptide fold or domain or sub-domain
FARISDQQEKVTYGSLMNIENLVKRVADQ

SEQ ID NO: 4669 - protein, 23 aa, artificial
  peptide fold or domain or sub-domain
FARLTLPAALVLHMLRLQSDLQI

SEQ ID NO: 4670 - protein, 29 aa, artificial
  peptide fold or domain or sub-domain
FARRQAQVNQLRYGEPVGVETLTKEITDY

SEQ ID NO: 4671 - protein, 27 aa, artificial
  peptide fold or domain or sub-domain
FASMVYFVTNESLEVFNLRMQLIGIAD

SEQ ID NO: 4672 - protein, 27 aa, artificial
  peptide fold or domain or sub-domain
FASPQVLGDLSTFDPLDDSVIKWWTDK

SEQ ID NO: 4673 - protein, 27 aa, artificial
  peptide fold or domain or sub-domain
FATIRSGQPDLDAQVLAGNLSPVFNWL

SEQ ID NO: 4674 - protein, 28 aa, artificial
  peptide fold or domain or sub-domain
FATRVPDDGDFPTLLNVRHLALRQDKPS

SEQ ID NO: 4675 - protein, 22 aa, artificial
  peptide fold or domain or sub-domain
FATVGKNLEQMRELALSGEFKP

SEQ ID NO: 4676 - protein, 26 aa, artificial
  peptide fold or domain or sub-domain
FATVGRADKVERARALGAEYVIDYRE

SEQ ID NO: 4677 - protein, 26 aa, artificial
  peptide fold or domain or sub-domain
FATYVEALKAEAIESGYKQDTLDKAF

SEQ ID NO: 4678 - protein, 24 aa, artificial
  peptide fold or domain or sub-domain
FAVCTIHARPTTMVHCVHYAKELY

SEQ ID NO: 4679 - protein, 20 aa, artificial
  peptide fold or domain or sub-domain
FAVDIKDVSQDMRRIAKTIN

SEQ ID NO: 4680 - protein, 27 aa, artificial
  peptide fold or domain or sub-domain
FAVDSAEQNGSTASLGNLELDVHPVDE

SEQ ID NO: 4681 - protein, 21 aa, artificial
  peptide fold or domain or sub-domain
FAVHSTRFGNYWDNPELYKAI

SEQ ID NO: 4682 - protein, 25 aa, artificial
  peptide fold or domain or sub-domain
FAWKRWVEGKPEIIIDPFLIEKPRN

SEQ ID NO: 4683 - protein, 29 aa, artificial
  peptide fold or domain or sub-domain
FCADCIITALRSGNKECPTCRKKLVSKRS

SEQ ID NO: 4684 - protein, 29 aa, artificial
  peptide fold or domain or sub-domain
FCCNESEAEILTGLTVGSAADAGEAALVL

SEQ ID NO: 4685 - protein, 25 aa, artificial
  peptide fold or domain or sub-domain
FCDALLKQCLNTPEVVKLDDALYTL

SEQ ID NO: 4686 - protein, 30 aa, artificial
  peptide fold or domain or sub-domain
FCEKLSVIPLSKYKPDFKGGDQDDAIDFME

SEQ ID NO: 4687 - protein, 27 aa, artificial
  peptide fold or domain or sub-domain
FCFMKNSNSQILSQVERGDFSYFVSWI

SEQ ID NO: 4688 - protein, 29 aa, artificial
  peptide fold or domain or sub-domain
FCFSCITWHWESAGLSCPKCRAVFDARPE

SEQ ID NO: 4689 - protein, 26 aa, artificial
  peptide fold or domain or sub-domain
FCGECFFCHHGYVNNCTDPNGGWALG

SEQ ID NO: 4690 - protein, 29 aa, artificial
  peptide fold or domain or sub-domain
FCGECLQPCLQVPSPLCPLCRLPFDPKKV

SEQ ID NO: 4691 - protein, 20 aa, artificial
  peptide fold or domain or sub-domain
FCGFTCTRLGEMYGVGHQAI

SEQ ID NO: 4692 - protein, 26 aa, artificial
  peptide fold or domain or sub-domain
FCGTCRWCMRGELQHCAHKRRSRDPG

SEQ ID NO: 4693 - protein, 25 aa, artificial
  peptide fold or domain or sub-domain
FCIGGSWIAPRNLITAKNWHAISAL

SEQ ID NO: 4694 - protein, 29 aa, artificial
  peptide fold or domain or sub-domain
FCKACIIKSIRDAGHKCPVDNEILLENQL

SEQ ID NO: 4695 - protein, 29 aa, artificial
  peptide fold or domain or sub-domain
FCKCCIERWINDGKGKCPIDNSDLTDGQM

SEQ ID NO: 4696 - protein, 29 aa, artificial
  peptide fold or domain or sub-domain
FCKGCISRSWEHRQHTCPVCKETSSFDDL

SEQ ID NO: 4697 - protein, 25 aa, artificial
  peptide fold or domain or sub-domain
FCKIAVNEGMQTDIDWAMTVEADLF

SEQ ID NO: 4698 - protein, 20 aa, artificial
  peptide fold or domain or sub-domain
FCKYSDSFCENYNEYCTLTQ

SEQ ID NO: 4699 - protein, 29 aa, artificial
  peptide fold or domain or sub-domain
FCMKCLKHAAAKCGKRCPKCRQLISNSRS

SEQ ID NO: 4700 - protein, 29 aa, artificial
  peptide fold or domain or sub-domain
FCMRNGHEEAKKHATYIAESNDDAGFAQA

SEQ ID NO: 4701 - protein, 29 aa, artificial
  peptide fold or domain or sub-domain
FCNPCVQKLTGTRQKKCPTCSASFGPNDI

SEQ ID NO: 4702 - protein, 29 aa, artificial
  peptide fold or domain or sub-domain
FCNQCLLNNFNIGKNNCPSCKQIINKNKL

SEQ ID NO: 4703 - protein, 22 aa, artificial
  peptide fold or domain or sub-domain
FCPLENMEKDIGMRSDFDITGH

SEQ ID NO: 4704 - protein, 29 aa, artificial
  peptide fold or domain or sub-domain
FCQECISQVGKGGGSVCPVCRQRFLLKNL

SEQ ID NO: 4705 - protein, 27 aa, artificial
  peptide fold or domain or sub-domain
FCQNATKDFADFEDFREGADKEWLLAQ

SEQ ID NO: 4706 - protein, 29 aa, artificial
  peptide fold or domain or sub-domain
FCRACILQTLQRSKPLCPLCRGSLTQSDL

SEQ ID NO: 4707 - protein, 29 aa, artificial
  peptide fold or domain or sub-domain
FCRDCIEKSMWLGNDECPACRTLASSHSL

SEQ ID NO: 4708 - protein, 29 aa, artificial
  peptide fold or domain or sub-domain
FCRECLRKSTRFNGEQCPLCREKFTTSQA

SEQ ID NO: 4709 - protein, 29 aa, artificial
  peptide fold or domain or sub-domain
FCRGCLKRCWDTGLRECPVCRKKVNKSSA

SEQ ID NO: 4710 - protein, 29 aa, artificial
  peptide fold or domain or sub-domain
FCRICILRCLKVMGSYCPSCRYPCFPTDL

SEQ ID NO: 4711 - protein, 29 aa, artificial
  peptide fold or domain or sub-domain
FCRKCFLTAMRESGAHCPLCRGNVTRRER

SEQ ID NO: 4712 - protein, 29 aa, artificial
  peptide fold or domain or sub-domain
FCRKCITDWLNEKNSNCPLDNEPLDIKCD

SEQ ID NO: 4713 - protein, 29 aa, artificial
  peptide fold or domain or sub-domain
FCRLCIIRYTHALGPNCPTCNQHLNPSHL

SEQ ID NO: 4714 - protein, 29 aa, artificial
  peptide fold or domain or sub-domain
FCRSCIATSLKNNKWTCPYCRAYLPSEGV

SEQ ID NO: 4715 - protein, 29 aa, artificial
  peptide fold or domain or sub-domain
FCRSCLTAWMQKNNQCCPMDNKRLSAEHD

SEQ ID NO: 4716 - protein, 29 aa, artificial
  peptide fold or domain or sub-domain
FCRSCMDSWLERENPSCPIDNTKLEKGVD

SEQ ID NO: 4717 - protein, 27 aa, artificial
  peptide fold or domain or sub-domain
FCSAYLGYRWGIHAPGKKGEREGFLSA

SEQ ID NO: 4718 - protein, 20 aa, artificial
  peptide fold or domain or sub-domain
FCSEAQFECQNHRCISKQWL

SEQ ID NO: 4719 - protein, 29 aa, artificial
  peptide fold or domain or sub-domain
FCSLCIQRYLTNTSQRCPTCMQEQQISQL

SEQ ID NO: 4720 - protein, 29 aa, artificial
  peptide fold or domain or sub-domain
FCVNELEAEVTSGISFDGKLSIEHIMNKL

SEQ ID NO: 4721 - protein, 29 aa, artificial
  peptide fold or domain or sub-domain
FCVNEVEASMITGIDVKDTQSAILATEEM

SEQ ID NO: 4722 - protein, 29 aa, artificial
  peptide fold or domain or sub-domain
FCWPCIHQWMNGYRNTCPVCKSSISKEKV

SEQ ID NO: 4723 - protein, 29 aa, artificial
  peptide fold or domain or sub-domain
FCWSCLLSWMNRRNYQCPICQAGISRDNV

SEQ ID NO: 4724 - protein, 27 aa, artificial
  peptide fold or domain or sub-domain
FDAASRAVPDIGPAIGRGDFTPLLGWL

SEQ ID NO: 4725 - protein, 27 aa, artificial
  peptide fold or domain or sub-domain
FDADAISQLGMGAYTAVGRGSDNPAHM

SEQ ID NO: 4726 - protein, 28 aa, artificial
  peptide fold or domain or sub-domain
FDAGRDPHVVDSVEFLKNQGIDFDLARQ

SEQ ID NO: 4727 - protein, 22 aa, artificial
  peptide fold or domain or sub-domain
FDALDLDFAELSASALSPDFEP

SEQ ID NO: 4728 - protein, 30 aa, artificial
  peptide fold or domain or sub-domain
FDANVASAAGANANGAQAETNSQGIGAGVT

SEQ ID NO: 4729 - protein, 26 aa, artificial
  peptide fold or domain or sub-domain
FDAWVAGFKDRAARQGIRSATLESAF

SEQ ID NO: 4730 - protein, 28 aa, artificial
  peptide fold or domain or sub-domain
FDCWKSNPDVSNFMKQNNFSTYEQLESY

SEQ ID NO: 4731 - protein, 23 aa, artificial
  peptide fold or domain or sub-domain
FDDEILADAFGVDVQTARRLKGQ

SEQ ID NO: 4732 - protein, 25 aa, artificial
  peptide fold or domain or sub-domain
FDDEKYYHPFCAITDWTDPKIYKNC

SEQ ID NO: 4733 - protein, 26 aa, artificial
  peptide fold or domain or sub-domain
FDDFRSEFRQEAIGQGIDPAVYDREM

SEQ ID NO: 4734 - protein, 21 aa, artificial
  peptide fold or domain or sub-domain
FDDFTTAALDRSKWRVVRTGT

SEQ ID NO: 4735 - protein, 25 aa, artificial
  peptide fold or domain or sub-domain
FDDPTWYHNKGNIQNYGNQQEVEDG

SEQ ID NO: 4736 - protein, 23 aa, artificial
  peptide fold or domain or sub-domain
FDDVLRDRGYQSRSKGIRDALKD

SEQ ID NO: 4737 - protein, 20 aa, artificial
  peptide fold or domain or sub-domain
FDDWLAKGYVPNEDVRDALL

SEQ ID NO: 4738 - protein, 28 aa, artificial
  peptide fold or domain or sub-domain
FDEHKCFKNDKSIAFLKSNGLNLDKIRE

SEQ ID NO: 4739 - protein, 23 aa, artificial
  peptide fold or domain or sub-domain
FDEIIKKRDSPSRSEAIRDALIS

SEQ ID NO: 4740 - protein, 29 aa, artificial
  peptide fold or domain or sub-domain
FDEIVESHADPERAAAILGNPFYQSLSAG

SEQ ID NO: 4741 - protein, 21 aa, artificial
  peptide fold or domain or sub-domain
FDEMKDALDLRSKSGIHRLIT

SEQ ID NO: 4742 - protein, 28 aa, artificial
  peptide fold or domain or sub-domain
FDETQDMCSEDIKDLLKQSGVDFVRHQQ

SEQ ID NO: 4743 - protein, 23 aa, artificial
  peptide fold or domain or sub-domain
FDETWQAEGLDSRSRAIREAMQE

SEQ ID NO: 4744 - protein, 23 aa, artificial
  peptide fold or domain or sub-domain
FDFEFAKKSEIFCLDPKLESDFK

SEQ ID NO: 4745 - protein, 26 aa, artificial
  peptide fold or domain or sub-domain
FDFWSSKDRLAAAPGDNEYVSATVFA

SEQ ID NO: 4746 - protein, 24 aa, artificial
  peptide fold or domain or sub-domain
FDGFAVFNNTIDLSSGRQNLILHE

SEQ ID NO: 4747 - protein, 26 aa, artificial
  peptide fold or domain or sub-domain
FDGFDVDIIAQSFGVNYETAQKLKSS

SEQ ID NO: 4748 - protein, 25 aa, artificial
  peptide fold or domain or sub-domain
FDGIVHNDPNFDEMNDVICVRRIRP

SEQ ID NO: 4749 - protein, 20 aa, artificial
  peptide fold or domain or sub-domain
FDGWAKRFNLTAEETTDWEI

SEQ ID NO: 4750 - protein, 24 aa, artificial
  peptide fold or domain or sub-domain
FDIGAYLSPKEARRMDVFIHYGLA

SEQ ID NO: 4751 - protein, 27 aa, artificial
  peptide fold or domain or sub-domain
FDKKRLEKEQMGLLLAVNRGSNLDPTL

SEQ ID NO: 4752 - protein, 27 aa, artificial
  peptide fold or domain or sub-domain
FDKSFMERKSMNLLLGVSQGSAQEPKL

SEQ ID NO: 4753 - protein, 30 aa, artificial
  peptide fold or domain or sub-domain
FDKSIISAASYEARKYNIKAAMPLFKAKKL

SEQ ID NO: 4754 - protein, 23 aa, artificial
  peptide fold or domain or sub-domain
FDKTSLYENDLLGLRTMNENGKL

SEQ ID NO: 4755 - protein, 21 aa, artificial
  peptide fold or domain or sub-domain
FDLAASAASNHHLQSLGGVCQ

SEQ ID NO: 4756 - protein, 26 aa, artificial
  peptide fold or domain or sub-domain
FDLKGLAERLSRVFPGLVKIRDDVKA

SEQ ID NO: 4757 - protein, 21 aa, artificial
  peptide fold or domain or sub-domain
FDLSVGQILGARENGLRYRQL

SEQ ID NO: 4758 - protein, 23 aa, artificial
  peptide fold or domain or sub-domain
FDLYNYMLDRLTKANINRDMSAI

SEQ ID NO: 4759 - protein, 27 aa, artificial
  peptide fold or domain or sub-domain
FDNKLGVNSFYGNCDICKLSYINCSGH

SEQ ID NO: 4760 - protein, 28 aa, artificial
  peptide fold or domain or sub-domain
FDPAEAVVGPDAPTDCFGEDCMVTPYER

SEQ ID NO: 4761 - protein, 24 aa, artificial
  peptide fold or domain or sub-domain
FDPANYISRKDIRRMDRFAQLAVA

SEQ ID NO: 4762 - protein, 27 aa, artificial
  peptide fold or domain or sub-domain
FDPENPQTPPATCPANGSSGEPLIGPV

SEQ ID NO: 4763 - protein, 28 aa, artificial
  peptide fold or domain or sub-domain
FDPKKEIMSTESLELLRKSGINFEKHEN

SEQ ID NO: 4764 - protein, 20 aa, artificial
  peptide fold or domain or sub-domain
FDPKMRQMLEGGLEQCQLSR

SEQ ID NO: 4765 - protein, 24 aa, artificial
  peptide fold or domain or sub-domain
FDPSLVMDPKEVKKADRFIQLGIK

SEQ ID NO: 4766 - protein, 25 aa, artificial
  peptide fold or domain or sub-domain
FDQLMRYFGEDPSDSFVRNSFISKF

SEQ ID NO: 4767 - protein, 28 aa, artificial
  peptide fold or domain or sub-domain
FDQRVHRHAAESVQLLAEHGVDLAAHRR

SEQ ID NO: 4768 - protein, 30 aa, artificial
  peptide fold or domain or sub-domain
FDQTPFAYEKAFQWADDDREFVRRSGFVMM

SEQ ID NO: 4769 - protein, 26 aa, artificial
  peptide fold or domain or sub-domain
FDRCLAGLQTQAAAKGVDAASFQRFT

SEQ ID NO: 4770 - protein, 26 aa, artificial
  peptide fold or domain or sub-domain
FDRDKDIDFMSGQSLFGNYRPGDYDK

SEQ ID NO: 4771 - protein, 21 aa, artificial
  peptide fold or domain or sub-domain
FDRSKADFTVAEFSCVIDGQS

SEQ ID NO: 4772 - protein, 20 aa, artificial
  peptide fold or domain or sub-domain
FDRTINLPEINQSSNMEVLA

SEQ ID NO: 4773 - protein, 27 aa, artificial
  peptide fold or domain or sub-domain
FDRYFAMNSTEPVNIDNSTSKRIRETV

SEQ ID NO: 4774 - protein, 28 aa, artificial
  peptide fold or domain or sub-domain
FDSDSAYLLEKRLAKRVQLHQLSGFRDY

SEQ ID NO: 4775 - protein, 27 aa, artificial
  peptide fold or domain or sub-domain
FDSTAAFYERLGFGIVFRDAGWMILQR

SEQ ID NO: 4776 - protein, 29 aa, artificial
  peptide fold or domain or sub-domain
FDSYDDFVEHSELDSEVDLKDYSVSNRGL

SEQ ID NO: 4777 - protein, 28 aa, artificial
  peptide fold or domain or sub-domain
FDTQAQMIASYLTAQRRDPASARRFDAL

SEQ ID NO: 4778 - protein, 30 aa, artificial
  peptide fold or domain or sub-domain
FDTRFLNPDKEDFFIDFLSIYSNIPKKSLK

SEQ ID NO: 4779 - protein, 27 aa, artificial
  peptide fold or domain or sub-domain
FDTRHQLMVEQLDNETWDAAADTCRKL

SEQ ID NO: 4780 - protein, 25 aa, artificial
  peptide fold or domain or sub-domain
FDTYIMKELLACSHPFSKSAIEHVQ

SEQ ID NO: 4781 - protein, 26 aa, artificial
  peptide fold or domain or sub-domain
FDVFADIERRTGERRGFATRGADYFR

SEQ ID NO: 4782 - protein, 24 aa, artificial
  peptide fold or domain or sub-domain
FDWGSGKWVRETPESELKFRPAPY

SEQ ID NO: 4783 - protein, 26 aa, artificial
  peptide fold or domain or sub-domain
FDWQPGYIKWYVDGVLKHTATANIPS

SEQ ID NO: 4784 - protein, 26 aa, artificial
  peptide fold or domain or sub-domain
FDWTKERVSFYVDGVFLYEMTENVPT

SEQ ID NO: 4785 - protein, 30 aa, artificial
  peptide fold or domain or sub-domain
FDYLTDAQGQLNANYTTDGLHLNPQAYQVI

SEQ ID NO: 4786 - protein, 26 aa, artificial
  peptide fold or domain or sub-domain
FDYWMDPATVESIGEERASFAIGASR

SEQ ID NO: 4787 - protein, 27 aa, artificial
  peptide fold or domain or sub-domain
FEAFAKQYPDWEQRISTGELNFVKAWL

SEQ ID NO: 4788 - protein, 26 aa, artificial
  peptide fold or domain or sub-domain
FEAFWEIFTATNERAKLGAFPREYYE

SEQ ID NO: 4789 - protein, 24 aa, artificial
  peptide fold or domain or sub-domain
FEASDYLSLKAAKRTERCIQFAIA

SEQ ID NO: 4790 - protein, 24 aa, artificial
  peptide fold or domain or sub-domain
FEDERIDDTTKMMLKELIPSGRFG

SEQ ID NO: 4791 - protein, 25 aa, artificial
  peptide fold or domain or sub-domain
FEDSRKVAKAAWDMDFTDEQIYVLR

SEQ ID NO: 4792 - protein, 29 aa, artificial
  peptide fold or domain or sub-domain
FEDVANESRQLGKFLAKYGVSDEKIYSLR

SEQ ID NO: 4793 - protein, 25 aa, artificial
  peptide fold or domain or sub-domain
FEEEKERSKNYLFTKIASPLLSVVE

SEQ ID NO: 4794 - protein, 25 aa, artificial
  peptide fold or domain or sub-domain
FEEEVGQHPTLEDMQEVVVHKKLRP

SEQ ID NO: 4795 - protein, 24 aa, artificial
  peptide fold or domain or sub-domain
FEEFWEKGFARQEVPEEARKWTRH

SEQ ID NO: 4796 - protein, 21 aa, artificial
  peptide fold or domain or sub-domain
FEEIAEGMGLSSLATVHKHIG

SEQ ID NO: 4797 - protein, 26 aa, artificial
  peptide fold or domain or sub-domain
FEEIGLMSEFLGDNPFRVRAYHQAAR

SEQ ID NO: 4798 - protein, 30 aa, artificial
  peptide fold or domain or sub-domain
FEEKIKKSPLTICYPEYAGSNTYEEAAAYI

SEQ ID NO: 4799 - protein, 30 aa, artificial
  peptide fold or domain or sub-domain
FEEKLTKVPLNTIFPEYTGGDNAVMGAQYI

SEQ ID NO: 4800 - protein, 30 aa, artificial
  peptide fold or domain or sub-domain
FEEKVKHVKIKDYFPKFEGANTVSEGTKFF

SEQ ID NO: 4801 - protein, 26 aa, artificial
  peptide fold or domain or sub-domain
FEELKAGLKRVGANLKESEILDLMQA

SEQ ID NO: 4802 - protein, 26 aa, artificial
  peptide fold or domain or sub-domain
FEELRDGLKKIGQVVPDGDVKMLMDA

SEQ ID NO: 4803 - protein, 21 aa, artificial
  peptide fold or domain or sub-domain
FEEPLSKQQKYCPPNLFSIVF

SEQ ID NO: 4804 - protein, 28 aa, artificial
  peptide fold or domain or sub-domain
FEEQKMYYVKNRVESRMEATGYENFRSY

SEQ ID NO: 4805 - protein, 30 aa, artificial
  peptide fold or domain or sub-domain
FEEQVSKRPNNVAIVCENEQLTYHELNVKA

SEQ ID NO: 4806 - protein, 20 aa, artificial
  peptide fold or domain or sub-domain
FEGALKKTPSVLRKWQHTGQ

SEQ ID NO: 4807 - protein, 21 aa, artificial
  peptide fold or domain or sub-domain
FEGNPVVESFTQRAAYISYIH

SEQ ID NO: 4808 - protein, 22 aa, artificial
  peptide fold or domain or sub-domain
FEGSGHDFAAIAAAADASAPIA

SEQ ID NO: 4809 - protein, 20 aa, artificial
  peptide fold or domain or sub-domain
FEGSGIRRMMAQGGPWEYLV

SEQ ID NO: 4810 - protein, 22 aa, artificial
  peptide fold or domain or sub-domain
FEGSGYTMDEILKLAMDNKPLP

SEQ ID NO: 4811 - protein, 27 aa, artificial
  peptide fold or domain or sub-domain
FEGWQPLRDDECQALGIAAGAEGWVRE

SEQ ID NO: 4812 - protein, 20 aa, artificial
  peptide fold or domain or sub-domain
FEHYINYRKHKVAHFWPKLL

SEQ ID NO: 4813 - protein, 24 aa, artificial
  peptide fold or domain or sub-domain
FEILGLCAQKTDKTNLVITYCQKA

SEQ ID NO: 4814 - protein, 20 aa, artificial
  peptide fold or domain or sub-domain
FEIWAKSFNLDNSQINDWKK

SEQ ID NO: 4815 - protein, 22 aa, artificial
  peptide fold or domain or sub-domain
FEKAGLSLPTLMARAADSPINL

SEQ ID NO: 4816 - protein, 21 aa, artificial
  peptide fold or domain or sub-domain
FEKEGVLKNYMYQDDIPYDTN

SEQ ID NO: 4817 - protein, 25 aa, artificial
  peptide fold or domain or sub-domain
FEKGIFRTDSPEEARRLVGEGIVET

SEQ ID NO: 4818 - protein, 29 aa, artificial
  peptide fold or domain or sub-domain
FEKLEDEDEQGWCKGRMNGRVGLYPANYV

SEQ ID NO: 4819 - protein, 25 aa, artificial
  peptide fold or domain or sub-domain
FEKLMLYWGENPANPNSKNTFFQKF

SEQ ID NO: 4820 - protein, 20 aa, artificial
  peptide fold or domain or sub-domain
FEKVGLDPAAMNIVARGINV

SEQ ID NO: 4821 - protein, 23 aa, artificial
  peptide fold or domain or sub-domain
FEKYNRKYYVGGAEEYNRLEKAA

SEQ ID NO: 4822 - protein, 22 aa, artificial
  peptide fold or domain or sub-domain
FEKYVRVNKPLETTRVGDLTFF

SEQ ID NO: 4823 - protein, 27 aa, artificial
  peptide fold or domain or sub-domain
FELKSHDKYPEIWALDEKDPFMGPEGG

SEQ ID NO: 4824 - protein, 26 aa, artificial
  peptide fold or domain or sub-domain
FELLESADEIFAYLRKTTTRTFLVVA

SEQ ID NO: 4825 - protein, 28 aa, artificial
  peptide fold or domain or sub-domain
FENHKLYYVEKRLSERMEELNMTCYRDY

SEQ ID NO: 4826 - protein, 26 aa, artificial
  peptide fold or domain or sub-domain
FENLYNILSIDEKTKFEALAYQRVAR

SEQ ID NO: 4827 - protein, 22 aa, artificial
  peptide fold or domain or sub-domain
FENPADIASDRALARTDPERVE

SEQ ID NO: 4828 - protein, 28 aa, artificial
  peptide fold or domain or sub-domain
FEPQAKTVKNIETRLEIRPIDLRRDALL

SEQ ID NO: 4829 - protein, 20 aa, artificial
  peptide fold or domain or sub-domain
FEPVSTAANNVCMSVIGRPC

SEQ ID NO: 4830 - protein, 26 aa, artificial
  peptide fold or domain or sub-domain
FEQCKQALGEKAVAAGVRESTVQSVM

SEQ ID NO: 4831 - protein, 28 aa, artificial
  peptide fold or domain or sub-domain
FEQDPKNKALIDAFKAKNQDPSGIFVLP

SEQ ID NO: 4832 - protein, 27 aa, artificial
  peptide fold or domain or sub-domain
FEQFVEAESPKEINIDYQTREEIKRKM

SEQ ID NO: 4833 - protein, 30 aa, artificial
  peptide fold or domain or sub-domain
FEQKLKTTSINVLFSTYQGSNDYAECVAYI

SEQ ID NO: 4834 - protein, 30 aa, artificial
  peptide fold or domain or sub-domain
FEQMIQKTDLSKCFPDYKGGSDVKTALEFI

SEQ ID NO: 4835 - protein, 26 aa, artificial
  peptide fold or domain or sub-domain
FEQWLADFRQRALAAGIGATTLDNAL

SEQ ID NO: 4836 - protein, 26 aa, artificial
  peptide fold or domain or sub-domain
FEQYVERLKQQAREEGISERILNEAF

SEQ ID NO: 4837 - protein, 21 aa, artificial
  peptide fold or domain or sub-domain
FERAQNGYENTLPDDAGVIVL

SEQ ID NO: 4838 - protein, 21 aa, artificial
  peptide fold or domain or sub-domain
FEREGTHRDAMFLHGEYLDVH

SEQ ID NO: 4839 - protein, 22 aa, artificial
  peptide fold or domain or sub-domain
FERHVRYVSPYKDMPLRFANLL

SEQ ID NO: 4840 - protein, 27 aa, artificial
  peptide fold or domain or sub-domain
FERILAQGTGAMGNLRERTHCDANLWQ

SEQ ID NO: 4841 - protein, 26 aa, artificial
  peptide fold or domain or sub-domain
FERMADILEFLGENPYRIRTYRRVAN

SEQ ID NO: 4842 - protein, 24 aa, artificial
  peptide fold or domain or sub-domain
FERVRRQLRENAEDQGNGCFEIFH

SEQ ID NO: 4843 - protein, 23 aa, artificial
  peptide fold or domain or sub-domain
FESAMHKLGYFNRSEAVRDLIRN

SEQ ID NO: 4844 - protein, 28 aa, artificial
  peptide fold or domain or sub-domain
FESIDLKYVNFTNPWSPGHTIMQSKLHR

SEQ ID NO: 4845 - protein, 20 aa, artificial
  peptide fold or domain or sub-domain
FESLAYTIRMQEMERLYQEV

SEQ ID NO: 4846 - protein, 24 aa, artificial
  peptide fold or domain or sub-domain
FESLGRDGYAAWDAVPEAGKLQII

SEQ ID NO: 4847 - protein, 25 aa, artificial
  peptide fold or domain or sub-domain
FESLMHTYGEDSGDKFAKISFFKKF

SEQ ID NO: 4848 - protein, 27 aa, artificial
  peptide fold or domain or sub-domain
FETATIESPDIQTALDAADYTPLRTWL

SEQ ID NO: 4849 - protein, 26 aa, artificial
  peptide fold or domain or sub-domain
FETFKAQERTRDGRAVFQAEDFIRSV

SEQ ID NO: 4850 - protein, 26 aa, artificial
  peptide fold or domain or sub-domain
FETIEAHPKNIEGTSLFSAEDYLRFS

SEQ ID NO: 4851 - protein, 27 aa, artificial
  peptide fold or domain or sub-domain
FETLTDRELLIYEKYEGVELTTEGETV

SEQ ID NO: 4852 - protein, 28 aa, artificial
  peptide fold or domain or sub-domain
FETRITPESGPDARARERHLIHRGEHGS

SEQ ID NO: 4853 - protein, 26 aa, artificial
  peptide fold or domain or sub-domain
FEVFKATPKNDEAQALFSESEFINTA

SEQ ID NO: 4854 - protein, 27 aa, artificial
  peptide fold or domain or sub-domain
FEVLGEVLAEHLGRTPLLASSYGYIAP

SEQ ID NO: 4855 - protein, 22 aa, artificial
  peptide fold or domain or sub-domain
FFAAGSDHSASETKVNVGGLDA

SEQ ID NO: 4856 - protein, 29 aa, artificial
  peptide fold or domain or sub-domain
FFAGEVEQYGDFIAVYEVDGTREPGIDYR

SEQ ID NO: 4857 - protein, 21 aa, artificial
  peptide fold or domain or sub-domain
FFAKYWFKNKPWENPEEYLKF

SEQ ID NO: 4858 - protein, 25 aa, artificial
  peptide fold or domain or sub-domain
FFDFDLTAKKIKEKIENEIEIDNEL

SEQ ID NO: 4859 - protein, 22 aa, artificial
  peptide fold or domain or sub-domain
FFDKNKPWILINNNKKKCEEVL

SEQ ID NO: 4860 - protein, 20 aa, artificial
  peptide fold or domain or sub-domain
FFDTGSMFNGEMIDLLDAAN

SEQ ID NO: 4861 - protein, 29 aa, artificial
  peptide fold or domain or sub-domain
FFEERSQRLLRGPGADDVNRARDELEEYL

SEQ ID NO: 4862 - protein, 21 aa, artificial
  peptide fold or domain or sub-domain
FFEVIEALGDVEYKEELKDTP

SEQ ID NO: 4863 - protein, 20 aa, artificial
  peptide fold or domain or sub-domain
FFGASSSGSSIFGAGSGGHR

SEQ ID NO: 4864 - protein, 23 aa, artificial
  peptide fold or domain or sub-domain
FFIGSQYGPEAEMVKTFNIPFYG

SEQ ID NO: 4865 - protein, 24 aa, artificial
  peptide fold or domain or sub-domain
FFLANKGEGIVSLVPKATLNELPG

SEQ ID NO: 4866 - protein, 21 aa, artificial
  peptide fold or domain or sub-domain
FFLPLYESGLLSQDHLLLLFP

SEQ ID NO: 4867 - protein, 29 aa, artificial
  peptide fold or domain or sub-domain
FFQDASKRLVQAVDADSAVAARDDFERYL

SEQ ID NO: 4868 - protein, 21 aa, artificial
  peptide fold or domain or sub-domain
FFSQYWMADMPWNIADKLWKR

SEQ ID NO: 4869 - protein, 29 aa, artificial
  peptide fold or domain or sub-domain
FFVEKTRVTISQGDTARSYAAYQEMSEYL

SEQ ID NO: 4870 - protein, 24 aa, artificial
  peptide fold or domain or sub-domain
FFVMSLNTPYLDSDDREELWDKFE

SEQ ID NO: 4871 - protein, 24 aa, artificial
  peptide fold or domain or sub-domain
FFVSLMKSFYGDAAQKENNWGYDW

SEQ ID NO: 4872 - protein, 24 aa, artificial
  peptide fold or domain or sub-domain
FFYCRKCLTYTNPKACPHGEGERE

SEQ ID NO: 4873 - protein, 24 aa, artificial
  peptide fold or domain or sub-domain
FFYRGLVLTKLHRYDEAVLSYNRA

SEQ ID NO: 4874 - protein, 24 aa, artificial
  peptide fold or domain or sub-domain
FFYRSRNFPHTLNSEEKKIWTTYK

SEQ ID NO: 4875 - protein, 25 aa, artificial
  peptide fold or domain or sub-domain
FGAEINADACQTYQENVGSPCHQLD

SEQ ID NO: 4876 - protein, 26 aa, artificial
  peptide fold or domain or sub-domain
FGAFLAGVRAEGLEKGLRSQTLDAAL

SEQ ID NO: 4877 - protein, 27 aa, artificial
  peptide fold or domain or sub-domain
FGAQPLSVLRECSPRLAINDFNELRAW

SEQ ID NO: 4878 - protein, 27 aa, artificial
  peptide fold or domain or sub-domain
FGATQCHDESETACLMPVLGAGPNKKT

SEQ ID NO: 4879 - protein, 24 aa, artificial
  peptide fold or domain or sub-domain
FGCIDALLRELPITYLKWDHNRDL

SEQ ID NO: 4880 - protein, 25 aa, artificial
  peptide fold or domain or sub-domain
FGDAMVAGPMALDVAISPDIAARKG

SEQ ID NO: 4881 - protein, 25 aa, artificial
  peptide fold or domain or sub-domain
FGDKINDRPTKDQMLLLVCKERQLP

SEQ ID NO: 4882 - protein, 25 aa, artificial
  peptide fold or domain or sub-domain
FGDLEGWTMKAVQETHPDIYNGIRT

SEQ ID NO: 4883 - protein, 30 aa, artificial
  peptide fold or domain or sub-domain
FGDLEGWTMKAVQETHPDIYNGIRTDSVNF

SEQ ID NO: 4884 - protein, 28 aa, artificial
  peptide fold or domain or sub-domain
FGDNDTSISLPSMRFLVKNKFNLNQVFM

SEQ ID NO: 4885 - protein, 28 aa, artificial
  peptide fold or domain or sub-domain
FGDPSDTRNELSIEFLRRHGLDLQKIRD

SEQ ID NO: 4886 - protein, 25 aa, artificial
  peptide fold or domain or sub-domain
FGDWEGFTLEELADEEQDLILHRRA

SEQ ID NO: 4887 - protein, 30 aa, artificial
  peptide fold or domain or sub-domain
FGDWEGLTHEEIKKFYPEEFKTWRMEPHMA

SEQ ID NO: 4888 - protein, 25 aa, artificial
  peptide fold or domain or sub-domain
FGDWEGSTLKELKATQAERVAERNA

SEQ ID NO: 4889 - protein, 25 aa, artificial
  peptide fold or domain or sub-domain
FGDWQGFMMEDIAKEREDLLEARAR

SEQ ID NO: 4890 - protein, 30 aa, artificial
  peptide fold or domain or sub-domain
FGEFEGKTFAEIEVLLPEQSLRWRKRDPEF

SEQ ID NO: 4891 - protein, 22 aa, artificial
  peptide fold or domain or sub-domain
FGEMERDCMIAHGAASFLKERL

SEQ ID NO: 4892 - protein, 28 aa, artificial
  peptide fold or domain or sub-domain
FGEMEVWALEAYGAAHTLQEMLTLKSDD

SEQ ID NO: 4893 - protein, 22 aa, artificial
  peptide fold or domain or sub-domain
FGEQSPQWQDVIKNGEQSRFAD

SEQ ID NO: 4894 - protein, 26 aa, artificial
  peptide fold or domain or sub-domain
FGEVYHGDPKFIAKYLEYIPSAANYP

SEQ ID NO: 4895 - protein, 30 aa, artificial
  peptide fold or domain or sub-domain
FGEWEGLNFEELEERYSEQYKLWKDAPEKA

SEQ ID NO: 4896 - protein, 25 aa, artificial
  peptide fold or domain or sub-domain
FGEWEGLTFEEIAQNYGELSSQWWA

SEQ ID NO: 4897 - protein, 30 aa, artificial
  peptide fold or domain or sub-domain
FGEWEGLTFEEIAQNYGELSSQWWANPFTT

SEQ ID NO: 4898 - protein, 30 aa, artificial
  peptide fold or domain or sub-domain
FGEWEGLTFEEMRKRPDYSYEQWRLMPHLV

SEQ ID NO: 4899 - protein, 28 aa, artificial
  peptide fold or domain or sub-domain
FGFEEVAYLLLSGRLPDKEELASFRELI

SEQ ID NO: 4900 - protein, 21 aa, artificial
  peptide fold or domain or sub-domain
FGFRKRSLPHYHYKNFEPETR

SEQ ID NO: 4901 - protein, 26 aa, artificial
  peptide fold or domain or sub-domain
FGFSRDDAGKFLDSYYKAKIYESDPF

SEQ ID NO: 4902 - protein, 25 aa, artificial
  peptide fold or domain or sub-domain
FGGAGHPDKPYGVREFKKRFGGEEV

SEQ ID NO: 4903 - protein, 24 aa, artificial
  peptide fold or domain or sub-domain
FGGEVLAMALTEQKIDGDWLLSRF

SEQ ID NO: 4904 - protein, 26 aa, artificial
  peptide fold or domain or sub-domain
FGGFDPRFLAEASNVKVGITKKLQSH

SEQ ID NO: 4905 - protein, 25 aa, artificial
  peptide fold or domain or sub-domain
FGGIGEFDNSDGLYKFKHEFAYHDP

SEQ ID NO: 4906 - protein, 29 aa, artificial
  peptide fold or domain or sub-domain
FGGKHFANLKGYEHYAQNASDFEDVPESK

SEQ ID NO: 4907 - protein, 24 aa, artificial
  peptide fold or domain or sub-domain
FGGSCGYCAHCRRGSAFACETVSA

SEQ ID NO: 4908 - protein, 22 aa, artificial
  peptide fold or domain or sub-domain
FGGTLFEAYFLRDQIDDYRRLL

SEQ ID NO: 4909 - protein, 27 aa, artificial
  peptide fold or domain or sub-domain
FGGTLFEAYFLRDQIDDYRRLLDDLDV

SEQ ID NO: 4910 - protein, 22 aa, artificial
  peptide fold or domain or sub-domain
FGGTLFEKYVSQKKVNEFHRYC

SEQ ID NO: 4911 - protein, 27 aa, artificial
  peptide fold or domain or sub-domain
FGGTLFEKYVSQKKVNEFHRYCTYFGC

SEQ ID NO: 4912 - protein, 30 aa, artificial
  peptide fold or domain or sub-domain
FGHRGNSGDFPENTLPAFSDALACGTPYLE

SEQ ID NO: 4913 - protein, 21 aa, artificial
  peptide fold or domain or sub-domain
FGILAFLAYNKVMSILFYMVA

SEQ ID NO: 4914 - protein, 20 aa, artificial
  peptide fold or domain or sub-domain
FGIPIEDITPELRRRVKAMS

SEQ ID NO: 4915 - protein, 29 aa, artificial
  peptide fold or domain or sub-domain
FGIPTSDDSEDKALKAGIPLTDFSAHRRI

SEQ ID NO: 4916 - protein, 30 aa, artificial
  peptide fold or domain or sub-domain
FGIQECIEKLKAGVLNEKEEQFYLKMLIHL

SEQ ID NO: 4917 - protein, 26 aa, artificial
  peptide fold or domain or sub-domain
FGISANELHELHENDYKAYENAVKKM

SEQ ID NO: 4918 - protein, 26 aa, artificial
  peptide fold or domain or sub-domain
FGISAREMKVMSEEAPGELQALIRRM

SEQ ID NO: 4919 - protein, 27 aa, artificial
  peptide fold or domain or sub-domain
FGLGHKVFQPEQFDNDVKSLGDLFVDQ

SEQ ID NO: 4920 - protein, 30 aa, artificial
  peptide fold or domain or sub-domain
FGLWEGLTIKEMKSKFPKEFDIWRNDTEDG

SEQ ID NO: 4921 - protein, 23 aa, artificial
  peptide fold or domain or sub-domain
FGLYDYCYRTMIEVSAKNDTALI

SEQ ID NO: 4922 - protein, 26 aa, artificial
  peptide fold or domain or sub-domain
FGMEASELKRRAQEDPLYIAKLAQAR

SEQ ID NO: 4923 - protein, 25 aa, artificial
  peptide fold or domain or sub-domain
FGMRELVRKALPESAHDEAITEPLL

SEQ ID NO: 4924 - protein, 22 aa, artificial
  peptide fold or domain or sub-domain
FGNMEGDCPSDWKTDSTCRMVT

SEQ ID NO: 4925 - protein, 25 aa, artificial
  peptide fold or domain or sub-domain
FGNVIIDGPLDVRTACEQASGDIKG

SEQ ID NO: 4926 - protein, 23 aa, artificial
  peptide fold or domain or sub-domain
FGPQVDSKVISEIFGVTSINFEN

SEQ ID NO: 4927 - protein, 28 aa, artificial
  peptide fold or domain or sub-domain
FGQMERDILIGLGAWNTLKELWSIDKTN

SEQ ID NO: 4928 - protein, 25 aa, artificial
  peptide fold or domain or sub-domain
FGQWEGQTWPELRRRDQLNVRKRDL

SEQ ID NO: 4929 - protein, 23 aa, artificial
  peptide fold or domain or sub-domain
FGRCPNGNCKLLENGKFKCKKCR

SEQ ID NO: 4930 - protein, 23 aa, artificial
  peptide fold or domain or sub-domain
FGRMLSPDIAKNLLGVDFAADLS

SEQ ID NO: 4931 - protein, 25 aa, artificial
  peptide fold or domain or sub-domain
FGRVEGLTYDDVVERYPDIAQKWAE

SEQ ID NO: 4932 - protein, 30 aa, artificial
  peptide fold or domain or sub-domain
FGRVEGLTYDDVVERYPDIAQKWAEGSFDV

SEQ ID NO: 4933 - protein, 24 aa, artificial
  peptide fold or domain or sub-domain
FGRVNVVGRSFGVLKMRLDEYEVD

SEQ ID NO: 4934 - protein, 24 aa, artificial
  peptide fold or domain or sub-domain
FGSAILGDLWGLETTTDPATFESK

SEQ ID NO: 4935 - protein, 24 aa, artificial
  peptide fold or domain or sub-domain
FGSEILARVLNGEEINNDMLVSML

SEQ ID NO: 4936 - protein, 25 aa, artificial
  peptide fold or domain or sub-domain
FGSKVREHPCVESMKDNVLRDRGRP

SEQ ID NO: 4937 - protein, 25 aa, artificial
  peptide fold or domain or sub-domain
FGSKVTTHPLARDKMMNGGHYTYSE

SEQ ID NO: 4938 - protein, 26 aa, artificial
  peptide fold or domain or sub-domain
FGTFSARFLARTLHTSNDTISRIQQQ

SEQ ID NO: 4939 - protein, 24 aa, artificial
  peptide fold or domain or sub-domain
FGTSGDDAVFLDGLKIDSKDQLYV

SEQ ID NO: 4940 - protein, 30 aa, artificial
  peptide fold or domain or sub-domain
FGTWEGIRVTEIDEKHPEERAKILHSPETY

SEQ ID NO: 4941 - protein, 20 aa, artificial
  peptide fold or domain or sub-domain
FGTWELRNNNIMSPADFAKY

SEQ ID NO: 4942 - protein, 20 aa, artificial
  peptide fold or domain or sub-domain
FGVAIEEVSKDQRTASKKIQ

SEQ ID NO: 4943 - protein, 26 aa, artificial
  peptide fold or domain or sub-domain
FGVDDHGILQVTHEQGKFFKDADKGL

SEQ ID NO: 4944 - protein, 20 aa, artificial
  peptide fold or domain or sub-domain
FGVGFNAVDKNQRRIAKTVV

SEQ ID NO: 4945 - protein, 24 aa, artificial
  peptide fold or domain or sub-domain
FGVRLYTMMHICDWSTFKHHVSQL

SEQ ID NO: 4946 - protein, 20 aa, artificial
  peptide fold or domain or sub-domain
FGVSEEFITENMRRIGKMVN

SEQ ID NO: 4947 - protein, 30 aa, artificial
  peptide fold or domain or sub-domain
FGVWEGLTYQEIIANHPREWEAWRQDPGAT

SEQ ID NO: 4948 - protein, 25 aa, artificial
  peptide fold or domain or sub-domain
FGYFEGVHTGLALTTLGAYKNDTFS

SEQ ID NO: 4949 - protein, 26 aa, artificial
  peptide fold or domain or sub-domain
FHADCQINDYNNATNVRNCELAALPD

SEQ ID NO: 4950 - protein, 20 aa, artificial
  peptide fold or domain or sub-domain
FHAHFIEEYRKMGLLNGMRP

SEQ ID NO: 4951 - protein, 26 aa, artificial
  peptide fold or domain or sub-domain
FHAPCSIWTYRDAESVWNCQVSGLQD

SEQ ID NO: 4952 - protein, 24 aa, artificial
  peptide fold or domain or sub-domain
FHAPDHIPGRLLPQTDPSTRLALT

SEQ ID NO: 4953 - protein, 28 aa, artificial
  peptide fold or domain or sub-domain
FHASKKYFLESRIARRLEATKCSDIHGY

SEQ ID NO: 4954 - protein, 26 aa, artificial
  peptide fold or domain or sub-domain
FHAWVSAFAREALAAGIRPQTVAATL

SEQ ID NO: 4955 - protein, 26 aa, artificial
  peptide fold or domain or sub-domain
FHCERSLNSWSDGFILNYGWLSGLCD

SEQ ID NO: 4956 - protein, 23 aa, artificial
  peptide fold or domain or sub-domain
FHDIRNFASGHYKKALLAICAGD

SEQ ID NO: 4957 - protein, 20 aa, artificial
  peptide fold or domain or sub-domain
FHDSYLLATKHSCSLETSHR

SEQ ID NO: 4958 - protein, 24 aa, artificial
  peptide fold or domain or sub-domain
FHENEYIWLQSKAQNSQVSSFFEL

SEQ ID NO: 4959 - protein, 25 aa, artificial
  peptide fold or domain or sub-domain
FHGEGAAVFDGRAKGKTKPLYETFM

SEQ ID NO: 4960 - protein, 28 aa, artificial
  peptide fold or domain or sub-domain
FHGYKRATFLRRVQRRMQVVQVDTLDHY

SEQ ID NO: 4961 - protein, 26 aa, artificial
  peptide fold or domain or sub-domain
FHHGPAIGDFNDRYQDQYYSLADIAD

SEQ ID NO: 4962 - protein, 27 aa, artificial
  peptide fold or domain or sub-domain
FHHHQQLNRLVDGWHKPDTVIVQDIVW

SEQ ID NO: 4963 - protein, 26 aa, artificial
  peptide fold or domain or sub-domain
FHHNGSISNWNNLKELQDKNLFDLAD

SEQ ID NO: 4964 - protein, 26 aa, artificial
  peptide fold or domain or sub-domain
FHHSGDITNYGDSNNVWIGALYGMSD

SEQ ID NO: 4965 - protein, 22 aa, artificial
  peptide fold or domain or sub-domain
FHIGNVVKKLGVLNAKHAIRLG

SEQ ID NO: 4966 - protein, 25 aa, artificial
  peptide fold or domain or sub-domain
FHIQQFPVTTEKLVNKRDLPYHVFG

SEQ ID NO: 4967 - protein, 22 aa, artificial
  peptide fold or domain or sub-domain
FHIRSVITKTNAANKAGAIAIA

SEQ ID NO: 4968 - protein, 26 aa, artificial
  peptide fold or domain or sub-domain
FHLDLSRTNVVDGQLTIIVRDKSIPL

SEQ ID NO: 4969 - protein, 22 aa, artificial
  peptide fold or domain or sub-domain
FHLNNARKALDAGSLAQATALA

SEQ ID NO: 4970 - protein, 22 aa, artificial
  peptide fold or domain or sub-domain
FHLQNAIQKLGVVNRQQAISRA

SEQ ID NO: 4971 - protein, 22 aa, artificial
  peptide fold or domain or sub-domain
FHLVNAMRKLNAANKTEAAVKA

SEQ ID NO: 4972 - protein, 22 aa, artificial
  peptide fold or domain or sub-domain
FHMKNIRTKFGVNSRRAAAVIA

SEQ ID NO: 4973 - protein, 22 aa, artificial
  peptide fold or domain or sub-domain
FHMSNVSSKLEVRTAKQAVYKA

SEQ ID NO: 4974 - protein, 26 aa, artificial
  peptide fold or domain or sub-domain
FHNRTTTTFSPRNLDPGIRFFRETIE

SEQ ID NO: 4975 - protein, 26 aa, artificial
  peptide fold or domain or sub-domain
FHPKKEIFDWNDQTQLENGWVYGLPD

SEQ ID NO: 4976 - protein, 26 aa, artificial
  peptide fold or domain or sub-domain
FHPLVPIKDWDNQKEVEEKCLGMLPD

SEQ ID NO: 4977 - protein, 24 aa, artificial
  peptide fold or domain or sub-domain
FHQDEINLLASVDPDQKMRLWLSL

SEQ ID NO: 4978 - protein, 23 aa, artificial
  peptide fold or domain or sub-domain
FHQRTSPLLLQDLLGVESLEDID

SEQ ID NO: 4979 - protein, 20 aa, artificial
  peptide fold or domain or sub-domain
FHRGEGSSPGGALVARGNHF

SEQ ID NO: 4980 - protein, 22 aa, artificial
  peptide fold or domain or sub-domain
FHTSTIVQKLGAANRSHAVAIA

SEQ ID NO: 4981 - protein, 20 aa, artificial
  peptide fold or domain or sub-domain
FHTTVLNLIKANNIQTAVNS

SEQ ID NO: 4982 - protein, 20 aa, artificial
  peptide fold or domain or sub-domain
FHVAKDEVTSAMRRQAKAVN

SEQ ID NO: 4983 - protein, 27 aa, artificial
  peptide fold or domain or sub-domain
FHVALLLDGKSPNTTNEEDIKTAYERL

SEQ ID NO: 4984 - protein, 20 aa, artificial
  peptide fold or domain or sub-domain
FHVIVAAGTTYAYPTEMTKQ

SEQ ID NO: 4985 - protein, 27 aa, artificial
  peptide fold or domain or sub-domain
FHVIWTGSGHKWDGYCSYLSFPPLKFE

SEQ ID NO: 4986 - protein, 25 aa, artificial
  peptide fold or domain or sub-domain
FHVNEFPASYEESADFEEASNITYD

SEQ ID NO: 4987 - protein, 21 aa, artificial
  peptide fold or domain or sub-domain
FHWCQEAYGLQYVCLRYFNAA

SEQ ID NO: 4988 - protein, 23 aa, artificial
  peptide fold or domain or sub-domain
FIAGLAKGMSPEEMRVFFCIPTD

SEQ ID NO: 4989 - protein, 26 aa, artificial
  peptide fold or domain or sub-domain
FIAGVAEDGFYVFSASKQECLDAIPF

SEQ ID NO: 4990 - protein, 20 aa, artificial
  peptide fold or domain or sub-domain
FIANDNTVRFSGTAAGYYDN

SEQ ID NO: 4991 - protein, 23 aa, artificial
  peptide fold or domain or sub-domain
FIANMMKNNTPSQIRARFGVSNK

SEQ ID NO: 4992 - protein, 21 aa, artificial
  peptide fold or domain or sub-domain
FIAPSQFKNHETMNGIKAPIG

SEQ ID NO: 4993 - protein, 25 aa, artificial
  peptide fold or domain or sub-domain
FIDDKLKKGVKGLTEQEVETILDKA

SEQ ID NO: 4994 - protein, 25 aa, artificial
  peptide fold or domain or sub-domain
FIDDNLKKDARKAIEGSIEATLQNS

SEQ ID NO: 4995 - protein, 29 aa, artificial
  peptide fold or domain or sub-domain
FIDETRFQAMVKEGAFLEHATIYERHYGT

SEQ ID NO: 4996 - protein, 27 aa, artificial
  peptide fold or domain or sub-domain
FIDKLKDSLDKQLENEGAREILLQKIA

SEQ ID NO: 4997 - protein, 29 aa, artificial
  peptide fold or domain or sub-domain
FIDKTIFEDKLKNEDFLEYDNYANNFYGT

SEQ ID NO: 4998 - protein, 22 aa, artificial
  peptide fold or domain or sub-domain
FIDNILRKWPGPKETSGLKTCH

SEQ ID NO: 4999 - protein, 27 aa, artificial
  peptide fold or domain or sub-domain
FIDRLFAQIDQEQNTAEVKLYLKQSLS

SEQ ID NO: 5000 - protein, 24 aa, artificial
  peptide fold or domain or sub-domain
FIDTPDAVLCDDRPSFALRHRRKS

SEQ ID NO: 5001 - protein, 22 aa, artificial
  peptide fold or domain or sub-domain
FIEIHGRHPYQRGVVGPISNGS

SEQ ID NO: 5002 - protein, 30 aa, artificial
  peptide fold or domain or sub-domain
FIEMLPSTGLEVCFEDYKGDRSFAVAINFI

SEQ ID NO: 5003 - protein, 22 aa, artificial
  peptide fold or domain or sub-domain
FIGRILKSKVDPALKKYLNDCV

SEQ ID NO: 5004 - protein, 24 aa, artificial
  peptide fold or domain or sub-domain
FIGSGDQFERIKPDPLPLLKTAER

SEQ ID NO: 5005 - protein, 29 aa, artificial
  peptide fold or domain or sub-domain
FIGWLLRQIDISLKLDMGMEVPIAFGAVV

SEQ ID NO: 5006 - protein, 26 aa, artificial
  peptide fold or domain or sub-domain
FIHENPEAKVLAYSRWNDEGSRVVVV

SEQ ID NO: 5007 - protein, 21 aa, artificial
  peptide fold or domain or sub-domain
FIKEGHLRQRWEVSSVISDSA

SEQ ID NO: 5008 - protein, 22 aa, artificial
  peptide fold or domain or sub-domain
FIKIPSDGSTPSLLKIKDPRGR

SEQ ID NO: 5009 - protein, 21 aa, artificial
  peptide fold or domain or sub-domain
FIKPLKEGEGGISKEIASQIC

SEQ ID NO: 5010 - protein, 20 aa, artificial
  peptide fold or domain or sub-domain
FIKTEMVMKDMNPEALKKWE

SEQ ID NO: 5011 - protein, 26 aa, artificial
  peptide fold or domain or sub-domain
FILDKEEALFQKWSEKAENIVFIQTD

SEQ ID NO: 5012 - protein, 29 aa, artificial
  peptide fold or domain or sub-domain
FILLKYGLVGGEGGRTTFRLQPPLSQYSV

SEQ ID NO: 5013 - protein, 24 aa, artificial
  peptide fold or domain or sub-domain
FIMPCTRCDECQRGRDDLCPQFFA

SEQ ID NO: 5014 - protein, 30 aa, artificial
  peptide fold or domain or sub-domain
FIMQEDCNLVLYDVDKPIWATNTGGLSRSC

SEQ ID NO: 5015 - protein, 21 aa, artificial
  peptide fold or domain or sub-domain
FINFRDLGWHKWIIAPKGFMA

SEQ ID NO: 5016 - protein, 27 aa, artificial
  peptide fold or domain or sub-domain
FINFTGSTGIGERIGKMAGMRPIMLEL

SEQ ID NO: 5017 - protein, 23 aa, artificial
  peptide fold or domain or sub-domain
FINGQWVKDMSDDGTGRPYDPDA

SEQ ID NO: 5018 - protein, 20 aa, artificial
  peptide fold or domain or sub-domain
FINSKGDLSRFAAFGLPAVK

SEQ ID NO: 5019 - protein, 26 aa, artificial
  peptide fold or domain or sub-domain
FINSSSNAGNRITDVHEGLYGETDLR

SEQ ID NO: 5020 - protein, 29 aa, artificial
  peptide fold or domain or sub-domain
FIPPARLKAAPGAWARYYAEWPEMLRERL

SEQ ID NO: 5021 - protein, 24 aa, artificial
  peptide fold or domain or sub-domain
FIPSCGKCPSCQAGMRNLCDLGAG

SEQ ID NO: 5022 - protein, 23 aa, artificial
  peptide fold or domain or sub-domain
FIPSDLAYGAQSPSPAIPANSVL

SEQ ID NO: 5023 - protein, 29 aa, artificial
  peptide fold or domain or sub-domain
FIPVRNKAEARDVWKAYYEKWECVTRDKA

SEQ ID NO: 5024 - protein, 27 aa, artificial
  peptide fold or domain or sub-domain
FIQEWASKNHPTWVEGGAELRALSEYG

SEQ ID NO: 5025 - protein, 20 aa, artificial
  peptide fold or domain or sub-domain
FIRDTATKYDLDPIWIEKTL

SEQ ID NO: 5026 - protein, 27 aa, artificial
  peptide fold or domain or sub-domain
FIRNICEVNTDSQSLHSSWVRHFTKIT

SEQ ID NO: 5027 - protein, 25 aa, artificial
  peptide fold or domain or sub-domain
FIRNYLINEMTVSVNQYHKRATHYV

SEQ ID NO: 5028 - protein, 25 aa, artificial
  peptide fold or domain or sub-domain
FIRTMLVSGGNVPVHVLHKRSIAYV

SEQ ID NO: 5029 - protein, 20 aa, artificial
  peptide fold or domain or sub-domain
FISANRSLPDYERLAPGRIL

SEQ ID NO: 5030 - protein, 30 aa, artificial
  peptide fold or domain or sub-domain
FISGCGACSECHAGHQQVCHNQQQPGFTHW

SEQ ID NO: 5031 - protein, 22 aa, artificial
  peptide fold or domain or sub-domain
FISGTKMRTYARTGENPPDGFM

SEQ ID NO: 5032 - protein, 29 aa, artificial
  peptide fold or domain or sub-domain
FISHEEFQKGIDSDHFLEWARVHENFYGT

SEQ ID NO: 5033 - protein, 26 aa, artificial
  peptide fold or domain or sub-domain
FISKKEAKRIWEQMSRYGIDITGESL

SEQ ID NO: 5034 - protein, 20 aa, artificial
  peptide fold or domain or sub-domain
FISNTEDVLQSLRSNQIDIG

SEQ ID NO: 5035 - protein, 29 aa, artificial
  peptide fold or domain or sub-domain
FISQDVFDEMVNMGKFILTFSYGNHKYGL

SEQ ID NO: 5036 - protein, 27 aa, artificial
  peptide fold or domain or sub-domain
FISRLEEAVYRMMPRGEGSDILIKQLA

SEQ ID NO: 5037 - protein, 27 aa, artificial
  peptide fold or domain or sub-domain
FISRLQVALERQIDNVDARGELCMKLA

SEQ ID NO: 5038 - protein, 25 aa, artificial
  peptide fold or domain or sub-domain
FISTDDPLIAKISKQCGAKIINRPA

SEQ ID NO: 5039 - protein, 21 aa, artificial
  peptide fold or domain or sub-domain
FISTDLGVLNLYECKLNKRGG

SEQ ID NO: 5040 - protein, 29 aa, artificial
  peptide fold or domain or sub-domain
FISTEEFDQMYVDDEFVEYTNYVGSKYGT

SEQ ID NO: 5041 - protein, 20 aa, artificial
  peptide fold or domain or sub-domain
FISYYTAQGEPFPNNVEKLC

SEQ ID NO: 5042 - protein, 29 aa, artificial
  peptide fold or domain or sub-domain
FITRQAFEADILARRFVEHGEYEKAYYGT

SEQ ID NO: 5043 - protein, 22 aa, artificial
  peptide fold or domain or sub-domain
FITSTVFTRSFFGVYPEKGTGT

SEQ ID NO: 5044 - protein, 28 aa, artificial
  peptide fold or domain or sub-domain
FIVCHFNGKVEVFFGCDRFELIAHCIGE

SEQ ID NO: 5045 - protein, 28 aa, artificial
  peptide fold or domain or sub-domain
FIVLDAKDRHTADYLSTLNVKSEYIYQK

SEQ ID NO: 5046 - protein, 22 aa, artificial
  peptide fold or domain or sub-domain
FKAAGQDGAALREAAASADYRG

SEQ ID NO: 5047 - protein, 26 aa, artificial
  peptide fold or domain or sub-domain
FKAARYRNYITKANYRLSASQIKNKV

SEQ ID NO: 5048 - protein, 24 aa, artificial
  peptide fold or domain or sub-domain
FKADEYIDRKSADRMDPYCQYGVI

SEQ ID NO: 5049 - protein, 24 aa, artificial
  peptide fold or domain or sub-domain
FKAILDEAVENGEFNPQNTELAAV

SEQ ID NO: 5050 - protein, 21 aa, artificial
  peptide fold or domain or sub-domain
FKAIMETLELDVEDESLARTP

SEQ ID NO: 5051 - protein, 26 aa, artificial
  peptide fold or domain or sub-domain
FKAYDAAKGASNPSADGALKRLGING

SEQ ID NO: 5052 - protein, 23 aa, artificial
  peptide fold or domain or sub-domain
FKCPYSDDCEINSVSRRFCQKCR

SEQ ID NO: 5053 - protein, 26 aa, artificial
  peptide fold or domain or sub-domain
FKDLLLLVGQLEKEHDSLNGVYDRTC

SEQ ID NO: 5054 - protein, 20 aa, artificial
  peptide fold or domain or sub-domain
FKEELQKHKEYTGAYTTLLI

SEQ ID NO: 5055 - protein, 30 aa, artificial
  peptide fold or domain or sub-domain
FKEILSQVNLQPCFSKFDGENTYEETSKYI

SEQ ID NO: 5056 - protein, 27 aa, artificial
  peptide fold or domain or sub-domain
FKEKIWGGTALRDRFGYSIPSESTGEC

SEQ ID NO: 5057 - protein, 30 aa, artificial
  peptide fold or domain or sub-domain
FKEKLPVSPMKNYFPDYEGGDDYAAACDYI

SEQ ID NO: 5058 - protein, 25 aa, artificial
  peptide fold or domain or sub-domain
FKFMCIQATPEEVIGRKGERGVFVI

SEQ ID NO: 5059 - protein, 25 aa, artificial
  peptide fold or domain or sub-domain
FKGIDARFLSEALGVSMHVAEKLQS

SEQ ID NO: 5060 - protein, 21 aa, artificial
  peptide fold or domain or sub-domain
FKGSIRTSDPVMTDEEYDTMF

SEQ ID NO: 5061 - protein, 25 aa, artificial
  peptide fold or domain or sub-domain
FKGVICRLPQEMSGFQKGLGMKKEY

SEQ ID NO: 5062 - protein, 30 aa, artificial
  peptide fold or domain or sub-domain
FKIKIKHTNITVALTSYKGPQECDSALDYI

SEQ ID NO: 5063 - protein, 27 aa, artificial
  peptide fold or domain or sub-domain
FKIKLALFSFSGGNLFIEIAMSISLSI

SEQ ID NO: 5064 - protein, 22 aa, artificial
  peptide fold or domain or sub-domain
FKITHYDGQPVNEPDVLQDTAF

SEQ ID NO: 5065 - protein, 22 aa, artificial
  peptide fold or domain or sub-domain
FKIVATDGQPLKNPQPIKDELL

SEQ ID NO: 5066 - protein, 20 aa, artificial
  peptide fold or domain or sub-domain
FKKAQQIFTFSTTQHQQIVA

SEQ ID NO: 5067 - protein, 26 aa, artificial
  peptide fold or domain or sub-domain
FKKDHKKMADQKSIGKDVVKREDKKF

SEQ ID NO: 5068 - protein, 22 aa, artificial
  peptide fold or domain or sub-domain
FKKLCVDCHGEQGEGVAGAAEN

SEQ ID NO: 5069 - protein, 21 aa, artificial
  peptide fold or domain or sub-domain
FKKLLQNMLKKGNKKKAQRLL

SEQ ID NO: 5070 - protein, 27 aa, artificial
  peptide fold or domain or sub-domain
FKKLNREGYINYEKYGAVTLTPKGEEI

SEQ ID NO: 5071 - protein, 23 aa, artificial
  peptide fold or domain or sub-domain
FKKYEGDKSQLSDVDQFIIETLK

SEQ ID NO: 5072 - protein, 21 aa, artificial
  peptide fold or domain or sub-domain
FKLDGILRDEEWLYDHFHDIA

SEQ ID NO: 5073 - protein, 26 aa, artificial
  peptide fold or domain or sub-domain
FKLFRLLDKDQNGIVQLSLAEWLCRA

SEQ ID NO: 5074 - protein, 23 aa, artificial
  peptide fold or domain or sub-domain
FKLYSFISSQLVKANLKKDINIL

SEQ ID NO: 5075 - protein, 28 aa, artificial
  peptide fold or domain or sub-domain
FKMGEWDADEAKLREEGINRLGNIFVPS

SEQ ID NO: 5076 - protein, 24 aa, artificial
  peptide fold or domain or sub-domain
FKNCILVGKRFRLAHIRFSKQIIE

SEQ ID NO: 5077 - protein, 24 aa, artificial
  peptide fold or domain or sub-domain
FKPEEYINPKLVRRTDRFVHFALV

SEQ ID NO: 5078 - protein, 28 aa, artificial
  peptide fold or domain or sub-domain
FKPSEICVPKSEHTFFQELEYFKNREFT

SEQ ID NO: 5079 - protein, 25 aa, artificial
  peptide fold or domain or sub-domain
FKQFEREAKELAFEEKADVVDKLLE

SEQ ID NO: 5080 - protein, 22 aa, artificial
  peptide fold or domain or sub-domain
FKQNCASCHGQDLSGGVGPNLQ

SEQ ID NO: 5081 - protein, 26 aa, artificial
  peptide fold or domain or sub-domain
FKQWIRNFKEDAISNGITTSTFDTAF

SEQ ID NO: 5082 - protein, 21 aa, artificial
  peptide fold or domain or sub-domain
FKRENGAESVAFGVTTPSGTP

SEQ ID NO: 5083 - protein, 28 aa, artificial
  peptide fold or domain or sub-domain
FKSASEARRAIKSGGVYLNNNRIEDEEQ

SEQ ID NO: 5084 - protein, 28 aa, artificial
  peptide fold or domain or sub-domain
FKSDFMNVLQSRGFIHQISDPDSLDALA

SEQ ID NO: 5085 - protein, 26 aa, artificial
  peptide fold or domain or sub-domain
FKSFKELEKEGSGVAELNISEWLYLT

SEQ ID NO: 5086 - protein, 30 aa, artificial
  peptide fold or domain or sub-domain
FKSFTDNKRPEHQGFHATLHKSSSSFHLQK

SEQ ID NO: 5087 - protein, 29 aa, artificial
  peptide fold or domain or sub-domain
FKTGLEFEELVKQNKFLEYAKIYDNYYGT

SEQ ID NO: 5088 - protein, 24 aa, artificial
  peptide fold or domain or sub-domain
FKTIKRGIAERILSDEKEKWWTCK

SEQ ID NO: 5089 - protein, 29 aa, artificial
  peptide fold or domain or sub-domain
FKTKEEFMLMIENDELFEWVEYCDNFYGT

SEQ ID NO: 5090 - protein, 30 aa, artificial
  peptide fold or domain or sub-domain
FKVFHRDGEPCERCGSIIEKTPFYWCPGCQ

SEQ ID NO: 5091 - protein, 21 aa, artificial
  peptide fold or domain or sub-domain
FKVGWSDEVSPGNDFQYIYLS

SEQ ID NO: 5092 - protein, 30 aa, artificial
  peptide fold or domain or sub-domain
FKVPKANEKGSSRGFEATYNKEATSFHLQK

SEQ ID NO: 5093 - protein, 29 aa, artificial
  peptide fold or domain or sub-domain
FKWGDIRNINYNYKKLKIIPISRKEDVFK

SEQ ID NO: 5094 - protein, 22 aa, artificial
  peptide fold or domain or sub-domain
FKYNYYSTWENRRNHGVDTPPQ

SEQ ID NO: 5095 - protein, 28 aa, artificial
  peptide fold or domain or sub-domain
FLAGKVVAEAERKGVSICDLTLEELKNI

SEQ ID NO: 5096 - protein, 27 aa, artificial
  peptide fold or domain or sub-domain
FLARLETAISHTVIREETKKQLEKLLA

SEQ ID NO: 5097 - protein, 22 aa, artificial
  peptide fold or domain or sub-domain
FLATNLKKAVYPDNIYSKLQEM

SEQ ID NO: 5098 - protein, 28 aa, artificial
  peptide fold or domain or sub-domain
FLATNLKKAVYPDNIYSKLQEMGYIIDA

SEQ ID NO: 5099 - protein, 22 aa, artificial
  peptide fold or domain or sub-domain
FLCKAINRYTEEREIASFIKSH

SEQ ID NO: 5100 - protein, 24 aa, artificial
  peptide fold or domain or sub-domain
FLDEMRHRFLKFKRQKYLPEIEKF

SEQ ID NO: 5101 - protein, 27 aa, artificial
  peptide fold or domain or sub-domain
FLDRFNNSLEKHVDNAQVRALIFQQLA

SEQ ID NO: 5102 - protein, 27 aa, artificial
  peptide fold or domain or sub-domain
FLDRLPNTLERQGGNQAARDALLKQLA

SEQ ID NO: 5103 - protein, 20 aa, artificial
  peptide fold or domain or sub-domain
FLDSKSTGYAVVNDVDLGGS

SEQ ID NO: 5104 - protein, 21 aa, artificial
  peptide fold or domain or sub-domain
FLEEGKARDGLYVNGMHHDLV

SEQ ID NO: 5105 - protein, 21 aa, artificial
  peptide fold or domain or sub-domain
FLELCSKIKTPEAFHDFFALF

SEQ ID NO: 5106 - protein, 27 aa, artificial
  peptide fold or domain or sub-domain
FLELCSKIKTPEAFHDFFALFLTFGER

SEQ ID NO: 5107 - protein, 24 aa, artificial
  peptide fold or domain or sub-domain
FLENIFKTIVKEFGYSYLKLDFLY

SEQ ID NO: 5108 - protein, 27 aa, artificial
  peptide fold or domain or sub-domain
FLETDAGVKKALPPYTAKELLEIAEAW

SEQ ID NO: 5109 - protein, 30 aa, artificial
  peptide fold or domain or sub-domain
FLFASVMADKDTTRRIHVSTDQGDTWSMAQ

SEQ ID NO: 5110 - protein, 28 aa, artificial
  peptide fold or domain or sub-domain
FLFGNSQHQQHNKLSQLPSATEIRWIKE

SEQ ID NO: 5111 - protein, 22 aa, artificial
  peptide fold or domain or sub-domain
FLFLATEWSEFLAFDWKKAADI

SEQ ID NO: 5112 - protein, 24 aa, artificial
  peptide fold or domain or sub-domain
FLHAEHAISMSDDPIYVLRHMRNT

SEQ ID NO: 5113 - protein, 25 aa, artificial
  peptide fold or domain or sub-domain
FLHDFSRNGIRVNSEKIGKGNTVQL

SEQ ID NO: 5114 - protein, 25 aa, artificial
  peptide fold or domain or sub-domain
FLHDHSSNGTFLNFERLAKNSRTIL

SEQ ID NO: 5115 - protein, 27 aa, artificial
  peptide fold or domain or sub-domain
FLHGSDLNSLHTNLPRSILPKEYGGTA

SEQ ID NO: 5116 - protein, 27 aa, artificial
  peptide fold or domain or sub-domain
FLHGVDFASLHYHIAPDCLPSTLGGTY

SEQ ID NO: 5117 - protein, 24 aa, artificial
  peptide fold or domain or sub-domain
FLISLLKAWWGEHATAENDFCFDY

SEQ ID NO: 5118 - protein, 30 aa, artificial
  peptide fold or domain or sub-domain
FLKEWRSTHNDKMPETRAEKDEFKKFFNSH

SEQ ID NO: 5119 - protein, 28 aa, artificial
  peptide fold or domain or sub-domain
FLKMNNAGLIEVKGKEITILDRNGLQAL

SEQ ID NO: 5120 - protein, 27 aa, artificial
  peptide fold or domain or sub-domain
FLKTSCGSPNYAAPEVISGKLYAGSEV

SEQ ID NO: 5121 - protein, 24 aa, artificial
  peptide fold or domain or sub-domain
FLLASREYASSDIETYSPQSPLGS

SEQ ID NO: 5122 - protein, 26 aa, artificial
  peptide fold or domain or sub-domain
FLLGDGLVAALTKGDDSALAGYSDAC

SEQ ID NO: 5123 - protein, 26 aa, artificial
  peptide fold or domain or sub-domain
FLNDVIKKHRISGAKTQMIMEDWDFL

SEQ ID NO: 5124 - protein, 28 aa, artificial
  peptide fold or domain or sub-domain
FLNKFEQSNWSKWPDPIRRREPDALGQA

SEQ ID NO: 5125 - protein, 21 aa, artificial
  peptide fold or domain or sub-domain
FLNNPLCSSAASNQEYRYMML

SEQ ID NO: 5126 - protein, 23 aa, artificial
  peptide fold or domain or sub-domain
FLNTASICDSVEAKIVLVSNIWE

SEQ ID NO: 5127 - protein, 23 aa, artificial
  peptide fold or domain or sub-domain
FLNYLREQGNTRENELYKKSEDL

SEQ ID NO: 5128 - protein, 25 aa, artificial
  peptide fold or domain or sub-domain
FLPCSQCHNKPGDAEQMSFYRAWHN

SEQ ID NO: 5129 - protein, 27 aa, artificial
  peptide fold or domain or sub-domain
FLPDDYLIKQRFPGMTPAQIRRYAERW

SEQ ID NO: 5130 - protein, 22 aa, artificial
  peptide fold or domain or sub-domain
FLPEKTCKLLKEGAELGHADDI

SEQ ID NO: 5131 - protein, 28 aa, artificial
  peptide fold or domain or sub-domain
FLPESMLWLLMTGGVPTFQQAASFRKEL

SEQ ID NO: 5132 - protein, 23 aa, artificial
  peptide fold or domain or sub-domain
FLPKGFKVIASTNKCLVASACNR

SEQ ID NO: 5133 - protein, 24 aa, artificial
  peptide fold or domain or sub-domain
FLPREYELLRSLPDEQKQKIFFRY

SEQ ID NO: 5134 - protein, 20 aa, artificial
  peptide fold or domain or sub-domain
FLPTRIMGPVEGYLTLGEGD

SEQ ID NO: 5135 - protein, 30 aa, artificial
  peptide fold or domain or sub-domain
FLPTTWEEVSGRLSLPSFSPEHQDQAALHL

SEQ ID NO: 5136 - protein, 25 aa, artificial
  peptide fold or domain or sub-domain
FLQAAAEATQFTSSKTLNPQHMKQA

SEQ ID NO: 5137 - protein, 30 aa, artificial
  peptide fold or domain or sub-domain
FLQLMIDSQKNSGAQQDKSLTDHEILSQSM

SEQ ID NO: 5138 - protein, 30 aa, artificial
  peptide fold or domain or sub-domain
FLQLQLLDAAARGEFGLERYETGTFQKQVL

SEQ ID NO: 5139 - protein, 22 aa, artificial
  peptide fold or domain or sub-domain
FLQTAAPWAQVKKDAEVARADL

SEQ ID NO: 5140 - protein, 20 aa, artificial
  peptide fold or domain or sub-domain
FLRAAIRVLPENLQKRYHLF

SEQ ID NO: 5141 - protein, 25 aa, artificial
  peptide fold or domain or sub-domain
FLREWTRGTNAAGTRRLQVEAANKM

SEQ ID NO: 5142 - protein, 29 aa, artificial
  peptide fold or domain or sub-domain
FLRTECMNYRYMHDSDAPLVMLADIVGAK

SEQ ID NO: 5143 - protein, 29 aa, artificial
  peptide fold or domain or sub-domain
FLSAAEFEEWIATDDLLEWACYVGNYYGT

SEQ ID NO: 5144 - protein, 26 aa, artificial
  peptide fold or domain or sub-domain
FLSKRELKVLVSSAAEIGIDLSGEEV

SEQ ID NO: 5145 - protein, 26 aa, artificial
  peptide fold or domain or sub-domain
FLSSYNYAGYSFNSVYNNYKGFVETT

SEQ ID NO: 5146 - protein, 30 aa, artificial
  peptide fold or domain or sub-domain
FLSTSWDRFAPVVKAQNFSPTYQDRVAIEL

SEQ ID NO: 5147 - protein, 29 aa, artificial
  peptide fold or domain or sub-domain
FLSYAKTNNSKNCYEQVYSYGGAQNRGCA

SEQ ID NO: 5148 - protein, 25 aa, artificial
  peptide fold or domain or sub-domain
FLTDLSKNGTFVNRTKIGRNNECVI

SEQ ID NO: 5149 - protein, 22 aa, artificial
  peptide fold or domain or sub-domain
FLTDMAPWKYKDDLKNKKLHII

SEQ ID NO: 5150 - protein, 27 aa, artificial
  peptide fold or domain or sub-domain
FLTGRREPELLAAANELGPSAIAIRTD

SEQ ID NO: 5151 - protein, 21 aa, artificial
  peptide fold or domain or sub-domain
FLTLCQKAETVDQLDELFGLL

SEQ ID NO: 5152 - protein, 27 aa, artificial
  peptide fold or domain or sub-domain
FLTLCQKAETVDQLDELFGLLFTLEEK

SEQ ID NO: 5153 - protein, 24 aa, artificial
  peptide fold or domain or sub-domain
FLTQLKQGHQQFLRDELPNHLALF

SEQ ID NO: 5154 - protein, 30 aa, artificial
  peptide fold or domain or sub-domain
FLTQMAAHLKAEDPDTYVSLGIAGYDKYYN

SEQ ID NO: 5155 - protein, 27 aa, artificial
  peptide fold or domain or sub-domain
FLTRSQEAVKRQIPHTTAAEMLTLTLA

SEQ ID NO: 5156 - protein, 25 aa, artificial
  peptide fold or domain or sub-domain
FLVAYTKKAPQLTSSELMAITRKMA

SEQ ID NO: 5157 - protein, 23 aa, artificial
  peptide fold or domain or sub-domain
FLVEVLKSAYDINGQDVARIRKS

SEQ ID NO: 5158 - protein, 25 aa, artificial
  peptide fold or domain or sub-domain
FLVKYSRMMPQAPTSFLIELTEKVG

SEQ ID NO: 5159 - protein, 26 aa, artificial
  peptide fold or domain or sub-domain
FLVTAYGREINLDGENSKLVDALIVK

SEQ ID NO: 5160 - protein, 24 aa, artificial
  peptide fold or domain or sub-domain
FLVTPDDVPAGRPYPWMCYKNAME

SEQ ID NO: 5161 - protein, 29 aa, artificial
  peptide fold or domain or sub-domain
FLWRETDSISTGRRKLIIECGGPSGKKHG

SEQ ID NO: 5162 - protein, 30 aa, artificial
  peptide fold or domain or sub-domain
FLYTGRQPRPEEAAEFQAEFVSTPELAAQS

SEQ ID NO: 5163 - protein, 23 aa, artificial
  peptide fold or domain or sub-domain
FMDANPLFLSAPYAKAHGFQDML

SEQ ID NO: 5164 - protein, 29 aa, artificial
  peptide fold or domain or sub-domain
FMDREEMEEAVRNNEFLEYGEHNGNLYGT

SEQ ID NO: 5165 - protein, 29 aa, artificial
  peptide fold or domain or sub-domain
FMEDNADKTLVFGVGVDKIGSEFVKVSLS

SEQ ID NO: 5166 - protein, 25 aa, artificial
  peptide fold or domain or sub-domain
FMEEGYTKARLEKRKLINYRDMANV

SEQ ID NO: 5167 - protein, 30 aa, artificial
  peptide fold or domain or sub-domain
FMEEVYLKPQWMQDDGIHPNRDAQPFIADW

SEQ ID NO: 5168 - protein, 30 aa, artificial
  peptide fold or domain or sub-domain
FMEKIQRVNITTAFPDYEGGQNYEEAVSFI

SEQ ID NO: 5169 - protein, 30 aa, artificial
  peptide fold or domain or sub-domain
FMGYTWKGLAKQYGFTDFSPATQDKAAVAL

SEQ ID NO: 5170 - protein, 22 aa, artificial
  peptide fold or domain or sub-domain
FMLERKNGQTYRLNGSEKIIDI

SEQ ID NO: 5171 - protein, 26 aa, artificial
  peptide fold or domain or sub-domain
FMLTTSQAEEDVLRSYQAHAASYVVK

SEQ ID NO: 5172 - protein, 26 aa, artificial
  peptide fold or domain or sub-domain
FMMTAFGREAELERAEELGVASFLSK

SEQ ID NO: 5173 - protein, 29 aa, artificial
  peptide fold or domain or sub-domain
FMRQECLDSRFVFDRPLPVSRLVSLIGSK

SEQ ID NO: 5174 - protein, 27 aa, artificial
  peptide fold or domain or sub-domain
FMSCFPWAEKKQDVKEQMFNELLTYNA

SEQ ID NO: 5175 - protein, 25 aa, artificial
  peptide fold or domain or sub-domain
FMVSKKPLNDVRVTCFDDEKSLLLA

SEQ ID NO: 5176 - protein, 27 aa, artificial
  peptide fold or domain or sub-domain
FNAAKRQIEGLDEQIKQGEFAPLLSWL

SEQ ID NO: 5177 - protein, 28 aa, artificial
  peptide fold or domain or sub-domain
FNAEDMGNKFAALGKTFKAADYAIKANN

SEQ ID NO: 5178 - protein, 28 aa, artificial
  peptide fold or domain or sub-domain
FNAQYDQLMSSVKNMLEQAGIKFDDLAS

SEQ ID NO: 5179 - protein, 21 aa, artificial
  peptide fold or domain or sub-domain
FNAYLNSFFSSSATKKRSVGT

SEQ ID NO: 5180 - protein, 20 aa, artificial
  peptide fold or domain or sub-domain
FNDFTDLFPDMKQREVKKIL

SEQ ID NO: 5181 - protein, 25 aa, artificial
  peptide fold or domain or sub-domain
FNDGKCKTASGGIESYNDPYQVRDC

SEQ ID NO: 5182 - protein, 20 aa, artificial
  peptide fold or domain or sub-domain
FNDLCKAVPELSMRQAKKII

SEQ ID NO: 5183 - protein, 26 aa, artificial
  peptide fold or domain or sub-domain
FNDQCRIVNPEDPHELRNCWKEDRPD

SEQ ID NO: 5184 - protein, 25 aa, artificial
  peptide fold or domain or sub-domain
FNDSMFFHPYCKITDYDNYPLAQTC

SEQ ID NO: 5185 - protein, 20 aa, artificial
  peptide fold or domain or sub-domain
FNDVAKAQGWNQEQKGRVAR

SEQ ID NO: 5186 - protein, 22 aa, artificial
  peptide fold or domain or sub-domain
FNEDVVNIMKYNNIKFKYKDIN

SEQ ID NO: 5187 - protein, 21 aa, artificial
  peptide fold or domain or sub-domain
FNELGISEKYLYINGEWRDHK

SEQ ID NO: 5188 - protein, 24 aa, artificial
  peptide fold or domain or sub-domain
FNEQNFVSKSDIKSMSSPTIMAIG

SEQ ID NO: 5189 - protein, 27 aa, artificial
  peptide fold or domain or sub-domain
FNESQLLEKGMGGILGVGQGSCQAPKF

SEQ ID NO: 5190 - protein, 30 aa, artificial
  peptide fold or domain or sub-domain
FNFDQQTSQNIKNQLAELNATNIYTVLDKI

SEQ ID NO: 5191 - protein, 25 aa, artificial
  peptide fold or domain or sub-domain
FNGFDDEILADAFGVDVQTARRLKG

SEQ ID NO: 5192 - protein, 25 aa, artificial
  peptide fold or domain or sub-domain
FNGFGPEVIAQALKIDLQTAQQLQN

SEQ ID NO: 5193 - protein, 25 aa, artificial
  peptide fold or domain or sub-domain
FNGFTKEVLSTSFNVPEELLGRLVT

SEQ ID NO: 5194 - protein, 26 aa, artificial
  peptide fold or domain or sub-domain
FNGFTKEVLSTSFNVPEELLGRLVTR

SEQ ID NO: 5195 - protein, 25 aa, artificial
  peptide fold or domain or sub-domain
FNHIPETYFAYVGTIEEALEKYEYD

SEQ ID NO: 5196 - protein, 24 aa, artificial
  peptide fold or domain or sub-domain
FNIEDHIDKKEARRMDRFTQYAIV

SEQ ID NO: 5197 - protein, 30 aa, artificial
  peptide fold or domain or sub-domain
FNIFCGSCYFCQKELYSNCHNTNPEATAVG

SEQ ID NO: 5198 - protein, 23 aa, artificial
  peptide fold or domain or sub-domain
FNIQLLSEALGISQQAAQRIQSQ

SEQ ID NO: 5199 - protein, 30 aa, artificial
  peptide fold or domain or sub-domain
FNIRMGFNTLNSLISNNSKQTSHAITLQKT

SEQ ID NO: 5200 - protein, 23 aa, artificial
  peptide fold or domain or sub-domain
FNKAIKETTGGAYDTYKCIPSLE

SEQ ID NO: 5201 - protein, 23 aa, artificial
  peptide fold or domain or sub-domain
FNKALNECTGGAMRPTSSSPPSR

SEQ ID NO: 5202 - protein, 28 aa, artificial
  peptide fold or domain or sub-domain
FNKDKDSCNKEAIKFLEESGIQFKDHAR

SEQ ID NO: 5203 - protein, 20 aa, artificial
  peptide fold or domain or sub-domain
FNKHWAGEIVQLNPDYFVEL

SEQ ID NO: 5204 - protein, 27 aa, artificial
  peptide fold or domain or sub-domain
FNKLKEEIPDWNQKIYSGDFLSITKWL

SEQ ID NO: 5205 - protein, 20 aa, artificial
  peptide fold or domain or sub-domain
FNKPLEKIKKYHRNIAKTIN

SEQ ID NO: 5206 - protein, 24 aa, artificial
  peptide fold or domain or sub-domain
FNKSNGYYTSPQAGNYAFTTFLHE

SEQ ID NO: 5207 - protein, 28 aa, artificial
  peptide fold or domain or sub-domain
FNLTEDMYSQDSIDLLANSGLQFQKHEE

SEQ ID NO: 5208 - protein, 20 aa, artificial
  peptide fold or domain or sub-domain
FNLVKARGKDVSNVFITFMS

SEQ ID NO: 5209 - protein, 30 aa, artificial
  peptide fold or domain or sub-domain
FNMLMFDNEYELTGDLKLKDALSNIREAFI

SEQ ID NO: 5210 - protein, 28 aa, artificial
  peptide fold or domain or sub-domain
FNPAHEKYIEQASSREAIRSLIESKIIA

SEQ ID NO: 5211 - protein, 28 aa, artificial
  peptide fold or domain or sub-domain
FNPERQGDIADAITREDVRELVDEGAIQ

SEQ ID NO: 5212 - protein, 24 aa, artificial
  peptide fold or domain or sub-domain
FNPYEYFDKREIRHYDLYTQYAFA

SEQ ID NO: 5213 - protein, 22 aa, artificial
  peptide fold or domain or sub-domain
FNQDAILLKKSSSIILSDREVN

SEQ ID NO: 5214 - protein, 26 aa, artificial
  peptide fold or domain or sub-domain
FNQFHLKNYGQVNVIEVHLHDWIKSI

SEQ ID NO: 5215 - protein, 27 aa, artificial
  peptide fold or domain or sub-domain
FNQGRRKNRLGRALRSAIPDSVWVALE

SEQ ID NO: 5216 - protein, 20 aa, artificial
  peptide fold or domain or sub-domain
FNRYEKKIPFTASESQTLKK

SEQ ID NO: 5217 - protein, 26 aa, artificial
  peptide fold or domain or sub-domain
FNSCTSDINYSNRWSVQNCDLVGLND

SEQ ID NO: 5218 - protein, 25 aa, artificial
  peptide fold or domain or sub-domain
FNSGKYYHNWQFVQNYDDPHETITG

SEQ ID NO: 5219 - protein, 29 aa, artificial
  peptide fold or domain or sub-domain
FNSLDIDLKNVMFEGPEDLLKRTDYTQPA

SEQ ID NO: 5220 - protein, 27 aa, artificial
  peptide fold or domain or sub-domain
FNSPRAFGDVDTADPLDPRVQQWWKTR

SEQ ID NO: 5221 - protein, 25 aa, artificial
  peptide fold or domain or sub-domain
FNSPSHYHPKRFLHNYDDTWDCEIA

SEQ ID NO: 5222 - protein, 23 aa, artificial
  peptide fold or domain or sub-domain
FNTTKGLDQKSSDEEKGKAFGAM

SEQ ID NO: 5223 - protein, 28 aa, artificial
  peptide fold or domain or sub-domain
FNVISDMFALDSIELLRKSAIDLEKNNE

SEQ ID NO: 5224 - protein, 28 aa, artificial
  peptide fold or domain or sub-domain
FNVNSPKYHGKSIDFLSSQGHDLTQHSK

SEQ ID NO: 5225 - protein, 20 aa, artificial
  peptide fold or domain or sub-domain
FNVPVEGMPSEVRRRAKAIN

SEQ ID NO: 5226 - protein, 24 aa, artificial
  peptide fold or domain or sub-domain
FNVRAERMGWLPSAPQLNVNPLDI

SEQ ID NO: 5227 - protein, 25 aa, artificial
  peptide fold or domain or sub-domain
FNWPQGRCPTSGDIDYSNIDSIRNC

SEQ ID NO: 5228 - protein, 29 aa, artificial
  peptide fold or domain or sub-domain
FNWSAIRKLSFKRRRFLIKLRADPTVSLT

SEQ ID NO: 5229 - protein, 24 aa, artificial
  peptide fold or domain or sub-domain
FNYKATLHPRFNNLSADINGFKLD

SEQ ID NO: 5230 - protein, 24 aa, artificial
  peptide fold or domain or sub-domain
FNYRARNFPGTLDYAEQQRWLEHR

SEQ ID NO: 5231 - protein, 24 aa, artificial
  peptide fold or domain or sub-domain
FNYSDYIKNGVLKEIGKGSQFAIA

SEQ ID NO: 5232 - protein, 25 aa, artificial
  peptide fold or domain or sub-domain
FNYVPSHYVDRIPSENRDPLLIRVN

SEQ ID NO: 5233 - protein, 27 aa, artificial
  peptide fold or domain or sub-domain
FPAALSYLGLDPNSTKQADLEKAADAV

SEQ ID NO: 5234 - protein, 28 aa, artificial
  peptide fold or domain or sub-domain
FPAARVKKIVKADRDIDIMSSEAVFMVS

SEQ ID NO: 5235 - protein, 27 aa, artificial
  peptide fold or domain or sub-domain
FPADDAWLPARTERARVPSSAPHAARW

SEQ ID NO: 5236 - protein, 20 aa, artificial
  peptide fold or domain or sub-domain
FPAERMRAVYRNPLWQVKSV

SEQ ID NO: 5237 - protein, 27 aa, artificial
  peptide fold or domain or sub-domain
FPAGDLGLQKSLGVKSSAELERRAENW

SEQ ID NO: 5238 - protein, 20 aa, artificial
  peptide fold or domain or sub-domain
FPAGNVEAIYRNNREHVVKL

SEQ ID NO: 5239 - protein, 28 aa, artificial
  peptide fold or domain or sub-domain
FPAPARHGVIPFIANLDQGWAGLHAEKY

SEQ ID NO: 5240 - protein, 20 aa, artificial
  peptide fold or domain or sub-domain
FPARPDEQRHRGHLRELAHV

SEQ ID NO: 5241 - protein, 27 aa, artificial
  peptide fold or domain or sub-domain
FPASDVGVRKALGGVDAKQSARAAEEW

SEQ ID NO: 5242 - protein, 28 aa, artificial
  peptide fold or domain or sub-domain
FPAVVQRGIVRTASNIDQRWLHCDVAAR

SEQ ID NO: 5243 - protein, 20 aa, artificial
  peptide fold or domain or sub-domain
FPAWGTEKYYRNPIDQVELF

SEQ ID NO: 5244 - protein, 25 aa, artificial
  peptide fold or domain or sub-domain
FPCQNGGICQRPNACSCPEGWMGRL

SEQ ID NO: 5245 - protein, 28 aa, artificial
  peptide fold or domain or sub-domain
FPDEKRYLLESRVKPRLLAQEVPDFETY

SEQ ID NO: 5246 - protein, 25 aa, artificial
  peptide fold or domain or sub-domain
FPDIEMYLDEYWSLQKLKGVTKQSL

SEQ ID NO: 5247 - protein, 29 aa, artificial
  peptide fold or domain or sub-domain
FPDLFHAEVDGRPALELVDMEWYEKVFIP

SEQ ID NO: 5248 - protein, 27 aa, artificial
  peptide fold or domain or sub-domain
FPDQPHAFVGGIESITTGGAAGEAWQV

SEQ ID NO: 5249 - protein, 24 aa, artificial
  peptide fold or domain or sub-domain
FPDTLSIGAAFGIIAVKENGQLFE

SEQ ID NO: 5250 - protein, 27 aa, artificial
  peptide fold or domain or sub-domain
FPEAPHGFFSDRRDSYRAGPAQEGWEM

SEQ ID NO: 5251 - protein, 27 aa, artificial
  peptide fold or domain or sub-domain
FPEENYSVLKQALAHLDPKFIPGSIGE

SEQ ID NO: 5252 - protein, 27 aa, artificial
  peptide fold or domain or sub-domain
FPETDVGLIRAAKSESAMALLASAELW

SEQ ID NO: 5253 - protein, 24 aa, artificial
  peptide fold or domain or sub-domain
FPFDKYFVKKDTNRFDNYSLYALY

SEQ ID NO: 5254 - protein, 28 aa, artificial
  peptide fold or domain or sub-domain
FPFDKYFVKKDTNRFDNYSLYALYAAQE

SEQ ID NO: 5255 - protein, 28 aa, artificial
  peptide fold or domain or sub-domain
FPFKIKERHGVDYIRQFPHLRCRTNVFG

SEQ ID NO: 5256 - protein, 24 aa, artificial
  peptide fold or domain or sub-domain
FPFNKFDITALEYKPFTRFTIAKS

SEQ ID NO: 5257 - protein, 24 aa, artificial
  peptide fold or domain or sub-domain
FPGAVYAILERAMRYPQALDVPEH

SEQ ID NO: 5258 - protein, 30 aa, artificial
  peptide fold or domain or sub-domain
FPGCLEITAESREGQIMALRHRTYDVHGIQ

SEQ ID NO: 5259 - protein, 24 aa, artificial
  peptide fold or domain or sub-domain
FPGELWYMYQQTGLATWRVRADAW

SEQ ID NO: 5260 - protein, 25 aa, artificial
  peptide fold or domain or sub-domain
FPGFIVEGPFGYDVAVSKAAAKAKK

SEQ ID NO: 5261 - protein, 28 aa, artificial
  peptide fold or domain or sub-domain
FPGIIQHGVVHSAANVDKSWLNTDIDAL

SEQ ID NO: 5262 - protein, 24 aa, artificial
  peptide fold or domain or sub-domain
FPGSLWYAYELTGNDTLKADAIQY

SEQ ID NO: 5263 - protein, 20 aa, artificial
  peptide fold or domain or sub-domain
FPGTGLEASWRNSIDDVCEL

SEQ ID NO: 5264 - protein, 28 aa, artificial
  peptide fold or domain or sub-domain
FPGVILDDEVHFAANLDQSWIGSSIVKI

SEQ ID NO: 5265 - protein, 24 aa, artificial
  peptide fold or domain or sub-domain
FPGWKRSNMMRSNKKPVKHGKLFC

SEQ ID NO: 5266 - protein, 29 aa, artificial
  peptide fold or domain or sub-domain
FPHASEQEREKMFPILEQRRNAPPDPRQF

SEQ ID NO: 5267 - protein, 27 aa, artificial
  peptide fold or domain or sub-domain
FPHETYAWLRHHFGALPRLEGPGSMGE

SEQ ID NO: 5268 - protein, 27 aa, artificial
  peptide fold or domain or sub-domain
FPILLNYLGKDPKGSNPEDLKAAAEVL

SEQ ID NO: 5269 - protein, 27 aa, artificial
  peptide fold or domain or sub-domain
FPIQDSSLRKAMSLLKDQDILIIPERA

SEQ ID NO: 5270 - protein, 28 aa, artificial
  peptide fold or domain or sub-domain
FPIVVSNAPEAIKRIALYITKASGGEGA

SEQ ID NO: 5271 - protein, 30 aa, artificial
  peptide fold or domain or sub-domain
FPKAAIKRLIQSITGTSVSQNVVIAMSGIS

SEQ ID NO: 5272 - protein, 27 aa, artificial
  peptide fold or domain or sub-domain
FPKEDVALRKKLGKVTAKQAEKLSQVW

SEQ ID NO: 5273 - protein, 24 aa, artificial
  peptide fold or domain or sub-domain
FPKTIDVGSKHGTVVVVHKGKAYE

SEQ ID NO: 5274 - protein, 27 aa, artificial
  peptide fold or domain or sub-domain
FPLASSRSAGGTVSFNGKQVEILDVDD

SEQ ID NO: 5275 - protein, 28 aa, artificial
  peptide fold or domain or sub-domain
FPLSRVRELLKFHSNFSIVAKDAGAVAG

SEQ ID NO: 5276 - protein, 28 aa, artificial
  peptide fold or domain or sub-domain
FPMARVRQIMRAEDATIRPSNEAVFLIN

SEQ ID NO: 5277 - protein, 24 aa, artificial
  peptide fold or domain or sub-domain
FPMCTIASMPRLPEHCIEYVRMLQ

SEQ ID NO: 5278 - protein, 23 aa, artificial
  peptide fold or domain or sub-domain
FPMFKKLGNDLAAAKGTAEFKDQ

SEQ ID NO: 5279 - protein, 28 aa, artificial
  peptide fold or domain or sub-domain
FPMNRIRRIMRSDNSAPQIMQDAVFLVN

SEQ ID NO: 5280 - protein, 28 aa, artificial
  peptide fold or domain or sub-domain
FPMNRIRTMLKGEISDLRVSQEAILAIN

SEQ ID NO: 5281 - protein, 29 aa, artificial
  peptide fold or domain or sub-domain
FPNKIDAAYERYFDHMIFFFKGNEYYKYN

SEQ ID NO: 5282 - protein, 24 aa, artificial
  peptide fold or domain or sub-domain
FPNNIKTGIKHGTIGIIFNKKIFE

SEQ ID NO: 5283 - protein, 28 aa, artificial
  peptide fold or domain or sub-domain
FPPARIKKIMQTDEEIGKVAAAVPVIIS

SEQ ID NO: 5284 - protein, 28 aa, artificial
  peptide fold or domain or sub-domain
FPPARIRKLTKINIDNKQLKTETVEILS

SEQ ID NO: 5285 - protein, 25 aa, artificial
  peptide fold or domain or sub-domain
FPPFYTEDRKSLFELIKNNPYPELP

SEQ ID NO: 5286 - protein, 26 aa, artificial
  peptide fold or domain or sub-domain
FPQFLAGLKQKAVAAGVSQGAIAEAS

SEQ ID NO: 5287 - protein, 30 aa, artificial
  peptide fold or domain or sub-domain
FPQIVRDLTEDGIGHPEVGDAVARLKEVLQ

SEQ ID NO: 5288 - protein, 24 aa, artificial
  peptide fold or domain or sub-domain
FPQQLIDGYHTFTEQRLPAEQSRY

SEQ ID NO: 5289 - protein, 30 aa, artificial
  peptide fold or domain or sub-domain
FPQQVIARVEEAGFKAIPTGIAFGTVTVVA

SEQ ID NO: 5290 - protein, 24 aa, artificial
  peptide fold or domain or sub-domain
FPRVIPIGIRHGTVQVHTRTRDVE

SEQ ID NO: 5291 - protein, 20 aa, artificial
  peptide fold or domain or sub-domain
FPSEDTVINSTWYRNSRVDV

SEQ ID NO: 5292 - protein, 20 aa, artificial
  peptide fold or domain or sub-domain
FPSESLEGLYRNRMRDVQRF

SEQ ID NO: 5293 - protein, 28 aa, artificial
  peptide fold or domain or sub-domain
FPSKNEARRMIQQGAVQAGNEKISDINA

SEQ ID NO: 5294 - protein, 24 aa, artificial
  peptide fold or domain or sub-domain
FPTAMLQGKDFPVYRMDIDGELCE

SEQ ID NO: 5295 - protein, 26 aa, artificial
  peptide fold or domain or sub-domain
FPTCVTNLQKRARREGLSEETINNTV

SEQ ID NO: 5296 - protein, 28 aa, artificial
  peptide fold or domain or sub-domain
FPTTIVKGKCIHTGNLSKDWLNVKVDKL

SEQ ID NO: 5297 - protein, 23 aa, artificial
  peptide fold or domain or sub-domain
FPTWLLEKTTGISQAEIRDLKNL

SEQ ID NO: 5298 - protein, 28 aa, artificial
  peptide fold or domain or sub-domain
FPVSKVKKIVQENQDVGKINNVVPYVLT

SEQ ID NO: 5299 - protein, 29 aa, artificial
  peptide fold or domain or sub-domain
FPVSVHDEENTREELRLRHRYLDLRRKRM

SEQ ID NO: 5300 - protein, 21 aa, artificial
  peptide fold or domain or sub-domain
FPVVDDPERARQLGFDNPFRT

SEQ ID NO: 5301 - protein, 29 aa, artificial
  peptide fold or domain or sub-domain
FPWKEFHTVTIDKRTIKIEQNKLDGGGSI

SEQ ID NO: 5302 - protein, 29 aa, artificial
  peptide fold or domain or sub-domain
FPWNEIQKLSYSQNKFYVKPVGASGEVLT

SEQ ID NO: 5303 - protein, 29 aa, artificial
  peptide fold or domain or sub-domain
FPWSEIRNISFNDKKFVIKPIDKKAPDFV

SEQ ID NO: 5304 - protein, 22 aa, artificial
  peptide fold or domain or sub-domain
FPYIKGKCRISLKTDLNPFATG

SEQ ID NO: 5305 - protein, 22 aa, artificial
  peptide fold or domain or sub-domain
FQAIGQMRHRYGQDLSESMLGC

SEQ ID NO: 5306 - protein, 20 aa, artificial
  peptide fold or domain or sub-domain
FQAVIRSGDTYVFTPETPEQ

SEQ ID NO: 5307 - protein, 25 aa, artificial
  peptide fold or domain or sub-domain
FQCEINKFCQKVLRKNWSKVPLHTD

SEQ ID NO: 5308 - protein, 29 aa, artificial
  peptide fold or domain or sub-domain
FQCNQVDNKNGEQYSFKCKSSDNTEFEAD

SEQ ID NO: 5309 - protein, 21 aa, artificial
  peptide fold or domain or sub-domain
FQEEGLLRKHMIQNGVAHDTI

SEQ ID NO: 5310 - protein, 21 aa, artificial
  peptide fold or domain or sub-domain
FQEIADEIGLGSKSGVARIMD

SEQ ID NO: 5311 - protein, 26 aa, artificial
  peptide fold or domain or sub-domain
FQEMADLNNALGEKYKVSSYHRSIES

SEQ ID NO: 5312 - protein, 26 aa, artificial
  peptide fold or domain or sub-domain
FQGMPEEVLMNSYRINRNEARTVKFN

SEQ ID NO: 5313 - protein, 25 aa, artificial
  peptide fold or domain or sub-domain
FQGMVPPDPTLDDMRTVVVDEKKQP

SEQ ID NO: 5314 - protein, 22 aa, artificial
  peptide fold or domain or sub-domain
FQGVNGYNADVAGYLAGGDAAG

SEQ ID NO: 5315 - protein, 20 aa, artificial
  peptide fold or domain or sub-domain
FQHFINESRPKTPVHWAKIL

SEQ ID NO: 5316 - protein, 30 aa, artificial
  peptide fold or domain or sub-domain
FQHLPYAPAKSFHWMADEQEYVQTCGFLTA

SEQ ID NO: 5317 - protein, 23 aa, artificial
  peptide fold or domain or sub-domain
FQIDDYINWQKGSSSAYSNWSPI

SEQ ID NO: 5318 - protein, 23 aa, artificial
  peptide fold or domain or sub-domain
FQINSAFGRRRVQEYSKSTCTYL

SEQ ID NO: 5319 - protein, 20 aa, artificial
  peptide fold or domain or sub-domain
FQKAMEISPECIIEWENQGA

SEQ ID NO: 5320 - protein, 26 aa, artificial
  peptide fold or domain or sub-domain
FQKCLSRLENTAIESGVSSQTVKSAL

SEQ ID NO: 5321 - protein, 24 aa, artificial
  peptide fold or domain or sub-domain
FQLIGIQDGYLSLLQDSGEVREDL

SEQ ID NO: 5322 - protein, 27 aa, artificial
  peptide fold or domain or sub-domain
FQMALRKLGYSGNTTDPKEIEAAYNEL

SEQ ID NO: 5323 - protein, 21 aa, artificial
  peptide fold or domain or sub-domain
FQNEGLLRQYEKAKGRYIDLY

SEQ ID NO: 5324 - protein, 26 aa, artificial
  peptide fold or domain or sub-domain
FQNFVRGLKDEAVSAGYAINTVNEFF

SEQ ID NO: 5325 - protein, 29 aa, artificial
  peptide fold or domain or sub-domain
FQNGLPVSPSPRLQVLEEGQVLKVSTAEV

SEQ ID NO: 5326 - protein, 22 aa, artificial
  peptide fold or domain or sub-domain
FQNISQLKNRYPNDAWQEIIGN

SEQ ID NO: 5327 - protein, 24 aa, artificial
  peptide fold or domain or sub-domain
FQNRKEMESYSEAVEAGEFPVFRG

SEQ ID NO: 5328 - protein, 27 aa, artificial
  peptide fold or domain or sub-domain
FQQMSTLTFETSTVQGQQAVLEKIQSL

SEQ ID NO: 5329 - protein, 26 aa, artificial
  peptide fold or domain or sub-domain
FQRCIANLRSQAISSGVNESTYDRYT

SEQ ID NO: 5330 - protein, 24 aa, artificial
  peptide fold or domain or sub-domain
FQRCIIIGKRFPICQVNMYGTKIE

SEQ ID NO: 5331 - protein, 27 aa, artificial
  peptide fold or domain or sub-domain
FQSLATVCDDELAVMNLRRDELALVRE

SEQ ID NO: 5332 - protein, 22 aa, artificial
  peptide fold or domain or sub-domain
FQSLGQMREAYGGRDATSKWFE

SEQ ID NO: 5333 - protein, 22 aa, artificial
  peptide fold or domain or sub-domain
FQSPAQIVGKYGEAAAETFSTN

SEQ ID NO: 5334 - protein, 24 aa, artificial
  peptide fold or domain or sub-domain
FQSTYDTGIAHGTVTVRENKECYE

SEQ ID NO: 5335 - protein, 22 aa, artificial
  peptide fold or domain or sub-domain
FQSYPQLEATYGIQDAAAITGY

SEQ ID NO: 5336 - protein, 23 aa, artificial
  peptide fold or domain or sub-domain
FQTISEHTRGGYQRALLSLCGGD

SEQ ID NO: 5337 - protein, 28 aa, artificial
  peptide fold or domain or sub-domain
FQTLQMKLENITNPWSPRHRVVQPTLEQ

SEQ ID NO: 5338 - protein, 25 aa, artificial
  peptide fold or domain or sub-domain
FQTMFGRELVVSFGSTEKKFEKFIY

SEQ ID NO: 5339 - protein, 26 aa, artificial
  peptide fold or domain or sub-domain
FQTMFGRELVVSFGSTEKKFEKFIYA

SEQ ID NO: 5340 - protein, 26 aa, artificial
  peptide fold or domain or sub-domain
FQTWLVEFKKSAYEQGISKTTLKKAF

SEQ ID NO: 5341 - protein, 21 aa, artificial
  peptide fold or domain or sub-domain
FQVAWNDAANPDKGFQYLYLT

SEQ ID NO: 5342 - protein, 25 aa, artificial
  peptide fold or domain or sub-domain
FQVLERSERSATLTANGRTPLLVIE

SEQ ID NO: 5343 - protein, 27 aa, artificial
  peptide fold or domain or sub-domain
FQYSKQKGFLPVVEAVGERSYFSESKN

SEQ ID NO: 5344 - protein, 30 aa, artificial
  peptide fold or domain or sub-domain
FRAAIKEQTDLGKKVKAVIDSGALVSDDLT

SEQ ID NO: 5345 - protein, 30 aa, artificial
  peptide fold or domain or sub-domain
FRAECKAGTEMGKVACSMISRGGFVSDDIV

SEQ ID NO: 5346 - protein, 25 aa, artificial
  peptide fold or domain or sub-domain
FRAFDAELLSEAFNVPQETIRRMQS

SEQ ID NO: 5347 - protein, 26 aa, artificial
  peptide fold or domain or sub-domain
FRAFDAELLSEAFNVPQETIRRMQSE

SEQ ID NO: 5348 - protein, 26 aa, artificial
  peptide fold or domain or sub-domain
FRAFHAFDKDGDGIIKLNVLEWLQLT

SEQ ID NO: 5349 - protein, 24 aa, artificial
  peptide fold or domain or sub-domain
FRALIEEGQRTGVFTKEIPADLVV

SEQ ID NO: 5350 - protein, 25 aa, artificial
  peptide fold or domain or sub-domain
FRARAIVLRDRLGWSLNVVDGMEID

SEQ ID NO: 5351 - protein, 26 aa, artificial
  peptide fold or domain or sub-domain
FRATPSEVLANAFGLRQRQVTELKLS

SEQ ID NO: 5352 - protein, 29 aa, artificial
  peptide fold or domain or sub-domain
FRAYHGTTYGALSLSAVSLPMRRDLGPFV

SEQ ID NO: 5353 - protein, 29 aa, artificial
  peptide fold or domain or sub-domain
FRCEAEGEGDAGKLSFICTVNEEPTFRAV

SEQ ID NO: 5354 - protein, 24 aa, artificial
  peptide fold or domain or sub-domain
FRDCPDVVTMEDKPSQVVRNGKNT

SEQ ID NO: 5355 - protein, 30 aa, artificial
  peptide fold or domain or sub-domain
FREAIKNQSVIGRKIAAIISQGGYVDDATT

SEQ ID NO: 5356 - protein, 20 aa, artificial
  peptide fold or domain or sub-domain
FREGGLEISGSYVSFADSAC

SEQ ID NO: 5357 - protein, 28 aa, artificial
  peptide fold or domain or sub-domain
FREHCISLISQSSWTLERACALVCLLLD

SEQ ID NO: 5358 - protein, 30 aa, artificial
  peptide fold or domain or sub-domain
FREHMSKETIIGLKAKEFIQAGKLVPDEFV

SEQ ID NO: 5359 - protein, 30 aa, artificial
  peptide fold or domain or sub-domain
FREKIAKIDLGDYFPAYTGGLSFDNSTQFI

SEQ ID NO: 5360 - protein, 25 aa, artificial
  peptide fold or domain or sub-domain
FRELLHDRTAELTGARLTTSFGRVG

SEQ ID NO: 5361 - protein, 21 aa, artificial
  peptide fold or domain or sub-domain
FREMCVHMNAKSTSSIAQMLG

SEQ ID NO: 5362 - protein, 21 aa, artificial
  peptide fold or domain or sub-domain
FREPFVSNSKLFSANDVENIF

SEQ ID NO: 5363 - protein, 26 aa, artificial
  peptide fold or domain or sub-domain
FRFFKTLDTDLDGVVTFDLFKWLQLT

SEQ ID NO: 5364 - protein, 26 aa, artificial
  peptide fold or domain or sub-domain
FRFTDMPLQSVSHIGGKGASLCAMSA

SEQ ID NO: 5365 - protein, 25 aa, artificial
  peptide fold or domain or sub-domain
FRGFETRLLAESFGVSEEIAQKLQA

SEQ ID NO: 5366 - protein, 26 aa, artificial
  peptide fold or domain or sub-domain
FRGFIAGVKAEGRRAGISDTILAQAL

SEQ ID NO: 5367 - protein, 26 aa, artificial
  peptide fold or domain or sub-domain
FRGVPVQVIANSYRISIGQARQLKQC

SEQ ID NO: 5368 - protein, 25 aa, artificial
  peptide fold or domain or sub-domain
FRIRHETFIERLGWDITSTDGKERD

SEQ ID NO: 5369 - protein, 26 aa, artificial
  peptide fold or domain or sub-domain
FRISKQLDSENTGTIELDLISWLCFS

SEQ ID NO: 5370 - protein, 24 aa, artificial
  peptide fold or domain or sub-domain
FRIVTPQEADFFAQKLSSDSPLGK

SEQ ID NO: 5371 - protein, 24 aa, artificial
  peptide fold or domain or sub-domain
FRKAQYLYRDGDHYYFMTLDDYEQ

SEQ ID NO: 5372 - protein, 30 aa, artificial
  peptide fold or domain or sub-domain
FRKKISEDSRFAAQIQNYLSSGSYVPDEIT

SEQ ID NO: 5373 - protein, 30 aa, artificial
  peptide fold or domain or sub-domain
FRKKLEHVPFQDYFPQYEGKNSVKSITRYI

SEQ ID NO: 5374 - protein, 28 aa, artificial
  peptide fold or domain or sub-domain
FRKLKEEGLIEVDGSRVVIFDMEKLKAA

SEQ ID NO: 5375 - protein, 25 aa, artificial
  peptide fold or domain or sub-domain
FRKMFRSKLSKKLKFRVAQRFFGGP

SEQ ID NO: 5376 - protein, 29 aa, artificial
  peptide fold or domain or sub-domain
FRLAGVPALAPVMSHLLPRAMIESSLRNV

SEQ ID NO: 5377 - protein, 25 aa, artificial
  peptide fold or domain or sub-domain
FRLEGTSLYITKGDDTHHKLVTSDY

SEQ ID NO: 5378 - protein, 27 aa, artificial
  peptide fold or domain or sub-domain
FRLFGKYLGKSVNELTPADVATIERMM

SEQ ID NO: 5379 - protein, 24 aa, artificial
  peptide fold or domain or sub-domain
FRLIERHYPDYLPAETQARSLGLC

SEQ ID NO: 5380 - protein, 25 aa, artificial
  peptide fold or domain or sub-domain
FRLRKKVFHDLLKWDVLVQGDFEMD

SEQ ID NO: 5381 - protein, 23 aa, artificial
  peptide fold or domain or sub-domain
FRLYDYCGRRLFEANINDELEGI

SEQ ID NO: 5382 - protein, 24 aa, artificial
  peptide fold or domain or sub-domain
FRNARIIGRRFKLVHVHFGREIIE

SEQ ID NO: 5383 - protein, 26 aa, artificial
  peptide fold or domain or sub-domain
FRNLKRVARELGETLTDEELREMIDE

SEQ ID NO: 5384 - protein, 30 aa, artificial
  peptide fold or domain or sub-domain
FRQNLRDNTELGKLAKEYMDKGLLVPDEVT

SEQ ID NO: 5385 - protein, 30 aa, artificial
  peptide fold or domain or sub-domain
FRQTIDQKGPYWEELKSYISKGLLVPDELT

SEQ ID NO: 5386 - protein, 26 aa, artificial
  peptide fold or domain or sub-domain
FRQWVAGFRATAVAGGVSGAVYDQAF

SEQ ID NO: 5387 - protein, 21 aa, artificial
  peptide fold or domain or sub-domain
FRREGTLREDCVVNGEVSDSW

SEQ ID NO: 5388 - protein, 23 aa, artificial
  peptide fold or domain or sub-domain
FRREKLLDTMNRLELLPIYGQIS

SEQ ID NO: 5389 - protein, 21 aa, artificial
  peptide fold or domain or sub-domain
FRRMITEYEHQKQRRVLDNSK

SEQ ID NO: 5390 - protein, 24 aa, artificial
  peptide fold or domain or sub-domain
FRRTVPTGIEHGTVTILFRGHSIE

SEQ ID NO: 5391 - protein, 26 aa, artificial
  peptide fold or domain or sub-domain
FRSIMKILKTKITTIDDFSYSINVIN

SEQ ID NO: 5392 - protein, 30 aa, artificial
  peptide fold or domain or sub-domain
FRSQIASNSELGIKLKEIVESGGYVPDSIT

SEQ ID NO: 5393 - protein, 30 aa, artificial
  peptide fold or domain or sub-domain
FRSVMQEQGALSQTLAHYMNQGLYVPDELT

SEQ ID NO: 5394 - protein, 23 aa, artificial
  peptide fold or domain or sub-domain
FRSVTCNSNVGGASNSRHMYGHA

SEQ ID NO: 5395 - protein, 30 aa, artificial
  peptide fold or domain or sub-domain
FRTIIKTSTSEAELINNYVKQGALIPNEIV

SEQ ID NO: 5396 - protein, 24 aa, artificial
  peptide fold or domain or sub-domain
FRVVGYDEIYGRNDYISIDSPMAR

SEQ ID NO: 5397 - protein, 27 aa, artificial
  peptide fold or domain or sub-domain
FRVYCAVKAHMSGKYDISKYKLGMKTP

SEQ ID NO: 5398 - protein, 30 aa, artificial
  peptide fold or domain or sub-domain
FRWNVQNHTKLGAQVKRIVAAGHLVGDDLV

SEQ ID NO: 5399 - protein, 24 aa, artificial
  peptide fold or domain or sub-domain
FRYKARNFFNILKNDEKKEWINYC

SEQ ID NO: 5400 - protein, 24 aa, artificial
  peptide fold or domain or sub-domain
FRYRARNYPSTLSDKELNKWRLFC

SEQ ID NO: 5401 - protein, 22 aa, artificial
  peptide fold or domain or sub-domain
FSAAGLDFAKEKAKALKGPYHT

SEQ ID NO: 5402 - protein, 27 aa, artificial
  peptide fold or domain or sub-domain
FSAASLYLGIDQCTEDPKAGQRILNVL

SEQ ID NO: 5403 - protein, 24 aa, artificial
  peptide fold or domain or sub-domain
FSAEEFYDISNMNSDEQINYFYDL

SEQ ID NO: 5404 - protein, 24 aa, artificial
  peptide fold or domain or sub-domain
FSAEEYAIIVNLPSREKNKAFIRI

SEQ ID NO: 5405 - protein, 26 aa, artificial
  peptide fold or domain or sub-domain
FSAEGTKAVKISDDIMKNTGDRDAVI

SEQ ID NO: 5406 - protein, 22 aa, artificial
  peptide fold or domain or sub-domain
FSAEKADQVNLEEHGVENILAR

SEQ ID NO: 5407 - protein, 28 aa, artificial
  peptide fold or domain or sub-domain
FSAEKADQVNLEEHGVENILARVGMPVP

SEQ ID NO: 5408 - protein, 26 aa, artificial
  peptide fold or domain or sub-domain
FSAIADLMEILDEDRFRVQAYRRASD

SEQ ID NO: 5409 - protein, 21 aa, artificial
  peptide fold or domain or sub-domain
FSALHTDGTKWVNANGDQVLL

SEQ ID NO: 5410 - protein, 28 aa, artificial
  peptide fold or domain or sub-domain
FSANLGFLWVDRPLPDAIRAAKAAGFDA

SEQ ID NO: 5411 - protein, 27 aa, artificial
  peptide fold or domain or sub-domain
FSAPQEIGNLDTSDPMNPKVKQWWRNK

SEQ ID NO: 5412 - protein, 28 aa, artificial
  peptide fold or domain or sub-domain
FSAQCAAECTLQEHGIADVEEWLGLPSP

SEQ ID NO: 5413 - protein, 24 aa, artificial
  peptide fold or domain or sub-domain
FSASERAAFFALPPDARRTRFFEL

SEQ ID NO: 5414 - protein, 28 aa, artificial
  peptide fold or domain or sub-domain
FSATPSDGHEFVRRHVGYVASKPGGRGA

SEQ ID NO: 5415 - protein, 29 aa, artificial
  peptide fold or domain or sub-domain
FSAVEIDFVGKSELYVYTASGQKIHINAL

SEQ ID NO: 5416 - protein, 27 aa, artificial
  peptide fold or domain or sub-domain
FSAYEFREALNDAGYHVSNRLINAIIN

SEQ ID NO: 5417 - protein, 28 aa, artificial
  peptide fold or domain or sub-domain
FSCNIEQWFRPMPFLQRIAAAKALGFSA

SEQ ID NO: 5418 - protein, 24 aa, artificial
  peptide fold or domain or sub-domain
FSDQHEWFQDALNGDVSKLDYFIF

SEQ ID NO: 5419 - protein, 24 aa, artificial
  peptide fold or domain or sub-domain
FSDREKDVFRKLPQDEKLGAFFNC

SEQ ID NO: 5420 - protein, 24 aa, artificial
  peptide fold or domain or sub-domain
FSDSEFNDLLTQPTAQQTSRFFDY

SEQ ID NO: 5421 - protein, 25 aa, artificial
  peptide fold or domain or sub-domain
FSDSLLRKGAKGGDSLKNTADVKTL

SEQ ID NO: 5422 - protein, 25 aa, artificial
  peptide fold or domain or sub-domain
FSEEAYDSSVKDKKKFIHYKHLSSV

SEQ ID NO: 5423 - protein, 29 aa, artificial
  peptide fold or domain or sub-domain
FSEGADIRAEDVHLTGPGARYRLITPVGE

SEQ ID NO: 5424 - protein, 28 aa, artificial
  peptide fold or domain or sub-domain
FSEKPFTIEPSALQFLAKHSFDFNRLIQ

SEQ ID NO: 5425 - protein, 30 aa, artificial
  peptide fold or domain or sub-domain
FSEMVNEANGLPEALSYDGVHPTDEGYKVM

SEQ ID NO: 5426 - protein, 24 aa, artificial
  peptide fold or domain or sub-domain
FSEQEYQELKKAHQSLKPALFFHI

SEQ ID NO: 5427 - protein, 23 aa, artificial
  peptide fold or domain or sub-domain
FSERAGGKLHRHLESLPQDSSPL

SEQ ID NO: 5428 - protein, 26 aa, artificial
  peptide fold or domain or sub-domain
FSEYYDVMVETGQRDGFTPAPMSDYS

SEQ ID NO: 5429 - protein, 27 aa, artificial
  peptide fold or domain or sub-domain
FSFIKKNHYEFLGAIIKGDFGLLIGWL

SEQ ID NO: 5430 - protein, 23 aa, artificial
  peptide fold or domain or sub-domain
FSFSERTIKKHGKAMVPRLSKHN

SEQ ID NO: 5431 - protein, 26 aa, artificial
  peptide fold or domain or sub-domain
FSGFDDQLLADAFNVDLKIIQKLKGP

SEQ ID NO: 5432 - protein, 25 aa, artificial
  peptide fold or domain or sub-domain
FSGFKRDFLEDAFNVNRHIVDRLQG

SEQ ID NO: 5433 - protein, 25 aa, artificial
  peptide fold or domain or sub-domain
FSGFNIQLLSEALGISQQAAQRIQS

SEQ ID NO: 5434 - protein, 26 aa, artificial
  peptide fold or domain or sub-domain
FSGFNNELLSEALGVNALVAKRLQGQ

SEQ ID NO: 5435 - protein, 25 aa, artificial
  peptide fold or domain or sub-domain
FSGFRAKDLAEVFNVNEDTIRNLQG

SEQ ID NO: 5436 - protein, 26 aa, artificial
  peptide fold or domain or sub-domain
FSGFRAKDLAEVFNVNEDTIRNLQGL

SEQ ID NO: 5437 - protein, 25 aa, artificial
  peptide fold or domain or sub-domain
FSGKTIAEIADRWGCNGAAAVIRLL

SEQ ID NO: 5438 - protein, 23 aa, artificial
  peptide fold or domain or sub-domain
FSGTHPVDPNLRNGTQGPEYGGP

SEQ ID NO: 5439 - protein, 23 aa, artificial
  peptide fold or domain or sub-domain
FSGTVSRLQSHVDGVEFDTTDVI

SEQ ID NO: 5440 - protein, 26 aa, artificial
  peptide fold or domain or sub-domain
FSGVGGSLYASLRRAHRAGPLDAAFR

SEQ ID NO: 5441 - protein, 21 aa, artificial
  peptide fold or domain or sub-domain
FSHVAQLLGFKSKNAVTSCVA

SEQ ID NO: 5442 - protein, 27 aa, artificial
  peptide fold or domain or sub-domain
FSIDSYQKLALQTGLTFDVENQALLGE

SEQ ID NO: 5443 - protein, 30 aa, artificial
  peptide fold or domain or sub-domain
FSIECGECWYCKHGYSGQCNVTNTFGKVGL

SEQ ID NO: 5444 - protein, 28 aa, artificial
  peptide fold or domain or sub-domain
FSIEGKSLKLDAITTEDEKSVFAVLLED

SEQ ID NO: 5445 - protein, 25 aa, artificial
  peptide fold or domain or sub-domain
FSIFGKAWDFHVTDIIKTSIEENLN

SEQ ID NO: 5446 - protein, 28 aa, artificial
  peptide fold or domain or sub-domain
FSIKEDVYAQDSIELLRHGGINFDYFND

SEQ ID NO: 5447 - protein, 21 aa, artificial
  peptide fold or domain or sub-domain
FSINYCEDGTINNDCRTGPKP

SEQ ID NO: 5448 - protein, 29 aa, artificial
  peptide fold or domain or sub-domain
FSIRRLGDELGINGTSLYYHFEDKDAILH

SEQ ID NO: 5449 - protein, 24 aa, artificial
  peptide fold or domain or sub-domain
FSKDERKYLFSLGKAQQLISFYDM

SEQ ID NO: 5450 - protein, 21 aa, artificial
  peptide fold or domain or sub-domain
FSKEKEGYTLILPDGSTRTLH

SEQ ID NO: 5451 - protein, 24 aa, artificial
  peptide fold or domain or sub-domain
FSKKEKKYLSYFDETQKKHNFYKM

SEQ ID NO: 5452 - protein, 24 aa, artificial
  peptide fold or domain or sub-domain
FSKKEYENLMLQNEQKQLECFFEY

SEQ ID NO: 5453 - protein, 26 aa, artificial
  peptide fold or domain or sub-domain
FSKLIEALQAAKESNTELVDQLLKEA

SEQ ID NO: 5454 - protein, 24 aa, artificial
  peptide fold or domain or sub-domain
FSKRENKYIASLSKDDRVDAFFML

SEQ ID NO: 5455 - protein, 24 aa, artificial
  peptide fold or domain or sub-domain
FSKTEYSDLLAKDKDEQTDYFYHL

SEQ ID NO: 5456 - protein, 24 aa, artificial
  peptide fold or domain or sub-domain
FSKTVNVGKSFGVMRVLVEGADIE

SEQ ID NO: 5457 - protein, 28 aa, artificial
  peptide fold or domain or sub-domain
FSLEDDMYNEESIQMLKKSGADFDKLAS

SEQ ID NO: 5458 - protein, 29 aa, artificial
  peptide fold or domain or sub-domain
FSLGEEYEHAPPATNRQISPYLPSGRFRT

SEQ ID NO: 5459 - protein, 28 aa, artificial
  peptide fold or domain or sub-domain
FSLKCDHPEWFEGLDTNAKTKEDYMFRR

SEQ ID NO: 5460 - protein, 28 aa, artificial
  peptide fold or domain or sub-domain
FSLKDDMYSQSQIESLLQAGIDFVALER

SEQ ID NO: 5461 - protein, 29 aa, artificial
  peptide fold or domain or sub-domain
FSLPRLAKHIGVRAPSLYHHFSDKSEILE

SEQ ID NO: 5462 - protein, 24 aa, artificial
  peptide fold or domain or sub-domain
FSLQELLSSKKALEPQISLSVQPP

SEQ ID NO: 5463 - protein, 24 aa, artificial
  peptide fold or domain or sub-domain
FSLQEYKLISQLPPQKQQETFFKI

SEQ ID NO: 5464 - protein, 29 aa, artificial
  peptide fold or domain or sub-domain
FSLRDVARELGVYPTAIYWHVPSRDELLV

SEQ ID NO: 5465 - protein, 23 aa, artificial
  peptide fold or domain or sub-domain
FSLSEDAASAIQRRLPKALFSHN

SEQ ID NO: 5466 - protein, 25 aa, artificial
  peptide fold or domain or sub-domain
FSLVDRQRKDAFLASRSGQLAIHIR

SEQ ID NO: 5467 - protein, 23 aa, artificial
  peptide fold or domain or sub-domain
FSLYDYMVQRLTDATVQNNLQIM

SEQ ID NO: 5468 - protein, 20 aa, artificial
  peptide fold or domain or sub-domain
FSLYLKCQGEPFSSESDRLC

SEQ ID NO: 5469 - protein, 29 aa, artificial
  peptide fold or domain or sub-domain
FSMHRLAAELNVTAMSVYWYVDTKDQLLE

SEQ ID NO: 5470 - protein, 28 aa, artificial
  peptide fold or domain or sub-domain
FSMISGLNRSVKINASQLFSYGGFSKVN

SEQ ID NO: 5471 - protein, 26 aa, artificial
  peptide fold or domain or sub-domain
FSMMIEALGDAREKDFEKAEEKKQEA

SEQ ID NO: 5472 - protein, 29 aa, artificial
  peptide fold or domain or sub-domain
FSMRALGARLDVDPTAVYRHFRTKNELLD

SEQ ID NO: 5473 - protein, 29 aa, artificial
  peptide fold or domain or sub-domain
FSMRKLAAALGCEAMSIYHHFPSVAHLHE

SEQ ID NO: 5474 - protein, 21 aa, artificial
  peptide fold or domain or sub-domain
FSNFKIIGDKIYDPNGQEFIA

SEQ ID NO: 5475 - protein, 20 aa, artificial
  peptide fold or domain or sub-domain
FSNSQVADMLGIEVGALKAR

SEQ ID NO: 5476 - protein, 24 aa, artificial
  peptide fold or domain or sub-domain
FSPAEQQALGTLPPSEYLEAFYRC

SEQ ID NO: 5477 - protein, 24 aa, artificial
  peptide fold or domain or sub-domain
FSPDTSISGKHTRFIMSFTHFALE

SEQ ID NO: 5478 - protein, 28 aa, artificial
  peptide fold or domain or sub-domain
FSPSDVPGLYDAFFADQEEFERLYTKYE

SEQ ID NO: 5479 - protein, 24 aa, artificial
  peptide fold or domain or sub-domain
FSPTEAEWVRAATGPALAERFFAV

SEQ ID NO: 5480 - protein, 22 aa, artificial
  peptide fold or domain or sub-domain
FSPYEDEVNSSFTSGRNNTMIR

SEQ ID NO: 5481 - protein, 24 aa, artificial
  peptide fold or domain or sub-domain
FSQGEGQALKLMAELKGARYPLSP

SEQ ID NO: 5482 - protein, 23 aa, artificial
  peptide fold or domain or sub-domain
FSQIIPLFRERSLEDTERHWLVK

SEQ ID NO: 5483 - protein, 24 aa, artificial
  peptide fold or domain or sub-domain
FSQKEFEQISKLPSAEQDREFFQL

SEQ ID NO: 5484 - protein, 28 aa, artificial
  peptide fold or domain or sub-domain
FSQYKPNTIYRRIERRMAVHQIDGIGGY

SEQ ID NO: 5485 - protein, 21 aa, artificial
  peptide fold or domain or sub-domain
FSRDGDLYRNQLGAGDALTLK

SEQ ID NO: 5486 - protein, 26 aa, artificial
  peptide fold or domain or sub-domain
FSRFVSGFWPTARAAGISSQTYNAVF

SEQ ID NO: 5487 - protein, 21 aa, artificial
  peptide fold or domain or sub-domain
FSRNRDRYEHKLVDGSVRTLK

SEQ ID NO: 5488 - protein, 30 aa, artificial
  peptide fold or domain or sub-domain
FSSDEEVVRRAGMPISEIVAKLGWTGFRDM

SEQ ID NO: 5489 - protein, 22 aa, artificial
  peptide fold or domain or sub-domain
FSSEFADRCTLAENGIEKVLEY

SEQ ID NO: 5490 - protein, 24 aa, artificial
  peptide fold or domain or sub-domain
FSSEGYIDGKNERRLDDCLKYCIV

SEQ ID NO: 5491 - protein, 29 aa, artificial
  peptide fold or domain or sub-domain
FSSLKHIQHTLVDSQSQEDISLLLQLVQN

SEQ ID NO: 5492 - protein, 20 aa, artificial
  peptide fold or domain or sub-domain
FSSPDANTNQQCASVFGRSC

SEQ ID NO: 5493 - protein, 23 aa, artificial
  peptide fold or domain or sub-domain
FSSQVVERHNKPEVEVRSSKELL

SEQ ID NO: 5494 - protein, 24 aa, artificial
  peptide fold or domain or sub-domain
FSTAAMGDAWGMINSPDKEGFVHK

SEQ ID NO: 5495 - protein, 20 aa, artificial
  peptide fold or domain or sub-domain
FSTAECAQIIGVSEGALKVR

SEQ ID NO: 5496 - protein, 27 aa, artificial
  peptide fold or domain or sub-domain
FSTGDLGVQRGMAAYMGRDTSKLKAKG

SEQ ID NO: 5497 - protein, 25 aa, artificial
  peptide fold or domain or sub-domain
FSTRNTFQTLKGHFPTIEHEVEDLI

SEQ ID NO: 5498 - protein, 28 aa, artificial
  peptide fold or domain or sub-domain
FSVCLDMIFTDRPFEQRLEHIADLGFRA

SEQ ID NO: 5499 - protein, 30 aa, artificial
  peptide fold or domain or sub-domain
FSVENQQFEDIIETSDHWISTRTGIKKRHL

SEQ ID NO: 5500 - protein, 24 aa, artificial
  peptide fold or domain or sub-domain
FSVQEYEAFRKIGNSKKREYFYLL

SEQ ID NO: 5501 - protein, 29 aa, artificial
  peptide fold or domain or sub-domain
FSVRKLGDRVGCDPMAILYHFKNKDGMYR

SEQ ID NO: 5502 - protein, 24 aa, artificial
  peptide fold or domain or sub-domain
FSVSEKAAFWSLADEQRVPGFHRW

SEQ ID NO: 5503 - protein, 23 aa, artificial
  peptide fold or domain or sub-domain
FSVSERTAAKILKENKVDWIKHN

SEQ ID NO: 5504 - protein, 21 aa, artificial
  peptide fold or domain or sub-domain
FSVSEWSIATNHDSSKGCASE

SEQ ID NO: 5505 - protein, 29 aa, artificial
  peptide fold or domain or sub-domain
FSVWKRRSGIGLLGNSIDVLSGRWIYPVS

SEQ ID NO: 5506 - protein, 27 aa, artificial
  peptide fold or domain or sub-domain
FSYADLADDIGIKKASIHHHFPTKEGM

SEQ ID NO: 5507 - protein, 27 aa, artificial
  peptide fold or domain or sub-domain
FSYAFSGSQVYTISGTKVTKVQSIHDL

SEQ ID NO: 5508 - protein, 27 aa, artificial
  peptide fold or domain or sub-domain
FSYDRLLEEGFGGIVSVGMGSEEKPRL

SEQ ID NO: 5509 - protein, 22 aa, artificial
  peptide fold or domain or sub-domain
FSYDVSFVKEVSGFNEDDEMIN

SEQ ID NO: 5510 - protein, 20 aa, artificial
  peptide fold or domain or sub-domain
FSYEEISQVLNEPMSIIKNR

SEQ ID NO: 5511 - protein, 28 aa, artificial
  peptide fold or domain or sub-domain
FTADQVYRKLSREPEPCSLASVYRALAQ

SEQ ID NO: 5512 - protein, 28 aa, artificial
  peptide fold or domain or sub-domain
FTAEGLLEEFKDQRDQISKATIYRILSI

SEQ ID NO: 5513 - protein, 25 aa, artificial
  peptide fold or domain or sub-domain
FTANAYGAVRCVMYLTGQHVVVPSE

SEQ ID NO: 5514 - protein, 26 aa, artificial
  peptide fold or domain or sub-domain
FTASESSAGASLADVVPGPLDAPLIA

SEQ ID NO: 5515 - protein, 29 aa, artificial
  peptide fold or domain or sub-domain
FTAVQDLSNGILSPGTATTDANGRAQVQF

SEQ ID NO: 5516 - protein, 23 aa, artificial
  peptide fold or domain or sub-domain
FTCASGGNCNMDLYTRRHCPACR

SEQ ID NO: 5517 - protein, 23 aa, artificial
  peptide fold or domain or sub-domain
FTCRFNKRCVIDKNFRCACRYCR

SEQ ID NO: 5518 - protein, 30 aa, artificial
  peptide fold or domain or sub-domain
FTCYRAPDSNRVPMSTLIETIYLDDKLDQE

SEQ ID NO: 5519 - protein, 27 aa, artificial
  peptide fold or domain or sub-domain
FTEIVQNGNDFKITTTTGPKVTVNQFT

SEQ ID NO: 5520 - protein, 25 aa, artificial
  peptide fold or domain or sub-domain
FTEQSLVLAKMDKRKKLQYKDFSNA

SEQ ID NO: 5521 - protein, 26 aa, artificial
  peptide fold or domain or sub-domain
FTFFLTMDPKNTGHICLSLEQWLQMT

SEQ ID NO: 5522 - protein, 24 aa, artificial
  peptide fold or domain or sub-domain
FTGECQQCRHCKSEESNMCDLLRI

SEQ ID NO: 5523 - protein, 26 aa, artificial
  peptide fold or domain or sub-domain
FTGFSTEFVGRAWDLDENNVKTLVGK

SEQ ID NO: 5524 - protein, 24 aa, artificial
  peptide fold or domain or sub-domain
FTGMALLSYEITKDTYFLQKLFSI

SEQ ID NO: 5525 - protein, 26 aa, artificial
  peptide fold or domain or sub-domain
FTGVGGSLAATLATAFPPRRVRAACA

SEQ ID NO: 5526 - protein, 21 aa, artificial
  peptide fold or domain or sub-domain
FTHEGTLRQAAHQYGEYFDLE

SEQ ID NO: 5527 - protein, 30 aa, artificial
  peptide fold or domain or sub-domain
FTHGCGECAACLAGFDGTCDRHPGHTNWSN

SEQ ID NO: 5528 - protein, 23 aa, artificial
  peptide fold or domain or sub-domain
FTHKINKAISSNEVSRNTLNNIV

SEQ ID NO: 5529 - protein, 25 aa, artificial
  peptide fold or domain or sub-domain
FTIRHEVYCEDLGFEPLRENRHETD

SEQ ID NO: 5530 - protein, 30 aa, artificial
  peptide fold or domain or sub-domain
FTIVKKNGSGGMWAWGYNGYGQLGDGTTSN

SEQ ID NO: 5531 - protein, 21 aa, artificial
  peptide fold or domain or sub-domain
FTKEGVIRHAEIVGDSHHDHV

SEQ ID NO: 5532 - protein, 24 aa, artificial
  peptide fold or domain or sub-domain
FTKGVHINQEHKTVLIPGEKGPIE

SEQ ID NO: 5533 - protein, 21 aa, artificial
  peptide fold or domain or sub-domain
FTKLLDDVGGAEDLATLVPLL

SEQ ID NO: 5534 - protein, 27 aa, artificial
  peptide fold or domain or sub-domain
FTKLLDDVGGAEDLATLVPLLLSAEEL

SEQ ID NO: 5535 - protein, 21 aa, artificial
  peptide fold or domain or sub-domain
FTLEARIRDRKDAQGNCCDDL

SEQ ID NO: 5536 - protein, 28 aa, artificial
  peptide fold or domain or sub-domain
FTLHFHDEQGQMIRSNYVNTKEHTDIHN

SEQ ID NO: 5537 - protein, 29 aa, artificial
  peptide fold or domain or sub-domain
FTLLEPDDGSGWVRVKIDGTDGLIPASYV

SEQ ID NO: 5538 - protein, 24 aa, artificial
  peptide fold or domain or sub-domain
FTLVGAGDEDYDSGKILVTSPFGQ

SEQ ID NO: 5539 - protein, 29 aa, artificial
  peptide fold or domain or sub-domain
FTMRKLGQEMSVSPMAVYRYFPNQEALFD

SEQ ID NO: 5540 - protein, 30 aa, artificial
  peptide fold or domain or sub-domain
FTNGLTLRRQIIATGAICQSTSDTEVVLHL

SEQ ID NO: 5541 - protein, 28 aa, artificial
  peptide fold or domain or sub-domain
FTNKIAEGSDPSLLLDQRHLALRGDALS

SEQ ID NO: 5542 - protein, 20 aa, artificial
  peptide fold or domain or sub-domain
FTNQEIAEILAVSIDTVKIR

SEQ ID NO: 5543 - protein, 27 aa, artificial
  peptide fold or domain or sub-domain
FTNQLKEHPTDFSVEFLEQNSNEVQEV

SEQ ID NO: 5544 - protein, 21 aa, artificial
  peptide fold or domain or sub-domain
FTNYEVVKEQIGDDFSALYER

SEQ ID NO: 5545 - protein, 29 aa, artificial
  peptide fold or domain or sub-domain
FTPAVSTGISESTWQMIERRPGATLREIL

SEQ ID NO: 5546 - protein, 27 aa, artificial
  peptide fold or domain or sub-domain
FTPDDLVLKRALGVRTGRQAAELAEPW

SEQ ID NO: 5547 - protein, 29 aa, artificial
  peptide fold or domain or sub-domain
FTPNETELATLTGLPTNNLDEIKVAACDL

SEQ ID NO: 5548 - protein, 21 aa, artificial
  peptide fold or domain or sub-domain
FTQDGVLREAILLYGRYHDMV

SEQ ID NO: 5549 - protein, 24 aa, artificial
  peptide fold or domain or sub-domain
FTQEEIDYFQYIPHDRQLSFFFDI

SEQ ID NO: 5550 - protein, 21 aa, artificial
  peptide fold or domain or sub-domain
FTQEGILRSNERLQGEFSDSY

SEQ ID NO: 5551 - protein, 28 aa, artificial
  peptide fold or domain or sub-domain
FTQYKPATVERRIERRIGINGLSSLQEY

SEQ ID NO: 5552 - protein, 29 aa, artificial
  peptide fold or domain or sub-domain
FTRDPGYLLFGRGEGRLGLRGAIPHAGTW

SEQ ID NO: 5553 - protein, 30 aa, artificial
  peptide fold or domain or sub-domain
FTRDSWDDAAKALNLTDFSPRSQDIAALFL

SEQ ID NO: 5554 - protein, 21 aa, artificial
  peptide fold or domain or sub-domain
FTREGITREGEWVNDRWIDLI

SEQ ID NO: 5555 - protein, 28 aa, artificial
  peptide fold or domain or sub-domain
FTRFQQNELIAAEGKEVHILDPIQLCAL

SEQ ID NO: 5556 - protein, 29 aa, artificial
  peptide fold or domain or sub-domain
FTRVEVDFNDKNGIYAYTTSGQRLPVNLL

SEQ ID NO: 5557 - protein, 25 aa, artificial
  peptide fold or domain or sub-domain
FTSEIKPAALEVLKQNYPDEVPYGD

SEQ ID NO: 5558 - protein, 26 aa, artificial
  peptide fold or domain or sub-domain
FTSEVAQLQGRGESREFSFLLSHQLA

SEQ ID NO: 5559 - protein, 29 aa, artificial
  peptide fold or domain or sub-domain
FTSKTRFEQDVAASKFVEYGDYEGNLYGT

SEQ ID NO: 5560 - protein, 29 aa, artificial
  peptide fold or domain or sub-domain
FTSREEMEQAISDGRFIESASFCGNMYGT

SEQ ID NO: 5561 - protein, 23 aa, artificial
  peptide fold or domain or sub-domain
FTSYLNKYVDEKQPWALNKERKK

SEQ ID NO: 5562 - protein, 29 aa, artificial
  peptide fold or domain or sub-domain
FTTETEFQHLYAQGAFVECTVYNGYHYGT

SEQ ID NO: 5563 - protein, 25 aa, artificial
  peptide fold or domain or sub-domain
FTTHRRTTLQDPYAVAKDKRDFSHG

SEQ ID NO: 5564 - protein, 22 aa, artificial
  peptide fold or domain or sub-domain
FTTIFQRLQSKVKSFFLIPRYL

SEQ ID NO: 5565 - protein, 28 aa, artificial
  peptide fold or domain or sub-domain
FTTIFQRLQSKVKSFFLIPRYLLGTGFS

SEQ ID NO: 5566 - protein, 22 aa, artificial
  peptide fold or domain or sub-domain
FTTVAANAKIRQGKTTRKKTKQ

SEQ ID NO: 5567 - protein, 20 aa, artificial
  peptide fold or domain or sub-domain
FTVPSTTAGEVCSTYLGRDC

SEQ ID NO: 5568 - protein, 22 aa, artificial
  peptide fold or domain or sub-domain
FTYPGALKNELKAAIGNYIVDM

SEQ ID NO: 5569 - protein, 24 aa, artificial
  peptide fold or domain or sub-domain
FTYQELQLFNKYDEIYKNQAAYKM

SEQ ID NO: 5570 - protein, 28 aa, artificial
  peptide fold or domain or sub-domain
FTYYKQTTLKRRIQRRMMLYKLEKLEDY

SEQ ID NO: 5571 - protein, 29 aa, artificial
  peptide fold or domain or sub-domain
FVADTASREQVTAAHILVATEDEAKKIIA

SEQ ID NO: 5572 - protein, 27 aa, artificial
  peptide fold or domain or sub-domain
FVARLLDTIGKIMSDEKAGMVLAKQLA

SEQ ID NO: 5573 - protein, 27 aa, artificial
  peptide fold or domain or sub-domain
FVARLQDVAQKSIADEKARKVIVELMA

SEQ ID NO: 5574 - protein, 25 aa, artificial
  peptide fold or domain or sub-domain
FVATDDQRIIDALRDESIQVVLTSS

SEQ ID NO: 5575 - protein, 29 aa, artificial
  peptide fold or domain or sub-domain
FVDKATMERDIASGKFLEHANVHQNIYGT

SEQ ID NO: 5576 - protein, 21 aa, artificial
  peptide fold or domain or sub-domain
FVDLLKNAYQNDLHLPLLNLM

SEQ ID NO: 5577 - protein, 27 aa, artificial
  peptide fold or domain or sub-domain
FVDLLKNAYQNDLHLPLLNLMLTPDER

SEQ ID NO: 5578 - protein, 27 aa, artificial
  peptide fold or domain or sub-domain
FVDRLLISASRILGSPDTGSPFVMQLA

SEQ ID NO: 5579 - protein, 27 aa, artificial
  peptide fold or domain or sub-domain
FVDRLLSQIKSEGHPQEISKFLTDTLT

SEQ ID NO: 5580 - protein, 30 aa, artificial
  peptide fold or domain or sub-domain
  misc_feature (8)..(8): Xaa can be any naturally occurring amino acid
FVDSCREXSWCRKGEEQYCDRGMNSTYNGR

SEQ ID NO: 5581 - protein, 29 aa, artificial
  peptide fold or domain or sub-domain
FVDTDTFKKMAADGAFLEWAHVFGHRYGT

SEQ ID NO: 5582 - protein, 25 aa, artificial
  peptide fold or domain or sub-domain
FVEASRDRDTVYYRGYGRDMCAYVA

SEQ ID NO: 5583 - protein, 21 aa, artificial
  peptide fold or domain or sub-domain
FVEEGTIRDYEYLQGVYHDRI

SEQ ID NO: 5584 - protein, 29 aa, artificial
  peptide fold or domain or sub-domain
FVEKEHFIELIGKGEFLEYAEVFGNYYGT

SEQ ID NO: 5585 - protein, 30 aa, artificial
  peptide fold or domain or sub-domain
FVEKLKTSPLRRSFKNYEGDNSEESAREFI

SEQ ID NO: 5586 - protein, 24 aa, artificial
  peptide fold or domain or sub-domain
FVEMIEQLQEEGIVQKQLHPKVMA

SEQ ID NO: 5587 - protein, 21 aa, artificial
  peptide fold or domain or sub-domain
FVEMLRTAFAQGKEQEILTLL

SEQ ID NO: 5588 - protein, 27 aa, artificial
  peptide fold or domain or sub-domain
FVEMLRTAFAQGKEQEILTLLLTPDER

SEQ ID NO: 5589 - protein, 27 aa, artificial
  peptide fold or domain or sub-domain
FVERLNIALDNGLPEGTPKDPILRSLA

SEQ ID NO: 5590 - protein, 27 aa, artificial
  peptide fold or domain or sub-domain
FVFPEGESFKHFDLKWSDYEDMNCIPV

SEQ ID NO: 5591 - protein, 25 aa, artificial
  peptide fold or domain or sub-domain
FVGKNLTEVGEMTGKEPIDAMMDLL

SEQ ID NO: 5592 - protein, 25 aa, artificial
  peptide fold or domain or sub-domain
FVGKSLKEISDLLHRDPFDVLFDIL

SEQ ID NO: 5593 - protein, 26 aa, artificial
  peptide fold or domain or sub-domain
FVGLPRPVVEEAFGLEEEEARALDRN

SEQ ID NO: 5594 - protein, 21 aa, artificial
  peptide fold or domain or sub-domain
FVGNPLEEKHSAENNWIEEAT

SEQ ID NO: 5595 - protein, 23 aa, artificial
  peptide fold or domain or sub-domain
FVGSANKCIEEKKPWVLAKTSAY

SEQ ID NO: 5596 - protein, 24 aa, artificial
  peptide fold or domain or sub-domain
FVHAPEVITMEDVPATAVKAKQES

SEQ ID NO: 5597 - protein, 25 aa, artificial
  peptide fold or domain or sub-domain
FVHDNSFNGTFINGRRVGRGRCSAL

SEQ ID NO: 5598 - protein, 27 aa, artificial
  peptide fold or domain or sub-domain
FVHGDDLSGFYQEIDENILPSDFGGTL

SEQ ID NO: 5599 - protein, 27 aa, artificial
  peptide fold or domain or sub-domain
FVHGNKMGLLTEQIPLKYLPEEYGGEN

SEQ ID NO: 5600 - protein, 24 aa, artificial
  peptide fold or domain or sub-domain
FVHTSRIVDPHVPVRQALRQSKGS

SEQ ID NO: 5601 - protein, 21 aa, artificial
  peptide fold or domain or sub-domain
FVKEAHLREAEFWEGKFLDKV

SEQ ID NO: 5602 - protein, 21 aa, artificial
  peptide fold or domain or sub-domain
FVKEGVLRKRLFRDGRYYDEY

SEQ ID NO: 5603 - protein, 27 aa, artificial
  peptide fold or domain or sub-domain
FVKKICRAEGATEEDDNKLVREFERLT

SEQ ID NO: 5604 - protein, 26 aa, artificial
  peptide fold or domain or sub-domain
FVLALNVNGINIYDPATSKMLESVKY

SEQ ID NO: 5605 - protein, 28 aa, artificial
  peptide fold or domain or sub-domain
FVLARTIDHDNRSKLRNAGADKVIAPSE

SEQ ID NO: 5606 - protein, 27 aa, artificial
  peptide fold or domain or sub-domain
FVLASENGAGSKVSFAGKSLTVGKADD

SEQ ID NO: 5607 - protein, 25 aa, artificial
  peptide fold or domain or sub-domain
FVLQGLYQWRVGGADEASIEAYAPE

SEQ ID NO: 5608 - protein, 22 aa, artificial
  peptide fold or domain or sub-domain
FVLRSSSIKELASFGGNLSGMV

SEQ ID NO: 5609 - protein, 20 aa, artificial
  peptide fold or domain or sub-domain
FVLVNGEVAVDETRLTGMRG

SEQ ID NO: 5610 - protein, 29 aa, artificial
  peptide fold or domain or sub-domain
FVMANAPKDLQERIGNVTQDNDNDGIYYA

SEQ ID NO: 5611 - protein, 30 aa, artificial
  peptide fold or domain or sub-domain
FVMTLNGDEKKKGRISVTLNTKEGYSYLYI

SEQ ID NO: 5612 - protein, 22 aa, artificial
  peptide fold or domain or sub-domain
FVNDVNLENSSLEEAVQALKGA

SEQ ID NO: 5613 - protein, 24 aa, artificial
  peptide fold or domain or sub-domain
FVNRHIVPSFYRVLQEQDQQKQIE

SEQ ID NO: 5614 - protein, 27 aa, artificial
  peptide fold or domain or sub-domain
FVNRLMEAAGNIFETVEEAMPLVRRLA

SEQ ID NO: 5615 - protein, 25 aa, artificial
  peptide fold or domain or sub-domain
FVPCTQCHKSDDPTDESGFYRAWHS

SEQ ID NO: 5616 - protein, 28 aa, artificial
  peptide fold or domain or sub-domain
FVPHFKEEEELMTRHAYPGIDEHRRRHR

SEQ ID NO: 5617 - protein, 29 aa, artificial
  peptide fold or domain or sub-domain
FVPNETELAIVSGMPVDSRDSAARAAEAL

SEQ ID NO: 5618 - protein, 29 aa, artificial
  peptide fold or domain or sub-domain
FVPPRSVGEARGAWRAYYEKWPMMTQQAL

SEQ ID NO: 5619 - protein, 23 aa, artificial
  peptide fold or domain or sub-domain
FVPSSPTLMNAGTELGQLAACFV

SEQ ID NO: 5620 - protein, 21 aa, artificial
  peptide fold or domain or sub-domain
FVQPLGERKDLISPNDHRTLF

SEQ ID NO: 5621 - protein, 20 aa, artificial
  peptide fold or domain or sub-domain
FVRALNRLYTGQPALYEEDC

SEQ ID NO: 5622 - protein, 21 aa, artificial
  peptide fold or domain or sub-domain
FVRHPAGRAPDGRMVDSDYFH

SEQ ID NO: 5623 - protein, 30 aa, artificial
  peptide fold or domain or sub-domain
FVRLGAVRGGRMVALAPASEKLRRRAVRNV

SEQ ID NO: 5624 - protein, 30 aa, artificial
  peptide fold or domain or sub-domain
FVRLSEAAGSSIIEIKPGEKYYPHTDDRFN

SEQ ID NO: 5625 - protein, 29 aa, artificial
  peptide fold or domain or sub-domain
FVRRIRRNADLSRGLKARAADSAAFNRYL

SEQ ID NO: 5626 - protein, 28 aa, artificial
  peptide fold or domain or sub-domain
FVSASEELKEAALSSLSARSRRMVEAEF

SEQ ID NO: 5627 - protein, 29 aa, artificial
  peptide fold or domain or sub-domain
FVSEDDFKQSLDREDFLEWVFLFGTYYGT

SEQ ID NO: 5628 - protein, 29 aa, artificial
  peptide fold or domain or sub-domain
FVSKQKFHEDAKSGKFVEFGEYQKFWYGT

SEQ ID NO: 5629 - protein, 29 aa, artificial
  peptide fold or domain or sub-domain
FVSRDQFLSMVENEELLEYALVYGEYKGI

SEQ ID NO: 5630 - protein, 29 aa, artificial
  peptide fold or domain or sub-domain
FVSREVMDKAVESNRLIEYGEYKDHMYGT

SEQ ID NO: 5631 - protein, 27 aa, artificial
  peptide fold or domain or sub-domain
FVSRLLEAAEQTLGHEDVENKLIKQLA

SEQ ID NO: 5632 - protein, 27 aa, artificial
  peptide fold or domain or sub-domain
FVSRLQETADRLFGSGESESSFVKHLA

SEQ ID NO: 5633 - protein, 25 aa, artificial
  peptide fold or domain or sub-domain
FVSSAGCGSASDKLACLRSASSDTL

SEQ ID NO: 5634 - protein, 26 aa, artificial
  peptide fold or domain or sub-domain
FVSSFSHEGKEYKDVHSKTNSKLVLQ

SEQ ID NO: 5635 - protein, 26 aa, artificial
  peptide fold or domain or sub-domain
FVSSREYHGQPVAAHNPTYRGDLRFE

SEQ ID NO: 5636 - protein, 25 aa, artificial
  peptide fold or domain or sub-domain
FVSTDSELYREICLERGISVVMRKP

SEQ ID NO: 5637 - protein, 29 aa, artificial
  peptide fold or domain or sub-domain
FVSVDEFKSMIKNNEFIEWAQFSGNYYGS

SEQ ID NO: 5638 - protein, 29 aa, artificial
  peptide fold or domain or sub-domain
FVSWALREVEICRKLGIGYHIPFAFAFAI

SEQ ID NO: 5639 - protein, 26 aa, artificial
  peptide fold or domain or sub-domain
FVTAGSDEKLAACKELGADVCINYKT

SEQ ID NO: 5640 - protein, 29 aa, artificial
  peptide fold or domain or sub-domain
FVTKDAFRDLIAKDGFVEHAQFGSNLYGT

SEQ ID NO: 5641 - protein, 30 aa, artificial
  peptide fold or domain or sub-domain
FVTLNDFHRGNFKPYLMKSSDLGKTWASIS

SEQ ID NO: 5642 - protein, 29 aa, artificial
  peptide fold or domain or sub-domain
FVTNEQMMADIQNNEYLEYGTHEESMYGT

SEQ ID NO: 5643 - protein, 27 aa, artificial
  peptide fold or domain or sub-domain
FVTRVYNNDYDTEEQHIDAVLEFKALS

SEQ ID NO: 5644 - protein, 20 aa, artificial
  peptide fold or domain or sub-domain
FVTSLNLVTNEQRHQAKTIN

SEQ ID NO: 5645 - protein, 25 aa, artificial
  peptide fold or domain or sub-domain
FVTTDDAAIAQVARQFGAEVIDRPE

SEQ ID NO: 5646 - protein, 21 aa, artificial
  peptide fold or domain or sub-domain
FVVEGYARDYLLINGKWQDHI

SEQ ID NO: 5647 - protein, 26 aa, artificial
  peptide fold or domain or sub-domain
FVVGRNANSDGLRLARSCNVETSSDG

SEQ ID NO: 5648 - protein, 30 aa, artificial
  peptide fold or domain or sub-domain
FVVIDNHLQGDVRPYLFYTRDYGATWENLL

SEQ ID NO: 5649 - protein, 24 aa, artificial
  peptide fold or domain or sub-domain
FVYCNMCRTLVSTKTCPHGHHHHI

SEQ ID NO: 5650 - protein, 24 aa, artificial
  peptide fold or domain or sub-domain
FWAAYIDGKLFPAWTGIMKAATEE

SEQ ID NO: 5651 - protein, 29 aa, artificial
  peptide fold or domain or sub-domain
FWKCLYLAGLTQEQMSADEDHKLIKQGIG

SEQ ID NO: 5652 - protein, 29 aa, artificial
  peptide fold or domain or sub-domain
FWKILYEAGITPKKFLPQEDSLLLDLNIG

SEQ ID NO: 5653 - protein, 29 aa, artificial
  peptide fold or domain or sub-domain
FWKVIYQAGFTDRQLKPQEAQHLLDYRCG

SEQ ID NO: 5654 - protein, 29 aa, artificial
  peptide fold or domain or sub-domain
FWPILADYFNQPVDSVEAKKALCLENDIL

SEQ ID NO: 5655 - protein, 29 aa, artificial
  peptide fold or domain or sub-domain
FWPVLHLSGFTPRLLKPSEQDELPSYGLG

SEQ ID NO: 5656 - protein, 29 aa, artificial
  peptide fold or domain or sub-domain
FWRAIHEAGITPRRYQPGEFAALIELGIG

SEQ ID NO: 5657 - protein, 29 aa, artificial
  peptide fold or domain or sub-domain
FWRAIHLSGFTPEQIEPNDDYTLLQYGCG

SEQ ID NO: 5658 - protein, 29 aa, artificial
  peptide fold or domain or sub-domain
FWSVLSETGLTTRKLAPHEFREVTNFGIG

SEQ ID NO: 5659 - protein, 29 aa, artificial
  peptide fold or domain or sub-domain
FYDEETAKRLAREKGWIVKEDSGRGWRRV

SEQ ID NO: 5660 - protein, 21 aa, artificial
  peptide fold or domain or sub-domain
FYDLYNSNNLWKICSLRYFNP

SEQ ID NO: 5661 - protein, 29 aa, artificial
  peptide fold or domain or sub-domain
FYEEHKENFVELETVTAKHILVASEEDAK

SEQ ID NO: 5662 - protein, 30 aa, artificial
  peptide fold or domain or sub-domain
FYENIKQYDLKSCFSEYEGGNDPEKAVSFI

SEQ ID NO: 5663 - protein, 29 aa, artificial
  peptide fold or domain or sub-domain
FYFLSYIPFLRQMVKWYVQRQDVTKALQQ

SEQ ID NO: 5664 - protein, 27 aa, artificial
  peptide fold or domain or sub-domain
FYGTTALGLPTFNNYLRIFLLPLIPAL

SEQ ID NO: 5665 - protein, 22 aa, artificial
  peptide fold or domain or sub-domain
FYIKRDQFDKLYFIEQHYSAHL

SEQ ID NO: 5666 - protein, 29 aa, artificial
  peptide fold or domain or sub-domain
FYKLLHESGLTPRCLIYEEDYKLLQYGIG

SEQ ID NO: 5667 - protein, 21 aa, artificial
  peptide fold or domain or sub-domain
FYLTDLQNCGFLKDIENRLVF

SEQ ID NO: 5668 - protein, 25 aa, artificial
  peptide fold or domain or sub-domain
FYQKNKEFQQNLHRGYIGFESDSQC

SEQ ID NO: 5669 - protein, 23 aa, artificial
  peptide fold or domain or sub-domain
FYRELPELDDSLAGKLLPGCTTM

SEQ ID NO: 5670 - protein, 30 aa, artificial
  peptide fold or domain or sub-domain
FYVDMVELAEARNIDPNKFTIGIGQDKMAF

SEQ ID NO: 5671 - protein, 28 aa, artificial
  peptide fold or domain or sub-domain
FYVGDFRANGADMFKMRVNRAGNIFVPE

SEQ ID NO: 5672 - protein, 29 aa, artificial
  peptide fold or domain or sub-domain
FYWLLWQAGLTERRYAPHEDARLLEIGYG

SEQ ID NO: 5673 - protein, 26 aa, artificial
  peptide fold or domain or sub-domain
FYWLTEYVLRYQVTSEEKTIQFIINF

SEQ ID NO: 5674 - protein, 26 aa, artificial
  peptide fold or domain or sub-domain
FYWMLDKYDELTSNKNFSGISKSMLL

SEQ ID NO: 5675 - protein, 25 aa, artificial
  peptide fold or domain or sub-domain
FYYDVYYTKIQFESGTKKEKYSVYK

SEQ ID NO: 5676 - protein, 23 aa, artificial
  peptide fold or domain or sub-domain
GAAAPLQFGNERLDARYRAVIHP

SEQ ID NO: 5677 - protein, 27 aa, artificial
  peptide fold or domain or sub-domain
GAAELKTVMKSFGVPLTDKEVAKIFKE

SEQ ID NO: 5678 - protein, 30 aa, artificial
  peptide fold or domain or sub-domain
GAAIFTKDIERAHRVASEIEAGMVWINSSN

SEQ ID NO: 5679 - protein, 30 aa, artificial
  peptide fold or domain or sub-domain
GAAIKRAHLIWDEKNLDAYIADPQKALPGT

SEQ ID NO: 5680 - protein, 20 aa, artificial
  peptide fold or domain or sub-domain
GAALKWLRDSLKVMYSAAES

SEQ ID NO: 5681 - protein, 27 aa, artificial
  peptide fold or domain or sub-domain
GAAQARLHKWRGVPLDYELAASRARAL

SEQ ID NO: 5682 - protein, 25 aa, artificial
  peptide fold or domain or sub-domain
GAARVHAILQDLGLSPGASDVELVQ

SEQ ID NO: 5683 - protein, 29 aa, artificial
  peptide fold or domain or sub-domain
GACDNVELGNLTHTLSNIAPAIYATTDIP

SEQ ID NO: 5684 - protein, 22 aa, artificial
  peptide fold or domain or sub-domain
GACHTTRPPYFGEGDRVDYHFI

SEQ ID NO: 5685 - protein, 29 aa, artificial
  peptide fold or domain or sub-domain
GACPQLVNLLMHASANILLPVITVLARIS

SEQ ID NO: 5686 - protein, 27 aa, artificial
  peptide fold or domain or sub-domain
GADFRFDDPGVYREWYGKELSGYENIK

SEQ ID NO: 5687 - protein, 30 aa, artificial
  peptide fold or domain or sub-domain
GADWLAIHGAGLWGVDKCSMNERVEWVMAN

SEQ ID NO: 5688 - protein, 21 aa, artificial
  peptide fold or domain or sub-domain
GAFCHQFYITVSENRKAITKF

SEQ ID NO: 5689 - protein, 22 aa, artificial
  peptide fold or domain or sub-domain
GAFDGKKWHSYKGKKTPKDAEL

SEQ ID NO: 5690 - protein, 21 aa, artificial
  peptide fold or domain or sub-domain
GAGEGEVQSEVTVRLIDKREF

SEQ ID NO: 5691 - protein, 25 aa, artificial
  peptide fold or domain or sub-domain
GAGEVYARGHRMPAELALSQAGIVP

SEQ ID NO: 5692 - protein, 28 aa, artificial
  peptide fold or domain or sub-domain
GAGVFSENASQIQRMVSAIDAGTVWVNN

SEQ ID NO: 5693 - protein, 30 aa, artificial
  peptide fold or domain or sub-domain
GAGVFSENASQIQRMVSAIDAGTVWVNNYV

SEQ ID NO: 5694 - protein, 29 aa, artificial
  peptide fold or domain or sub-domain
GAHFYACGPLAFLDSYEDSCGKLGLAHVH

SEQ ID NO: 5695 - protein, 29 aa, artificial
  peptide fold or domain or sub-domain
GAHLYYCGPAGFMKACAQAATKRSDIHVN

SEQ ID NO: 5696 - protein, 24 aa, artificial
  peptide fold or domain or sub-domain
GAHRIDFLKWDMNRAFSEAGWPGQ

SEQ ID NO: 5697 - protein, 29 aa, artificial
  peptide fold or domain or sub-domain
GAIDANTTFAENDFRNVVPRFSEENRNAN

SEQ ID NO: 5698 - protein, 29 aa, artificial
  peptide fold or domain or sub-domain
GAIGPLVDLLGNGTPRGKKDAATALFNLS

SEQ ID NO: 5699 - protein, 30 aa, artificial
  peptide fold or domain or sub-domain
GAIMVDIDARKREAAEKAGALATVDPKAPD

SEQ ID NO: 5700 - protein, 29 aa, artificial
  peptide fold or domain or sub-domain
GAIPAFISLLASPHAHISEQAVWALGNIA

SEQ ID NO: 5701 - protein, 22 aa, artificial
  peptide fold or domain or sub-domain
GAIQSFSEEAVASDVIAPDRAR

SEQ ID NO: 5702 - protein, 22 aa, artificial
  peptide fold or domain or sub-domain
GAITPEELEREPFKGLPNDSVV

SEQ ID NO: 5703 - protein, 29 aa, artificial
  peptide fold or domain or sub-domain
GAIVLLVELLYSTDSATQENAVTALLNLS

SEQ ID NO: 5704 - protein, 30 aa, artificial
  peptide fold or domain or sub-domain
GAIYATNYIYPSEQTIRYFAEKGMSIIRLP

SEQ ID NO: 5705 - protein, 24 aa, artificial
  peptide fold or domain or sub-domain
GAIYKQRGLLTSAGKDIKNKEEIL

SEQ ID NO: 5706 - protein, 29 aa, artificial
  peptide fold or domain or sub-domain
GAIYVTDTGNRRIQKFDSTGSYVTKWVSP

SEQ ID NO: 5707 - protein, 27 aa, artificial
  peptide fold or domain or sub-domain
GAKALKRNQNNPLWRKLKAVEQNQVYV

SEQ ID NO: 5708 - protein, 27 aa, artificial
  peptide fold or domain or sub-domain
GAKLTEIAAGAGMLAPSIYHHFSSKDD

SEQ ID NO: 5709 - protein, 27 aa, artificial
  peptide fold or domain or sub-domain
GAKRDCRKLVSPAAKLPPHAGALGMRF

SEQ ID NO: 5710 - protein, 20 aa, artificial
  peptide fold or domain or sub-domain
GALEFQENEYEELKELYESL

SEQ ID NO: 5711 - protein, 26 aa, artificial
  peptide fold or domain or sub-domain
GALGLAASEFKGGTDFTHGTALADVR

SEQ ID NO: 5712 - protein, 24 aa, artificial
  peptide fold or domain or sub-domain
GALGTGEGIFGFVGIFLLSAVLEL

SEQ ID NO: 5713 - protein, 27 aa, artificial
  peptide fold or domain or sub-domain
GALISPELKDFKKDIEDSLNVEVEIGT

SEQ ID NO: 5714 - protein, 30 aa, artificial
  peptide fold or domain or sub-domain
GALLNERAALDALGDAVNAPPYGRPPQAPI

SEQ ID NO: 5715 - protein, 29 aa, artificial
  peptide fold or domain or sub-domain
GALRPGQVFPPDDWRAYSPTFQGERFAKL

SEQ ID NO: 5716 - protein, 29 aa, artificial
  peptide fold or domain or sub-domain
GAMEALSNLMRSGSPRLVLSCLWSIRNLS

SEQ ID NO: 5717 - protein, 25 aa, artificial
  peptide fold or domain or sub-domain
GAMSDFSGVILSPGFPGNYPSSLDC

SEQ ID NO: 5718 - protein, 23 aa, artificial
  peptide fold or domain or sub-domain
GAMYDYMYRRLVQANIKNDTGML

SEQ ID NO: 5719 - protein, 30 aa, artificial
  peptide fold or domain or sub-domain
GANLDHLGVARWKLEQMGVQFTQQGAVLRV

SEQ ID NO: 5720 - protein, 30 aa, artificial
  peptide fold or domain or sub-domain
GANLILLDISPEIEKLADELCGRGHRCTAV

SEQ ID NO: 5721 - protein, 30 aa, artificial
  peptide fold or domain or sub-domain
GANLVIADLNEESSKATADEISKQTGVKAI

SEQ ID NO: 5722 - protein, 22 aa, artificial
  peptide fold or domain or sub-domain
GAPAQSVGTVSANGATYDVYKV

SEQ ID NO: 5723 - protein, 24 aa, artificial
  peptide fold or domain or sub-domain
GAPFDAYLLGYTHVLSEQQIRGWK

SEQ ID NO: 5724 - protein, 30 aa, artificial
  peptide fold or domain or sub-domain
GAPRENDEFCKMGRYNLSPSIFFCATPPDD

SEQ ID NO: 5725 - protein, 27 aa, artificial
  peptide fold or domain or sub-domain
GAQIVAGATDVGLWITRQHRQYAQLID

SEQ ID NO: 5726 - protein, 30 aa, artificial
  peptide fold or domain or sub-domain
GAQQRSMMTFLNTFRKVGGAFEIDDEGIRF

SEQ ID NO: 5727 - protein, 24 aa, artificial
  peptide fold or domain or sub-domain
GAQTYPIDNQTLAIIEIAVFAFLE

SEQ ID NO: 5728 - protein, 29 aa, artificial
  peptide fold or domain or sub-domain
GAQVYVCGPGRLIDSVLEVARDWPAGTVH

SEQ ID NO: 5729 - protein, 20 aa, artificial
  peptide fold or domain or sub-domain
GARHFRERVFPIRKSQFEAL

SEQ ID NO: 5730 - protein, 29 aa, artificial
  peptide fold or domain or sub-domain
GARKRAKADLKKATDPFVKAVLDGRQLAL

SEQ ID NO: 5731 - protein, 25 aa, artificial
  peptide fold or domain or sub-domain
GARLGYTIFGINGVTSTLTSSTSRH

SEQ ID NO: 5732 - protein, 30 aa, artificial
  peptide fold or domain or sub-domain
GARVVISSRNAEACAHARKELSVYGDVWAV

SEQ ID NO: 5733 - protein, 21 aa, artificial
  peptide fold or domain or sub-domain
GARWDGTFTPNGGVASCSEKV

SEQ ID NO: 5734 - protein, 21 aa, artificial
  peptide fold or domain or sub-domain
GARYDGSWVNGDQTSSYIGSC

SEQ ID NO: 5735 - protein, 24 aa, artificial
  peptide fold or domain or sub-domain
GASANLLAQKSKQGDLVEATSVLS

SEQ ID NO: 5736 - protein, 23 aa, artificial
  peptide fold or domain or sub-domain
GASCKTAKPEGLSYCGVPASKTI

SEQ ID NO: 5737 - protein, 23 aa, artificial
  peptide fold or domain or sub-domain
GASEDTAIANGLRVRGTEASNIL

SEQ ID NO: 5738 - protein, 23 aa, artificial
  peptide fold or domain or sub-domain
GASGATSQQDNLGYSGVKASHKM

SEQ ID NO: 5739 - protein, 20 aa, artificial
  peptide fold or domain or sub-domain
GASIQWLRDEMKLINDAYDS

SEQ ID NO: 5740 - protein, 26 aa, artificial
  peptide fold or domain or sub-domain
GASNPEKCAAAKDKARALMNDLGESG

SEQ ID NO: 5741 - protein, 30 aa, artificial
  peptide fold or domain or sub-domain
GASQREFASMNLGGHVGDEAGSVETNRRLL

SEQ ID NO: 5742 - protein, 30 aa, artificial
  peptide fold or domain or sub-domain
GASSGLFSGLNCGYGSSDQAEIVSINRTRV

SEQ ID NO: 5743 - protein, 30 aa, artificial
  peptide fold or domain or sub-domain
GASVILNVHHEIEAADWQALTAEYPRLTQL

SEQ ID NO: 5744 - protein, 28 aa, artificial
  peptide fold or domain or sub-domain
GATGLMQVLPETGNRFGVTNSASSVSAN

SEQ ID NO: 5745 - protein, 27 aa, artificial
  peptide fold or domain or sub-domain
GATIITADGKKRNVNKEENSDLFWAIR

SEQ ID NO: 5746 - protein, 29 aa, artificial
  peptide fold or domain or sub-domain
GATILAVSRFGGECELEQIADRGTAAERA

SEQ ID NO: 5747 - protein, 29 aa, artificial
  peptide fold or domain or sub-domain
GATIVATSKWKSEMEFTEMMAEGPGTQRA

SEQ ID NO: 5748 - protein, 30 aa, artificial
  peptide fold or domain or sub-domain
GATLLLKHMATLQSAGYLTVDALPLVQESI

SEQ ID NO: 5749 - protein, 27 aa, artificial
  peptide fold or domain or sub-domain
GATLNDIAERFGTDRASIYYYFASKKE

SEQ ID NO: 5750 - protein, 20 aa, artificial
  peptide fold or domain or sub-domain
GATVEWMRRNMNLFSHITEC

SEQ ID NO: 5751 - protein, 29 aa, artificial
  peptide fold or domain or sub-domain
GAVAASKESEELLRKQGIEVFNANDVSSL

SEQ ID NO: 5752 - protein, 29 aa, artificial
  peptide fold or domain or sub-domain
GAVASSVATENRLKEHRIPVVDLNSVSNV

SEQ ID NO: 5753 - protein, 29 aa, artificial
  peptide fold or domain or sub-domain
GAVEPLTKLLTHEDKIVRRNATMIFGILA

SEQ ID NO: 5754 - protein, 28 aa, artificial
  peptide fold or domain or sub-domain
GAVEWAWANDEYIPHGWAANEGGLSTCF

SEQ ID NO: 5755 - protein, 28 aa, artificial
  peptide fold or domain or sub-domain
GAVGDDQFGSFLLNVLDENHVDITLTQR

SEQ ID NO: 5756 - protein, 28 aa, artificial
  peptide fold or domain or sub-domain
GAVGEDPLGEISLRELRAEGVDVSFVKR

SEQ ID NO: 5757 - protein, 29 aa, artificial
  peptide fold or domain or sub-domain
GAVKPLVKLIKCHNIKVQVKAAAALESLG

SEQ ID NO: 5758 - protein, 30 aa, artificial
  peptide fold or domain or sub-domain
GAVLESREVLLRSSFSDADKRQATIYLMHY

SEQ ID NO: 5759 - protein, 29 aa, artificial
  peptide fold or domain or sub-domain
GAVPVLVSLLSSTDPDVQYYCTTALSNIA

SEQ ID NO: 5760 - protein, 29 aa, artificial
  peptide fold or domain or sub-domain
GAVRRAEEYPESDFRRRDPRFQGANFDAN

SEQ ID NO: 5761 - protein, 20 aa, artificial
  peptide fold or domain or sub-domain
GAVVQWLRDGLNIIRSSTEI

SEQ ID NO: 5762 - protein, 26 aa, artificial
  peptide fold or domain or sub-domain
GAVYNAELAHELQKLGYQLRYGKDGN

SEQ ID NO: 5763 - protein, 24 aa, artificial
  peptide fold or domain or sub-domain
GAWQAYLKNQPSLSPYYSWYVWTG

SEQ ID NO: 5764 - protein, 24 aa, artificial
  peptide fold or domain or sub-domain
GAYQAWKEGNQSLSPYGDWYTINS

SEQ ID NO: 5765 - protein, 20 aa, artificial
  peptide fold or domain or sub-domain
GCAFKAAAQTGAASPERLAF

SEQ ID NO: 5766 - protein, 20 aa, artificial
  peptide fold or domain or sub-domain
GCAIKKALSDGTLSVVRLES

SEQ ID NO: 5767 - protein, 20 aa, artificial
  peptide fold or domain or sub-domain
GCALANAMRESEVSVRRIDL

SEQ ID NO: 5768 - protein, 20 aa, artificial
  peptide fold or domain or sub-domain
GCALKAAVDAGKISEDRFNN

SEQ ID NO: 5769 - protein, 20 aa, artificial
  peptide fold or domain or sub-domain
GCALLQALEDGRIQAQRMAS

SEQ ID NO: 5770 - protein, 20 aa, artificial
  peptide fold or domain or sub-domain
GCALWEAVAEGRVLQRRVES

SEQ ID NO: 5771 - protein, 20 aa, artificial
  peptide fold or domain or sub-domain
GCAMLFALETESMTLERRKS

SEQ ID NO: 5772 - protein, 20 aa, artificial
  peptide fold or domain or sub-domain
GCAVLAAVASDTLDARRVRN

SEQ ID NO: 5773 - protein, 20 aa, artificial
  peptide fold or domain or sub-domain
GCAVLEAIEHEIADAIRLES

SEQ ID NO: 5774 - protein, 20 aa, artificial
  peptide fold or domain or sub-domain
GCAVQTAIDDSSLSMQHYEN

SEQ ID NO: 5775 - protein, 20 aa, artificial
  peptide fold or domain or sub-domain
GCAVRAAVEVGTVTSERLQS

SEQ ID NO: 5776 - protein, 20 aa, artificial
  peptide fold or domain or sub-domain
GCAVREALKTGQISQAHFEN

SEQ ID NO: 5777 - protein, 20 aa, artificial
  peptide fold or domain or sub-domain
GCAVRGALESGVLDPARWAH

SEQ ID NO: 5778 - protein, 20 aa, artificial
  peptide fold or domain or sub-domain
GCEIVKQVSLGNINPVRFKN

SEQ ID NO: 5779 - protein, 20 aa, artificial
  peptide fold or domain or sub-domain
GCGRCENCIDGKYTACLNYG

SEQ ID NO: 5780 - protein, 26 aa, artificial
  peptide fold or domain or sub-domain
GCGRCRSCLSGVIQTCENGQGACYGL

SEQ ID NO: 5781 - protein, 26 aa, artificial
  peptide fold or domain or sub-domain
GCGRCYNCKHMRSEVCENTNTDVDCG

SEQ ID NO: 5782 - protein, 24 aa, artificial
  peptide fold or domain or sub-domain
GCISSVSDWLISIGLPMYAGTLST

SEQ ID NO: 5783 - protein, 26 aa, artificial
  peptide fold or domain or sub-domain
GCKKSRWNPLLVGFIYKIRKNIYILN

SEQ ID NO: 5784 - protein, 25 aa, artificial
  peptide fold or domain or sub-domain
GCKNAAEEAGEKLSSADKDQVTQIC

SEQ ID NO: 5785 - protein, 22 aa, artificial
  peptide fold or domain or sub-domain
GCKPGMYCTHKHQSCSSCTQHR

SEQ ID NO: 5786 - protein, 29 aa, artificial
  peptide fold or domain or sub-domain
GCMRALVAQLKSESEDLQQVIASVLRNLS

SEQ ID NO: 5787 - protein, 30 aa, artificial
  peptide fold or domain or sub-domain
GCNIVLNSRHAIPEEVLKQLPDNNRVFSAI

SEQ ID NO: 5788 - protein, 22 aa, artificial
  peptide fold or domain or sub-domain
GCQKGYYCDSEKGSCVVCQSCD

SEQ ID NO: 5789 - protein, 29 aa, artificial
  peptide fold or domain or sub-domain
GCQNGFDNGGIKDVCEWHTRPEYREHSLS

SEQ ID NO: 5790 - protein, 22 aa, artificial
  peptide fold or domain or sub-domain
GCQSGWCVDCSTVPCGKSSPFS

SEQ ID NO: 5791 - protein, 20 aa, artificial
  peptide fold or domain or sub-domain
GCRADQFKCKNDKCISEKQK

SEQ ID NO: 5792 - protein, 30 aa, artificial
  peptide fold or domain or sub-domain
GCREEHQTVLIEKLRTVGARISIETPAIIM

SEQ ID NO: 5793 - protein, 27 aa, artificial
  peptide fold or domain or sub-domain
GCRIADVARAAEVAYGLVYHYFRNKDE

SEQ ID NO: 5794 - protein, 22 aa, artificial
  peptide fold or domain or sub-domain
GCRKNQYRHYWSENLFQCFNCS

SEQ ID NO: 5795 - protein, 22 aa, artificial
  peptide fold or domain or sub-domain
GCRPNMFCQVGSKDCSSCVRYR

SEQ ID NO: 5796 - protein, 20 aa, artificial
  peptide fold or domain or sub-domain
GCSPGHFCIVQDHCAACRAY

SEQ ID NO: 5797 - protein, 20 aa, artificial
  peptide fold or domain or sub-domain
GCTVVDAVEAGRLEPRRLFN

SEQ ID NO: 5798 - protein, 29 aa, artificial
  peptide fold or domain or sub-domain
GCVVALPEGDLGREHSAVLSDPRVQLCAG

SEQ ID NO: 5799 - protein, 27 aa, artificial
  peptide fold or domain or sub-domain
GDAANCSTTNEPVALLPAHSGVTGIVF

SEQ ID NO: 5800 - protein, 22 aa, artificial
  peptide fold or domain or sub-domain
GDCPWDPKIRKERRCTCLTKKD

SEQ ID NO: 5801 - protein, 29 aa, artificial
  peptide fold or domain or sub-domain
GDDKARRYLKKIDYGNADPSTGDYWIEGS

SEQ ID NO: 5802 - protein, 30 aa, artificial
  peptide fold or domain or sub-domain
GDDLVSLLIDAVDPESGGMFTDEQIRDEVS

SEQ ID NO: 5803 - protein, 26 aa, artificial
  peptide fold or domain or sub-domain
GDELAGVLKALGSNTSKEEIGRIMEE

SEQ ID NO: 5804 - protein, 21 aa, artificial
  peptide fold or domain or sub-domain
GDFATNIASGRYHAPVTKGSP

SEQ ID NO: 5805 - protein, 28 aa, artificial
  peptide fold or domain or sub-domain
GDFDVIESRLKARKGHFFKTQMLVTQFE

SEQ ID NO: 5806 - protein, 28 aa, artificial
  peptide fold or domain or sub-domain
GDFLEVCYLLLYGELPTKAQKADFDYRV

SEQ ID NO: 5807 - protein, 28 aa, artificial
  peptide fold or domain or sub-domain
GDFLSFDKDRMRYIATAPPAQVSVDRLN

SEQ ID NO: 5808 - protein, 30 aa, artificial
  peptide fold or domain or sub-domain
GDFWYREFHKKAPKSGGQYWRITSKEVGLG

SEQ ID NO: 5809 - protein, 27 aa, artificial
  peptide fold or domain or sub-domain
GDGLWRQLGTYGTELAWRNMGKSFDMT

SEQ ID NO: 5810 - protein, 25 aa, artificial
  peptide fold or domain or sub-domain
GDIFLLGSRNMQKMDAKSDALKSIS

SEQ ID NO: 5811 - protein, 22 aa, artificial
  peptide fold or domain or sub-domain
GDIITRVRLPEEYAAVWTGTTA

SEQ ID NO: 5812 - protein, 27 aa, artificial
  peptide fold or domain or sub-domain
GDIKEVIDGKEFKTVTAGSKTYKARAI

SEQ ID NO: 5813 - protein, 29 aa, artificial
  peptide fold or domain or sub-domain
GDISPLLELDSDTLRERLYTAKTDLAVPV

SEQ ID NO: 5814 - protein, 29 aa, artificial
  peptide fold or domain or sub-domain
GDIYVSDLERNCIQKFSNTGTFITVIGGP

SEQ ID NO: 5815 - protein, 22 aa, artificial
  peptide fold or domain or sub-domain
GDKAEIAYQQQHGGIISELFKG

SEQ ID NO: 5816 - protein, 21 aa, artificial
  peptide fold or domain or sub-domain
GDKDARQPMFASRTADYLDDD

SEQ ID NO: 5817 - protein, 29 aa, artificial
  peptide fold or domain or sub-domain
GDKSADVYPLAVKLSLVESEVLVRTPQGD

SEQ ID NO: 5818 - protein, 29 aa, artificial
  peptide fold or domain or sub-domain
GDKVELFGYQGFAGGLDTKNHLMGEYTYV

SEQ ID NO: 5819 - protein, 22 aa, artificial
  peptide fold or domain or sub-domain
GDLLEDLEKLIEKTKNFEIVDH

SEQ ID NO: 5820 - protein, 25 aa, artificial
  peptide fold or domain or sub-domain
GDLTGPSGVILSPNYPEPYPPGKEC

SEQ ID NO: 5821 - protein, 30 aa, artificial
  peptide fold or domain or sub-domain
GDNVAATTRSPERLTTALGGAADTGRLLAL

SEQ ID NO: 5822 - protein, 28 aa, artificial
  peptide fold or domain or sub-domain
GDNYFKRYIPIFQPLTVQMMMAAFTNME

SEQ ID NO: 5823 - protein, 23 aa, artificial
  peptide fold or domain or sub-domain
GDPIRVVLGGMMISSSEINNFLN

SEQ ID NO: 5824 - protein, 27 aa, artificial
  peptide fold or domain or sub-domain
GDPPSDGGTRGALISFPAHSVPTGVTF

SEQ ID NO: 5825 - protein, 28 aa, artificial
  peptide fold or domain or sub-domain
GDPRPETRQFIENFSKKYNTAPTPYAAQ

SEQ ID NO: 5826 - protein, 30 aa, artificial
  peptide fold or domain or sub-domain
GDRLVLAARREEPLLALRDELAPRTEVHAV

SEQ ID NO: 5827 - protein, 30 aa, artificial
  peptide fold or domain or sub-domain
GDRVSACCRQPAQASALIQLAEIHANLNII

SEQ ID NO: 5828 - protein, 28 aa, artificial
  peptide fold or domain or sub-domain
GDSDENVKKFVESYKKEYNKEPDSFAAL

SEQ ID NO: 5829 - protein, 20 aa, artificial
  peptide fold or domain or sub-domain
GDTIVWLKEKLGIISDPSET

SEQ ID NO: 5830 - protein, 20 aa, artificial
  peptide fold or domain or sub-domain
GDTLVFLSEQLELFNDYDTA

SEQ ID NO: 5831 - protein, 27 aa, artificial
  peptide fold or domain or sub-domain
GDTTLNGTHPLKKIKQAPLEIEGIDNV

SEQ ID NO: 5832 - protein, 27 aa, artificial
  peptide fold or domain or sub-domain
GDVIVTPLNLDGGSDPATLAGQAETAP

SEQ ID NO: 5833 - protein, 20 aa, artificial
  peptide fold or domain or sub-domain
GDYIIRLEKRGDSSKVEVIN

SEQ ID NO: 5834 - protein, 28 aa, artificial
  peptide fold or domain or sub-domain
GDYKIIATAGMGYVFQRQYGDETLMVAV

SEQ ID NO: 5835 - protein, 27 aa, artificial
  peptide fold or domain or sub-domain
GEADTLPGIEAPKWVYIPSIAPSSLML

SEQ ID NO: 5836 - protein, 24 aa, artificial
  peptide fold or domain or sub-domain
GEAIDAETRYERLVIPDVQRACDL

SEQ ID NO: 5837 - protein, 26 aa, artificial
  peptide fold or domain or sub-domain
GEAMENGDDTQNSSESQAAVRIAKMM

SEQ ID NO: 5838 - protein, 22 aa, artificial
  peptide fold or domain or sub-domain
GEAPVFMPIGGGLNIRATIIQP

SEQ ID NO: 5839 - protein, 23 aa, artificial
  peptide fold or domain or sub-domain
GEARGKGAEYWGIDYLDNDQYVH

SEQ ID NO: 5840 - protein, 20 aa, artificial
  peptide fold or domain or sub-domain
GEARGKGAEYWGPDYEQTTV

SEQ ID NO: 5841 - protein, 28 aa, artificial
  peptide fold or domain or sub-domain
GEARGKGAEYWGPDYEQTTVWLLTNGVP

SEQ ID NO: 5842 - protein, 24 aa, artificial
  peptide fold or domain or sub-domain
GEAVDIQFPGALVIETASGTEVVS

SEQ ID NO: 5843 - protein, 30 aa, artificial
  peptide fold or domain or sub-domain
GEAVKECLEAVRIDPSYSRAHQRLASLYLR

SEQ ID NO: 5844 - protein, 21 aa, artificial
  peptide fold or domain or sub-domain
GECYFAGCTHIHEPDCAVRAA

SEQ ID NO: 5845 - protein, 20 aa, artificial
  peptide fold or domain or sub-domain
GEDGTWRSGLLSAVNPKGEG

SEQ ID NO: 5846 - protein, 24 aa, artificial
  peptide fold or domain or sub-domain
GEEFWDPGVRFGTVCAKKGDMEVQ

SEQ ID NO: 5847 - protein, 26 aa, artificial
  peptide fold or domain or sub-domain
GEEGEVIGDRWAQLTADHADQLGGYR

SEQ ID NO: 5848 - protein, 26 aa, artificial
  peptide fold or domain or sub-domain
GEEGEVIPPELAHLEGAAGDPLADHR

SEQ ID NO: 5849 - protein, 29 aa, artificial
  peptide fold or domain or sub-domain
GEEINLKGWNKYCGKLDTKFESDGDKALY

SEQ ID NO: 5850 - protein, 27 aa, artificial
  peptide fold or domain or sub-domain
GEEIRQIGNKLFKASDFENAIQKYEKA

SEQ ID NO: 5851 - protein, 30 aa, artificial
  peptide fold or domain or sub-domain
GEEWIHEELLGLKFRISPHSFFQTNTPAAE

SEQ ID NO: 5852 - protein, 30 aa, artificial
  peptide fold or domain or sub-domain
GEFLNNIKINDIPGIGKVLSKNLNEIGIEY

SEQ ID NO: 5853 - protein, 27 aa, artificial
  peptide fold or domain or sub-domain
GEFRNCSEFTAPEVELGPHVAALGMTF

SEQ ID NO: 5854 - protein, 25 aa, artificial
  peptide fold or domain or sub-domain
GEGDVYYQGRKVAAADALKSAGIAT

SEQ ID NO: 5855 - protein, 25 aa, artificial
  peptide fold or domain or sub-domain
GEGEFWQGDKIVPAREALKAHGLEP

SEQ ID NO: 5856 - protein, 25 aa, artificial
  peptide fold or domain or sub-domain
GEGEVFYKGTKTKASFALKEEEIEP

SEQ ID NO: 5857 - protein, 25 aa, artificial
  peptide fold or domain or sub-domain
GEGEVFYRGQRMASAEVLRTAGLGA

SEQ ID NO: 5858 - protein, 25 aa, artificial
  peptide fold or domain or sub-domain
GEGEVLYNNERKMTFEVFEKLQIKP

SEQ ID NO: 5859 - protein, 25 aa, artificial
  peptide fold or domain or sub-domain
GEGKARYKGQWLSATEALAVAGLEP

SEQ ID NO: 5860 - protein, 25 aa, artificial
  peptide fold or domain or sub-domain
GEGLVDYEGNRYEAREVFKRLHLKP

SEQ ID NO: 5861 - protein, 30 aa, artificial
  peptide fold or domain or sub-domain
GEGLYREFHRKDPLSGLHHWRVTHRKADLA

SEQ ID NO: 5862 - protein, 25 aa, artificial
  peptide fold or domain or sub-domain
GEGPVLYKNDVRDSNEVFRIFNIEK

SEQ ID NO: 5863 - protein, 27 aa, artificial
  peptide fold or domain or sub-domain
GEGTAKEGLEQPLFYWDPSIAPGAIAV

SEQ ID NO: 5864 - protein, 22 aa, artificial
  peptide fold or domain or sub-domain
GEGTWEVRGPGDPDLVWDDVVA

SEQ ID NO: 5865 - protein, 22 aa, artificial
  peptide fold or domain or sub-domain
GEGWQDTGLTVCFKAEPWTKFC

SEQ ID NO: 5866 - protein, 26 aa, artificial
  peptide fold or domain or sub-domain
GEIEAEHYQQMGLNKVEAARLKGRLR

SEQ ID NO: 5867 - protein, 28 aa, artificial
  peptide fold or domain or sub-domain
GEIELYKRAGKPLPEGVAIDERGQPTCD

SEQ ID NO: 5868 - protein, 22 aa, artificial
  peptide fold or domain or sub-domain
GEIGPKALEKQSDGYYKQGDYI

SEQ ID NO: 5869 - protein, 30 aa, artificial
  peptide fold or domain or sub-domain
GEIKATKGDIVSVGLQGGEVRDIKSEKVEK

SEQ ID NO: 5870 - protein, 27 aa, artificial
  peptide fold or domain or sub-domain
GEILCINEQCILYIPRIVDNSKLIHYY

SEQ ID NO: 5871 - protein, 29 aa, artificial
  peptide fold or domain or sub-domain
GEILVTDSRNHRIQLFSPDGLFISRYSFD

SEQ ID NO: 5872 - protein, 22 aa, artificial
  peptide fold or domain or sub-domain
GEISDEELKNPAFVGYNSGDYL

SEQ ID NO: 5873 - protein, 22 aa, artificial
  peptide fold or domain or sub-domain
GEISEQELDLPEYGKYNAGEMV

SEQ ID NO: 5874 - protein, 22 aa, artificial
  peptide fold or domain or sub-domain
GEISEQQLAERKEQGYRLGDII

SEQ ID NO: 5875 - protein, 22 aa, artificial
  peptide fold or domain or sub-domain
GEITKEELKRFYSKGYRPNSLI

SEQ ID NO: 5876 - protein, 30 aa, artificial
  peptide fold or domain or sub-domain
GEIVSETSDSFTFKTVDGQDRQVKKDDANQ

SEQ ID NO: 5877 - protein, 27 aa, artificial
  peptide fold or domain or sub-domain
GEIWISPQGNDLNDGTRPSPKATLTSA

SEQ ID NO: 5878 - protein, 29 aa, artificial
  peptide fold or domain or sub-domain
GEKIRLKDWERYRGGLDVKGDMTGKYSIY

SEQ ID NO: 5879 - protein, 24 aa, artificial
  peptide fold or domain or sub-domain
GEKPEVLEVLPSANRARLLSLDLL

SEQ ID NO: 5880 - protein, 24 aa, artificial
  peptide fold or domain or sub-domain
GEKYSKPLNATFLNNHGKPDVLQM

SEQ ID NO: 5881 - protein, 30 aa, artificial
  peptide fold or domain or sub-domain
GELGGAGIDVFDMEPPVPEEYELLKTNNSV

SEQ ID NO: 5882 - protein, 27 aa, artificial
  peptide fold or domain or sub-domain
GELLWKGEGAVLLKVGTDIKVVPRRKA

SEQ ID NO: 5883 - protein, 20 aa, artificial
  peptide fold or domain or sub-domain
GEMSMDAFNYVNHRTRNNLD

SEQ ID NO: 5884 - protein, 26 aa, artificial
  peptide fold or domain or sub-domain
GENCLYILQKKLNLPFEKVYSELIAE

SEQ ID NO: 5885 - protein, 24 aa, artificial
  peptide fold or domain or sub-domain
GENFARAFDIKFQDRDLQVKYVHT

SEQ ID NO: 5886 - protein, 22 aa, artificial
  peptide fold or domain or sub-domain
GENFWQRTPTSAELDAMWPGAR

SEQ ID NO: 5887 - protein, 23 aa, artificial
  peptide fold or domain or sub-domain
GENIHEQTNAVVREIYPDGMHNT

SEQ ID NO: 5888 - protein, 22 aa, artificial
  peptide fold or domain or sub-domain
GENINFHLGGGFVELGDTDTNK

SEQ ID NO: 5889 - protein, 27 aa, artificial
  peptide fold or domain or sub-domain
GEPGAREYLVLGGGLNRAAASAIDPPS

SEQ ID NO: 5890 - protein, 20 aa, artificial
  peptide fold or domain or sub-domain
GEPLREPVIQHGPFVMNTNE

SEQ ID NO: 5891 - protein, 22 aa, artificial
  peptide fold or domain or sub-domain
GEPYWRHEPEGEYLQAIGVTRS

SEQ ID NO: 5892 - protein, 22 aa, artificial
  peptide fold or domain or sub-domain
GEPYWRQLPATEEIAQACGVSS

SEQ ID NO: 5893 - protein, 24 aa, artificial
  peptide fold or domain or sub-domain
GEQEYFTDTTTLFIVELVLIGWAE

SEQ ID NO: 5894 - protein, 27 aa, artificial
  peptide fold or domain or sub-domain
GEQRLHFLDSLPYSEFIAPIGAVVAGA

SEQ ID NO: 5895 - protein, 25 aa, artificial
  peptide fold or domain or sub-domain
GEREVYYQGKIIPVQQVYQQKAIQP

SEQ ID NO: 5896 - protein, 30 aa, artificial
  peptide fold or domain or sub-domain
GERGIVACASYAAKKQGVMRGVPLHQARKM

SEQ ID NO: 5897 - protein, 30 aa, artificial
  peptide fold or domain or sub-domain
GERLGNLDADAVEALVTELEAVGESMRQAE

SEQ ID NO: 5898 - protein, 20 aa, artificial
  peptide fold or domain or sub-domain
GERRAAVDTYNRQNRWTKRG

SEQ ID NO: 5899 - protein, 29 aa, artificial
  peptide fold or domain or sub-domain
GERVDMKTYPGYCGGLNCNGFPFGTEIIV

SEQ ID NO: 5900 - protein, 27 aa, artificial
  peptide fold or domain or sub-domain
GERWGAPFLDEARRLGLRHKNWVWLRE

SEQ ID NO: 5901 - protein, 20 aa, artificial
  peptide fold or domain or sub-domain
GESASAVRSRIATGAEWQAL

SEQ ID NO: 5902 - protein, 26 aa, artificial
  peptide fold or domain or sub-domain
GESAWKWNPTLKSFIYKEISQIHIIR

SEQ ID NO: 5903 - protein, 22 aa, artificial
  peptide fold or domain or sub-domain
GESEVLVPLGLGTFAKSKVSSG

SEQ ID NO: 5904 - protein, 26 aa, artificial
  peptide fold or domain or sub-domain
GESLKETKKKNLPFIYGFRHNYSIIN

SEQ ID NO: 5905 - protein, 30 aa, artificial
  peptide fold or domain or sub-domain
GETFHASQPSLTVDGFTDPSNSERFCLGLL

SEQ ID NO: 5906 - protein, 20 aa, artificial
  peptide fold or domain or sub-domain
GEVIYNSSLPFIHEHFKGRL

SEQ ID NO: 5907 - protein, 28 aa, artificial
  peptide fold or domain or sub-domain
GEVKHRRAEGRPLGSGWATDRGGLPTAE

SEQ ID NO: 5908 - protein, 27 aa, artificial
  peptide fold or domain or sub-domain
GEVQQLNDKGEVKEVVVDGKAIKARTV

SEQ ID NO: 5909 - protein, 28 aa, artificial
  peptide fold or domain or sub-domain
GEVRVADLVMNLDGREIFRGGRRVELSA

SEQ ID NO: 5910 - protein, 22 aa, artificial
  peptide fold or domain or sub-domain
GEVSEDMLNSPKWELYNPGDIV

SEQ ID NO: 5911 - protein, 22 aa, artificial
  peptide fold or domain or sub-domain
GEVTPRDRERFRRVAFRSGDLV

SEQ ID NO: 5912 - protein, 30 aa, artificial
  peptide fold or domain or sub-domain
GEVVEINGDQIKVLCASGKQVVVKDSNIYP

SEQ ID NO: 5913 - protein, 30 aa, artificial
  peptide fold or domain or sub-domain
GEVVEIRGGDATIVSTDGKTIVASLASIYP

SEQ ID NO: 5914 - protein, 30 aa, artificial
  peptide fold or domain or sub-domain
GEVVKINGEEVHAHTTNGKTVVANIANVFP

SEQ ID NO: 5915 - protein, 25 aa, artificial
  peptide fold or domain or sub-domain
GEVVQALGDERYLLRDIKGQVEIEL

SEQ ID NO: 5916 - protein, 27 aa, artificial
  peptide fold or domain or sub-domain
GEVYVSPHGSDRNAGTKEAPYLTLNRA

SEQ ID NO: 5917 - protein, 25 aa, artificial
  peptide fold or domain or sub-domain
GEWDVMYQGKRRSSAEVRKELGLKK

SEQ ID NO: 5918 - protein, 30 aa, artificial
  peptide fold or domain or sub-domain
GEYRLLQEGDDWVLQFNHHQHWQSMYRFDL

SEQ ID NO: 5919 - protein, 22 aa, artificial
  peptide fold or domain or sub-domain
GEYVQHMMRDVHHIPEEMRKIR

SEQ ID NO: 5920 - protein, 30 aa, artificial
  peptide fold or domain or sub-domain
GFAIVLCGRNMEKLAELKEELSAVVPVETL

SEQ ID NO: 5921 - protein, 28 aa, artificial
  peptide fold or domain or sub-domain
GFAKNGPTRWQYKRTINQVVHRWGSHTV

SEQ ID NO: 5922 - protein, 28 aa, artificial
  peptide fold or domain or sub-domain
GFCSDCEAEISIDKLQENVTTKRCDICE

SEQ ID NO: 5923 - protein, 28 aa, artificial
  peptide fold or domain or sub-domain
GFCSLCEQAIQEARLLLMPESSLCVGCA

SEQ ID NO: 5924 - protein, 25 aa, artificial
  peptide fold or domain or sub-domain
GFDIVLRSLYNDNKIDENNKHLDTL

SEQ ID NO: 5925 - protein, 20 aa, artificial
  peptide fold or domain or sub-domain
GFEKFKTEVYDKKPDFFEPL

SEQ ID NO: 5926 - protein, 22 aa, artificial
  peptide fold or domain or sub-domain
GFETLVEAGYAPEMAYFECLHE

SEQ ID NO: 5927 - protein, 27 aa, artificial
  peptide fold or domain or sub-domain
GFETVFRVAVKHDVTPRIAAYIIALKK

SEQ ID NO: 5928 - protein, 28 aa, artificial
  peptide fold or domain or sub-domain
GFFQETGEAIGIKRLLLVPESLYSVESM

SEQ ID NO: 5929 - protein, 27 aa, artificial
  peptide fold or domain or sub-domain
GFFSLAFREENGGMGLGMLEICCIQAE

SEQ ID NO: 5930 - protein, 25 aa, artificial
  peptide fold or domain or sub-domain
GFHFQYKAGQWICSKTGVEFAHMVK

SEQ ID NO: 5931 - protein, 20 aa, artificial
  peptide fold or domain or sub-domain
GFHRFRTEVFPQQKEFYRSL

SEQ ID NO: 5932 - protein, 25 aa, artificial
  peptide fold or domain or sub-domain
GFHYKFRGNQWLDTKDSSEFFTGLS

SEQ ID NO: 5933 - protein, 25 aa, artificial
  peptide fold or domain or sub-domain
GFHYRFVDGAWRDTRSGDEFFAALT

SEQ ID NO: 5934 - protein, 25 aa, artificial
  peptide fold or domain or sub-domain
GFHYRYDGQHWNDTRGGPRLPDALS

SEQ ID NO: 5935 - protein, 27 aa, artificial
  peptide fold or domain or sub-domain
GFIAAPFGEEFGGPKLPETVVQALYFI

SEQ ID NO: 5936 - protein, 20 aa, artificial
  peptide fold or domain or sub-domain
GFIKFKKEKYETNPALYGEL

SEQ ID NO: 5937 - protein, 29 aa, artificial
  peptide fold or domain or sub-domain
GFISFLDGRARFVGGGNKREWLIEEAEDL

SEQ ID NO: 5938 - protein, 25 aa, artificial
  peptide fold or domain or sub-domain
GFITGHLRGDHYLFRDDSGEIDIEI

SEQ ID NO: 5939 - protein, 27 aa, artificial
  peptide fold or domain or sub-domain
GFKASYEFAKKHKVDMRKASMAIAVDR

SEQ ID NO: 5940 - protein, 25 aa, artificial
  peptide fold or domain or sub-domain
GFKMSAAEAVKEKWLPYEAGQRFLE

SEQ ID NO: 5941 - protein, 24 aa, artificial
  peptide fold or domain or sub-domain
GFKPVPTGMEHGTITVVVQGYPFE

SEQ ID NO: 5942 - protein, 20 aa, artificial
  peptide fold or domain or sub-domain
GFLHINCFKGSDGKIYSGRI

SEQ ID NO: 5943 - protein, 29 aa, artificial
  peptide fold or domain or sub-domain
GFLIEATPKNGGYPTFRQTIPSDRRTYVV

SEQ ID NO: 5944 - protein, 29 aa, artificial
  peptide fold or domain or sub-domain
GFLIEVSDPDGLSDGQNHTLSGQEFSLAV

SEQ ID NO: 5945 - protein, 27 aa, artificial
  peptide fold or domain or sub-domain
GFLIITEPEFSAIAKRAGISEPGMYAI

SEQ ID NO: 5946 - protein, 26 aa, artificial
  peptide fold or domain or sub-domain
GFLLPFYGWAPELQRAVMKNLVEAYT

SEQ ID NO: 5947 - protein, 29 aa, artificial
  peptide fold or domain or sub-domain
GFLLTVGNTKSLDNKTSLLNYIIQFISEK

SEQ ID NO: 5948 - protein, 28 aa, artificial
  peptide fold or domain or sub-domain
GFLTPTGVGTVEGKQTLTLDGKTWLLER

SEQ ID NO: 5949 - protein, 21 aa, artificial
  peptide fold or domain or sub-domain
GFPPVQTMTGAQARATIRSRF

SEQ ID NO: 5950 - protein, 30 aa, artificial
  peptide fold or domain or sub-domain
GFQDVSSAEIAELTSKAEELGVRRGMKVEE

SEQ ID NO: 5951 - protein, 29 aa, artificial
  peptide fold or domain or sub-domain
GFRVEYELSEEGDEPQYLDLPSTATSVNI

SEQ ID NO: 5952 - protein, 29 aa, artificial
  peptide fold or domain or sub-domain
GFRVLEYPFGRWLATRITPRMLVEQSLLG

SEQ ID NO: 5953 - protein, 30 aa, artificial
  peptide fold or domain or sub-domain
GFSHPPYDSFNVATHVGDNLKNVIKNRQLL

SEQ ID NO: 5954 - protein, 23 aa, artificial
  peptide fold or domain or sub-domain
GFSNDFKERIKQHMIKSVREAKI

SEQ ID NO: 5955 - protein, 26 aa, artificial
  peptide fold or domain or sub-domain
GFSSRKYEGRPLEAAWPQLWDGRLFA

SEQ ID NO: 5956 - protein, 27 aa, artificial
  peptide fold or domain or sub-domain
GFVAVIDPEKSEAAKLLSLKQKGAYSV

SEQ ID NO: 5957 - protein, 27 aa, artificial
  peptide fold or domain or sub-domain
GFVTGEKFYPTISALRTAFEAGELGME

SEQ ID NO: 5958 - protein, 24 aa, artificial
  peptide fold or domain or sub-domain
GFVYQYVNGGSSLGNQNQEFSGRT

SEQ ID NO: 5959 - protein, 27 aa, artificial
  peptide fold or domain or sub-domain
GFWGIEVDEKLGGQGLGMFAKTLVVEE

SEQ ID NO: 5960 - protein, 27 aa, artificial
  peptide fold or domain or sub-domain
GFWGINTPEEYGGADLGQMMQAIVAME

SEQ ID NO: 5961 - protein, 29 aa, artificial
  peptide fold or domain or sub-domain
GFWHLLTSAGNGDKWKKLPLNVPKLKEAM

SEQ ID NO: 5962 - protein, 24 aa, artificial
  peptide fold or domain or sub-domain
GFYKAFDGNILRDFDLVKVDNQWV

SEQ ID NO: 5963 - protein, 27 aa, artificial
  peptide fold or domain or sub-domain
GFYTASLPVEIGGQGLSIAEVCALKAD

SEQ ID NO: 5964 - protein, 25 aa, artificial
  peptide fold or domain or sub-domain
GFYVARTELGQPFTELQNRLEWLSY

SEQ ID NO: 5965 - protein, 23 aa, artificial
  peptide fold or domain or sub-domain
GGAIHLVGREVLGWSESVVHERA

SEQ ID NO: 5966 - protein, 27 aa, artificial
  peptide fold or domain or sub-domain
GGAISYQSPDLSQYQTADKNWLQPEIV

SEQ ID NO: 5967 - protein, 21 aa, artificial
  peptide fold or domain or sub-domain
GGALLWLSGHAGTQAQGAARV

SEQ ID NO: 5968 - protein, 20 aa, artificial
  peptide fold or domain or sub-domain
GGAMSWFRDTFYVGVNAAVP

SEQ ID NO: 5969 - protein, 22 aa, artificial
  peptide fold or domain or sub-domain
GGANTVAEQTGISIETAKQVVD

SEQ ID NO: 5970 - protein, 30 aa, artificial
  peptide fold or domain or sub-domain
GGAVFSQDINVALRVARGVRTGRMWVNTYN

SEQ ID NO: 5971 - protein, 29 aa, artificial
  peptide fold or domain or sub-domain
GGAVYCCGPTPMLESVRRAFPGSPATALH

SEQ ID NO: 5972 - protein, 27 aa, artificial
  peptide fold or domain or sub-domain
GGAYLAGGTNLVDHLRAGIREVDQIVD

SEQ ID NO: 5973 - protein, 26 aa, artificial
  peptide fold or domain or sub-domain
GGCGDGPGGVKPGDPGHDPAAVALMR

SEQ ID NO: 5974 - protein, 25 aa, artificial
  peptide fold or domain or sub-domain
GGDASESVAGAEDGAAAGLKEMRNE

SEQ ID NO: 5975 - protein, 21 aa, artificial
  peptide fold or domain or sub-domain
GGDDPDDRKPMLWADMTYDNE

SEQ ID NO: 5976 - protein, 20 aa, artificial
  peptide fold or domain or sub-domain
GGDEGAGSYVEHAEAPLLSV

SEQ ID NO: 5977 - protein, 25 aa, artificial
  peptide fold or domain or sub-domain
GGDEGVASMNAQFRGKAGATNVLSF

SEQ ID NO: 5978 - protein, 20 aa, artificial
  peptide fold or domain or sub-domain
GGDGDGYSESDEMGMALLRE

SEQ ID NO: 5979 - protein, 30 aa, artificial
  peptide fold or domain or sub-domain
GGDIVLVDLNKEQIEQAAADVAKEFGVKTL

SEQ ID NO: 5980 - protein, 30 aa, artificial
  peptide fold or domain or sub-domain
GGDWENREWEELPKLWPEEYDSWENRPHEH

SEQ ID NO: 5981 - protein, 20 aa, artificial
  peptide fold or domain or sub-domain
GGEEAWRLAGLSRPKQRTLL

SEQ ID NO: 5982 - protein, 30 aa, artificial
  peptide fold or domain or sub-domain
GGETGWGNPATTRKMIDQMKKAGFNTVRIP

SEQ ID NO: 5983 - protein, 24 aa, artificial
  peptide fold or domain or sub-domain
GGFIRRVTNDARENEMDENLEQVS

SEQ ID NO: 5984 - protein, 27 aa, artificial
  peptide fold or domain or sub-domain
GGFKFMEFTDRGITCEKFAKNSFIDEL

SEQ ID NO: 5985 - protein, 27 aa, artificial
  peptide fold or domain or sub-domain
GGFLIDILLKRLGNRPPFMLGSQDAIV

SEQ ID NO: 5986 - protein, 28 aa, artificial
  peptide fold or domain or sub-domain
GGFQQLYANGETIAFQREAPEERMIIVV

SEQ ID NO: 5987 - protein, 26 aa, artificial
  peptide fold or domain or sub-domain
GGGLDILDGTARPFPEIAKRYSIAGV

SEQ ID NO: 5988 - protein, 24 aa, artificial
  peptide fold or domain or sub-domain
GGGTMEMPIWEFPTRFDKICMPEW

SEQ ID NO: 5989 - protein, 28 aa, artificial
  peptide fold or domain or sub-domain
GGHADFAPVGQRQMDVLTCLRQNFKRVS

SEQ ID NO: 5990 - protein, 28 aa, artificial
  peptide fold or domain or sub-domain
GGHADWGAKTEQEWFIYRYLKSKYSHVS

SEQ ID NO: 5991 - protein, 28 aa, artificial
  peptide fold or domain or sub-domain
GGHCTFSPRDETQTFIRDQLAREYGHVS

SEQ ID NO: 5992 - protein, 28 aa, artificial
  peptide fold or domain or sub-domain
GGHFGFSPQTAQQGELWAWLLAQNGRVT

SEQ ID NO: 5993 - protein, 20 aa, artificial
  peptide fold or domain or sub-domain
GGHGLTDSASRRNFGGSWDG

SEQ ID NO: 5994 - protein, 28 aa, artificial
  peptide fold or domain or sub-domain
GGHIAFAPVTDEQSRLMDWLHRERSHIS

SEQ ID NO: 5995 - protein, 28 aa, artificial
  peptide fold or domain or sub-domain
GGHIDFTPGEPREVPVFEALQARHGRVS

SEQ ID NO: 5996 - protein, 28 aa, artificial
  peptide fold or domain or sub-domain
GGHIDIGPRTERDYQIFPHIERIEGRVT

SEQ ID NO: 5997 - protein, 28 aa, artificial
  peptide fold or domain or sub-domain
GGHIEIMPVTDDEWIAWRAAHDQFGRVS

SEQ ID NO: 5998 - protein, 28 aa, artificial
  peptide fold or domain or sub-domain
GGHISLAAVTDLDAKLLIELRKEHPHVS

SEQ ID NO: 5999 - protein, 28 aa, artificial
  peptide fold or domain or sub-domain
GGHMAYAPRTDIEHDLARLLARDHGYVS

SEQ ID NO: 6000 - protein, 28 aa, artificial
  peptide fold or domain or sub-domain
GGHSTLPPATQAESLIVEVLRTHWPHVS

SEQ ID NO: 6001 - protein, 28 aa, artificial
  peptide fold or domain or sub-domain
GGHTDFAPVDELDVKIFQQLKTTKKRLS

SEQ ID NO: 6002 - protein, 28 aa, artificial
  peptide fold or domain or sub-domain
GGHTTFAPRNQVEKDLLDYLHQRYNHVS

SEQ ID NO: 6003 - protein, 28 aa, artificial
  peptide fold or domain or sub-domain
GGHVDFAPNSEEEAIILEILRAEIGHVS

SEQ ID NO: 6004 - protein, 28 aa, artificial
  peptide fold or domain or sub-domain
GGHVDFAPVDLTQMVVWQHIYKKLGRVT

SEQ ID NO: 6005 - protein, 28 aa, artificial
  peptide fold or domain or sub-domain
GGHVDFSPVDDEQVELFKFMRKTFHRIS

SEQ ID NO: 6006 - protein, 28 aa, artificial
  peptide fold or domain or sub-domain
GGHVDLPVTSPRDFALWQGLQARYGHVS

SEQ ID NO: 6007 - protein, 28 aa, artificial
  peptide fold or domain or sub-domain
GGHVDLTSCNEQEDYILSYLRERHHRVS

SEQ ID NO: 6008 - protein, 28 aa, artificial
  peptide fold or domain or sub-domain
GGHVNVAPATQLECEVIRAAMAEHGHVS

SEQ ID NO: 6009 - protein, 28 aa, artificial
  peptide fold or domain or sub-domain
GGHVSFAPFDDLEILVWQYARSKFNHVS

SEQ ID NO: 6010 - protein, 25 aa, artificial
  peptide fold or domain or sub-domain
GGIDTDEACRYAFEHNNDAPFIRRD

SEQ ID NO: 6011 - protein, 21 aa, artificial
  peptide fold or domain or sub-domain
GGIEPWHVRVAKENQFALKLV

SEQ ID NO: 6012 - protein, 23 aa, artificial
  peptide fold or domain or sub-domain
GGIIMVAAEYFGTHSQAGVLADV

SEQ ID NO: 6013 - protein, 29 aa, artificial
  peptide fold or domain or sub-domain
GGINAYVNAFGGNATTWYTNTAAQTQYRK

SEQ ID NO: 6014 - protein, 29 aa, artificial
  peptide fold or domain or sub-domain
GGINIYCAYFGCTHETFWTHADAQEAYKD

SEQ ID NO: 6015 - protein, 29 aa, artificial
  peptide fold or domain or sub-domain
GGIQLLVDLLDHRMTEVHRSACGALRNLV

SEQ ID NO: 6016 - protein, 22 aa, artificial
  peptide fold or domain or sub-domain
GGITEAKTDERYNEGFMPASLL

SEQ ID NO: 6017 - protein, 27 aa, artificial
  peptide fold or domain or sub-domain
GGITSFEFRRDGAVDVVPLSLSSETLY

SEQ ID NO: 6018 - protein, 23 aa, artificial
  peptide fold or domain or sub-domain
GGIVSCAREYLGGVDDSDLRDEV

SEQ ID NO: 6019 - protein, 20 aa, artificial
  peptide fold or domain or sub-domain
GGIVSPDNGRRMSIQEATRV

SEQ ID NO: 6020 - protein, 29 aa, artificial
  peptide fold or domain or sub-domain
GGLEPLINQMMGDNVEVQCNAVGCITNLA

SEQ ID NO: 6021 - protein, 22 aa, artificial
  peptide fold or domain or sub-domain
GGLFTCITQKIGIPTGVQKYGS

SEQ ID NO: 6022 - protein, 27 aa, artificial
  peptide fold or domain or sub-domain
GGLIAYHSLDRSWLLGKMAELSLLDLV

SEQ ID NO: 6023 - protein, 27 aa, artificial
  peptide fold or domain or sub-domain
GGLLRYRRYDTSALLTASSAGGFRAAL

SEQ ID NO: 6024 - protein, 29 aa, artificial
  peptide fold or domain or sub-domain
GGLPIMVNILDSPHKSLKCLAAETIANVA

SEQ ID NO: 6025 - protein, 27 aa, artificial
  peptide fold or domain or sub-domain
GGMCVYHFGKGRVIVEPVLNDPTALLE

SEQ ID NO: 6026 - protein, 20 aa, artificial
  peptide fold or domain or sub-domain
GGPAMIEGGGLGVFAADDIG

SEQ ID NO: 6027 - protein, 21 aa, artificial
  peptide fold or domain or sub-domain
GGPKQAGDHFVREAFPWKDRT

SEQ ID NO: 6028 - protein, 26 aa, artificial
  peptide fold or domain or sub-domain
GGPPCDFRIVPDDNAGLSYFLGGTPR

SEQ ID NO: 6029 - protein, 20 aa, artificial
  peptide fold or domain or sub-domain
GGPPLVKMATGEVSDDESLG

SEQ ID NO: 6030 - protein, 27 aa, artificial
  peptide fold or domain or sub-domain
GGPWLADTLADIEEAVLLKHIENEKKS

SEQ ID NO: 6031 - protein, 27 aa, artificial
  peptide fold or domain or sub-domain
GGPWVKELLGQVENSIISGHLANKKEE

SEQ ID NO: 6032 - protein, 22 aa, artificial
  peptide fold or domain or sub-domain
GGQELVEKEPLMGGFVYATILN

SEQ ID NO: 6033 - protein, 27 aa, artificial
  peptide fold or domain or sub-domain
GGQFDDKPGKDICGNAQKWGGSFLVNE

SEQ ID NO: 6034 - protein, 21 aa, artificial
  peptide fold or domain or sub-domain
GGQLKVVGSQLCDSNGKPIQL

SEQ ID NO: 6035 - protein, 27 aa, artificial
  peptide fold or domain or sub-domain
GGQRDIERLDMGMFLAVARGSVNEPRL

SEQ ID NO: 6036 - protein, 22 aa, artificial
  peptide fold or domain or sub-domain
GGQVETWAADIAREHGFSDVSH

SEQ ID NO: 6037 - protein, 21 aa, artificial
  peptide fold or domain or sub-domain
GGREGISEDTITAGRSAYEQA

SEQ ID NO: 6038 - protein, 23 aa, artificial
  peptide fold or domain or sub-domain
GGSFDSSNMRNLPRGGLPGGKLD

SEQ ID NO: 6039 - protein, 20 aa, artificial
  peptide fold or domain or sub-domain
GGSFKWFRDSFGLEEKIIAN

SEQ ID NO: 6040 - protein, 24 aa, artificial
  peptide fold or domain or sub-domain
GGSFVPFMAEKGTYRIVVGDEILD

SEQ ID NO: 6041 - protein, 20 aa, artificial
  peptide fold or domain or sub-domain
GGSGADKWVSWYDAWRFAGS

SEQ ID NO: 6042 - protein, 20 aa, artificial
  peptide fold or domain or sub-domain
GGSLVRLAEQTGQPLHKILQ

SEQ ID NO: 6043 - protein, 25 aa, artificial
  peptide fold or domain or sub-domain
GGSNLQGAQRWAQRNKRSFWLSAAR

SEQ ID NO: 6044 - protein, 26 aa, artificial
  peptide fold or domain or sub-domain
GGSSLLKEHVFESLEAHKIGEFDRLY

SEQ ID NO: 6045 - protein, 27 aa, artificial
  peptide fold or domain or sub-domain
GGVILLKPRPPVEVEELEPGSLRFVVV

SEQ ID NO: 6046 - protein, 23 aa, artificial
  peptide fold or domain or sub-domain
GGVIYLDMAGEPDADADVINARV

SEQ ID NO: 6047 - protein, 22 aa, artificial
  peptide fold or domain or sub-domain
GGVLDFGSDASGGEVISPNRAS

SEQ ID NO: 6048 - protein, 21 aa, artificial
  peptide fold or domain or sub-domain
GGVLLSDAGLATDAVSGAARI

SEQ ID NO: 6049 - protein, 27 aa, artificial
  peptide fold or domain or sub-domain
GGVNYIRFNPDHSVDVEPVPTAPEFLD

SEQ ID NO: 6050 - protein, 29 aa, artificial
  peptide fold or domain or sub-domain
GGVPAYEAAFGRGSSTWFKHEPAQAQYQA

SEQ ID NO: 6051 - protein, 29 aa, artificial
  peptide fold or domain or sub-domain
GGVPHLIQILAVDSDTLQEEACLALAELS

SEQ ID NO: 6052 - protein, 29 aa, artificial
  peptide fold or domain or sub-domain
GGVPVLVSLLCSDRQVVQCMATAVLCHMT

SEQ ID NO: 6053 - protein, 23 aa, artificial
  peptide fold or domain or sub-domain
GGVTIGEFAGIGPNVRIHAAYHT

SEQ ID NO: 6054 - protein, 28 aa, artificial
  peptide fold or domain or sub-domain
GGVTKGPKVDTHLGLPLFGSMEKAAEEL

SEQ ID NO: 6055 - protein, 27 aa, artificial
  peptide fold or domain or sub-domain
GGVTLAVTAEASVIARTVHSQPQFMAL

SEQ ID NO: 6056 - protein, 23 aa, artificial
  peptide fold or domain or sub-domain
GGVTSSSLEVLASLSFDDASFKE

SEQ ID NO: 6057 - protein, 23 aa, artificial
  peptide fold or domain or sub-domain
GGVTVSYFEWVKNLSHIRFGRMQ

SEQ ID NO: 6058 - protein, 27 aa, artificial
  peptide fold or domain or sub-domain
GGWIAYRAPDRAAVLALARAHGVEAAL

SEQ ID NO: 6059 - protein, 27 aa, artificial
  peptide fold or domain or sub-domain
GGWIAYTTFDQEWVKHRLAYKSLEWFM

SEQ ID NO: 6060 - protein, 30 aa, artificial
  peptide fold or domain or sub-domain
GGWKQSERKTEFVNAGKEVAAKRGIPQYNP

SEQ ID NO: 6061 - protein, 27 aa, artificial
  peptide fold or domain or sub-domain
GGWLAYQTFDKTWLKQELKSKTLSDVV

SEQ ID NO: 6062 - protein, 27 aa, artificial
  peptide fold or domain or sub-domain
GGWLVYGSPDRRWVSETLATRSVTELL

SEQ ID NO: 6063 - protein, 20 aa, artificial
  peptide fold or domain or sub-domain
GGYDKQNDSIFVPSEAVGMI

SEQ ID NO: 6064 - protein, 28 aa, artificial
  peptide fold or domain or sub-domain
GGYDKQNDSIFVPSEAVGMIIGKGGETI

SEQ ID NO: 6065 - protein, 21 aa, artificial
  peptide fold or domain or sub-domain
GGYLGTVSIVTTVKWFWFVIS

SEQ ID NO: 6066 - protein, 20 aa, artificial
  peptide fold or domain or sub-domain
GGYMYHTDPVDVLDNFKGRT

SEQ ID NO: 6067 - protein, 30 aa, artificial
  peptide fold or domain or sub-domain
GHAAYRDFHTYDHVTGLKPARVTGRNVPSS

SEQ ID NO: 6068 - protein, 20 aa, artificial
  peptide fold or domain or sub-domain
GHALSWLQNKVRILPDSRDA

SEQ ID NO: 6069 - protein, 26 aa, artificial
  peptide fold or domain or sub-domain
GHAVELGHVNNQPFIYGVRDGISIID

SEQ ID NO: 6070 - protein, 23 aa, artificial
  peptide fold or domain or sub-domain
GHEFYKHGTCCEGYNTEEAYFKL

SEQ ID NO: 6071 - protein, 29 aa, artificial
  peptide fold or domain or sub-domain
GHELIELSDTGDHITATVQGPDGRVEYSA

SEQ ID NO: 6072 - protein, 26 aa, artificial
  peptide fold or domain or sub-domain
GHERKRWNPKFARYIYAERNGIHIID

SEQ ID NO: 6073 - protein, 29 aa, artificial
  peptide fold or domain or sub-domain
GHEVTAIRQDADGVEAEVAGPDGTYTLRA

SEQ ID NO: 6074 - protein, 22 aa, artificial
  peptide fold or domain or sub-domain
GHFLKTGQEHSLPPSGTRHYGD

SEQ ID NO: 6075 - protein, 22 aa, artificial
  peptide fold or domain or sub-domain
GHFNPAGAPHAAPTAEKHHLGD

SEQ ID NO: 6076 - protein, 22 aa, artificial
  peptide fold or domain or sub-domain
GHFSIAETEHGLMVEAGPHSGD

SEQ ID NO: 6077 - protein, 26 aa, artificial
  peptide fold or domain or sub-domain
GHFSTKWNPKMKKYVFCKQNGKYIID

SEQ ID NO: 6078 - protein, 25 aa, artificial
  peptide fold or domain or sub-domain
GHFVGFTPSGDMNAKRWNSDPALLE

SEQ ID NO: 6079 - protein, 25 aa, artificial
  peptide fold or domain or sub-domain
GHGEVLHRGEWRPVGEVLEELGLAP

SEQ ID NO: 6080 - protein, 29 aa, artificial
  peptide fold or domain or sub-domain
GHHPEWGSVSPNDRGSLIMDVAEKLDLVI

SEQ ID NO: 6081 - protein, 24 aa, artificial
  peptide fold or domain or sub-domain
GHHTYTESDFFSLQASMKHISLSR

SEQ ID NO: 6082 - protein, 26 aa, artificial
  peptide fold or domain or sub-domain
GHHVNKWNSETGPYLLGQRGNIHIID

SEQ ID NO: 6083 - protein, 28 aa, artificial
  peptide fold or domain or sub-domain
GHIDLWADTNSYCFARTAREGAVIIAAN

SEQ ID NO: 6084 - protein, 25 aa, artificial
  peptide fold or domain or sub-domain
GHIESRIHSDHFIFRDNAGIVEVEV

SEQ ID NO: 6085 - protein, 25 aa, artificial
  peptide fold or domain or sub-domain
GHILKKISHDKYIFADSTGQITIDV

SEQ ID NO: 6086 - protein, 26 aa, artificial
  peptide fold or domain or sub-domain
GHIPERYVAEGEEEGGPDADTEATGD

SEQ ID NO: 6087 - protein, 30 aa, artificial
  peptide fold or domain or sub-domain
GHIQSISTEMASVLLKNGSVVTVSAEDLLP

SEQ ID NO: 6088 - protein, 29 aa, artificial
  peptide fold or domain or sub-domain
GHIVTTDFNNHRLVVIHSDFQSAQYLGSE

SEQ ID NO: 6089 - protein, 26 aa, artificial
  peptide fold or domain or sub-domain
GHKAGCRHRFMEPYIFGSRLDHDIID

SEQ ID NO: 6090 - protein, 26 aa, artificial
  peptide fold or domain or sub-domain
GHKVGTVNNNMKWALYGERLGVCLFD

SEQ ID NO: 6091 - protein, 25 aa, artificial
  peptide fold or domain or sub-domain
GHLENLARVAQMLPAFAGIVDRADP

SEQ ID NO: 6092 - protein, 25 aa, artificial
  peptide fold or domain or sub-domain
GHLKAPNGIILSPGWPELYKEALNC

SEQ ID NO: 6093 - protein, 24 aa, artificial
  peptide fold or domain or sub-domain
GHNKIGSVIRQRDRIDFPDYDTLQ

SEQ ID NO: 6094 - protein, 26 aa, artificial
  peptide fold or domain or sub-domain
GHNLIAVLHRERGCSWQEAADEAYRM

SEQ ID NO: 6095 - protein, 24 aa, artificial
  peptide fold or domain or sub-domain
GHPVAVDLFSSDSSMGMEHIDLAR

SEQ ID NO: 6096 - protein, 21 aa, artificial
  peptide fold or domain or sub-domain
GHPVEISPLAKKNKEDERFTD

SEQ ID NO: 6097 - protein, 26 aa, artificial
  peptide fold or domain or sub-domain
GHPVIQCDSGMKKYIRGQSNGKHFIN

SEQ ID NO: 6098 - protein, 26 aa, artificial
  peptide fold or domain or sub-domain
GHQTRYWNPKMKPFIFGARNKVHIIN

SEQ ID NO: 6099 - protein, 29 aa, artificial
  peptide fold or domain or sub-domain
GHRALVGKRHLVVRDGHETVTTLLDPAEH

SEQ ID NO: 6100 - protein, 25 aa, artificial
  peptide fold or domain or sub-domain
GHRENLERLERLLPAFSANALDAGA

SEQ ID NO: 6101 - protein, 29 aa, artificial
  peptide fold or domain or sub-domain
GHRILTRQALTTWTEGKKTIQPVTSDDQY

SEQ ID NO: 6102 - protein, 26 aa, artificial
  peptide fold or domain or sub-domain
GHRRRILDKTMNSYVAGNQQDISILN

SEQ ID NO: 6103 - protein, 29 aa, artificial
  peptide fold or domain or sub-domain
GHRVVGFTEEADRVTVAIEGPAGPARIEA

SEQ ID NO: 6104 - protein, 30 aa, artificial
  peptide fold or domain or sub-domain
GHSESILTENYSNAKKFVSEIDAAAVYVNA

SEQ ID NO: 6105 - protein, 26 aa, artificial
  peptide fold or domain or sub-domain
GHSLSSLKAANQPYIYGQRHGVAIFD

SEQ ID NO: 6106 - protein, 30 aa, artificial
  peptide fold or domain or sub-domain
GHTAGIVSTDIKAINRFVREVEAGVIKVNK

SEQ ID NO: 6107 - protein, 29 aa, artificial
  peptide fold or domain or sub-domain
GHTDADVMAQHLSLNLQGIGFDLVIGADH

SEQ ID NO: 6108 - protein, 30 aa, artificial
  peptide fold or domain or sub-domain
GHTESIIAEDMEIVEKFFNHLDSAILLHNA

SEQ ID NO: 6109 - protein, 30 aa, artificial
  peptide fold or domain or sub-domain
GHTEVIITENDETAKRFIREVDSAVTMANV

SEQ ID NO: 6110 - protein, 20 aa, artificial
  peptide fold or domain or sub-domain
GHTKVAKTGIITRQEATGNQ

SEQ ID NO: 6111 - protein, 29 aa, artificial
  peptide fold or domain or sub-domain
GHTLKDLKQYETFVQLEIEQRETIYKIEV

SEQ ID NO: 6112 - protein, 26 aa, artificial
  peptide fold or domain or sub-domain
GHTRNPITSGVEVVPQVARDLQGRGI

SEQ ID NO: 6113 - protein, 24 aa, artificial
  peptide fold or domain or sub-domain
GHTVYTDLWDPRPSNAMAHIELSR

SEQ ID NO: 6114 - protein, 30 aa, artificial
  peptide fold or domain or sub-domain
GHVFLTEDGTVLDTVMPDFLHLTSEQYQVW

SEQ ID NO: 6115 - protein, 28 aa, artificial
  peptide fold or domain or sub-domain
GHVGDEIYGEFLLDVLHEEGIGTVALNG

SEQ ID NO: 6116 - protein, 21 aa, artificial
  peptide fold or domain or sub-domain
GHVINFMQGLPWEKPEAYTHG

SEQ ID NO: 6117 - protein, 28 aa, artificial
  peptide fold or domain or sub-domain
GHVSYQPDQGTLWTFTLRDVPSPLRAKL

SEQ ID NO: 6118 - protein, 29 aa, artificial
  peptide fold or domain or sub-domain
GHWLPWGLLPDAIRSGERQIKAAHGTETY

SEQ ID NO: 6119 - protein, 22 aa, artificial
  peptide fold or domain or sub-domain
GHWLSGAQVHAFPENTSRHFGD

SEQ ID NO: 6120 - protein, 22 aa, artificial
  peptide fold or domain or sub-domain
GHWNPTGENHGKWMEAPFHIGD

SEQ ID NO: 6121 - protein, 24 aa, artificial
  peptide fold or domain or sub-domain
GHWYDSYVNATTIFDDSDKTKGYD

SEQ ID NO: 6122 - protein, 22 aa, artificial
  peptide fold or domain or sub-domain
GHYDPGNTHHHLGPEGDGHMGD

SEQ ID NO: 6123 - protein, 22 aa, artificial
  peptide fold or domain or sub-domain
GHYNPDKVDHSGHESDTRHAGD

SEQ ID NO: 6124 - protein, 22 aa, artificial
  peptide fold or domain or sub-domain
GHYNPLGKEHGFNNLKGPHAGD

SEQ ID NO: 6125 - protein, 24 aa, artificial
  peptide fold or domain or sub-domain
GIAADQRVDFVLIRDDMVARQVRA

SEQ ID NO: 6126 - protein, 29 aa, artificial
  peptide fold or domain or sub-domain
GIAFCAKEVLKKEIPHHVDKRDFLEVLPL

SEQ ID NO: 6127 - protein, 29 aa, artificial
  peptide fold or domain or sub-domain
GIAFHAKPKLAAAADARIRSLDLRVLPYL

SEQ ID NO: 6128 - protein, 29 aa, artificial
  peptide fold or domain or sub-domain
GIAFNAKEVLKDVADGSISKENLVGLASV

SEQ ID NO: 6129 - protein, 29 aa, artificial
  peptide fold or domain or sub-domain
GIAFNAKPALQAIADYSVNSNNLLEILGC

SEQ ID NO: 6130 - protein, 29 aa, artificial
  peptide fold or domain or sub-domain
GIAFRAKPIVRETAKQAISTLGLDAILYL

SEQ ID NO: 6131 - protein, 27 aa, artificial
  peptide fold or domain or sub-domain
GIAKYFFPLLRTGKPGTQENLEKLNAA

SEQ ID NO: 6132 - protein, 29 aa, artificial
  peptide fold or domain or sub-domain
GIAMGSGTDIAIESADIIILSNRLDALPV

SEQ ID NO: 6133 - protein, 24 aa, artificial
  peptide fold or domain or sub-domain
GIARGVDETGALILVTTEGVQRYH

SEQ ID NO: 6134 - protein, 24 aa, artificial
  peptide fold or domain or sub-domain
GIARGVNAIGELQLEIDGQLQVYN

SEQ ID NO: 6135 - protein, 25 aa, artificial
  peptide fold or domain or sub-domain
GIARLIPYLPEDFENRAKYVQLFKD

SEQ ID NO: 6136 - protein, 29 aa, artificial
  peptide fold or domain or sub-domain
GIAWKAKPVVRKKIHHQINYHGFELLLFL

SEQ ID NO: 6137 - protein, 29 aa, artificial
  peptide fold or domain or sub-domain
GIAYHAKPVVQQQATYALNHVDLEGLVYL

SEQ ID NO: 6138 - protein, 30 aa, artificial
  peptide fold or domain or sub-domain
GIAYIGENTLVVWEEMADLPQFQGYELIRV

SEQ ID NO: 6139 - protein, 28 aa, artificial
  peptide fold or domain or sub-domain
GICDVSGEEIPLARLMAIPYATMTVKAQ

SEQ ID NO: 6140 - protein, 24 aa, artificial
  peptide fold or domain or sub-domain
GICEGIDPQGGIRIRQDGEVKSYY

SEQ ID NO: 6141 - protein, 28 aa, artificial
  peptide fold or domain or sub-domain
GICEVCGKPISEERLEFVPYAENCVECQ

SEQ ID NO: 6142 - protein, 28 aa, artificial
  peptide fold or domain or sub-domain
GICIDCNTDIDYQRLQINPTVKRCFDCQ

SEQ ID NO: 6143 - protein, 24 aa, artificial
  peptide fold or domain or sub-domain
GICLGINTEGALRMQVNDLQQTFH

SEQ ID NO: 6144 - protein, 28 aa, artificial
  peptide fold or domain or sub-domain
GICQICDEPIPYKRLFALPEATICVDCA

SEQ ID NO: 6145 - protein, 28 aa, artificial
  peptide fold or domain or sub-domain
GICTKSGKPIPKKRLEAVPHTSVRIEFK

SEQ ID NO: 6146 - protein, 26 aa, artificial
  peptide fold or domain or sub-domain
GICVESYASNPLTQLSSDPFINPMML

SEQ ID NO: 6147 - protein, 28 aa, artificial
  peptide fold or domain or sub-domain
GIDDNIQSLRKSLQELKTLLSKDDLPTP

SEQ ID NO: 6148 - protein, 22 aa, artificial
  peptide fold or domain or sub-domain
GIDQAYPGLSNAYGVNPWQWYC

SEQ ID NO: 6149 - protein, 24 aa, artificial
  peptide fold or domain or sub-domain
GIDRLLQYNQKWAEQILTQDPTFF

SEQ ID NO: 6150 - protein, 29 aa, artificial
  peptide fold or domain or sub-domain
GIEAIEGGDSVTGVRLSTGETVPAGLVLV

SEQ ID NO: 6151 - protein, 22 aa, artificial
  peptide fold or domain or sub-domain
GIEAVLAKGGDPWDGEQVRTEL

SEQ ID NO: 6152 - protein, 26 aa, artificial
  peptide fold or domain or sub-domain
GIEEAKRGHKEGLLSEDALKAAEEAF

SEQ ID NO: 6153 - protein, 29 aa, artificial
  peptide fold or domain or sub-domain
GIEIDKFHGFMDDMEFVQCLMSEESVFCL

SEQ ID NO: 6154 - protein, 24 aa, artificial
  peptide fold or domain or sub-domain
GIEKLMEGNQTFVENEYAENIEYY

SEQ ID NO: 6155 - protein, 29 aa, artificial
  peptide fold or domain or sub-domain
GIELTYGPKDVPGDRTTIDLSEDENQYSI

SEQ ID NO: 6156 - protein, 29 aa, artificial
  peptide fold or domain or sub-domain
GIEMEHFPEFENDVEFTERLVAEQSVHCL

SEQ ID NO: 6157 - protein, 24 aa, artificial
  peptide fold or domain or sub-domain
GIEQGIDERGYLKVLCGNKIQMFN

SEQ ID NO: 6158 - protein, 24 aa, artificial
  peptide fold or domain or sub-domain
GIEQQDVFTQDLFGLKTVYDAGKV

SEQ ID NO: 6159 - protein, 21 aa, artificial
  peptide fold or domain or sub-domain
GIETEGTDSFILDSPHVHAGS

SEQ ID NO: 6160 - protein, 26 aa, artificial
  peptide fold or domain or sub-domain
GIETPLPKKELLLPGNNRKVYELSNV

SEQ ID NO: 6161 - protein, 24 aa, artificial
  peptide fold or domain or sub-domain
GIFKGIREDGELILDLEGQEMTFS

SEQ ID NO: 6162 - protein, 27 aa, artificial
  peptide fold or domain or sub-domain
GIFRKLYFSDINLNNPISLLKMWLIFI

SEQ ID NO: 6163 - protein, 30 aa, artificial
  peptide fold or domain or sub-domain
GIFSFFIYGANTYGLDKLTFDERYQWVIDN

SEQ ID NO: 6164 - protein, 24 aa, artificial
  peptide fold or domain or sub-domain
GIFSRRATLDTKTPVFDVADVDKH

SEQ ID NO: 6165 - protein, 25 aa, artificial
  peptide fold or domain or sub-domain
GIGEIWNDGQYIPAEQALKMHNFEP

SEQ ID NO: 6166 - protein, 20 aa, artificial
  peptide fold or domain or sub-domain
GIGIKDGRVISLDGVLEHDY

SEQ ID NO: 6167 - protein, 25 aa, artificial
  peptide fold or domain or sub-domain
GIGQVSYRGQIVAAEQALNEEGLAP

SEQ ID NO: 6168 - protein, 29 aa, artificial
  peptide fold or domain or sub-domain
GIGVNAQYSIRRQADYLIDNNNLSELLDI

SEQ ID NO: 6169 - protein, 24 aa, artificial
  peptide fold or domain or sub-domain
GIHEMLKHLPEVDADKDIYKHAMH

SEQ ID NO: 6170 - protein, 21 aa, artificial
  peptide fold or domain or sub-domain
GIHVTAVEPGSFRTDFLDTTS

SEQ ID NO: 6171 - protein, 27 aa, artificial
  peptide fold or domain or sub-domain
GIIIIVNKEKSEVAKVAGIDKEGKFAI

SEQ ID NO: 6172 - protein, 30 aa, artificial
  peptide fold or domain or sub-domain
GIIKSFGEKTIHVSIEGEGEIDVDFNMCFN

SEQ ID NO: 6173 - protein, 29 aa, artificial
  peptide fold or domain or sub-domain
GIKDATADMEQLVHTIAACEGRIEFYSGD

SEQ ID NO: 6174 - protein, 29 aa, artificial
  peptide fold or domain or sub-domain
GIKDATGDIPRGQALIEGLNGKMAVYSGD

SEQ ID NO: 6175 - protein, 29 aa, artificial
  peptide fold or domain or sub-domain
GIKDSSGDMRFFSRIIRHKNEKFDIFQGQ

SEQ ID NO: 6176 - protein, 29 aa, artificial
  peptide fold or domain or sub-domain
GIKDSSGSIGRIAELVRRVGDKINILAGT

SEQ ID NO: 6177 - protein, 29 aa, artificial
  peptide fold or domain or sub-domain
GIKDSSKDLSRVKKIKFFSKKNFCLLCGD

SEQ ID NO: 6178 - protein, 29 aa, artificial
  peptide fold or domain or sub-domain
GIKEATGNLTRVNQIKELVSDDFVLLSGD

SEQ ID NO: 6179 - protein, 25 aa, artificial
  peptide fold or domain or sub-domain
GIKRTPINALLKISDTELVGEKAAI

SEQ ID NO: 6180 - protein, 23 aa, artificial
  peptide fold or domain or sub-domain
GILAGRHATVYRSPAAVAEMKKA

SEQ ID NO: 6181 - protein, 29 aa, artificial
  peptide fold or domain or sub-domain
GILFHAPENVIREFPQFPAVHTYEDLKRE

SEQ ID NO: 6182 - protein, 29 aa, artificial
  peptide fold or domain or sub-domain
GILKRITELLISDNVSIQVPALRTIGNIT

SEQ ID NO: 6183 - protein, 26 aa, artificial
  peptide fold or domain or sub-domain
GILLLVKAALKNGETAEQLQKMMTEF

SEQ ID NO: 6184 - protein, 30 aa, artificial
  peptide fold or domain or sub-domain
GILLPHVIRFNATDDATPFVAIAAALGLEE

SEQ ID NO: 6185 - protein, 26 aa, artificial
  peptide fold or domain or sub-domain
GILMRSLGGNPTESQLKSIITTENLS

SEQ ID NO: 6186 - protein, 24 aa, artificial
  peptide fold or domain or sub-domain
GILRGIQADGTLQIETETGLKAFH

SEQ ID NO: 6187 - protein, 23 aa, artificial
  peptide fold or domain or sub-domain
GILRLTLNVMLTEPKDERRLQSV

SEQ ID NO: 6188 - protein, 30 aa, artificial
  peptide fold or domain or sub-domain
GILTSQEMSKLAKLPESVFTDKIGIKQKPI

SEQ ID NO: 6189 - protein, 20 aa, artificial
  peptide fold or domain or sub-domain
GINFEEEVNLHQFVNQYKYM

SEQ ID NO: 6190 - protein, 29 aa, artificial
  peptide fold or domain or sub-domain
GINFEEEVNLHQFVNQYKYMGFQATNLGI

SEQ ID NO: 6191 - protein, 30 aa, artificial
  peptide fold or domain or sub-domain
GINLSDIRCIANELEAIGAMVELYDGSIVI

SEQ ID NO: 6192 - protein, 21 aa, artificial
  peptide fold or domain or sub-domain
GINVMTVEPSAFRTEWAGSSN

SEQ ID NO: 6193 - protein, 29 aa, artificial
  peptide fold or domain or sub-domain
GIPTSINNNVLKRYFQGKKREHIITSSEL

SEQ ID NO: 6194 - protein, 30 aa, artificial
  peptide fold or domain or sub-domain
GIQKLITNPSCFFENGYMAGEQFKMIKSAK

SEQ ID NO: 6195 - protein, 28 aa, artificial
  peptide fold or domain or sub-domain
GIQPDLIYTSEEADAPQYMEHLGIETVL

SEQ ID NO: 6196 - protein, 21 aa, artificial
  peptide fold or domain or sub-domain
GIQVVMIEPGSYDTDIWTRNA

SEQ ID NO: 6197 - protein, 22 aa, artificial
  peptide fold or domain or sub-domain
GIREISEEFKARGEFLKMHAVQ

SEQ ID NO: 6198 - protein, 22 aa, artificial
  peptide fold or domain or sub-domain
GIRELGEQAKEAGDYLFSHLIQ

SEQ ID NO: 6199 - protein, 30 aa, artificial
  peptide fold or domain or sub-domain
GISILDCNFGNLEEELGELKRNGVTNIHLD

SEQ ID NO: 6200 - protein, 21 aa, artificial
  peptide fold or domain or sub-domain
GISNGVPRLHELPPAKAREQY

SEQ ID NO: 6201 - protein, 24 aa, artificial
  peptide fold or domain or sub-domain
GISQGIDNDGALKIKTRKETKKIF

SEQ ID NO: 6202 - protein, 24 aa, artificial
  peptide fold or domain or sub-domain
GISRGIDKQGALLLEQDGIIKPWM

SEQ ID NO: 6203 - protein, 30 aa, artificial
  peptide fold or domain or sub-domain
GISSGPYRYGNVSLKVGDAPFNVEWNRERI

SEQ ID NO: 6204 - protein, 20 aa, artificial
  peptide fold or domain or sub-domain
GISSSKVRELIGLRLSPRFL

SEQ ID NO: 6205 - protein, 22 aa, artificial
  peptide fold or domain or sub-domain
GISTKDAMCETCGQGLNECIGH

SEQ ID NO: 6206 - protein, 24 aa, artificial
  peptide fold or domain or sub-domain
GISTLLEGNEKFVNGTFTEEKEQF

SEQ ID NO: 6207 - protein, 29 aa, artificial
  peptide fold or domain or sub-domain
GISVSYGPNTDSSDRNTIELSSIETQYHL

SEQ ID NO: 6208 - protein, 22 aa, artificial
  peptide fold or domain or sub-domain
GITTVSLQRTWLGMQEASGVGT

SEQ ID NO: 6209 - protein, 21 aa, artificial
  peptide fold or domain or sub-domain
GITWESLKEKGWQKLSLPSAP

SEQ ID NO: 6210 - protein, 28 aa, artificial
  peptide fold or domain or sub-domain
GIVGFNAFCSKHASGEGAMKIVNLLNDL

SEQ ID NO: 6211 - protein, 28 aa, artificial
  peptide fold or domain or sub-domain
GIVIRANSPEELRKKLRGVKRRAIVGII

SEQ ID NO: 6212 - protein, 20 aa, artificial
  peptide fold or domain or sub-domain
GIVLMWLRDIMKFKDYNDII

SEQ ID NO: 6213 - protein, 29 aa, artificial
  peptide fold or domain or sub-domain
GIVLVLDANDQYWPTLNCNSIPNLHVVNG

SEQ ID NO: 6214 - protein, 27 aa, artificial
  peptide fold or domain or sub-domain
GIVLVVDPENSRVASTLGITTKGKYAI

SEQ ID NO: 6215 - protein, 25 aa, artificial
  peptide fold or domain or sub-domain
GIVNILKLLPQDHPQRPRLETLYLE

SEQ ID NO: 6216 - protein, 30 aa, artificial
  peptide fold or domain or sub-domain
GIVPEHLSSFLLKLEEMGTKFKIEGDKLEV

SEQ ID NO: 6217 - protein, 22 aa, artificial
  peptide fold or domain or sub-domain
GIVSMTNGSMFSSSEEEEGTGS

SEQ ID NO: 6218 - protein, 22 aa, artificial
  peptide fold or domain or sub-domain
GIWEALKAKVMGAEAPKEPRGV

SEQ ID NO: 6219 - protein, 29 aa, artificial
  peptide fold or domain or sub-domain
GIWGEWENSWDFIENDGVPEGQAGYEKRT

SEQ ID NO: 6220 - protein, 22 aa, artificial
  peptide fold or domain or sub-domain
GIYDYLQEKGYSDCAWEIVRVE

SEQ ID NO: 6221 - protein, 28 aa, artificial
  peptide fold or domain or sub-domain
GKADIMELLNHSDSRVKYEALKATQAII

SEQ ID NO: 6222 - protein, 30 aa, artificial
  peptide fold or domain or sub-domain
GKAFEAKVPTITIDGATGASDECRMSLTSQ

SEQ ID NO: 6223 - protein, 24 aa, artificial
  peptide fold or domain or sub-domain
GKAIDISDTGALIVRTDEGSKSFA

SEQ ID NO: 6224 - protein, 24 aa, artificial
  peptide fold or domain or sub-domain
GKALGIDDEGVLLLETNEGIKKIY

SEQ ID NO: 6225 - protein, 21 aa, artificial
  peptide fold or domain or sub-domain
GKCKYKDCSHLGVQGCAVTGG

SEQ ID NO: 6226 - protein, 28 aa, artificial
  peptide fold or domain or sub-domain
GKCLVASLGGKKLPKGALIDSDGTLSDD

SEQ ID NO: 6227 - protein, 28 aa, artificial
  peptide fold or domain or sub-domain
GKCVICGKPIEPARLEAIPWTPYCKADQ

SEQ ID NO: 6228 - protein, 28 aa, artificial
  peptide fold or domain or sub-domain
GKDFVERSKRRYSEKIMDEPVFRSMSHW

SEQ ID NO: 6229 - protein, 27 aa, artificial
  peptide fold or domain or sub-domain
GKDGRREQASLSRRGFLVTSLGAGVMF

SEQ ID NO: 6230 - protein, 21 aa, artificial
  peptide fold or domain or sub-domain
GKEIAELLGMDGDKIFPYKRG

SEQ ID NO: 6231 - protein, 27 aa, artificial
  peptide fold or domain or sub-domain
GKELQNLDFPKIPKSTEVKEFISQAVL

SEQ ID NO: 6232 - protein, 29 aa, artificial
  peptide fold or domain or sub-domain
GKELTELTQDEDTVVAKVVGADGVEEIVA

SEQ ID NO: 6233 - protein, 30 aa, artificial
  peptide fold or domain or sub-domain
GKEWAARAVGAAFGGTKQSYAARSQWTYEN

SEQ ID NO: 6234 - protein, 29 aa, artificial
  peptide fold or domain or sub-domain
GKFKFDSQFPSDDNRSGNEDFSGERLKKN

SEQ ID NO: 6235 - protein, 24 aa, artificial
  peptide fold or domain or sub-domain
GKFQYFAPASSLFGVQMLLFAWAE

SEQ ID NO: 6236 - protein, 30 aa, artificial
  peptide fold or domain or sub-domain
GKFRARIQVAKKFVHIGMFATAEEAHAAYM

SEQ ID NO: 6237 - protein, 29 aa, artificial
  peptide fold or domain or sub-domain
GKFRRGQPIPEGTRVAERGRDDKRLSEPL

SEQ ID NO: 6238 - protein, 29 aa, artificial
  peptide fold or domain or sub-domain
GKFSKDTTFEQDDHRNFNRNGEAFNVGET

SEQ ID NO: 6239 - protein, 20 aa, artificial
  peptide fold or domain or sub-domain
GKGGEGKFDSREAQQKYRED

SEQ ID NO: 6240 - protein, 26 aa, artificial
  peptide fold or domain or sub-domain
GKGLQEIGLIPKILTNQALTRAAYQF

SEQ ID NO: 6241 - protein, 25 aa, artificial
  peptide fold or domain or sub-domain
GKGMVKYNEKLMNASDALKITSIEP

SEQ ID NO: 6242 - protein, 28 aa, artificial
  peptide fold or domain or sub-domain
GKGQCRPGDSMATNNSTQKVQKETQGRF

SEQ ID NO: 6243 - protein, 21 aa, artificial
  peptide fold or domain or sub-domain
GKGYKYGKDIITFGTEDEKQM

SEQ ID NO: 6244 - protein, 21 aa, artificial
  peptide fold or domain or sub-domain
GKHFKKLDKSGDGTLDKDELQ

SEQ ID NO: 6245 - protein, 28 aa, artificial
  peptide fold or domain or sub-domain
GKHWSENEEIKKFKEKHQLKNNHELQTH

SEQ ID NO: 6246 - protein, 25 aa, artificial
  peptide fold or domain or sub-domain
GKIATYALMGREGYDARRHEIEQAR

SEQ ID NO: 6247 - protein, 24 aa, artificial
  peptide fold or domain or sub-domain
GKIELEQPQYLGFPIQLTVTQLTI

SEQ ID NO: 6248 - protein, 28 aa, artificial
  peptide fold or domain or sub-domain
GKIEMYAREGKKCQPGWVCDRSGKVLSE

SEQ ID NO: 6249 - protein, 29 aa, artificial
  peptide fold or domain or sub-domain
GKIGGDSTFDSTDFRSTLPRFAPEALKAN

SEQ ID NO: 6250 - protein, 28 aa, artificial
  peptide fold or domain or sub-domain
GKIGNDYFAEMITNYLRKENLDLCLTYG

SEQ ID NO: 6251 - protein, 29 aa, artificial
  peptide fold or domain or sub-domain
GKIGPDRVFEGDDQRKDNPRFSIANREKV

SEQ ID NO: 6252 - protein, 28 aa, artificial
  peptide fold or domain or sub-domain
GKIGQDRFGELATAELRAEGVRAEVLAS

SEQ ID NO: 6253 - protein, 28 aa, artificial
  peptide fold or domain or sub-domain
GKILEALRKKIKIPEGCAVDKDGKPTTD

SEQ ID NO: 6254 - protein, 30 aa, artificial
  peptide fold or domain or sub-domain
GKILSTSGEESVISLPEGKVIKVISETLVP

SEQ ID NO: 6255 - protein, 22 aa, artificial
  peptide fold or domain or sub-domain
GKINQKEFNQLSESEYAGTDVM

SEQ ID NO: 6256 - protein, 28 aa, artificial
  peptide fold or domain or sub-domain
GKIQLAVARGDKIPTGWIIDAEGRHTND

SEQ ID NO: 6257 - protein, 30 aa, artificial
  peptide fold or domain or sub-domain
GKIQSTSADTSLVMLSTANVVKVSTEELFP

SEQ ID NO: 6258 - protein, 28 aa, artificial
  peptide fold or domain or sub-domain
GKIQVLAKKGAQIPGDWAVDEHRQVLHD

SEQ ID NO: 6259 - protein, 28 aa, artificial
  peptide fold or domain or sub-domain
GKIRNKMNENASMPIGWGTDSNGEPTTD

SEQ ID NO: 6260 - protein, 29 aa, artificial
  peptide fold or domain or sub-domain
GKISLGVEVREEAAQHHREEGRNVIAGDA

SEQ ID NO: 6261 - protein, 30 aa, artificial
  peptide fold or domain or sub-domain
GKITDHLKSGHLKETQTQIAADKTVQIVCG

SEQ ID NO: 6262 - protein, 23 aa, artificial
  peptide fold or domain or sub-domain
GKITKIIDGDTVIVDNQGQRLKV

SEQ ID NO: 6263 - protein, 29 aa, artificial
  peptide fold or domain or sub-domain
GKIVLIGRRCFTVEDGVERTKVLVKADEF

SEQ ID NO: 6264 - protein, 28 aa, artificial
  peptide fold or domain or sub-domain
GKIVVVTSETTNMVHWINTETYENFDNT

SEQ ID NO: 6265 - protein, 28 aa, artificial
  peptide fold or domain or sub-domain
GKIYHARQTNMPIPETWAITSEGAPTTD

SEQ ID NO: 6266 - protein, 27 aa, artificial
  peptide fold or domain or sub-domain
GKKDKAIFLDTLEMRYEYVPLELGDYT

SEQ ID NO: 6267 - protein, 28 aa, artificial
  peptide fold or domain or sub-domain
GKKLYVANGKSNSVTVVDTVADKALKEI

SEQ ID NO: 6268 - protein, 27 aa, artificial
  peptide fold or domain or sub-domain
GKLDGTGCSLHRGNLHPLDRSPAAKKI

SEQ ID NO: 6269 - protein, 28 aa, artificial
  peptide fold or domain or sub-domain
GKLEILQRKNLDAPLGWIQDKNGVTTPN

SEQ ID NO: 6270 - protein, 28 aa, artificial
  peptide fold or domain or sub-domain
GKLEVYRRKGEEIPEGWAINSKGEITRS

SEQ ID NO: 6271 - protein, 24 aa, artificial
  peptide fold or domain or sub-domain
GKLIRERALDSTSLGVAHQAKARE

SEQ ID NO: 6272 - protein, 28 aa, artificial
  peptide fold or domain or sub-domain
GKLKLAQRAETELPEGWALTRQGTPQRD

SEQ ID NO: 6273 - protein, 28 aa, artificial
  peptide fold or domain or sub-domain
GKLLLSADRDDDSVSVVDTATRARKAVI

SEQ ID NO: 6274 - protein, 28 aa, artificial
  peptide fold or domain or sub-domain
GKLRVARDRGEQVAEGLVLDAAGRPSTT

SEQ ID NO: 6275 - protein, 25 aa, artificial
  peptide fold or domain or sub-domain
GKLVKHLGGENYMFRDASGEVEVEV

SEQ ID NO: 6276 - protein, 23 aa, artificial
  peptide fold or domain or sub-domain
GKMAQLANYKLCNAFHYRVLDVL

SEQ ID NO: 6277 - protein, 29 aa, artificial
  peptide fold or domain or sub-domain
GKMSLDQKFEPHDSRPKYPCFRGEEYAKN

SEQ ID NO: 6278 - protein, 28 aa, artificial
  peptide fold or domain or sub-domain
GKNLICADREDNQISILDPVHFKHLASI

SEQ ID NO: 6279 - protein, 27 aa, artificial
  peptide fold or domain or sub-domain
GKPGFCDNMQPPAITLRAHSTPIGITF

SEQ ID NO: 6280 - protein, 28 aa, artificial
  peptide fold or domain or sub-domain
GKPIDVVFCGSDYDENSFWKQCYPESEL

SEQ ID NO: 6281 - protein, 23 aa, artificial
  peptide fold or domain or sub-domain
GKPVVAEDEDALAVMLGFEDAAA

SEQ ID NO: 6282 - protein, 28 aa, artificial
  peptide fold or domain or sub-domain
GKQGQEILRTNNAFEYAVGVGAASNPKL

SEQ ID NO: 6283 - protein, 28 aa, artificial
  peptide fold or domain or sub-domain
GKQIVMQHLGHEDPNVRYEALLAVQKLM

SEQ ID NO: 6284 - protein, 28 aa, artificial
  peptide fold or domain or sub-domain
GKQVYICIRAESWVDIVDTASLQRVKRV

SEQ ID NO: 6285 - protein, 28 aa, artificial
  peptide fold or domain or sub-domain
GKQVYVTNMASSTLSVIDTTSNTVAGTV

SEQ ID NO: 6286 - protein, 27 aa, artificial
  peptide fold or domain or sub-domain
GKREDLAIFTPDYWVDDLRSLSALAAT

SEQ ID NO: 6287 - protein, 27 aa, artificial
  peptide fold or domain or sub-domain
GKRKRLLTYLYKKDFLKYKFVIQSLGI

SEQ ID NO: 6288 - protein, 25 aa, artificial
  peptide fold or domain or sub-domain
GKRLANARLGAPGYDTETADLGAFL

SEQ ID NO: 6289 - protein, 28 aa, artificial
  peptide fold or domain or sub-domain
GKRLWVSAEVGGTVSVIDPQTRQIIRKI

SEQ ID NO: 6290 - protein, 27 aa, artificial
  peptide fold or domain or sub-domain
GKRRRLLAYLRNKDVARYREIVEKLGL

SEQ ID NO: 6291 - protein, 24 aa, artificial
  peptide fold or domain or sub-domain
GKRWARNSWKLANGEDAKLKEPVK

SEQ ID NO: 6292 - protein, 30 aa, artificial
  peptide fold or domain or sub-domain
GKSGGGDEFSRKGDQTLAPDFHIIGEHVRG

SEQ ID NO: 6293 - protein, 28 aa, artificial
  peptide fold or domain or sub-domain
GKSLYVSNEDDALLSAFDVASGRKLFEV

SEQ ID NO: 6294 - protein, 27 aa, artificial
  peptide fold or domain or sub-domain
GKSWRPHFNDVVNEGVGLPRSAQKLVE

SEQ ID NO: 6295 - protein, 23 aa, artificial
  peptide fold or domain or sub-domain
GKSYDLTLRRWYETFNDKWDQVA

SEQ ID NO: 6296 - protein, 28 aa, artificial
  peptide fold or domain or sub-domain
GKTIVVANWGDNALSLIDPSSLTVTGTI

SEQ ID NO: 6297 - protein, 28 aa, artificial
  peptide fold or domain or sub-domain
GKTIYTSNEDDALLTVIDIATRTVKTQI

SEQ ID NO: 6298 - protein, 30 aa, artificial
  peptide fold or domain or sub-domain
GKTTLSRHIDYLTADQEKEEIIASAGFVLD

SEQ ID NO: 6299 - protein, 28 aa, artificial
  peptide fold or domain or sub-domain
GKVADDREGGLLRSNLSSEGVTDFTVVA

SEQ ID NO: 6300 - protein, 29 aa, artificial
  peptide fold or domain or sub-domain
GKVAQNTEYQEGDFRGQMGRFKPEVMAQN

SEQ ID NO: 6301 - protein, 27 aa, artificial
  peptide fold or domain or sub-domain
GKVAVIHPKPPVRVEALEMPGGVFVVL

SEQ ID NO: 6302 - protein, 28 aa, artificial
  peptide fold or domain or sub-domain
GKVEEYRLNGKKLPIPGGYDENDEITND

SEQ ID NO: 6303 - protein, 28 aa, artificial
  peptide fold or domain or sub-domain
GKVELAARKENPVPLSWGVGAGGKETVD

SEQ ID NO: 6304 - protein, 28 aa, artificial
  peptide fold or domain or sub-domain
GKVEVYSKNNQKLNYGWAMDDEGRKTDN

SEQ ID NO: 6305 - protein, 25 aa, artificial
  peptide fold or domain or sub-domain
GKVIGYTEKAEAVAIILNNNPEFIT

SEQ ID NO: 6306 - protein, 23 aa, artificial
  peptide fold or domain or sub-domain
GKVIHIADGDTLTVMVNNTQHKI

SEQ ID NO: 6307 - protein, 28 aa, artificial
  peptide fold or domain or sub-domain
GKVKTLLQSGGKMPEGWMIDKQGNPLTD

SEQ ID NO: 6308 - protein, 26 aa, artificial
  peptide fold or domain or sub-domain
GKVKWFNNEKGYGFIEVEGGSDVFVH

SEQ ID NO: 6309 - protein, 23 aa, artificial
  peptide fold or domain or sub-domain
GKVLHIKDGDTIDVNVKRQKQTV

SEQ ID NO: 6310 - protein, 22 aa, artificial
  peptide fold or domain or sub-domain
GKVNAEDLKTLQKKGYQADDPV

SEQ ID NO: 6311 - protein, 29 aa, artificial
  peptide fold or domain or sub-domain
GKVTPQDQFGFDDVRKFVPQLSKENIEAN

SEQ ID NO: 6312 - protein, 23 aa, artificial
  peptide fold or domain or sub-domain
GKVVGVTDGDTLTIMKGGRGAKV

SEQ ID NO: 6313 - protein, 30 aa, artificial
  peptide fold or domain or sub-domain
GKVVPEYLNRWQLITPDDLGRPCAQVWAEK

SEQ ID NO: 6314 - protein, 28 aa, artificial
  peptide fold or domain or sub-domain
GKWIAAANEEDNSVAVIDTDSHKVSFII

SEQ ID NO: 6315 - protein, 28 aa, artificial
  peptide fold or domain or sub-domain
GKWMYVSAEEAKYVDVVDVAKRSSIKLV

SEQ ID NO: 6316 - protein, 27 aa, artificial
  peptide fold or domain or sub-domain
GKYIAHHTGTIAKKIENVNTVSLEIEK

SEQ ID NO: 6317 - protein, 28 aa, artificial
  peptide fold or domain or sub-domain
GKYIFVSDQKQNALLVIDLKTKKVTDKI

SEQ ID NO: 6318 - protein, 29 aa, artificial
  peptide fold or domain or sub-domain
GKYNSSNPPQNARFSRYLNSGERQKKMAH

SEQ ID NO: 6319 - protein, 29 aa, artificial
  peptide fold or domain or sub-domain
GKYSRHGNNETARTRSYPVMKSRYFKDYD

SEQ ID NO: 6320 - protein, 29 aa, artificial
  peptide fold or domain or sub-domain
GKYTEDFKLNEGDWRQSVNLFEENTYKSN

SEQ ID NO: 6321 - protein, 29 aa, artificial
  peptide fold or domain or sub-domain
GKYTEDTTFPEGDLRNEQEHFKGERFKEN

SEQ ID NO: 6322 - protein, 29 aa, artificial
  peptide fold or domain or sub-domain
GKYTPSNLPTFEDVRRNDPLFTPQNLKLV

SEQ ID NO: 6323 - protein, 29 aa, artificial
  peptide fold or domain or sub-domain
GKYTTDATFPADDIRSQITDLKEPRYSTI

SEQ ID NO: 6324 - protein, 30 aa, artificial
  peptide fold or domain or sub-domain
GLAAAIYSNDLSRVHTLIPRLHAGSIYVNA

SEQ ID NO: 6325 - protein, 30 aa, artificial
  peptide fold or domain or sub-domain
GLAAGVFTKNLDTANRVSRALKAGTVWVNC

SEQ ID NO: 6326 - protein, 30 aa, artificial
  peptide fold or domain or sub-domain
GLAATVWSSNVGRVHRVAKKLQSGLVWTNC

SEQ ID NO: 6327 - protein, 30 aa, artificial
  peptide fold or domain or sub-domain
GLAAYAVTQNAGNVEKFVREVKAGSFYINQ

SEQ ID NO: 6328 - protein, 30 aa, artificial
  peptide fold or domain or sub-domain
GLAAYIFTNSVQRSWRVFEALEYGLVGVNE

SEQ ID NO: 6329 - protein, 29 aa, artificial
  peptide fold or domain or sub-domain
GLAEFQQKLASATTDLEKAEAQIGVEVHS

SEQ ID NO: 6330 - protein, 30 aa, artificial
  peptide fold or domain or sub-domain
GLAGSVYTTDIDHGLAVAKQIRTGTYAINW

SEQ ID NO: 6331 - protein, 30 aa, artificial
  peptide fold or domain or sub-domain
GLAGVVWTNDLRRAQRVVSQIDSGLLWINC

SEQ ID NO: 6332 - protein, 30 aa, artificial
  peptide fold or domain or sub-domain
GLAGYFYSQNISTIFDAAEKLNVGMVGVNT

SEQ ID NO: 6333 - protein, 24 aa, artificial
  peptide fold or domain or sub-domain
GLAKEIGDHGELIVQTNEQKMSLS

SEQ ID NO: 6334 - protein, 25 aa, artificial
  peptide fold or domain or sub-domain
GLAKVLKDLPETDKYRQEYIDRFRT

SEQ ID NO: 6335 - protein, 27 aa, artificial
  peptide fold or domain or sub-domain
GLALKNMANTQFSKANFDIALEKYSKA

SEQ ID NO: 6336 - protein, 27 aa, artificial
  peptide fold or domain or sub-domain
GLASQSVGMSLDYNGSYNSPPQPSQPP

SEQ ID NO: 6337 - protein, 30 aa, artificial
  peptide fold or domain or sub-domain
GLAWLKVQLSNVYGFDKASLQEREDFATNN

SEQ ID NO: 6338 - protein, 30 aa, artificial
  peptide fold or domain or sub-domain
GLAYLEHNNLLAAGEFVSKPEFQDFNIIEI

SEQ ID NO: 6339 - protein, 28 aa, artificial
  peptide fold or domain or sub-domain
GLCCACHSDLEPELLNADPAVVFCQECA

SEQ ID NO: 6340 - protein, 28 aa, artificial
  peptide fold or domain or sub-domain
GLCEHCQKEIPLGRLEALPFTTVCTECS

SEQ ID NO: 6341 - protein, 30 aa, artificial
  peptide fold or domain or sub-domain
GLCGMDDTMGDFLEDGYIDGDQATEIRAEI

SEQ ID NO: 6342 - protein, 28 aa, artificial
  peptide fold or domain or sub-domain
GLCSDCEEPLAIEQLEQDPTLQRCPRCE

SEQ ID NO: 6343 - protein, 26 aa, artificial
  peptide fold or domain or sub-domain
GLDAMQVFGGTGVSSAAGVDRLLLDS

SEQ ID NO: 6344 - protein, 23 aa, artificial
  peptide fold or domain or sub-domain
GLDQWISGLDQQDASAFTQIRQR

SEQ ID NO: 6345 - protein, 24 aa, artificial
  peptide fold or domain or sub-domain
GLDTLCEAAGPLRWFQLYMLRDRG

SEQ ID NO: 6346 - protein, 26 aa, artificial
  peptide fold or domain or sub-domain
GLDVLKKLEKNHEMSEDDQKRHADEV

SEQ ID NO: 6347 - protein, 27 aa, artificial
  peptide fold or domain or sub-domain
GLEKNADGDWRDSAMGKKYSHRYGFGK

SEQ ID NO: 6348 - protein, 29 aa, artificial
  peptide fold or domain or sub-domain
GLEQGDVRPLALAATLEGLQLTVATPWGT

SEQ ID NO: 6349 - protein, 30 aa, artificial
  peptide fold or domain or sub-domain
GLESLEEYNSDKLKSSFKVFVNGCWIGTHK

SEQ ID NO: 6350 - protein, 28 aa, artificial
  peptide fold or domain or sub-domain
GLFEEIKENIGLNRNPTISDRSNLPLTD

SEQ ID NO: 6351 - protein, 30 aa, artificial
  peptide fold or domain or sub-domain
GLGAAIFTKDIERAHRVASEIEAGMVWINS

SEQ ID NO: 6352 - protein, 30 aa, artificial
  peptide fold or domain or sub-domain
GLGAGVWSRNGNLAYKMGRGIQAGRVWTNC

SEQ ID NO: 6353 - protein, 30 aa, artificial
  peptide fold or domain or sub-domain
GLGCLMDAGGWFVENDLLEGAKAKAIRKEV

SEQ ID NO: 6354 - protein, 25 aa, artificial
  peptide fold or domain or sub-domain
GLGDIEYQGQVRPAADVLAELGLSP

SEQ ID NO: 6355 - protein, 25 aa, artificial
  peptide fold or domain or sub-domain
GLGEAEYKGEIMSGKEAMDKAGIPI

SEQ ID NO: 6356 - protein, 25 aa, artificial
  peptide fold or domain or sub-domain
GLGEAVVNGERLSGAEALQRVGLRP

SEQ ID NO: 6357 - protein, 30 aa, artificial
  peptide fold or domain or sub-domain
GLGSGLWTRDVSKAHAVAKSLRAGSVWVNC

SEQ ID NO: 6358 - protein, 30 aa, artificial
  peptide fold or domain or sub-domain
GLGSGVFSTNPKTLEFFSNNIEAGMCSLNN

SEQ ID NO: 6359 - protein, 27 aa, artificial
  peptide fold or domain or sub-domain
GLGSVLIPKENGGAGKGLRLACEILYH

SEQ ID NO: 6360 - protein, 27 aa, artificial
  peptide fold or domain or sub-domain
GLHGTQIEKLETLATELGDRVKLFPAN

SEQ ID NO: 6361 - protein, 25 aa, artificial
  peptide fold or domain or sub-domain
GLHNAKEILTRLGVEPSDDDCVSVQ

SEQ ID NO: 6362 - protein, 27 aa, artificial
  peptide fold or domain or sub-domain
GLIAAGHDEALGGMRLPKLVEAASFLF

SEQ ID NO: 6363 - protein, 24 aa, artificial
  peptide fold or domain or sub-domain
GLIDNHTLSRDPNCPRDFVDSFLN

SEQ ID NO: 6364 - protein, 22 aa, artificial
  peptide fold or domain or sub-domain
GLIGGNSLWSRHYEARAAREPD

SEQ ID NO: 6365 - protein, 30 aa, artificial
  peptide fold or domain or sub-domain
GLKALKIYTANAFGLDKRSKEERLDWVEQN

SEQ ID NO: 6366 - protein, 30 aa, artificial
  peptide fold or domain or sub-domain
GLKEAEEAGPVPPEWMFEDVFAEKPWHLLR

SEQ ID NO: 6367 - protein, 25 aa, artificial
  peptide fold or domain or sub-domain
GLKEALREHKDLLSKDIVEKGNRLV

SEQ ID NO: 6368 - protein, 22 aa, artificial
  peptide fold or domain or sub-domain
GLKEIIKDGSDPYNGQLLLQKL

SEQ ID NO: 6369 - protein, 22 aa, artificial
  peptide fold or domain or sub-domain
GLKELFKRGKNPSDGRALVESI

SEQ ID NO: 6370 - protein, 29 aa, artificial
  peptide fold or domain or sub-domain
GLKHSSKDLEYLSHLFLEAGRDFLVFCGL

SEQ ID NO: 6371 - protein, 25 aa, artificial
  peptide fold or domain or sub-domain
GLKIGDLEIFIERHLVIRNGVALDF

SEQ ID NO: 6372 - protein, 30 aa, artificial
  peptide fold or domain or sub-domain
GLKWYETEYNCLPENYQNDEFEKIYKKACD

SEQ ID NO: 6373 - protein, 30 aa, artificial
  peptide fold or domain or sub-domain
GLLEATQKKARFLSEITVKLGLSGVEIISQ

SEQ ID NO: 6374 - protein, 24 aa, artificial
  peptide fold or domain or sub-domain
GLLEIASQLDESDPERQRFIDAAK

SEQ ID NO: 6375 - protein, 24 aa, artificial
  peptide fold or domain or sub-domain
GLLELIESGLLDKTEKNLYQSAVW

SEQ ID NO: 6376 - protein, 24 aa, artificial
  peptide fold or domain or sub-domain
GLLELSRQLPLNDEKHGYYEKVAL

SEQ ID NO: 6377 - protein, 24 aa, artificial
  peptide fold or domain or sub-domain
GLLEMKKLKLLKPELLEVYERAAN

SEQ ID NO: 6378 - protein, 25 aa, artificial
  peptide fold or domain or sub-domain
GLLEYLEIAELEKGIKDYLLDTWHS

SEQ ID NO: 6379 - protein, 27 aa, artificial
  peptide fold or domain or sub-domain
GLLKNVDPNGTSLTLTLSDGVDAQVNL

SEQ ID NO: 6380 - protein, 30 aa, artificial
  peptide fold or domain or sub-domain
GLLLPKVVEFNSVVQPEKAAKIAELLGRKG

SEQ ID NO: 6381 - protein, 30 aa, artificial
  peptide fold or domain or sub-domain
GLLTFVKQNGHLPALHSQEDAEKLLHIVKD

SEQ ID NO: 6382 - protein, 23 aa, artificial
  peptide fold or domain or sub-domain
GLLTGKKATVFPDDEAIAVLQQK

SEQ ID NO: 6383 - protein, 30 aa, artificial
  peptide fold or domain or sub-domain
GLLTSAELDTRFGHEDGYIEQITGIRTRLK

SEQ ID NO: 6384 - protein, 29 aa, artificial
  peptide fold or domain or sub-domain
GLMVVVAEGDLAWSSWTEVAGKPLLTCSG

SEQ ID NO: 6385 - protein, 30 aa, artificial
  peptide fold or domain or sub-domain
GLNIIINDLGTFREGDFVESDTAKQMKDRV

SEQ ID NO: 6386 - protein, 24 aa, artificial
  peptide fold or domain or sub-domain
GLNLNIDEQGNLIIDSGDSIECLN

SEQ ID NO: 6387 - protein, 24 aa, artificial
  peptide fold or domain or sub-domain
GLNSDQLVCAINAIESDVTGSITE

SEQ ID NO: 6388 - protein, 30 aa, artificial
  peptide fold or domain or sub-domain
GLNWLKVHLANLFGISKKDFATRQAFVDDN

SEQ ID NO: 6389 - protein, 25 aa, artificial
  peptide fold or domain or sub-domain
GLPLLLQTLPKEHPTYNYYLNIYKE

SEQ ID NO: 6390 - protein, 23 aa, artificial
  peptide fold or domain or sub-domain
GLPTGYKTIATSDNSPYCGIVHE

SEQ ID NO: 6391 - protein, 29 aa, artificial
  peptide fold or domain or sub-domain
GLPVMQWLAGATYFNEPSRLDGTELAEIL

SEQ ID NO: 6392 - protein, 26 aa, artificial
  peptide fold or domain or sub-domain
GLPWHNATRSLNLPKVREWKMYCRRA

SEQ ID NO: 6393 - protein, 26 aa, artificial
  peptide fold or domain or sub-domain
GLQEILKSCGIPKGSFYHYFPSKEAF

SEQ ID NO: 6394 - protein, 27 aa, artificial
  peptide fold or domain or sub-domain
GLQEYQSWLSEQNYKPTSKARMLSAIR

SEQ ID NO: 6395 - protein, 25 aa, artificial
  peptide fold or domain or sub-domain
GLQFVATLGPDAKETNARAIGPARL

SEQ ID NO: 6396 - protein, 20 aa, artificial
  peptide fold or domain or sub-domain
GLQKFREGYFSSHRDLFEQL

SEQ ID NO: 6397 - protein, 30 aa, artificial
  peptide fold or domain or sub-domain
GLQSSVFTRDINEAFYIANKLEVGTVHVNN

SEQ ID NO: 6398 - protein, 30 aa, artificial
  peptide fold or domain or sub-domain
GLQVGVFTNDVKLAWKCIKEIEAGGVLINE

SEQ ID NO: 6399 - protein, 21 aa, artificial
  peptide fold or domain or sub-domain
GLRIAELYRAEGKFEEAKKFE

SEQ ID NO: 6400 - protein, 21 aa, artificial
  peptide fold or domain or sub-domain
GLRQGDHYQMTLKSGLILRLE

SEQ ID NO: 6401 - protein, 29 aa, artificial
  peptide fold or domain or sub-domain
GLRVYCCGPESLLTAVGESMSHAPLGTVH

SEQ ID NO: 6402 - protein, 30 aa, artificial
  peptide fold or domain or sub-domain
GLRWLKIHMGNLYGLDKQTFEARVAFTEAH

SEQ ID NO: 6403 - protein, 30 aa, artificial
  peptide fold or domain or sub-domain
GLSASIYTKNIGNALEFIKDIEAGLIKVNA

SEQ ID NO: 6404 - protein, 30 aa, artificial
  peptide fold or domain or sub-domain
GLSATLWTSDLSRTMRMSNELEAGIVWVNT

SEQ ID NO: 6405 - protein, 23 aa, artificial
  peptide fold or domain or sub-domain
GLSCGRCERCLAGEDNLCPRYQI

SEQ ID NO: 6406 - protein, 30 aa, artificial
  peptide fold or domain or sub-domain
GLSCGRCERCLAGEDNLCPRYQILGEHRHG

SEQ ID NO: 6407 - protein, 28 aa, artificial
  peptide fold or domain or sub-domain
GLSDESGQPIPKERLEVMPEAILTVAEQ

SEQ ID NO: 6408 - protein, 30 aa, artificial
  peptide fold or domain or sub-domain
GLSDYPKNAFNMARYIDDCPYNITQHQLQL

SEQ ID NO: 6409 - protein, 20 aa, artificial
  peptide fold or domain or sub-domain
GLSGGAAAGEAAGTAGLDFF

SEQ ID NO: 6410 - protein, 30 aa, artificial
  peptide fold or domain or sub-domain
GLSSSIFTKDVNRVFKAQRDLDTGIVYVNA

SEQ ID NO: 6411 - protein, 29 aa, artificial
  peptide fold or domain or sub-domain
GLSVSTTDESLMNNIVAAADLLNLKSEFK

SEQ ID NO: 6412 - protein, 30 aa, artificial
  peptide fold or domain or sub-domain
GLTAGIATRSLRYAEEFIERSQTGLVNVNL

SEQ ID NO: 6413 - protein, 24 aa, artificial
  peptide fold or domain or sub-domain
GLTAQAQALTATANKYQALGNLLS

SEQ ID NO: 6414 - protein, 23 aa, artificial
  peptide fold or domain or sub-domain
GLTGPLLRHTTPPEVRLRIQEEL

SEQ ID NO: 6415 - protein, 24 aa, artificial
  peptide fold or domain or sub-domain
GLTKEIIEQGQKLGEIKPDIDAEA

SEQ ID NO: 6416 - protein, 27 aa, artificial
  peptide fold or domain or sub-domain
GLTNADVPAEYGGSEMDKVSSALIADH

SEQ ID NO: 6417 - protein, 30 aa, artificial
  peptide fold or domain or sub-domain
GLTSAVITNDLQMSIFFSENLESGMVHING

SEQ ID NO: 6418 - protein, 27 aa, artificial
  peptide fold or domain or sub-domain
GLVAFVDHGIPGQNNSAVEEMTPDIII

SEQ ID NO: 6419 - protein, 30 aa, artificial
  peptide fold or domain or sub-domain
GLVEEINENDLVVNCTSGKKVTINVGSAYP

SEQ ID NO: 6420 - protein, 25 aa, artificial
  peptide fold or domain or sub-domain
GLVEMLRELPAKSKYRPFYQELFQK

SEQ ID NO: 6421 - protein, 30 aa, artificial
  peptide fold or domain or sub-domain
GLVGAVFTKDINKSIIVSDQVQSGLVWVNS

SEQ ID NO: 6422 - protein, 25 aa, artificial
  peptide fold or domain or sub-domain
GLVGVFEESFKETDKEEALRKIIDP

SEQ ID NO: 6423 - protein, 24 aa, artificial
  peptide fold or domain or sub-domain
GLVHEFKEGKDELSEQDEMFRGRT

SEQ ID NO: 6424 - protein, 29 aa, artificial
  peptide fold or domain or sub-domain
GLVISLAVDDPYWAALPCAKDARIQRVDG

SEQ ID NO: 6425 - protein, 27 aa, artificial
  peptide fold or domain or sub-domain
GLVNGAHVGDKTFTLRSSDGVLVPVEL

SEQ ID NO: 6426 - protein, 25 aa, artificial
  peptide fold or domain or sub-domain
GLVRVLDALPPQDPSRPRFEKLYRD

SEQ ID NO: 6427 - protein, 29 aa, artificial
  peptide fold or domain or sub-domain
GLVTLLNYTLKYTSQGEQTELELEPGQAY

SEQ ID NO: 6428 - protein, 30 aa, artificial
  peptide fold or domain or sub-domain
GLWQIEEQQGYFLKYGYFTAEQMDKVQTSV

SEQ ID NO: 6429 - protein, 27 aa, artificial
  peptide fold or domain or sub-domain
GLYAANMPEEVGGAGLDTLSWLMYEKE

SEQ ID NO: 6430 - protein, 23 aa, artificial
  peptide fold or domain or sub-domain
GLYAPWKQSVHLIGSFNDWNQTA

SEQ ID NO: 6431 - protein, 30 aa, artificial
  peptide fold or domain or sub-domain
GLYIIREDFEFFRNSNYLKKGKAKAIIKLI

SEQ ID NO: 6432 - protein, 30 aa, artificial
  peptide fold or domain or sub-domain
GLYWIQVHVANCFGEDKARFDARAAWAVER

SEQ ID NO: 6433 - protein, 29 aa, artificial
  peptide fold or domain or sub-domain
GMAFHAKPVVEAQADAAIRFGGVENTLYA

SEQ ID NO: 6434 - protein, 25 aa, artificial
  peptide fold or domain or sub-domain
GMAKAQGMLEALGLQPSERDCCRVQ

SEQ ID NO: 6435 - protein, 30 aa, artificial
  peptide fold or domain or sub-domain
GMAVLLGTRDAAAGAQAAAALAAHGHAARA

SEQ ID NO: 6436 - protein, 20 aa, artificial
  peptide fold or domain or sub-domain
GMDFEKEWDFMAIMRSFETM

SEQ ID NO: 6437 - protein, 29 aa, artificial
  peptide fold or domain or sub-domain
GMDFEKEWDFMAIMRSFETMGFQGSNLYR

SEQ ID NO: 6438 - protein, 30 aa, artificial
  peptide fold or domain or sub-domain
GMDSLDEISPILIKDRVKIFLNGTWVGVFN

SEQ ID NO: 6439 - protein, 30 aa, artificial
  peptide fold or domain or sub-domain
GMDSSATGALSALGQASATLSSASDTTAAD

SEQ ID NO: 6440 - protein, 30 aa, artificial
  peptide fold or domain or sub-domain
GMEELMDDTCTPLFGKHKVLLNGDWVGLCA

SEQ ID NO: 6441 - protein, 30 aa, artificial
  peptide fold or domain or sub-domain
GMEPLEDYVPHQSPDATRVFVNGVWHGVHR

SEQ ID NO: 6442 - protein, 26 aa, artificial
  peptide fold or domain or sub-domain
GMEQTKALEKKSEISQDDMKTWTDAI

SEQ ID NO: 6443 - protein, 27 aa, artificial
  peptide fold or domain or sub-domain
GMFRAGGGGDEPGRKRAVLYQGIRVLQ

SEQ ID NO: 6444 - protein, 25 aa, artificial
  peptide fold or domain or sub-domain
GMFVALTKLGQPDAEQWNSRLDLLE

SEQ ID NO: 6445 - protein, 30 aa, artificial
  peptide fold or domain or sub-domain
GMGDAAMDGVRHIRDRFNVPVSDADIEKLP

SEQ ID NO: 6446 - protein, 24 aa, artificial
  peptide fold or domain or sub-domain
GMIRIYEVEKDEEFLKKGLKLVRD

SEQ ID NO: 6447 - protein, 27 aa, artificial
  peptide fold or domain or sub-domain
GMIVVIDPQKSCIAKRLGLEKPGIYAL

SEQ ID NO: 6448 - protein, 24 aa, artificial
  peptide fold or domain or sub-domain
GMKELLSTMDLDTDANTIPELKER

SEQ ID NO: 6449 - protein, 21 aa, artificial
  peptide fold or domain or sub-domain
GMLATKKEVEDASNDKQVRDM

SEQ ID NO: 6450 - protein, 28 aa, artificial
  peptide fold or domain or sub-domain
GMLEVNRLAGRQLPVDGGFDDEGNLTKE

SEQ ID NO: 6451 - protein, 26 aa, artificial
  peptide fold or domain or sub-domain
GMLIPYTGFSPWSAKLIQENRIEGYM

SEQ ID NO: 6452 - protein, 22 aa, artificial
  peptide fold or domain or sub-domain
GMLSLVFNNQMYGTIRMHQEIH

SEQ ID NO: 6453 - protein, 28 aa, artificial
  peptide fold or domain or sub-domain
GMMNWLIREGKKMPLDWAITPDGDETDD

SEQ ID NO: 6454 - protein, 30 aa, artificial
  peptide fold or domain or sub-domain
GMNKLHEIPTEEVPRMDKIFLNGDWVGSCS

SEQ ID NO: 6455 - protein, 25 aa, artificial
  peptide fold or domain or sub-domain
GMQPRAAWMKQEPPEYWKNETEHAM

SEQ ID NO: 6456 - protein, 30 aa, artificial
  peptide fold or domain or sub-domain
GMRAHILDAVIDKLREAGATIDEGVDTLRV

SEQ ID NO: 6457 - protein, 20 aa, artificial
  peptide fold or domain or sub-domain
GMRTKMRAAAYPEEDPMSRI

SEQ ID NO: 6458 - protein, 20 aa, artificial
  peptide fold or domain or sub-domain
GMRVSEIARELDLSARFVRD

SEQ ID NO: 6459 - protein, 26 aa, artificial
  peptide fold or domain or sub-domain
GMTWRKVADPKEILKLKKEFFSNYEP

SEQ ID NO: 6460 - protein, 30 aa, artificial
  peptide fold or domain or sub-domain
GMVLALADLEGVIDLLRQAPDSATAKAQLQ

SEQ ID NO: 6461 - protein, 29 aa, artificial
  peptide fold or domain or sub-domain
GMVYVAVPARQYILVASTGGEALLQWTGF

SEQ ID NO: 6462 - protein, 27 aa, artificial
  peptide fold or domain or sub-domain
GNAAEQLATYARAGRKDDAEQIRKIAE

SEQ ID NO: 6463 - protein, 28 aa, artificial
  peptide fold or domain or sub-domain
GNAHFAVPENAAAVLAVAATGTFINTKI

SEQ ID NO: 6464 - protein, 27 aa, artificial
  peptide fold or domain or sub-domain
GNALLFEKDSHNGTINTNNFKFLDDFP

SEQ ID NO: 6465 - protein, 29 aa, artificial
  peptide fold or domain or sub-domain
GNATVQTDAEGQASIDISANNAGISSITA

SEQ ID NO: 6466 - protein, 27 aa, artificial
  peptide fold or domain or sub-domain
GNAVRGSVVEALVGLGFAAKQAEEATD

SEQ ID NO: 6467 - protein, 28 aa, artificial
  peptide fold or domain or sub-domain
GNCHLCRRAIDRERLVIVPQARYCARCQ

SEQ ID NO: 6468 - protein, 28 aa, artificial
  peptide fold or domain or sub-domain
GNCQICGNKILEERLEIMPASITCIDCA

SEQ ID NO: 6469 - protein, 24 aa, artificial
  peptide fold or domain or sub-domain
GNCSVYHDWMDVRNGWIPHTEISR

SEQ ID NO: 6470 - protein, 30 aa, artificial
  peptide fold or domain or sub-domain
GNDSTDLLNLLIRRETIGKMTKREVIENCF

SEQ ID NO: 6471 - protein, 21 aa, artificial
  peptide fold or domain or sub-domain
GNEYNEFLYSKAGREELERVN

SEQ ID NO: 6472 - protein, 26 aa, artificial
  peptide fold or domain or sub-domain
GNFEELVRADAQVTALLSAEEIDQCF

SEQ ID NO: 6473 - protein, 29 aa, artificial
  peptide fold or domain or sub-domain
GNFVRLTDDLSDDFFASDVESFLIEHGII

SEQ ID NO: 6474 - protein, 26 aa, artificial
  peptide fold or domain or sub-domain
GNGDLAKRFFLAFAHSVSSELGEWVE

SEQ ID NO: 6475 - protein, 26 aa, artificial
  peptide fold or domain or sub-domain
GNGDVARAAFMSYADRTHPGLSEWIG

SEQ ID NO: 6476 - protein, 26 aa, artificial
  peptide fold or domain or sub-domain
GNGGKLKNALVSFAAQCNLTLATWLA

SEQ ID NO: 6477 - protein, 20 aa, artificial
  peptide fold or domain or sub-domain
GNGKFNQSIDPKNYNFVNPI

SEQ ID NO: 6478 - protein, 26 aa, artificial
  peptide fold or domain or sub-domain
GNGRVLHAAVTRMAARRDRGFGDFVA

SEQ ID NO: 6479 - protein, 23 aa, artificial
  peptide fold or domain or sub-domain
GNHLTNLRRVASLGEYLFERLTL

SEQ ID NO: 6480 - protein, 21 aa, artificial
  peptide fold or domain or sub-domain
GNIAISGGYKRSQGMELTAEE

SEQ ID NO: 6481 - protein, 26 aa, artificial
  peptide fold or domain or sub-domain
GNIEEAKNILSNESDADMREMAKEEM

SEQ ID NO: 6482 - protein, 25 aa, artificial
  peptide fold or domain or sub-domain
GNIIKRVGRKDYVFKDGSGELEIEI

SEQ ID NO: 6483 - protein, 25 aa, artificial
  peptide fold or domain or sub-domain
GNITQQIDDDEFWFTDGTGQIKIEI

SEQ ID NO: 6484 - protein, 25 aa, artificial
  peptide fold or domain or sub-domain
GNITSSNGTVYSPGFPSPYSSSQDC

SEQ ID NO: 6485 - protein, 25 aa, artificial
  peptide fold or domain or sub-domain
GNIVERISDDLYVFKDASGTINVDI

SEQ ID NO: 6486 - protein, 26 aa, artificial
  peptide fold or domain or sub-domain
GNIYKNIYFDNYKYIYKIKFNYCILN

SEQ ID NO: 6487 - protein, 29 aa, artificial
  peptide fold or domain or sub-domain
GNIYVADTLNHRIEVFAADGTPIRTIGTQ

SEQ ID NO: 6488 - protein, 20 aa, artificial
  peptide fold or domain or sub-domain
GNKGDGPFHKDVQEGKAWSR

SEQ ID NO: 6489 - protein, 20 aa, artificial
  peptide fold or domain or sub-domain
GNKKFIETKKAQDAAYFDTL

SEQ ID NO: 6490 - protein, 20 aa, artificial
  peptide fold or domain or sub-domain
GNKNYVAKKLAEDPDYFSKL

SEQ ID NO: 6491 - protein, 24 aa, artificial
  peptide fold or domain or sub-domain
GNKVINDMFEEPKSWEIQHISLAK

SEQ ID NO: 6492 - protein, 28 aa, artificial
  peptide fold or domain or sub-domain
GNLEDYLQHVKEYTNNPVLVEEAERTKT

SEQ ID NO: 6493 - protein, 29 aa, artificial
  peptide fold or domain or sub-domain
GNLLSITKDLGDEFYPNDLDNYLVEHGFL

SEQ ID NO: 6494 - protein, 25 aa, artificial
  peptide fold or domain or sub-domain
GNLPTKSASSFKKVAYWIDTDSSMY

SEQ ID NO: 6495 - protein, 29 aa, artificial
  peptide fold or domain or sub-domain
GNLYVADTGNDRILRLDANGEAISVWGSS

SEQ ID NO: 6496 - protein, 29 aa, artificial
  peptide fold or domain or sub-domain
GNMLVADWGNSRIQVFDSTGSFLSYVNTA

SEQ ID NO: 6497 - protein, 30 aa, artificial
  peptide fold or domain or sub-domain
GNNADVSSCNYEARKYGIKNGMWLKQAYNL

SEQ ID NO: 6498 - protein, 29 aa, artificial
  peptide fold or domain or sub-domain
GNNILLNNRLKLAHADAVTETFINDVSSF

SEQ ID NO: 6499 - protein, 28 aa, artificial
  peptide fold or domain or sub-domain
GNNIVLAIFKHVTNPEARQYLLRQAFEE

SEQ ID NO: 6500 - protein, 26 aa, artificial
  peptide fold or domain or sub-domain
GNNKKFLNFSMKKYIIFTINNLNIFD

SEQ ID NO: 6501 - protein, 25 aa, artificial
  peptide fold or domain or sub-domain
GNNTMRYFPDLSSFQSIYTEGDFIE

SEQ ID NO: 6502 - protein, 28 aa, artificial
  peptide fold or domain or sub-domain
GNPLYIANEDDNQVTVLDVEANKVIAQV

SEQ ID NO: 6503 - protein, 24 aa, artificial
  peptide fold or domain or sub-domain
GNPVAQDMWDESEEASIRHIRLAR

SEQ ID NO: 6504 - protein, 24 aa, artificial
  peptide fold or domain or sub-domain
GNPVKVDLMGEQVHGHVDHVLLTH

SEQ ID NO: 6505 - protein, 21 aa, artificial
  peptide fold or domain or sub-domain
GNQMARRDNADPSGLGNTLGW

SEQ ID NO: 6506 - protein, 28 aa, artificial
  peptide fold or domain or sub-domain
GNQWRYWLARSQEITGNALAAQELYEDL

SEQ ID NO: 6507 - protein, 20 aa, artificial
  peptide fold or domain or sub-domain
GNRAWAEEIKKTNPGFFETL

SEQ ID NO: 6508 - protein, 20 aa, artificial
  peptide fold or domain or sub-domain
GNRRFVAEVFEKERETFATL

SEQ ID NO: 6509 - protein, 22 aa, artificial
  peptide fold or domain or sub-domain
GNSAQSRGTLQAAGGTYTLHES

SEQ ID NO: 6510 - protein, 22 aa, artificial
  peptide fold or domain or sub-domain
GNSENNWDFSESFTGFLCIRPI

SEQ ID NO: 6511 - protein, 28 aa, artificial
  peptide fold or domain or sub-domain
GNSVWGSDLDRAAAVADRLEGGTSWVNT

SEQ ID NO: 6512 - protein, 22 aa, artificial
  peptide fold or domain or sub-domain
GNSYFRFIKPFVPLGKFLGVMP

SEQ ID NO: 6513 - protein, 28 aa, artificial
  peptide fold or domain or sub-domain
GNTGMPIVAEHVDGHQRKAVLNFMAMME

SEQ ID NO: 6514 - protein, 26 aa, artificial
  peptide fold or domain or sub-domain
GNTKFVLQSYYKPFLLGYKNNYCIYN

SEQ ID NO: 6515 - protein, 28 aa, artificial
  peptide fold or domain or sub-domain
GNTLLDRSSSLSNLRDQEHDFYGIPLMA

SEQ ID NO: 6516 - protein, 25 aa, artificial
  peptide fold or domain or sub-domain
GNVISQQQEEWYTFRDPTGTIKVRI

SEQ ID NO: 6517 - protein, 27 aa, artificial
  peptide fold or domain or sub-domain
GNVSALPYSCALRAGGSYNYLVVNGVR

SEQ ID NO: 6518 - protein, 29 aa, artificial
  peptide fold or domain or sub-domain
GNVVAGMGLKGMKTTVRDLEGLLLYFKAV

SEQ ID NO: 6519 - protein, 29 aa, artificial
  peptide fold or domain or sub-domain
GNVYVADADNNRIQKFAPVYPPVTNFVSN

SEQ ID NO: 6520 - protein, 26 aa, artificial
  peptide fold or domain or sub-domain
GNVYVTDTDNNRVVKLEAESNNQVVL

SEQ ID NO: 6521 - protein, 24 aa, artificial
  peptide fold or domain or sub-domain
GNYGELGAYESKYSKYYKWYRFYD

SEQ ID NO: 6522 - protein, 30 aa, artificial
  peptide fold or domain or sub-domain
GNYMLEMRKNDEFLDQSSTDDWTLGYAFYI

SEQ ID NO: 6523 - protein, 25 aa, artificial
  peptide fold or domain or sub-domain
GNYRRAIFIEKLGWPLPLVDGLEID

SEQ ID NO: 6524 - protein, 30 aa, artificial
  peptide fold or domain or sub-domain
GPAAYALPVLRHLVPSVKGIISDIAKEGGV

SEQ ID NO: 6525 - protein, 28 aa, artificial
  peptide fold or domain or sub-domain
GPAFVHGHVIRPYSHSLSDDEKLYRPEA

SEQ ID NO: 6526 - protein, 20 aa, artificial
  peptide fold or domain or sub-domain
GPAGDQLQSIAASLEQYAAL

SEQ ID NO: 6527 - protein, 29 aa, artificial
  peptide fold or domain or sub-domain
GPAGDQLQSIAASLEQYAALGFQASHFSQ

SEQ ID NO: 6528 - protein, 28 aa, artificial
  peptide fold or domain or sub-domain
GPAGLDNVAEFLLSNMSKRMSENLREAM

SEQ ID NO: 6529 - protein, 28 aa, artificial
  peptide fold or domain or sub-domain
GPAILQVHTFRFNGHSPADPEHERNRKD

SEQ ID NO: 6530 - protein, 29 aa, artificial
  peptide fold or domain or sub-domain
GPANLFNKDFSLIRNQIEETETLKTKSEL

SEQ ID NO: 6531 - protein, 24 aa, artificial
  peptide fold or domain or sub-domain
GPATLDNATIVLPDTLRQVLQNDT

SEQ ID NO: 6532 - protein, 28 aa, artificial
  peptide fold or domain or sub-domain
GPEGQKIFAKYHYFATPKEAFAWLGEKK

SEQ ID NO: 6533 - protein, 27 aa, artificial
  peptide fold or domain or sub-domain
GPFSTSEDYHPFCWITDYNNQTNVEQC

SEQ ID NO: 6534 - protein, 27 aa, artificial
  peptide fold or domain or sub-domain
GPFVLRAIQLFGMPADEAQAREKTEKL

SEQ ID NO: 6535 - protein, 22 aa, artificial
  peptide fold or domain or sub-domain
GPGGGASLTTAEENQNKTGRFK

SEQ ID NO: 6536 - protein, 20 aa, artificial
  peptide fold or domain or sub-domain
GPHSRARLESGYHQHSPETY

SEQ ID NO: 6537 - protein, 28 aa, artificial
  peptide fold or domain or sub-domain
GPILMELQTYRYHGHSMSDPGVSYRTRE

SEQ ID NO: 6538 - protein, 22 aa, artificial
  peptide fold or domain or sub-domain
GPINSEELKQKEYKGYKDDAVI

SEQ ID NO: 6539 - protein, 23 aa, artificial
  peptide fold or domain or sub-domain
GPIVNVADGDTVTLRAPGGQRRI

SEQ ID NO: 6540 - protein, 27 aa, artificial
  peptide fold or domain or sub-domain
GPKAGGNSKCGDGAGGIDNLWHDSDPM

SEQ ID NO: 6541 - protein, 30 aa, artificial
  peptide fold or domain or sub-domain
GPKLVQADGTLPEALMPDGTHPSEAGYRIW

SEQ ID NO: 6542 - protein, 24 aa, artificial
  peptide fold or domain or sub-domain
GPLFSEILKNWKDESDKKIIQSQI

SEQ ID NO: 6543 - protein, 29 aa, artificial
  peptide fold or domain or sub-domain
GPLKALTTLVYSDNLNLQRSAALAFAEIT

SEQ ID NO: 6544 - protein, 28 aa, artificial
  peptide fold or domain or sub-domain
GPLTAGALWLDPETHRAGCNRHDLTLTP

SEQ ID NO: 6545 - protein, 22 aa, artificial
  peptide fold or domain or sub-domain
GPLTDYYCVDQLFNCKKAIKHS

SEQ ID NO: 6546 - protein, 21 aa, artificial
  peptide fold or domain or sub-domain
GPMQWDNTVYHGFSDHLPWKH

SEQ ID NO: 6547 - protein, 22 aa, artificial
  peptide fold or domain or sub-domain
GPMRPNDICSTCHLNSYQCPGH

SEQ ID NO: 6548 - protein, 21 aa, artificial
  peptide fold or domain or sub-domain
GPPCCSGSSGSSAGCSRDCDE

SEQ ID NO: 6549 - protein, 22 aa, artificial
  peptide fold or domain or sub-domain
GPQEGLGELAVCVNERPWSLYC

SEQ ID NO: 6550 - protein, 21 aa, artificial
  peptide fold or domain or sub-domain
GPRDFAGHDLAGHDLADRAGE

SEQ ID NO: 6551 - protein, 26 aa, artificial
  peptide fold or domain or sub-domain
GPSANISGQASGVTFNQILEDFDQEV

SEQ ID NO: 6552 - protein, 30 aa, artificial
  peptide fold or domain or sub-domain
GPSILNSDLANLGAECLRMLDSGADYLHLD

SEQ ID NO: 6553 - protein, 27 aa, artificial
  peptide fold or domain or sub-domain
GPSKAGSCTLQEGILSSCEIRRLISEK

SEQ ID NO: 6554 - protein, 20 aa, artificial
  peptide fold or domain or sub-domain
GPSPTQRDADGYRTFTPEDY

SEQ ID NO: 6555 - protein, 27 aa, artificial
  peptide fold or domain or sub-domain
GPSSPVPGGSITTTPGFLSIAELNDIK

SEQ ID NO: 6556 - protein, 28 aa, artificial
  peptide fold or domain or sub-domain
GPTILWVELDRLVSHTNSDDHRIYRPKE

SEQ ID NO: 6557 - protein, 28 aa, artificial
  peptide fold or domain or sub-domain
GPTLIEALTYRFRGHSVADPDEMRAVKQ

SEQ ID NO: 6558 - protein, 28 aa, artificial
  peptide fold or domain or sub-domain
GPTLIEALTYRWDDHSMRANLPAYRSEA

SEQ ID NO: 6559 - protein, 28 aa, artificial
  peptide fold or domain or sub-domain
GPTLIEARCIRITSHSSDDDQRRYRDPE

SEQ ID NO: 6560 - protein, 28 aa, artificial
  peptide fold or domain or sub-domain
GPTLVESVTFRYGPHTTSDDPKRYRSQE

SEQ ID NO: 6561 - protein, 28 aa, artificial
  peptide fold or domain or sub-domain
GPVCLVADVVRLLPHSSSDDHTKYRTPD

SEQ ID NO: 6562 - protein, 22 aa, artificial
  peptide fold or domain or sub-domain
GPVQDSPWCSADGKSCLKDNRP

SEQ ID NO: 6563 - protein, 20 aa, artificial
  peptide fold or domain or sub-domain
GPVSQSHPFFRYHPFTPASY

SEQ ID NO: 6564 - protein, 20 aa, artificial
  peptide fold or domain or sub-domain
GPYAKFKIENGYPLHAPESY

SEQ ID NO: 6565 - protein, 28 aa, artificial
  peptide fold or domain or sub-domain
GPYAYITNSGDNNVSVIDTTTNKVTAMI

SEQ ID NO: 6566 - protein, 29 aa, artificial
  peptide fold or domain or sub-domain
GQAHWESDIKRGKGTVSTESGVLNQQPYG

SEQ ID NO: 6567 - protein, 21 aa, artificial
  peptide fold or domain or sub-domain
GQCQFRNCTHTHEKNCGLKTA

SEQ ID NO: 6568 - protein, 21 aa, artificial
  peptide fold or domain or sub-domain
GQCRFRDCKHQIDPGCALVKA

SEQ ID NO: 6569 - protein, 24 aa, artificial
  peptide fold or domain or sub-domain
GQEPLTAMLRLERGEIDVVGDGIP

SEQ ID NO: 6570 - protein, 28 aa, artificial
  peptide fold or domain or sub-domain
GQFLLDKPLPLKQLRNHIHYYDNTPFIV

SEQ ID NO: 6571 - protein, 23 aa, artificial
  peptide fold or domain or sub-domain
GQFVADDTSGDYKKILVALVGGT

SEQ ID NO: 6572 - protein, 21 aa, artificial
  peptide fold or domain or sub-domain
GQFVVQYYTVMKKCPSGIHRF

SEQ ID NO: 6573 - protein, 27 aa, artificial
  peptide fold or domain or sub-domain
GQGKDPAKYTAPALSLGAHVAPLGIHF

SEQ ID NO: 6574 - protein, 27 aa, artificial
  peptide fold or domain or sub-domain
GQGRALPLRDEWRCLGLPRAAETLARE

SEQ ID NO: 6575 - protein, 29 aa, artificial
  peptide fold or domain or sub-domain
GQGVAIKSLGKNELETTTGERVKFDAAFI

SEQ ID NO: 6576 - protein, 24 aa, artificial
  peptide fold or domain or sub-domain
GQGVCNEKGLAYEKHGQLCYYVTF

SEQ ID NO: 6577 - protein, 27 aa, artificial
  peptide fold or domain or sub-domain
GQHTQIPHDNELSLLHANGETSYQARE

SEQ ID NO: 6578 - protein, 29 aa, artificial
  peptide fold or domain or sub-domain
GQIDTLHRRLLSDVDPVRENAIRAEADEL

SEQ ID NO: 6579 - protein, 29 aa, artificial
  peptide fold or domain or sub-domain
GQIITLRATGGDATTVNDIEWQLKQAHAI

SEQ ID NO: 6580 - protein, 23 aa, artificial
  peptide fold or domain or sub-domain
GQILPESQWNDSSIDKIEDRDFL

SEQ ID NO: 6581 - protein, 29 aa, artificial
  peptide fold or domain or sub-domain
GQIQTFKKLWRGEKVNFRNGVGTDVAVQA

SEQ ID NO: 6582 - protein, 29 aa, artificial
  peptide fold or domain or sub-domain
GQIRSRDDFGPGDLRAMLPRYSPENFGKN

SEQ ID NO: 6583 - protein, 21 aa, artificial
  peptide fold or domain or sub-domain
GQITNQFPGMPWEELEHYWQR

SEQ ID NO: 6584 - protein, 28 aa, artificial
  peptide fold or domain or sub-domain
GQIVIGDLKILPDHYEAYFKESQLELTP

SEQ ID NO: 6585 - protein, 26 aa, artificial
  peptide fold or domain or sub-domain
GQKDIWTLINETAAEAQKESGKSIVN

SEQ ID NO: 6586 - protein, 24 aa, artificial
  peptide fold or domain or sub-domain
GQKFAKVFNIKFIDQNNTQQFAEM

SEQ ID NO: 6587 - protein, 26 aa, artificial
  peptide fold or domain or sub-domain
GQKLQDLGIVPKWMNNAELIRAAKKY

SEQ ID NO: 6588 - protein, 29 aa, artificial
  peptide fold or domain or sub-domain
GQKPCGSGGRCAAAGICCNDESCVTEPEC

SEQ ID NO: 6589 - protein, 29 aa, artificial
  peptide fold or domain or sub-domain
GQKVKLQDFKGFRGGLDVTHGQTGTESVY

SEQ ID NO: 6590 - protein, 20 aa, artificial
  peptide fold or domain or sub-domain
GQLFNWAKDKLQWFENWEQL

SEQ ID NO: 6591 - protein, 28 aa, artificial
  peptide fold or domain or sub-domain
GQLGSGPNGDFLRAAFAAEGIETLTPPS

SEQ ID NO: 6592 - protein, 24 aa, artificial
  peptide fold or domain or sub-domain
GQNFAKAFNVTFADKDGNRDFVWA

SEQ ID NO: 6593 - protein, 24 aa, artificial
  peptide fold or domain or sub-domain
GQNFAKASEIKYLSAEGKEEFAWT

SEQ ID NO: 6594 - protein, 24 aa, artificial
  peptide fold or domain or sub-domain
GQNFAKNFEIFYKNKENKSQIPFQ

SEQ ID NO: 6595 - protein, 24 aa, artificial
  peptide fold or domain or sub-domain
GQNFARAFDITFLDENQERVHPYQ

SEQ ID NO: 6596 - protein, 24 aa, artificial
  peptide fold or domain or sub-domain
GQNFARTFEVTYETEEGDQEYVYM

SEQ ID NO: 6597 - protein, 28 aa, artificial
  peptide fold or domain or sub-domain
GQNYYDQFIPLFKNNEIRNMLGSFAARE

SEQ ID NO: 6598 - protein, 28 aa, artificial
  peptide fold or domain or sub-domain
GQPDDIIMEESHQEGDYVLSDEYPSLLV

SEQ ID NO: 6599 - protein, 24 aa, artificial
  peptide fold or domain or sub-domain
GQPVHDDIFATAEAQRIPHINLGR

SEQ ID NO: 6600 - protein, 30 aa, artificial
  peptide fold or domain or sub-domain
GQQNGRIDPAEASALVSGLQHLPDQAGQTL

SEQ ID NO: 6601 - protein, 24 aa, artificial
  peptide fold or domain or sub-domain
GQRFSSTFDILYANKANESVHPYL

SEQ ID NO: 6602 - protein, 27 aa, artificial
  peptide fold or domain or sub-domain
GQRRRLLKYLERTDYDAYIALTDKLGI

SEQ ID NO: 6603 - protein, 27 aa, artificial
  peptide fold or domain or sub-domain
GQRSRLQNYLKKKNFEEYSQTMDALGL

SEQ ID NO: 6604 - protein, 29 aa, artificial
  peptide fold or domain or sub-domain
GQRVRLKGFSKYRAQLDNKTDSTGTHSLY

SEQ ID NO: 6605 - protein, 20 aa, artificial
  peptide fold or domain or sub-domain
GQSFYSTRPPSIHKDYVNRL

SEQ ID NO: 6606 - protein, 27 aa, artificial
  peptide fold or domain or sub-domain
GQSGVKELTELLQDPHCALKTLRFLRS

SEQ ID NO: 6607 - protein, 30 aa, artificial
  peptide fold or domain or sub-domain
GQSNVPEYFPKIAAEYYRRQKITPLITKEK

SEQ ID NO: 6608 - protein, 26 aa, artificial
  peptide fold or domain or sub-domain
GQSTSLWRSSTQSYIYGEYKGIHIID

SEQ ID NO: 6609 - protein, 24 aa, artificial
  peptide fold or domain or sub-domain
GQTFTKPFGLTFQNQANQQAIPYS

SEQ ID NO: 6610 - protein, 20 aa, artificial
  peptide fold or domain or sub-domain
GQTLVWTDGHRVNYRTSNRY

SEQ ID NO: 6611 - protein, 28 aa, artificial
  peptide fold or domain or sub-domain
GQTNTSWRRDIRWEGKPLAYLIKDKILR

SEQ ID NO: 6612 - protein, 30 aa, artificial
  peptide fold or domain or sub-domain
GQTNVPATFMQMAQADYQSQGLSVDEQTKR

SEQ ID NO: 6613 - protein, 23 aa, artificial
  peptide fold or domain or sub-domain
GQVAYVMDGDSLILRSGSVHRRI

SEQ ID NO: 6614 - protein, 29 aa, artificial
  peptide fold or domain or sub-domain
GQVFLRQRRYLTVENGREQVRTITDDDEF

SEQ ID NO: 6615 - protein, 29 aa, artificial
  peptide fold or domain or sub-domain
GQVFLTNNMFTIVENGHEKVTLLVDPERR

SEQ ID NO: 6616 - protein, 23 aa, artificial
  peptide fold or domain or sub-domain
GQVIHVTDGDTLTLVINKEWVRA

SEQ ID NO: 6617 - protein, 25 aa, artificial
  peptide fold or domain or sub-domain
GQVKASFEAVETWDAPSLDKLLHDF

SEQ ID NO: 6618 - protein, 29 aa, artificial
  peptide fold or domain or sub-domain
GQVTLVANLFRSIIGGEETVKHVRDEAEL

SEQ ID NO: 6619 - protein, 25 aa, artificial
  peptide fold or domain or sub-domain
GQVVKSLGDEKYQFRDKTGVITVDI

SEQ ID NO: 6620 - protein, 26 aa, artificial
  peptide fold or domain or sub-domain
GQVVRFVADADYGFIATDDGREVYFH

SEQ ID NO: 6621 - protein, 30 aa, artificial
  peptide fold or domain or sub-domain
GQVYNHSQPIYLTADQEDKYRIAPGDITLD

SEQ ID NO: 6622 - protein, 29 aa, artificial
  peptide fold or domain or sub-domain
GQYKSVEDFDEDDYRRFSPRFQGENFQKN

SEQ ID NO: 6623 - protein, 23 aa, artificial
  peptide fold or domain or sub-domain
GRAERTAGSTSARLAGTAMPGPR

SEQ ID NO: 6624 - protein, 24 aa, artificial
  peptide fold or domain or sub-domain
GRALCVDPDGALVLDCNGDRRRVV

SEQ ID NO: 6625 - protein, 30 aa, artificial
  peptide fold or domain or sub-domain
GRARNAISTGDAAALRDAIRDLPGAVQQVL

SEQ ID NO: 6626 - protein, 29 aa, artificial
  peptide fold or domain or sub-domain
GRDLRGAHLPFNFRLIEAQWDARHIERQI

SEQ ID NO: 6627 - protein, 24 aa, artificial
  peptide fold or domain or sub-domain
GRDSGKSALELQLGWLAKVSTFAE

SEQ ID NO: 6628 - protein, 30 aa, artificial
  peptide fold or domain or sub-domain
GRELALQFMKSSKTFCMDPAVESDIANVLS

SEQ ID NO: 6629 - protein, 28 aa, artificial
  peptide fold or domain or sub-domain
GRFEKYVRMGKTVDKSWASMKGGKPIED

SEQ ID NO: 6630 - protein, 20 aa, artificial
  peptide fold or domain or sub-domain
GRFGALDIQAGQVRSFQEKP

SEQ ID NO: 6631 - protein, 29 aa, artificial
  peptide fold or domain or sub-domain
GRFGPGHQFEPEDNRSKNQLFQGETYARA

SEQ ID NO: 6632 - protein, 21 aa, artificial
  peptide fold or domain or sub-domain
GRFYGEAYGLRTFITRMGTHT

SEQ ID NO: 6633 - protein, 28 aa, artificial
  peptide fold or domain or sub-domain
GRGPGMAFMPYCSLPELESAMNIWQTME

SEQ ID NO: 6634 - protein, 29 aa, artificial
  peptide fold or domain or sub-domain
GRIEMLHQQSLQEIDEANIAATTRHLEGY

SEQ ID NO: 6635 - protein, 29 aa, artificial
  peptide fold or domain or sub-domain
GRIIVADSKNQRILVFNQNLDFMWDIEVR

SEQ ID NO: 6636 - protein, 22 aa, artificial
  peptide fold or domain or sub-domain
GRINARELQKINTNNYNIDDDI

SEQ ID NO: 6637 - protein, 22 aa, artificial
  peptide fold or domain or sub-domain
GRINEQELKNLDPINYSGTHHI

SEQ ID NO: 6638 - protein, 22 aa, artificial
  peptide fold or domain or sub-domain
GRINTKDLEKLDKQRYQGSLFL

SEQ ID NO: 6639 - protein, 30 aa, artificial
  peptide fold or domain or sub-domain
GRIRGAALDVHESEPFSFAQGPLKDAPNLI

SEQ ID NO: 6640 - protein, 27 aa, artificial
  peptide fold or domain or sub-domain
GRIRPSVENLPAIRDKKARMREAVINN

SEQ ID NO: 6641 - protein, 21 aa, artificial
  peptide fold or domain or sub-domain
GRISNVLPEYRGEDGVRVGRI

SEQ ID NO: 6642 - protein, 22 aa, artificial
  peptide fold or domain or sub-domain
GRITARDLRRIDRSAYRGTNHI

SEQ ID NO: 6643 - protein, 29 aa, artificial
  peptide fold or domain or sub-domain
GRITLKEGALVVTSGGARHEQRLPDEAAW

SEQ ID NO: 6644 - protein, 29 aa, artificial
  peptide fold or domain or sub-domain
GRITLRGRIFRSVGANREEERELATFDEL

SEQ ID NO: 6645 - protein, 26 aa, artificial
  peptide fold or domain or sub-domain
GRITTFFEDKGFGFITDENGDNRYFH

SEQ ID NO: 6646 - protein, 25 aa, artificial
  peptide fold or domain or sub-domain
GRIVRQLKHEHYEFQDRTGSIEVEI

SEQ ID NO: 6647 - protein, 27 aa, artificial
  peptide fold or domain or sub-domain
GRKGWSDGLAGSLDVKPTVIAATVDEA

SEQ ID NO: 6648 - protein, 26 aa, artificial
  peptide fold or domain or sub-domain
GRLDYPIRKYNALARSLEEKGEKVIY

SEQ ID NO: 6649 - protein, 27 aa, artificial
  peptide fold or domain or sub-domain
GRLEKIHPTGKMFILSDGEGKNGTIEL

SEQ ID NO: 6650 - protein, 27 aa, artificial
  peptide fold or domain or sub-domain
GRLEKQSVHTLLTGDQQAVITDQYQIR

SEQ ID NO: 6651 - protein, 30 aa, artificial
  peptide fold or domain or sub-domain
GRLNAFEAELADPKTDAAERLLAFKFVLHF

SEQ ID NO: 6652 - protein, 29 aa, artificial
  peptide fold or domain or sub-domain
GRLSLLDGEFRHRHPDGRVIAHHVPSDKL

SEQ ID NO: 6653 - protein, 27 aa, artificial
  peptide fold or domain or sub-domain
GRLVLRDDLKVEEVYGEKTKSKSVMPE

SEQ ID NO: 6654 - protein, 25 aa, artificial
  peptide fold or domain or sub-domain
GRMTWDGLSCTVLTKCDIHWGAYIH

SEQ ID NO: 6655 - protein, 28 aa, artificial
  peptide fold or domain or sub-domain
GRNAKNWKRNIRCEGMTLGELLKRKNSD

SEQ ID NO: 6656 - protein, 24 aa, artificial
  peptide fold or domain or sub-domain
GRNLRFTVDAQGVIRPAVAPDHAV

SEQ ID NO: 6657 - protein, 21 aa, artificial
  peptide fold or domain or sub-domain
GRPAYETLTAAEARAYYAQAR

SEQ ID NO: 6658 - protein, 30 aa, artificial
  peptide fold or domain or sub-domain
GRPGFAALDVFEQEPILDPAHPLPNHPRVL

SEQ ID NO: 6659 - protein, 24 aa, artificial
  peptide fold or domain or sub-domain
GRPVLTDMWSLPEDGVVGHVSLGM

SEQ ID NO: 6660 - protein, 24 aa, artificial
  peptide fold or domain or sub-domain
GRPVSDSLLDPAAEASMGHIELAK

SEQ ID NO: 6661 - protein, 28 aa, artificial
  peptide fold or domain or sub-domain
GRQLYVALGSEDAIAIVDTAERKVIGRI

SEQ ID NO: 6662 - protein, 25 aa, artificial
  peptide fold or domain or sub-domain
GRRFKENGEPAFTVNTIDRHGVAIG

SEQ ID NO: 6663 - protein, 27 aa, artificial
  peptide fold or domain or sub-domain
GRRKRLLNYIAKRSPDRFRELAERLNI

SEQ ID NO: 6664 - protein, 21 aa, artificial
  peptide fold or domain or sub-domain
GRRLGFAFDYTDAAAVFAEYV

SEQ ID NO: 6665 - protein, 27 aa, artificial
  peptide fold or domain or sub-domain
GRRRRLLNYIKKNNVSKYLDLISKLGI

SEQ ID NO: 6666 - protein, 20 aa, artificial
  peptide fold or domain or sub-domain
GRSAVNKDAQTKRFFGTVSG

SEQ ID NO: 6667 - protein, 20 aa, artificial
  peptide fold or domain or sub-domain
GRSETGSTKEDIIRLDENGG

SEQ ID NO: 6668 - protein, 22 aa, artificial
  peptide fold or domain or sub-domain
GRSGVVTLEDTGRKTVIFSPYL

SEQ ID NO: 6669 - protein, 28 aa, artificial
  peptide fold or domain or sub-domain
GRSPNVALLPLISIPELETWVETWAFSE

SEQ ID NO: 6670 - protein, 29 aa, artificial
  peptide fold or domain or sub-domain
GRTLGVDLDPASVRPEDLDALVGRAFGRF

SEQ ID NO: 6671 - protein, 28 aa, artificial
  peptide fold or domain or sub-domain
GRTVYVADWYAAAVRVIDAASRSVRASI

SEQ ID NO: 6672 - protein, 26 aa, artificial
  peptide fold or domain or sub-domain
GRTWYNNEDGRLGNRDAEAPRNPPGY

SEQ ID NO: 6673 - protein, 29 aa, artificial
  peptide fold or domain or sub-domain
GRVAQIRQQIEEATSDYDREKLQERVAKL

SEQ ID NO: 6674 - protein, 24 aa, artificial
  peptide fold or domain or sub-domain
GRVEGIADDGVLLIKNEHGNQRFS

SEQ ID NO: 6675 - protein, 28 aa, artificial
  peptide fold or domain or sub-domain
GRVGDDSCGNTLLAELEGWGVNTAFCRR

SEQ ID NO: 6676 - protein, 24 aa, artificial
  peptide fold or domain or sub-domain
GRVLGVDSRGALRLEVDGVEQGFS

SEQ ID NO: 6677 - protein, 29 aa, artificial
  peptide fold or domain or sub-domain
GRVLVSVPARNTLLLTDDSGAGLISWGGT

SEQ ID NO: 6678 - protein, 24 aa, artificial
  peptide fold or domain or sub-domain
GRVNLDDPAVKKSWQDKTAMRRIG

SEQ ID NO: 6679 - protein, 30 aa, artificial
  peptide fold or domain or sub-domain
GRVNNLERQEQFNVSETFLTEKTGMRYLAV

SEQ ID NO: 6680 - protein, 29 aa, artificial
  peptide fold or domain or sub-domain
GRVTLFNRAFSRGLPPDLDTRMIADADDL

SEQ ID NO: 6681 - protein, 29 aa, artificial
  peptide fold or domain or sub-domain
GRVTLSERRLIITRGGERQERELGSAEEY

SEQ ID NO: 6682 - protein, 23 aa, artificial
  peptide fold or domain or sub-domain
GRVVRVLDGDTIEVMDSRKAVRI

SEQ ID NO: 6683 - protein, 29 aa, artificial
  peptide fold or domain or sub-domain
GRVVVTDIGKHRITIHDPDGNLISSFGSR

SEQ ID NO: 6684 - protein, 28 aa, artificial
  peptide fold or domain or sub-domain
GRYRGHVSAALDELESLGITLGDDAIDD

SEQ ID NO: 6685 - protein, 29 aa, artificial
  peptide fold or domain or sub-domain
GSAAINNNVLRLHQGGQVEETLLDTEDKL

SEQ ID NO: 6686 - protein, 29 aa, artificial
  peptide fold or domain or sub-domain
GSALLALEQMHRNPKTRRGENEWVDKIWE

SEQ ID NO: 6687 - protein, 29 aa, artificial
  peptide fold or domain or sub-domain
GSASELTDREKTRATQDAKTKTLYGSNPD

SEQ ID NO: 6688 - protein, 26 aa, artificial
  peptide fold or domain or sub-domain
GSATSYRQKKFINYIYKKYNNKHFFN

SEQ ID NO: 6689 - protein, 29 aa, artificial
  peptide fold or domain or sub-domain
GSAVWSGGLKDGKGFISTQSGALDNVAYG

SEQ ID NO: 6690 - protein, 24 aa, artificial
  peptide fold or domain or sub-domain
GSCAPCADGTDFPQLCQLCPGCGC

SEQ ID NO: 6691 - protein, 23 aa, artificial
  peptide fold or domain or sub-domain
GSCTKRFQPIGLSNTEEHRRQYR

SEQ ID NO: 6692 - protein, 21 aa, artificial
  peptide fold or domain or sub-domain
GSELADILRSLGSDVGEAEVK

SEQ ID NO: 6693 - protein, 23 aa, artificial
  peptide fold or domain or sub-domain
GSESLRLSLNIKISSATIRNHFK

SEQ ID NO: 6694 - protein, 27 aa, artificial
  peptide fold or domain or sub-domain
GSFGADDDDMEAARKAIKFRRFITDFQ

SEQ ID NO: 6695 - protein, 20 aa, artificial
  peptide fold or domain or sub-domain
GSGFAWIGQMLGVPSVTQLT

SEQ ID NO: 6696 - protein, 28 aa, artificial
  peptide fold or domain or sub-domain
GSGGDKASRQDMMPSEVDYYNATNVLGT

SEQ ID NO: 6697 - protein, 26 aa, artificial
  peptide fold or domain or sub-domain
GSGINQLDGKVEGFNQIARAYQAAGD

SEQ ID NO: 6698 - protein, 24 aa, artificial
  peptide fold or domain or sub-domain
GSGLDMHTKPWVRARARKEYWENL

SEQ ID NO: 6699 - protein, 23 aa, artificial
  peptide fold or domain or sub-domain
GSIIPILQEAISSPDAKTKEGAC

SEQ ID NO: 6700 - protein, 22 aa, artificial
  peptide fold or domain or sub-domain
GSIRGFSAEDGGASVLSFNRAR

SEQ ID NO: 6701 - protein, 22 aa, artificial
  peptide fold or domain or sub-domain
GSISKKSLEKSDHAIYRGGDIV

SEQ ID NO: 6702 - protein, 27 aa, artificial
  peptide fold or domain or sub-domain
GSITLPYDQRFRRRIQWQDDAGSPFLL

SEQ ID NO: 6703 - protein, 24 aa, artificial
  peptide fold or domain or sub-domain
GSKFDKWLEGDKNALNQDELEGYN

SEQ ID NO: 6704 - protein, 25 aa, artificial
  peptide fold or domain or sub-domain
GSKINLIYSRDHSVDESLDYMATWN

SEQ ID NO: 6705 - protein, 23 aa, artificial
  peptide fold or domain or sub-domain
GSKLLTHLPYLKFASATIRYDMV

SEQ ID NO: 6706 - protein, 23 aa, artificial
  peptide fold or domain or sub-domain
GSKLLTKKYFKNLSGGTLRNEMA

SEQ ID NO: 6707 - protein, 28 aa, artificial
  peptide fold or domain or sub-domain
GSKLYVANRDSNDLAIIDTQSLQVLQRV

SEQ ID NO: 6708 - protein, 23 aa, artificial
  peptide fold or domain or sub-domain
GSKNLLKEKSLPYSSATIRNEMG

SEQ ID NO: 6709 - protein, 23 aa, artificial
  peptide fold or domain or sub-domain
GSKTLAQQAGLDISPATIRNILA

SEQ ID NO: 6710 - protein, 23 aa, artificial
  peptide fold or domain or sub-domain
GSKTLFDKHDIGLSPASIRTVLK

SEQ ID NO: 6711 - protein, 23 aa, artificial
  peptide fold or domain or sub-domain
GSKTVMNQLPVKVSSATVRNEMA

SEQ ID NO: 6712 - protein, 26 aa, artificial
  peptide fold or domain or sub-domain
GSLASWNDERGFGFITLESGDRIFAH

SEQ ID NO: 6713 - protein, 27 aa, artificial
  peptide fold or domain or sub-domain
GSLGICQATEPSVMALPSHSTPAGIVF

SEQ ID NO: 6714 - protein, 28 aa, artificial
  peptide fold or domain or sub-domain
GSLKVLKVTDDGMVFIRECGEEQVVIFI

SEQ ID NO: 6715 - protein, 23 aa, artificial
  peptide fold or domain or sub-domain
GSLNLKQSYGIKKSPSYLRAIMN

SEQ ID NO: 6716 - protein, 22 aa, artificial
  peptide fold or domain or sub-domain
GSLRIEGRYQSDDFPIPPEAAE

SEQ ID NO: 6717 - protein, 23 aa, artificial
  peptide fold or domain or sub-domain
GSLVETKFLRLAKDSSMSLAKFH

SEQ ID NO: 6718 - protein, 29 aa, artificial
  peptide fold or domain or sub-domain
GSLYVADTYNNRIMKFTNKDQFLYTVGNF

SEQ ID NO: 6719 - protein, 22 aa, artificial
  peptide fold or domain or sub-domain
GSMDGLKSSEAHYAPFTISQLL

SEQ ID NO: 6720 - protein, 22 aa, artificial
  peptide fold or domain or sub-domain
GSNSTLKGTTTVDGRTYQIYQN

SEQ ID NO: 6721 - protein, 24 aa, artificial
  peptide fold or domain or sub-domain
GSNWQQNNWTTSKNEPVQHRDLIE

SEQ ID NO: 6722 - protein, 26 aa, artificial
  peptide fold or domain or sub-domain
GSPPAYVRWAQKLAYLLEDGDGAELF

SEQ ID NO: 6723 - protein, 20 aa, artificial
  peptide fold or domain or sub-domain
GSPRMAEMVIGEKVSLEEMG

SEQ ID NO: 6724 - protein, 22 aa, artificial
  peptide fold or domain or sub-domain
GSQAQYKGTFYTDGDQYDIFVS

SEQ ID NO: 6725 - protein, 22 aa, artificial
  peptide fold or domain or sub-domain
GSQDRIVEFKAANDDYSAILLE

SEQ ID NO: 6726 - protein, 24 aa, artificial
  peptide fold or domain or sub-domain
GSQIFSEGGLDYLGNPSLVHAQSI

SEQ ID NO: 6727 - protein, 29 aa, artificial
  peptide fold or domain or sub-domain
GSQLYFCGPPGFMKAVQAASAHWPQGSVH

SEQ ID NO: 6728 - protein, 21 aa, artificial
  peptide fold or domain or sub-domain
GSQMLRLAGVAPDGESARKML

SEQ ID NO: 6729 - protein, 21 aa, artificial
  peptide fold or domain or sub-domain
GSQMVVLAKKADTLDEARAKL

SEQ ID NO: 6730 - protein, 23 aa, artificial
  peptide fold or domain or sub-domain
GSQQLTRRPGFEVSSATMRNVLA

SEQ ID NO: 6731 - protein, 24 aa, artificial
  peptide fold or domain or sub-domain
GSQTVGDDTASGGDGDDEITGSNA

SEQ ID NO: 6732 - protein, 28 aa, artificial
  peptide fold or domain or sub-domain
GSRIYASNEDANSASAIDVRARRVIASV

SEQ ID NO: 6733 - protein, 23 aa, artificial
  peptide fold or domain or sub-domain
GSRSISKREDITFSPATIRNEMA

SEQ ID NO: 6734 - protein, 23 aa, artificial
  peptide fold or domain or sub-domain
GSRTLVQRFGIPASSATVRSAMG

SEQ ID NO: 6735 - protein, 23 aa, artificial
  peptide fold or domain or sub-domain
GSRTVSRRSGLALSPASMRNTMS

SEQ ID NO: 6736 - protein, 23 aa, artificial
  peptide fold or domain or sub-domain
GSSELGTRMSTSIPASTIRVYFK

SEQ ID NO: 6737 - protein, 20 aa, artificial
  peptide fold or domain or sub-domain
GSSINWARDNMGLYKDFHEL

SEQ ID NO: 6738 - protein, 27 aa, artificial
  peptide fold or domain or sub-domain
GSSVKAYPKALKQPYSSEAVKNLPALS

SEQ ID NO: 6739 - protein, 20 aa, artificial
  peptide fold or domain or sub-domain
GSSVKFLKDNFEFISSSDEV

SEQ ID NO: 6740 - protein, 30 aa, artificial
  peptide fold or domain or sub-domain
GSSVNKDSVLKADKIIAIKDKDVTSYSLLV

SEQ ID NO: 6741 - protein, 30 aa, artificial
  peptide fold or domain or sub-domain
GSSVWTSDITTAMRATRDLRFGTVWVNEHV

SEQ ID NO: 6742 - protein, 28 aa, artificial
  peptide fold or domain or sub-domain
GSTQQRWINNDVYIYERKFGKSVAVVAV

SEQ ID NO: 6743 - protein, 20 aa, artificial
  peptide fold or domain or sub-domain
GSTVTWLRDKLQINTEINSN

SEQ ID NO: 6744 - protein, 22 aa, artificial
  peptide fold or domain or sub-domain
GSVADRLPEQADAANPIAPDRA

SEQ ID NO: 6745 - protein, 28 aa, artificial
  peptide fold or domain or sub-domain
GSVGNDPFGEFLINEVKGYGVNTDQVAS

SEQ ID NO: 6746 - protein, 20 aa, artificial
  peptide fold or domain or sub-domain
GSVLRWLQNSLHLFRSAKDI

SEQ ID NO: 6747 - protein, 21 aa, artificial
  peptide fold or domain or sub-domain
GSVMTSLGYCATDSELKDMIH

SEQ ID NO: 6748 - protein, 23 aa, artificial
  peptide fold or domain or sub-domain
GSVNTCEVLKYLGLDLPEDLFGA

SEQ ID NO: 6749 - protein, 27 aa, artificial
  peptide fold or domain or sub-domain
GSVSRCRQTLPPEVEMQAHSAPLGITF

SEQ ID NO: 6750 - protein, 29 aa, artificial
  peptide fold or domain or sub-domain
GSYIFNDTHAFLVDLFGLVSEPKPISNIF

SEQ ID NO: 6751 - protein, 22 aa, artificial
  peptide fold or domain or sub-domain
GSYKYFSPTDMNCVCIKELMKN

SEQ ID NO: 6752 - protein, 25 aa, artificial
  peptide fold or domain or sub-domain
GTAAGFQPFSYLEEQLQKKLDHEQL

SEQ ID NO: 6753 - protein, 30 aa, artificial
  peptide fold or domain or sub-domain
GTAGTLTGLGLTAGSVAIAPQTTGLASAAS

SEQ ID NO: 6754 - protein, 30 aa, artificial
  peptide fold or domain or sub-domain
GTAQWADLSSQFYLREEDIGKNRAEVSQPR

SEQ ID NO: 6755 - protein, 20 aa, artificial
  peptide fold or domain or sub-domain
GTCHQLTSFDKKSRDDIGTG

SEQ ID NO: 6756 - protein, 30 aa, artificial
  peptide fold or domain or sub-domain
GTEEEGVDMAHYLLKHDGLFLGGSSALNCV

SEQ ID NO: 6757 - protein, 20 aa, artificial
  peptide fold or domain or sub-domain
GTEMFCHPRTGKPLPKYPRI

SEQ ID NO: 6758 - protein, 25 aa, artificial
  peptide fold or domain or sub-domain
GTFIPTTPEAQVAAQVWNEDYAKIE

SEQ ID NO: 6759 - protein, 30 aa, artificial
  peptide fold or domain or sub-domain
GTFRLTLKDDLYWLAARQPAGWRMMYVFDL

SEQ ID NO: 6760 - protein, 24 aa, artificial
  peptide fold or domain or sub-domain
GTGDVDAKGIYYTQGAYKQYYVDF

SEQ ID NO: 6761 - protein, 27 aa, artificial
  peptide fold or domain or sub-domain
GTGRPWTRNKPTTPAFKVNYDAQVRLA

SEQ ID NO: 6762 - protein, 27 aa, artificial
  peptide fold or domain or sub-domain
GTGVEEISKETQLGKGALYHHIGNKEA

SEQ ID NO: 6763 - protein, 22 aa, artificial
  peptide fold or domain or sub-domain
GTHLVVELMNQGRTPQQACKEA

SEQ ID NO: 6764 - protein, 29 aa, artificial
  peptide fold or domain or sub-domain
GTHLYVCGPQGFMDWVISTAEAAGHASAN

SEQ ID NO: 6765 - protein, 22 aa, artificial
  peptide fold or domain or sub-domain
GTIENTSICPLDSNTGKDCPGY

SEQ ID NO: 6766 - protein, 23 aa, artificial
  peptide fold or domain or sub-domain
GTIGKKFVTINVENNEENRRAYR

SEQ ID NO: 6767 - protein, 27 aa, artificial
  peptide fold or domain or sub-domain
GTIGKKSSNGRNLELRTTDGVQVNITL

SEQ ID NO: 6768 - protein, 21 aa, artificial
  peptide fold or domain or sub-domain
GTIQYLTDTSKYPKGYFVQNT

SEQ ID NO: 6769 - protein, 20 aa, artificial
  peptide fold or domain or sub-domain
GTKLSPADMTNLRKLIEIVS

SEQ ID NO: 6770 - protein, 24 aa, artificial
  peptide fold or domain or sub-domain
GTKYSAALEANFSDENGRSKPFEM

SEQ ID NO: 6771 - protein, 24 aa, artificial
  peptide fold or domain or sub-domain
GTKYSEPMGATVQGPDGKPVPVHM

SEQ ID NO: 6772 - protein, 24 aa, artificial
  peptide fold or domain or sub-domain
GTKYSQAFKALFVNASNVPAVAEM

SEQ ID NO: 6773 - protein, 24 aa, artificial
  peptide fold or domain or sub-domain
GTKYSRPMQVLFADEAGELQPALM

SEQ ID NO: 6774 - protein, 21 aa, artificial
  peptide fold or domain or sub-domain
GTKYVYQQIALPTEQRDIKLL

SEQ ID NO: 6775 - protein, 20 aa, artificial
  peptide fold or domain or sub-domain
GTLIDWLGQGIGLSDTPKVL

SEQ ID NO: 6776 - protein, 21 aa, artificial
  peptide fold or domain or sub-domain
GTLLAPIIGGKQTQGHYTMMM

SEQ ID NO: 6777 - protein, 29 aa, artificial
  peptide fold or domain or sub-domain
GTLTKLKGATFNTHGLDREFDTDGQYTFC

SEQ ID NO: 6778 - protein, 20 aa, artificial
  peptide fold or domain or sub-domain
GTLVNYLIRNLGFAKDSAEL

SEQ ID NO: 6779 - protein, 25 aa, artificial
  peptide fold or domain or sub-domain
GTLVRQLNKDTYIFTDGSAEIQVEL

SEQ ID NO: 6780 - protein, 29 aa, artificial
  peptide fold or domain or sub-domain
GTMSVDQPLSSDDVRSTLPRFKQDAMVAN

SEQ ID NO: 6781 - protein, 24 aa, artificial
  peptide fold or domain or sub-domain
GTNFAKMFKIEFEDENEVKQYVHQ

SEQ ID NO: 6782 - protein, 24 aa, artificial
  peptide fold or domain or sub-domain
GTNFAKSYDLKYQTKNNNYDLMFQ

SEQ ID NO: 6783 - protein, 24 aa, artificial
  peptide fold or domain or sub-domain
GTNFTKVFEVTYLDADGTRKLAHT

SEQ ID NO: 6784 - protein, 25 aa, artificial
  peptide fold or domain or sub-domain
GTPCSDCHALEQDGDTPGLQDAYHQ

SEQ ID NO: 6785 - protein, 28 aa, artificial
  peptide fold or domain or sub-domain
GTPDEYVEQVAQYKALPVVLENARILKN

SEQ ID NO: 6786 - protein, 28 aa, artificial
  peptide fold or domain or sub-domain
GTPEGCFFLLTSGSMPTKKEAQEVTNEW

SEQ ID NO: 6787 - protein, 23 aa, artificial
  peptide fold or domain or sub-domain
GTPIANRLNQQAPGANITAADVS

SEQ ID NO: 6788 - protein, 25 aa, artificial
  peptide fold or domain or sub-domain
GTPLSDEAFDRLQAEAPDTTIVVHF

SEQ ID NO: 6789 - protein, 22 aa, artificial
  peptide fold or domain or sub-domain
GTQTRERLCDTCGRNQEDCPGH

SEQ ID NO: 6790 - protein, 29 aa, artificial
  peptide fold or domain or sub-domain
GTRIGLDLTDLLTTGTKEDLKPTEIAQPA

SEQ ID NO: 6791 - protein, 27 aa, artificial
  peptide fold or domain or sub-domain
GTRKKERANFFYKRSEFTTAIHLYRRA

SEQ ID NO: 6792 - protein, 25 aa, artificial
  peptide fold or domain or sub-domain
GTRVPFDPNQQAKTVTCSGGENNYH

SEQ ID NO: 6793 - protein, 26 aa, artificial
  peptide fold or domain or sub-domain
GTSANLSGCKSSLNASEAKIQLGDRV

SEQ ID NO: 6794 - protein, 23 aa, artificial
  peptide fold or domain or sub-domain
GTSCGVCSYCKAGYENLCKDVGV

SEQ ID NO: 6795 - protein, 30 aa, artificial
  peptide fold or domain or sub-domain
GTSCGVCSYCKAGYENLCKDVGVFGFDRDG

SEQ ID NO: 6796 - protein, 30 aa, artificial
  peptide fold or domain or sub-domain
GTSIGDFAGLNVGAHVGDDLLLVKANRSLI

SEQ ID NO: 6797 - protein, 22 aa, artificial
  peptide fold or domain or sub-domain
GTSNKQINCATCGESMADCMGH

SEQ ID NO: 6798 - protein, 28 aa, artificial
  peptide fold or domain or sub-domain
GTSRGRGAEYWGPSKLADDQLIRTMGFD

SEQ ID NO: 6799 - protein, 28 aa, artificial
  peptide fold or domain or sub-domain
GTTDILFSNDDALVYKRQFFDKQVIVAV

SEQ ID NO: 6800 - protein, 28 aa, artificial
  peptide fold or domain or sub-domain
GTTEEYVQYLKQFNKKRDVLDNAENIKK

SEQ ID NO: 6801 - protein, 27 aa, artificial
  peptide fold or domain or sub-domain
GTTMDDIAKEANVAKGTLYYHFKSKEE

SEQ ID NO: 6802 - protein, 26 aa, artificial
  peptide fold or domain or sub-domain
GTTNGGEQWRLAALPFLSQRYAVRAV

SEQ ID NO: 6803 - protein, 22 aa, artificial
  peptide fold or domain or sub-domain
GTVFWYKGNTLIESATQENIIH

SEQ ID NO: 6804 - protein, 30 aa, artificial
  peptide fold or domain or sub-domain
GTVHFTDAKEDARATGTRIFVDGRLIGYYK

SEQ ID NO: 6805 - protein, 24 aa, artificial
  peptide fold or domain or sub-domain
GTVKGVDGQGVLHLETAEGKQTVV

SEQ ID NO: 6806 - protein, 29 aa, artificial
  peptide fold or domain or sub-domain
GTVKPDTRFAPQDWRAKSDIFSGDGFLRN

SEQ ID NO: 6807 - protein, 27 aa, artificial
  peptide fold or domain or sub-domain
GTVLRVSPSGQKVHMRCVDGREIDCNL

SEQ ID NO: 6808 - protein, 26 aa, artificial
  peptide fold or domain or sub-domain
GTVRFYNKERGFGFVVSDDGESVFLP

SEQ ID NO: 6809 - protein, 29 aa, artificial
  peptide fold or domain or sub-domain
GTVYVADEGGMCVHVFSNTGAWIRTIGTP

SEQ ID NO: 6810 - protein, 29 aa, artificial
  peptide fold or domain or sub-domain
GTVYVTFAGGNAIEKYGGTGELLSRYDSS

SEQ ID NO: 6811 - protein, 29 aa, artificial
  peptide fold or domain or sub-domain
GTWEGGREKAPAAMCRKVAIAKLTGNHEI

SEQ ID NO: 6812 - protein, 24 aa, artificial
  peptide fold or domain or sub-domain
GVACGVAENGALLAQTAQGTRSFH

SEQ ID NO: 6813 - protein, 29 aa, artificial
  peptide fold or domain or sub-domain
GVACHGKPLVNEKADVAIRIGSLHSMLYF

SEQ ID NO: 6814 - protein, 21 aa, artificial
  peptide fold or domain or sub-domain
GVADGSFNEGLISVAKQTLQP

SEQ ID NO: 6815 - protein, 22 aa, artificial
  peptide fold or domain or sub-domain
GVAELVAHHQAAHDDYRAIMVE

SEQ ID NO: 6816 - protein, 29 aa, artificial
  peptide fold or domain or sub-domain
GVAERVVELLSHCSFLVQTPALRTVGNIV

SEQ ID NO: 6817 - protein, 20 aa, artificial
  peptide fold or domain or sub-domain
GVAFIYEQCQKTQEDYRSIL

SEQ ID NO: 6818 - protein, 24 aa, artificial
  peptide fold or domain or sub-domain
GVAGRYPLAWGSRGLANHLWRTMA

SEQ ID NO: 6819 - protein, 24 aa, artificial
  peptide fold or domain or sub-domain
GVAISVAADGALLVDTSTGVVQLR

SEQ ID NO: 6820 - protein, 20 aa, artificial
  peptide fold or domain or sub-domain
GVAKFQRDVFPKNKEVFQKL

SEQ ID NO: 6821 - protein, 29 aa, artificial
  peptide fold or domain or sub-domain
GVAMENASELVKKSADFVTTANDADGIYY

SEQ ID NO: 6822 - protein, 29 aa, artificial
  peptide fold or domain or sub-domain
GVAMGNAPNEIKQAANVVTATNNEDGLAL

SEQ ID NO: 6823 - protein, 29 aa, artificial
  peptide fold or domain or sub-domain
GVARILGNRRVSGVETSDGRTLPADLVLI

SEQ ID NO: 6824 - protein, 29 aa, artificial
  peptide fold or domain or sub-domain
GVAWRAKSKVQLEAPTRLNGESMLDILYL

SEQ ID NO: 6825 - protein, 28 aa, artificial
  peptide fold or domain or sub-domain
GVCEGCGEDIPVARLKASPATRLCVFCQ

SEQ ID NO: 6826 - protein, 28 aa, artificial
  peptide fold or domain or sub-domain
GVCEMCDDEIDVERLKVKPHAKYCINCR

SEQ ID NO: 6827 - protein, 24 aa, artificial
  peptide fold or domain or sub-domain
GVCQGIDTSGALLLESEDGLRAYH

SEQ ID NO: 6828 - protein, 28 aa, artificial
  peptide fold or domain or sub-domain
GVCQNCHESIEVDRVMADPLVTFCLGCL

SEQ ID NO: 6829 - protein, 29 aa, artificial
  peptide fold or domain or sub-domain
GVDTKLFKDITNDTEFYEMLEDEENVQVV

SEQ ID NO: 6830 - protein, 30 aa, artificial
  peptide fold or domain or sub-domain
GVEEIDTVTPTDFLHYCTVFLNGTLIGIHR

SEQ ID NO: 6831 - protein, 22 aa, artificial
  peptide fold or domain or sub-domain
GVEELSKAYEDDGDDYSSIMVK

SEQ ID NO: 6832 - protein, 20 aa, artificial
  peptide fold or domain or sub-domain
GVEQFSDEVFPATQALFESL

SEQ ID NO: 6833 - protein, 26 aa, artificial
  peptide fold or domain or sub-domain
GVEVLVNEPYEKDDGEKGQYTHKIYH

SEQ ID NO: 6834 - protein, 26 aa, artificial
  peptide fold or domain or sub-domain
GVEVVQNEPFEDPHHGNGQFTEKRVY

SEQ ID NO: 6835 - protein, 27 aa, artificial
  peptide fold or domain or sub-domain
GVFFTGSTATGRTIAQKCALRPHLLEL

SEQ ID NO: 6836 - protein, 20 aa, artificial
  peptide fold or domain or sub-domain
GVFTHQREAAKAAGLSQSTV

SEQ ID NO: 6837 - protein, 25 aa, artificial
  peptide fold or domain or sub-domain
GVGDVNYKGKKCEAISVLDEFGWEP

SEQ ID NO: 6838 - protein, 24 aa, artificial
  peptide fold or domain or sub-domain
GVGGGIDETGNYLLKTAEGEIPVR

SEQ ID NO: 6839 - protein, 29 aa, artificial
  peptide fold or domain or sub-domain
GVGISGREGLQAARAADYSVGKFRFLKRL

SEQ ID NO: 6840 - protein, 25 aa, artificial
  peptide fold or domain or sub-domain
GVGKIDVGGAIMPAAEALAQAELTP

SEQ ID NO: 6841 - protein, 20 aa, artificial
  peptide fold or domain or sub-domain
GVGNFDPKKDPAKFNLVDPP

SEQ ID NO: 6842 - protein, 30 aa, artificial
  peptide fold or domain or sub-domain
GVGVPPHDSFNLGVRAGDRPEAVAENRRRL

SEQ ID NO: 6843 - protein, 29 aa, artificial
  peptide fold or domain or sub-domain
GVHFYACGPAPMLDAFEAATAGLPEGHAH

SEQ ID NO: 6844 - protein, 30 aa, artificial
  peptide fold or domain or sub-domain
GVIERDLAEVIYVLRKMGCVIDLRENKAFI

SEQ ID NO: 6845 - protein, 30 aa, artificial
  peptide fold or domain or sub-domain
GVIPTHLESIIAKLVEMGVIVEEYDDVIRV

SEQ ID NO: 6846 - protein, 20 aa, artificial
  peptide fold or domain or sub-domain
GVIQFRNTIRKDLVKQFEEI

SEQ ID NO: 6847 - protein, 26 aa, artificial
  peptide fold or domain or sub-domain
GVIRWNEDKTLNLERLILPVYDENKN

SEQ ID NO: 6848 - protein, 22 aa, artificial
  peptide fold or domain or sub-domain
GVISEEEYKTYKDNGYTMNDMI

SEQ ID NO: 6849 - protein, 23 aa, artificial
  peptide fold or domain or sub-domain
GVKAIEQTDRLNGATARSARNWL

SEQ ID NO: 6850 - protein, 29 aa, artificial
  peptide fold or domain or sub-domain
GVKDACGDFTQTTELLLNRPDNFSILTGE

SEQ ID NO: 6851 - protein, 29 aa, artificial
  peptide fold or domain or sub-domain
GVKDATCDISRPLNLKTLVQKDIVLFSGD

SEQ ID NO: 6852 - protein, 29 aa, artificial
  peptide fold or domain or sub-domain
GVKDATGNLLRPSLERMACGEDFNLLTGE

SEQ ID NO: 6853 - protein, 29 aa, artificial
  peptide fold or domain or sub-domain
GVKDSSGDFRYHLDLIHLLGKRLSVLQGL

SEQ ID NO: 6854 - protein, 29 aa, artificial
  peptide fold or domain or sub-domain
GVKDSSGNFDNILQYIESTDDSFAVLSGN

SEQ ID NO: 6855 - protein, 29 aa, artificial
  peptide fold or domain or sub-domain
GVKEASGDISQIAEIARIMGKSFEIYSGN

SEQ ID NO: 6856 - protein, 29 aa, artificial
  peptide fold or domain or sub-domain
GVKEASGNIGSNIELINRAPEGFVVLSGD

SEQ ID NO: 6857 - protein, 29 aa, artificial
  peptide fold or domain or sub-domain
GVKESNKDFEHVNRVLWHCGRDFLLFSGI

SEQ ID NO: 6858 - protein, 29 aa, artificial
  peptide fold or domain or sub-domain
GVKESSGDFSHALRMLQANFDDFEVVCGC

SEQ ID NO: 6859 - protein, 24 aa, artificial
  peptide fold or domain or sub-domain
GVKPLHKSVAKHGGGNLPPVMLVN

SEQ ID NO: 6860 - protein, 20 aa, artificial
  peptide fold or domain or sub-domain
GVKQEALAKGLSANAADQTL

SEQ ID NO: 6861 - protein, 22 aa, artificial
  peptide fold or domain or sub-domain
GVKVILFNNSRLGMVRELQKTK

SEQ ID NO: 6862 - protein, 28 aa, artificial
  peptide fold or domain or sub-domain
GVLAVGGLRIDPLGRSVFKDGREIALTP

SEQ ID NO: 6863 - protein, 29 aa, artificial
  peptide fold or domain or sub-domain
GVLEILQDGFGFLRSAAGPDDIYVSPSQI

SEQ ID NO: 6864 - protein, 21 aa, artificial
  peptide fold or domain or sub-domain
GVLELVREEQLLDEATLADIL

SEQ ID NO: 6865 - protein, 29 aa, artificial
  peptide fold or domain or sub-domain
GVLFQPSMATLLAAPDLRATSSYSEVLDI

SEQ ID NO: 6866 - protein, 24 aa, artificial
  peptide fold or domain or sub-domain
GVLHDLGEDGSLIINDGNTVKRFA

SEQ ID NO: 6867 - protein, 23 aa, artificial
  peptide fold or domain or sub-domain
GVLKGKESTVFNSPDTVTELEKY

SEQ ID NO: 6868 - protein, 26 aa, artificial
  peptide fold or domain or sub-domain
GVLLQVRKALDTRTEPGDIRKAMAEF

SEQ ID NO: 6869 - protein, 29 aa, artificial
  peptide fold or domain or sub-domain
GVLNGLQKRYLDDADTSGGSSTKRDLDNM

SEQ ID NO: 6870 - protein, 28 aa, artificial
  peptide fold or domain or sub-domain
GVLVAFAEKTGLVASNGEARRQIKAGGL

SEQ ID NO: 6871 - protein, 27 aa, artificial
  peptide fold or domain or sub-domain
GVLVRDADQADMVRMRHGKGIVVVEGD

SEQ ID NO: 6872 - protein, 27 aa, artificial
  peptide fold or domain or sub-domain
GVLYRDESPQDVIYGDLDQKTGFVLFI

SEQ ID NO: 6873 - protein, 29 aa, artificial
  peptide fold or domain or sub-domain
GVLYVVDNLNSRVCGFDEQGNFLFTFGSK

SEQ ID NO: 6874 - protein, 30 aa, artificial
  peptide fold or domain or sub-domain
GVNPDYLVAVLSELKCAGAKITCDSDSIQL

SEQ ID NO: 6875 - protein, 29 aa, artificial
  peptide fold or domain or sub-domain
GVNVLDFDLNTVIRNVFGTFTQTMYDLNN

SEQ ID NO: 6876 - protein, 25 aa, artificial
  peptide fold or domain or sub-domain
GVPCADCHAVKAQGKRTPLRRAYHR

SEQ ID NO: 6877 - protein, 30 aa, artificial
  peptide fold or domain or sub-domain
GVPCRRCAHCKRGDYHLCESVRFMATPPHD

SEQ ID NO: 6878 - protein, 30 aa, artificial
  peptide fold or domain or sub-domain
GVQIETAVRDRLAAEDKYEEEEEEALEKVI

SEQ ID NO: 6879 - protein, 25 aa, artificial
  peptide fold or domain or sub-domain
GVRDLLDDACTVLPALGEYELAECE

SEQ ID NO: 6880 - protein, 30 aa, artificial
  peptide fold or domain or sub-domain
GVRSQDIVDAVKAQTGTELDPKTIDLPSNM

SEQ ID NO: 6881 - protein, 24 aa, artificial
  peptide fold or domain or sub-domain
GVSAAPIRDCEVACPLTASVSEWQ

SEQ ID NO: 6882 - protein, 28 aa, artificial
  peptide fold or domain or sub-domain
GVSERTGEPIAYERLAAVPWTRVAADDE

SEQ ID NO: 6883 - protein, 30 aa, artificial
  peptide fold or domain or sub-domain
GVSHPHNWYPQHTQAFADIKSHGANTVRVV

SEQ ID NO: 6884 - protein, 30 aa, artificial
  peptide fold or domain or sub-domain
GVSKGIYDSLNVGRGSQDEPADVEENRARI

SEQ ID NO: 6885 - protein, 30 aa, artificial
  peptide fold or domain or sub-domain
GVSKGKYASLNLSLKRFDIKEEVYENFKII

SEQ ID NO: 6886 - protein, 30 aa, artificial
  peptide fold or domain or sub-domain
GVSPEPWSSLNFGSHTGDSAERIATNIGLV

SEQ ID NO: 6887 - protein, 30 aa, artificial
  peptide fold or domain or sub-domain
GVSQGAYQSLNLGTHVGDNPEAVRRNREIV

SEQ ID NO: 6888 - protein, 22 aa, artificial
  peptide fold or domain or sub-domain
GVSQSIVSLSSFAGRKRIRVCS

SEQ ID NO: 6889 - protein, 29 aa, artificial
  peptide fold or domain or sub-domain
GVSRAQSELSTANTEVGKTEAQIAIEAFE

SEQ ID NO: 6890 - protein, 30 aa, artificial
  peptide fold or domain or sub-domain
GVSRPPYNSLNLGSNTEDAAYNVEGNRSTF

SEQ ID NO: 6891 - protein, 30 aa, artificial
  peptide fold or domain or sub-domain
GVSSGIFESMNLGFRRGDYEDLVMENYERI

SEQ ID NO: 6892 - protein, 22 aa, artificial
  peptide fold or domain or sub-domain
GVSSSSLECATCHGNLASCHGH

SEQ ID NO: 6893 - protein, 30 aa, artificial
  peptide fold or domain or sub-domain
GVSYLNNDYVLVSGELINHQAFGHLKQIVV

SEQ ID NO: 6894 - protein, 30 aa, artificial
  peptide fold or domain or sub-domain
GVTPIDGAPHRSYSECYPVLLDGVMVGWVD

SEQ ID NO: 6895 - protein, 30 aa, artificial
  peptide fold or domain or sub-domain
GVTSEILGCLAHELEGMGGKVTDVPDGLVV

SEQ ID NO: 6896 - protein, 30 aa, artificial
  peptide fold or domain or sub-domain
GVTVFASARGPGSASELKDWSKTHSNVHII

SEQ ID NO: 6897 - protein, 28 aa, artificial
  peptide fold or domain or sub-domain
GVVEGLLGGLGGGLEVAVVNGPGQVVVA

SEQ ID NO: 6898 - protein, 23 aa, artificial
  peptide fold or domain or sub-domain
GVVIKEHTKINAHVTVASGTFLP

SEQ ID NO: 6899 - protein, 29 aa, artificial
  peptide fold or domain or sub-domain
GVVIVTRREWFEVVEKRVFHEKVLGIVEG

SEQ ID NO: 6900 - protein, 26 aa, artificial
  peptide fold or domain or sub-domain
GVVKVYYPLKGFGFISRAKGKDLFFY

SEQ ID NO: 6901 - protein, 29 aa, artificial
  peptide fold or domain or sub-domain
GVVMNESADISKQMSDILLLDNRLDFFQE

SEQ ID NO: 6902 - protein, 30 aa, artificial
  peptide fold or domain or sub-domain
GVVQSREGGQVNVKTQTDETVKVKEEDCLP

SEQ ID NO: 6903 - protein, 27 aa, artificial
  peptide fold or domain or sub-domain
GVVSLLGHFLGIHAPGIKDLRTSLEVS

SEQ ID NO: 6904 - protein, 20 aa, artificial
  peptide fold or domain or sub-domain
GVVVDYHYYPTATHLLTVNT

SEQ ID NO: 6905 - protein, 21 aa, artificial
  peptide fold or domain or sub-domain
GVYEILLERGLMQKEHLDAVL

SEQ ID NO: 6906 - protein, 25 aa, artificial
  peptide fold or domain or sub-domain
GVYRAVTPQGRPVAEYWNSQKEVLE

SEQ ID NO: 6907 - protein, 30 aa, artificial
  peptide fold or domain or sub-domain
GVYSQASTITSYLEHFVNAGLPLIIGEFGH

SEQ ID NO: 6908 - protein, 28 aa, artificial
  peptide fold or domain or sub-domain
GWCDDSGEPIGLKRLLISPTTKYCIEAQ

SEQ ID NO: 6909 - protein, 27 aa, artificial
  peptide fold or domain or sub-domain
GWCGIQYPEKYGGSGNTYVEYVIMQIE

SEQ ID NO: 6910 - protein, 28 aa, artificial
  peptide fold or domain or sub-domain
GWCNQCGALIALGRLVFDPATPLCITCA

SEQ ID NO: 6911 - protein, 27 aa, artificial
  peptide fold or domain or sub-domain
GWDARKANGRALGLAAHRSFLSYVAVV

SEQ ID NO: 6912 - protein, 29 aa, artificial
  peptide fold or domain or sub-domain
GWEFTGLDQDDDAVEITVRTPEGERRLRA

SEQ ID NO: 6913 - protein, 27 aa, artificial
  peptide fold or domain or sub-domain
GWGHAWSDNDKPEAVWHWSETRKQYYY

SEQ ID NO: 6914 - protein, 30 aa, artificial
  peptide fold or domain or sub-domain
GWGVCATCRRPEEARELTALAAQHRDVSVH

SEQ ID NO: 6915 - protein, 29 aa, artificial
  peptide fold or domain or sub-domain
GWHPSWGSPTTNTRGKITQRFIDNTHLIL

SEQ ID NO: 6916 - protein, 30 aa, artificial
  peptide fold or domain or sub-domain
GWKYYYRVYRFKLIKSLLLLLGKKDAVEKL

SEQ ID NO: 6917 - protein, 27 aa, artificial
  peptide fold or domain or sub-domain
GWLYNDIFYETTEAFRHAFFSTGFVKL

SEQ ID NO: 6918 - protein, 27 aa, artificial
  peptide fold or domain or sub-domain
GWMGLPIPAKYNGAGHDFITYMMTIHE

SEQ ID NO: 6919 - protein, 23 aa, artificial
  peptide fold or domain or sub-domain
GWNIKEALIKVDKTNEDFYEENY

SEQ ID NO: 6920 - protein, 29 aa, artificial
  peptide fold or domain or sub-domain
GWNLIFRNMKEEDGEILNFLSHPETMFEQ

SEQ ID NO: 6921 - protein, 26 aa, artificial
  peptide fold or domain or sub-domain
GWNSAEGKAMLSGKRTLEDIAERVVK

SEQ ID NO: 6922 - protein, 26 aa, artificial
  peptide fold or domain or sub-domain
GWNSELGQQILKGQMSLADLAKYAQE

SEQ ID NO: 6923 - protein, 22 aa, artificial
  peptide fold or domain or sub-domain
GWQQVDPEIVACAESWWSNDVW

SEQ ID NO: 6924 - protein, 30 aa, artificial
  peptide fold or domain or sub-domain
GWQVIATCRSPENAKQLNELVTQSNQLQLM

SEQ ID NO: 6925 - protein, 27 aa, artificial
  peptide fold or domain or sub-domain
GWRCVLETSIRRGLSLREAATVTAVER

SEQ ID NO: 6926 - protein, 22 aa, artificial
  peptide fold or domain or sub-domain
GWRQIDNDIITCGDVSWTYNTA

SEQ ID NO: 6927 - protein, 27 aa, artificial
  peptide fold or domain or sub-domain
GWRVHTQPQQQALRQGEPADIVHGQGV

SEQ ID NO: 6928 - protein, 27 aa, artificial
  peptide fold or domain or sub-domain
GWTGINEAEKYGGQALPLSVGFTTREM

SEQ ID NO: 6929 - protein, 29 aa, artificial
  peptide fold or domain or sub-domain
GWTLDIKTHSGFLGGLDKTYLSTGEYIRY

SEQ ID NO: 6930 - protein, 30 aa, artificial
  peptide fold or domain or sub-domain
GWTVLGTCRDPDNAVEAKALAAAEPCVTLY

SEQ ID NO: 6931 - protein, 26 aa, artificial
  peptide fold or domain or sub-domain
GWVISADKTTGGSTEYHDQVRNANEV

SEQ ID NO: 6932 - protein, 27 aa, artificial
  peptide fold or domain or sub-domain
GWVYGNEFYKDLDGLRAAVAKPDFKPL

SEQ ID NO: 6933 - protein, 29 aa, artificial
  peptide fold or domain or sub-domain
GYAEVVDEVTALFRSNQKDKAAEIIPNEL

SEQ ID NO: 6934 - protein, 23 aa, artificial
  peptide fold or domain or sub-domain
GYAPEEGRWVKIPQVGRVVIEHD

SEQ ID NO: 6935 - protein, 28 aa, artificial
  peptide fold or domain or sub-domain
GYCDSCGDDLPEGRLSLDPAATRCVSCA

SEQ ID NO: 6936 - protein, 28 aa, artificial
  peptide fold or domain or sub-domain
GYCEETEEAIEPERLRAIPWTRLSIEGA

SEQ ID NO: 6937 - protein, 28 aa, artificial
  peptide fold or domain or sub-domain
GYCESCGVEIGIRRLEARPTADLCIDCK

SEQ ID NO: 6938 - protein, 27 aa, artificial
  peptide fold or domain or sub-domain
GYCISLDTESLEYDFHKMDLEGCEFYL

SEQ ID NO: 6939 - protein, 20 aa, artificial
  peptide fold or domain or sub-domain
GYDFNRGVNYRALLEAFGTT

SEQ ID NO: 6940 - protein, 29 aa, artificial
  peptide fold or domain or sub-domain
GYDFNRGVNYRALLEAFGTTGFQATNFGR

SEQ ID NO: 6941 - protein, 20 aa, artificial
  peptide fold or domain or sub-domain
GYDFRGTFDLESLIDSYATT

SEQ ID NO: 6942 - protein, 29 aa, artificial
  peptide fold or domain or sub-domain
GYDFRGTFDLESLIDSYATTGFQATHLAE

SEQ ID NO: 6943 - protein, 20 aa, artificial
  peptide fold or domain or sub-domain
GYDFSHSIDYNKIMESMRTI

SEQ ID NO: 6944 - protein, 29 aa, artificial
  peptide fold or domain or sub-domain
GYDFSHSIDYNKIMESMRTIGFQASHFGA

SEQ ID NO: 6945 - protein, 24 aa, artificial
  peptide fold or domain or sub-domain
GYEDVMGQHGLGGRNENGDRFANL

SEQ ID NO: 6946 - protein, 28 aa, artificial
  peptide fold or domain or sub-domain
GYEFALKLVDGLKEGDPDIIASASHEYD

SEQ ID NO: 6947 - protein, 20 aa, artificial
  peptide fold or domain or sub-domain
GYEIKDDNIIKDGRYRLGIP

SEQ ID NO: 6948 - protein, 27 aa, artificial
  peptide fold or domain or sub-domain
GYEILSKFFPGVISQEWDSTLTPNEKG

SEQ ID NO: 6949 - protein, 27 aa, artificial
  peptide fold or domain or sub-domain
GYEVVLGSGEVVYVDQRSHPDLWLALK

SEQ ID NO: 6950 - protein, 23 aa, artificial
  peptide fold or domain or sub-domain
GYEWEKHGTCYPGEVSQNYFFQT

SEQ ID NO: 6951 - protein, 24 aa, artificial
  peptide fold or domain or sub-domain
GYFTELNPLKAVKAIPTAGLLQIV

SEQ ID NO: 6952 - protein, 29 aa, artificial
  peptide fold or domain or sub-domain
GYGDAAREVQDLYLAKRQRDAAAAVPLEL

SEQ ID NO: 6953 - protein, 20 aa, artificial
  peptide fold or domain or sub-domain
GYGGDNLDVTEVMAMDRNGT

SEQ ID NO: 6954 - protein, 27 aa, artificial
  peptide fold or domain or sub-domain
GYGKCGQLGFTTLTETCECVTKFFKPN

SEQ ID NO: 6955 - protein, 25 aa, artificial
  peptide fold or domain or sub-domain
GYHFDLKGDEWICDRSGETFWDLLE

SEQ ID NO: 6956 - protein, 25 aa, artificial
  peptide fold or domain or sub-domain
GYHFEYINKQWICNRTKKDFWNVLQ

SEQ ID NO: 6957 - protein, 25 aa, artificial
  peptide fold or domain or sub-domain
GYHFGYVEGKWLDGRNGGEFMPFVQ

SEQ ID NO: 6958 - protein, 25 aa, artificial
  peptide fold or domain or sub-domain
GYHFKLQEGVWCNTVSGEPLIDMLN

SEQ ID NO: 6959 - protein, 25 aa, artificial
  peptide fold or domain or sub-domain
GYHFNYRDGHWYCSRSGEEFLAKLS

SEQ ID NO: 6960 - protein, 30 aa, artificial
  peptide fold or domain or sub-domain
GYHGPRRKADAEASTGARWYESLDQLLEES

SEQ ID NO: 6961 - protein, 26 aa, artificial
  peptide fold or domain or sub-domain
GYHIANWNPRTNFFLIGKYKNTNIFN

SEQ ID NO: 6962 - protein, 24 aa, artificial
  peptide fold or domain or sub-domain
GYHPLKIGAKHQTLSVFQQGQRMD

SEQ ID NO: 6963 - protein, 27 aa, artificial
  peptide fold or domain or sub-domain
GYHQLRAEQKAKQEAFKRGETREIMGI

SEQ ID NO: 6964 - protein, 29 aa, artificial
  peptide fold or domain or sub-domain
GYICVADSGNNRIQIFHPDGSFLRAFGSW

SEQ ID NO: 6965 - protein, 29 aa, artificial
  peptide fold or domain or sub-domain
GYIIKYEKPGSPPREVVPRPRPGVTEATI

SEQ ID NO: 6966 - protein, 29 aa, artificial
  peptide fold or domain or sub-domain
GYILTYRAEDGSMQTVEKTLTARDNRFAL

SEQ ID NO: 6967 - protein, 25 aa, artificial
  peptide fold or domain or sub-domain
GYITASLGDEMYTFSDGQDNISVEI

SEQ ID NO: 6968 - protein, 25 aa, artificial
  peptide fold or domain or sub-domain
GYKHRLEKVKGSVEPGKFSNLMETV

SEQ ID NO: 6969 - protein, 24 aa, artificial
  peptide fold or domain or sub-domain
GYLFANPRKGKHIITTKIEHPSVL

SEQ ID NO: 6970 - protein, 25 aa, artificial
  peptide fold or domain or sub-domain
GYLIEPLGKEVYVFKDNTGSLNVKI

SEQ ID NO: 6971 - protein, 22 aa, artificial
  peptide fold or domain or sub-domain
GYLKSARYKLGCPTLSAAIAHA

SEQ ID NO: 6972 - protein, 24 aa, artificial
  peptide fold or domain or sub-domain
GYMSAETPSGPFNLLRTEEAGNPI

SEQ ID NO: 6973 - protein, 29 aa, artificial
  peptide fold or domain or sub-domain
GYPGPDDPATPSERGRWKRAANPRPLPPG

SEQ ID NO: 6974 - protein, 30 aa, artificial
  peptide fold or domain or sub-domain
GYPLIITGRRKERLQKLSDQLSPITDVFFY

SEQ ID NO: 6975 - protein, 30 aa, artificial
  peptide fold or domain or sub-domain
GYQFYDEDGNALPACGQSLLNLASVSTENR

SEQ ID NO: 6976 - protein, 24 aa, artificial
  peptide fold or domain or sub-domain
GYQQVGRDFPVFLHPQTHEEYALA

SEQ ID NO: 6977 - protein, 29 aa, artificial
  peptide fold or domain or sub-domain
GYRIRHHPEHFSGRPREDRVPHSRNSITL

SEQ ID NO: 6978 - protein, 30 aa, artificial
  peptide fold or domain or sub-domain
GYRLALAARTAETLRQTAIELEQSLNAEVL

SEQ ID NO: 6979 - protein, 20 aa, artificial
  peptide fold or domain or sub-domain
GYRNFMAGRYSAESARYRSL

SEQ ID NO: 6980 - protein, 29 aa, artificial
  peptide fold or domain or sub-domain
GYRRQIVSSKVLEDPSFLKSLREIDVEPV

SEQ ID NO: 6981 - protein, 29 aa, artificial
  peptide fold or domain or sub-domain
GYRVRVTPKEKTGPMKEINLAPDSSSVVV

SEQ ID NO: 6982 - protein, 29 aa, artificial
  peptide fold or domain or sub-domain
GYRVVVTPRNQLATSKEMTVSPDSTQVLV

SEQ ID NO: 6983 - protein, 30 aa, artificial
  peptide fold or domain or sub-domain
GYSEGAYASFNCSPFSGDKLERVEKNQTLL

SEQ ID NO: 6984 - protein, 22 aa, artificial
  peptide fold or domain or sub-domain
GYSGRGGLETKRRLLALEGVPL

SEQ ID NO: 6985 - protein, 30 aa, artificial
  peptide fold or domain or sub-domain
GYSHNPYNYLNLGFHVGDDSNTVVENRKRL

SEQ ID NO: 6986 - protein, 29 aa, artificial
  peptide fold or domain or sub-domain
GYSKPAQAAVIMSGLGFSGNQQQEPVNSF

SEQ ID NO: 6987 - protein, 20 aa, artificial
  peptide fold or domain or sub-domain
GYSLDWFKRTFAPNESFEQL

SEQ ID NO: 6988 - protein, 20 aa, artificial
  peptide fold or domain or sub-domain
GYSLEWLKQLISADENFTTF

SEQ ID NO: 6989 - protein, 26 aa, artificial
  peptide fold or domain or sub-domain
GYTIHHPTDEQTTVFEASRRYRDEGI

SEQ ID NO: 6990 - protein, 26 aa, artificial
  peptide fold or domain or sub-domain
GYTVHFPDRKIASVYEVAMQYKKEGV

SEQ ID NO: 6991 - protein, 30 aa, artificial
  peptide fold or domain or sub-domain
GYTWSGGQGTATINVSGKTVFDVLDDIKQV

SEQ ID NO: 6992 - protein, 29 aa, artificial
  peptide fold or domain or sub-domain
GYVALQNDRLRRVTALGVQQENIDGADHL

SEQ ID NO: 6993 - protein, 29 aa, artificial
  peptide fold or domain or sub-domain
GYVLAINEHDHVAQNLPLTQKHKAHFCKG

SEQ ID NO: 6994 - protein, 27 aa, artificial
  peptide fold or domain or sub-domain
GYVVIIDPARSEIAKLMNVKRPGKFAL

SEQ ID NO: 6995 - protein, 29 aa, artificial
  peptide fold or domain or sub-domain
GYYITYEEAGGLPLELVPRPHATQSYAII

SEQ ID NO: 6996 - protein, 30 aa, artificial
  peptide fold or domain or sub-domain
GYYWLKIHGANCAGVDKVPFPERIKFIEEN

SEQ ID NO: 6997 - protein, 25 aa, artificial
  peptide fold or domain or sub-domain
HAAIIVFSPAGKLHCFGEPNTDQIL

SEQ ID NO: 6998 - protein, 30 aa, artificial
  peptide fold or domain or sub-domain
HAALANAEGGIDRDLAPDGIHPNAKGYAVM

SEQ ID NO: 6999 - protein, 23 aa, artificial
  peptide fold or domain or sub-domain
HAAVEKLQVAHGIDEESAYAILR

SEQ ID NO: 7000 - protein, 25 aa, artificial
  peptide fold or domain or sub-domain
HADALLKKSNKATAENSLEEALADV

SEQ ID NO: 7001 - protein, 26 aa, artificial
  peptide fold or domain or sub-domain
HADLSQAVREQVLAAFKAGEVTALVA

SEQ ID NO: 7002 - protein, 29 aa, artificial
  peptide fold or domain or sub-domain
HADNVDSNASQPRDTVKFWDGNNVQIAAT

SEQ ID NO: 7003 - protein, 30 aa, artificial
  peptide fold or domain or sub-domain
HAEAVDFLDLLIEALETDKEDVETTVDNLL

SEQ ID NO: 7004 - protein, 22 aa, artificial
  peptide fold or domain or sub-domain
HAEKDIGKRIGDLTERLARLGR

SEQ ID NO: 7005 - protein, 28 aa, artificial
  peptide fold or domain or sub-domain
HAEKDIGKRIGDLTERLARLGRLYTQVH

SEQ ID NO: 7006 - protein, 22 aa, artificial
  peptide fold or domain or sub-domain
HAFLKEQWPEVYRQWLEDRRST

SEQ ID NO: 7007 - protein, 23 aa, artificial
  peptide fold or domain or sub-domain
HAFVEDDCGGDFKKMLLAILHGE

SEQ ID NO: 7008 - protein, 26 aa, artificial
  peptide fold or domain or sub-domain
HAGLDSEHRQRVQQQFLEGRIEVMVA

SEQ ID NO: 7009 - protein, 25 aa, artificial
  peptide fold or domain or sub-domain
HAGNAIPSADQIRIAPSLKSQRGSV

SEQ ID NO: 7010 - protein, 26 aa, artificial
  peptide fold or domain or sub-domain
HAGTPAEEREEAIDGFSEGDVDVLVA

SEQ ID NO: 7011 - protein, 30 aa, artificial
  peptide fold or domain or sub-domain
HAHRGGRDLFPENSMSAFLRSAGLGVTAIE

SEQ ID NO: 7012 - protein, 28 aa, artificial
  peptide fold or domain or sub-domain
HAISRLCNQALAEDRPLGEVLRADPQVA

SEQ ID NO: 7013 - protein, 25 aa, artificial
  peptide fold or domain or sub-domain
HAKAAANRAFDVDLISGLEYEADQF

SEQ ID NO: 7014 - protein, 24 aa, artificial
  peptide fold or domain or sub-domain
HAKRTLVVDTNKYNKPPNGKNRVK

SEQ ID NO: 7015 - protein, 27 aa, artificial
  peptide fold or domain or sub-domain
HAKVMEYGALDKSDEVLKQWLDVLADK

SEQ ID NO: 7016 - protein, 30 aa, artificial
  peptide fold or domain or sub-domain
HAKYKYEIECPDNVPKSFLKEVEITSVKKG

SEQ ID NO: 7017 - protein, 23 aa, artificial
  peptide fold or domain or sub-domain
HALAVTKRGVDELLIEEEFAQKL

SEQ ID NO: 7018 - protein, 27 aa, artificial
  peptide fold or domain or sub-domain
HAPYLEIAPYFLTSETDRKSFAKMARR

SEQ ID NO: 7019 - protein, 22 aa, artificial
  peptide fold or domain or sub-domain
HAQRAGEIPEEFPIVWRKNATM

SEQ ID NO: 7020 - protein, 20 aa, artificial
  peptide fold or domain or sub-domain
HAQVNAGMTVGELASEYEHA

SEQ ID NO: 7021 - protein, 29 aa, artificial
  peptide fold or domain or sub-domain
HAQVNAGMTVGELASEYEHAGIGAASMDT

SEQ ID NO: 7022 - protein, 27 aa, artificial
  peptide fold or domain or sub-domain
HAREIEDLVTALVQMGYDRKMAAEVIA

SEQ ID NO: 7023 - protein, 27 aa, artificial
  peptide fold or domain or sub-domain
HARLISGNSELAIELKFRFIDLPAVIN

SEQ ID NO: 7024 - protein, 29 aa, artificial
  peptide fold or domain or sub-domain
HARQSWERQAELLSPEEAQALADAQVDYL

SEQ ID NO: 7025 - protein, 28 aa, artificial
  peptide fold or domain or sub-domain
HARSKNWRMSVRCGGMPLRWLIELGNSD

SEQ ID NO: 7026 - protein, 27 aa, artificial
  peptide fold or domain or sub-domain
HASIERALRADGLAEKLAASRAWLILA

SEQ ID NO: 7027 - protein, 24 aa, artificial
  peptide fold or domain or sub-domain
HAVCREYIPNGENLSNEEVDEYAA

SEQ ID NO: 7028 - protein, 23 aa, artificial
  peptide fold or domain or sub-domain
HAVDLIKDMTLEQVREVFNIVND

SEQ ID NO: 7029 - protein, 25 aa, artificial
  peptide fold or domain or sub-domain
HAVYEDFKKLAEQDEEGQFDLEQRY

SEQ ID NO: 7030 - protein, 22 aa, artificial
  peptide fold or domain or sub-domain
HCDLEELRKLKAINSIAFHAAK

SEQ ID NO: 7031 - protein, 25 aa, artificial
  peptide fold or domain or sub-domain
HCDQELRVGMKGNSETEIDEKLQDI

SEQ ID NO: 7032 - protein, 20 aa, artificial
  peptide fold or domain or sub-domain
HCKIKALVQANIIPQFFYND

SEQ ID NO: 7033 - protein, 22 aa, artificial
  peptide fold or domain or sub-domain
HCPIKELEAVALEQHGFIISAH

SEQ ID NO: 7034 - protein, 25 aa, artificial
  peptide fold or domain or sub-domain
HCPLCKAPISLIASPIRCQNSHSFD

SEQ ID NO: 7035 - protein, 20 aa, artificial
  peptide fold or domain or sub-domain
HCRAGTFQCKNTNCTPSATI

SEQ ID NO: 7036 - protein, 26 aa, artificial
  peptide fold or domain or sub-domain
HCSDLLMPYTEHGRRNLLAEGIPGQR

SEQ ID NO: 7037 - protein, 23 aa, artificial
  peptide fold or domain or sub-domain
HDAAFYQSLWQALHNRDAWSGEV

SEQ ID NO: 7038 - protein, 23 aa, artificial
  peptide fold or domain or sub-domain
HDAIIENENLSDKHKSIITEKLA

SEQ ID NO: 7039 - protein, 24 aa, artificial
  peptide fold or domain or sub-domain
HDALVQIISKEVGVEKLEAMKTLA

SEQ ID NO: 7040 - protein, 25 aa, artificial
  peptide fold or domain or sub-domain
HDDIPETCFYMAGTIDEVVERAREL

SEQ ID NO: 7041 - protein, 27 aa, artificial
  peptide fold or domain or sub-domain
HDEAWAKEKKMNSFLSVTNGTKEAAKF

SEQ ID NO: 7042 - protein, 20 aa, artificial
  peptide fold or domain or sub-domain
HDEAYLRTLGLSQPKARYAR

SEQ ID NO: 7043 - protein, 21 aa, artificial
  peptide fold or domain or sub-domain
HDEFEGSEVNKEYWTFEKGNG

SEQ ID NO: 7044 - protein, 30 aa, artificial
  peptide fold or domain or sub-domain
HDELDQLLDNARQATDEEERLELYRKAQNV

SEQ ID NO: 7045 - protein, 24 aa, artificial
  peptide fold or domain or sub-domain
HDFDKYGTTNYEGAAVIDPYAAEH

SEQ ID NO: 7046 - protein, 27 aa, artificial
  peptide fold or domain or sub-domain
HDFETKQAEMIVKFWGPLRWTFNKDIK

SEQ ID NO: 7047 - protein, 27 aa, artificial
  peptide fold or domain or sub-domain
HDFFFGKILPVVSYQVGELNLGYALLP

SEQ ID NO: 7048 - protein, 27 aa, artificial
  peptide fold or domain or sub-domain
HDGRHLSKLREMVGYESLPAEYGGPAT

SEQ ID NO: 7049 - protein, 27 aa, artificial
  peptide fold or domain or sub-domain
HDLDVSTVKLKLRLWGFLPWSVSREVL

SEQ ID NO: 7050 - protein, 20 aa, artificial
  peptide fold or domain or sub-domain
HDLESRVEEEEERNQILQNE

SEQ ID NO: 7051 - protein, 23 aa, artificial
  peptide fold or domain or sub-domain
HDPNAIYFLQARGIDAKTAADAL

SEQ ID NO: 7052 - protein, 20 aa, artificial
  peptide fold or domain or sub-domain
HDPTQGMRQGNDHGSQYRSA

SEQ ID NO: 7053 - protein, 20 aa, artificial
  peptide fold or domain or sub-domain
HDPTTLNRQGRYVGLNMDLG

SEQ ID NO: 7054 - protein, 30 aa, artificial
  peptide fold or domain or sub-domain
HDQLPLKGMKIRDSDNKTGSEFAFIIDAQG

SEQ ID NO: 7055 - protein, 28 aa, artificial
  peptide fold or domain or sub-domain
HDRLADLIADRPGLSIAAVNAPSAGVVS

SEQ ID NO: 7056 - protein, 29 aa, artificial
  peptide fold or domain or sub-domain
HDSVQAGSPLREGYEGNGFKEYVEQRRGK

SEQ ID NO: 7057 - protein, 25 aa, artificial
  peptide fold or domain or sub-domain
HDTFRDAVKGSTFDLNKGGFCAGNI

SEQ ID NO: 7058 - protein, 28 aa, artificial
  peptide fold or domain or sub-domain
HDVFDNDPQKIGRTVGNVVVKHIDELKK

SEQ ID NO: 7059 - protein, 21 aa, artificial
  peptide fold or domain or sub-domain
HDYWVELLGHPRRDRDFIRET

SEQ ID NO: 7060 - protein, 20 aa, artificial
  peptide fold or domain or sub-domain
HEAGTATLANMLLDGELDLA

SEQ ID NO: 7061 - protein, 27 aa, artificial
  peptide fold or domain or sub-domain
HEALRRDIADLDAQLSEGNTSGATEWL

SEQ ID NO: 7062 - protein, 29 aa, artificial
  peptide fold or domain or sub-domain
HEAQTELWLKEFTPTASGFRARVDGQWGE

SEQ ID NO: 7063 - protein, 20 aa, artificial
  peptide fold or domain or sub-domain
HEAQTHQLLAQLDSGKLDAV

SEQ ID NO: 7064 - protein, 30 aa, artificial
  peptide fold or domain or sub-domain
HEAVKDDFPTFEEFAKERGYEGGFVAEKVV

SEQ ID NO: 7065 - protein, 28 aa, artificial
  peptide fold or domain or sub-domain
HEERIAGMLQHYDFVNPDIMSYFKRRLT

SEQ ID NO: 7066 - protein, 30 aa, artificial
  peptide fold or domain or sub-domain
HEFILVLRKGNVKSGRTQRDDALPAKHEEF

SEQ ID NO: 7067 - protein, 21 aa, artificial
  peptide fold or domain or sub-domain
HEFVQLYYALFQSRVDELLKM

SEQ ID NO: 7068 - protein, 26 aa, artificial
  peptide fold or domain or sub-domain
HEIKSVKRVEEENKWQIGIDGIEELV

SEQ ID NO: 7069 - protein, 23 aa, artificial
  peptide fold or domain or sub-domain
HEKAFFETMWNNLLGGGKWNGEI

SEQ ID NO: 7070 - protein, 27 aa, artificial
  peptide fold or domain or sub-domain
HEKYIQMDSPREVNLDFTTKEITKKSI

SEQ ID NO: 7071 - protein, 22 aa, artificial
  peptide fold or domain or sub-domain
HELLANDKEEQIRADLARVIRV

SEQ ID NO: 7072 - protein, 29 aa, artificial
  peptide fold or domain or sub-domain
HELLARCLSFPSFYGQNWDAFWDSISDLV

SEQ ID NO: 7073 - protein, 29 aa, artificial
  peptide fold or domain or sub-domain
HELRALTVTDTGAEAEATGPDGRPVRVSA

SEQ ID NO: 7074 - protein, 28 aa, artificial
  peptide fold or domain or sub-domain
HELTLTGFKYPLNNCHITLGSTLCISNE

SEQ ID NO: 7075 - protein, 26 aa, artificial
  peptide fold or domain or sub-domain
HEMARRFIDIVKLDDAQGKKLHALAA

SEQ ID NO: 7076 - protein, 27 aa, artificial
  peptide fold or domain or sub-domain
HEPSSNTRVFPNPNNKQALYYSELLQI

SEQ ID NO: 7077 - protein, 27 aa, artificial
  peptide fold or domain or sub-domain
HEQFPPTVYEHHRNSAIFFIQGNRNPF

SEQ ID NO: 7078 - protein, 29 aa, artificial
  peptide fold or domain or sub-domain
HEQSLLLNRLPPTLDENSLAPLKSLSQKQ

SEQ ID NO: 7079 - protein, 25 aa, artificial
  peptide fold or domain or sub-domain
HERVGRLLKGSLTGPKRDSLTIRFN

SEQ ID NO: 7080 - protein, 24 aa, artificial
  peptide fold or domain or sub-domain
HERVYTDLFDPQSEFDAGHIRLAR

SEQ ID NO: 7081 - protein, 24 aa, artificial
  peptide fold or domain or sub-domain
HETLSLIITKHMSIDEADAQALLH

SEQ ID NO: 7082 - protein, 22 aa, artificial
  peptide fold or domain or sub-domain
HETNTYPDISWFEQELGVKAPG

SEQ ID NO: 7083 - protein, 28 aa, artificial
  peptide fold or domain or sub-domain
HEVLGNMAEEKGLPRDHLASLLKHQRRW

SEQ ID NO: 7084 - protein, 24 aa, artificial
  peptide fold or domain or sub-domain
HEVLRLLRRAGEAGALRAAGRGEG

SEQ ID NO: 7085 - protein, 23 aa, artificial
  peptide fold or domain or sub-domain
HEVRTLRETGGDDQAVGAMATAW

SEQ ID NO: 7086 - protein, 25 aa, artificial
  peptide fold or domain or sub-domain
HEWTALTEKAYATKLTWENNKVSLK

SEQ ID NO: 7087 - protein, 28 aa, artificial
  peptide fold or domain or sub-domain
HEYQLQTADILKQTIGLSTFYPQYTINS

SEQ ID NO: 7088 - protein, 29 aa, artificial
  peptide fold or domain or sub-domain
HEYTDDEFDSWEKLNTIDQIMFDTRMFDA

SEQ ID NO: 7089 - protein, 23 aa, artificial
  peptide fold or domain or sub-domain
HEYYITNDNFDTNFKNQISWLLF

SEQ ID NO: 7090 - protein, 23 aa, artificial
  peptide fold or domain or sub-domain
HFAYGWARASDRMAFFKANWFYL

SEQ ID NO: 7091 - protein, 25 aa, artificial
  peptide fold or domain or sub-domain
HFDVSNERQLRRVFNEDIVKELNGS

SEQ ID NO: 7092 - protein, 28 aa, artificial
  peptide fold or domain or sub-domain
HFEPSIVFSSEPQDKAPYEKYLGLEVSL

SEQ ID NO: 7093 - protein, 30 aa, artificial
  peptide fold or domain or sub-domain
HFFDAESWTLGEYFDAEWKPSTGEKGSWTE

SEQ ID NO: 7094 - protein, 22 aa, artificial
  peptide fold or domain or sub-domain
HFGGSSPRLADERLHLAIEGKK

SEQ ID NO: 7095 - protein, 22 aa, artificial
  peptide fold or domain or sub-domain
HFGLTKKAGAREPMFSRGTEIF

SEQ ID NO: 7096 - protein, 27 aa, artificial
  peptide fold or domain or sub-domain
HFGRIGAVVKGDVPYNKDEVAKNAAIV

SEQ ID NO: 7097 - protein, 27 aa, artificial
  peptide fold or domain or sub-domain
HFGRMTPVVKGQAPYDAAQIKANVEVL

SEQ ID NO: 7098 - protein, 24 aa, artificial
  peptide fold or domain or sub-domain
HFHANQTSKGHTGGHHSPVKGAKP

SEQ ID NO: 7099 - protein, 27 aa, artificial
  peptide fold or domain or sub-domain
HFHGSDMKSLQKFLDPSVLPANYKGTL

SEQ ID NO: 7100 - protein, 27 aa, artificial
  peptide fold or domain or sub-domain
HFHLPNSETLFDYVSRDVLPAEYGGNV

SEQ ID NO: 7101 - protein, 30 aa, artificial
  peptide fold or domain or sub-domain
HFIKKVISGEIVVQGKTRKELTEELSKIDM

SEQ ID NO: 7102 - protein, 26 aa, artificial
  peptide fold or domain or sub-domain
HFKDLEKGCHSSIKLQRSFNKHGNVF

SEQ ID NO: 7103 - protein, 24 aa, artificial
  peptide fold or domain or sub-domain
HFQLGEAKTKKNPLTEAISCYRRA

SEQ ID NO: 7104 - protein, 27 aa, artificial
  peptide fold or domain or sub-domain
HFQPNRDHITPTYQLNEFSDLTKLLTL

SEQ ID NO: 7105 - protein, 25 aa, artificial
  peptide fold or domain or sub-domain
HFQRFCVYNGFAIARDGEHALQPED

SEQ ID NO: 7106 - protein, 22 aa, artificial
  peptide fold or domain or sub-domain
HFQSLTNNTTDRSSKDSYKLCL

SEQ ID NO: 7107 - protein, 22 aa, artificial
  peptide fold or domain or sub-domain
HFSGTMVRDTLKNGLSPETYLF

SEQ ID NO: 7108 - protein, 27 aa, artificial
  peptide fold or domain or sub-domain
HFSRLGAMANGRVPFDAKVAADNAEIV

SEQ ID NO: 7109 - protein, 29 aa, artificial
  peptide fold or domain or sub-domain
HFTPFHWVDALLMGKSKRALHILQQLRLE

SEQ ID NO: 7110 - protein, 25 aa, artificial
  peptide fold or domain or sub-domain
HFVEFLDARPQDGAAALMAARPAEL

SEQ ID NO: 7111 - protein, 28 aa, artificial
  peptide fold or domain or sub-domain
HFVYDEKMNDVELYEAGYNRVYDTLEPE

SEQ ID NO: 7112 - protein, 21 aa, artificial
  peptide fold or domain or sub-domain
HGALAVTNGTLVDKNGQPFQL

SEQ ID NO: 7113 - protein, 28 aa, artificial
  peptide fold or domain or sub-domain
HGALMSSLTGAKSDGSASSLSAEAEADA

SEQ ID NO: 7114 - protein, 29 aa, artificial
  peptide fold or domain or sub-domain
HGAYHGSTHLAIAMTTPEYSDGWHKAEGI

SEQ ID NO: 7115 - protein, 26 aa, artificial
  peptide fold or domain or sub-domain
HGCHPLDQDLVNSWPEKPAKYREVVA

SEQ ID NO: 7116 - protein, 20 aa, artificial
  peptide fold or domain or sub-domain
HGDKRFKLYPEKYHEIFNDP

SEQ ID NO: 7117 - protein, 26 aa, artificial
  peptide fold or domain or sub-domain
HGDKSQRDRDKVMDLFKTGRVNTLIA

SEQ ID NO: 7118 - protein, 26 aa, artificial
  peptide fold or domain or sub-domain
HGDLNQSAREAVLGRFRRQQLNVVVA

SEQ ID NO: 7119 - protein, 26 aa, artificial
  peptide fold or domain or sub-domain
HGDLPQSKRNRIVQDLRNGKCKILVA

SEQ ID NO: 7120 - protein, 26 aa, artificial
  peptide fold or domain or sub-domain
HGDLTQAKREKVMKKFRNAEIQFLIA

SEQ ID NO: 7121 - protein, 26 aa, artificial
  peptide fold or domain or sub-domain
HGDMNQAQRNRVMSRFKEGYIELLVA

SEQ ID NO: 7122 - protein, 26 aa, artificial
  peptide fold or domain or sub-domain
HGDRSQREREDALKCFRSGDCPILVA

SEQ ID NO: 7123 - protein, 30 aa, artificial
  peptide fold or domain or sub-domain
HGDWEGKFEPEVEAAYPGELERWRTTPALV

SEQ ID NO: 7124 - protein, 29 aa, artificial
  peptide fold or domain or sub-domain
HGEKLQVFKQSHPDIVNTLFPPLYKELFN

SEQ ID NO: 7125 - protein, 26 aa, artificial
  peptide fold or domain or sub-domain
HGEQIAQWRKAGYQDDPQYADFKALL

SEQ ID NO: 7126 - protein, 26 aa, artificial
  peptide fold or domain or sub-domain
HGETIVQWREAKYQEQEEFAYLKDFF

SEQ ID NO: 7127 - protein, 27 aa, artificial
  peptide fold or domain or sub-domain
HGEVLTAATVNQRSMIPEAHGLFCTEI

SEQ ID NO: 7128 - protein, 29 aa, artificial
  peptide fold or domain or sub-domain
HGGFHGRTVATATMTTSGTRFSAGFSPLM

SEQ ID NO: 7129 - protein, 24 aa, artificial
  peptide fold or domain or sub-domain
HGGHCSTCDQCRQGNFLQCENGEI

SEQ ID NO: 7130 - protein, 26 aa, artificial
  peptide fold or domain or sub-domain
HGGHTQAKRKSTLSKFHSSNAHALVC

SEQ ID NO: 7131 - protein, 26 aa, artificial
  peptide fold or domain or sub-domain
HGGKDQVDRDETISDFKAGNVPIVTA

SEQ ID NO: 7132 - protein, 26 aa, artificial
  peptide fold or domain or sub-domain
HGGKSQEQREISLEGFRAKRYNVLVA

SEQ ID NO: 7133 - protein, 20 aa, artificial
  peptide fold or domain or sub-domain
HGIVDPENCRIVPYSELVKK

SEQ ID NO: 7134 - protein, 30 aa, artificial
  peptide fold or domain or sub-domain
HGKWSGLLVEEVKQKFPKEFEKWLKEPHRV

SEQ ID NO: 7135 - protein, 25 aa, artificial
  peptide fold or domain or sub-domain
HGLQVTSHWTSREFIHQYCAATYTA

SEQ ID NO: 7136 - protein, 26 aa, artificial
  peptide fold or domain or sub-domain
HGNKSQNARQRALGNFKTRQTRVLVA

SEQ ID NO: 7137 - protein, 21 aa, artificial
  peptide fold or domain or sub-domain
HGNLRVKGTHLADEKGETVQL

SEQ ID NO: 7138 - protein, 23 aa, artificial
  peptide fold or domain or sub-domain
HGPAFYEAMWDTMRQTGHWQGEI

SEQ ID NO: 7139 - protein, 27 aa, artificial
  peptide fold or domain or sub-domain
HGPRIGSLLAAVEAWWEDLDYRPDRSQ

SEQ ID NO: 7140 - protein, 30 aa, artificial
  peptide fold or domain or sub-domain
HGQIPLKGVVLEDSELDRSVANCFTLYGGN

SEQ ID NO: 7141 - protein, 21 aa, artificial
  peptide fold or domain or sub-domain
HGQLSISNGELVNERGEQVQL

SEQ ID NO: 7142 - protein, 26 aa, artificial
  peptide fold or domain or sub-domain
HGQMSQSKRLGSLNKFKAKESSILLA

SEQ ID NO: 7143 - protein, 29 aa, artificial
  peptide fold or domain or sub-domain
HGTTLSQTDLYEHTFDKVASIQNLREHPY

SEQ ID NO: 7144 - protein, 25 aa, artificial
  peptide fold or domain or sub-domain
HHALHTLLTGEQRGYYEGFGSIEQM

SEQ ID NO: 7145 - protein, 25 aa, artificial
  peptide fold or domain or sub-domain
HHASDLEGLWRGLANGAFTVWSSDH

SEQ ID NO: 7146 - protein, 25 aa, artificial
  peptide fold or domain or sub-domain
HHAVHVNVTGETTGYYSDFDSLAAL

SEQ ID NO: 7147 - protein, 27 aa, artificial
  peptide fold or domain or sub-domain
HHCVIFCNNCEQYQKSNVFQIKKMMPG

SEQ ID NO: 7148 - protein, 26 aa, artificial
  peptide fold or domain or sub-domain
HHFDPAGEADRYAPFCRQLIREHGVR

SEQ ID NO: 7149 - protein, 22 aa, artificial
  peptide fold or domain or sub-domain
HHGASQLRTIYGNDGAASLSNL

SEQ ID NO: 7150 - protein, 24 aa, artificial
  peptide fold or domain or sub-domain
HHHSSGHISGDAMEDKQERANYEK

SEQ ID NO: 7151 - protein, 30 aa, artificial
  peptide fold or domain or sub-domain
HHIAGPKGDVISIQHIYSRGGVSFCVKHFE

SEQ ID NO: 7152 - protein, 22 aa, artificial
  peptide fold or domain or sub-domain
HHIAPIPKTGRERNVLIDAGEM

SEQ ID NO: 7153 - protein, 27 aa, artificial
  peptide fold or domain or sub-domain
HHIQDITDADDREADTLIHSYTLPDDM

SEQ ID NO: 7154 - protein, 22 aa, artificial
  peptide fold or domain or sub-domain
HHIRSIMKKFDVPTRRQAVLMA

SEQ ID NO: 7155 - protein, 28 aa, artificial
  peptide fold or domain or sub-domain
HHITHHLTAHENDLAIAAINTPTSLVIS

SEQ ID NO: 7156 - protein, 21 aa, artificial
  peptide fold or domain or sub-domain
HHNGDISNWDDRYEAQWKNFT

SEQ ID NO: 7157 - protein, 29 aa, artificial
  peptide fold or domain or sub-domain
HHNGDITDGDYNSNNQWKIENGDVAGLDD

SEQ ID NO: 7158 - protein, 24 aa, artificial
  peptide fold or domain or sub-domain
HHNLALTLVQQQKFDDAIVSYGQA

SEQ ID NO: 7159 - protein, 24 aa, artificial
  peptide fold or domain or sub-domain
HHQLGHALIELKQNDWAVVELRQA

SEQ ID NO: 7160 - protein, 24 aa, artificial
  peptide fold or domain or sub-domain
HHQLGHTLSKLKRWDEAVISYRQA

SEQ ID NO: 7161 - protein, 25 aa, artificial
  peptide fold or domain or sub-domain
HHSIHAYLTGERQGYYTDFGNLDDI

SEQ ID NO: 7162 - protein, 26 aa, artificial
  peptide fold or domain or sub-domain
HHTFPPSRRNPSHWPIHPSDYRQVVG

SEQ ID NO: 7163 - protein, 30 aa, artificial
  peptide fold or domain or sub-domain
HHVPCNTCHYCLNGHHSVCDTLRTTNFYPG

SEQ ID NO: 7164 - protein, 24 aa, artificial
  peptide fold or domain or sub-domain
HHYAQVEEQTEAFEQIAEVVEEAP

SEQ ID NO: 7165 - protein, 29 aa, artificial
  peptide fold or domain or sub-domain
HHYRIFESLPKTLEMGKNQGPSSIGLSSF

SEQ ID NO: 7166 - protein, 23 aa, artificial
  peptide fold or domain or sub-domain
HIAERAENSPVRCADSEAEALMM

SEQ ID NO: 7167 - protein, 29 aa, artificial
  peptide fold or domain or sub-domain
HIDDVHLDDPNFENREYQKWASYGQSKTA

SEQ ID NO: 7168 - protein, 22 aa, artificial
  peptide fold or domain or sub-domain
HIDRVRRKFNGPHGRRRIEVCK

SEQ ID NO: 7169 - protein, 29 aa, artificial
  peptide fold or domain or sub-domain
HIEAARKRMDDAEHDDTRFKAEEYLSQLL

SEQ ID NO: 7170 - protein, 22 aa, artificial
  peptide fold or domain or sub-domain
HIEAHKTQGSGATAESFDEAGS

SEQ ID NO: 7171 - protein, 20 aa, artificial
  peptide fold or domain or sub-domain
HIGSGRLAEMFGASQVETDK

SEQ ID NO: 7172 - protein, 23 aa, artificial
  peptide fold or domain or sub-domain
HIGSGRLAEMFGASQVETDKYLR

SEQ ID NO: 7173 - protein, 28 aa, artificial
  peptide fold or domain or sub-domain
HIGSGRLAEMFGASQVETDKYLRTMGWG

SEQ ID NO: 7174 - protein, 29 aa, artificial
  peptide fold or domain or sub-domain
HIHGWPVGRDPKTKRLNYETFATGAAMPK

SEQ ID NO: 7175 - protein, 30 aa, artificial
  peptide fold or domain or sub-domain
HIHRGNIAGLNYGLNVPDDPLAVAQNRTEI

SEQ ID NO: 7176 - protein, 28 aa, artificial
  peptide fold or domain or sub-domain
HIIARTHFLSELDKFHIAGADEVISDEF

SEQ ID NO: 7177 - protein, 30 aa, artificial
  peptide fold or domain or sub-domain
HIINNLTSTQKNAAAIYYKMSSAYSLSTVN

SEQ ID NO: 7178 - protein, 24 aa, artificial
  peptide fold or domain or sub-domain
HIKAIPTGIKHGTITALVNNTAYE

SEQ ID NO: 7179 - protein, 29 aa, artificial
  peptide fold or domain or sub-domain
HIKESSGDIRKARDLVRQGEGAFQVFCGS

SEQ ID NO: 7180 - protein, 26 aa, artificial
  peptide fold or domain or sub-domain
HILGITREQMLLMLTETKEVIMTHPL

SEQ ID NO: 7181 - protein, 29 aa, artificial
  peptide fold or domain or sub-domain
HIMYTGSTAVGKIVMAAAAKHLTPVTLEL

SEQ ID NO: 7182 - protein, 30 aa, artificial
  peptide fold or domain or sub-domain
HINTWGLRSGGPGGGIYRSLDGGDSWEALS

SEQ ID NO: 7183 - protein, 28 aa, artificial
  peptide fold or domain or sub-domain
HIPQLVIHQQVCFPHLHPDDHFDAENFA

SEQ ID NO: 7184 - protein, 23 aa, artificial
  peptide fold or domain or sub-domain
HIPRGGNLLLSGAEIMELLSVPP

SEQ ID NO: 7185 - protein, 21 aa, artificial
  peptide fold or domain or sub-domain
HIRNAIKGDTDGATKGYAQGM

SEQ ID NO: 7186 - protein, 26 aa, artificial
  peptide fold or domain or sub-domain
HIRYLKGNYHHNHKLQRDFNLHKCTD

SEQ ID NO: 7187 - protein, 26 aa, artificial
  peptide fold or domain or sub-domain
HISDYLFAVTDLQVDQLKREGLPDSK

SEQ ID NO: 7188 - protein, 28 aa, artificial
  peptide fold or domain or sub-domain
HISGRVVQLAEKHGVPMDQLSLEQLKSV

SEQ ID NO: 7189 - protein, 29 aa, artificial
  peptide fold or domain or sub-domain
HISRFPIHPYESRYAANYRTWWDFRELPK

SEQ ID NO: 7190 - protein, 30 aa, artificial
  peptide fold or domain or sub-domain
HITCGHCRNCRGGRTHLCRNTIGVGVNRPG

SEQ ID NO: 7191 - protein, 26 aa, artificial
  peptide fold or domain or sub-domain
HITSDKLAGKTISEVFPEVSFPKNLV

SEQ ID NO: 7192 - protein, 23 aa, artificial
  peptide fold or domain or sub-domain
HIVCNRCPRCHMGEYHLCENTKI

SEQ ID NO: 7193 - protein, 30 aa, artificial
  peptide fold or domain or sub-domain
HIVCNRCPRCHMGEYHLCENTKILGVDTDG

SEQ ID NO: 7194 - protein, 28 aa, artificial
  peptide fold or domain or sub-domain
HIVGEAVVEAIRQGKPLEDLPLSELQKF

SEQ ID NO: 7195 - protein, 29 aa, artificial
  peptide fold or domain or sub-domain
HIVTTSNRSKKQLEGLGFKVDELADIDQA

SEQ ID NO: 7196 - protein, 20 aa, artificial
  peptide fold or domain or sub-domain
HIYHQHFDSVMQLQEEAHLN

SEQ ID NO: 7197 - protein, 24 aa, artificial
  peptide fold or domain or sub-domain
HIYTRTKEKAEALLSQGALWESDP

SEQ ID NO: 7198 - protein, 26 aa, artificial
  peptide fold or domain or sub-domain
HKDSQMLIDELVNEYGFEEAYVIEVL

SEQ ID NO: 7199 - protein, 27 aa, artificial
  peptide fold or domain or sub-domain
HKELGLVLRKKDRLFAGGKGDEGGWAP

SEQ ID NO: 7200 - protein, 24 aa, artificial
  peptide fold or domain or sub-domain
HKESFLIRNQAPTAPLIVNIGAVQ

SEQ ID NO: 7201 - protein, 23 aa, artificial
  peptide fold or domain or sub-domain
HKGDRMAIINAQKTTITEEDFRH

SEQ ID NO: 7202 - protein, 30 aa, artificial
  peptide fold or domain or sub-domain
HKGLGNLYKVKRNAQCSINYCELGVLENMH

SEQ ID NO: 7203 - protein, 30 aa, artificial
  peptide fold or domain or sub-domain
HKGVNNMYKIKKSKKFNVLTSEIAVLENMH

SEQ ID NO: 7204 - protein, 30 aa, artificial
  peptide fold or domain or sub-domain
HKIAGAGLDVFIDEPFKETLSNLFQLDNVV

SEQ ID NO: 7205 - protein, 30 aa, artificial
  peptide fold or domain or sub-domain
HKIVVNGRKKFNQDPWKALDWLASRNVVAK

SEQ ID NO: 7206 - protein, 27 aa, artificial
  peptide fold or domain or sub-domain
HKKVNNTAIQPKYEISSLMALIDILND

SEQ ID NO: 7207 - protein, 29 aa, artificial
  peptide fold or domain or sub-domain
HKLQEANEESKSVTKASEMKAINKRMEKD

SEQ ID NO: 7208 - protein, 25 aa, artificial
  peptide fold or domain or sub-domain
HKLRAQVFKERKGWDVSVIDEMEID

SEQ ID NO: 7209 - protein, 23 aa, artificial
  peptide fold or domain or sub-domain
HKLYFYCSTRLLNANLKMDVTLI

SEQ ID NO: 7210 - protein, 20 aa, artificial
  peptide fold or domain or sub-domain
HKQEAARLLGWGRNTLTRKL

SEQ ID NO: 7211 - protein, 27 aa, artificial
  peptide fold or domain or sub-domain
HKQYPPQTWERQRNHMVGCVMGWGNPY

SEQ ID NO: 7212 - protein, 27 aa, artificial
  peptide fold or domain or sub-domain
HKRVLKYILKVDTSFTGGKNDEGAWTP

SEQ ID NO: 7213 - protein, 26 aa, artificial
  peptide fold or domain or sub-domain
HKSILDYFKTNNLHESFATLMREANQ

SEQ ID NO: 7214 - protein, 22 aa, artificial
  peptide fold or domain or sub-domain
HKVTYLQNGKDRKYFHHNSDFH

SEQ ID NO: 7215 - protein, 27 aa, artificial
  peptide fold or domain or sub-domain
HKWLIDTRLEEVVTDLNLRYELKSVIT

SEQ ID NO: 7216 - protein, 25 aa, artificial
  peptide fold or domain or sub-domain
HKYNRAEMKEKVAASKANGGPVLTH

SEQ ID NO: 7217 - protein, 20 aa, artificial
  peptide fold or domain or sub-domain
HLAALQQAYAEHGVTGNLVA

SEQ ID NO: 7218 - protein, 26 aa, artificial
  peptide fold or domain or sub-domain
HLAMYHFAPTENSRQNLLREWVPENR

SEQ ID NO: 7219 - protein, 27 aa, artificial
  peptide fold or domain or sub-domain
HLARKKPPLAEAQLLQVLPRQHTLQRD

SEQ ID NO: 7220 - protein, 29 aa, artificial
  peptide fold or domain or sub-domain
HLATGGFSLSPSENCINLEEAFHQGLISA

SEQ ID NO: 7221 - protein, 26 aa, artificial
  peptide fold or domain or sub-domain
HLAYPEEKRDLSIWPKTPSDYIEATS

SEQ ID NO: 7222 - protein, 29 aa, artificial
  peptide fold or domain or sub-domain
HLCDIKDPAFCDLISLDIRATTLGHLQRS

SEQ ID NO: 7223 - protein, 25 aa, artificial
  peptide fold or domain or sub-domain
HLDAAMRKGQGSGTEEQFNNHLDEI

SEQ ID NO: 7224 - protein, 25 aa, artificial
  peptide fold or domain or sub-domain
HLDHHESLDDIRRKVHAGVRSAMID

SEQ ID NO: 7225 - protein, 24 aa, artificial
  peptide fold or domain or sub-domain
HLEDREIYQEDWIGLKKLGKRGDL

SEQ ID NO: 7226 - protein, 25 aa, artificial
  peptide fold or domain or sub-domain
HLEGQKVNEKIAFVRNVRKGETINS

SEQ ID NO: 7227 - protein, 24 aa, artificial
  peptide fold or domain or sub-domain
HLGLAIVLKKQQKLDEAIVHNQRA

SEQ ID NO: 7228 - protein, 30 aa, artificial
  peptide fold or domain or sub-domain
HLGTKDIFQIEVPVATKVPSNWTKLSGTKD

SEQ ID NO: 7229 - protein, 25 aa, artificial
  peptide fold or domain or sub-domain
HLGYEGDNVDSQVLEFLLKADPALI

SEQ ID NO: 7230 - protein, 29 aa, artificial
  peptide fold or domain or sub-domain
HLHSDNGPCFTAHRIENLCKYLGITKTTG

SEQ ID NO: 7231 - protein, 23 aa, artificial
  peptide fold or domain or sub-domain
HLIEKIYKNTREVVTREDAERLE

SEQ ID NO: 7232 - protein, 28 aa, artificial
  peptide fold or domain or sub-domain
HLIEKIYKNTREVVTREDAERLEGKSDI

SEQ ID NO: 7233 - protein, 25 aa, artificial
  peptide fold or domain or sub-domain
HLIHYSYGVNSTEKGDLSSESTVSR

SEQ ID NO: 7234 - protein, 26 aa, artificial
  peptide fold or domain or sub-domain
HLIQEIDGMDTAKFGGKAAGLARMAA

SEQ ID NO: 7235 - protein, 29 aa, artificial
  peptide fold or domain or sub-domain
HLKYLTDQMTRPDGSMTFAEAKEALYDYL

SEQ ID NO: 7236 - protein, 27 aa, artificial
  peptide fold or domain or sub-domain
HLLASAESAGQRMGFAESSLRVGDVDS

SEQ ID NO: 7237 - protein, 25 aa, artificial
  peptide fold or domain or sub-domain
HLMGQKVTDQVAEMRSLPSGIDQRS

SEQ ID NO: 7238 - protein, 27 aa, artificial
  peptide fold or domain or sub-domain
HLPADCVAFWDFDDPAIPHTNRDTSAT

SEQ ID NO: 7239 - protein, 27 aa, artificial
  peptide fold or domain or sub-domain
HLPADLIPYWDFDFNDQMPSDKDSSAL

SEQ ID NO: 7240 - protein, 25 aa, artificial
  peptide fold or domain or sub-domain
HLPGEKVNEEVSRTRMIPLGSDAIS

SEQ ID NO: 7241 - protein, 25 aa, artificial
  peptide fold or domain or sub-domain
HLPGSKVTAKIAEARNATIGSDLIS

SEQ ID NO: 7242 - protein, 24 aa, artificial
  peptide fold or domain or sub-domain
HLPTKDKLLKELSSVVNPDSSEYL

SEQ ID NO: 7243 - protein, 29 aa, artificial
  peptide fold or domain or sub-domain
HLPTKDKLLKELSSVVNPDSSEYLAPSLL

SEQ ID NO: 7244 - protein, 26 aa, artificial
  peptide fold or domain or sub-domain
HLPWQGLKSPKKDARFERIRDVKTAT

SEQ ID NO: 7245 - protein, 26 aa, artificial
  peptide fold or domain or sub-domain
HLPWSGLRMKDREAKEKAIGEIKQKL

SEQ ID NO: 7246 - protein, 22 aa, artificial
  peptide fold or domain or sub-domain
HLQLGLPGKSAGLEIATRLGMP

SEQ ID NO: 7247 - protein, 27 aa, artificial
  peptide fold or domain or sub-domain
HLRACVLSVGNSVDANVAYEKFAGRKA

SEQ ID NO: 7248 - protein, 22 aa, artificial
  peptide fold or domain or sub-domain
HLRWVRERGLVRSRIGFEEYRS

SEQ ID NO: 7249 - protein, 21 aa, artificial
  peptide fold or domain or sub-domain
HLSGAHLAVAQGAVPAPELQD

SEQ ID NO: 7250 - protein, 22 aa, artificial
  peptide fold or domain or sub-domain
HLSGTKVRALLRDGQLPPPEFS

SEQ ID NO: 7251 - protein, 22 aa, artificial
  peptide fold or domain or sub-domain
HLSQMWPIFQELLAVFPSLTYV

SEQ ID NO: 7252 - protein, 23 aa, artificial
  peptide fold or domain or sub-domain
HLTALAKAAEENPELAAALGSDY

SEQ ID NO: 7253 - protein, 28 aa, artificial
  peptide fold or domain or sub-domain
HLTGAAVALAEEKGVTLEELPLEDYRGI

SEQ ID NO: 7254 - protein, 27 aa, artificial
  peptide fold or domain or sub-domain
HLTIEDAEIINENWPHNKPGSIDFVRS

SEQ ID NO: 7255 - protein, 20 aa, artificial
  peptide fold or domain or sub-domain
HLTRPDTFHLDGERTVQVPM

SEQ ID NO: 7256 - protein, 22 aa, artificial
  peptide fold or domain or sub-domain
HLTVLPREGARVTLRKQIPADM

SEQ ID NO: 7257 - protein, 26 aa, artificial
  peptide fold or domain or sub-domain
HLVHPDGLADHALWPAYPPDYIAATR

SEQ ID NO: 7258 - protein, 28 aa, artificial
  peptide fold or domain or sub-domain
HLVYECSMQAFEQNQPFKSVLLAHPVLS

SEQ ID NO: 7259 - protein, 20 aa, artificial
  peptide fold or domain or sub-domain
HLYAAEASDWYWWYGEDFTT

SEQ ID NO: 7260 - protein, 27 aa, artificial
  peptide fold or domain or sub-domain
HMEVLHREIYRPMTNIPLQGGVLDSRL

SEQ ID NO: 7261 - protein, 27 aa, artificial
  peptide fold or domain or sub-domain
HMHGNNYKQSLLQHFPDILPLEYGGEE

SEQ ID NO: 7262 - protein, 24 aa, artificial
  peptide fold or domain or sub-domain
HMIDKHRKDWNPAETRDFIDAYLK

SEQ ID NO: 7263 - protein, 27 aa, artificial
  peptide fold or domain or sub-domain
HMKALSAIVKGQLPLNAEAAKHAEAIA

SEQ ID NO: 7264 - protein, 20 aa, artificial
  peptide fold or domain or sub-domain
HMNITQGMGVAELIEEMGRS

SEQ ID NO: 7265 - protein, 29 aa, artificial
  peptide fold or domain or sub-domain
HMTDSLNSLSSWFQNDVPTSFETTHGKGY

SEQ ID NO: 7266 - protein, 27 aa, artificial
  peptide fold or domain or sub-domain
HNADPVSQKEIDRNQAVYEFQGNRNPF

SEQ ID NO: 7267 - protein, 22 aa, artificial
  peptide fold or domain or sub-domain
HNEDADQLDAASNVLLPPAMRT

SEQ ID NO: 7268 - protein, 27 aa, artificial
  peptide fold or domain or sub-domain
HNEVKNIKIPTLVKESKIQKELVAIMN

SEQ ID NO: 7269 - protein, 26 aa, artificial
  peptide fold or domain or sub-domain
HNGAVTRKALLAFAALHNAELHDWIK

SEQ ID NO: 7270 - protein, 25 aa, artificial
  peptide fold or domain or sub-domain
HNGDINWSLADGRYDQWAQDYLENH

SEQ ID NO: 7271 - protein, 26 aa, artificial
  peptide fold or domain or sub-domain
HNGHVLKKMLLAYIELFDQALAQWVN

SEQ ID NO: 7272 - protein, 26 aa, artificial
  peptide fold or domain or sub-domain
HNGHVTSDGVIGLARLIDEDLAGWVS

SEQ ID NO: 7273 - protein, 26 aa, artificial
  peptide fold or domain or sub-domain
HNGKITQNVVMRFAEKVDAELASWIA

SEQ ID NO: 7274 - protein, 24 aa, artificial
  peptide fold or domain or sub-domain
HNIFTANGQNGRGDSLTRKDYVDG

SEQ ID NO: 7275 - protein, 28 aa, artificial
  peptide fold or domain or sub-domain
HNISDAFDQKFSKVPTKVKGYDNLFAME

SEQ ID NO: 7276 - protein, 29 aa, artificial
  peptide fold or domain or sub-domain
HNITVDESGNDAGLYSRFHKTPLPKEVTN

SEQ ID NO: 7277 - protein, 24 aa, artificial
  peptide fold or domain or sub-domain
HNKCIIDSFDRPNEYDVHHISLAH

SEQ ID NO: 7278 - protein, 22 aa, artificial
  peptide fold or domain or sub-domain
HNLAEHYTLQADLFPEYVITDD

SEQ ID NO: 7279 - protein, 24 aa, artificial
  peptide fold or domain or sub-domain
HNLAVEQGAMQQLLLWLGLLEILT

SEQ ID NO: 7280 - protein, 28 aa, artificial
  peptide fold or domain or sub-domain
HNNDTGKDELLNSYFDTYKELKDMNQNR

SEQ ID NO: 7281 - protein, 24 aa, artificial
  peptide fold or domain or sub-domain
HNNLAVALQDNQQIDAALRHCKIA

SEQ ID NO: 7282 - protein, 24 aa, artificial
  peptide fold or domain or sub-domain
HNNLGLIFQEKGNLSKASNYYQQA

SEQ ID NO: 7283 - protein, 24 aa, artificial
  peptide fold or domain or sub-domain
HNPEITPPQVFEKMASEILLKRAG

SEQ ID NO: 7284 - protein, 21 aa, artificial
  peptide fold or domain or sub-domain
HNPGTGYDLRGITYERLRDTP

SEQ ID NO: 7285 - protein, 29 aa, artificial
  peptide fold or domain or sub-domain
HNQISKIFSIQDYYGNNLDALWDLLSTNV

SEQ ID NO: 7286 - protein, 20 aa, artificial
  peptide fold or domain or sub-domain
HNRQWAAEKQEKDPEYFSRL

SEQ ID NO: 7287 - protein, 27 aa, artificial
  peptide fold or domain or sub-domain
HNSIRSEALTALITLGFTKTVAEKNLD

SEQ ID NO: 7288 - protein, 24 aa, artificial
  peptide fold or domain or sub-domain
HNSLGVTFEEEGNFTASIASYQKA

SEQ ID NO: 7289 - protein, 29 aa, artificial
  peptide fold or domain or sub-domain
HNWQFVQNYDDPHETITGWLGDSHVNLPD

SEQ ID NO: 7290 - protein, 23 aa, artificial
  peptide fold or domain or sub-domain
HPASFYQEMWATITQGQTWHGQV

SEQ ID NO: 7291 - protein, 30 aa, artificial
  peptide fold or domain or sub-domain
HPELAVGDFDSLTLEELRLVRGHVQKLQQV

SEQ ID NO: 7292 - protein, 29 aa, artificial
  peptide fold or domain or sub-domain
HPFCAITDWTDPKIYKNCWFAVETVALPD

SEQ ID NO: 7293 - protein, 29 aa, artificial
  peptide fold or domain or sub-domain
HPFCFIQNYEDQTQVEDCWLGDNTVSLPD

SEQ ID NO: 7294 - protein, 21 aa, artificial
  peptide fold or domain or sub-domain
HPFLEWYIPDSSPLGYSGLKL

SEQ ID NO: 7295 - protein, 27 aa, artificial
  peptide fold or domain or sub-domain
HPGAGHAFDNPSPMFHHEGASLEAWAK

SEQ ID NO: 7296 - protein, 30 aa, artificial
  peptide fold or domain or sub-domain
HPGRSEVFLKNTFDATYVHYNGLQVLEQMH

SEQ ID NO: 7297 - protein, 30 aa, artificial
  peptide fold or domain or sub-domain
HPGRTNAFLAAVQDPVSFKFSGKGTLEQLH

SEQ ID NO: 7298 - protein, 30 aa, artificial
  peptide fold or domain or sub-domain
HPGRTNAFLVATNAPQAVLYNDRSVLENHH

SEQ ID NO: 7299 - protein, 30 aa, artificial
  peptide fold or domain or sub-domain
HPGTNNQLLCNCESEVAQNFKNVSILENFH

SEQ ID NO: 7300 - protein, 30 aa, artificial
  peptide fold or domain or sub-domain
HPGYNNIYQINARTELALRYNDISPLENHH

SEQ ID NO: 7301 - protein, 22 aa, artificial
  peptide fold or domain or sub-domain
HPHITPCTLTQPPAPSHNPLLK

SEQ ID NO: 7302 - protein, 23 aa, artificial
  peptide fold or domain or sub-domain
HPIFADRAENCRVWDVEGREYLD

SEQ ID NO: 7303 - protein, 21 aa, artificial
  peptide fold or domain or sub-domain
HPKYDPISKKDKGIKRAFDYD

SEQ ID NO: 7304 - protein, 21 aa, artificial
  peptide fold or domain or sub-domain
HPNYNINGKKEAGIPEFYDYD

SEQ ID NO: 7305 - protein, 23 aa, artificial
  peptide fold or domain or sub-domain
HPPEFYKNLWETILSGREWYGEF

SEQ ID NO: 7306 - protein, 22 aa, artificial
  peptide fold or domain or sub-domain
HPPLSVNSAWIDRSCLQNSQEL

SEQ ID NO: 7307 - protein, 30 aa, artificial
  peptide fold or domain or sub-domain
HPQVSLGRINVKEKGDRLEQEKMAFHYTVY

SEQ ID NO: 7308 - protein, 21 aa, artificial
  peptide fold or domain or sub-domain
HPRFDLKGLKDKNVKEFYDYD

SEQ ID NO: 7309 - protein, 25 aa, artificial
  peptide fold or domain or sub-domain
HPRRNIEKMASGEPLNDDDRKPWLQ

SEQ ID NO: 7310 - protein, 30 aa, artificial
  peptide fold or domain or sub-domain
HPSLASANPLHYGRELTALDNLDFGSLHLD

SEQ ID NO: 7311 - protein, 30 aa, artificial
  peptide fold or domain or sub-domain
HPTCWSDLAAQFLLSEQDLERSRAEASQEL

SEQ ID NO: 7312 - protein, 29 aa, artificial
  peptide fold or domain or sub-domain
HPWNKTKKIAFDRRKFIVEPFDATGMKFV

SEQ ID NO: 7313 - protein, 29 aa, artificial
  peptide fold or domain or sub-domain
HPYCKITDWNNYTNAQLCQTGDDKVALPD

SEQ ID NO: 7314 - protein, 29 aa, artificial
  peptide fold or domain or sub-domain
HPYCNVTEWENATNIQDCWLYPYGIALAD

SEQ ID NO: 7315 - protein, 27 aa, artificial
  peptide fold or domain or sub-domain
HQEDAVDANEMRRNDRIQEWQGNRNPL

SEQ ID NO: 7316 - protein, 29 aa, artificial
  peptide fold or domain or sub-domain
HQFTFDLFVQAQSLHTKVSFPEMIGEIIS

SEQ ID NO: 7317 - protein, 22 aa, artificial
  peptide fold or domain or sub-domain
HQHIAAYLQVLQKARGKEDDDG

SEQ ID NO: 7318 - protein, 22 aa, artificial
  peptide fold or domain or sub-domain
HQKVYYKDGKQLPNSYNLEKIT

SEQ ID NO: 7319 - protein, 22 aa, artificial
  peptide fold or domain or sub-domain
HQLPRTLDSQQLHSGGFQALFP

SEQ ID NO: 7320 - protein, 25 aa, artificial
  peptide fold or domain or sub-domain
HQLRHQAFVDRLRYAVPSHDGLEWD

SEQ ID NO: 7321 - protein, 24 aa, artificial
  peptide fold or domain or sub-domain
HQNLGVALEKQGQIEEGIICYRKA

SEQ ID NO: 7322 - protein, 24 aa, artificial
  peptide fold or domain or sub-domain
HQPVVTSMWDINSEYSVEHVSLAE

SEQ ID NO: 7323 - protein, 27 aa, artificial
  peptide fold or domain or sub-domain
HQRAKILKYLKAKSPQRYHAILPRIGI

SEQ ID NO: 7324 - protein, 27 aa, artificial
  peptide fold or domain or sub-domain
HQRQRMLKYLRKVNFDRYVHCIKNLGL

SEQ ID NO: 7325 - protein, 28 aa, artificial
  peptide fold or domain or sub-domain
HQSRLDSWPQHYPWIKEEGYFYFRSRLS

SEQ ID NO: 7326 - protein, 24 aa, artificial
  peptide fold or domain or sub-domain
HQTLIEIIEKEGGMSREQAEAYVT

SEQ ID NO: 7327 - protein, 29 aa, artificial
  peptide fold or domain or sub-domain
HQTLKKELALPEYYGENLDALWDCLTGWV

SEQ ID NO: 7328 - protein, 27 aa, artificial
  peptide fold or domain or sub-domain
HQYFLKRGEYPDYQQCQGLNDSPQSSR

SEQ ID NO: 7329 - protein, 30 aa, artificial
  peptide fold or domain or sub-domain
HRAFSEAGGERWSDLLVDGIHYSGRGYEVF

SEQ ID NO: 7330 - protein, 22 aa, artificial
  peptide fold or domain or sub-domain
HRAGEPLPVPRDAWLDEWGVDL

SEQ ID NO: 7331 - protein, 24 aa, artificial
  peptide fold or domain or sub-domain
HRALLAIVMQEGGRTQEQAEEYLE

SEQ ID NO: 7332 - protein, 20 aa, artificial
  peptide fold or domain or sub-domain
HRARGTSASFLGTEAAAWDV

SEQ ID NO: 7333 - protein, 23 aa, artificial
  peptide fold or domain or sub-domain
HRARGTSASFLGTEAAAWDVFAR

SEQ ID NO: 7334 - protein, 22 aa, artificial
  peptide fold or domain or sub-domain
HRASGNELLSVALQNQVPTPDS

SEQ ID NO: 7335 - protein, 23 aa, artificial
  peptide fold or domain or sub-domain
HREIFDMDEIPEEAIPELVNAVG

SEQ ID NO: 7336 - protein, 20 aa, artificial
  peptide fold or domain or sub-domain
HREKTAAALGISPRTLSNKL

SEQ ID NO: 7337 - protein, 25 aa, artificial
  peptide fold or domain or sub-domain
HRFFASFLATCFGQQCDDVAEEMLN

SEQ ID NO: 7338 - protein, 25 aa, artificial
  peptide fold or domain or sub-domain
HRFNRADMKAELDRRYAAGDATFSH

SEQ ID NO: 7339 - protein, 30 aa, artificial
  peptide fold or domain or sub-domain
HRGTNNAFQAKSGSALAQLYGTSATLEHHH

SEQ ID NO: 7340 - protein, 23 aa, artificial
  peptide fold or domain or sub-domain
HRHVYGEQWIKFMKDGVNATPLP

SEQ ID NO: 7341 - protein, 25 aa, artificial
  peptide fold or domain or sub-domain
HRIDEPICPTCDCPTCTRYGRSYLH

SEQ ID NO: 7342 - protein, 26 aa, artificial
  peptide fold or domain or sub-domain
HRIWPPSCVNYRFWPKNPPEYREVNE

SEQ ID NO: 7343 - protein, 24 aa, artificial
  peptide fold or domain or sub-domain
HRKEYKALLQEGFRREAAAKEKQI

SEQ ID NO: 7344 - protein, 27 aa, artificial
  peptide fold or domain or sub-domain
HRKIGDILSEKMKDISIGVGDERAWSV

SEQ ID NO: 7345 - protein, 21 aa, artificial
  peptide fold or domain or sub-domain
HRKVLKELYPSLPEDVFHSLD

SEQ ID NO: 7346 - protein, 22 aa, artificial
  peptide fold or domain or sub-domain
HRLDAVHARLRALPQYRRLVRQ

SEQ ID NO: 7347 - protein, 26 aa, artificial
  peptide fold or domain or sub-domain
HRLLVKNITEAIDASAERDRALKALD

SEQ ID NO: 7348 - protein, 23 aa, artificial
  peptide fold or domain or sub-domain
HRLTQLLSIAEECETLDRLKQLV

SEQ ID NO: 7349 - protein, 28 aa, artificial
  peptide fold or domain or sub-domain
HRLTQLLSIAEECETLDRLKQLVDSGRI

SEQ ID NO: 7350 - protein, 27 aa, artificial
  peptide fold or domain or sub-domain
HRMDPPDAEEKARNDKIEVLQGTRNRF

SEQ ID NO: 7351 - protein, 28 aa, artificial
  peptide fold or domain or sub-domain
HRPAEVLLAPELLENGAFLDEFRKRFPV

SEQ ID NO: 7352 - protein, 20 aa, artificial
  peptide fold or domain or sub-domain
HRRMEAELAAQGVDRLYREV

SEQ ID NO: 7353 - protein, 27 aa, artificial
  peptide fold or domain or sub-domain
HRRSQTPLGSVDILPRRGFAGLSRRFG

SEQ ID NO: 7354 - protein, 30 aa, artificial
  peptide fold or domain or sub-domain
HRSFGYSMEVTKTHLDKVPPRYIQRQTMTN

SEQ ID NO: 7355 - protein, 30 aa, artificial
  peptide fold or domain or sub-domain
HRTFGYFLAVSKSKANTVPDHWIRRQTLAN

SEQ ID NO: 7356 - protein, 24 aa, artificial
  peptide fold or domain or sub-domain
HRTLHTIAQEQGSMDSTQAEGFVK

SEQ ID NO: 7357 - protein, 25 aa, artificial
  peptide fold or domain or sub-domain
HRYTRNEMNRLIEDAERIGQRGISH

SEQ ID NO: 7358 - protein, 22 aa, artificial
  peptide fold or domain or sub-domain
HSCPIDTSIRLANKCDCDPSKD

SEQ ID NO: 7359 - protein, 20 aa, artificial
  peptide fold or domain or sub-domain
HSDKEISQCLGISCKRVPQV

SEQ ID NO: 7360 - protein, 20 aa, artificial
  peptide fold or domain or sub-domain
HSEDELRQCGFSVSKAKALL

SEQ ID NO: 7361 - protein, 20 aa, artificial
  peptide fold or domain or sub-domain
HSGEDIARRFSVTRSSVWNA

SEQ ID NO: 7362 - protein, 20 aa, artificial
  peptide fold or domain or sub-domain
HSGEQLGETLGMSRAAINKH

SEQ ID NO: 7363 - protein, 20 aa, artificial
  peptide fold or domain or sub-domain
HSGQDLAYEFDLSRASIFNV

SEQ ID NO: 7364 - protein, 26 aa, artificial
  peptide fold or domain or sub-domain
HSGRSQEARAKVLNDFKEGKLQYLVA

SEQ ID NO: 7365 - protein, 20 aa, artificial
  peptide fold or domain or sub-domain
HSGTALGQQTGRTRTAVWKA

SEQ ID NO: 7366 - protein, 20 aa, artificial
  peptide fold or domain or sub-domain
HSGTTLGQALKVSRSSISNT

SEQ ID NO: 7367 - protein, 24 aa, artificial
  peptide fold or domain or sub-domain
HSGYCMTCHSCLSGYHNLCATAES

SEQ ID NO: 7368 - protein, 29 aa, artificial
  peptide fold or domain or sub-domain
HSIIGFDELGGDNFSEQALINILKKWKLI

SEQ ID NO: 7369 - protein, 26 aa, artificial
  peptide fold or domain or sub-domain
HSINGIPVVKLSDSPEKETGERDALR

SEQ ID NO: 7370 - protein, 22 aa, artificial
  peptide fold or domain or sub-domain
HSITYPDNRPRHAGAFIDRYIF

SEQ ID NO: 7371 - protein, 28 aa, artificial
  peptide fold or domain or sub-domain
HSLADVLETKLGDTPKKLKAKGALYARE

SEQ ID NO: 7372 - protein, 21 aa, artificial
  peptide fold or domain or sub-domain
HSLEELAAELQISKEKVRSLE

SEQ ID NO: 7373 - protein, 30 aa, artificial
  peptide fold or domain or sub-domain
HSLFIDKDGELKGEWTVDGVHITGEGYKTW

SEQ ID NO: 7374 - protein, 28 aa, artificial
  peptide fold or domain or sub-domain
HSLGDCFERSVGGDITRVDELDNLWLLE

SEQ ID NO: 7375 - protein, 28 aa, artificial
  peptide fold or domain or sub-domain
HSLGDSLGQPVGPIPVEVAGAPGLAALE

SEQ ID NO: 7376 - protein, 28 aa, artificial
  peptide fold or domain or sub-domain
HSLGDVLQSEVKDIALAVTDLPNLSVQA

SEQ ID NO: 7377 - protein, 30 aa, artificial
  peptide fold or domain or sub-domain
HSLLILLQLLGIVASVKKCYNNKSTTMAYI

SEQ ID NO: 7378 - protein, 29 aa, artificial
  peptide fold or domain or sub-domain
HSLPVLCRLLYFSDLEVMTDACWALSYIS

SEQ ID NO: 7379 - protein, 28 aa, artificial
  peptide fold or domain or sub-domain
HSLSDTFDTDIPPEPARIRDDIPLYAAE

SEQ ID NO: 7380 - protein, 23 aa, artificial
  peptide fold or domain or sub-domain
HSLVEEKVKQLVQSEPREVVEAS

SEQ ID NO: 7381 - protein, 30 aa, artificial
  peptide fold or domain or sub-domain
HSMALAGGTVWAWGSNSAGQLALNPISSAT

SEQ ID NO: 7382 - protein, 25 aa, artificial
  peptide fold or domain or sub-domain
HSMDTIVSMLHNRSETVTFAKVKQG

SEQ ID NO: 7383 - protein, 30 aa, artificial
  peptide fold or domain or sub-domain
HSMIVTEKNIVTYSPVAKDYMNKPFTLEQA

SEQ ID NO: 7384 - protein, 24 aa, artificial
  peptide fold or domain or sub-domain
HSMLAQQIANLDVADLRDVETELE

SEQ ID NO: 7385 - protein, 24 aa, artificial
  peptide fold or domain or sub-domain
HSNLASIHKDSGNIPEAIASYRTA

SEQ ID NO: 7386 - protein, 24 aa, artificial
  peptide fold or domain or sub-domain
HSNLASILQQQGKLNDAILHYKEA

SEQ ID NO: 7387 - protein, 24 aa, artificial
  peptide fold or domain or sub-domain
HSNLASVLQQQGKLQEALMHYKEA

SEQ ID NO: 7388 - protein, 21 aa, artificial
  peptide fold or domain or sub-domain
HSPEALKKYPDEAQLRVHPVG

SEQ ID NO: 7389 - protein, 25 aa, artificial
  peptide fold or domain or sub-domain
HSPFRQHKTKDKHEIDRMTLTMAVE

SEQ ID NO: 7390 - protein, 30 aa, artificial
  peptide fold or domain or sub-domain
HSPPIVQRQVWGWGWNEHGNLAQGLHDEAD

SEQ ID NO: 7391 - protein, 27 aa, artificial
  peptide fold or domain or sub-domain
HSPSGKALNDITLDNVLNDDIKANDLR

SEQ ID NO: 7392 - protein, 29 aa, artificial
  peptide fold or domain or sub-domain
HSQETLDAALEYLLGKPLAEKAADLYPRS

SEQ ID NO: 7393 - protein, 30 aa, artificial
  peptide fold or domain or sub-domain
HSRGVICTANYIARGYGVQSAISSSYAKKL

SEQ ID NO: 7394 - protein, 22 aa, artificial
  peptide fold or domain or sub-domain
HSRYKHMAEAPDGFELPWGGRR

SEQ ID NO: 7395 - protein, 21 aa, artificial
  peptide fold or domain or sub-domain
HSTEELSARFQLPVHTIRLIE

SEQ ID NO: 7396 - protein, 28 aa, artificial
  peptide fold or domain or sub-domain
HSVGDRFEMSVGATPTSVHDTYPLYAAE

SEQ ID NO: 7397 - protein, 30 aa, artificial
  peptide fold or domain or sub-domain
HSVMRDAQNGMQSLLTYDGVHCNKAGYEVM

SEQ ID NO: 7398 - protein, 26 aa, artificial
  peptide fold or domain or sub-domain
HSVQCLVVDKESRKCKAVIDQFGQRI

SEQ ID NO: 7399 - protein, 29 aa, artificial
  peptide fold or domain or sub-domain
HSYCIISDSDFATKNMYNIQHCRLAGLAD

SEQ ID NO: 7400 - protein, 22 aa, artificial
  peptide fold or domain or sub-domain
HSYLNRANKYDPKGPIYNDQNM

SEQ ID NO: 7401 - protein, 26 aa, artificial
  peptide fold or domain or sub-domain
HTADINMTYSDIAREYLLAEGVPADR

SEQ ID NO: 7402 - protein, 24 aa, artificial
  peptide fold or domain or sub-domain
HTDHCKYFDPRVQIREGLKHMSAR

SEQ ID NO: 7403 - protein, 25 aa, artificial
  peptide fold or domain or sub-domain
HTDQERDYFMQRYRDVISSFGGKTS

SEQ ID NO: 7404 - protein, 21 aa, artificial
  peptide fold or domain or sub-domain
HTFDQLATEKNTSKEKIRQWE

SEQ ID NO: 7405 - protein, 30 aa, artificial
  peptide fold or domain or sub-domain
HTGHSNAYETNSKSELFTLYGNESPLEKHH

SEQ ID NO: 7406 - protein, 20 aa, artificial
  peptide fold or domain or sub-domain
HTGLALTTLGAYKNDTFSDF

SEQ ID NO: 7407 - protein, 30 aa, artificial
  peptide fold or domain or sub-domain
HTGRTNIFEINNFSEKAIRYHDKNVLEQYH

SEQ ID NO: 7408 - protein, 30 aa, artificial
  peptide fold or domain or sub-domain
HTIAVAQDGRTMWSFGGGDNGKLGHGDTNR

SEQ ID NO: 7409 - protein, 29 aa, artificial
  peptide fold or domain or sub-domain
HTIFVQRQHSSAPALAVAQALDARIIRVD

SEQ ID NO: 7410 - protein, 30 aa, artificial
  peptide fold or domain or sub-domain
HTILIGQRRETNRTQKEMDNSQVEHIQKRN

SEQ ID NO: 7411 - protein, 20 aa, artificial
  peptide fold or domain or sub-domain
HTKNQIAAELPTRDNAKTFI

SEQ ID NO: 7412 - protein, 30 aa, artificial
  peptide fold or domain or sub-domain
HTLALPVNRIQYCGTGTAYYGELGDHVFDN

SEQ ID NO: 7413 - protein, 21 aa, artificial
  peptide fold or domain or sub-domain
HTLEEVGQQFSVTRERIRQIE

SEQ ID NO: 7414 - protein, 28 aa, artificial
  peptide fold or domain or sub-domain
HTPEEALALLKRGAEEIVPEEELLAKLK

SEQ ID NO: 7415 - protein, 28 aa, artificial
  peptide fold or domain or sub-domain
  misc_feature (25)..(25): Xaa can be any naturally occurring amino acid
HTTMLGIKSSHKDTLHPFELTLPKXGHA

SEQ ID NO: 7416 - protein, 29 aa, artificial
  peptide fold or domain or sub-domain
HTVIGLVEAPDGVSVVATAPSGERLRLSA

SEQ ID NO: 7417 - protein, 30 aa, artificial
  peptide fold or domain or sub-domain
HTVLVVDGGYKLWSWGRGRNGVLGTGNVSD

SEQ ID NO: 7418 - protein, 27 aa, artificial
  peptide fold or domain or sub-domain
HTVPNQGSGDGWYDYNNKFVDNSAVHF

SEQ ID NO: 7419 - protein, 29 aa, artificial
  peptide fold or domain or sub-domain
HTVVLSRQAGYSAPGCAVVSTLSHVSPST

SEQ ID NO: 7420 - protein, 24 aa, artificial
  peptide fold or domain or sub-domain
HTYDFSEILSRKGIGLDEECQVFE

SEQ ID NO: 7421 - protein, 22 aa, artificial
  peptide fold or domain or sub-domain
HTYDHDPNDEAAEKLGIDPNRS

SEQ ID NO: 7422 - protein, 28 aa, artificial
  peptide fold or domain or sub-domain
HTYEEVAEWLWTGELRPGAAFSAPESSV

SEQ ID NO: 7423 - protein, 26 aa, artificial
  peptide fold or domain or sub-domain
HVCDQLFATSPDAVEHLYREGLPPRA

SEQ ID NO: 7424 - protein, 25 aa, artificial
  peptide fold or domain or sub-domain
HVDAEKVTEEIAHIRNVEPYQEINS

SEQ ID NO: 7425 - protein, 21 aa, artificial
  peptide fold or domain or sub-domain
HVDFNQIGWGSWIIFPKRYNA

SEQ ID NO: 7426 - protein, 25 aa, artificial
  peptide fold or domain or sub-domain
HVDSKLRAGNKEATDEELERTLDKI

SEQ ID NO: 7427 - protein, 21 aa, artificial
  peptide fold or domain or sub-domain
HVEGIRDLQRGDVAAAAHLGY

SEQ ID NO: 7428 - protein, 27 aa, artificial
  peptide fold or domain or sub-domain
HVEIRQDGDQFYIKTSTTVRTTEINFK

SEQ ID NO: 7429 - protein, 20 aa, artificial
  peptide fold or domain or sub-domain
HVERAAARLGIPRSSLYERL

SEQ ID NO: 7430 - protein, 24 aa, artificial
  peptide fold or domain or sub-domain
HVFDISKDAKESLKAKGAVPYDNV

SEQ ID NO: 7431 - protein, 20 aa, artificial
  peptide fold or domain or sub-domain
HVGNTQDVITRVSEFSVDLG

SEQ ID NO: 7432 - protein, 23 aa, artificial
  peptide fold or domain or sub-domain
HVGPSAIIGKGGIINTGAVVEHE

SEQ ID NO: 7433 - protein, 28 aa, artificial
  peptide fold or domain or sub-domain
HVGQSYSAWTEARPANDFGRMVPYLEKT

SEQ ID NO: 7434 - protein, 29 aa, artificial
  peptide fold or domain or sub-domain
HVGYLMKILTGAELPSGLDAFTTMATGTL

SEQ ID NO: 7435 - protein, 30 aa, artificial
  peptide fold or domain or sub-domain
HVHVEHLKPQSLGLPADSFLLHLSRSQNGH

SEQ ID NO: 7436 - protein, 24 aa, artificial
  peptide fold or domain or sub-domain
HVIDEELKIGQSQDHSNLVSSMLD

SEQ ID NO: 7437 - protein, 21 aa, artificial
  peptide fold or domain or sub-domain
HVKAFLNGDPHQVSSFASRIS

SEQ ID NO: 7438 - protein, 29 aa, artificial
  peptide fold or domain or sub-domain
HVLAERFLPLEWLLHLLARTPLDYTDYLL

SEQ ID NO: 7439 - protein, 30 aa, artificial
  peptide fold or domain or sub-domain
HVLLGKILQNHMLDLRISNSKLFWRALAML

SEQ ID NO: 7440 - protein, 20 aa, artificial
  peptide fold or domain or sub-domain
HVLSRGETVVEAGELKAARG

SEQ ID NO: 7441 - protein, 20 aa, artificial
  peptide fold or domain or sub-domain
HVLVGGVPVVADGVRTGAVP

SEQ ID NO: 7442 - protein, 20 aa, artificial
  peptide fold or domain or sub-domain
HVLVNGALSMRNGVRTDSNA

SEQ ID NO: 7443 - protein, 27 aa, artificial
  peptide fold or domain or sub-domain
HVQIVNRELFDLVKRKPTPYGVLDNKL

SEQ ID NO: 7444 - protein, 24 aa, artificial
  peptide fold or domain or sub-domain
HVQVWNELTWPQEYPLSFYELSYL

SEQ ID NO: 7445 - protein, 20 aa, artificial
  peptide fold or domain or sub-domain
HVRAQIIRKKVTKEGEVLPF

SEQ ID NO: 7446 - protein, 26 aa, artificial
  peptide fold or domain or sub-domain
HVRDPGGVISAYHTACDDLIRNVRVE

SEQ ID NO: 7447 - protein, 25 aa, artificial
  peptide fold or domain or sub-domain
HVREYIVLKLQSKPHRLHQVSKSYV

SEQ ID NO: 7448 - protein, 29 aa, artificial
  peptide fold or domain or sub-domain
HVRILQALQYAKQTGKGTPANWMPGQQGM

SEQ ID NO: 7449 - protein, 25 aa, artificial
  peptide fold or domain or sub-domain
HVRLTDARVDLTAAPERAMRDLRGG

SEQ ID NO: 7450 - protein, 20 aa, artificial
  peptide fold or domain or sub-domain
HVRLYMACSKINSRGDRELI

SEQ ID NO: 7451 - protein, 26 aa, artificial
  peptide fold or domain or sub-domain
HVSDLLFAPTKVAVNNLINEGIAEDR

SEQ ID NO: 7452 - protein, 21 aa, artificial
  peptide fold or domain or sub-domain
HVSFRKLRWQDWVIAPEGYSA

SEQ ID NO: 7453 - protein, 23 aa, artificial
  peptide fold or domain or sub-domain
HVSGKYGYGRAGFRGLIPRNASL

SEQ ID NO: 7454 - protein, 22 aa, artificial
  peptide fold or domain or sub-domain
HVSLATHLRNEYNASTCLAWDK

SEQ ID NO: 7455 - protein, 20 aa, artificial
  peptide fold or domain or sub-domain
HVSNRENVLKQLSDNIMDLA

SEQ ID NO: 7456 - protein, 28 aa, artificial
  peptide fold or domain or sub-domain
HVSRLALDPYLRDHLIANNLTTARDVLL

SEQ ID NO: 7457 - protein, 29 aa, artificial
  peptide fold or domain or sub-domain
HVTGWPLSAYDEDRPANYAAWWGIRALPK

SEQ ID NO: 7458 - protein, 21 aa, artificial
  peptide fold or domain or sub-domain
HVTLGDYVINSAVEPLPAYTF

SEQ ID NO: 7459 - protein, 21 aa, artificial
  peptide fold or domain or sub-domain
HVVANPQAEGQLQWLNDRANA

SEQ ID NO: 7460 - protein, 24 aa, artificial
  peptide fold or domain or sub-domain
HVVATDEVPNGRPWPAQALANVIA

SEQ ID NO: 7461 - protein, 28 aa, artificial
  peptide fold or domain or sub-domain
HVVEAACKTAVAEQKHLKDIISQVDEVK

SEQ ID NO: 7462 - protein, 28 aa, artificial
  peptide fold or domain or sub-domain
HVVKGDRFVRSGEWKKRGVAWHPKWFLG

SEQ ID NO: 7463 - protein, 29 aa, artificial
  peptide fold or domain or sub-domain
HVVVALNKNDTHFDHLAIASHHKIARIYG

SEQ ID NO: 7464 - protein, 30 aa, artificial
  peptide fold or domain or sub-domain
HVVVGSSFDDIYVEKLKTYEELKNINFYYN

SEQ ID NO: 7465 - protein, 27 aa, artificial
  peptide fold or domain or sub-domain
HVYEKNQHLVNQFENENDRVACLSSLN

SEQ ID NO: 7466 - protein, 23 aa, artificial
  peptide fold or domain or sub-domain
HWADGTNIKKPIKCSAPKYIDYL

SEQ ID NO: 7467 - protein, 25 aa, artificial
  peptide fold or domain or sub-domain
HWHALRGNDHLFRGDLVATPLPFGS

SEQ ID NO: 7468 - protein, 20 aa, artificial
  peptide fold or domain or sub-domain
HWHIDANNNVTSHDGGDGAA

SEQ ID NO: 7469 - protein, 21 aa, artificial
  peptide fold or domain or sub-domain
HWKQERGVFYEWVEDDGDYTH

SEQ ID NO: 7470 - protein, 23 aa, artificial
  peptide fold or domain or sub-domain
HWLGSEHGIENDLVPDAGYSLHR

SEQ ID NO: 7471 - protein, 26 aa, artificial
  peptide fold or domain or sub-domain
HWLTDAGAADPSRSGGKGAKLALLVR

SEQ ID NO: 7472 - protein, 26 aa, artificial
  peptide fold or domain or sub-domain
HYADFAPQVEAVTGATLRDEVFFNQT

SEQ ID NO: 7473 - protein, 30 aa, artificial
  peptide fold or domain or sub-domain
HYDGCRTCPNCRTGWMQNCDNTRIAFGGNG

SEQ ID NO: 7474 - protein, 21 aa, artificial
  peptide fold or domain or sub-domain
HYEIVQERGPAHNREFVSEVV

SEQ ID NO: 7475 - protein, 29 aa, artificial
  peptide fold or domain or sub-domain
HYFTDNPERPWELDSNLPMQTWYKKYCFD

SEQ ID NO: 7476 - protein, 29 aa, artificial
  peptide fold or domain or sub-domain
HYHFGRQPAPFDLDPNSPINRWYLRYREG

SEQ ID NO: 7477 - protein, 29 aa, artificial
  peptide fold or domain or sub-domain
HYIFFETLVSPKISQIIAGEAGAQTLVLN

SEQ ID NO: 7478 - protein, 28 aa, artificial
  peptide fold or domain or sub-domain
HYKGTDCTNDIQLRNECIDRIYDVYLPD

SEQ ID NO: 7479 - protein, 22 aa, artificial
  peptide fold or domain or sub-domain
HYLDKAREKLEAATVPHLVAIA

SEQ ID NO: 7480 - protein, 29 aa, artificial
  peptide fold or domain or sub-domain
HYLLSYYPLGKELSGKQIQVPKEQHSYEI

SEQ ID NO: 7481 - protein, 24 aa, artificial
  peptide fold or domain or sub-domain
HYNLGIILKDLGNLQDAEFYNRKA

SEQ ID NO: 7482 - protein, 22 aa, artificial
  peptide fold or domain or sub-domain
HYNSQSLKELLRAGIVPPAVFM

SEQ ID NO: 7483 - protein, 28 aa, artificial
  peptide fold or domain or sub-domain
HYQAAGPVDDNVLRDNYIDRIYDTYIDE

SEQ ID NO: 7484 - protein, 28 aa, artificial
  peptide fold or domain or sub-domain
HYRDLSPQQEQELLERHLNRVTDTCIPE

SEQ ID NO: 7485 - protein, 20 aa, artificial
  peptide fold or domain or sub-domain
HYRWLVNRKLDNGYRTHSKG

SEQ ID NO: 7486 - protein, 28 aa, artificial
  peptide fold or domain or sub-domain
HYVGSHLVDDEDLFEHGVDRIYDVFAVE

SEQ ID NO: 7487 - protein, 29 aa, artificial
  peptide fold or domain or sub-domain
HYVKAKQPEEVKARQILVKTQQEAEKIIA

SEQ ID NO: 7488 - protein, 24 aa, artificial
  peptide fold or domain or sub-domain
HYYENDNANVGAHQLSVRATDAYE

SEQ ID NO: 7489 - protein, 29 aa, artificial
  peptide fold or domain or sub-domain
HYYYPHDHRWKFQAPAELFQHKIKIFDRP

SEQ ID NO: 7490 - protein, 24 aa, artificial
  peptide fold or domain or sub-domain
IAAAKDHAAGQGLAISYFAGELAD

SEQ ID NO: 7491 - protein, 26 aa, artificial
  peptide fold or domain or sub-domain
IAACSTPEKLDFAVNQGADYTINYTE

SEQ ID NO: 7492 - protein, 26 aa, artificial
  peptide fold or domain or sub-domain
IAADIYKDIKARKLELTRAKAGASLM

SEQ ID NO: 7493 - protein, 28 aa, artificial
  peptide fold or domain or sub-domain
IAAFDVSPAIVGKEVNGLKVLHFDKFRD

SEQ ID NO: 7494 - protein, 28 aa, artificial
  peptide fold or domain or sub-domain
IAAGGIMTMEQVHMLALAGIDAVCFGRR

SEQ ID NO: 7495 - protein, 23 aa, artificial
  peptide fold or domain or sub-domain
IAALCIEAAKSKEVSPIIRQASL

SEQ ID NO: 7496 - protein, 27 aa, artificial
  peptide fold or domain or sub-domain
IAALEWKLNSKQFEDEIRQDYLQELET

SEQ ID NO: 7497 - protein, 29 aa, artificial
  peptide fold or domain or sub-domain
IAALVTSEEDKGEAFARAFDLTPDDVYSY

SEQ ID NO: 7498 - protein, 26 aa, artificial
  peptide fold or domain or sub-domain
IAAQKCLKKADEVSPNNSDVQKELAL

SEQ ID NO: 7499 - protein, 25 aa, artificial
  peptide fold or domain or sub-domain
IAARAGIDDAATRLAQLRALPAERV

SEQ ID NO: 7500 - protein, 26 aa, artificial
  peptide fold or domain or sub-domain
IAATRGKEGTEIAREMGADHVIDTRQ

SEQ ID NO: 7501 - protein, 26 aa, artificial
  peptide fold or domain or sub-domain
IACAGSEEKGQRLKEVGADEVILYTK

SEQ ID NO: 7502 - protein, 25 aa, artificial
  peptide fold or domain or sub-domain
IACGGSWMVSKELISSKDFKKIEEE

SEQ ID NO: 7503 - protein, 30 aa, artificial
  peptide fold or domain or sub-domain
IADGEDAQEIDSLRKEAREMRDLRASLLQA

SEQ ID NO: 7504 - protein, 30 aa, artificial
  peptide fold or domain or sub-domain
IADGFKIICKSDDGIVSGIENERLGYYGVQ

SEQ ID NO: 7505 - protein, 24 aa, artificial
  peptide fold or domain or sub-domain
IADLIKQAREAGEVRPDVDPMTAA

SEQ ID NO: 7506 - protein, 25 aa, artificial
  peptide fold or domain or sub-domain
IADQLLDRMENKEEITLIDDYAFPL

SEQ ID NO: 7507 - protein, 27 aa, artificial
  peptide fold or domain or sub-domain
IADRYLDDSYAPDAVAQRCGIPADTIR

SEQ ID NO: 7508 - protein, 27 aa, artificial
  peptide fold or domain or sub-domain
IAEAKKNQVLEKSLGVKVSADFYDDLY

SEQ ID NO: 7509 - protein, 23 aa, artificial
  peptide fold or domain or sub-domain
IAEATYAEMWKTLNEGREWRGEL

SEQ ID NO: 7510 - protein, 22 aa, artificial
  peptide fold or domain or sub-domain
IAEEAMREHTLEREIASVIKKE

SEQ ID NO: 7511 - protein, 23 aa, artificial
  peptide fold or domain or sub-domain
IAEEEVEYLMARGLNKDEATAAI

SEQ ID NO: 7512 - protein, 25 aa, artificial
  peptide fold or domain or sub-domain
IAEEGARCLSTLSPLSEPKIKDVLD

SEQ ID NO: 7513 - protein, 30 aa, artificial
  peptide fold or domain or sub-domain
IAEEISGIKDIGKNIGLIGYLTDNNITRKD

SEQ ID NO: 7514 - protein, 21 aa, artificial
  peptide fold or domain or sub-domain
IAEFNQAIQLNPKYAYAYNNR

SEQ ID NO: 7515 - protein, 25 aa, artificial
  peptide fold or domain or sub-domain
IAEQLLDEMEKENKADIMKSFASPL

SEQ ID NO: 7516 - protein, 25 aa, artificial
  peptide fold or domain or sub-domain
IAEQLLDSVQQQDRVDLLDAFAFPL

SEQ ID NO: 7517 - protein, 29 aa, artificial
  peptide fold or domain or sub-domain
IAESGASEEQLRTCLDGTVPTAPAAKCYI

SEQ ID NO: 7518 - protein, 28 aa, artificial
  peptide fold or domain or sub-domain
IAESGIHNSNDVKTMNACGINTFLVGES

SEQ ID NO: 7519 - protein, 28 aa, artificial
  peptide fold or domain or sub-domain
IAESGIMSIEDLNVIKEYRVDGVLIGEL

SEQ ID NO: 7520 - protein, 29 aa, artificial
  peptide fold or domain or sub-domain
IAETKVDPALIDRADNGDFTDDAKLQCFS

SEQ ID NO: 7521 - protein, 24 aa, artificial
  peptide fold or domain or sub-domain
IAETNIEKCRQAGDMNWVNFAKCK

SEQ ID NO: 7522 - protein, 25 aa, artificial
  peptide fold or domain or sub-domain
IAEVHPSLRSADIFPKMRNLTEKDL

SEQ ID NO: 7523 - protein, 25 aa, artificial
  peptide fold or domain or sub-domain
IAFDKWNMPQVDPKTFVSTNPKVFF

SEQ ID NO: 7524 - protein, 24 aa, artificial
  peptide fold or domain or sub-domain
IAFDVNKDSLKKYAKEGLAVCEDV

SEQ ID NO: 7525 - protein, 27 aa, artificial
  peptide fold or domain or sub-domain
IAFIVDTANQERVLSQKHRLAKKTILV

SEQ ID NO: 7526 - protein, 29 aa, artificial
  peptide fold or domain or sub-domain
IAFKSIKDTDKKTNVIQLIGKEKSFNLSA

SEQ ID NO: 7527 - protein, 29 aa, artificial
  peptide fold or domain or sub-domain
IAFSATALEEVGESCALLAQSESLSAHAQ

SEQ ID NO: 7528 - protein, 26 aa, artificial
  peptide fold or domain or sub-domain
IAGEAEKAGMNPVDYTVKSLKEGSIR

SEQ ID NO: 7529 - protein, 25 aa, artificial
  peptide fold or domain or sub-domain
IAGFDPKTLVIAFNTTFEDLDQTLL

SEQ ID NO: 7530 - protein, 20 aa, artificial
  peptide fold or domain or sub-domain
IAGKLGENLRAHADAARLSK

SEQ ID NO: 7531 - protein, 25 aa, artificial
  peptide fold or domain or sub-domain
IAGTGKYKGKRLTKEIYEELRRNYQ

SEQ ID NO: 7532 - protein, 22 aa, artificial
  peptide fold or domain or sub-domain
IAHGKSNSEIALILGLSRRNVT

SEQ ID NO: 7533 - protein, 30 aa, artificial
  peptide fold or domain or sub-domain
IAHGTARELLPGNTLEGALNAVAVGADIIE

SEQ ID NO: 7534 - protein, 30 aa, artificial
  peptide fold or domain or sub-domain
IAHQGGEALWPSNTLTAYRGAVALGVDLLE

SEQ ID NO: 7535 - protein, 23 aa, artificial
  peptide fold or domain or sub-domain
IAHQYAFNNRQVITTGMAIEVEE

SEQ ID NO: 7536 - protein, 30 aa, artificial
  peptide fold or domain or sub-domain
IAHRGASGHAPENTMAAFQKGFDMKVDYIE

SEQ ID NO: 7537 - protein, 30 aa, artificial
  peptide fold or domain or sub-domain
IAHRGFRGRYPEMTAQAYEKACELPIHGVE

SEQ ID NO: 7538 - protein, 30 aa, artificial
  peptide fold or domain or sub-domain
IAHRGIYFNEPENSLEAIEDSIKHKVDYAE

SEQ ID NO: 7539 - protein, 25 aa, artificial
  peptide fold or domain or sub-domain
IAHRSVDLGNWERHQRDPGFLPEER

SEQ ID NO: 7540 - protein, 21 aa, artificial
  peptide fold or domain or sub-domain
IAHSWVMVFENEAESFRKYHE

SEQ ID NO: 7541 - protein, 25 aa, artificial
  peptide fold or domain or sub-domain
IAHTKIDLISPDSNRDSPGYYIEET

SEQ ID NO: 7542 - protein, 29 aa, artificial
  peptide fold or domain or sub-domain
IAIDKDERTVQQLEIEGLNGKAPALIADA

SEQ ID NO: 7543 - protein, 25 aa, artificial
  peptide fold or domain or sub-domain
IAIFYGISDLHLKYKTLKTREDAIR

SEQ ID NO: 7544 - protein, 20 aa, artificial
  peptide fold or domain or sub-domain
IAILLTSSKNSLIHSDCVIV

SEQ ID NO: 7545 - protein, 22 aa, artificial
  peptide fold or domain or sub-domain
IAINAVKEYKQEKQIAHYIKYE

SEQ ID NO: 7546 - protein, 22 aa, artificial
  peptide fold or domain or sub-domain
IAIRKGEQKTPEFTKLNPMQKV

SEQ ID NO: 7547 - protein, 26 aa, artificial
  peptide fold or domain or sub-domain
IAITHEVANYPASDAGSTGPGLIEKL

SEQ ID NO: 7548 - protein, 27 aa, artificial
  peptide fold or domain or sub-domain
IAIYNSNDAKARALQEELPKLDVYKCN

SEQ ID NO: 7549 - protein, 25 aa, artificial
  peptide fold or domain or sub-domain
IAKDAYCCAQQGKRKTLQRRDLDNA

SEQ ID NO: 7550 - protein, 21 aa, artificial
  peptide fold or domain or sub-domain
IAKFISYIMNNGKKNLAQKIF

SEQ ID NO: 7551 - protein, 26 aa, artificial
  peptide fold or domain or sub-domain
IAKGVAAFAGHDGALADLFGVDQVSR

SEQ ID NO: 7552 - protein, 26 aa, artificial
  peptide fold or domain or sub-domain
IAKISRPSYVHIIDKLGLDVALNPVN

SEQ ID NO: 7553 - protein, 20 aa, artificial
  peptide fold or domain or sub-domain
IAKKALVNVTGKIVSYSTIR

SEQ ID NO: 7554 - protein, 27 aa, artificial
  peptide fold or domain or sub-domain
IAKLSELGYLQYDLYESILLTEKGKET

SEQ ID NO: 7555 - protein, 30 aa, artificial
  peptide fold or domain or sub-domain
IAKTGMTEKEKNEMILKLINIFEKNGDSYE

SEQ ID NO: 7556 - protein, 26 aa, artificial
  peptide fold or domain or sub-domain
IAKVKSQTAKKVLEKIGADSVISPEY

SEQ ID NO: 7557 - protein, 28 aa, artificial
  peptide fold or domain or sub-domain
IAKVNTNEVNYIEKLGSLGYDSICLEKK

SEQ ID NO: 7558 - protein, 26 aa, artificial
  peptide fold or domain or sub-domain
IAKVVAQLLVLPGVTDDYLINTTFPK

SEQ ID NO: 7559 - protein, 22 aa, artificial
  peptide fold or domain or sub-domain
IALAEARRRYDLCNNTQLVALA

SEQ ID NO: 7560 - protein, 28 aa, artificial
  peptide fold or domain or sub-domain
IALDPNMYYCSMSTADTLRKAADLGFRY

SEQ ID NO: 7561 - protein, 26 aa, artificial
  peptide fold or domain or sub-domain
IALFATEWGTSDCNGSGGTYIEESQR

SEQ ID NO: 7562 - protein, 26 aa, artificial
  peptide fold or domain or sub-domain
IALFVTEWGSVNANGDGAVANSETNA

SEQ ID NO: 7563 - protein, 25 aa, artificial
  peptide fold or domain or sub-domain
IALNHRSGHPSRPKYPKQVNRLRER

SEQ ID NO: 7564 - protein, 28 aa, artificial
  peptide fold or domain or sub-domain
IALNVSLTMRELAWSERFDTAARLGFGT

SEQ ID NO: 7565 - protein, 25 aa, artificial
  peptide fold or domain or sub-domain
IALQVLYGCEIAHDPVGPALRNMLE

SEQ ID NO: 7566 - protein, 25 aa, artificial
  peptide fold or domain or sub-domain
IALQVLYSLEVVEMEAGEAIELYWA

SEQ ID NO: 7567 - protein, 28 aa, artificial
  peptide fold or domain or sub-domain
IALSGITTRDDAEKYKKEGVHGFLVGEA

SEQ ID NO: 7568 - protein, 24 aa, artificial
  peptide fold or domain or sub-domain
IALSYRSAKALVEMQNWRALLEND

SEQ ID NO: 7569 - protein, 24 aa, artificial
  peptide fold or domain or sub-domain
IALSYRSAKALVEMRDWRALLEKD

SEQ ID NO: 7570 - protein, 26 aa, artificial
  peptide fold or domain or sub-domain
IALTANVMPEDKAYALEVGFNAHLAK

SEQ ID NO: 7571 - protein, 26 aa, artificial
  peptide fold or domain or sub-domain
IALTAYAGEIDEKRALKVGFQRHISK

SEQ ID NO: 7572 - protein, 25 aa, artificial
  peptide fold or domain or sub-domain
IALTDVPMLLAGGDVLDAKTIIGLS

SEQ ID NO: 7573 - protein, 25 aa, artificial
  peptide fold or domain or sub-domain
IALTTDTSALSAIGNDYGFEFVFSR

SEQ ID NO: 7574 - protein, 21 aa, artificial
  peptide fold or domain or sub-domain
IALYRAQFRGREWLAMRQQRI

SEQ ID NO: 7575 - protein, 29 aa, artificial
  peptide fold or domain or sub-domain
IAMAGSSPQVQQSANKTIGSNTEDSIATE

SEQ ID NO: 7576 - protein, 29 aa, artificial
  peptide fold or domain or sub-domain
IAMDPCCWENPNEFLPERFLVSPIDFKGQ

SEQ ID NO: 7577 - protein, 29 aa, artificial
  peptide fold or domain or sub-domain
IAMGQADDEVKAEASAVTSSVEDEGFAKA

SEQ ID NO: 7578 - protein, 23 aa, artificial
  peptide fold or domain or sub-domain
IAMKELSEQVGLSVTPCIERVKR

SEQ ID NO: 7579 - protein, 25 aa, artificial
  peptide fold or domain or sub-domain
IAMKLIYQLEIQKDSREEQINNTLE

SEQ ID NO: 7580 - protein, 26 aa, artificial
  peptide fold or domain or sub-domain
IAMTAHTLPGDRERCLKAGMDDYLGK

SEQ ID NO: 7581 - protein, 28 aa, artificial
  peptide fold or domain or sub-domain
IAMVRSYDCVPMIKSYLELFVGAHNQEI

SEQ ID NO: 7582 - protein, 26 aa, artificial
  peptide fold or domain or sub-domain
IAMYLQGVDNVYEVQWNENVKYGDVF

SEQ ID NO: 7583 - protein, 30 aa, artificial
  peptide fold or domain or sub-domain
IANADELAGMVGGCTFTPQNSSDTMIAASR

SEQ ID NO: 7584 - protein, 23 aa, artificial
  peptide fold or domain or sub-domain
IANDQLIKLMSLGLNEKEAEDTI

SEQ ID NO: 7585 - protein, 25 aa, artificial
  peptide fold or domain or sub-domain
IANELVKDIENCSEVDIVEQFAAPL

SEQ ID NO: 7586 - protein, 27 aa, artificial
  peptide fold or domain or sub-domain
IANQIQQGDHPTWWKNVHEWVDELDAA

SEQ ID NO: 7587 - protein, 25 aa, artificial
  peptide fold or domain or sub-domain
IANRIMQRIVEVRPEIANGKGVKGL

SEQ ID NO: 7588 - protein, 29 aa, artificial
  peptide fold or domain or sub-domain
IANRQALPQPYTLDKISIPYWRAQHIDDV

SEQ ID NO: 7589 - protein, 23 aa, artificial
  peptide fold or domain or sub-domain
IANTELADEIGLTPAPTLRRVRR

SEQ ID NO: 7590 - protein, 24 aa, artificial
  peptide fold or domain or sub-domain
IANTFNRGNQKQGDQQKALAASIA

SEQ ID NO: 7591 - protein, 23 aa, artificial
  peptide fold or domain or sub-domain
IANVSGQAPAYGLTAEEVASVFA

SEQ ID NO: 7592 - protein, 25 aa, artificial
  peptide fold or domain or sub-domain
IAPDARDVYDPQVWNEDHILTSTTE

SEQ ID NO: 7593 - protein, 25 aa, artificial
  peptide fold or domain or sub-domain
IAPEDKDLFDASDRATKVGATDAER

SEQ ID NO: 7594 - protein, 25 aa, artificial
  peptide fold or domain or sub-domain
IAPFDIDVYSSKVLTETTCCTKVEQ

SEQ ID NO: 7595 - protein, 25 aa, artificial
  peptide fold or domain or sub-domain
IAPGENDVWSHRQMLKVVSHTPPEL

SEQ ID NO: 7596 - protein, 29 aa, artificial
  peptide fold or domain or sub-domain
IAPIPYMETGISGFLTKHAVEIHVTKHHQ

SEQ ID NO: 7597 - protein, 25 aa, artificial
  peptide fold or domain or sub-domain
IAPKDNDVHDPQIWQGKVLVSPQER

SEQ ID NO: 7598 - protein, 25 aa, artificial
  peptide fold or domain or sub-domain
IAPSEIDIHTPQKYEGGIMASKIER

SEQ ID NO: 7599 - protein, 25 aa, artificial
  peptide fold or domain or sub-domain
IAPTDVDVWDITQFEGATHVTPAER

SEQ ID NO: 7600 - protein, 24 aa, artificial
  peptide fold or domain or sub-domain
IAPVISDERVMQSMRQNTPLGRLA

SEQ ID NO: 7601 - protein, 30 aa, artificial
  peptide fold or domain or sub-domain
IAPWKSAPNSLSKEDYLEFYRYLYPFQEDP

SEQ ID NO: 7602 - protein, 26 aa, artificial
  peptide fold or domain or sub-domain
IAQARGAEKLAVAKAAGADHLIDASD

SEQ ID NO: 7603 - protein, 27 aa, artificial
  peptide fold or domain or sub-domain
IAQGMTAAVNWGTASSASIRGIEVAGK

SEQ ID NO: 7604 - protein, 27 aa, artificial
  peptide fold or domain or sub-domain
IAQKAQSPEAPAWWENISDWVEEIKNE

SEQ ID NO: 7605 - protein, 29 aa, artificial
  peptide fold or domain or sub-domain
IAQKQFLSDRSNGFNNNNEEILRSLQSDQ

SEQ ID NO: 7606 - protein, 27 aa, artificial
  peptide fold or domain or sub-domain
IAQLLQHGEEARWETEHATWVAQIVEF

SEQ ID NO: 7607 - protein, 29 aa, artificial
  peptide fold or domain or sub-domain
IAQYYQDNKAQFMTQHLAHIQFANEQDAK

SEQ ID NO: 7608 - protein, 26 aa, artificial
  peptide fold or domain or sub-domain
IARADRSDYVPLFEMVGIDIAVSPRE

SEQ ID NO: 7609 - protein, 26 aa, artificial
  peptide fold or domain or sub-domain
IAREFFKHFAEEHAAHTENAWRDRFR

SEQ ID NO: 7610 - protein, 26 aa, artificial
  peptide fold or domain or sub-domain
IARGERPSTERKLVQAGADKVILPTH

SEQ ID NO: 7611 - protein, 25 aa, artificial
  peptide fold or domain or sub-domain
IARITKLVSGSMSGKKADEFAKKLN

SEQ ID NO: 7612 - protein, 23 aa, artificial
  peptide fold or domain or sub-domain
IARKINFLKNKDILKTNKFAFRL

SEQ ID NO: 7613 - protein, 23 aa, artificial
  peptide fold or domain or sub-domain
IARLRQLAKDAHLDPDFAEKFLN

SEQ ID NO: 7614 - protein, 27 aa, artificial
  peptide fold or domain or sub-domain
IARLSRYFEHEYPDQQAQRLSILGVFD

SEQ ID NO: 7615 - protein, 27 aa, artificial
  peptide fold or domain or sub-domain
IARNYRHWTSHPLWARLDAVGNDRVFE

SEQ ID NO: 7616 - protein, 24 aa, artificial
  peptide fold or domain or sub-domain
IARYHPDRFVNASPEDLEYARRRS

SEQ ID NO: 7617 - protein, 26 aa, artificial
  peptide fold or domain or sub-domain
IASSSTNFGKPITTEFPQLKSNLKFD

SEQ ID NO: 7618 - protein, 28 aa, artificial
  peptide fold or domain or sub-domain
IASYHEWVAYRTGNAQAIGDAEAQWRKS

SEQ ID NO: 7619 - protein, 28 aa, artificial
  peptide fold or domain or sub-domain
IASYLEKIQNAQNDYWEKEYVFKDIISR

SEQ ID NO: 7620 - protein, 27 aa, artificial
  peptide fold or domain or sub-domain
IATAEIEKLQSTGVIKGGMIPKLASAA

SEQ ID NO: 7621 - protein, 27 aa, artificial
  peptide fold or domain or sub-domain
IATDILTEELNQMAQELGDKVTPMTHD

SEQ ID NO: 7622 - protein, 26 aa, artificial
  peptide fold or domain or sub-domain
IATDNDESRFPELRAMGADATICWPT

SEQ ID NO: 7623 - protein, 30 aa, artificial
  peptide fold or domain or sub-domain
IATDVTTGEKTTYYSMSELARALGVNKNTV

SEQ ID NO: 7624 - protein, 22 aa, artificial
  peptide fold or domain or sub-domain
IATEYARKLFAGDNYTDYLYFH

SEQ ID NO: 7625 - protein, 24 aa, artificial
  peptide fold or domain or sub-domain
IATLIENGRSDGSLADGAPPLQLA

SEQ ID NO: 7626 - protein, 26 aa, artificial
  peptide fold or domain or sub-domain
IATRSGPVQVLSLPWVNRSTLLTREE

SEQ ID NO: 7627 - protein, 26 aa, artificial
  peptide fold or domain or sub-domain
IATSASDEKLKTVKARGADHIINVTR

SEQ ID NO: 7628 - protein, 22 aa, artificial
  peptide fold or domain or sub-domain
IATSSKMVIKKLARKDTPCFSL

SEQ ID NO: 7629 - protein, 20 aa, artificial
  peptide fold or domain or sub-domain
IATYFTHPDTVLYLNDLNRM

SEQ ID NO: 7630 - protein, 26 aa, artificial
  peptide fold or domain or sub-domain
IAVAEHNGAVYNADGLNIDALNKYKL

SEQ ID NO: 7631 - protein, 27 aa, artificial
  peptide fold or domain or sub-domain
IAVDRNASHTFFPVAKNTHVDGVLSES

SEQ ID NO: 7632 - protein, 22 aa, artificial
  peptide fold or domain or sub-domain
IAVGKTMEEIADVEGVKYNSVR

SEQ ID NO: 7633 - protein, 29 aa, artificial
  peptide fold or domain or sub-domain
IAVGNAKPEVLEIAHMVTTPGKEDGVAKS

SEQ ID NO: 7634 - protein, 27 aa, artificial
  peptide fold or domain or sub-domain
IAVLSARLVEKAVPDSDADAIAINILT

SEQ ID NO: 7635 - protein, 25 aa, artificial
  peptide fold or domain or sub-domain
IAVMALYQLELTQPPLKEVLKFKWY

SEQ ID NO: 7636 - protein, 26 aa, artificial
  peptide fold or domain or sub-domain
IAVTAYSMEGDRERCLASGMNDYVSK

SEQ ID NO: 7637 - protein, 26 aa, artificial
  peptide fold or domain or sub-domain
IAVVGSAEKARVVREIGADGVVDYRD

SEQ ID NO: 7638 - protein, 26 aa, artificial
  peptide fold or domain or sub-domain
IAWFTPEGAEMAQRDWNSARASALTV

SEQ ID NO: 7639 - protein, 26 aa, artificial
  peptide fold or domain or sub-domain
IAWLTPSGREMTHEDWGRGFDRCVAV

SEQ ID NO: 7640 - protein, 26 aa, artificial
  peptide fold or domain or sub-domain
IAWLVNGTEMIPNPPTFDGRSVLAIG

SEQ ID NO: 7641 - protein, 26 aa, artificial
  peptide fold or domain or sub-domain
IAWRRPDGAAMAAPDWDDAQSRSFAG

SEQ ID NO: 7642 - protein, 29 aa, artificial
  peptide fold or domain or sub-domain
IAWSKSELARTGEKIARFADHEGLQAHAE

SEQ ID NO: 7643 - protein, 30 aa, artificial
  peptide fold or domain or sub-domain
IAYDPYISDERFKRFNVEKKDTLEDLLKES

SEQ ID NO: 7644 - protein, 27 aa, artificial
  peptide fold or domain or sub-domain
IAYDPYPMKGDHPDFDYVSLEDLFKQS

SEQ ID NO: 7645 - protein, 30 aa, artificial
  peptide fold or domain or sub-domain
IAYDVVKIDPMLVRELGIVTTDLDTLLRSS

SEQ ID NO: 7646 - protein, 28 aa, artificial
  peptide fold or domain or sub-domain
IAYHFAEEEAMMARADFPFLELHRHSHQ

SEQ ID NO: 7647 - protein, 29 aa, artificial
  peptide fold or domain or sub-domain
IAYTGEALEQVGGAVMRLAGVEGLFAHAG

SEQ ID NO: 7648 - protein, 22 aa, artificial
  peptide fold or domain or sub-domain
IAYVWSHNGIKIRDIDIKNMNY

SEQ ID NO: 7649 - protein, 27 aa, artificial
  peptide fold or domain or sub-domain
ICAEIEELVREARLDGVDEMLSALDEE

SEQ ID NO: 7650 - protein, 24 aa, artificial
  peptide fold or domain or sub-domain
ICDELGEEAKREGRVTAHDYVASR

SEQ ID NO: 7651 - protein, 28 aa, artificial
  peptide fold or domain or sub-domain
ICESGIDNATQIREMMDIGFDGFLIGSS

SEQ ID NO: 7652 - protein, 27 aa, artificial
  peptide fold or domain or sub-domain
ICETVEDEAKEQSMDQLTALVNQLNNE

SEQ ID NO: 7653 - protein, 24 aa, artificial
  peptide fold or domain or sub-domain
ICGGNIPKHVAAHLKGNGIAEVFP

SEQ ID NO: 7654 - protein, 25 aa, artificial
  peptide fold or domain or sub-domain
ICIGGSWMVPKDWLAQGHWDNIKNA

SEQ ID NO: 7655 - protein, 29 aa, artificial
  peptide fold or domain or sub-domain
ICINDKTEVMLSSNVLNIKIDDVSCLLSF

SEQ ID NO: 7656 - protein, 29 aa, artificial
  peptide fold or domain or sub-domain
ICIPTGFQSRNLILDNKLQLGSIEQYPRI

SEQ ID NO: 7657 - protein, 24 aa, artificial
  peptide fold or domain or sub-domain
ICKELLEKWNKNDTKGALEIHQKL

SEQ ID NO: 7658 - protein, 30 aa, artificial
  peptide fold or domain or sub-domain
ICKKATTDREVELDELHTDIYAKNVDGKIR

SEQ ID NO: 7659 - protein, 25 aa, artificial
  peptide fold or domain or sub-domain
ICKKLVYEGGDLPLRGGIDYEQDQF

SEQ ID NO: 7660 - protein, 26 aa, artificial
  peptide fold or domain or sub-domain
ICNKRLRAQRSESSTDTAMKETRTLL

SEQ ID NO: 7661 - protein, 28 aa, artificial
  peptide fold or domain or sub-domain
ICNTPDQFKIHVLTSLTPKLKAMAREDL

SEQ ID NO: 7662 - protein, 24 aa, artificial
  peptide fold or domain or sub-domain
ICPAPDVISGEEKPSLALRRARKS

SEQ ID NO: 7663 - protein, 25 aa, artificial
  peptide fold or domain or sub-domain
ICPLCALPLALTERTWGCPQSHKFD

SEQ ID NO: 7664 - protein, 25 aa, artificial
  peptide fold or domain or sub-domain
ICPLCQTKLQRTNNTQICANNHHFD

SEQ ID NO: 7665 - protein, 25 aa, artificial
  peptide fold or domain or sub-domain
ICPLCSAALGEVDNGVACPAGHRFD

SEQ ID NO: 7666 - protein, 26 aa, artificial
  peptide fold or domain or sub-domain
ICQLKRFEVIPLVEQIDIDIVLSPRI

SEQ ID NO: 7667 - protein, 23 aa, artificial
  peptide fold or domain or sub-domain
ICQLMSHLEGDEDILAVFENLFE

SEQ ID NO: 7668 - protein, 24 aa, artificial
  peptide fold or domain or sub-domain
ICRNMATGSLVERLPFEEGEKLDP

SEQ ID NO: 7669 - protein, 29 aa, artificial
  peptide fold or domain or sub-domain
ICTNENEAEFITGIAQNNVKDAEKAARAM

SEQ ID NO: 7670 - protein, 23 aa, artificial
  peptide fold or domain or sub-domain
ICTSDYGYGDQGRQYIVPPRAQL

SEQ ID NO: 7671 - protein, 30 aa, artificial
  peptide fold or domain or sub-domain
ICTSPIAIERMEEWTKSDDEWIGRAGWSLL

SEQ ID NO: 7672 - protein, 29 aa, artificial
  peptide fold or domain or sub-domain
ICVPTSIDTEIKAKSLGIPLTSLTKNLKI

SEQ ID NO: 7673 - protein, 27 aa, artificial
  peptide fold or domain or sub-domain
IDAAAYADLRAKGKVAAGMLPKLHNCF

SEQ ID NO: 7674 - protein, 26 aa, artificial
  peptide fold or domain or sub-domain
IDAAQLEKLAAPLAKNGYGQYLKRLL

SEQ ID NO: 7675 - protein, 30 aa, artificial
  peptide fold or domain or sub-domain
IDADEYLEQKEGKTIKDIFEECDEGKFREI

SEQ ID NO: 7676 - protein, 30 aa, artificial
  peptide fold or domain or sub-domain
IDADVELQRRAQRTIAQIFAADGEPAFRDL

SEQ ID NO: 7677 - protein, 28 aa, artificial
  peptide fold or domain or sub-domain
IDAEQYARNARVLGKVFTGVDWAIKGAD

SEQ ID NO: 7678 - protein, 30 aa, artificial
  peptide fold or domain or sub-domain
IDAFDATSRPSQRQIDSLAHLVGVDPTQIA

SEQ ID NO: 7679 - protein, 27 aa, artificial
  peptide fold or domain or sub-domain
IDAHEMRTALKKAGFTLNNQVQQTIAT

SEQ ID NO: 7680 - protein, 23 aa, artificial
  peptide fold or domain or sub-domain
IDALRDELGFSGRSDVIRVAARM

SEQ ID NO: 7681 - protein, 27 aa, artificial
  peptide fold or domain or sub-domain
IDANELNTAFQTFGYRLSPQFCNLIVR

SEQ ID NO: 7682 - protein, 29 aa, artificial
  peptide fold or domain or sub-domain
IDANSNQIIYEQAGFLHLLNPETKETKQI

SEQ ID NO: 7683 - protein, 22 aa, artificial
  peptide fold or domain or sub-domain
IDANWYPNLSRSPFLKMWRKMS

SEQ ID NO: 7684 - protein, 28 aa, artificial
  peptide fold or domain or sub-domain
IDAQDMANKLGNISKAFKFADVVMKVEK

SEQ ID NO: 7685 - protein, 27 aa, artificial
  peptide fold or domain or sub-domain
IDASGLKKAVQLAGLPISNALINVMVL

SEQ ID NO: 7686 - protein, 20 aa, artificial
  peptide fold or domain or sub-domain
IDCSRMLVYIQNRHMNHLNY

SEQ ID NO: 7687 - protein, 20 aa, artificial
  peptide fold or domain or sub-domain
IDDACLRTCGVSSNKILALR

SEQ ID NO: 7688 - protein, 21 aa, artificial
  peptide fold or domain or sub-domain
IDDAKQASKIDPKFGKAYSRL

SEQ ID NO: 7689 - protein, 28 aa, artificial
  peptide fold or domain or sub-domain
IDDAVPMEGDAQPGAQSFALERMVRHTG

SEQ ID NO: 7690 - protein, 24 aa, artificial
  peptide fold or domain or sub-domain
IDDENALSERYQVSRVVIRDAVKI

SEQ ID NO: 7691 - protein, 23 aa, artificial
  peptide fold or domain or sub-domain
IDDEQIFYLRSRGINQQDAQQMI

SEQ ID NO: 7692 - protein, 27 aa, artificial
  peptide fold or domain or sub-domain
IDDLESDFETNRQKNALEESAECVRKL

SEQ ID NO: 7693 - protein, 27 aa, artificial
  peptide fold or domain or sub-domain
IDDQLEKLAGFFEKKQIPEARDVIGRL

SEQ ID NO: 7694 - protein, 25 aa, artificial
  peptide fold or domain or sub-domain
IDDRLDLLEAEGPSADLQGLFADPV

SEQ ID NO: 7695 - protein, 23 aa, artificial
  peptide fold or domain or sub-domain
IDDTVLALAFKTDVTTIQNLKKG

SEQ ID NO: 7696 - protein, 23 aa, artificial
  peptide fold or domain or sub-domain
IDEAEYKRRLHRKKELKNENFYF

SEQ ID NO: 7697 - protein, 29 aa, artificial
  peptide fold or domain or sub-domain
IDEDELMMKVLDFGAEDFASEEEVFIITT

SEQ ID NO: 7698 - protein, 20 aa, artificial
  peptide fold or domain or sub-domain
IDEDGNGDEFTGARLGLDVT

SEQ ID NO: 7699 - protein, 23 aa, artificial
  peptide fold or domain or sub-domain
IDEEECRARIRYAQEHDITNFYM

SEQ ID NO: 7700 - protein, 25 aa, artificial
  peptide fold or domain or sub-domain
IDEEEQRSQKYLNSSSHDKMRRLLH

SEQ ID NO: 7701 - protein, 24 aa, artificial
  peptide fold or domain or sub-domain
IDEELSMAEQYPKPSISQMFEHVY

SEQ ID NO: 7702 - protein, 23 aa, artificial
  peptide fold or domain or sub-domain
IDEEQIFYLQTRCLTEAEAERTI

SEQ ID NO: 7703 - protein, 26 aa, artificial
  peptide fold or domain or sub-domain
IDEFAAALHKKGQIVTEKEIEKIMKE

SEQ ID NO: 7704 - protein, 30 aa, artificial
  peptide fold or domain or sub-domain
IDEHMAKQVTREIIKNEGLLLGFSSGASIA

SEQ ID NO: 7705 - protein, 21 aa, artificial
  peptide fold or domain or sub-domain
IDEIVPGGIRVGADHHELDII

SEQ ID NO: 7706 - protein, 26 aa, artificial
  peptide fold or domain or sub-domain
IDELKIGLQKLGHAIPQDDLQILMDA

SEQ ID NO: 7707 - protein, 27 aa, artificial
  peptide fold or domain or sub-domain
IDELYEQLNKSFLENNLDEAKENLIRL

SEQ ID NO: 7708 - protein, 23 aa, artificial
  peptide fold or domain or sub-domain
IDENKLFYIMSRGFSETEAKKLV

SEQ ID NO: 7709 - protein, 26 aa, artificial
  peptide fold or domain or sub-domain
IDERAQRQARIAHPDASEAEIKQIVQ

SEQ ID NO: 7710 - protein, 25 aa, artificial
  peptide fold or domain or sub-domain
IDEREIKVEEFENELKNKLTEEAKN

SEQ ID NO: 7711 - protein, 28 aa, artificial
  peptide fold or domain or sub-domain
IDETKDYLVKTRLAPIAGTSGYADIDAL

SEQ ID NO: 7712 - protein, 25 aa, artificial
  peptide fold or domain or sub-domain
IDFERAMALLRTGEANNGPLILSLI

SEQ ID NO: 7713 - protein, 25 aa, artificial
  peptide fold or domain or sub-domain
IDFGAMVYLLYKGELPKGNESKIIN

SEQ ID NO: 7714 - protein, 30 aa, artificial
  peptide fold or domain or sub-domain
IDFIARLPIESFWGVGPVTARKMHLLGIHN

SEQ ID NO: 7715 - protein, 28 aa, artificial
  peptide fold or domain or sub-domain
IDFISFDKDRMVWVTSVSWGEITKNKWD

SEQ ID NO: 7716 - protein, 25 aa, artificial
  peptide fold or domain or sub-domain
IDFQRIYSDKLEDRKELAKEVGDAC

SEQ ID NO: 7717 - protein, 24 aa, artificial
  peptide fold or domain or sub-domain
IDFSKVPNYADVVPALKSKPFFVP

SEQ ID NO: 7718 - protein, 25 aa, artificial
  peptide fold or domain or sub-domain
IDFTDYFWLLVLGERPTETQRRMMD

SEQ ID NO: 7719 - protein, 26 aa, artificial
  peptide fold or domain or sub-domain
IDGFHLRGALNSAGYHLNNRLLNALA

SEQ ID NO: 7720 - protein, 27 aa, artificial
  peptide fold or domain or sub-domain
IDGFHLRGALNSAGYHLNNRLLNALAH

SEQ ID NO: 7721 - protein, 27 aa, artificial
  peptide fold or domain or sub-domain
IDGSKDISKAISNFNDYTSRNLFQIER

SEQ ID NO: 7722 - protein, 28 aa, artificial
  peptide fold or domain or sub-domain
IDGSKRRLSAEEALDILKKIRKEEMSIL

SEQ ID NO: 7723 - protein, 30 aa, artificial
  peptide fold or domain or sub-domain
IDGYLGFDEVNAGFDKLAEGRALRQILAPH

SEQ ID NO: 7724 - protein, 29 aa, artificial
  peptide fold or domain or sub-domain
IDHEAADDIGQAISAGEFTAAFDGVTEAM

SEQ ID NO: 7725 - protein, 23 aa, artificial
  peptide fold or domain or sub-domain
IDHFRNLTIMRAVGDAGDLLDLS

SEQ ID NO: 7726 - protein, 22 aa, artificial
  peptide fold or domain or sub-domain
IDHLIEMSEDDNWHDHELLEEA

SEQ ID NO: 7727 - protein, 24 aa, artificial
  peptide fold or domain or sub-domain
IDHSRDTVLSAIAARKISPLLEQD

SEQ ID NO: 7728 - protein, 26 aa, artificial
  peptide fold or domain or sub-domain
IDHWFDDEEMERAPERQRRRYFEAGR

SEQ ID NO: 7729 - protein, 25 aa, artificial
  peptide fold or domain or sub-domain
IDIAPLYGTDLEAWQDVARQIDSAC

SEQ ID NO: 7730 - protein, 25 aa, artificial
  peptide fold or domain or sub-domain
IDIAPMLSGEGDDRKRVGEAVATAC

SEQ ID NO: 7731 - protein, 30 aa, artificial
  peptide fold or domain or sub-domain
IDIDEVITSEQGMSVSDIFAKYGEKEFRRL

SEQ ID NO: 7732 - protein, 30 aa, artificial
  peptide fold or domain or sub-domain
IDIKLIDLKADALSVDSDAIAISGADDAEN

SEQ ID NO: 7733 - protein, 29 aa, artificial
  peptide fold or domain or sub-domain
IDILFSAIKGKPINAMVDQLKTIASTFYI

SEQ ID NO: 7734 - protein, 30 aa, artificial
  peptide fold or domain or sub-domain
IDIRSNMERKQTQGLIVLLDKKAKRFSLHI

SEQ ID NO: 7735 - protein, 28 aa, artificial
  peptide fold or domain or sub-domain
IDISKDLIKEITETGISTIENNYEFDII

SEQ ID NO: 7736 - protein, 28 aa, artificial
  peptide fold or domain or sub-domain
IDISNQQIELITETGIRVHGQTVECEAI

SEQ ID NO: 7737 - protein, 27 aa, artificial
  peptide fold or domain or sub-domain
IDISSYRGDVGAIMKAYSWDEITSSQV

SEQ ID NO: 7738 - protein, 21 aa, artificial
  peptide fold or domain or sub-domain
IDKAAKGSTLHKNAAARRKSR

SEQ ID NO: 7739 - protein, 27 aa, artificial
  peptide fold or domain or sub-domain
IDKDKTGKLSIPEGKKFDTLWQLVEHY

SEQ ID NO: 7740 - protein, 28 aa, artificial
  peptide fold or domain or sub-domain
IDKIPRLKEVNDRYKKKYGVDLNGNSAR

SEQ ID NO: 7741 - protein, 20 aa, artificial
  peptide fold or domain or sub-domain
IDKKKDENQVTQIKLLMDVN

SEQ ID NO: 7742 - protein, 26 aa, artificial
  peptide fold or domain or sub-domain
IDKKTADQYKITNIAQLKDPKIAKLF

SEQ ID NO: 7743 - protein, 21 aa, artificial
  peptide fold or domain or sub-domain
IDKLIRVCTKDGEKETSRKNV

SEQ ID NO: 7744 - protein, 25 aa, artificial
  peptide fold or domain or sub-domain
IDKMTADGTFDNLSKREKLQITRQR

SEQ ID NO: 7745 - protein, 27 aa, artificial
  peptide fold or domain or sub-domain
IDKNELKQALTAFGYRLSDGIYDTLIR

SEQ ID NO: 7746 - protein, 27 aa, artificial
  peptide fold or domain or sub-domain
IDKNVALPGHDSGKPVPVCRGCFRQMQ

SEQ ID NO: 7747 - protein, 21 aa, artificial
  peptide fold or domain or sub-domain
IDKNYIRMFGGIEAALKAVAH

SEQ ID NO: 7748 - protein, 27 aa, artificial
  peptide fold or domain or sub-domain
IDKRLGVTESHLECSTCGETALRCPGH

SEQ ID NO: 7749 - protein, 29 aa, artificial
  peptide fold or domain or sub-domain
IDKRLKKGVKYAVRSSGLKEDLDNLSFAG

SEQ ID NO: 7750 - protein, 30 aa, artificial
  peptide fold or domain or sub-domain
IDKTKVSASEALATAPLLAEALGINSANYV

SEQ ID NO: 7751 - protein, 21 aa, artificial
  peptide fold or domain or sub-domain
IDKTVKVGAMHRNTGNHRKSL

SEQ ID NO: 7752 - protein, 25 aa, artificial
  peptide fold or domain or sub-domain
IDLAGFLSGDSCLASEATRLVSKAA

SEQ ID NO: 7753 - protein, 25 aa, artificial
  peptide fold or domain or sub-domain
IDLAGVRGGDRDALARAGREIRDAC

SEQ ID NO: 7754 - protein, 25 aa, artificial
  peptide fold or domain or sub-domain
IDLCPSEPETWNRQLDNDGCPDGIS

SEQ ID NO: 7755 - protein, 30 aa, artificial
  peptide fold or domain or sub-domain
IDLDDEVVKRQQRSINAIFREEGEDVFRRY

SEQ ID NO: 7756 - protein, 24 aa, artificial
  peptide fold or domain or sub-domain
IDLDLPEMFPVQNIKNHLVHAFSG

SEQ ID NO: 7757 - protein, 25 aa, artificial
  peptide fold or domain or sub-domain
IDLEGLFSEEGLSDDVIMARISEAC

SEQ ID NO: 7758 - protein, 29 aa, artificial
  peptide fold or domain or sub-domain
IDLENIINKDSSIPQKMQNRHIVIRSEHT

SEQ ID NO: 7759 - protein, 27 aa, artificial
  peptide fold or domain or sub-domain
IDLFASIFEHSGVPKDNIYILANRAFA

SEQ ID NO: 7760 - protein, 22 aa, artificial
  peptide fold or domain or sub-domain
IDLFKGGHLSSDYLKINPLHTV

SEQ ID NO: 7761 - protein, 21 aa, artificial
  peptide fold or domain or sub-domain
IDLFKVEKFNHHPKVFGGLFK

SEQ ID NO: 7762 - protein, 25 aa, artificial
  peptide fold or domain or sub-domain
IDLGGRDFQDAIKRNNAIEEIKEAA

SEQ ID NO: 7763 - protein, 25 aa, artificial
  peptide fold or domain or sub-domain
IDLGLLSQQVAAGGGEEVEKLRSAL

SEQ ID NO: 7764 - protein, 25 aa, artificial
  peptide fold or domain or sub-domain
IDLKNIESDDEKIRENCIEELKKAS

SEQ ID NO: 7765 - protein, 25 aa, artificial
  peptide fold or domain or sub-domain
IDLMITHEKQLSRQMVQHFSRIEET

SEQ ID NO: 7766 - protein, 25 aa, artificial
  peptide fold or domain or sub-domain
IDLNILKSVKAASGDLSDTTDQHTK

SEQ ID NO: 7767 - protein, 24 aa, artificial
  peptide fold or domain or sub-domain
IDLPDEEIRRCVYDQQFPKLYNYD

SEQ ID NO: 7768 - protein, 24 aa, artificial
  peptide fold or domain or sub-domain
IDLPNEEVKELIRQQNWDSLIAGD

SEQ ID NO: 7769 - protein, 27 aa, artificial
  peptide fold or domain or sub-domain
IDLRMGTTERDYLCATCNQDNYVCAGH

SEQ ID NO: 7770 - protein, 25 aa, artificial
  peptide fold or domain or sub-domain
IDLSDAQSPSLQKRKAVAAEIRNAC

SEQ ID NO: 7771 - protein, 25 aa, artificial
  peptide fold or domain or sub-domain
IDLSGFLNGNEAETQLAAKAVKKAC

SEQ ID NO: 7772 - protein, 25 aa, artificial
  peptide fold or domain or sub-domain
IDLSHLTSGEEVKRKRCVKQMVAAA

SEQ ID NO: 7773 - protein, 29 aa, artificial
  peptide fold or domain or sub-domain
IDLSKDTFDTVELTARKLAHVEQLYNHEQ

SEQ ID NO: 7774 - protein, 25 aa, artificial
  peptide fold or domain or sub-domain
IDLSKLSKPDNDDFFFEILKLSQAC

SEQ ID NO: 7775 - protein, 24 aa, artificial
  peptide fold or domain or sub-domain
IDLSLLEEKIRGVGLYRNKARHLK

SEQ ID NO: 7776 - protein, 25 aa, artificial
  peptide fold or domain or sub-domain
IDLSLLEEKIRGVGLYRNKARHLKK

SEQ ID NO: 7777 - protein, 24 aa, artificial
  peptide fold or domain or sub-domain
IDLSSPTSGEANQKLYNTAYTQPA

SEQ ID NO: 7778 - protein, 24 aa, artificial
  peptide fold or domain or sub-domain
IDLTNDAVRSMLAREDLVGLYSRD

SEQ ID NO: 7779 - protein, 24 aa, artificial
  peptide fold or domain or sub-domain
IDLTNDQVKPMILQKLYAKIFECD

SEQ ID NO: 7780 - protein, 24 aa, artificial
  peptide fold or domain or sub-domain
IDLTYEEVFYFVKRQDWKKLLEFD

SEQ ID NO: 7781 - protein, 25 aa, artificial
  peptide fold or domain or sub-domain
IDLVLKVDADLPKLLAQHFSQIEEK

SEQ ID NO: 7782 - protein, 24 aa, artificial
  peptide fold or domain or sub-domain
IDMDGDVVRQIVAKKEYGLLFEHD

SEQ ID NO: 7783 - protein, 30 aa, artificial
  peptide fold or domain or sub-domain
IDMDRHLTGTFGRDIQCWVRTHGWKSFRDE

SEQ ID NO: 7784 - protein, 24 aa, artificial
  peptide fold or domain or sub-domain
IDMEKDELKECVRNGDLSTVLEFD

SEQ ID NO: 7785 - protein, 26 aa, artificial
  peptide fold or domain or sub-domain
IDMREFAKQAEKIFPGMVKYIEETNV

SEQ ID NO: 7786 - protein, 27 aa, artificial
  peptide fold or domain or sub-domain
IDMSWVCDGTTHCHDGLDEAHCCRPDQ

SEQ ID NO: 7787 - protein, 23 aa, artificial
  peptide fold or domain or sub-domain
IDNARAEMLGAENEDEYIFDSTR

SEQ ID NO: 7788 - protein, 26 aa, artificial
  peptide fold or domain or sub-domain
IDNRANLNYLLSHSGLDYKRNILNDR

SEQ ID NO: 7789 - protein, 28 aa, artificial
  peptide fold or domain or sub-domain
IDNSVNTISWYDWPEPLKNRHLAALEEV

SEQ ID NO: 7790 - protein, 25 aa, artificial
  peptide fold or domain or sub-domain
IDPAEALAMCRDGRINNAMAVLAIQ

SEQ ID NO: 7791 - protein, 29 aa, artificial
  peptide fold or domain or sub-domain
IDPAKVDAIRAGLKEGNFGAAFGNVDENM

SEQ ID NO: 7792 - protein, 20 aa, artificial
  peptide fold or domain or sub-domain
IDPEEMHKGRMEGIESPNRN

SEQ ID NO: 7793 - protein, 22 aa, artificial
  peptide fold or domain or sub-domain
IDPFHKAIRRNPDTQWITKPVH

SEQ ID NO: 7794 - protein, 22 aa, artificial
  peptide fold or domain or sub-domain
IDPNCRNVRNSWKIQWICSSKF

SEQ ID NO: 7795 - protein, 28 aa, artificial
  peptide fold or domain or sub-domain
IDPNHLKEVAEALTKDDIRELIKRGIIK

SEQ ID NO: 7796 - protein, 22 aa, artificial
  peptide fold or domain or sub-domain
IDPNHPAIQNDDDLSWICADDQ

SEQ ID NO: 7797 - protein, 29 aa, artificial
  peptide fold or domain or sub-domain
IDPSAVANVPFEPADIRYPLWQAAGAQSL

SEQ ID NO: 7798 - protein, 20 aa, artificial
  peptide fold or domain or sub-domain
IDPTDVGGQFHDRGQSYETV

SEQ ID NO: 7799 - protein, 20 aa, artificial
  peptide fold or domain or sub-domain
IDPYSVNKQGEDVGEKYRTG

SEQ ID NO: 7800 - protein, 30 aa, artificial
  peptide fold or domain or sub-domain
IDQDRAFEMCRTLARQAGVFCGGSTGLNVV

SEQ ID NO: 7801 - protein, 25 aa, artificial
  peptide fold or domain or sub-domain
IDQDVSNEQRSKPKSFNRDSVLKKI

SEQ ID NO: 7802 - protein, 25 aa, artificial
  peptide fold or domain or sub-domain
IDQERDRSEAYMAPTTTTLLVAEVR

SEQ ID NO: 7803 - protein, 23 aa, artificial
  peptide fold or domain or sub-domain
IDQLGLRELSTAMQAGKACTVIL

SEQ ID NO: 7804 - protein, 26 aa, artificial
  peptide fold or domain or sub-domain
IDQNELSNALQSFGYRLSPKLLHIVT

SEQ ID NO: 7805 - protein, 24 aa, artificial
  peptide fold or domain or sub-domain
IDQRRENVISSIANGELAYLLEHD

SEQ ID NO: 7806 - protein, 24 aa, artificial
  peptide fold or domain or sub-domain
IDRIIMEGMEKGEFRQDLDVRLTR

SEQ ID NO: 7807 - protein, 24 aa, artificial
  peptide fold or domain or sub-domain
IDRISSRMPGAVYDPGSFPGMILK

SEQ ID NO: 7808 - protein, 20 aa, artificial
  peptide fold or domain or sub-domain
IDRIVPATTDSDRADLEAKV

SEQ ID NO: 7809 - protein, 30 aa, artificial
  peptide fold or domain or sub-domain
IDRLRRGIEVMRAKHDITSANVFEAILADE

SEQ ID NO: 7810 - protein, 27 aa, artificial
  peptide fold or domain or sub-domain
IDRTELHSALMGFGFSLPPEMIRKIEK

SEQ ID NO: 7811 - protein, 24 aa, artificial
  peptide fold or domain or sub-domain
IDSDNEEVRKLVELDDLDKLASYD

SEQ ID NO: 7812 - protein, 23 aa, artificial
  peptide fold or domain or sub-domain
IDSEEFERRQHRYSKDRNRHYYF

SEQ ID NO: 7813 - protein, 28 aa, artificial
  peptide fold or domain or sub-domain
IDSLDRALEVAMSAMVEDIELTLKSMLD

SEQ ID NO: 7814 - protein, 26 aa, artificial
  peptide fold or domain or sub-domain
IDSMIPVLMYNRNMTVQEAIADTCAE

SEQ ID NO: 7815 - protein, 20 aa, artificial
  peptide fold or domain or sub-domain
IDSSTLEINSSGQLTVRSTS

SEQ ID NO: 7816 - protein, 22 aa, artificial
  peptide fold or domain or sub-domain
IDSWVKENRLHELKFARQKSAY

SEQ ID NO: 7817 - protein, 30 aa, artificial
  peptide fold or domain or sub-domain
IDTDAVMEARCGQSLQALMAERGVEGFRAA

SEQ ID NO: 7818 - protein, 28 aa, artificial
  peptide fold or domain or sub-domain
IDTDGKGIQSVTPNGIVANGQEYPVDIL

SEQ ID NO: 7819 - protein, 30 aa, artificial
  peptide fold or domain or sub-domain
IDTDLEIERLTEMTVSEIFRRHGETRFRSE

SEQ ID NO: 7820 - protein, 30 aa, artificial
  peptide fold or domain or sub-domain
IDTDRIIMEKEKRPLRDIVNHDGLEKFLEI

SEQ ID NO: 7821 - protein, 29 aa, artificial
  peptide fold or domain or sub-domain
IDTEKAEQIAEAIGKGDFGTAIGLVDEDM

SEQ ID NO: 7822 - protein, 28 aa, artificial
  peptide fold or domain or sub-domain
IDTHVHQFMAQWFKVPAASRSLTPATYR

SEQ ID NO: 7823 - protein, 26 aa, artificial
  peptide fold or domain or sub-domain
IDTLRIYILNRHAGDPKCSVIFAKLL

SEQ ID NO: 7824 - protein, 28 aa, artificial
  peptide fold or domain or sub-domain
IDTNSIDQVLDATSREDVRKLIDLHIIQ

SEQ ID NO: 7825 - protein, 21 aa, artificial
  peptide fold or domain or sub-domain
IDTVLYMKEKATKAKPGILLF

SEQ ID NO: 7826 - protein, 30 aa, artificial
  peptide fold or domain or sub-domain
IDTVRRLYADYAAEARRLIDARLPVPAHSY

SEQ ID NO: 7827 - protein, 23 aa, artificial
  peptide fold or domain or sub-domain
IDTYEHAYYVDYKNKRPPYIDAF

SEQ ID NO: 7828 - protein, 20 aa, artificial
  peptide fold or domain or sub-domain
IDVKRLIRIPNSLHGKSGLI

SEQ ID NO: 7829 - protein, 21 aa, artificial
  peptide fold or domain or sub-domain
IDVLHHPGMNHRVEIIEGVLR

SEQ ID NO: 7830 - protein, 27 aa, artificial
  peptide fold or domain or sub-domain
IDVNELRDALLSLGFSVSPVVLDLLVS

SEQ ID NO: 7831 - protein, 25 aa, artificial
  peptide fold or domain or sub-domain
IDVSPLFGGAEQEIMKVAKQLDHAC

SEQ ID NO: 7832 - protein, 25 aa, artificial
  peptide fold or domain or sub-domain
IDVSRLIDGAEEEREKCKEAIARAS

SEQ ID NO: 7833 - protein, 26 aa, artificial
  peptide fold or domain or sub-domain
IDVTPDSIQHVHRQQVVVVRGRVLPL

SEQ ID NO: 7834 - protein, 27 aa, artificial
  peptide fold or domain or sub-domain
IDVYIGINELKYIENIDEYIDFYRSLI

SEQ ID NO: 7835 - protein, 24 aa, artificial
  peptide fold or domain or sub-domain
IDVYTQKELPNLSADAQGQVGILN

SEQ ID NO: 7836 - protein, 30 aa, artificial
  peptide fold or domain or sub-domain
IDWINNCLAKDVDLKSRLPIPEDGDKFFAA

SEQ ID NO: 7837 - protein, 26 aa, artificial
  peptide fold or domain or sub-domain
IDWLPKDSFWYLNDKQVAANTYSVPR

SEQ ID NO: 7838 - protein, 24 aa, artificial
  peptide fold or domain or sub-domain
IDWNVQEILTNIKSGHYEVLFNHD

SEQ ID NO: 7839 - protein, 26 aa, artificial
  peptide fold or domain or sub-domain
IDWRADRIDFFIDNVLQETITTNIAT

SEQ ID NO: 7840 - protein, 27 aa, artificial
  peptide fold or domain or sub-domain
IDYLFQKRLLNRSFKKNISNHEYDYLK

SEQ ID NO: 7841 - protein, 25 aa, artificial
  peptide fold or domain or sub-domain
IDYSLLINGNHDQRTKTIHDIGKAC

SEQ ID NO: 7842 - protein, 30 aa, artificial
  peptide fold or domain or sub-domain
IEAAQFYINPILREFKETDPRHVEWTKAWK

SEQ ID NO: 7843 - protein, 28 aa, artificial
  peptide fold or domain or sub-domain
IEAEIHHDIMAVVKALSEVCGEHGKYVH

SEQ ID NO: 7844 - protein, 26 aa, artificial
  peptide fold or domain or sub-domain
IEAFMDLHEETARRQGFALRPREYYR

SEQ ID NO: 7845 - protein, 28 aa, artificial
  peptide fold or domain or sub-domain
IEAITKHDVIAFLTHLGEFIGPEARFIH

SEQ ID NO: 7846 - protein, 27 aa, artificial
  peptide fold or domain or sub-domain
IEAKDTNAWDLGSSWTIASSTSAPNLE

SEQ ID NO: 7847 - protein, 29 aa, artificial
  peptide fold or domain or sub-domain
IEALVDGNAEKAKIVAAEYGVDPRKIYDY

SEQ ID NO: 7848 - protein, 22 aa, artificial
  peptide fold or domain or sub-domain
IEAWVQKFGLVRTEREWTLFHA

SEQ ID NO: 7849 - protein, 29 aa, artificial
  peptide fold or domain or sub-domain
IECTPCILGHIQRGGSPIAKDRILATKMG

SEQ ID NO: 7850 - protein, 28 aa, artificial
  peptide fold or domain or sub-domain
IEDGQVTFVSGDKICVTNKKGDEIAYYL

SEQ ID NO: 7851 - protein, 28 aa, artificial
  peptide fold or domain or sub-domain
IEDHFTDEEEMMKSKSYEDLDSHKKIHS

SEQ ID NO: 7852 - protein, 29 aa, artificial
  peptide fold or domain or sub-domain
IEDIETEAVQGNLDLYTKDPHRKWTLREA

SEQ ID NO: 7853 - protein, 30 aa, artificial
  peptide fold or domain or sub-domain
IEDLDEYLKNIFNGKPVPESVREENLRKYE

SEQ ID NO: 7854 - protein, 26 aa, artificial
  peptide fold or domain or sub-domain
IEEDGMSDPAVFARKAQRMLNDDKAV

SEQ ID NO: 7855 - protein, 26 aa, artificial
  peptide fold or domain or sub-domain
IEEFLKIGLLVGDKAKIAASRVVSAF

SEQ ID NO: 7856 - protein, 21 aa, artificial
  peptide fold or domain or sub-domain
IEEITNIRQWKWGTSEYEELH

SEQ ID NO: 7857 - protein, 25 aa, artificial
  peptide fold or domain or sub-domain
IEEMISSGRINKLIKKEAVEIQKEH

SEQ ID NO: 7858 - protein, 23 aa, artificial
  peptide fold or domain or sub-domain
IEENKGWYLEHDYISGSKSLAIN

SEQ ID NO: 7859 - protein, 27 aa, artificial
  peptide fold or domain or sub-domain
IEEQELTQAFTQMGFRFSPEFINFLVK

SEQ ID NO: 7860 - protein, 29 aa, artificial
  peptide fold or domain or sub-domain
IEETGVVPNILELLKADNYVADDKNKSFL

SEQ ID NO: 7861 - protein, 21 aa, artificial
  peptide fold or domain or sub-domain
IEFNTLKELLEATDGNLASHI

SEQ ID NO: 7862 - protein, 25 aa, artificial
  peptide fold or domain or sub-domain
IEFSKLAECVRPSGFYNQKAKRLID

SEQ ID NO: 7863 - protein, 27 aa, artificial
  peptide fold or domain or sub-domain
IEGDKLVPFICNGLKNVGLGCKIAARC

SEQ ID NO: 7864 - protein, 27 aa, artificial
  peptide fold or domain or sub-domain
IEGICGVTDWGETELGSATHEEFRRQM

SEQ ID NO: 7865 - protein, 27 aa, artificial
  peptide fold or domain or sub-domain
IEGISGVVNGSHTSPQGYDYSRARKLM

SEQ ID NO: 7866 - protein, 26 aa, artificial
  peptide fold or domain or sub-domain
IEGLLELGIVEGDSEQLIKDQAHKEF

SEQ ID NO: 7867 - protein, 27 aa, artificial
  peptide fold or domain or sub-domain
IEGTAGITNWDEAKKGNPDYAEFREYM

SEQ ID NO: 7868 - protein, 27 aa, artificial
  peptide fold or domain or sub-domain
IEGTCGIVNWDETKLECEFSQHYRTQM

SEQ ID NO: 7869 - protein, 27 aa, artificial
  peptide fold or domain or sub-domain
IEGVAGVFATEQTRAGNPEYERARRWM

SEQ ID NO: 7870 - protein, 27 aa, artificial
  peptide fold or domain or sub-domain
IEGVAGVVSSEHTTPAGFEDQQAREWY

SEQ ID NO: 7871 - protein, 26 aa, artificial
  peptide fold or domain or sub-domain
IEGVRPDQIPFDELFQSNQPIILRGL

SEQ ID NO: 7872 - protein, 21 aa, artificial
  peptide fold or domain or sub-domain
IEHFIRFLIKGWKKKKAINLL

SEQ ID NO: 7873 - protein, 27 aa, artificial
  peptide fold or domain or sub-domain
IEHLNLKLVQHFKANDLDGAKEAIIRL

SEQ ID NO: 7874 - protein, 23 aa, artificial
  peptide fold or domain or sub-domain
IEHPALMTHGSIPAEKRSEIGIS

SEQ ID NO: 7875 - protein, 23 aa, artificial
  peptide fold or domain or sub-domain
IEHPASMTHAAVPEHLLKQQGLT

SEQ ID NO: 7876 - protein, 23 aa, artificial
  peptide fold or domain or sub-domain
IEHPLSMSHGKHLLRYLDGPTVA

SEQ ID NO: 7877 - protein, 21 aa, artificial
  peptide fold or domain or sub-domain
IEHVTNMLMRHGKKEKARKQL

SEQ ID NO: 7878 - protein, 21 aa, artificial
  peptide fold or domain or sub-domain
IEHYQKSLEIKPNNAEVYHSL

SEQ ID NO: 7879 - protein, 26 aa, artificial
  peptide fold or domain or sub-domain
IEIEELREALSDELGTSEEVVDAIIR

SEQ ID NO: 7880 - protein, 25 aa, artificial
  peptide fold or domain or sub-domain
IEIGKLFDHFKNSFSMIMGTVVSKE

SEQ ID NO: 7881 - protein, 23 aa, artificial
  peptide fold or domain or sub-domain
IEIIYLFLLMQRGLSISESISLL

SEQ ID NO: 7882 - protein, 28 aa, artificial
  peptide fold or domain or sub-domain
IEKFYDKLIKNQAIGQFFVKTDPIKQKN

SEQ ID NO: 7883 - protein, 26 aa, artificial
  peptide fold or domain or sub-domain
IEKGTKTVNGISVFANYDGPGQDRVL

SEQ ID NO: 7884 - protein, 30 aa, artificial
  peptide fold or domain or sub-domain
IEKIDYEEGKMLVHFERWSHRYDEWIYWDS

SEQ ID NO: 7885 - protein, 23 aa, artificial
  peptide fold or domain or sub-domain
IEKIYPKVTGKDFYKDLLEMLSV

SEQ ID NO: 7886 - protein, 29 aa, artificial
  peptide fold or domain or sub-domain
IEKLQAKQEQLTDPEQQQNARAYLIYMRK

SEQ ID NO: 7887 - protein, 28 aa, artificial
  peptide fold or domain or sub-domain
IEKMAVLYQTPNSIYYQKDTLQKDIMYA

SEQ ID NO: 7888 - protein, 27 aa, artificial
  peptide fold or domain or sub-domain
IEKMTKQIIQDISNEQYQKAYEIILYL

SEQ ID NO: 7889 - protein, 29 aa, artificial
  peptide fold or domain or sub-domain
IELDADREESKRSATAEEASERQERMNAT

SEQ ID NO: 7890 - protein, 26 aa, artificial
  peptide fold or domain or sub-domain
IELIPPGGWSNCSHDIPKTAIQMALD

SEQ ID NO: 7891 - protein, 28 aa, artificial
  peptide fold or domain or sub-domain
IELIVQPDPSGLNLLGRPDLDTVLTKLH

SEQ ID NO: 7892 - protein, 22 aa, artificial
  peptide fold or domain or sub-domain
IELKDGEHKKEPFIFRNPFGKV

SEQ ID NO: 7893 - protein, 25 aa, artificial
  peptide fold or domain or sub-domain
IELLPVFDLATVNEFSDKVADIQQP

SEQ ID NO: 7894 - protein, 24 aa, artificial
  peptide fold or domain or sub-domain
IELNDNKVRSLIEKGSLEELYEKD

SEQ ID NO: 7895 - protein, 25 aa, artificial
  peptide fold or domain or sub-domain
IELNNYNSIKTNNRIYQTNHKNIFA

SEQ ID NO: 7896 - protein, 21 aa, artificial
  peptide fold or domain or sub-domain
IELSEKEILRTKNNREENKVA

SEQ ID NO: 7897 - protein, 27 aa, artificial
  peptide fold or domain or sub-domain
IELSSVAHCGGVDQLLHDSSDFAWRTN

SEQ ID NO: 7898 - protein, 28 aa, artificial
  peptide fold or domain or sub-domain
IELTTVAPVTRTFTWSGGRSRNTMTLER

SEQ ID NO: 7899 - protein, 28 aa, artificial
  peptide fold or domain or sub-domain
IELVPLLVQSGFTASNGEFRRLVQQGGV

SEQ ID NO: 7900 - protein, 28 aa, artificial
  peptide fold or domain or sub-domain
IELVRYNSTEDTFFGYTAIGQKFAEEYN

SEQ ID NO: 7901 - protein, 24 aa, artificial
  peptide fold or domain or sub-domain
IELVSTLEADPFNNKISIESPLGQ

SEQ ID NO: 7902 - protein, 23 aa, artificial
  peptide fold or domain or sub-domain
IEMEPAVTLSAVRKGNVMIWARG

SEQ ID NO: 7903 - protein, 26 aa, artificial
  peptide fold or domain or sub-domain
IEMFRERDTDNSDTAFFNLDDWLERT

SEQ ID NO: 7904 - protein, 30 aa, artificial
  peptide fold or domain or sub-domain
IENADRLRSALAGAGHRFTSAVDSEVLTHL

SEQ ID NO: 7905 - protein, 24 aa, artificial
  peptide fold or domain or sub-domain
IENEAAYENKISAGELDINNVFSG

SEQ ID NO: 7906 - protein, 30 aa, artificial
  peptide fold or domain or sub-domain
IENHEPLREELKARGYTFVSETDTEVIAHL

SEQ ID NO: 7907 - protein, 27 aa, artificial
  peptide fold or domain or sub-domain
IENIENQCDLLGPSMSSLCREYVSQYS

SEQ ID NO: 7908 - protein, 24 aa, artificial
  peptide fold or domain or sub-domain
IENIMLAPVESGKQGKDEARASAL

SEQ ID NO: 7909 - protein, 23 aa, artificial
  peptide fold or domain or sub-domain
IENIRKALVEHDPAHAETYNRNA

SEQ ID NO: 7910 - protein, 28 aa, artificial
  peptide fold or domain or sub-domain
IENLLTNFMREIKVKEVLYFYTMQAAQE

SEQ ID NO: 7911 - protein, 30 aa, artificial
  peptide fold or domain or sub-domain
IENYREIKTFLLKNNIPFKSNTDTEVVANL

SEQ ID NO: 7912 - protein, 21 aa, artificial
  peptide fold or domain or sub-domain
IEPEKIQEMFPLLNMNKVLAG

SEQ ID NO: 7913 - protein, 28 aa, artificial
  peptide fold or domain or sub-domain
IEPELDGSAQVTSHDASTNGLINFIKQQ

SEQ ID NO: 7914 - protein, 25 aa, artificial
  peptide fold or domain or sub-domain
IEPFVRADMDLPREIVRHFNSLEEK

SEQ ID NO: 7915 - protein, 22 aa, artificial
  peptide fold or domain or sub-domain
IEPSFLDKYDGKENLSSKVSRI

SEQ ID NO: 7916 - protein, 28 aa, artificial
  peptide fold or domain or sub-domain
IEPSFLDKYDGKENLSSKVSRILELLDK

SEQ ID NO: 7917 - protein, 27 aa, artificial
  peptide fold or domain or sub-domain
IEPTLLDELICHIGSLASVYHKPPNAF

SEQ ID NO: 7918 - protein, 29 aa, artificial
  peptide fold or domain or sub-domain
IEQFIFAGKTIYYRNGLCVDENGTLSGSS

SEQ ID NO: 7919 - protein, 27 aa, artificial
  peptide fold or domain or sub-domain
IEQFLDALWLEKNLAENTLNAYRRDLS

SEQ ID NO: 7920 - protein, 23 aa, artificial
  peptide fold or domain or sub-domain
IEQHYKEHSEQSYFNDNCDFMVS

SEQ ID NO: 7921 - protein, 24 aa, artificial
  peptide fold or domain or sub-domain
IEQIPQLPYWLWIVMTIGIGRAEL

SEQ ID NO: 7922 - protein, 23 aa, artificial
  peptide fold or domain or sub-domain
IEQPLVMSYFHYSPEERACFGIA

SEQ ID NO: 7923 - protein, 27 aa, artificial
  peptide fold or domain or sub-domain
IEQTSGGQLTCDKEEYFSNLTQLVSHY

SEQ ID NO: 7924 - protein, 29 aa, artificial
  peptide fold or domain or sub-domain
IEQVERAERAEPDAASRAPYPMYLSLMRK

SEQ ID NO: 7925 - protein, 23 aa, artificial
  peptide fold or domain or sub-domain
IERAVAKGRELGLADSFVETLFQ

SEQ ID NO: 7926 - protein, 27 aa, artificial
  peptide fold or domain or sub-domain
IERELNGTYAIAGGRTHASPADLCHYH

SEQ ID NO: 7927 - protein, 23 aa, artificial
  peptide fold or domain or sub-domain
IERENYIEDLLQLSGDRRESVRS

SEQ ID NO: 7928 - protein, 21 aa, artificial
  peptide fold or domain or sub-domain
IERFDGISVNWNNWTAQTNAN

SEQ ID NO: 7929 - protein, 26 aa, artificial
  peptide fold or domain or sub-domain
IERFFSAYSASVHRLGTPVFSRKYFR

SEQ ID NO: 7930 - protein, 28 aa, artificial
  peptide fold or domain or sub-domain
IERFYTKLNNDENLQKMFQFLDRDTQTS

SEQ ID NO: 7931 - protein, 25 aa, artificial
  peptide fold or domain or sub-domain
IERMDRDGTLDKLKKKEKLMRLREH

SEQ ID NO: 7932 - protein, 21 aa, artificial
  peptide fold or domain or sub-domain
IERMNERGVVVGDTEYPLDCL

SEQ ID NO: 7933 - protein, 30 aa, artificial
  peptide fold or domain or sub-domain
IERNKQLFEIYSDEAKMLLRAGLPLPAYTF

SEQ ID NO: 7934 - protein, 25 aa, artificial
  peptide fold or domain or sub-domain
IERQEKNGELKLLPKKEQMLIKKEK

SEQ ID NO: 7935 - protein, 26 aa, artificial
  peptide fold or domain or sub-domain
IERRIDDYYEDHGDAYYLRLGENESL

SEQ ID NO: 7936 - protein, 23 aa, artificial
  peptide fold or domain or sub-domain
IERTRKIARENGIDENKLTELMK

SEQ ID NO: 7937 - protein, 21 aa, artificial
  peptide fold or domain or sub-domain
IERVCQLRGWQKDTPKNKETY

SEQ ID NO: 7938 - protein, 30 aa, artificial
  peptide fold or domain or sub-domain
IESCQVGMVKPEPQIYKFLLDTLKASPSEV

SEQ ID NO: 7939 - protein, 25 aa, artificial
  peptide fold or domain or sub-domain
IESFIKAEGNLTREMIKHLERCEHR

SEQ ID NO: 7940 - protein, 21 aa, artificial
  peptide fold or domain or sub-domain
IESFRSSFCGNSNFQKNNLLI

SEQ ID NO: 7941 - protein, 28 aa, artificial
  peptide fold or domain or sub-domain
IESMACAWATPGSSYHKDPEILSACIEG

SEQ ID NO: 7942 - protein, 21 aa, artificial
  peptide fold or domain or sub-domain
IESNIYDRNDISLTELESLII

SEQ ID NO: 7943 - protein, 30 aa, artificial
  peptide fold or domain or sub-domain
IESVVTAACQLARHRKSSTLEVKDVQLHLE

SEQ ID NO: 7944 - protein, 21 aa, artificial
  peptide fold or domain or sub-domain
IETILEVDENTKNNNSNFIIY

SEQ ID NO: 7945 - protein, 21 aa, artificial
  peptide fold or domain or sub-domain
IETMNKLRDELNKINSNIMLY

SEQ ID NO: 7946 - protein, 21 aa, artificial
  peptide fold or domain or sub-domain
IETMTANAIVTSKGTYEADAV

SEQ ID NO: 7947 - protein, 30 aa, artificial
  peptide fold or domain or sub-domain
IETYDLNGAGDEAVNTGTVTTESVASLDLS

SEQ ID NO: 7948 - protein, 24 aa, artificial
  peptide fold or domain or sub-domain
IETYLVSGSESSTVKGESFFDTLK

SEQ ID NO: 7949 - protein, 26 aa, artificial
  peptide fold or domain or sub-domain
IEVDPSILKTIGGKPVIVLRGEIIPV

SEQ ID NO: 7950 - protein, 30 aa, artificial
  peptide fold or domain or sub-domain
IEVIIAGARNLEAANELRELAKADNRLHAI

SEQ ID NO: 7951 - protein, 25 aa, artificial
  peptide fold or domain or sub-domain
IEVSKRETIVVDVNTMQTSKENVYA

SEQ ID NO: 7952 - protein, 25 aa, artificial
  peptide fold or domain or sub-domain
IEVVIRSEEGLSRDMVKHLNSIEEQ

SEQ ID NO: 7953 - protein, 27 aa, artificial
  peptide fold or domain or sub-domain
IEVVMTKQCYNTMARFYDVSKWNVKIV

SEQ ID NO: 7954 - protein, 21 aa, artificial
  peptide fold or domain or sub-domain
IEVYTQAINLNSQKSVYYSNR

SEQ ID NO: 7955 - protein, 26 aa, artificial
  peptide fold or domain or sub-domain
IEWEPGEIRWYIDGKLYHVANDWYSR

SEQ ID NO: 7956 - protein, 26 aa, artificial
  peptide fold or domain or sub-domain
IEWFKNAILWYVDGQLVREQTNAIPQ

SEQ ID NO: 7957 - protein, 29 aa, artificial
  peptide fold or domain or sub-domain
IEYDEAALKDISEVVINFADAEDLPAHGE

SEQ ID NO: 7958 - protein, 21 aa, artificial
  peptide fold or domain or sub-domain
IEYFRKSLELNPDYAMTHNSL

SEQ ID NO: 7959 - protein, 26 aa, artificial
  peptide fold or domain or sub-domain
IFAGRNFNSAGMKRANELGVHISDRG

SEQ ID NO: 7960 - protein, 22 aa, artificial
  peptide fold or domain or sub-domain
IFALEWDEDELEFYVDDVLYHV

SEQ ID NO: 7961 - protein, 28 aa, artificial
  peptide fold or domain or sub-domain
IFASEDSEFTYSNNIDEYGDNFFPSQRF

SEQ ID NO: 7962 - protein, 26 aa, artificial
  peptide fold or domain or sub-domain
IFASSTQVRLEVTAANDGNLGTRWGS

SEQ ID NO: 7963 - protein, 29 aa, artificial
  peptide fold or domain or sub-domain
IFAWYMHIYTRAKALGIKPYLAYGFTGAI

SEQ ID NO: 7964 - protein, 25 aa, artificial
  peptide fold or domain or sub-domain
IFCEVDPLAKAVLSKNFPGVKIEDD

SEQ ID NO: 7965 - protein, 23 aa, artificial
  peptide fold or domain or sub-domain
IFDFPLRLTIGTDIDTAEVLEEM

SEQ ID NO: 7966 - protein, 30 aa, artificial
  peptide fold or domain or sub-domain
IFDLQVSKQGHFMEDRYMSPQQIDQLKSGI

SEQ ID NO: 7967 - protein, 26 aa, artificial
  peptide fold or domain or sub-domain
IFEDEEANPSVAVQKAEKLFDVQKVD

SEQ ID NO: 7968 - protein, 26 aa, artificial
  peptide fold or domain or sub-domain
IFEDLIQDIAVRAQAFGSGALRAALA

SEQ ID NO: 7969 - protein, 24 aa, artificial
  peptide fold or domain or sub-domain
IFEDLVPNYYHFMDADGTPRTSFG

SEQ ID NO: 7970 - protein, 21 aa, artificial
  peptide fold or domain or sub-domain
IFEERSTRLTFAEMNNVIKDS

SEQ ID NO: 7971 - protein, 20 aa, artificial
  peptide fold or domain or sub-domain
IFEKNPYLSNKQVREIMNKA

SEQ ID NO: 7972 - protein, 28 aa, artificial
  peptide fold or domain or sub-domain
IFESGIDSPYSAFIIGSLDFDGLLCGSY

SEQ ID NO: 7973 - protein, 28 aa, artificial
  peptide fold or domain or sub-domain
IFESLKDECSKLGLDEIVALVLLARLCK

SEQ ID NO: 7974 - protein, 21 aa, artificial
  peptide fold or domain or sub-domain
IFEVKGTGLTFSEMDSKQKRE

SEQ ID NO: 7975 - protein, 21 aa, artificial
  peptide fold or domain or sub-domain
IFFDPLYGMTAAQMGAELKNK

SEQ ID NO: 7976 - protein, 21 aa, artificial
  peptide fold or domain or sub-domain
IFFDTNLGKTFGELPLKEKKQ

SEQ ID NO: 7977 - protein, 26 aa, artificial
  peptide fold or domain or sub-domain
IFFSDKKKVNLKDVGGKGLNLIHMIQ

SEQ ID NO: 7978 - protein, 27 aa, artificial
  peptide fold or domain or sub-domain
IFFSTSQYGKYVPIIKNKINFIYNAFD

SEQ ID NO: 7979 - protein, 21 aa, artificial
  peptide fold or domain or sub-domain
IFFVPSEGKTAAELTREEKSA

SEQ ID NO: 7980 - protein, 27 aa, artificial
  peptide fold or domain or sub-domain
IFHGTDRESLHKYMSPKCLPAAYGGFR

SEQ ID NO: 7981 - protein, 30 aa, artificial
  peptide fold or domain or sub-domain
IFIEERIYKDKEFEQSKDMDAACEHIDRRL

SEQ ID NO: 7982 - protein, 21 aa, artificial
  peptide fold or domain or sub-domain
IFIPEGEDSTFAELGVEEKCK

SEQ ID NO: 7983 - protein, 21 aa, artificial
  peptide fold or domain or sub-domain
IFIPEHHDCSAAQMSSDEKNT

SEQ ID NO: 7984 - protein, 26 aa, artificial
  peptide fold or domain or sub-domain
IFISALDDVFDKVKAFEIGGADYITK

SEQ ID NO: 7985 - protein, 26 aa, artificial
  peptide fold or domain or sub-domain
IFITALNDRRSRIRGIEVGADDFLSK

SEQ ID NO: 7986 - protein, 21 aa, artificial
  peptide fold or domain or sub-domain
IFKQHMNMIGGFEALLKKLPE

SEQ ID NO: 7987 - protein, 26 aa, artificial
  peptide fold or domain or sub-domain
IFKRDELDGVGKDKQFKKFPINFSLE

SEQ ID NO: 7988 - protein, 29 aa, artificial
  peptide fold or domain or sub-domain
IFKSWVDQSQNVKDEKKMNEVQKQMIGYF

SEQ ID NO: 7989 - protein, 21 aa, artificial
  peptide fold or domain or sub-domain
IFLLPHLGRTFAQLSIEEKNR

SEQ ID NO: 7990 - protein, 25 aa, artificial
  peptide fold or domain or sub-domain
IFLMMLQKGGEEKSHEKITAKLDEK

SEQ ID NO: 7991 - protein, 25 aa, artificial
  peptide fold or domain or sub-domain
IFLNNIENINTFRKLIKLKCETNES

SEQ ID NO: 7992 - protein, 26 aa, artificial
  peptide fold or domain or sub-domain
IFLSARSEAADKIKGLAIGGADYITK

SEQ ID NO: 7993 - protein, 26 aa, artificial
  peptide fold or domain or sub-domain
IFLTAKAMKDDVLKGYKVGADDYLNK

SEQ ID NO: 7994 - protein, 26 aa, artificial
  peptide fold or domain or sub-domain
IFLTASNEKQDLLQAFAKGAVDYVTK

SEQ ID NO: 7995 - protein, 26 aa, artificial
  peptide fold or domain or sub-domain
IFLTGYDLVLTPEQRKVLPHAILLRK

SEQ ID NO: 7996 - protein, 26 aa, artificial
  peptide fold or domain or sub-domain
IFLTSFSDEESIRKGFESGGQDYVVK

SEQ ID NO: 7997 - protein, 21 aa, artificial
  peptide fold or domain or sub-domain
IFMPNGYDKTFAQISLMEKGE

SEQ ID NO: 7998 - protein, 26 aa, artificial
  peptide fold or domain or sub-domain
IFMTALCDSESKVKALELGAVDYIVK

SEQ ID NO: 7999 - protein, 20 aa, artificial
  peptide fold or domain or sub-domain
IFNGFDDEILADAFGVDVQT

SEQ ID NO: 8000 - protein, 22 aa, artificial
  peptide fold or domain or sub-domain
IFQDNEPWKRKNNSPQETKELI

SEQ ID NO: 8001 - protein, 20 aa, artificial
  peptide fold or domain or sub-domain
IFRGFETRLLAESFGVSEEI

SEQ ID NO: 8002 - protein, 25 aa, artificial
  peptide fold or domain or sub-domain
IFRNQEPNVISFYNDQQIREEVVEF

SEQ ID NO: 8003 - protein, 27 aa, artificial
  peptide fold or domain or sub-domain
IFSEMVQGQENPAQKELGEAELLAGVA

SEQ ID NO: 8004 - protein, 20 aa, artificial
  peptide fold or domain or sub-domain
IFSGFNIQLLSEALGISQQA

SEQ ID NO: 8005 - protein, 24 aa, artificial
  peptide fold or domain or sub-domain
IFSSVHINGERAYKKARRGEFFEL

SEQ ID NO: 8006 - protein, 28 aa, artificial
  peptide fold or domain or sub-domain
IFTLARAYKLPGGELENDPQLLAMLVES

SEQ ID NO: 8007 - protein, 27 aa, artificial
  peptide fold or domain or sub-domain
IFVKGDVKQLFQSVNKEQIEEKFGGTQ

SEQ ID NO: 8008 - protein, 26 aa, artificial
  peptide fold or domain or sub-domain
IFVTAMGDAVSEQQGLQLGAIDYMSK

SEQ ID NO: 8009 - protein, 30 aa, artificial
  peptide fold or domain or sub-domain
IFYDPFSRDGQDKALGFERVFSLDEFMSRS

SEQ ID NO: 8010 - protein, 21 aa, artificial
  peptide fold or domain or sub-domain
IFYSHDLGKSFGQASEKEKDS

SEQ ID NO: 8011 - protein, 21 aa, artificial
  peptide fold or domain or sub-domain
IFYVEEYKKAMAELSSDEKNA

SEQ ID NO: 8012 - protein, 21 aa, artificial
  peptide fold or domain or sub-domain
IFYVPEKQLTFAEMTPELKKS

SEQ ID NO: 8013 - protein, 27 aa, artificial
  peptide fold or domain or sub-domain
IGAAAVYLGFDMNTTVRSELQQIQQLL

SEQ ID NO: 8014 - protein, 27 aa, artificial
  peptide fold or domain or sub-domain
IGAACAYLGEGFACKTKAAWIKAAKLI

SEQ ID NO: 8015 - protein, 27 aa, artificial
  peptide fold or domain or sub-domain
IGAALMRLGYSINSTDPDELAEAEESL

SEQ ID NO: 8016 - protein, 27 aa, artificial
  peptide fold or domain or sub-domain
IGAAMLFLGKDRNSSDAADLEAAKKVL

SEQ ID NO: 8017 - protein, 29 aa, artificial
  peptide fold or domain or sub-domain
IGAFHGRTQGSLSFTASKPIHHRGFFPSM

SEQ ID NO: 8018 - protein, 27 aa, artificial
  peptide fold or domain or sub-domain
IGAKLLDIMRGVALADVLNPLEKILGK

SEQ ID NO: 8019 - protein, 22 aa, artificial
  peptide fold or domain or sub-domain
IGANSYGEDGVMGPPNLNDIFD

SEQ ID NO: 8020 - protein, 27 aa, artificial
  peptide fold or domain or sub-domain
IGAVLRMLGYSYNSQNEAQIKQAYEKL

SEQ ID NO: 8021 - protein, 29 aa, artificial
  peptide fold or domain or sub-domain
IGAYHGQTLGATSVASFQVSQKRGYSPLM

SEQ ID NO: 8022 - protein, 24 aa, artificial
  peptide fold or domain or sub-domain
IGDANVVLNRYLAGEIDQVMSIPA

SEQ ID NO: 8023 - protein, 25 aa, artificial
  peptide fold or domain or sub-domain
IGDDDLIHWIQGSVNGQRLFMLGKL

SEQ ID NO: 8024 - protein, 27 aa, artificial
  peptide fold or domain or sub-domain
IGDLRIIPESRWKAPQRVCTACAGTLN

SEQ ID NO: 8025 - protein, 28 aa, artificial
  peptide fold or domain or sub-domain
IGDNSDTDRDGDGVANNDDAFPDNANET

SEQ ID NO: 8026 - protein, 22 aa, artificial
  peptide fold or domain or sub-domain
IGDPGCQTCASCGPGPHGPPND

SEQ ID NO: 8027 - protein, 28 aa, artificial
  peptide fold or domain or sub-domain
IGDRDHIGYRDDGNDKGQEFSLELDQES

SEQ ID NO: 8028 - protein, 24 aa, artificial
  peptide fold or domain or sub-domain
IGDTSLEWQDVVEKEEKSAYRDWF

SEQ ID NO: 8029 - protein, 28 aa, artificial
  peptide fold or domain or sub-domain
IGDVCETDYDGDGVLDGNENCPKSNRYH

SEQ ID NO: 8030 - protein, 26 aa, artificial
  peptide fold or domain or sub-domain
IGEAGGIDPSTAQRWLDPATGFFDLL

SEQ ID NO: 8031 - protein, 23 aa, artificial
  peptide fold or domain or sub-domain
IGEDQLFYFQQRGIDPEEAVGVI

SEQ ID NO: 8032 - protein, 23 aa, artificial
  peptide fold or domain or sub-domain
IGEELFRSRLMKYDTQRLEHFYF

SEQ ID NO: 8033 - protein, 28 aa, artificial
  peptide fold or domain or sub-domain
IGEGRFSNPADVAHGRLIGANAIIVGTA

SEQ ID NO: 8034 - protein, 24 aa, artificial
  peptide fold or domain or sub-domain
IGEILEQGRKEGVFRQDISVGLAK

SEQ ID NO: 8035 - protein, 28 aa, artificial
  peptide fold or domain or sub-domain
IGEMEKDSIISHGAGDVAKDRLFEQSDI

SEQ ID NO: 8036 - protein, 22 aa, artificial
  peptide fold or domain or sub-domain
IGEMESDVFATNGSVYAIHELQ

SEQ ID NO: 8037 - protein, 26 aa, artificial
  peptide fold or domain or sub-domain
IGEMFSYDPNVSCSVRNYLDSITSYP

SEQ ID NO: 8038 - protein, 25 aa, artificial
  peptide fold or domain or sub-domain
IGEMIATNKLNITPESRAAELKNNF

SEQ ID NO: 8039 - protein, 26 aa, artificial
  peptide fold or domain or sub-domain
IGEQAVRQLLIVNPDATPQEQDAVRN

SEQ ID NO: 8040 - protein, 23 aa, artificial
  peptide fold or domain or sub-domain
IGEQLPQPVFTDIFGVPDVSQLD

SEQ ID NO: 8041 - protein, 27 aa, artificial
  peptide fold or domain or sub-domain
IGEQQMKELGMHSYLAVGQGSQNESLM

SEQ ID NO: 8042 - protein, 23 aa, artificial
  peptide fold or domain or sub-domain
IGESVNSDILQKLFNVRSAAELP

SEQ ID NO: 8043 - protein, 29 aa, artificial
  peptide fold or domain or sub-domain
IGETKTTIEDVEATEYGEFPEDEKLKCYF

SEQ ID NO: 8044 - protein, 26 aa, artificial
  peptide fold or domain or sub-domain
IGETWTKDINELKAYYGTGARELQMP

SEQ ID NO: 8045 - protein, 26 aa, artificial
  peptide fold or domain or sub-domain
IGEVLDGDPAYTCPYQNVMDGVLNYP

SEQ ID NO: 8046 - protein, 24 aa, artificial
  peptide fold or domain or sub-domain
IGFDVNEERSLLFKKSGGNIALSS

SEQ ID NO: 8047 - protein, 21 aa, artificial
  peptide fold or domain or sub-domain
IGFTTISMPLVRTPMIAPTNL

SEQ ID NO: 8048 - protein, 24 aa, artificial
  peptide fold or domain or sub-domain
IGGAPDIVLNRHNIPIEAAHKIRS

SEQ ID NO: 8049 - protein, 23 aa, artificial
  peptide fold or domain or sub-domain
IGGDGFKFVTEKGKHHKIPQVGG

SEQ ID NO: 8050 - protein, 20 aa, artificial
  peptide fold or domain or sub-domain
IGGKVGANLRENIDNVVLAR

SEQ ID NO: 8051 - protein, 28 aa, artificial
  peptide fold or domain or sub-domain
IGGQIIDIQSNGHLPELSQLQKMHEMKT

SEQ ID NO: 8052 - protein, 28 aa, artificial
  peptide fold or domain or sub-domain
IGGQVLDLEAEHTHADAATVEYIHRSKT

SEQ ID NO: 8053 - protein, 28 aa, artificial
  peptide fold or domain or sub-domain
IGGQVVDVERTGSVLSKEELLFIYELKT

SEQ ID NO: 8054 - protein, 21 aa, artificial
  peptide fold or domain or sub-domain
IGGREIANAYSELNDAEDQAE

SEQ ID NO: 8055 - protein, 22 aa, artificial
  peptide fold or domain or sub-domain
IGGYHWGEAVKRALLVREGASI

SEQ ID NO: 8056 - protein, 30 aa, artificial
  peptide fold or domain or sub-domain
IGHRGAAGLAPENTQISFEMASQSGIDGVE

SEQ ID NO: 8057 - protein, 30 aa, artificial
  peptide fold or domain or sub-domain
IGHRGATGYTDEHTIKGYQMALDKGADYIE

SEQ ID NO: 8058 - protein, 30 aa, artificial
  peptide fold or domain or sub-domain
IGHRGFEDKGVENSIPSLKAAAKANVEYVE

SEQ ID NO: 8059 - protein, 30 aa, artificial
  peptide fold or domain or sub-domain
IGHRGNPSKYPEETIQSDNSAFADGADYVE

SEQ ID NO: 8060 - protein, 24 aa, artificial
  peptide fold or domain or sub-domain
IGIAEKKASCIRKTGELMFYHADI

SEQ ID NO: 8061 - protein, 20 aa, artificial
  peptide fold or domain or sub-domain
IGIALDAPFDVIGGKLTLLA

SEQ ID NO: 8062 - protein, 24 aa, artificial
  peptide fold or domain or sub-domain
IGIGEENRKRWLRTGKCSFLPEER

SEQ ID NO: 8063 - protein, 27 aa, artificial
  peptide fold or domain or sub-domain
IGIGHIMNGTSVNSTDEDEIKAAADYI

SEQ ID NO: 8064 - protein, 23 aa, artificial
  peptide fold or domain or sub-domain
IGILYENGLGVKKDPGQAFIWYQ

SEQ ID NO: 8065 - protein, 28 aa, artificial
  peptide fold or domain or sub-domain
IGIRTKGMLEHYDFISRETLAYFDKRPV

SEQ ID NO: 8066 - protein, 27 aa, artificial
  peptide fold or domain or sub-domain
IGIVINSSNFLHKKKRFRYGGLFCEEI

SEQ ID NO: 8067 - protein, 24 aa, artificial
  peptide fold or domain or sub-domain
IGIWRGKPQRWLNTGQVQLLAGER

SEQ ID NO: 8068 - protein, 23 aa, artificial
  peptide fold or domain or sub-domain
IGIYLSTYYKKSVEELSSEIEKI

SEQ ID NO: 8069 - protein, 27 aa, artificial
  peptide fold or domain or sub-domain
IGKHKKCDHNVDCSDKSDELDCYPTEE

SEQ ID NO: 8070 - protein, 26 aa, artificial
  peptide fold or domain or sub-domain
IGKSADEMYEINEQDSELFENLFKQL

SEQ ID NO: 8071 - protein, 26 aa, artificial
  peptide fold or domain or sub-domain
IGKSVENLLDQHPADEAYIPKQITDL

SEQ ID NO: 8072 - protein, 24 aa, artificial
  peptide fold or domain or sub-domain
IGLDSHFVRELVAQKDYQKLYNND

SEQ ID NO: 8073 - protein, 25 aa, artificial
  peptide fold or domain or sub-domain
IGLEARDLPDPDRQTGGIMASDAER

SEQ ID NO: 8074 - protein, 25 aa, artificial
  peptide fold or domain or sub-domain
IGLFIAPSDLHLKYKHKKPRDVVVA

SEQ ID NO: 8075 - protein, 24 aa, artificial
  peptide fold or domain or sub-domain
IGLHAIRENIRKLGLYNKKSSNIL

SEQ ID NO: 8076 - protein, 25 aa, artificial
  peptide fold or domain or sub-domain
IGLHAIRENIRKLGLYNKKSSNILR

SEQ ID NO: 8077 - protein, 27 aa, artificial
  peptide fold or domain or sub-domain
IGLLREAFVRAGVPERRAHALALLVES

SEQ ID NO: 8078 - protein, 24 aa, artificial
  peptide fold or domain or sub-domain
IGLNSETARALVKKRDFETLYEND

SEQ ID NO: 8079 - protein, 22 aa, artificial
  peptide fold or domain or sub-domain
IGLSEHLRNLMVCKDKATIALL

SEQ ID NO: 8080 - protein, 26 aa, artificial
  peptide fold or domain or sub-domain
IGMSAGELHKLREESESEFSAALHRA

SEQ ID NO: 8081 - protein, 28 aa, artificial
  peptide fold or domain or sub-domain
IGNNADPDDDNDGINDEDDAAPLDPSIG

SEQ ID NO: 8082 - protein, 24 aa, artificial
  peptide fold or domain or sub-domain
IGNQSPLWLDVVKNGDKSPYADWF

SEQ ID NO: 8083 - protein, 28 aa, artificial
  peptide fold or domain or sub-domain
IGNVIEGNESISKLHVATQPLLKKINEL

SEQ ID NO: 8084 - protein, 29 aa, artificial
  peptide fold or domain or sub-domain
IGPADLAKFMTDWQGDRNATEERATSLMA

SEQ ID NO: 8085 - protein, 21 aa, artificial
  peptide fold or domain or sub-domain
IGPEEIAELAPITNVDGILGG

SEQ ID NO: 8086 - protein, 29 aa, artificial
  peptide fold or domain or sub-domain
IGPLAHGAEFESLSEADIDVLLSRAIERY

SEQ ID NO: 8087 - protein, 24 aa, artificial
  peptide fold or domain or sub-domain
IGQAKKRFAHEGLAVNALRENIEN

SEQ ID NO: 8088 - protein, 23 aa, artificial
  peptide fold or domain or sub-domain
IGQLVRERVSDGDIGHDELVSIA

SEQ ID NO: 8089 - protein, 25 aa, artificial
  peptide fold or domain or sub-domain
IGQVPARHGGFRFMSDRELAPQRRE

SEQ ID NO: 8090 - protein, 29 aa, artificial
  peptide fold or domain or sub-domain
IGRDPASWPAPDEFNPDRFVGSDVDYYGS

SEQ ID NO: 8091 - protein, 29 aa, artificial
  peptide fold or domain or sub-domain
IGRDSSVWEESETFLPERFLETSIDYRGM

SEQ ID NO: 8092 - protein, 26 aa, artificial
  peptide fold or domain or sub-domain
IGREGDPHLPANIWPREVPQFRRVMV

SEQ ID NO: 8093 - protein, 29 aa, artificial
  peptide fold or domain or sub-domain
IGREGEYWGDGEIFRPERFENSTVDFRGA

SEQ ID NO: 8094 - protein, 25 aa, artificial
  peptide fold or domain or sub-domain
IGRERKPDGTVRMQSHHEIDLMRPK

SEQ ID NO: 8095 - protein, 23 aa, artificial
  peptide fold or domain or sub-domain
IGRLIARNRQTPVMTHDEIVGTA

SEQ ID NO: 8096 - protein, 27 aa, artificial
  peptide fold or domain or sub-domain
IGRLTNFDMLHFETKKPVFGGLLCERI

SEQ ID NO: 8097 - protein, 26 aa, artificial
  peptide fold or domain or sub-domain
IGRPVLNLVASVHGARDIVPPEIKAI

SEQ ID NO: 8098 - protein, 23 aa, artificial
  peptide fold or domain or sub-domain
IGRQLPLETLRALFGTENVDEII

SEQ ID NO: 8099 - protein, 27 aa, artificial
  peptide fold or domain or sub-domain
IGSGFKEKLLEIIDIDNIPDFLGGNSK

SEQ ID NO: 8100 - protein, 27 aa, artificial
  peptide fold or domain or sub-domain
IGSGRGFTITETDNLVPCFGSGAEVEG

SEQ ID NO: 8101 - protein, 23 aa, artificial
  peptide fold or domain or sub-domain
IGSLVTARDEEDKLTEGELVRLA

SEQ ID NO: 8102 - protein, 26 aa, artificial
  peptide fold or domain or sub-domain
IGSPVVLDDEHGPVAFYGIPYLEPEI

SEQ ID NO: 8103 - protein, 28 aa, artificial
  peptide fold or domain or sub-domain
IGSYFEWLQNRNGELWQLDEVMIKLEKK

SEQ ID NO: 8104 - protein, 26 aa, artificial
  peptide fold or domain or sub-domain
IGTASSTDKIELAKAHGFDHVINYRE

SEQ ID NO: 8105 - protein, 27 aa, artificial
  peptide fold or domain or sub-domain
IGTATSESGAQAISDYLGDNGKGMALN

SEQ ID NO: 8106 - protein, 23 aa, artificial
  peptide fold or domain or sub-domain
IGTDELTYLRSRGLSEDEASSMI

SEQ ID NO: 8107 - protein, 25 aa, artificial
  peptide fold or domain or sub-domain
IGTFVKSIATLPRELKRHLFLIEEK

SEQ ID NO: 8108 - protein, 26 aa, artificial
  peptide fold or domain or sub-domain
IGTVGSEAKKEIALDAGADYVIGHQD

SEQ ID NO: 8109 - protein, 26 aa, artificial
  peptide fold or domain or sub-domain
IGTVSSPEKARLARQHGAWETIDYSH

SEQ ID NO: 8110 - protein, 26 aa, artificial
  peptide fold or domain or sub-domain
IGTVSTNEKAAQAKEDGCHHVIMYKN

SEQ ID NO: 8111 - protein, 30 aa, artificial
  peptide fold or domain or sub-domain
IGVELDLPKGSHNGQFNGKQYFQGRDQHCM

SEQ ID NO: 8112 - protein, 25 aa, artificial
  peptide fold or domain or sub-domain
IGVERNGTVKINGESMLTGAAGVFA

SEQ ID NO: 8113 - protein, 29 aa, artificial
  peptide fold or domain or sub-domain
IGVPTSEVTRADAERCGIRLTSLDEIDRL

SEQ ID NO: 8114 - protein, 27 aa, artificial
  peptide fold or domain or sub-domain
IGVTNPLASAPGSIRGDFGVDVGRNII

SEQ ID NO: 8115 - protein, 26 aa, artificial
  peptide fold or domain or sub-domain
IGVTSKKEKARYVLEAGADEVIISTQ

SEQ ID NO: 8116 - protein, 30 aa, artificial
  peptide fold or domain or sub-domain
IGYDPFITTEISSQYNIHIVKNLRDLLAQA

SEQ ID NO: 8117 - protein, 30 aa, artificial
  peptide fold or domain or sub-domain
IGYDPYIPKEVAESMGVELVDDINELCKRA

SEQ ID NO: 8118 - protein, 20 aa, artificial
  peptide fold or domain or sub-domain
IGYKALIASSGFSISHSTIK

SEQ ID NO: 8119 - protein, 22 aa, artificial
  peptide fold or domain or sub-domain
IGYVQYLSKPTTRILYGAPVFI

SEQ ID NO: 8120 - protein, 21 aa, artificial
  peptide fold or domain or sub-domain
IHAFHVAHGLPYTVLRYFNVC

SEQ ID NO: 8121 - protein, 25 aa, artificial
  peptide fold or domain or sub-domain
IHAKVISKPALKLMNEYGQSFSYDE

SEQ ID NO: 8122 - protein, 22 aa, artificial
  peptide fold or domain or sub-domain
IHALRQGLGSRFTPELEAAWTA

SEQ ID NO: 8123 - protein, 21 aa, artificial
  peptide fold or domain or sub-domain
IHATLTTSQPVIREEEENTIF

SEQ ID NO: 8124 - protein, 30 aa, artificial
  peptide fold or domain or sub-domain
IHDEQMLSMLYYLAQHEGLLVGTSAALNIF

SEQ ID NO: 8125 - protein, 29 aa, artificial
  peptide fold or domain or sub-domain
IHDTNITFMSKSSIQQGVPAKLGLKRRIG

SEQ ID NO: 8126 - protein, 28 aa, artificial
  peptide fold or domain or sub-domain
IHEVSINSDDAALRDEGTIRVTDMAFDE

SEQ ID NO: 8127 - protein, 21 aa, artificial
  peptide fold or domain or sub-domain
IHFFDNDENYGKGIEWYRKKM

SEQ ID NO: 8128 - protein, 27 aa, artificial
  peptide fold or domain or sub-domain
IHGSRQCNGIRDCVDGSDEVNCKNVNQ

SEQ ID NO: 8129 - protein, 24 aa, artificial
  peptide fold or domain or sub-domain
IHGWKRKGWKTSTGSEVLNQDVLM

SEQ ID NO: 8130 - protein, 24 aa, artificial
  peptide fold or domain or sub-domain
IHHAAQIVGMEDPATHSIRQKINS

SEQ ID NO: 8131 - protein, 29 aa, artificial
  peptide fold or domain or sub-domain
IHHDPDLWKNPDEFNPDRFLSPDTKQVVQ

SEQ ID NO: 8132 - protein, 28 aa, artificial
  peptide fold or domain or sub-domain
IHHTDIEQDEYTHIEIHPALLTGICVSQ

SEQ ID NO: 8133 - protein, 24 aa, artificial
  peptide fold or domain or sub-domain
IHHTEESVSMEAKPSQVLRQGRKS

SEQ ID NO: 8134 - protein, 25 aa, artificial
  peptide fold or domain or sub-domain
IHIAVPASDIHIFQKLRKDRKWVIQ

SEQ ID NO: 8135 - protein, 30 aa, artificial
  peptide fold or domain or sub-domain
IHICGKNKLDPEFNGMKGYKQFEYLEDKFP

SEQ ID NO: 8136 - protein, 29 aa, artificial
  peptide fold or domain or sub-domain
IHILFSALATKDVDEMIQDLKQVPNAHLY

SEQ ID NO: 8137 - protein, 30 aa, artificial
  peptide fold or domain or sub-domain
IHITGSIQEADELKIFYANYQVKASVKAFE

SEQ ID NO: 8138 - protein, 25 aa, artificial
  peptide fold or domain or sub-domain
IHIVLGSSNVHITKKFNKNPEDILQ

SEQ ID NO: 8139 - protein, 20 aa, artificial
  peptide fold or domain or sub-domain
IHKPWSQREKARIQHYQGTI

SEQ ID NO: 8140 - protein, 23 aa, artificial
  peptide fold or domain or sub-domain
IHLMHKDHVNSFKEYTEFMDLEE

SEQ ID NO: 8141 - protein, 26 aa, artificial
  peptide fold or domain or sub-domain
IHNAVLVVQNFFGVDYPAALGVVQDL

SEQ ID NO: 8142 - protein, 28 aa, artificial
  peptide fold or domain or sub-domain
IHNQSEEFRKVILANMSKSRAALVLDEE

SEQ ID NO: 8143 - protein, 24 aa, artificial
  peptide fold or domain or sub-domain
IHNWKKRGWKTADKKPVKNVDLWQ

SEQ ID NO: 8144 - protein, 23 aa, artificial
  peptide fold or domain or sub-domain
IHPCGKCKNCITGKENLCEVFAK

SEQ ID NO: 8145 - protein, 24 aa, artificial
  peptide fold or domain or sub-domain
IHPVSNVIEMDDEPVISVREKKKS

SEQ ID NO: 8146 - protein, 28 aa, artificial
  peptide fold or domain or sub-domain
IHQGDFRVDDTELYHAGIERIYDIFITD

SEQ ID NO: 8147 - protein, 25 aa, artificial
  peptide fold or domain or sub-domain
IHQITDESIDLNVAKDMLQEAVIEN

SEQ ID NO: 8148 - protein, 27 aa, artificial
  peptide fold or domain or sub-domain
IHQNQNESFYLDKSQTFQSLEKLVDYY

SEQ ID NO: 8149 - protein, 30 aa, artificial
  peptide fold or domain or sub-domain
IHQRDAENTMRELAVREGIFCGVSSGGAVA

SEQ ID NO: 8150 - protein, 28 aa, artificial
  peptide fold or domain or sub-domain
IHRDGTMISRFERMDLSLSNYLKIYPVI

SEQ ID NO: 8151 - protein, 29 aa, artificial
  peptide fold or domain or sub-domain
IHRDPEIWEEPEKFNPDRYNDGCGSDYYV

SEQ ID NO: 8152 - protein, 20 aa, artificial
  peptide fold or domain or sub-domain
IHRLSDINERTRIEKAGGKV

SEQ ID NO: 8153 - protein, 29 aa, artificial
  peptide fold or domain or sub-domain
IHRNPNVWKDPEAFIPERFMDNQIDYKGL

SEQ ID NO: 8154 - protein, 21 aa, artificial
  peptide fold or domain or sub-domain
IHRPGYKPLEDCTVEETRAMV

SEQ ID NO: 8155 - protein, 24 aa, artificial
  peptide fold or domain or sub-domain
IHRWQAQNWMRSETEPVKNADLWA

SEQ ID NO: 8156 - protein, 22 aa, artificial
  peptide fold or domain or sub-domain
IHSFAKLAETYGKEGAQNLASL

SEQ ID NO: 8157 - protein, 25 aa, artificial
  peptide fold or domain or sub-domain
IHTDNYGKVVSNQETLETNIPGVYV

SEQ ID NO: 8158 - protein, 25 aa, artificial
  peptide fold or domain or sub-domain
IHTFIATSPMHIATKLRSTLDEVIE

SEQ ID NO: 8159 - protein, 25 aa, artificial
  peptide fold or domain or sub-domain
IHTFISTSDIHLEHQLRKSRAEVLA

SEQ ID NO: 8160 - protein, 21 aa, artificial
  peptide fold or domain or sub-domain
IHTLINEGLANNIKGAKKIIQ

SEQ ID NO: 8161 - protein, 25 aa, artificial
  peptide fold or domain or sub-domain
IHTYLATSDMFREIVFNMSREEAIS

SEQ ID NO: 8162 - protein, 23 aa, artificial
  peptide fold or domain or sub-domain
IHVAKYAEIFGLTSAEASKDIRQ

SEQ ID NO: 8163 - protein, 25 aa, artificial
  peptide fold or domain or sub-domain
IHVFIGSSSLHIEEKLRMHPLDVVD

SEQ ID NO: 8164 - protein, 29 aa, artificial
  peptide fold or domain or sub-domain
IHVLYKDNDNWWFGSLANGQQGYFPANYV

SEQ ID NO: 8165 - protein, 29 aa, artificial
  peptide fold or domain or sub-domain
IHWVAGFKADKDMEAVVSSLLPFVVQAYC

SEQ ID NO: 8166 - protein, 28 aa, artificial
  peptide fold or domain or sub-domain
IHYNNSEKAALSLAQEIEQMGKKSLVVR

SEQ ID NO: 8167 - protein, 28 aa, artificial
  peptide fold or domain or sub-domain
IIAARNESESKETQDQLKDMGSKAFEIP

SEQ ID NO: 8168 - protein, 21 aa, artificial
  peptide fold or domain or sub-domain
IIAEHGSEAILPYSYSGNYGA

SEQ ID NO: 8169 - protein, 23 aa, artificial
  peptide fold or domain or sub-domain
IIAGGSQNDGLELTIEELKDELQ

SEQ ID NO: 8170 - protein, 29 aa, artificial
  peptide fold or domain or sub-domain
IIAISDPSLETAKTFATGNNLSPETVTIY

SEQ ID NO: 8171 - protein, 22 aa, artificial
  peptide fold or domain or sub-domain
IIASLTNQATDPKLKGRYETCS

SEQ ID NO: 8172 - protein, 30 aa, artificial
  peptide fold or domain or sub-domain
IIAYGARVDEIQYFKQWAKDTGNTLEYHTE

SEQ ID NO: 8173 - protein, 29 aa, artificial
  peptide fold or domain or sub-domain
IIDAMKEEKGVHFDTDLTADDLKELAEKF

SEQ ID NO: 8174 - protein, 20 aa, artificial
  peptide fold or domain or sub-domain
IIDTEVNRKGMPDIDHNEWV

SEQ ID NO: 8175 - protein, 24 aa, artificial
  peptide fold or domain or sub-domain
IIDYKTCRQKKFWGDRVRDSMICA

SEQ ID NO: 8176 - protein, 26 aa, artificial
  peptide fold or domain or sub-domain
IIEDPASDPATYADRARRLVIRDRCI

SEQ ID NO: 8177 - protein, 21 aa, artificial
  peptide fold or domain or sub-domain
IIEITETGVKTATGDYALDTI

SEQ ID NO: 8178 - protein, 26 aa, artificial
  peptide fold or domain or sub-domain
IIEKCIRLLFQTKDLSKIKKYLQNEF

SEQ ID NO: 8179 - protein, 20 aa, artificial
  peptide fold or domain or sub-domain
IIENTQLIEELIMENKVDIA

SEQ ID NO: 8180 - protein, 28 aa, artificial
  peptide fold or domain or sub-domain
IIEQAVKFKRHSKRDVLTTDDIARALRV

SEQ ID NO: 8181 - protein, 21 aa, artificial
  peptide fold or domain or sub-domain
IIERHGAHSILWGERTNLNTH

SEQ ID NO: 8182 - protein, 29 aa, artificial
  peptide fold or domain or sub-domain
IIESDRGTHFTGKIMTTVCDMLGVQQRFH

SEQ ID NO: 8183 - protein, 28 aa, artificial
  peptide fold or domain or sub-domain
IIESGLSRPEEVERACSLYARGVLIGTA

SEQ ID NO: 8184 - protein, 20 aa, artificial
  peptide fold or domain or sub-domain
IIETPMMQRFTGGTEEGRET

SEQ ID NO: 8185 - protein, 21 aa, artificial
  peptide fold or domain or sub-domain
IIEYGENFIVHREGPEATPYL

SEQ ID NO: 8186 - protein, 30 aa, artificial
  peptide fold or domain or sub-domain
IIFNDFLIGLRPKDKLNVICKSWNEEMKLK

SEQ ID NO: 8187 - protein, 27 aa, artificial
  peptide fold or domain or sub-domain
IIGLHEGSRSREKAKADGFEVYTPREA

SEQ ID NO: 8188 - protein, 26 aa, artificial
  peptide fold or domain or sub-domain
IIGSSSVDHAKQLWPHDYESFTDVID

SEQ ID NO: 8189 - protein, 29 aa, artificial
  peptide fold or domain or sub-domain
IIHFPQSRLDQMDEWCTKTHAESGLTAAV

SEQ ID NO: 8190 - protein, 23 aa, artificial
  peptide fold or domain or sub-domain
IIHPASTTHEQLSREEQEKAGVT

SEQ ID NO: 8191 - protein, 26 aa, artificial
  peptide fold or domain or sub-domain
IIHSGRDLSREDEQRLRNYAESIIIK

SEQ ID NO: 8192 - protein, 24 aa, artificial
  peptide fold or domain or sub-domain
IIHTDEKIASDDEPVKAIRRKKTA

SEQ ID NO: 8193 - protein, 24 aa, artificial
  peptide fold or domain or sub-domain
IIHTKDLVKGTDSPLEGAKRGKNT

SEQ ID NO: 8194 - protein, 26 aa, artificial
  peptide fold or domain or sub-domain
IIIDEGGRIKTGKYAGVSIREARAKI

SEQ ID NO: 8195 - protein, 25 aa, artificial
  peptide fold or domain or sub-domain
IIIPRDLQGHARKVMGLEDDEDAVI

SEQ ID NO: 8196 - protein, 25 aa, artificial
  peptide fold or domain or sub-domain
IIIPSVLGEEVKTIKAWETQIETLR

SEQ ID NO: 8197 - protein, 26 aa, artificial
  peptide fold or domain or sub-domain
IIITGFSTVDTAVEAMKNGAFDYIAK

SEQ ID NO: 8198 - protein, 28 aa, artificial
  peptide fold or domain or sub-domain
IIIVGYLKEQFDYLKEKYGVRLVFNDKY

SEQ ID NO: 8199 - protein, 21 aa, artificial
  peptide fold or domain or sub-domain
IIKKHGPESIVMSCRGGPFVD

SEQ ID NO: 8200 - protein, 25 aa, artificial
  peptide fold or domain or sub-domain
IIKNALIADKNLISEKEFNIINHAI

SEQ ID NO: 8201 - protein, 25 aa, artificial
  peptide fold or domain or sub-domain
IIKRMRARCEAFLPDLKKARVDPEY

SEQ ID NO: 8202 - protein, 22 aa, artificial
  peptide fold or domain or sub-domain
IILENLKKHSHERDIAYYIKRE

SEQ ID NO: 8203 - protein, 26 aa, artificial
  peptide fold or domain or sub-domain
IILGINKRGVHFFRPVPKEYLHSAEL

SEQ ID NO: 8204 - protein, 26 aa, artificial
  peptide fold or domain or sub-domain
IIMLLQEVDHFKKILYADGITYGELF

SEQ ID NO: 8205 - protein, 24 aa, artificial
  peptide fold or domain or sub-domain
IINELIQQFVSEGKIEPIYHYYSR

SEQ ID NO: 8206 - protein, 29 aa, artificial
  peptide fold or domain or sub-domain
IINLEQFKGFQKDLDFLQALLTEENVWIL

SEQ ID NO: 8207 - protein, 24 aa, artificial
  peptide fold or domain or sub-domain
IINQAFKFHSQGNIKEAAKNYQYF

SEQ ID NO: 8208 - protein, 21 aa, artificial
  peptide fold or domain or sub-domain
IINSEKSIEINPNNSQGNFNL

SEQ ID NO: 8209 - protein, 29 aa, artificial
  peptide fold or domain or sub-domain
IINTEEFSEINSSIDFAKKLQQEQNVLVF

SEQ ID NO: 8210 - protein, 30 aa, artificial
  peptide fold or domain or sub-domain
IIPNELRASSIPYLAYLLEIPVDELNEKVA

SEQ ID NO: 8211 - protein, 23 aa, artificial
  peptide fold or domain or sub-domain
IIPPHLGYGEAGVDGEVPGSAVL

SEQ ID NO: 8212 - protein, 25 aa, artificial
  peptide fold or domain or sub-domain
IIPQDADAARPEVWQDDALARSESR

SEQ ID NO: 8213 - protein, 23 aa, artificial
  peptide fold or domain or sub-domain
IIPSAMGYGKKGIKGVIPGGSAL

SEQ ID NO: 8214 - protein, 24 aa, artificial
  peptide fold or domain or sub-domain
IIPSLDDIPMDLAPALALRNFKQS

SEQ ID NO: 8215 - protein, 23 aa, artificial
  peptide fold or domain or sub-domain
IIPSSLGYGATGSGRRIPPYTVL

SEQ ID NO: 8216 - protein, 20 aa, artificial
  peptide fold or domain or sub-domain
IIQAFNENILAEAFDVSVDI

SEQ ID NO: 8217 - protein, 24 aa, artificial
  peptide fold or domain or sub-domain
IIQALQKQIKAAGGKDMAAYEASQ

SEQ ID NO: 8218 - protein, 22 aa, artificial
  peptide fold or domain or sub-domain
IIQEIGGTRLKAEFEIGLVTNM

SEQ ID NO: 8219 - protein, 29 aa, artificial
  peptide fold or domain or sub-domain
IIQELVLYKGYATLADISRSLNVKRQSVR

SEQ ID NO: 8220 - protein, 25 aa, artificial
  peptide fold or domain or sub-domain
IIQESCKQTRLHQAKRVTVSHLKHA

SEQ ID NO: 8221 - protein, 23 aa, artificial
  peptide fold or domain or sub-domain
IIQIPGKRAMGVSEIINGKHPFA

SEQ ID NO: 8222 - protein, 23 aa, artificial
  peptide fold or domain or sub-domain
IIQPKYAFKSEGNSELGVPPNSV

SEQ ID NO: 8223 - protein, 20 aa, artificial
  peptide fold or domain or sub-domain
IIRAFDQQMISEALNIPQDI

SEQ ID NO: 8224 - protein, 28 aa, artificial
  peptide fold or domain or sub-domain
IIRAVWTLDTCAPIVGADVLSFKDEREL

SEQ ID NO: 8225 - protein, 25 aa, artificial
  peptide fold or domain or sub-domain
IIRCIWERAAEFFPKLRDISLEDFI

SEQ ID NO: 8226 - protein, 25 aa, artificial
  peptide fold or domain or sub-domain
IIRTMLVEKGNSQVNKLHQKASSLV

SEQ ID NO: 8227 - protein, 20 aa, artificial
  peptide fold or domain or sub-domain
IISANRNQDVYEQSGCRIIG

SEQ ID NO: 8228 - protein, 20 aa, artificial
  peptide fold or domain or sub-domain
IISCNRNAERYRAYADRLVE

SEQ ID NO: 8229 - protein, 28 aa, artificial
  peptide fold or domain or sub-domain
IISCRDEEKAKAAIEKVSAEGVKADYVI

SEQ ID NO: 8230 - protein, 23 aa, artificial
  peptide fold or domain or sub-domain
IISEKMKSKSTRELAEFIGMECN

SEQ ID NO: 8231 - protein, 27 aa, artificial
  peptide fold or domain or sub-domain
IISGSNEEKLKSLGNALKDNYTIEVCN

SEQ ID NO: 8232 - protein, 24 aa, artificial
  peptide fold or domain or sub-domain
IISHDICNGLYSEYGIVEEAELCA

SEQ ID NO: 8233 - protein, 27 aa, artificial
  peptide fold or domain or sub-domain
IISKTNMLQFVQKIDANSSLDDQGCDM

SEQ ID NO: 8234 - protein, 22 aa, artificial
  peptide fold or domain or sub-domain
IISMAQTLQEDFTPELQAAFEK

SEQ ID NO: 8235 - protein, 20 aa, artificial
  peptide fold or domain or sub-domain
IISRPEFIDRFQENGENEVY

SEQ ID NO: 8236 - protein, 25 aa, artificial
  peptide fold or domain or sub-domain
IISSAKIAGLSLKHFSKASDIEKEF

SEQ ID NO: 8237 - protein, 24 aa, artificial
  peptide fold or domain or sub-domain
IISSEQCNRATWYGGEINDNMICA

SEQ ID NO: 8238 - protein, 24 aa, artificial
  peptide fold or domain or sub-domain
IISSVACSRFVKEFGIDEGYVFDK

SEQ ID NO: 8239 - protein, 20 aa, artificial
  peptide fold or domain or sub-domain
IISTNSQLASQFEYEYVIID

SEQ ID NO: 8240 - protein, 23 aa, artificial
  peptide fold or domain or sub-domain
IISYKLLFGELGCPPRIKPKADA

SEQ ID NO: 8241 - protein, 27 aa, artificial
  peptide fold or domain or sub-domain
IITSFIISEKHRGQSVNSINRAIVSIR

SEQ ID NO: 8242 - protein, 22 aa, artificial
  peptide fold or domain or sub-domain
IITYTNRSPRPGEKDQEDYYFV

SEQ ID NO: 8243 - protein, 30 aa, artificial
  peptide fold or domain or sub-domain
IIVISPDGIEKEYPSTKCACEELGLTRGKV

SEQ ID NO: 8244 - protein, 25 aa, artificial
  peptide fold or domain or sub-domain
IIVRFTQRAPQAPFELIQKLAHRFE

SEQ ID NO: 8245 - protein, 26 aa, artificial
  peptide fold or domain or sub-domain
IIVSAADDMENVVKGIQMGAEDYLAK

SEQ ID NO: 8246 - protein, 22 aa, artificial
  peptide fold or domain or sub-domain
IIVTNRYDNELQDVKNKVYSRD

SEQ ID NO: 8247 - protein, 30 aa, artificial
  peptide fold or domain or sub-domain
IIVWRIEKMELALVPVSAHGNFYEGDCYVI

SEQ ID NO: 8248 - protein, 26 aa, artificial
  peptide fold or domain or sub-domain
IIWHKDGQALSRVENDSQVGRVLRVR

SEQ ID NO: 8249 - protein, 30 aa, artificial
  peptide fold or domain or sub-domain
IIYAVEYSAKPFEKLLELVRERNNIIPLLF

SEQ ID NO: 8250 - protein, 27 aa, artificial
  peptide fold or domain or sub-domain
IIYCKKKIELEFEKTRYKKVIKIISEL

SEQ ID NO: 8251 - protein, 29 aa, artificial
  peptide fold or domain or sub-domain
IIYELSERDEKISNKQIAEKMSVSAPAVS

SEQ ID NO: 8252 - protein, 29 aa, artificial
  peptide fold or domain or sub-domain
IIYEPMLNKLESEDQSVLVNDLENFKKQA

SEQ ID NO: 8253 - protein, 29 aa, artificial
  peptide fold or domain or sub-domain
IIYHIVAEKQVARAKEIATRLKVSRSSVT

SEQ ID NO: 8254 - protein, 28 aa, artificial
  peptide fold or domain or sub-domain
IKAFVMSCLQHEAETVRDAAIVTLSKVL

SEQ ID NO: 8255 - protein, 27 aa, artificial
  peptide fold or domain or sub-domain
IKAGKNILTDVNMSAVGISQKLMGHWG

SEQ ID NO: 8256 - protein, 21 aa, artificial
  peptide fold or domain or sub-domain
IKAQHGPESVAFSSKSGSLSS

SEQ ID NO: 8257 - protein, 21 aa, artificial
  peptide fold or domain or sub-domain
IKARAISSNRPEKSIVNSAIR

SEQ ID NO: 8258 - protein, 23 aa, artificial
  peptide fold or domain or sub-domain
IKARRSKAKEAGLSEDLIEDVIR

SEQ ID NO: 8259 - protein, 21 aa, artificial
  peptide fold or domain or sub-domain
IKARSEDVTADPDAVFDSVRA

SEQ ID NO: 8260 - protein, 21 aa, artificial
  peptide fold or domain or sub-domain
IKARSIDSVRDPAGVIREETA

SEQ ID NO: 8261 - protein, 21 aa, artificial
  peptide fold or domain or sub-domain
IKARSIDTAASPKEIFKEEVK

SEQ ID NO: 8262 - protein, 27 aa, artificial
  peptide fold or domain or sub-domain
IKAVGVSNERDMERALNYREFPILLDT

SEQ ID NO: 8263 - protein, 28 aa, artificial
  peptide fold or domain or sub-domain
IKAWETDPHVQALLKREGLQTVKEAERY

SEQ ID NO: 8264 - protein, 24 aa, artificial
  peptide fold or domain or sub-domain
IKAYFKSFDNMDMSEIKQSPKLRA

SEQ ID NO: 8265 - protein, 29 aa, artificial
  peptide fold or domain or sub-domain
IKAYLKAHLPKRLHFANSRRIEDVGVLVD

SEQ ID NO: 8266 - protein, 26 aa, artificial
  peptide fold or domain or sub-domain
IKDCYKIIEETYKNVRLPLADISLLE

SEQ ID NO: 8267 - protein, 28 aa, artificial
  peptide fold or domain or sub-domain
IKDFQSIMGLTVDGIWGTNTSGAAQQIF

SEQ ID NO: 8268 - protein, 30 aa, artificial
  peptide fold or domain or sub-domain
IKDIKETISIAEKEKDFVSVMLLEEMLKNE

SEQ ID NO: 8269 - protein, 28 aa, artificial
  peptide fold or domain or sub-domain
IKDKADEVRDKMLSNVSKRRKEIILDEE

SEQ ID NO: 8270 - protein, 21 aa, artificial
  peptide fold or domain or sub-domain
IKDNHIEYIGSIKKIINMTRL

SEQ ID NO: 8271 - protein, 21 aa, artificial
  peptide fold or domain or sub-domain
IKDNHISIIGNVKDAIKQAKE

SEQ ID NO: 8272 - protein, 21 aa, artificial
  peptide fold or domain or sub-domain
IKDNHLAMYSSSREPVEKIKA

SEQ ID NO: 8273 - protein, 21 aa, artificial
  peptide fold or domain or sub-domain
IKDNHLKMYGSAERAVQEVRK

SEQ ID NO: 8274 - protein, 21 aa, artificial
  peptide fold or domain or sub-domain
IKDNHVAAAGSVVDALRAVRN

SEQ ID NO: 8275 - protein, 30 aa, artificial
  peptide fold or domain or sub-domain
IKDQDAFRNVKSLAINEGLLVGSSSGAALQ

SEQ ID NO: 8276 - protein, 25 aa, artificial
  peptide fold or domain or sub-domain
IKDSDFIAIAAGKMKPDQAFMQGKM

SEQ ID NO: 8277 - protein, 24 aa, artificial
  peptide fold or domain or sub-domain
IKDSEFETIRTYAGQKFLMSSKLM

SEQ ID NO: 8278 - protein, 27 aa, artificial
  peptide fold or domain or sub-domain
IKDSLRKVVTEGTGKAAQEANLPISGK

SEQ ID NO: 8279 - protein, 21 aa, artificial
  peptide fold or domain or sub-domain
IKDTHLKTIKDLKSYIQKARQ

SEQ ID NO: 8280 - protein, 21 aa, artificial
  peptide fold or domain or sub-domain
IKDYALANPKFKTAILRYFNV

SEQ ID NO: 8281 - protein, 23 aa, artificial
  peptide fold or domain or sub-domain
IKEAAGGDIPLDHPEQFLLDISL

SEQ ID NO: 8282 - protein, 28 aa, artificial
  peptide fold or domain or sub-domain
IKEAHNGAGWHQWDKDIAWREPEALKIW

SEQ ID NO: 8283 - protein, 27 aa, artificial
  peptide fold or domain or sub-domain
IKEAMQGVVQQGTGTLAQVPGVTVAGK

SEQ ID NO: 8284 - protein, 28 aa, artificial
  peptide fold or domain or sub-domain
IKEFQASEDLLVDGIAGLQTLGALHALE

SEQ ID NO: 8285 - protein, 24 aa, artificial
  peptide fold or domain or sub-domain
IKEILYQGIQNCELRSNLDIDALA

SEQ ID NO: 8286 - protein, 21 aa, artificial
  peptide fold or domain or sub-domain
IKEKFGGEALTEFVYSGNEGH

SEQ ID NO: 8287 - protein, 26 aa, artificial
  peptide fold or domain or sub-domain
IKELDRIIACKRKNPTSCSRRFYQLT

SEQ ID NO: 8288 - protein, 26 aa, artificial
  peptide fold or domain or sub-domain
IKELRKMVTKCPNNSGQSWQRFYQLT

SEQ ID NO: 8289 - protein, 26 aa, artificial
  peptide fold or domain or sub-domain
IKELRRSVGKAPTTLDRRGNRSSQLT

SEQ ID NO: 8290 - protein, 21 aa, artificial
  peptide fold or domain or sub-domain
IKENHIAACGGIDRAIAEARR

SEQ ID NO: 8291 - protein, 21 aa, artificial
  peptide fold or domain or sub-domain
IKENHIIASGSVRQAVEKASW

SEQ ID NO: 8292 - protein, 25 aa, artificial
  peptide fold or domain or sub-domain
IKESLTDNVPSVFPTSRNKEMLNNF

SEQ ID NO: 8293 - protein, 20 aa, artificial
  peptide fold or domain or sub-domain
IKEVKAELSSLRGVGQVMAE

SEQ ID NO: 8294 - protein, 23 aa, artificial
  peptide fold or domain or sub-domain
IKEYQGDQMQLGAAEQYMLTVMD

SEQ ID NO: 8295 - protein, 25 aa, artificial
  peptide fold or domain or sub-domain
IKFPDMLAMGVGKLPGAKAFLTGKL

SEQ ID NO: 8296 - protein, 29 aa, artificial
  peptide fold or domain or sub-domain
IKFWKSTEVPERLHYGTNPRVHDFVIEAE

SEQ ID NO: 8297 - protein, 20 aa, artificial
  peptide fold or domain or sub-domain
IKGALQQNLLNHKESALLCK

SEQ ID NO: 8298 - protein, 25 aa, artificial
  peptide fold or domain or sub-domain
IKGCVVDGPLALDIALSEEAAHHKG

SEQ ID NO: 8299 - protein, 21 aa, artificial
  peptide fold or domain or sub-domain
IKGFRYGPQVIPISPDQIETL

SEQ ID NO: 8300 - protein, 23 aa, artificial
  peptide fold or domain or sub-domain
IKGSEIHESKLDKPERWILEIYG

SEQ ID NO: 8301 - protein, 21 aa, artificial
  peptide fold or domain or sub-domain
IKGSRKRRIAAGSGMQVQDVN

SEQ ID NO: 8302 - protein, 21 aa, artificial
  peptide fold or domain or sub-domain
IKGYLYGRSLIPVDSIMEDKM

SEQ ID NO: 8303 - protein, 23 aa, artificial
  peptide fold or domain or sub-domain
IKHAHFKDRLYVRYSGLRSEAIA

SEQ ID NO: 8304 - protein, 25 aa, artificial
  peptide fold or domain or sub-domain
IKHAKKNRGVSYGNTYVTTGEEWIA

SEQ ID NO: 8305 - protein, 24 aa, artificial
  peptide fold or domain or sub-domain
IKHDFDHETLTAITGRPFANRIDL

SEQ ID NO: 8306 - protein, 29 aa, artificial
  peptide fold or domain or sub-domain
IKHKDSRRPASHRSENITISKQDATDELK

SEQ ID NO: 8307 - protein, 30 aa, artificial
  peptide fold or domain or sub-domain
IKHLTRTRQKAKDTNQPMLSQAIKIIMNSL

SEQ ID NO: 8308 - protein, 20 aa, artificial
  peptide fold or domain or sub-domain
IKHMMNDIIELPEDAQKIRY

SEQ ID NO: 8309 - protein, 27 aa, artificial
  peptide fold or domain or sub-domain
IKHPDYRYYYITTKCSFSSLQELIQFY

SEQ ID NO: 8310 - protein, 25 aa, artificial
  peptide fold or domain or sub-domain
IKIDEPLDKSCDCHTCKNYSKAYIH

SEQ ID NO: 8311 - protein, 26 aa, artificial
  peptide fold or domain or sub-domain
IKIDKAEIHQVASGEIINLRDRILPI

SEQ ID NO: 8312 - protein, 25 aa, artificial
  peptide fold or domain or sub-domain
IKIEANLYEIRRERKPTVRAIATLT

SEQ ID NO: 8313 - protein, 28 aa, artificial
  peptide fold or domain or sub-domain
IKIESISKKIGIDVKNDRGSFSQYSRLF

SEQ ID NO: 8314 - protein, 28 aa, artificial
  peptide fold or domain or sub-domain
IKIIDLLNLANISSSNRIARDFLNTGSI

SEQ ID NO: 8315 - protein, 28 aa, artificial
  peptide fold or domain or sub-domain
IKILKNNNCIQLAKEYFQQYSDRNSQLV

SEQ ID NO: 8316 - protein, 29 aa, artificial
  peptide fold or domain or sub-domain
IKILNKKGQQGWWRGEIYGRIGWFPSNYV

SEQ ID NO: 8317 - protein, 23 aa, artificial
  peptide fold or domain or sub-domain
IKILRNALILRLGAQNVLLDMMD

SEQ ID NO: 8318 - protein, 29 aa, artificial
  peptide fold or domain or sub-domain
IKILTECDEDGFYLGECNGLRGLVPSNMV

SEQ ID NO: 8319 - protein, 21 aa, artificial
  peptide fold or domain or sub-domain
IKINSSYFEYLPIPLVEINNA

SEQ ID NO: 8320 - protein, 26 aa, artificial
  peptide fold or domain or sub-domain
IKIVKTAFLYRRKKLYNSLKKLSFSS

SEQ ID NO: 8321 - protein, 27 aa, artificial
  peptide fold or domain or sub-domain
IKKAFEAPKDFDKKPAQIQERILSGWL

SEQ ID NO: 8322 - protein, 25 aa, artificial
  peptide fold or domain or sub-domain
IKKFPVLENGLENVDGNNLNYETFG

SEQ ID NO: 8323 - protein, 21 aa, artificial
  peptide fold or domain or sub-domain
IKKICDLHSWPIDGKKHNEAR

SEQ ID NO: 8324 - protein, 25 aa, artificial
  peptide fold or domain or sub-domain
IKKIEKDTSVSYDRCWTAEKETFVA

SEQ ID NO: 8325 - protein, 27 aa, artificial
  peptide fold or domain or sub-domain
IKKLAARGLVNHEKYAGVTLTEQGKTL

SEQ ID NO: 8326 - protein, 28 aa, artificial
  peptide fold or domain or sub-domain
IKKLALGYYEPSSELFEKPEVYDAIVKG

SEQ ID NO: 8327 - protein, 27 aa, artificial
  peptide fold or domain or sub-domain
IKKLHSMGFVEYKPYQGVELTEKGAEE

SEQ ID NO: 8328 - protein, 21 aa, artificial
  peptide fold or domain or sub-domain
IKKLVHICMIDGKKTRSRAIV

SEQ ID NO: 8329 - protein, 27 aa, artificial
  peptide fold or domain or sub-domain
IKKNDSGQWYVAERHAFQSIPELIWYH

SEQ ID NO: 8330 - protein, 26 aa, artificial
  peptide fold or domain or sub-domain
IKKRICRQVKIVYPEASAEEVEQLVE

SEQ ID NO: 8331 - protein, 27 aa, artificial
  peptide fold or domain or sub-domain
IKLDESNKYFISEKHRFPSIKELIEYH

SEQ ID NO: 8332 - protein, 28 aa, artificial
  peptide fold or domain or sub-domain
IKLDLLQLTSSEQPDVKKNAIYAVQKIM

SEQ ID NO: 8333 - protein, 29 aa, artificial
  peptide fold or domain or sub-domain
IKLLKKTTNGWWYGEDKNQVKGYFPHNFV

SEQ ID NO: 8334 - protein, 20 aa, artificial
  peptide fold or domain or sub-domain
IKLPHLINAGIRKSIAKSIL

SEQ ID NO: 8335 - protein, 25 aa, artificial
  peptide fold or domain or sub-domain
IKLTTDKAYLEKGSSSVIYVDYDNI

SEQ ID NO: 8336 - protein, 21 aa, artificial
  peptide fold or domain or sub-domain
IKMLIRFKFSVGIREAKRHIY

SEQ ID NO: 8337 - protein, 27 aa, artificial
  peptide fold or domain or sub-domain
IKNEKFTLPKKNNTFHGRDVFAPVAAY

SEQ ID NO: 8338 - protein, 25 aa, artificial
  peptide fold or domain or sub-domain
IKNHIIDNPEFIQPESSRESILARL

SEQ ID NO: 8339 - protein, 27 aa, artificial
  peptide fold or domain or sub-domain
IKNILENTPENHPDHSHLKHALEKAEE

SEQ ID NO: 8340 - protein, 28 aa, artificial
  peptide fold or domain or sub-domain
IKPKEILLNARELSDDIISGNWYPQLAE

SEQ ID NO: 8341 - protein, 22 aa, artificial
  peptide fold or domain or sub-domain
IKQKLSNEDLEPAIEDTLEDCQ

SEQ ID NO: 8342 - protein, 28 aa, artificial
  peptide fold or domain or sub-domain
IKQKYPLTYSKRLEEIENLKLEQEKKVI

SEQ ID NO: 8343 - protein, 30 aa, artificial
  peptide fold or domain or sub-domain
IKQSYYLPPIFFNIEEESNQSIITGDLIHE

SEQ ID NO: 8344 - protein, 25 aa, artificial
  peptide fold or domain or sub-domain
IKQTRWNSIVTNGGTMMTDDDGVFA

SEQ ID NO: 8345 - protein, 28 aa, artificial
  peptide fold or domain or sub-domain
IKRAHGGAEWRHWPAALRNRDDEALAAW

SEQ ID NO: 8346 - protein, 25 aa, artificial
  peptide fold or domain or sub-domain
IKREEKAMTIYWDDHTKKPLSMALN

SEQ ID NO: 8347 - protein, 27 aa, artificial
  peptide fold or domain or sub-domain
IKRGLRDAVRKGTAKLAFSRIVDIAGK

SEQ ID NO: 8348 - protein, 20 aa, artificial
  peptide fold or domain or sub-domain
IKRIEKKENLHKIDISDIVD

SEQ ID NO: 8349 - protein, 21 aa, artificial
  peptide fold or domain or sub-domain
IKRILNEKLADTYLSAKKLIR

SEQ ID NO: 8350 - protein, 26 aa, artificial
  peptide fold or domain or sub-domain
IKRKIIEEILISKDVKKAIKLVKSTV

SEQ ID NO: 8351 - protein, 27 aa, artificial
  peptide fold or domain or sub-domain
IKRLAKKELVIHKPYYGVSLTDLGNHE

SEQ ID NO: 8352 - protein, 27 aa, artificial
  peptide fold or domain or sub-domain
IKRLDEGGFFLTRRRIFSTLNEFVSHY

SEQ ID NO: 8353 - protein, 27 aa, artificial
  peptide fold or domain or sub-domain
IKRLDELEFLTYEAYEGATLTDPGRTV

SEQ ID NO: 8354 - protein, 21 aa, artificial
  peptide fold or domain or sub-domain
IKRLKDQGSVYTIRSAKKMIQ

SEQ ID NO: 8355 - protein, 21 aa, artificial
  peptide fold or domain or sub-domain
IKRPLENNNEILNYEEQKTLF

SEQ ID NO: 8356 - protein, 29 aa, artificial
  peptide fold or domain or sub-domain
IKRTNKKAGGSPKDGIDEKKWLNKFLDVR

SEQ ID NO: 8357 - protein, 22 aa, artificial
  peptide fold or domain or sub-domain
IKRWAEDEVQLYPEEWEGQFDG

SEQ ID NO: 8358 - protein, 20 aa, artificial
  peptide fold or domain or sub-domain
IKRYCPVTDSELPADHVYFK

SEQ ID NO: 8359 - protein, 23 aa, artificial
  peptide fold or domain or sub-domain
IKSAQRDGIHDTNKQAQAENSRQ

SEQ ID NO: 8360 - protein, 23 aa, artificial
  peptide fold or domain or sub-domain
IKSEEQWRRELSPIQYAVLREKA

SEQ ID NO: 8361 - protein, 23 aa, artificial
  peptide fold or domain or sub-domain
IKSLQSRSTRDSTKKTQAENLKR

SEQ ID NO: 8362 - protein, 28 aa, artificial
  peptide fold or domain or sub-domain
IKSMALASQTPGSTLYGNTDLIADTIMA

SEQ ID NO: 8363 - protein, 30 aa, artificial
  peptide fold or domain or sub-domain
IKSNISLIEAMIEVGYENKATLARRAEKMR

SEQ ID NO: 8364 - protein, 29 aa, artificial
  peptide fold or domain or sub-domain
IKSQFGNGKEYHVRHILVEKEADAKAIIA

SEQ ID NO: 8365 - protein, 27 aa, artificial
  peptide fold or domain or sub-domain
IKSRADRWFYIDDGPLFETLPHLVDHY

SEQ ID NO: 8366 - protein, 20 aa, artificial
  peptide fold or domain or sub-domain
IKSSIREKLEAGKDMAFLSK

SEQ ID NO: 8367 - protein, 24 aa, artificial
  peptide fold or domain or sub-domain
IKSTAGYNTNPTGSNYGGMVLVHE

SEQ ID NO: 8368 - protein, 28 aa, artificial
  peptide fold or domain or sub-domain
IKTDAAGVTGLSPKGILVGDTLYEVDLV

SEQ ID NO: 8369 - protein, 24 aa, artificial
  peptide fold or domain or sub-domain
IKTENYFPGPLKSVTWDGKYFGVP

SEQ ID NO: 8370 - protein, 21 aa, artificial
  peptide fold or domain or sub-domain
IKTKFGNASLHRGKSSWASNH

SEQ ID NO: 8371 - protein, 23 aa, artificial
  peptide fold or domain or sub-domain
IKTLYKLAKGDRAQRTQAEGVKS

SEQ ID NO: 8372 - protein, 25 aa, artificial
  peptide fold or domain or sub-domain
IKTMEPGETLGYGGSYKITRTTRVA

SEQ ID NO: 8373 - protein, 26 aa, artificial
  peptide fold or domain or sub-domain
IKTPIIFVSGRCEDHDQILGLGLGAT

SEQ ID NO: 8374 - protein, 30 aa, artificial
  peptide fold or domain or sub-domain
IKTQDAWKMARAVVKYDGIMCGMSSGAAIL

SEQ ID NO: 8375 - protein, 24 aa, artificial
  peptide fold or domain or sub-domain
IKVATQSETVTGTSANTAVSPKNL

SEQ ID NO: 8376 - protein, 21 aa, artificial
  peptide fold or domain or sub-domain
IKVCWNDENKKELGYKYIYIT

SEQ ID NO: 8377 - protein, 27 aa, artificial
  peptide fold or domain or sub-domain
IKVIASNAGKIYLKNITNKETLDVKAV

SEQ ID NO: 8378 - protein, 25 aa, artificial
  peptide fold or domain or sub-domain
IKVMEKEAKELAFKMEGEEVDKVFG

SEQ ID NO: 8379 - protein, 26 aa, artificial
  peptide fold or domain or sub-domain
IKVMEKEAKELAFKMEGEEVDKVFGK

SEQ ID NO: 8380 - protein, 28 aa, artificial
  peptide fold or domain or sub-domain
IKVTDLFVQVGLCTTKSDARRLIAQGGA

SEQ ID NO: 8381 - protein, 29 aa, artificial
  peptide fold or domain or sub-domain
IKVTEMEDDSGWFTAEIQGKRGYIPQNYI

SEQ ID NO: 8382 - protein, 30 aa, artificial
  peptide fold or domain or sub-domain
IKVYVICDIQKEAIPESMYGEFYSENDYII

SEQ ID NO: 8383 - protein, 26 aa, artificial
  peptide fold or domain or sub-domain
IKYDNKSDNTEAASVATRLITQDKVP

SEQ ID NO: 8384 - protein, 29 aa, artificial
  peptide fold or domain or sub-domain
IKYSKEQFLKDAPFAIEIAQKEGFLFHAN

SEQ ID NO: 8385 - protein, 29 aa, artificial
  peptide fold or domain or sub-domain
ILAKAKIDLDSAKTTKEIIDASQELKIAS

SEQ ID NO: 8386 - protein, 22 aa, artificial
  peptide fold or domain or sub-domain
ILAKLEHEYGTEVSRKMFDDLV

SEQ ID NO: 8387 - protein, 20 aa, artificial
  peptide fold or domain or sub-domain
ILAQDRRLSGRQVARIICRT

SEQ ID NO: 8388 - protein, 25 aa, artificial
  peptide fold or domain or sub-domain
ILCAEYDNETSAAFLSKATELSEVY

SEQ ID NO: 8389 - protein, 29 aa, artificial
  peptide fold or domain or sub-domain
ILDAKKHAHGVKHDKDLPVEALRELVAEF

SEQ ID NO: 8390 - protein, 24 aa, artificial
  peptide fold or domain or sub-domain
ILDATQELSAYKNGELDMARVPVG

SEQ ID NO: 8391 - protein, 23 aa, artificial
  peptide fold or domain or sub-domain
ILDDVLAKAFMIDKDQVDWIQAK

SEQ ID NO: 8392 - protein, 21 aa, artificial
  peptide fold or domain or sub-domain
ILDFSKNSDMAVMILRYFNVI

SEQ ID NO: 8393 - protein, 22 aa, artificial
  peptide fold or domain or sub-domain
ILDIGVPGSSFTLEIAEKSGLA

SEQ ID NO: 8394 - protein, 22 aa, artificial
  peptide fold or domain or sub-domain
ILDRLVRKWGPEVIADFDIVGR

SEQ ID NO: 8395 - protein, 24 aa, artificial
  peptide fold or domain or sub-domain
ILDWFVKNKSGEDYTKQNHPGVKL

SEQ ID NO: 8396 - protein, 24 aa, artificial
  peptide fold or domain or sub-domain
ILDWQKREQNRQIIPISDDMGVQS

SEQ ID NO: 8397 - protein, 24 aa, artificial
  peptide fold or domain or sub-domain
ILDWYKANTDKKEYAPAEDPGVVS

SEQ ID NO: 8398 - protein, 24 aa, artificial
  peptide fold or domain or sub-domain
ILDYYKSKNPTTDYTNEKDPGVKS

SEQ ID NO: 8399 - protein, 20 aa, artificial
  peptide fold or domain or sub-domain
ILEARYRDGLTESECVELVS

SEQ ID NO: 8400 - protein, 27 aa, artificial
  peptide fold or domain or sub-domain
ILEDEVSDWEVSATFHGRDVFAPAAAR

SEQ ID NO: 8401 - protein, 23 aa, artificial
  peptide fold or domain or sub-domain
ILEFDGDTAKLADAETFLFHLLK

SEQ ID NO: 8402 - protein, 28 aa, artificial
  peptide fold or domain or sub-domain
ILEGQYNSTAGKVIGYTEKAEAVAIILN

SEQ ID NO: 8403 - protein, 27 aa, artificial
  peptide fold or domain or sub-domain
ILEIRLDGETWNFDQFSTFKNTKLSFK

SEQ ID NO: 8404 - protein, 20 aa, artificial
  peptide fold or domain or sub-domain
ILENQQIFDHNSIHIEKVLN

SEQ ID NO: 8405 - protein, 29 aa, artificial
  peptide fold or domain or sub-domain
ILEQKKQELGIHLDTELGVDDLKDLVGKY

SEQ ID NO: 8406 - protein, 26 aa, artificial
  peptide fold or domain or sub-domain
ILERSLKLLFETRDISLIKQYVQRQC

SEQ ID NO: 8407 - protein, 28 aa, artificial
  peptide fold or domain or sub-domain
ILETLNAMSRSDKVAIAAINGPQSIVIS

SEQ ID NO: 8408 - protein, 24 aa, artificial
  peptide fold or domain or sub-domain
ILFLARYRPDMLDYSEKYFWIQRY

SEQ ID NO: 8409 - protein, 30 aa, artificial
  peptide fold or domain or sub-domain
ILGDGDDRGALTAQVAAAGLEKRVLLPGQV

SEQ ID NO: 8410 - protein, 26 aa, artificial
  peptide fold or domain or sub-domain
ILGFINRAGYERVGTPMDRPMNFTKC

SEQ ID NO: 8411 - protein, 21 aa, artificial
  peptide fold or domain or sub-domain
ILGNPLMSVASILNEVEEQVV

SEQ ID NO: 8412 - protein, 28 aa, artificial
  peptide fold or domain or sub-domain
ILGQALDCYFENTPLNLEQLTFLHEHKT

SEQ ID NO: 8413 - protein, 28 aa, artificial
  peptide fold or domain or sub-domain
ILGSRDMVKGKKALEELAAQGIEADLIQ

SEQ ID NO: 8414 - protein, 24 aa, artificial
  peptide fold or domain or sub-domain
ILGTGCVGFDPDGALPEIPETNAS

SEQ ID NO: 8415 - protein, 23 aa, artificial
  peptide fold or domain or sub-domain
ILHMRNLLIIKVSQNPYEVLDMS

SEQ ID NO: 8416 - protein, 20 aa, artificial
  peptide fold or domain or sub-domain
ILIDDGDITRPPFGLNSVIT

SEQ ID NO: 8417 - protein, 29 aa, artificial
  peptide fold or domain or sub-domain
ILIERDPNLVNRLLHTFTSKKVKIFNKDA

SEQ ID NO: 8418 - protein, 25 aa, artificial
  peptide fold or domain or sub-domain
ILIRYTKKMPQVPTDLLLETGKKMT

SEQ ID NO: 8419 - protein, 25 aa, artificial
  peptide fold or domain or sub-domain
ILITDTRTDSRWLVTSERHQDVRSV

SEQ ID NO: 8420 - protein, 25 aa, artificial
  peptide fold or domain or sub-domain
ILKDAVNSGLEMDLEHALQYEAECF

SEQ ID NO: 8421 - protein, 30 aa, artificial
  peptide fold or domain or sub-domain
ILKDGKVFGKPKHKMDAYRMLMSFSGEEHT

SEQ ID NO: 8422 - protein, 26 aa, artificial
  peptide fold or domain or sub-domain
ILKESLDTILFKKDTPTAVTETVECI

SEQ ID NO: 8423 - protein, 26 aa, artificial
  peptide fold or domain or sub-domain
ILKKIKEDQKEGLIPEDDAKRLENEI

SEQ ID NO: 8424 - protein, 27 aa, artificial
  peptide fold or domain or sub-domain
ILLDLNQEPLEKLRETLAGEHLSFCVD

SEQ ID NO: 8425 - protein, 30 aa, artificial
  peptide fold or domain or sub-domain
ILLDSLAKRVNFLKKLSTRLGLKKLEVVHA

SEQ ID NO: 8426 - protein, 23 aa, artificial
  peptide fold or domain or sub-domain
ILLEDPVLISIGQKYSKSPAQVS

SEQ ID NO: 8427 - protein, 23 aa, artificial
  peptide fold or domain or sub-domain
ILLQDPVINEIAKAKGRTPAQIA

SEQ ID NO: 8428 - protein, 28 aa, artificial
  peptide fold or domain or sub-domain
ILLSLPGKDYDKINPDIKVLQYNTEKNL

SEQ ID NO: 8429 - protein, 25 aa, artificial
  peptide fold or domain or sub-domain
ILLTAKVPEASADISCQVTCSLPEV

SEQ ID NO: 8430 - protein, 26 aa, artificial
  peptide fold or domain or sub-domain
ILLTARTRTQERILGYQSGCDLYLPK

SEQ ID NO: 8431 - protein, 26 aa, artificial
  peptide fold or domain or sub-domain
ILLTSRRAVEDRVEGLDTGADDFLSK

SEQ ID NO: 8432 - protein, 28 aa, artificial
  peptide fold or domain or sub-domain
ILLVDLMLDSKIVPSKSEGRRLIDSGGV

SEQ ID NO: 8433 - protein, 29 aa, artificial
  peptide fold or domain or sub-domain
ILLVHGDKREAKAHLHAQAKPYENISLCQ

SEQ ID NO: 8434 - protein, 23 aa, artificial
  peptide fold or domain or sub-domain
ILMAILIGLSPDEQDLEIRENSI

SEQ ID NO: 8435 - protein, 30 aa, artificial
  peptide fold or domain or sub-domain
ILMHSNERQKHSGRLHFTLDNSIKSSSLSI

SEQ ID NO: 8436 - protein, 24 aa, artificial
  peptide fold or domain or sub-domain
ILMSNEDVRRKIVSKEYASLFEKD

SEQ ID NO: 8437 - protein, 26 aa, artificial
  peptide fold or domain or sub-domain
ILMTPHDWLEKGTSSQLANPVSYIAK

SEQ ID NO: 8438 - protein, 24 aa, artificial
  peptide fold or domain or sub-domain
ILNDIPERLHAVYLARQLEDACRI

SEQ ID NO: 8439 - protein, 25 aa, artificial
  peptide fold or domain or sub-domain
ILNKSLKKHLKLISKKELKKIKYTQ

SEQ ID NO: 8440 - protein, 25 aa, artificial
  peptide fold or domain or sub-domain
ILPAKKNTEEISKFREIEAHTEIHS

SEQ ID NO: 8441 - protein, 22 aa, artificial
  peptide fold or domain or sub-domain
ILPDALARRMDLPPPQLLLTLR

SEQ ID NO: 8442 - protein, 23 aa, artificial
  peptide fold or domain or sub-domain
ILPFALFANDLPSELVEATTFLS

SEQ ID NO: 8443 - protein, 25 aa, artificial
  peptide fold or domain or sub-domain
ILPSAEDAYNIKGFEDDALYRLEIR

SEQ ID NO: 8444 - protein, 23 aa, artificial
  peptide fold or domain or sub-domain
ILPSEIRSRWSPRSTTDLASDKE

SEQ ID NO: 8445 - protein, 27 aa, artificial
  peptide fold or domain or sub-domain
ILQAKKKNILARHLKADIDDAIYDELL

SEQ ID NO: 8446 - protein, 28 aa, artificial
  peptide fold or domain or sub-domain
ILQALQAETDQSSFDSSTERLINYVLKI

SEQ ID NO: 8447 - protein, 29 aa, artificial
  peptide fold or domain or sub-domain
ILQDCKEFPNPEKFDPGHFLNANGTFRRS

SEQ ID NO: 8448 - protein, 20 aa, artificial
  peptide fold or domain or sub-domain
ILQKHGDLTPETIKLILEKT

SEQ ID NO: 8449 - protein, 27 aa, artificial
  peptide fold or domain or sub-domain
ILQNWGIEGEHYEVVDGERVIPEEEMD

SEQ ID NO: 8450 - protein, 24 aa, artificial
  peptide fold or domain or sub-domain
ILQWKECRDIWQDERIHESNVCAG

SEQ ID NO: 8451 - protein, 20 aa, artificial
  peptide fold or domain or sub-domain
ILRALPVNVLANAYRISRQE

SEQ ID NO: 8452 - protein, 29 aa, artificial
  peptide fold or domain or sub-domain
ILRCLEALQFSDENGAACPLDWKKGDKGI

SEQ ID NO: 8453 - protein, 27 aa, artificial
  peptide fold or domain or sub-domain
ILRDYMSSLIAKGIVKGSIARKLSAVR

SEQ ID NO: 8454 - protein, 30 aa, artificial
  peptide fold or domain or sub-domain
ILREIAPEVTVEALTALTEAAFITAPGLKT

SEQ ID NO: 8455 - protein, 27 aa, artificial
  peptide fold or domain or sub-domain
ILRSPRGYKIKGFRKEFSSLKALITHH

SEQ ID NO: 8456 - protein, 29 aa, artificial
  peptide fold or domain or sub-domain
ILRVIDALQTADEYKVALPANWYPGDKVV

SEQ ID NO: 8457 - protein, 29 aa, artificial
  peptide fold or domain or sub-domain
ILRVVISLQLTAEKRVATPVDWKDGDSVM

SEQ ID NO: 8458 - protein, 26 aa, artificial
  peptide fold or domain or sub-domain
ILSFYMKHGRQLVGTKSGLPLDQTDC

SEQ ID NO: 8459 - protein, 26 aa, artificial
  peptide fold or domain or sub-domain
ILSIKNFFNCGIIIKNKKEIQYVVNS

SEQ ID NO: 8460 - protein, 25 aa, artificial
  peptide fold or domain or sub-domain
ILSILRDHPENRIYRRKIEELSKRF

SEQ ID NO: 8461 - protein, 20 aa, artificial
  peptide fold or domain or sub-domain
ILSKHPTWTNAQVRDRLEST

SEQ ID NO: 8462 - protein, 30 aa, artificial
  peptide fold or domain or sub-domain
ILSNEATKSDLQMAVLSFEKDDDHNGHIDF

SEQ ID NO: 8463 - protein, 24 aa, artificial
  peptide fold or domain or sub-domain
ILSQEECRNSNYGESKITDNMICA

SEQ ID NO: 8464 - protein, 21 aa, artificial
  peptide fold or domain or sub-domain
ILSTPKGIMSGTEAIRRGEGG

SEQ ID NO: 8465 - protein, 21 aa, artificial
  peptide fold or domain or sub-domain
ILSTSQGVLTDKEARQKGTGG

SEQ ID NO: 8466 - protein, 26 aa, artificial
  peptide fold or domain or sub-domain
ILTALYMDEAAETMPDSEPLKGRLSR

SEQ ID NO: 8467 - protein, 29 aa, artificial
  peptide fold or domain or sub-domain
ILTDTKIANNYESDLDLTIDDLKEIVAKF

SEQ ID NO: 8468 - protein, 27 aa, artificial
  peptide fold or domain or sub-domain
ILTERGAVGSLLAARTGEAYQKPDDFF

SEQ ID NO: 8469 - protein, 25 aa, artificial
  peptide fold or domain or sub-domain
ILTGAPAINKMLGREVYTSNLQLGG

SEQ ID NO: 8470 - protein, 26 aa, artificial
  peptide fold or domain or sub-domain
ILTGIQIDVLAEKNALEEPLANMVRR

SEQ ID NO: 8471 - protein, 24 aa, artificial
  peptide fold or domain or sub-domain
ILTNAKCRRAGYWPFQITGRMLCA

SEQ ID NO: 8472 - protein, 28 aa, artificial
  peptide fold or domain or sub-domain
ILTSRDPEQGKTAAEKLQSEGLDVLFHP

SEQ ID NO: 8473 - protein, 28 aa, artificial
  peptide fold or domain or sub-domain
ILTSRNEADGLAAKQQLSSEGLDADYCV

SEQ ID NO: 8474 - protein, 21 aa, artificial
  peptide fold or domain or sub-domain
ILTTSKGLMTVNECKRAQIGG

SEQ ID NO: 8475 - protein, 22 aa, artificial
  peptide fold or domain or sub-domain
ILVDRGIRVEHGRGFADRVIGS

SEQ ID NO: 8476 - protein, 23 aa, artificial
  peptide fold or domain or sub-domain
ILVEANKYIEDNKPWELAKNQQE

SEQ ID NO: 8477 - protein, 25 aa, artificial
  peptide fold or domain or sub-domain
ILVKDIDQDSRFQGMTRDRYKTPSF

SEQ ID NO: 8478 - protein, 22 aa, artificial
  peptide fold or domain or sub-domain
ILVMAMYFPKDFTAEVHVSVDK

SEQ ID NO: 8479 - protein, 20 aa, artificial
  peptide fold or domain or sub-domain
ILVNAPADGSFDAFGEQVVP

SEQ ID NO: 8480 - protein, 22 aa, artificial
  peptide fold or domain or sub-domain
ILVQDTDTALKELEKVTGIQLL

SEQ ID NO: 8481 - protein, 22 aa, artificial
  peptide fold or domain or sub-domain
ILVSVYVFSYSSLRELKFLEYY

SEQ ID NO: 8482 - protein, 26 aa, artificial
  peptide fold or domain or sub-domain
ILVTASSDPEIIEDATRMGFAEALLK

SEQ ID NO: 8483 - protein, 26 aa, artificial
  peptide fold or domain or sub-domain
ILVTGHGDIPMAVQAIQDGAYDFIAK

SEQ ID NO: 8484 - protein, 20 aa, artificial
  peptide fold or domain or sub-domain
ILVTNDSQKFPKAFRKCTII

SEQ ID NO: 8485 - protein, 26 aa, artificial
  peptide fold or domain or sub-domain
ILVVISKQGVGFMDPETKEELDLYPF

SEQ ID NO: 8486 - protein, 23 aa, artificial
  peptide fold or domain or sub-domain
ILYGQALAEVAVDALPQIVQAAA

SEQ ID NO: 8487 - protein, 25 aa, artificial
  peptide fold or domain or sub-domain
ILYPQEIKGKAQKLMGISPVVPLKG

SEQ ID NO: 8488 - protein, 23 aa, artificial
  peptide fold or domain or sub-domain
ILYTFTKDEVEGPLLDVNDMREL

SEQ ID NO: 8489 - protein, 26 aa, artificial
  peptide fold or domain or sub-domain
IMCSSKGEEFDRFWGMRQGADAYIAK

SEQ ID NO: 8490 - protein, 30 aa, artificial
  peptide fold or domain or sub-domain
IMDEMTGEKDVRSGQGAMGVLTAGHLNRAE

SEQ ID NO: 8491 - protein, 24 aa, artificial
  peptide fold or domain or sub-domain
IMDPTQDIARTVKKQITKQQAKTA

SEQ ID NO: 8492 - protein, 23 aa, artificial
  peptide fold or domain or sub-domain
IMDYRGEKEELATVEQYFMHIMQ

SEQ ID NO: 8493 - protein, 26 aa, artificial
  peptide fold or domain or sub-domain
IMEETEKMKENKEISEDDFHGAKKEI

SEQ ID NO: 8494 - protein, 27 aa, artificial
  peptide fold or domain or sub-domain
IMEKSKLDDLMQQISSTTVLEENVKDV

SEQ ID NO: 8495 - protein, 30 aa, artificial
  peptide fold or domain or sub-domain
IMESLTKNPDVRMTDGAIGYLTDGEISRKA

SEQ ID NO: 8496 - protein, 21 aa, artificial
  peptide fold or domain or sub-domain
IMGYMYGSTVVPYDNTIDIEY

SEQ ID NO: 8497 - protein, 25 aa, artificial
  peptide fold or domain or sub-domain
IMIGLAQRISVASFVNISSVALHFA

SEQ ID NO: 8498 - protein, 26 aa, artificial
  peptide fold or domain or sub-domain
IMISAKSKEEHIVEGLAAGSNDYVVK

SEQ ID NO: 8499 - protein, 20 aa, artificial
  peptide fold or domain or sub-domain
IMKVMLPTLGEERQATYSPF

SEQ ID NO: 8500 - protein, 26 aa, artificial
  peptide fold or domain or sub-domain
IMLISGGGQRGYPDSSSNFITGYLSK

SEQ ID NO: 8501 - protein, 26 aa, artificial
  peptide fold or domain or sub-domain
IMLTAKNRVSDLVMGLEVGANDYLSK

SEQ ID NO: 8502 - protein, 26 aa, artificial
  peptide fold or domain or sub-domain
IMLTSAAQKGDARRAKEHGFSGYLTK

SEQ ID NO: 8503 - protein, 26 aa, artificial
  peptide fold or domain or sub-domain
IMMSAYGSLETALNCMKNGAYDYISK

SEQ ID NO: 8504 - protein, 20 aa, artificial
  peptide fold or domain or sub-domain
IMMYFASKKLDKLIESMSEF

SEQ ID NO: 8505 - protein, 29 aa, artificial
  peptide fold or domain or sub-domain
IMNAKSQDVQQRWVREMEDAGIPNLRIHF

SEQ ID NO: 8506 - protein, 29 aa, artificial
  peptide fold or domain or sub-domain
IMNHFKRLYGRQVKREFTPQEIKELALAY

SEQ ID NO: 8507 - protein, 23 aa, artificial
  peptide fold or domain or sub-domain
IMPCGTCSYCAKGHDDLCEDFFA

SEQ ID NO: 8508 - protein, 23 aa, artificial
  peptide fold or domain or sub-domain
IMPEILAKAFQLDVNVVKYLEAR

SEQ ID NO: 8509 - protein, 28 aa, artificial
  peptide fold or domain or sub-domain
IMQEAIKCMRHSKRTTLTASDVDGALNL

SEQ ID NO: 8510 - protein, 27 aa, artificial
  peptide fold or domain or sub-domain
IMQILEKRKLNRSFKMNINQNVYNNLI

SEQ ID NO: 8511 - protein, 28 aa, artificial
  peptide fold or domain or sub-domain
IMRKFSGSCRCCAKQIKFYRMRHHYKSC

SEQ ID NO: 8512 - protein, 21 aa, artificial
  peptide fold or domain or sub-domain
IMRKQLTQFNSQTGKVNLQKH

SEQ ID NO: 8513 - protein, 29 aa, artificial
  peptide fold or domain or sub-domain
IMRSFKQQYGVKKKGQFSAEQMRQLAFAY

SEQ ID NO: 8514 - protein, 28 aa, artificial
  peptide fold or domain or sub-domain
IMSGRDSSKLRKAVNSLKYDGHVIEGLL

SEQ ID NO: 8515 - protein, 28 aa, artificial
  peptide fold or domain or sub-domain
IMSHIEWVNNRMGGWITDEEALKKLEQK

SEQ ID NO: 8516 - protein, 28 aa, artificial
  peptide fold or domain or sub-domain
IMSYLEWVENLQWLSWDEEETRKRLEAI

SEQ ID NO: 8517 - protein, 26 aa, artificial
  peptide fold or domain or sub-domain
IMTGIELDKLAEAQKLSPEFQKIMEK

SEQ ID NO: 8518 - protein, 26 aa, artificial
  peptide fold or domain or sub-domain
IMTTAFGSEQIAVNAIRHGADDYLRK

SEQ ID NO: 8519 - protein, 26 aa, artificial
  peptide fold or domain or sub-domain
IMVTAYDRDEMLRRLGSNTVDGFLTK

SEQ ID NO: 8520 - protein, 26 aa, artificial
  peptide fold or domain or sub-domain
IMVTAYGREEIIKGAQAADIGEVLIK

SEQ ID NO: 8521 - protein, 26 aa, artificial
  peptide fold or domain or sub-domain
IMVTGENVHSSRYRHALGDFDAIVEK

SEQ ID NO: 8522 - protein, 22 aa, artificial
  peptide fold or domain or sub-domain
INADATNARRHMTLDCDYGLTN

SEQ ID NO: 8523 - protein, 25 aa, artificial
  peptide fold or domain or sub-domain
INAGKGLEFDTNTSESPDINPIKTK

SEQ ID NO: 8524 - protein, 21 aa, artificial
  peptide fold or domain or sub-domain
INAKRALIDSTTSISFYLQDP

SEQ ID NO: 8525 - protein, 21 aa, artificial
  peptide fold or domain or sub-domain
INALRHGKNNLRFKYRGMKTQ

SEQ ID NO: 8526 - protein, 23 aa, artificial
  peptide fold or domain or sub-domain
INCDHLFYLMARGIPFKTARALL

SEQ ID NO: 8527 - protein, 28 aa, artificial
  peptide fold or domain or sub-domain
INCFINKNIKKSSTDSNYQLAVFMLMET

SEQ ID NO: 8528 - protein, 26 aa, artificial
  peptide fold or domain or sub-domain
INCQALPGALKAAGFDLHDQLHVLLA

SEQ ID NO: 8529 - protein, 27 aa, artificial
  peptide fold or domain or sub-domain
INCQALPGALKAAGFDLHDQLHVLLAR

SEQ ID NO: 8530 - protein, 23 aa, artificial
  peptide fold or domain or sub-domain
INDEVLEKAFNLNQKQVQHIKAS

SEQ ID NO: 8531 - protein, 28 aa, artificial
  peptide fold or domain or sub-domain
INDLPGISQTVINKLIEAGYSSLETLAV

SEQ ID NO: 8532 - protein, 25 aa, artificial
  peptide fold or domain or sub-domain
INDNEISSINQKWMNKSGSTDVLSF

SEQ ID NO: 8533 - protein, 24 aa, artificial
  peptide fold or domain or sub-domain
INDQGRDGHSELLTMQRALHALES

SEQ ID NO: 8534 - protein, 24 aa, artificial
  peptide fold or domain or sub-domain
INDVSSDLENYKAGGESLTYNNLP

SEQ ID NO: 8535 - protein, 27 aa, artificial
  peptide fold or domain or sub-domain
INDVVEKLENEFQNKNYQEALKQTVYL

SEQ ID NO: 8536 - protein, 22 aa, artificial
  peptide fold or domain or sub-domain
INEDAKLLSEFANSGQSIAHIN

SEQ ID NO: 8537 - protein, 25 aa, artificial
  peptide fold or domain or sub-domain
INEEIERVMHCLDKSTEEPIVKVVE

SEQ ID NO: 8538 - protein, 23 aa, artificial
  peptide fold or domain or sub-domain
INEELLMKAFGLSLKQIGTLKKR

SEQ ID NO: 8539 - protein, 28 aa, artificial
  peptide fold or domain or sub-domain
INEFKRLGVLRAEGRSLEIINYDKLKDF

SEQ ID NO: 8540 - protein, 29 aa, artificial
  peptide fold or domain or sub-domain
INEFLKFCKEGTIAENGWPDEADGIAKVG

SEQ ID NO: 8541 - protein, 20 aa, artificial
  peptide fold or domain or sub-domain
INEKQDEHEITEVKLCFDIT

SEQ ID NO: 8542 - protein, 28 aa, artificial
  peptide fold or domain or sub-domain
INEMKREGVLGNVGRILCVRDQKALRKI

SEQ ID NO: 8543 - protein, 29 aa, artificial
  peptide fold or domain or sub-domain
INENSQKIKNVLKIKNLSQRLNIISKLCL

SEQ ID NO: 8544 - protein, 23 aa, artificial
  peptide fold or domain or sub-domain
INEPQFRRRMIQYDEEGIKHFYF

SEQ ID NO: 8545 - protein, 23 aa, artificial
  peptide fold or domain or sub-domain
INEQALLYLMSKGIDEETAKNIY

SEQ ID NO: 8546 - protein, 24 aa, artificial
  peptide fold or domain or sub-domain
INERVIIKFVNDQLSVQKHLHGGV

SEQ ID NO: 8547 - protein, 23 aa, artificial
  peptide fold or domain or sub-domain
INETIVAGLSQQSGNAFFAWDTY

SEQ ID NO: 8548 - protein, 23 aa, artificial
  peptide fold or domain or sub-domain
INETYSYQQDSYGLKTLDNQGKL

SEQ ID NO: 8549 - protein, 24 aa, artificial
  peptide fold or domain or sub-domain
INFDLPQVIENAPPLSGIEHVGGD

SEQ ID NO: 8550 - protein, 29 aa, artificial
  peptide fold or domain or sub-domain
INFNQAALNKTSAAIMELANSEGLHSHSR

SEQ ID NO: 8551 - protein, 27 aa, artificial
  peptide fold or domain or sub-domain
INFYILDNKVIRKDILNWKGSKLEINL

SEQ ID NO: 8552 - protein, 23 aa, artificial
  peptide fold or domain or sub-domain
INHAEFQRRMEQKQRDRDENYYF

SEQ ID NO: 8553 - protein, 27 aa, artificial
  peptide fold or domain or sub-domain
INHAEFQRYIAEGVIQGGMIPKLENSF

SEQ ID NO: 8554 - protein, 20 aa, artificial
  peptide fold or domain or sub-domain
INHMRKVVQTKMLSCCEIIG

SEQ ID NO: 8555 - protein, 23 aa, artificial
  peptide fold or domain or sub-domain
INHSWSMSHCSLSPEQKGVMGIS

SEQ ID NO: 8556 - protein, 24 aa, artificial
  peptide fold or domain or sub-domain
INIDNTINPSGGVGSNAWTDALHE

SEQ ID NO: 8557 - protein, 30 aa, artificial
  peptide fold or domain or sub-domain
INIGCGNCYWCRRNEVLNCGEVEQIGIGRD

SEQ ID NO: 8558 - protein, 30 aa, artificial
  peptide fold or domain or sub-domain
INIYSQNKHSREGRYSVEFYKPNQMLKLTI

SEQ ID NO: 8559 - protein, 20 aa, artificial
  peptide fold or domain or sub-domain
INKNISKRLNESKELILTNK

SEQ ID NO: 8560 - protein, 22 aa, artificial
  peptide fold or domain or sub-domain
INLAKGEQFISKYQNIHPFQKV

SEQ ID NO: 8561 - protein, 22 aa, artificial
  peptide fold or domain or sub-domain
INLDKLEQKQEWFLKINPNGRI

SEQ ID NO: 8562 - protein, 27 aa, artificial
  peptide fold or domain or sub-domain
INLEDYEPRQRSMQAILGIETANQHQV

SEQ ID NO: 8563 - protein, 24 aa, artificial
  peptide fold or domain or sub-domain
INLSGDEVKNAVRNGDYAKLVEND

SEQ ID NO: 8564 - protein, 24 aa, artificial
  peptide fold or domain or sub-domain
INLSYEKTHEFISMKDWNGLFQND

SEQ ID NO: 8565 - protein, 27 aa, artificial
  peptide fold or domain or sub-domain
INLTNLEKLVKEKKITDRMIPKIEAIK

SEQ ID NO: 8566 - protein, 25 aa, artificial
  peptide fold or domain or sub-domain
INLVRDKDGQLKVADKNQLRLLRTR

SEQ ID NO: 8567 - protein, 25 aa, artificial
  peptide fold or domain or sub-domain
INLVVPASDKHVEQKVGTSKSENVD

SEQ ID NO: 8568 - protein, 28 aa, artificial
  peptide fold or domain or sub-domain
INNAKDIGSTSPDYENSEPHVAEADFLE

SEQ ID NO: 8569 - protein, 30 aa, artificial
  peptide fold or domain or sub-domain
INNLTATLGADLVDSTDNTKINRGIFNEFK

SEQ ID NO: 8570 - protein, 24 aa, artificial
  peptide fold or domain or sub-domain
INNNLDRSREILDTHTQSEYNRDS

SEQ ID NO: 8571 - protein, 28 aa, artificial
  peptide fold or domain or sub-domain
INNPADLRDPASIAHLRGRGVDFGRLPC

SEQ ID NO: 8572 - protein, 24 aa, artificial
  peptide fold or domain or sub-domain
INPEEIIEFCRKELSPYKVPKGVI

SEQ ID NO: 8573 - protein, 28 aa, artificial
  peptide fold or domain or sub-domain
INPIYYSFLKSENNRKKIIDLFKKRIII

SEQ ID NO: 8574 - protein, 24 aa, artificial
  peptide fold or domain or sub-domain
INPLFATGSSWTSGSFNYYSLIHE

SEQ ID NO: 8575 - protein, 20 aa, artificial
  peptide fold or domain or sub-domain
INPSLKDQVGNDRGSQYRHG

SEQ ID NO: 8576 - protein, 25 aa, artificial
  peptide fold or domain or sub-domain
INQLEREAKELSFNMPREEIEEIFE

SEQ ID NO: 8577 - protein, 26 aa, artificial
  peptide fold or domain or sub-domain
INQLEREAKELSFNMPREEIEEIFES

SEQ ID NO: 8578 - protein, 27 aa, artificial
  peptide fold or domain or sub-domain
INQMSKYLETEPYEKFRRRLQLMTVND

SEQ ID NO: 8579 - protein, 28 aa, artificial
  peptide fold or domain or sub-domain
INQVHMAENFKLFSKAFGFTGKVIERYD

SEQ ID NO: 8580 - protein, 23 aa, artificial
  peptide fold or domain or sub-domain
INRGDFSKQDWEAQIDKELSQNQ

SEQ ID NO: 8581 - protein, 23 aa, artificial
  peptide fold or domain or sub-domain
INRTLNTATELNLDVGSVKEIFE

SEQ ID NO: 8582 - protein, 23 aa, artificial
  peptide fold or domain or sub-domain
INSEEFDRRVMMMQAAKETNYYF

SEQ ID NO: 8583 - protein, 27 aa, artificial
  peptide fold or domain or sub-domain
INSKKANELIDQEVISGGMIPKIKNCL

SEQ ID NO: 8584 - protein, 30 aa, artificial
  peptide fold or domain or sub-domain
INSLSVSYVEEHNLLSKVSDNDAMIFQRMS

SEQ ID NO: 8585 - protein, 24 aa, artificial
  peptide fold or domain or sub-domain
INSNIASVSANQTPGSVPSIEADF

SEQ ID NO: 8586 - protein, 20 aa, artificial
  peptide fold or domain or sub-domain
INSQVLGVRVGVDPSVIRKD

SEQ ID NO: 8587 - protein, 26 aa, artificial
  peptide fold or domain or sub-domain
INSVLLHMKNHPGLEIEDSIAHIEKI

SEQ ID NO: 8588 - protein, 26 aa, artificial
  peptide fold or domain or sub-domain
INSYEMRNAVNDAGFHLNNQLYDIIT

SEQ ID NO: 8589 - protein, 27 aa, artificial
  peptide fold or domain or sub-domain
INSYEMRNAVNDAGFHLNNQLYDIITM

SEQ ID NO: 8590 - protein, 21 aa, artificial
  peptide fold or domain or sub-domain
INTIKNIVSKVKQINPNVIIY

SEQ ID NO: 8591 - protein, 24 aa, artificial
  peptide fold or domain or sub-domain
INTLRPKALDLIKKNDIKTLLQSD

SEQ ID NO: 8592 - protein, 28 aa, artificial
  peptide fold or domain or sub-domain
INTNHPAFVQKILSNLSKNRAQLVRDEY

SEQ ID NO: 8593 - protein, 26 aa, artificial
  peptide fold or domain or sub-domain
INTPVIILSALDSTENKIEGLKSGSD

SEQ ID NO: 8594 - protein, 27 aa, artificial
  peptide fold or domain or sub-domain
INTTADGKVYVTAESRFSTLAELVHHH

SEQ ID NO: 8595 - protein, 28 aa, artificial
  peptide fold or domain or sub-domain
INVSFEKDYDAAKSEAKVREIYNTLLKI

SEQ ID NO: 8596 - protein, 28 aa, artificial
  peptide fold or domain or sub-domain
INVYELAMKANCFKSDYDARRIIEAGGF

SEQ ID NO: 8597 - protein, 24 aa, artificial
  peptide fold or domain or sub-domain
INYAQNRNKETNLNINYLFQSYLN

SEQ ID NO: 8598 - protein, 24 aa, artificial
  peptide fold or domain or sub-domain
INYDKLAFGASPLHVEKEIRESPR

SEQ ID NO: 8599 - protein, 22 aa, artificial
  peptide fold or domain or sub-domain
INYKIIIPFSKLAFYEGEIKYT

SEQ ID NO: 8600 - protein, 30 aa, artificial
  peptide fold or domain or sub-domain
INYRDHIAEANADQQINHGKVYTDISEYGL

SEQ ID NO: 8601 - protein, 28 aa, artificial
  peptide fold or domain or sub-domain
INYRNSDKEAEELKAILEEKGVKVLTVK

SEQ ID NO: 8602 - protein, 28 aa, artificial
  peptide fold or domain or sub-domain
INYRSNEEEAKKTEELCRQYGVETLLVK

SEQ ID NO: 8603 - protein, 28 aa, artificial
  peptide fold or domain or sub-domain
INYRTNDDAAFRVVSKLKNLGRKVVAIR

SEQ ID NO: 8604 - protein, 24 aa, artificial
  peptide fold or domain or sub-domain
INYSFSDNQHPSRLNYGGGVLTHE

SEQ ID NO: 8605 - protein, 26 aa, artificial
  peptide fold or domain or sub-domain
INYVWMYMIENNQASIDDSVRHVQTI

SEQ ID NO: 8606 - protein, 25 aa, artificial
  peptide fold or domain or sub-domain
IPADEAIGQVADGHYRAAMPVIALQ

SEQ ID NO: 8607 - protein, 21 aa, artificial
  peptide fold or domain or sub-domain
IPAGYFDDENAQNRMNSQSVG

SEQ ID NO: 8608 - protein, 26 aa, artificial
  peptide fold or domain or sub-domain
IPASAYLMKSPPEQLPDDIARAQLEE

SEQ ID NO: 8609 - protein, 22 aa, artificial
  peptide fold or domain or sub-domain
IPAYHASEQLFKCACHGGEFDT

SEQ ID NO: 8610 - protein, 30 aa, artificial
  peptide fold or domain or sub-domain
IPDAEALPYVFDLLHEEGLVLGGSSGVNIA

SEQ ID NO: 8611 - protein, 24 aa, artificial
  peptide fold or domain or sub-domain
IPDASAALQAFLAGEGDVLGQRPP

SEQ ID NO: 8612 - protein, 23 aa, artificial
  peptide fold or domain or sub-domain
IPDAVLAENYQVDVKIIRLLKSK

SEQ ID NO: 8613 - protein, 25 aa, artificial
  peptide fold or domain or sub-domain
IPDAYFSGPLALDLILSEKSKVIKG

SEQ ID NO: 8614 - protein, 24 aa, artificial
  peptide fold or domain or sub-domain
IPDHNARALALETGEVDFVVHLLP

SEQ ID NO: 8615 - protein, 23 aa, artificial
  peptide fold or domain or sub-domain
IPDHVLTTTFQIGTKEIEKIKSK

SEQ ID NO: 8616 - protein, 23 aa, artificial
  peptide fold or domain or sub-domain
IPDKVHKVAFKVDGHVVDKLQEP

SEQ ID NO: 8617 - protein, 26 aa, artificial
  peptide fold or domain or sub-domain
IPDLFKVLCEFGSLSLSEVKNAWNLG

SEQ ID NO: 8618 - protein, 30 aa, artificial
  peptide fold or domain or sub-domain
IPDLVIGDFDSLTESELNFFKKQGVTIRKY

SEQ ID NO: 8619 - protein, 24 aa, artificial
  peptide fold or domain or sub-domain
IPDNSVRFLELMSGNVHICQYPNP

SEQ ID NO: 8620 - protein, 28 aa, artificial
  peptide fold or domain or sub-domain
IPDQRFLCQTSSINFLMSQGFDFNKLFK

SEQ ID NO: 8621 - protein, 25 aa, artificial
  peptide fold or domain or sub-domain
IPDSVFTELVVGKINPQKAFLAGKF

SEQ ID NO: 8622 - protein, 30 aa, artificial
  peptide fold or domain or sub-domain
IPDYIKGDLDSLHEGVSDFFSKKGSSIVLD

SEQ ID NO: 8623 - protein, 24 aa, artificial
  peptide fold or domain or sub-domain
IPEDTSMLAALETGEVDIATGMPP

SEQ ID NO: 8624 - protein, 20 aa, artificial
  peptide fold or domain or sub-domain
IPEFPGDTLLDRSLFQFELF

SEQ ID NO: 8625 - protein, 27 aa, artificial
  peptide fold or domain or sub-domain
IPEHWTCDGDNDCGDYSDETHANCTNQ

SEQ ID NO: 8626 - protein, 30 aa, artificial
  peptide fold or domain or sub-domain
IPENFYLVSSSENCLICSIYNKEYNIYGVQ

SEQ ID NO: 8627 - protein, 30 aa, artificial
  peptide fold or domain or sub-domain
IPFFSVGDFDSVSKEERQLLTEQLQIKPVQ

SEQ ID NO: 8628 - protein, 26 aa, artificial
  peptide fold or domain or sub-domain
IPFIIGEKDRPGFKKFIGKAISRRLI

SEQ ID NO: 8629 - protein, 20 aa, artificial
  peptide fold or domain or sub-domain
IPFKDIAEVTGVSENTVKSR

SEQ ID NO: 8630 - protein, 30 aa, artificial
  peptide fold or domain or sub-domain
IPFLLEGVWDRDGMMQDDGVHPTAKAQPEI

SEQ ID NO: 8631 - protein, 30 aa, artificial
  peptide fold or domain or sub-domain
IPFLMAGVGGHEDMMQRDGLHPNAAGARKV

SEQ ID NO: 8632 - protein, 29 aa, artificial
  peptide fold or domain or sub-domain
IPFNLAHGDRPPQSTRLRNRTLDLRHPTA

SEQ ID NO: 8633 - protein, 23 aa, artificial
  peptide fold or domain or sub-domain
IPFSRLAKMLNLSEATIYVRIKR

SEQ ID NO: 8634 - protein, 20 aa, artificial
  peptide fold or domain or sub-domain
IPGALGKKLKEGVEDARHSY

SEQ ID NO: 8635 - protein, 22 aa, artificial
  peptide fold or domain or sub-domain
IPGDTEFVCSLSGIQEDYEKLT

SEQ ID NO: 8636 - protein, 28 aa, artificial
  peptide fold or domain or sub-domain
IPGDVRDQIFSAKSQHGQARVNELFRRV

SEQ ID NO: 8637 - protein, 24 aa, artificial
  peptide fold or domain or sub-domain
IPGEAKLAEFLDVSRPTMREVVRT

SEQ ID NO: 8638 - protein, 26 aa, artificial
  peptide fold or domain or sub-domain
IPGKKLGLEFTVDEKTGAKITGLSGR

SEQ ID NO: 8639 - protein, 28 aa, artificial
  peptide fold or domain or sub-domain
IPGMPETEDGTLYAANVPAASGKPLRAD

SEQ ID NO: 8640 - protein, 30 aa, artificial
  peptide fold or domain or sub-domain
IPGSEFYTNKVLVATKGKEQNKYDWALNFI

SEQ ID NO: 8641 - protein, 28 aa, artificial
  peptide fold or domain or sub-domain
IPGSVDVARGLVHLAPNLFWRDFSLRDE

SEQ ID NO: 8642 - protein, 26 aa, artificial
  peptide fold or domain or sub-domain
IPGYIQDKYNVKSVYDLKKPEVAKLF

SEQ ID NO: 8643 - protein, 27 aa, artificial
  peptide fold or domain or sub-domain
IPHDNVCDDADDCGDWSDELGCNKGKE

SEQ ID NO: 8644 - protein, 28 aa, artificial
  peptide fold or domain or sub-domain
IPHGPSGYQKITDGGVSVNGIRVTNPET

SEQ ID NO: 8645 - protein, 23 aa, artificial
  peptide fold or domain or sub-domain
IPHTTRPPEENGKNYYFVSHDQM

SEQ ID NO: 8646 - protein, 27 aa, artificial
  peptide fold or domain or sub-domain
IPIALHYLGLPYNSHNPDDYKKAQELL

SEQ ID NO: 8647 - protein, 24 aa, artificial
  peptide fold or domain or sub-domain
IPICTLKNFPNAIEHTLQWARDEF

SEQ ID NO: 8648 - protein, 29 aa, artificial
  peptide fold or domain or sub-domain
IPIEAAHKIRSCLGKYDFKGASNLITEDM

SEQ ID NO: 8649 - protein, 21 aa, artificial
  peptide fold or domain or sub-domain
IPIEEKITYKENSSGVSSRHD

SEQ ID NO: 8650 - protein, 30 aa, artificial
  peptide fold or domain or sub-domain
IPKCIIGDLDSLKPEIQQYYESHNCSIIKV

SEQ ID NO: 8651 - protein, 24 aa, artificial
  peptide fold or domain or sub-domain
IPKEADLMTQFGISRNTLREAIRA

SEQ ID NO: 8652 - protein, 20 aa, artificial
  peptide fold or domain or sub-domain
IPKEGEIDPIKGIWKSVNDY

SEQ ID NO: 8653 - protein, 20 aa, artificial
  peptide fold or domain or sub-domain
IPKGECLDEKLGIYTGVNEV

SEQ ID NO: 8654 - protein, 30 aa, artificial
  peptide fold or domain or sub-domain
IPKGFSIIASTKNCKYAAIFNKKNKFYGVQ

SEQ ID NO: 8655 - protein, 23 aa, artificial
  peptide fold or domain or sub-domain
IPKGVSQIHDLFNASSNDSIACY

SEQ ID NO: 8656 - protein, 22 aa, artificial
  peptide fold or domain or sub-domain
IPKINYTYPIKAEIADKYGIRK

SEQ ID NO: 8657 - protein, 21 aa, artificial
  peptide fold or domain or sub-domain
IPKPLESVKSADEFLEKLSDY

SEQ ID NO: 8658 - protein, 22 aa, artificial
  peptide fold or domain or sub-domain
IPLDCEEVMKISGLKESYENMV

SEQ ID NO: 8659 - protein, 21 aa, artificial
  peptide fold or domain or sub-domain
IPLEYIERMGIDNDTELSKQI

SEQ ID NO: 8660 - protein, 26 aa, artificial
  peptide fold or domain or sub-domain
IPLFYRLMDEAGERDDFYVEPIDHFN

SEQ ID NO: 8661 - protein, 25 aa, artificial
  peptide fold or domain or sub-domain
IPLGSDGWPEVDSLSGETSRRNVFL

SEQ ID NO: 8662 - protein, 24 aa, artificial
  peptide fold or domain or sub-domain
IPLLELLWGSSSHLIDQTAYTQPA

SEQ ID NO: 8663 - protein, 20 aa, artificial
  peptide fold or domain or sub-domain
IPLLHESKHSHLKCSWAQQV

SEQ ID NO: 8664 - protein, 27 aa, artificial
  peptide fold or domain or sub-domain
IPLMSRARPPEDEWDRRLLADGEMLGR

SEQ ID NO: 8665 - protein, 24 aa, artificial
  peptide fold or domain or sub-domain
IPLPDNEVKEKIKKKDFYNLFLVD

SEQ ID NO: 8666 - protein, 25 aa, artificial
  peptide fold or domain or sub-domain
IPLQHQADTKSEKQKNARPETSTHA

SEQ ID NO: 8667 - protein, 21 aa, artificial
  peptide fold or domain or sub-domain
IPLSEFQKEKDHIEGFAPELF

SEQ ID NO: 8668 - protein, 21 aa, artificial
  peptide fold or domain or sub-domain
IPLTFFSERYESAKSSISEDL

SEQ ID NO: 8669 - protein, 28 aa, artificial
  peptide fold or domain or sub-domain
IPMARLKKIVSSQKGNMMMTFDMPAFLS

SEQ ID NO: 8670 - protein, 22 aa, artificial
  peptide fold or domain or sub-domain
IPMKARRYAIPESLYREHGVQV

SEQ ID NO: 8671 - protein, 24 aa, artificial
  peptide fold or domain or sub-domain
IPNCDVTGIVATTASIVSSLAVNT

SEQ ID NO: 8672 - protein, 29 aa, artificial
  peptide fold or domain or sub-domain
IPNDQTISSVTSNIFYSQYNVKLEYAEIY

SEQ ID NO: 8673 - protein, 24 aa, artificial
  peptide fold or domain or sub-domain
IPNENDIGAELGVSRTALREAFKL

SEQ ID NO: 8674 - protein, 23 aa, artificial
  peptide fold or domain or sub-domain
IPNEVLISAFKADSKTINMLRSK

SEQ ID NO: 8675 - protein, 24 aa, artificial
  peptide fold or domain or sub-domain
IPNGATRLAALLAGDVQAIENVPT

SEQ ID NO: 8676 - protein, 30 aa, artificial
  peptide fold or domain or sub-domain
IPNGEKWIEMLKEKGAVFQSSLDSEVFLHL

SEQ ID NO: 8677 - protein, 28 aa, artificial
  peptide fold or domain or sub-domain
IPNSPSALTDINARFRQRYLDFIINNTG

SEQ ID NO: 8678 - protein, 27 aa, artificial
  peptide fold or domain or sub-domain
IPNTFVCDNDNDCEDGEDEAAEKCYSK

SEQ ID NO: 8679 - protein, 20 aa, artificial
  peptide fold or domain or sub-domain
IPPDLSAAVSAQYGSVEKFE

SEQ ID NO: 8680 - protein, 26 aa, artificial
  peptide fold or domain or sub-domain
IPPDVAMKWSDSFEDLLSHSDGVEVF

SEQ ID NO: 8681 - protein, 25 aa, artificial
  peptide fold or domain or sub-domain
IPPFNADHPQQIFDNILNRNIQWPP

SEQ ID NO: 8682 - protein, 26 aa, artificial
  peptide fold or domain or sub-domain
IPPICQLLVEVGGLAESEAYHTLNMG

SEQ ID NO: 8683 - protein, 26 aa, artificial
  peptide fold or domain or sub-domain
IPPIFSFLQEYGKLKEEDMFNVFNMG

SEQ ID NO: 8684 - protein, 30 aa, artificial
  peptide fold or domain or sub-domain
IPPIYSAIQVEGKRLYDLARKGEIIEVPAR

SEQ ID NO: 8685 - protein, 30 aa, artificial
  peptide fold or domain or sub-domain
IPPKVSSVHVNGERAYKKSFNNENFELAPR

SEQ ID NO: 8686 - protein, 26 aa, artificial
  peptide fold or domain or sub-domain
IPPLFRLIQECSNTEWSEMYKVFNCG

SEQ ID NO: 8687 - protein, 25 aa, artificial
  peptide fold or domain or sub-domain
IPPSLLNMYKELENTIPGFTRPNHG

SEQ ID NO: 8688 - protein, 25 aa, artificial
  peptide fold or domain or sub-domain
IPPSLRRILEALRDCYPSIPKETHG

SEQ ID NO: 8689 - protein, 20 aa, artificial
  peptide fold or domain or sub-domain
IPQGNEPFFGKLLDLQMLVN

SEQ ID NO: 8690 - protein, 24 aa, artificial
  peptide fold or domain or sub-domain
IPQSMPTALAPYSGAWAQGWAQVL

SEQ ID NO: 8691 - protein, 29 aa, artificial
  peptide fold or domain or sub-domain
IPQTSVAFVSQAGIDSGVVGTYGLKKRIV

SEQ ID NO: 8692 - protein, 22 aa, artificial
  peptide fold or domain or sub-domain
IPRENYLYAVPENWEKNNLVRR

SEQ ID NO: 8693 - protein, 26 aa, artificial
  peptide fold or domain or sub-domain
IPRLSQSDPRAEELIENEEPVVLTDT

SEQ ID NO: 8694 - protein, 29 aa, artificial
  peptide fold or domain or sub-domain
IPRQNMISQPSQASEVIFRDWKALGAQYV

SEQ ID NO: 8695 - protein, 27 aa, artificial
  peptide fold or domain or sub-domain
IPRQWMCDFADDCGDGSDESETQCKGK

SEQ ID NO: 8696 - protein, 21 aa, artificial
  peptide fold or domain or sub-domain
IPRRYLSGNHGPVNPDYEPVV

SEQ ID NO: 8697 - protein, 30 aa, artificial
  peptide fold or domain or sub-domain
IPSDFITVASTESCPFAIMANEEKRFYGVQ

SEQ ID NO: 8698 - protein, 29 aa, artificial
  peptide fold or domain or sub-domain
IPSDKRIRPQVSEGFFSQDGPNVQFEELY

SEQ ID NO: 8699 - protein, 23 aa, artificial
  peptide fold or domain or sub-domain
IPSDPQDAQVAKHYLTDRNSFND

SEQ ID NO: 8700 - protein, 29 aa, artificial
  peptide fold or domain or sub-domain
IPSDYFNSEVGTLRILTEDEWRGLGITQS

SEQ ID NO: 8701 - protein, 26 aa, artificial
  peptide fold or domain or sub-domain
IPSIMLELEKRGNIAREEMYGTFNMG

SEQ ID NO: 8702 - protein, 20 aa, artificial
  peptide fold or domain or sub-domain
IPSLAQAQQLNEDQIQELRD

SEQ ID NO: 8703 - protein, 25 aa, artificial
  peptide fold or domain or sub-domain
IPSLGIVKAVYEKYQRSPVPVAEMA

SEQ ID NO: 8704 - protein, 21 aa, artificial
  peptide fold or domain or sub-domain
IPSMVSFTDNDVYVGYESVEL

SEQ ID NO: 8705 - protein, 29 aa, artificial
  peptide fold or domain or sub-domain
IPSMVSFTDNDVYVGYESVELADSNPQNT

SEQ ID NO: 8706 - protein, 30 aa, artificial
  peptide fold or domain or sub-domain
IPSMYSALKYQGKKLYEYARQGIEVPREAR

SEQ ID NO: 8707 - protein, 20 aa, artificial
  peptide fold or domain or sub-domain
IPSPLEDALTQSFGTVALFK

SEQ ID NO: 8708 - protein, 21 aa, artificial
  peptide fold or domain or sub-domain
IPSSLEEIHYLNDFNLKLNEL

SEQ ID NO: 8709 - protein, 30 aa, artificial
  peptide fold or domain or sub-domain
IPSVLPADWANMGQCVKDLEEAGVDRIQFD

SEQ ID NO: 8710 - protein, 21 aa, artificial
  peptide fold or domain or sub-domain
IPSVLSYVEGEEYHGAQAKAQ

SEQ ID NO: 8711 - protein, 29 aa, artificial
  peptide fold or domain or sub-domain
IPSVLSYVEGEEYHGAQAKAQLVRNPKNT

SEQ ID NO: 8712 - protein, 29 aa, artificial
  peptide fold or domain or sub-domain
IPSVVAFTEKGRLVGEEALAQADTDPANC

SEQ ID NO: 8713 - protein, 21 aa, artificial
  peptide fold or domain or sub-domain
IPSVVSFYKSAKLVGHNALCM

SEQ ID NO: 8714 - protein, 29 aa, artificial
  peptide fold or domain or sub-domain
IPSVVSFYKSAKLVGHNALCMKDANPKNT

SEQ ID NO: 8715 - protein, 29 aa, artificial
  peptide fold or domain or sub-domain
IPSVVSIEGDEIKVGKKAKNQILLKPELT

SEQ ID NO: 8716 - protein, 24 aa, artificial
  peptide fold or domain or sub-domain
IPTCDTAGILGPAIQMVTAFQSVE

SEQ ID NO: 8717 - protein, 28 aa, artificial
  peptide fold or domain or sub-domain
IPTFKTLTEKPLKMRCEYCETIIDENEI

SEQ ID NO: 8718 - protein, 23 aa, artificial
  peptide fold or domain or sub-domain
IPTFVQSANGALVTDVDGNQYID

SEQ ID NO: 8719 - protein, 23 aa, artificial
  peptide fold or domain or sub-domain
IPTPVLTKALRVEAGVVELLKSK

SEQ ID NO: 8720 - protein, 20 aa, artificial
  peptide fold or domain or sub-domain
IPTTGIFQQWRNSKEEIAKY

SEQ ID NO: 8721 - protein, 27 aa, artificial
  peptide fold or domain or sub-domain
IPVASEKSVGKKIMYKEKSYTVVSLED

SEQ ID NO: 8722 - protein, 24 aa, artificial
  peptide fold or domain or sub-domain
IPVCSIRQIPEKPTHCIAWARMLY

SEQ ID NO: 8723 - protein, 25 aa, artificial
  peptide fold or domain or sub-domain
IPVKKAVVLYEGEKKRVQSDLKEGI

SEQ ID NO: 8724 - protein, 29 aa, artificial
  peptide fold or domain or sub-domain
IPVSQDVSDVDWAGTDAPGYYFNWTRIPN

SEQ ID NO: 8725 - protein, 27 aa, artificial
  peptide fold or domain or sub-domain
IPVSWHCDGVKDCSDNSDEDPETCSQK

SEQ ID NO: 8726 - protein, 29 aa, artificial
  peptide fold or domain or sub-domain
IPVVLIENSGRCNKNDSDEKVLPNGIAWI

SEQ ID NO: 8727 - protein, 29 aa, artificial
  peptide fold or domain or sub-domain
IPVYAMENSRRCKRNEQGQRVLIDGTPCL

SEQ ID NO: 8728 - protein, 22 aa, artificial
  peptide fold or domain or sub-domain
IPYAHLAAKTQTPLKSLRGVAR

SEQ ID NO: 8729 - protein, 23 aa, artificial
  peptide fold or domain or sub-domain
IPYEVLSKAFVISVQEVSQIRKS

SEQ ID NO: 8730 - protein, 24 aa, artificial
  peptide fold or domain or sub-domain
IPYRTVSEWLESIRMKRYILHFHS

SEQ ID NO: 8731 - protein, 27 aa, artificial
  peptide fold or domain or sub-domain
IQALSDQLTAEGRTPERAHRLATFCLS

SEQ ID NO: 8732 - protein, 24 aa, artificial
  peptide fold or domain or sub-domain
IQARFPQFAGKDLDTIKTSGQFAT

SEQ ID NO: 8733 - protein, 27 aa, artificial
  peptide fold or domain or sub-domain
IQCMGDFYYKIDNGPLFQGLDQLINYY

SEQ ID NO: 8734 - protein, 24 aa, artificial
  peptide fold or domain or sub-domain
IQCMNAAKENNPTFVQIIQDTTYE

SEQ ID NO: 8735 - protein, 21 aa, artificial
  peptide fold or domain or sub-domain
IQDASKAIEVDSRYSKGYYRR

SEQ ID NO: 8736 - protein, 30 aa, artificial
  peptide fold or domain or sub-domain
IQDFRLAYTSPFRKSYDIDVDYQYIERKIE

SEQ ID NO: 8737 - protein, 27 aa, artificial
  peptide fold or domain or sub-domain
IQDIEAQLGQCYNDKDYAAAVKLTVEL

SEQ ID NO: 8738 - protein, 22 aa, artificial
  peptide fold or domain or sub-domain
IQDLKNLDEIYGETSRHSLMGN

SEQ ID NO: 8739 - protein, 22 aa, artificial
  peptide fold or domain or sub-domain
IQDWAQLDETYGKDAAKTLLGC

SEQ ID NO: 8740 - protein, 21 aa, artificial
  peptide fold or domain or sub-domain
IQDYAHVNDFKFAILRYFNVA

SEQ ID NO: 8741 - protein, 24 aa, artificial
  peptide fold or domain or sub-domain
IQEARERWNFDFVTETPLEGDFAW

SEQ ID NO: 8742 - protein, 21 aa, artificial
  peptide fold or domain or sub-domain
IQGFRYGSDIVPFSKVDEEQM

SEQ ID NO: 8743 - protein, 26 aa, artificial
  peptide fold or domain or sub-domain
IQGLYNLKALYEDFPNYKPDITLGFG

SEQ ID NO: 8744 - protein, 26 aa, artificial
  peptide fold or domain or sub-domain
IQGYKRIMKNQEQAEQQAERILEEID

SEQ ID NO: 8745 - protein, 30 aa, artificial
  peptide fold or domain or sub-domain
IQHTRPIEDAPEYYKLFNDRKVLKTVFKMN

SEQ ID NO: 8746 - protein, 20 aa, artificial
  peptide fold or domain or sub-domain
IQIRELIEEAGLSCCRATLI

SEQ ID NO: 8747 - protein, 24 aa, artificial
  peptide fold or domain or sub-domain
IQIVLPSYADVKQSKISILAPLSV

SEQ ID NO: 8748 - protein, 24 aa, artificial
  peptide fold or domain or sub-domain
IQKFFAKFGNVAVDSLAGNVDYEK

SEQ ID NO: 8749 - protein, 28 aa, artificial
  peptide fold or domain or sub-domain
IQKIDIVPTTTTYPWSNGRSYNTFKAPR

SEQ ID NO: 8750 - protein, 21 aa, artificial
  peptide fold or domain or sub-domain
IQKIFQSGKASTILGAKKILQ

SEQ ID NO: 8751 - protein, 23 aa, artificial
  peptide fold or domain or sub-domain
IQKLDGLCKELEEKQGAHSALVR

SEQ ID NO: 8752 - protein, 25 aa, artificial
  peptide fold or domain or sub-domain
IQKNVQLYKMRNGYELSPTAAANFT

SEQ ID NO: 8753 - protein, 30 aa, artificial
  peptide fold or domain or sub-domain
IQLDLNDNVLNEFESMVQAEQETGVSRRNI

SEQ ID NO: 8754 - protein, 24 aa, artificial
  peptide fold or domain or sub-domain
IQLFTKMQGLTKDNVEASEGIKYY

SEQ ID NO: 8755 - protein, 25 aa, artificial
  peptide fold or domain or sub-domain
IQLKDLTSDDVQQLQNMLGCELQAM

SEQ ID NO: 8756 - protein, 25 aa, artificial
  peptide fold or domain or sub-domain
IQMKNNRRGEFLPVDEKQVQRIRSR

SEQ ID NO: 8757 - protein, 24 aa, artificial
  peptide fold or domain or sub-domain
IQNIADIKNYSRAIEEQGLASFRG

SEQ ID NO: 8758 - protein, 29 aa, artificial
  peptide fold or domain or sub-domain
IQNLEKNIYSNGYSYTSIEEEFRVDTFEY

SEQ ID NO: 8759 - protein, 24 aa, artificial
  peptide fold or domain or sub-domain
IQNVGPLKQYFAKIDETGFPYLDV

SEQ ID NO: 8760 - protein, 24 aa, artificial
  peptide fold or domain or sub-domain
IQNVMDPLVVVQGKARDEARAIAL

SEQ ID NO: 8761 - protein, 24 aa, artificial
  peptide fold or domain or sub-domain
IQNVMEGLTVARKIPKKIAREIAE

SEQ ID NO: 8762 - protein, 26 aa, artificial
  peptide fold or domain or sub-domain
IQPDQNQIRLIKNEPLLWVRGEYWPI

SEQ ID NO: 8763 - protein, 26 aa, artificial
  peptide fold or domain or sub-domain
IQPNAEQVKTLNGDELLNVRGHYWPV

SEQ ID NO: 8764 - protein, 27 aa, artificial
  peptide fold or domain or sub-domain
IQQAIQKKLFNRAFKTNISTLAYTNLA

SEQ ID NO: 8765 - protein, 27 aa, artificial
  peptide fold or domain or sub-domain
IQQFGSIIQAPLGSDRRKFFDLILKMQ

SEQ ID NO: 8766 - protein, 21 aa, artificial
  peptide fold or domain or sub-domain
IQQLRLQGIVFTVTAAKVLIA

SEQ ID NO: 8767 - protein, 29 aa, artificial
  peptide fold or domain or sub-domain
IQQPMVRVLELSDEAVTRMHTNNGLFDEV

SEQ ID NO: 8768 - protein, 21 aa, artificial
  peptide fold or domain or sub-domain
IQRITETGIQTDKGIEEFDLI

SEQ ID NO: 8769 - protein, 27 aa, artificial
  peptide fold or domain or sub-domain
IQRQPSGMVGIADGPQFPGPVELVNHH

SEQ ID NO: 8770 - protein, 27 aa, artificial
  peptide fold or domain or sub-domain
IQRSSIGAYFVSDRISFATLGELISYY

SEQ ID NO: 8771 - protein, 22 aa, artificial
  peptide fold or domain or sub-domain
IQSIAQLDFIYGTHEAGAIADL

SEQ ID NO: 8772 - protein, 28 aa, artificial
  peptide fold or domain or sub-domain
IQSLLGSTDSVAAIRRHEHSWRGIPVLA

SEQ ID NO: 8773 - protein, 22 aa, artificial
  peptide fold or domain or sub-domain
IQSLSALTGTYDDAGKQNFLSN

SEQ ID NO: 8774 - protein, 29 aa, artificial
  peptide fold or domain or sub-domain
IQSMDDLVVHYRLGRTPKTAILRKVSVKS

SEQ ID NO: 8775 - protein, 26 aa, artificial
  peptide fold or domain or sub-domain
IQSMPRQVVAATCGIRGNEAEQLIGS

SEQ ID NO: 8776 - protein, 23 aa, artificial
  peptide fold or domain or sub-domain
IQSRRQQAEKAGVPPDLVEDLLR

SEQ ID NO: 8777 - protein, 22 aa, artificial
  peptide fold or domain or sub-domain
IQSRSQLRNVYGEHGADEIVSN

SEQ ID NO: 8778 - protein, 20 aa, artificial
  peptide fold or domain or sub-domain
IQSVRRHTNSMLEGTKNRHP

SEQ ID NO: 8779 - protein, 26 aa, artificial
  peptide fold or domain or sub-domain
IQTRRLKLWEDSFEELLADSLGRETL

SEQ ID NO: 8780 - protein, 25 aa, artificial
  peptide fold or domain or sub-domain
IQTVPAHTGVSYGHRYVTSRPSRIA

SEQ ID NO: 8781 - protein, 30 aa, artificial
  peptide fold or domain or sub-domain
IQVDEKTVGEPGWLYGSFQGNFGWFPCNYV

SEQ ID NO: 8782 - protein, 29 aa, artificial
  peptide fold or domain or sub-domain
IQVIQKNKKKGWWYGICKNQTGYFPCNYV

SEQ ID NO: 8783 - protein, 29 aa, artificial
  peptide fold or domain or sub-domain
IQVLNQLETGWWDGVINNSVRGWFPSNYC

SEQ ID NO: 8784 - protein, 22 aa, artificial
  peptide fold or domain or sub-domain
IQVLQSKHPGDFGADAQGAMNK

SEQ ID NO: 8785 - protein, 21 aa, artificial
  peptide fold or domain or sub-domain
IQWLQEHEYAENVKVAEKMIL

SEQ ID NO: 8786 - protein, 24 aa, artificial
  peptide fold or domain or sub-domain
IQYDRGKDVENGDFEQTGALPPPP

SEQ ID NO: 8787 - protein, 21 aa, artificial
  peptide fold or domain or sub-domain
IQYILQNKLAQTVVGAKNLLK

SEQ ID NO: 8788 - protein, 21 aa, artificial
  peptide fold or domain or sub-domain
IQYLISFNLTKTIPGAKHIIH

SEQ ID NO: 8789 - protein, 28 aa, artificial
  peptide fold or domain or sub-domain
IQYNTKEAAKELTAERCLEIFKKIRDED

SEQ ID NO: 8790 - protein, 28 aa, artificial
  peptide fold or domain or sub-domain
IRAAAYTKDFASKDSKKRQIAVATYLID

SEQ ID NO: 8791 - protein, 25 aa, artificial
  peptide fold or domain or sub-domain
IRAELLAKFAATYPEIGELKPVFDI

SEQ ID NO: 8792 - protein, 21 aa, artificial
  peptide fold or domain or sub-domain
IRAIARAMGYQNASSIQRYFS

SEQ ID NO: 8793 - protein, 21 aa, artificial
  peptide fold or domain or sub-domain
IRALLEESGVKNIRAAKNLLQ

SEQ ID NO: 8794 - protein, 26 aa, artificial
  peptide fold or domain or sub-domain
IRALPDDVLANAFQISREEARRLKYN

SEQ ID NO: 8795 - protein, 27 aa, artificial
  peptide fold or domain or sub-domain
IRAMLETDGEEGTARIARLPDYRIGAK

SEQ ID NO: 8796 - protein, 24 aa, artificial
  peptide fold or domain or sub-domain
IRAPHILEAGENVEVLSEHNGRIV

SEQ ID NO: 8797 - protein, 28 aa, artificial
  peptide fold or domain or sub-domain
IRARVARDLARKGMPREKVIAAVVHLLD

SEQ ID NO: 8798 - protein, 21 aa, artificial
  peptide fold or domain or sub-domain
IRCYQKALSIRPNYIDAHFGF

SEQ ID NO: 8799 - protein, 26 aa, artificial
  peptide fold or domain or sub-domain
IRDAHHYGWEVAQPVQHNWKTMAEAV

SEQ ID NO: 8800 - protein, 25 aa, artificial
  peptide fold or domain or sub-domain
IRDFSSLVDKKLENRKGTFKAAQEC

SEQ ID NO: 8801 - protein, 30 aa, artificial
  peptide fold or domain or sub-domain
IRDHIARGTEFGVRAQSFLNKGEHVPDSIL

SEQ ID NO: 8802 - protein, 26 aa, artificial
  peptide fold or domain or sub-domain
IRDQTERQIRIVKGDISDADMRRMVD

SEQ ID NO: 8803 - protein, 21 aa, artificial
  peptide fold or domain or sub-domain
IRDRDGNDDNIAVKCFDHGGS

SEQ ID NO: 8804 - protein, 26 aa, artificial
  peptide fold or domain or sub-domain
IRDVLLEDVAQRNIPLSHKKLRRAMK

SEQ ID NO: 8805 - protein, 25 aa, artificial
  peptide fold or domain or sub-domain
IREAETNRIQRWEFFGGDLQGIIEK

SEQ ID NO: 8806 - protein, 26 aa, artificial
  peptide fold or domain or sub-domain
IREAMVNDIRRRGLEISVKTLKRCLA

SEQ ID NO: 8807 - protein, 23 aa, artificial
  peptide fold or domain or sub-domain
IREAVLERAFGLTPAELRRLEKR

SEQ ID NO: 8808 - protein, 27 aa, artificial
  peptide fold or domain or sub-domain
IREDALIPYIMENPACAEIAYKLASKG

SEQ ID NO: 8809 - protein, 21 aa, artificial
  peptide fold or domain or sub-domain
IREIAKQMKIKSTSTIFHHLR

SEQ ID NO: 8810 - protein, 21 aa, artificial
  peptide fold or domain or sub-domain
IREIQDGLRISSTSVVAYNLR

SEQ ID NO: 8811 - protein, 28 aa, artificial
  peptide fold or domain or sub-domain
IREKLHSDLQLCWLVDVMEIISVDDAEA

SEQ ID NO: 8812 - protein, 26 aa, artificial
  peptide fold or domain or sub-domain
IRELAKAISLRHKGVVASSQRFYHLT

SEQ ID NO: 8813 - protein, 26 aa, artificial
  peptide fold or domain or sub-domain
IRELHRAVGQQTSSPVQCWKRFYQLT

SEQ ID NO: 8814 - protein, 21 aa, artificial
  peptide fold or domain or sub-domain
IRELMEALDLKYPNLVYHHIE

SEQ ID NO: 8815 - protein, 21 aa, artificial
  peptide fold or domain or sub-domain
IREMINQGLASNMKIARNLIE

SEQ ID NO: 8816 - protein, 25 aa, artificial
  peptide fold or domain or sub-domain
IREPIMWLAEKITGNRKTYGLGIIG

SEQ ID NO: 8817 - protein, 27 aa, artificial
  peptide fold or domain or sub-domain
IRESLHDVVLRGTAQNKGLEVYKAAGK

SEQ ID NO: 8818 - protein, 29 aa, artificial
  peptide fold or domain or sub-domain
IREWLPFSEYYAVRSSAVGEDGADLSSAG

SEQ ID NO: 8819 - protein, 21 aa, artificial
  peptide fold or domain or sub-domain
IRFNGRTLPMFPKFDDSAFSR

SEQ ID NO: 8820 - protein, 21 aa, artificial
  peptide fold or domain or sub-domain
IRFSEDANLAKEFGVEGQFAQ

SEQ ID NO: 8821 - protein, 25 aa, artificial
  peptide fold or domain or sub-domain
IRFSKGDDDQRFNKDVLDKSEMAHV

SEQ ID NO: 8822 - protein, 21 aa, artificial
  peptide fold or domain or sub-domain
IRGLIRQHLASNIGVAKSQIR

SEQ ID NO: 8823 - protein, 26 aa, artificial
  peptide fold or domain or sub-domain
IRGLLELGILRGSEDELFDKRISVAF

SEQ ID NO: 8824 - protein, 21 aa, artificial
  peptide fold or domain or sub-domain
IRGYPYGPQIVPLSTSHWDAF

SEQ ID NO: 8825 - protein, 24 aa, artificial
  peptide fold or domain or sub-domain
IRHAIEKFEKTDSGKERSKNADYI

SEQ ID NO: 8826 - protein, 29 aa, artificial
  peptide fold or domain or sub-domain
IRHYCKKTPTKLRISEALSGSKFGANIKV

SEQ ID NO: 8827 - protein, 29 aa, artificial
  peptide fold or domain or sub-domain
IRIAGLSDPDADFMINIANGGGVYDQKEI

SEQ ID NO: 8828 - protein, 29 aa, artificial
  peptide fold or domain or sub-domain
IRIHELKEPTSLGLVYLNEYGAASAALVL

SEQ ID NO: 8829 - protein, 26 aa, artificial
  peptide fold or domain or sub-domain
IRIKREDIQSLQGKDVLNYRNQIIEV

SEQ ID NO: 8830 - protein, 30 aa, artificial
  peptide fold or domain or sub-domain
IRKEIAEGTPLGREMQAYLARGDLIPDTIV

SEQ ID NO: 8831 - protein, 28 aa, artificial
  peptide fold or domain or sub-domain
IRKHFQHEEQAMLKHHYPGMEAHIKAHR

SEQ ID NO: 8832 - protein, 21 aa, artificial
  peptide fold or domain or sub-domain
IRKIKEVVQPKAYNPTTEAND

SEQ ID NO: 8833 - protein, 25 aa, artificial
  peptide fold or domain or sub-domain
IRKIKQGGSVGYSRAFTATRDSLIA

SEQ ID NO: 8834 - protein, 28 aa, artificial
  peptide fold or domain or sub-domain
IRKRLENDLNQDGMPKTKCLALVLSIMD

SEQ ID NO: 8835 - protein, 23 aa, artificial
  peptide fold or domain or sub-domain
IRKRPLELTDEIACQIDPKAGSL

SEQ ID NO: 8836 - protein, 29 aa, artificial
  peptide fold or domain or sub-domain
IRKTAMKKARTPAQGGDETTYLNGFLDAR

SEQ ID NO: 8837 - protein, 28 aa, artificial
  peptide fold or domain or sub-domain
IRKYYAPAVWSDWPHPLKERDPQALHEF

SEQ ID NO: 8838 - protein, 20 aa, artificial
  peptide fold or domain or sub-domain
IRLLGRAAEIEGPRGLNNDI

SEQ ID NO: 8839 - protein, 23 aa, artificial
  peptide fold or domain or sub-domain
IRLLGRAAEIEGPRGLNNDILVR

SEQ ID NO: 8840 - protein, 28 aa, artificial
  peptide fold or domain or sub-domain
IRLLGRAAEIEGPRGLNNDILVRAYEAT

SEQ ID NO: 8841 - protein, 23 aa, artificial
  peptide fold or domain or sub-domain
IRLSELAEVVGLSIPSVSERLDK

SEQ ID NO: 8842 - protein, 27 aa, artificial
  peptide fold or domain or sub-domain
IRLSSFKREHSLRELLSKDMSEYWATD

SEQ ID NO: 8843 - protein, 27 aa, artificial
  peptide fold or domain or sub-domain
IRNDLYDVVHAGYSLPAEIPEIKVAGK

SEQ ID NO: 8844 - protein, 27 aa, artificial
  peptide fold or domain or sub-domain
IRNLDNGGFYISPRITFPGLHELVRHY

SEQ ID NO: 8845 - protein, 26 aa, artificial
  peptide fold or domain or sub-domain
IRNWSWFDKTKPAETWPSAWEKAQNY

SEQ ID NO: 8846 - protein, 22 aa, artificial
  peptide fold or domain or sub-domain
IRPEINPLSSSGISVDDFNVFA

SEQ ID NO: 8847 - protein, 22 aa, artificial
  peptide fold or domain or sub-domain
IRPESSWLSKDNTDGALMYNCV

SEQ ID NO: 8848 - protein, 28 aa, artificial
  peptide fold or domain or sub-domain
IRPQKYGDSKIVPSYLGKQEKAVSMPFS

SEQ ID NO: 8849 - protein, 22 aa, artificial
  peptide fold or domain or sub-domain
IRPTYYHTYDGSIKNNVRVEEA

SEQ ID NO: 8850 - protein, 23 aa, artificial
  peptide fold or domain or sub-domain
IRQFATRYAKKFGVDKAKMMDRL

SEQ ID NO: 8851 - protein, 30 aa, artificial
  peptide fold or domain or sub-domain
IRQGSDEQNAKSGRYSVNFKKAAKSVALTI

SEQ ID NO: 8852 - protein, 25 aa, artificial
  peptide fold or domain or sub-domain
IRQIPRQVSDLTFPGSGEEVEELLE

SEQ ID NO: 8853 - protein, 26 aa, artificial
  peptide fold or domain or sub-domain
IRQIPRQVSDLTFPGSGEEVEELLEN

SEQ ID NO: 8854 - protein, 25 aa, artificial
  peptide fold or domain or sub-domain
IRQLDRAVNELTFPGSAEDIERLIK

SEQ ID NO: 8855 - protein, 21 aa, artificial
  peptide fold or domain or sub-domain
IRQLRTNKIAATIVGAKKLIR

SEQ ID NO: 8856 - protein, 21 aa, artificial
  peptide fold or domain or sub-domain
IRQMMRAMNLRSPAPIQSRLE

SEQ ID NO: 8857 - protein, 23 aa, artificial
  peptide fold or domain or sub-domain
IRQSVADVREREYEEGGVGDSYL

SEQ ID NO: 8858 - protein, 28 aa, artificial
  peptide fold or domain or sub-domain
IRRFQRDNGLPVTGAVDNQTAARLASAV

SEQ ID NO: 8859 - protein, 24 aa, artificial
  peptide fold or domain or sub-domain
IRRIIQTGIERGEIEPHVNAEEIA

SEQ ID NO: 8860 - protein, 28 aa, artificial
  peptide fold or domain or sub-domain
IRRKVSAFLSGDEPTREFALSAVIELIA

SEQ ID NO: 8861 - protein, 27 aa, artificial
  peptide fold or domain or sub-domain
IRRLTDDRKRESTKMAEAIRNFVNTFI

SEQ ID NO: 8862 - protein, 21 aa, artificial
  peptide fold or domain or sub-domain
IRRLVERGIAKSVKSAKKLID

SEQ ID NO: 8863 - protein, 28 aa, artificial
  peptide fold or domain or sub-domain
IRRRAMADIGKQDHGQEMTLAALTLLLD

SEQ ID NO: 8864 - protein, 27 aa, artificial
  peptide fold or domain or sub-domain
IRRSEEVLEQAFKEDDIAGAKEEAVKL

SEQ ID NO: 8865 - protein, 25 aa, artificial
  peptide fold or domain or sub-domain
IRRVPAGQGVGYGSTFTTRKPSLLA

SEQ ID NO: 8866 - protein, 20 aa, artificial
  peptide fold or domain or sub-domain
IRSLRPDLSNQEVMDIMKKT

SEQ ID NO: 8867 - protein, 21 aa, artificial
  peptide fold or domain or sub-domain
IRSSIGRHVAPSTGAAKPPIR

SEQ ID NO: 8868 - protein, 25 aa, artificial
  peptide fold or domain or sub-domain
IRSVKKGEFIGYGEHFYTNEETLVG

SEQ ID NO: 8869 - protein, 26 aa, artificial
  peptide fold or domain or sub-domain
IRTDIAKKLGITTISDLQKHASELRF

SEQ ID NO: 8870 - protein, 25 aa, artificial
  peptide fold or domain or sub-domain
IRVFLTFDARIPMGLKWHLKEVELQ

SEQ ID NO: 8871 - protein, 29 aa, artificial
  peptide fold or domain or sub-domain
IRVSQAGAQKLGRIASLLAHGEGLTAHAR

SEQ ID NO: 8872 - protein, 30 aa, artificial
  peptide fold or domain or sub-domain
IRVVKRTGTDQDWWLGELGGTQGNFPANYC

SEQ ID NO: 8873 - protein, 26 aa, artificial
  peptide fold or domain or sub-domain
IRWVKQDGTLPLNRNTMLQDSSLRIS

SEQ ID NO: 8874 - protein, 26 aa, artificial
  peptide fold or domain or sub-domain
ISAAINCAPTERAAQNLINEKVSRDT

SEQ ID NO: 8875 - protein, 23 aa, artificial
  peptide fold or domain or sub-domain
ISAAQARADEFKLNPDDVQRLFR

SEQ ID NO: 8876 - protein, 29 aa, artificial
  peptide fold or domain or sub-domain
ISADGKKIAFERDFGIWIFDLTSGDMAPI

SEQ ID NO: 8877 - protein, 29 aa, artificial
  peptide fold or domain or sub-domain
ISAHELQVVLGKLGLTEGNEIARVQQMIG

SEQ ID NO: 8878 - protein, 21 aa, artificial
  peptide fold or domain or sub-domain
ISAKYGNKAVWIYPPVPATGI

SEQ ID NO: 8879 - protein, 23 aa, artificial
  peptide fold or domain or sub-domain
ISALIQAESEGTQLSTEELYSMI

SEQ ID NO: 8880 - protein, 23 aa, artificial
  peptide fold or domain or sub-domain
ISALITTEDPDGVVDDMFLMNAA

SEQ ID NO: 8881 - protein, 26 aa, artificial
  peptide fold or domain or sub-domain
ISAMPELVEAVQKRDLARIKALIDPM

SEQ ID NO: 8882 - protein, 23 aa, artificial
  peptide fold or domain or sub-domain
ISANVQQDTLKSVFNTTDLTEIK

SEQ ID NO: 8883 - protein, 27 aa, artificial
  peptide fold or domain or sub-domain
ISASFECDGEPDCIDESDENACDRPMQ

SEQ ID NO: 8884 - protein, 20 aa, artificial
  peptide fold or domain or sub-domain
ISAVAATNLGEKQPELLNQY

SEQ ID NO: 8885 - protein, 24 aa, artificial
  peptide fold or domain or sub-domain
ISAVIEQGQEAGALNREMDPNALA

SEQ ID NO: 8886 - protein, 30 aa, artificial
  peptide fold or domain or sub-domain
ISAVYSLDQINDGFAALKSGQNIRGIIRFE

SEQ ID NO: 8887 - protein, 30 aa, artificial
  peptide fold or domain or sub-domain
ISAWRVSENHPEQLSDETIGHFSNSHSYII

SEQ ID NO: 8888 - protein, 21 aa, artificial
  peptide fold or domain or sub-domain
ISDAAYDILKEHGFFCLQYLR

SEQ ID NO: 8889 - protein, 21 aa, artificial
  peptide fold or domain or sub-domain
ISDAERCVEIDPNFVKGYYRQ

SEQ ID NO: 8890 - protein, 23 aa, artificial
  peptide fold or domain or sub-domain
ISDAQCEQRLWDMKHKGMKDFYM

SEQ ID NO: 8891 - protein, 21 aa, artificial
  peptide fold or domain or sub-domain
ISDECRAYPLGAVSLRYFNVA

SEQ ID NO: 8892 - protein, 25 aa, artificial
  peptide fold or domain or sub-domain
ISDEDFYLVGTKQKTFQEVLQQEKA

SEQ ID NO: 8893 - protein, 29 aa, artificial
  peptide fold or domain or sub-domain
ISDEQIFELAIESGADECISNDEFHEIQC

SEQ ID NO: 8894 - protein, 22 aa, artificial
  peptide fold or domain or sub-domain
ISDFSLAQDIKVSKKEAKEYID

SEQ ID NO: 8895 - protein, 30 aa, artificial
  peptide fold or domain or sub-domain
ISDKQSMLAVRDLLSREGILAGSSSGTLLS

SEQ ID NO: 8896 - protein, 30 aa, artificial
  peptide fold or domain or sub-domain
ISDLECVVACRRLIGREAVLAGGSSGATVA

SEQ ID NO: 8897 - protein, 20 aa, artificial
  peptide fold or domain or sub-domain
ISDPNHPNYDYLTHYLCAIG

SEQ ID NO: 8898 - protein, 30 aa, artificial
  peptide fold or domain or sub-domain
ISDQEGLRKSISCFKKRDCLLGCRRGSISA

SEQ ID NO: 8899 - protein, 26 aa, artificial
  peptide fold or domain or sub-domain
ISDRAKSQIKLIYPNMKDDEVDKIVE

SEQ ID NO: 8900 - protein, 25 aa, artificial
  peptide fold or domain or sub-domain
ISDRDMIRIALGQLSPQVAFMKGKV

SEQ ID NO: 8901 - protein, 22 aa, artificial
  peptide fold or domain or sub-domain
ISDYGLSQNLGITRKEAGAFID

SEQ ID NO: 8902 - protein, 26 aa, artificial
  peptide fold or domain or sub-domain
ISEAINLHGGVGVIRETGVERFLRSV

SEQ ID NO: 8903 - protein, 29 aa, artificial
  peptide fold or domain or sub-domain
ISEDELVDVAVGGGAEDVINEGDVYRVIS

SEQ ID NO: 8904 - protein, 22 aa, artificial
  peptide fold or domain or sub-domain
ISEGELCGDVITCPRHEAQFSI

SEQ ID NO: 8905 - protein, 20 aa, artificial
  peptide fold or domain or sub-domain
ISEKVKNNLLKGKENGMLCY

SEQ ID NO: 8906 - protein, 23 aa, artificial
  peptide fold or domain or sub-domain
ISELIAISDGDSTLTEREIIALS

SEQ ID NO: 8907 - protein, 23 aa, artificial
  peptide fold or domain or sub-domain
ISEMIQARNGEDVFADEEVMMNA

SEQ ID NO: 8908 - protein, 25 aa, artificial
  peptide fold or domain or sub-domain
ISEMQENGQIDLLTKKEALMLSRQK

SEQ ID NO: 8909 - protein, 28 aa, artificial
  peptide fold or domain or sub-domain
ISEQEERRPWWEWPEPLRTRQPEALAQK

SEQ ID NO: 8910 - protein, 24 aa, artificial
  peptide fold or domain or sub-domain
ISEQTIQQTAQKGVPLAPKKDWIA

SEQ ID NO: 8911 - protein, 28 aa, artificial
  peptide fold or domain or sub-domain
ISESGIQDESTIKRLIEQGFNGVLVGEF

SEQ ID NO: 8912 - protein, 23 aa, artificial
  peptide fold or domain or sub-domain
ISESMVFYLMQRGLDEAAAKSLI

SEQ ID NO: 8913 - protein, 28 aa, artificial
  peptide fold or domain or sub-domain
ISESSISSAVEARRAGKGGADAVLVGTA

SEQ ID NO: 8914 - protein, 29 aa, artificial
  peptide fold or domain or sub-domain
ISFAEGYREITSHPYGILKGVVDNNAFRK

SEQ ID NO: 8915 - protein, 28 aa, artificial
  peptide fold or domain or sub-domain
ISFCPNDAIDEVKDVCDYVLSKKGGEGT

SEQ ID NO: 8916 - protein, 23 aa, artificial
  peptide fold or domain or sub-domain
ISFDEINLLKSKGIKKKDCYNIL

SEQ ID NO: 8917 - protein, 28 aa, artificial
  peptide fold or domain or sub-domain
ISFNFGPFKIDLVKHEFFSNDEKIYLTP

SEQ ID NO: 8918 - protein, 30 aa, artificial
  peptide fold or domain or sub-domain
ISFQGTLYGKPKDRQDAYEMLRQLSGQTHQ

SEQ ID NO: 8919 - protein, 24 aa, artificial
  peptide fold or domain or sub-domain
ISFTYDNPDELIVKSEYSDFKMKT

SEQ ID NO: 8920 - protein, 30 aa, artificial
  peptide fold or domain or sub-domain
ISGCGACSECHAGHQQVCHNQQQPGFTHWG

SEQ ID NO: 8921 - protein, 20 aa, artificial
  peptide fold or domain or sub-domain
ISGDELVPAGLERRAGAIWE

SEQ ID NO: 8922 - protein, 25 aa, artificial
  peptide fold or domain or sub-domain
ISGEVQSYGVLFEAAVGADSHDALS

SEQ ID NO: 8923 - protein, 24 aa, artificial
  peptide fold or domain or sub-domain
ISGIVKKGQEMGIFRPEVLPGVFK

SEQ ID NO: 8924 - protein, 20 aa, artificial
  peptide fold or domain or sub-domain
ISGKVGRQLENHFRIALRAR

SEQ ID NO: 8925 - protein, 23 aa, artificial
  peptide fold or domain or sub-domain
ISGLIRASDHGEHLTENEAAAMC

SEQ ID NO: 8926 - protein, 26 aa, artificial
  peptide fold or domain or sub-domain
ISGLYDLEPIRLCYLNRVVGLNEADV

SEQ ID NO: 8927 - protein, 20 aa, artificial
  peptide fold or domain or sub-domain
ISGQKISDALGCSRTAVWKH

SEQ ID NO: 8928 - protein, 24 aa, artificial
  peptide fold or domain or sub-domain
ISGSCSHCLQCLGGDANLCPSLEA

SEQ ID NO: 8929 - protein, 20 aa, artificial
  peptide fold or domain or sub-domain
ISGSELAQRLEIHPRTVRRY

SEQ ID NO: 8930 - protein, 23 aa, artificial
  peptide fold or domain or sub-domain
ISHAATMTHAGMAPEARAAAGIS

SEQ ID NO: 8931 - protein, 24 aa, artificial
  peptide fold or domain or sub-domain
ISHFSRLEGHTIENVMQSDGIKHY

SEQ ID NO: 8932 - protein, 30 aa, artificial
  peptide fold or domain or sub-domain
ISHRFELENMLEAVELARKQEIIKGVLIMP

SEQ ID NO: 8933 - protein, 30 aa, artificial
  peptide fold or domain or sub-domain
ISHRGGCRENVENTMQAFQHAYDLGTDCLE

SEQ ID NO: 8934 - protein, 28 aa, artificial
  peptide fold or domain or sub-domain
ISIARKEKDLKTIREYLLYCLDLNNDSV

SEQ ID NO: 8935 - protein, 25 aa, artificial
  peptide fold or domain or sub-domain
ISIDALKKMFGNGTKTLYQIYQEIF

SEQ ID NO: 8936 - protein, 29 aa, artificial
  peptide fold or domain or sub-domain
ISIDGRELIYRRGGSLFMRQIMLSADNTI

SEQ ID NO: 8937 - protein, 26 aa, artificial
  peptide fold or domain or sub-domain
ISIEDHNVQVFDQVIKSGLECRNTFF

SEQ ID NO: 8938 - protein, 21 aa, artificial
  peptide fold or domain or sub-domain
ISIEEAQELNPLVNFDGIRCV

SEQ ID NO: 8939 - protein, 25 aa, artificial
  peptide fold or domain or sub-domain
ISISGLFSPLLEDRLQVAMQMKQAC

SEQ ID NO: 8940 - protein, 30 aa, artificial
  peptide fold or domain or sub-domain
ISISSIKDKNEDGRFTVFLNKSAKHLSLHI

SEQ ID NO: 8941 - protein, 22 aa, artificial
  peptide fold or domain or sub-domain
ISITEGIERGIVDSITGQRLLE

SEQ ID NO: 8942 - protein, 20 aa, artificial
  peptide fold or domain or sub-domain
ISKAQKQKIRDGKEQALFLK

SEQ ID NO: 8943 - protein, 22 aa, artificial
  peptide fold or domain or sub-domain
ISKDALDKYQLERDIAGTVKKQ

SEQ ID NO: 8944 - protein, 21 aa, artificial
  peptide fold or domain or sub-domain
ISKFTNMMMIGGNKVLARSLM

SEQ ID NO: 8945 - protein, 21 aa, artificial
  peptide fold or domain or sub-domain
ISKGQLAGLLGTIPETLSRIF

SEQ ID NO: 8946 - protein, 21 aa, artificial
  peptide fold or domain or sub-domain
ISKKFLKKNIKKEIFNISISV

SEQ ID NO: 8947 - protein, 23 aa, artificial
  peptide fold or domain or sub-domain
ISKLCTEQVKPGNIDKSDAVQIA

SEQ ID NO: 8948 - protein, 21 aa, artificial
  peptide fold or domain or sub-domain
ISKLINVLMKKGNKSKIEKIV

SEQ ID NO: 8949 - protein, 23 aa, artificial
  peptide fold or domain or sub-domain
ISKLIYKNKKNNTYLANILASDL

SEQ ID NO: 8950 - protein, 28 aa, artificial
  peptide fold or domain or sub-domain
ISKLKQEKVIVYKNSCFYVQNLDYLKRY

SEQ ID NO: 8951 - protein, 23 aa, artificial
  peptide fold or domain or sub-domain
ISKLVELEATGDALSESELLATA

SEQ ID NO: 8952 - protein, 27 aa, artificial
  peptide fold or domain or sub-domain
ISKRFVCDGYEDCAKGEDEDNCPTQKQ

SEQ ID NO: 8953 - protein, 27 aa, artificial
  peptide fold or domain or sub-domain
ISKSINGSIEFFPVAENHHTNGILATS

SEQ ID NO: 8954 - protein, 24 aa, artificial
  peptide fold or domain or sub-domain
ISLARKKAARAQSQAEFKLGVVER

SEQ ID NO: 8955 - protein, 22 aa, artificial
  peptide fold or domain or sub-domain
ISLEQGKTLAQSQAEVLRGCDL

SEQ ID NO: 8956 - protein, 22 aa, artificial
  peptide fold or domain or sub-domain
ISLFEGYQYGEEFGKINPLRKF

SEQ ID NO: 8957 - protein, 27 aa, artificial
  peptide fold or domain or sub-domain
ISLIWKCDGMDDCGDYSDEANCENPTE

SEQ ID NO: 8958 - protein, 21 aa, artificial
  peptide fold or domain or sub-domain
ISLLIRWIGDDVDRPGLIGTP

SEQ ID NO: 8959 - protein, 23 aa, artificial
  peptide fold or domain or sub-domain
ISLPFNSSQAGFTHQQRVDMGIL

SEQ ID NO: 8960 - protein, 26 aa, artificial
  peptide fold or domain or sub-domain
ISLQEFEKALVAFGYRLSQPFVTVLY

SEQ ID NO: 8961 - protein, 27 aa, artificial
  peptide fold or domain or sub-domain
ISLQEFEKALVAFGYRLSQPFVTVLYT

SEQ ID NO: 8962 - protein, 23 aa, artificial
  peptide fold or domain or sub-domain
ISLSETKLEKVTEEFPELVVKFT

SEQ ID NO: 8963 - protein, 22 aa, artificial
  peptide fold or domain or sub-domain
ISLSNLVSILQVPSSKIGNVRR

SEQ ID NO: 8964 - protein, 22 aa, artificial
  peptide fold or domain or sub-domain
ISLTGPDLQRQRQALLAEGVMV

SEQ ID NO: 8965 - protein, 24 aa, artificial
  peptide fold or domain or sub-domain
ISLTYEEVVPCIAQGKLSYLFEYD

SEQ ID NO: 8966 - protein, 28 aa, artificial
  peptide fold or domain or sub-domain
ISLVDLLHDTGFEPSKGAAKRLIQGNGC

SEQ ID NO: 8967 - protein, 29 aa, artificial
  peptide fold or domain or sub-domain
ISLYDFQKFLQMDQKESWASDLSLVRDFL

SEQ ID NO: 8968 - protein, 24 aa, artificial
  peptide fold or domain or sub-domain
ISMEFEEGRVRIKLIGKSVRSIVV

SEQ ID NO: 8969 - protein, 20 aa, artificial
  peptide fold or domain or sub-domain
ISMLHTAMCAAVKHPTNEQA

SEQ ID NO: 8970 - protein, 23 aa, artificial
  peptide fold or domain or sub-domain
ISMPCRMSHASIDAKTRQERAMP

SEQ ID NO: 8971 - protein, 25 aa, artificial
  peptide fold or domain or sub-domain
ISMQGIYEDYCRRVGINKDDPVLFT

SEQ ID NO: 8972 - protein, 29 aa, artificial
  peptide fold or domain or sub-domain
ISMVQLAKDFGVAPGLIHYYLGGRDQLVS

SEQ ID NO: 8973 - protein, 23 aa, artificial
  peptide fold or domain or sub-domain
ISNEELERRLQHKVAQKDENYYF

SEQ ID NO: 8974 - protein, 25 aa, artificial
  peptide fold or domain or sub-domain
ISNELFDSAMAAGKMEFSAEFSAPL

SEQ ID NO: 8975 - protein, 23 aa, artificial
  peptide fold or domain or sub-domain
ISNLNLSKKIGLSPSACLARTKN

SEQ ID NO: 8976 - protein, 30 aa, artificial
  peptide fold or domain or sub-domain
ISNQAELKQELLNNGSLFQTAIDTEIILKL

SEQ ID NO: 8977 - protein, 23 aa, artificial
  peptide fold or domain or sub-domain
ISNQQLADQVGLSSAACWRRVKA

SEQ ID NO: 8978 - protein, 29 aa, artificial
  peptide fold or domain or sub-domain
ISNSGKGMTDSNGTAIASLTGTLAGTHMI

SEQ ID NO: 8979 - protein, 23 aa, artificial
  peptide fold or domain or sub-domain
ISNSKLAEEVSLSATAVLARVQK

SEQ ID NO: 8980 - protein, 30 aa, artificial
  peptide fold or domain or sub-domain
ISNYEELKDKVLLNGHRLTSRSDFEVVAHV

SEQ ID NO: 8981 - protein, 28 aa, artificial
  peptide fold or domain or sub-domain
ISPAECLLAGSGSLTGSWEEEWLRQQNI

SEQ ID NO: 8982 - protein, 22 aa, artificial
  peptide fold or domain or sub-domain
ISPDKNIPSTEWFWLNYNMTSR

SEQ ID NO: 8983 - protein, 28 aa, artificial
  peptide fold or domain or sub-domain
ISPDKNIPSTEWFWLNYNMTSRIYDAIS

SEQ ID NO: 8984 - protein, 28 aa, artificial
  peptide fold or domain or sub-domain
ISPEAAERLEEVVTKDDVRALIDQGLIW

SEQ ID NO: 8985 - protein, 20 aa, artificial
  peptide fold or domain or sub-domain
ISPEGCAAILWNDPAKSEAA

SEQ ID NO: 8986 - protein, 22 aa, artificial
  peptide fold or domain or sub-domain
ISPERRTYAIPAEWTREMQIQK

SEQ ID NO: 8987 - protein, 22 aa, artificial
  peptide fold or domain or sub-domain
ISPFGLSKKLNISIKKSKNLIY

SEQ ID NO: 8988 - protein, 21 aa, artificial
  peptide fold or domain or sub-domain
ISPKKVAELHHLLNVHDLVGA

SEQ ID NO: 8989 - protein, 26 aa, artificial
  peptide fold or domain or sub-domain
ISPNWQALMTRQLALGDFKKLCHQVE

SEQ ID NO: 8990 - protein, 23 aa, artificial
  peptide fold or domain or sub-domain
ISPPKEKHITEHSILYKIITEEK

SEQ ID NO: 8991 - protein, 21 aa, artificial
  peptide fold or domain or sub-domain
ISPREAQERFPIGDFSNTLAA

SEQ ID NO: 8992 - protein, 22 aa, artificial
  peptide fold or domain or sub-domain
ISPWGLAQRMRMPVDEAQDIIK

SEQ ID NO: 8993 - protein, 27 aa, artificial
  peptide fold or domain or sub-domain
ISQDSRGLFYITEAHRFPTVVQLIEHH

SEQ ID NO: 8994 - protein, 21 aa, artificial
  peptide fold or domain or sub-domain
ISQEQLGVFVGAARESVNRQL

SEQ ID NO: 8995 - protein, 25 aa, artificial
  peptide fold or domain or sub-domain
ISQIPSQVQELAFPRSAKDIENLIK

SEQ ID NO: 8996 - protein, 26 aa, artificial
  peptide fold or domain or sub-domain
ISQIPSQVQELAFPRSAKDIENLIKS

SEQ ID NO: 8997 - protein, 22 aa, artificial
  peptide fold or domain or sub-domain
ISQLGENGVKFDDGLYSGSKSS

SEQ ID NO: 8998 - protein, 23 aa, artificial
  peptide fold or domain or sub-domain
ISQLINAEEGGDKLTEKELYGVV

SEQ ID NO: 8999 - protein, 27 aa, artificial
  peptide fold or domain or sub-domain
ISQYDVCNGEKNCPDGSDETALTCVSQ

SEQ ID NO: 9000 - protein, 22 aa, artificial
  peptide fold or domain or sub-domain
ISQYGLAKQINVSNHEADEFLN

SEQ ID NO: 9001 - protein, 23 aa, artificial
  peptide fold or domain or sub-domain
ISQYHKHGSCSQPLYDPQEYFLK

SEQ ID NO: 9002 - protein, 29 aa, artificial
  peptide fold or domain or sub-domain
ISRDTFASFVCDIQDEDWDAETLNEKLAL

SEQ ID NO: 9003 - protein, 24 aa, artificial
  peptide fold or domain or sub-domain
ISRESVMYQDFKKNHDDSKYKDFF

SEQ ID NO: 9004 - protein, 27 aa, artificial
  peptide fold or domain or sub-domain
ISRHPDGSVAIQDGAKFDSPIELIQYH

SEQ ID NO: 9005 - protein, 28 aa, artificial
  peptide fold or domain or sub-domain
ISRLAQAYSNSSNTYYQDQSVYNDYVKS

SEQ ID NO: 9006 - protein, 23 aa, artificial
  peptide fold or domain or sub-domain
ISRLITEYVATGQLDHATTAMNS

SEQ ID NO: 9007 - protein, 23 aa, artificial
  peptide fold or domain or sub-domain
ISRLLHDEVEGGALTDEEVVGIA

SEQ ID NO: 9008 - protein, 21 aa, artificial
  peptide fold or domain or sub-domain
ISRPKRCELAATMGLPESTIK

SEQ ID NO: 9009 - protein, 30 aa, artificial
  peptide fold or domain or sub-domain
ISRSYTLQQINQALADVEQGSVLKAVIQPN

SEQ ID NO: 9010 - protein, 21 aa, artificial
  peptide fold or domain or sub-domain
ISSDYADAEVSEFENGPAAVG

SEQ ID NO: 9011 - protein, 23 aa, artificial
  peptide fold or domain or sub-domain
ISSELLTKALQVDNNIVDNLQKQ

SEQ ID NO: 9012 - protein, 24 aa, artificial
  peptide fold or domain or sub-domain
ISSEVTDVNRYRSGEIDMTYNNMP

SEQ ID NO: 9013 - protein, 20 aa, artificial
  peptide fold or domain or sub-domain
ISSGEIAEGVGVSPAQVRKD

SEQ ID NO: 9014 - protein, 28 aa, artificial
  peptide fold or domain or sub-domain
ISSGKKAMLCGRLGNRLREHQFSTYTQY

SEQ ID NO: 9015 - protein, 26 aa, artificial
  peptide fold or domain or sub-domain
ISSKYKSYLQPIRSNGSHYSPKLSNS

SEQ ID NO: 9016 - protein, 26 aa, artificial
  peptide fold or domain or sub-domain
ISSLLLGALLLEDELYVKRKDSEIAD

SEQ ID NO: 9017 - protein, 25 aa, artificial
  peptide fold or domain or sub-domain
ISSNLELHSLSTGRLPRVVTANRML

SEQ ID NO: 9018 - protein, 22 aa, artificial
  peptide fold or domain or sub-domain
ISSQHDWFQQSEKQQAPFSDYF

SEQ ID NO: 9019 - protein, 20 aa, artificial
  peptide fold or domain or sub-domain
ISSSLIRDIHKYDGDVSGFL

SEQ ID NO: 9020 - protein, 20 aa, artificial
  peptide fold or domain or sub-domain
ISSSLIRQRIREKLPYSHLI

SEQ ID NO: 9021 - protein, 20 aa, artificial
  peptide fold or domain or sub-domain
ISSSRLREQVNRGESIRYQT

SEQ ID NO: 9022 - protein, 20 aa, artificial
  peptide fold or domain or sub-domain
ISSTAVREMASLGRDPVEFT

SEQ ID NO: 9023 - protein, 20 aa, artificial
  peptide fold or domain or sub-domain
ISSTDVRRRAEHDEPVWYLV

SEQ ID NO: 9024 - protein, 20 aa, artificial
  peptide fold or domain or sub-domain
ISSTFIRQALDEKKDVRYFL

SEQ ID NO: 9025 - protein, 20 aa, artificial
  peptide fold or domain or sub-domain
ISSTLIRERVRQSLEVKFFL

SEQ ID NO: 9026 - protein, 20 aa, artificial
  peptide fold or domain or sub-domain
ISSTMIRNRVKEGKSIKYLV

SEQ ID NO: 9027 - protein, 20 aa, artificial
  peptide fold or domain or sub-domain
ISSTQIRDKIKHSDTIDFLT

SEQ ID NO: 9028 - protein, 22 aa, artificial
  peptide fold or domain or sub-domain
ISTEEAIRKGFIDGRAAQRLQD

SEQ ID NO: 9029 - protein, 26 aa, artificial
  peptide fold or domain or sub-domain
ISTQALLEQAERLKKNQYGKYLIKIA

SEQ ID NO: 9030 - protein, 27 aa, artificial
  peptide fold or domain or sub-domain
ISTSQIVPYILNKLSNVALALIVATRG

SEQ ID NO: 9031 - protein, 28 aa, artificial
  peptide fold or domain or sub-domain
ISVAQEYLDRQQGASGGINEVRKRIAQI

SEQ ID NO: 9032 - protein, 26 aa, artificial
  peptide fold or domain or sub-domain
ISVEKEQIKNLEGQEAIIYRNHILPV

SEQ ID NO: 9033 - protein, 24 aa, artificial
  peptide fold or domain or sub-domain
ISVMNWVQAADDASKVTPDMGLKD

SEQ ID NO: 9034 - protein, 29 aa, artificial
  peptide fold or domain or sub-domain
ISVQNAPSEIKECAKYVAPSNNDDAVHHA

SEQ ID NO: 9035 - protein, 26 aa, artificial
  peptide fold or domain or sub-domain
ISVRKKDVRHIRSEEVILINEKTLPL

SEQ ID NO: 9036 - protein, 29 aa, artificial
  peptide fold or domain or sub-domain
ISVVFSALKDKPYQNMIKRLETIAHAIHF

SEQ ID NO: 9037 - protein, 23 aa, artificial
  peptide fold or domain or sub-domain
ISVYLSQTLQEQVMPSQQIVHIM

SEQ ID NO: 9038 - protein, 29 aa, artificial
  peptide fold or domain or sub-domain
ISVYRKGEVPKRLRCGTNPRLGELVVIPD

SEQ ID NO: 9039 - protein, 24 aa, artificial
  peptide fold or domain or sub-domain
ISWDYGSGKFKERPDGKGGVFEPG

SEQ ID NO: 9040 - protein, 23 aa, artificial
  peptide fold or domain or sub-domain
ISWKEAKRRSQAYENQGLTDAYI

SEQ ID NO: 9041 - protein, 26 aa, artificial
  peptide fold or domain or sub-domain
ISWTVNNSPQTGATLDESGRSSLIIE

SEQ ID NO: 9042 - protein, 22 aa, artificial
  peptide fold or domain or sub-domain
ISYDQAAIQAKVPLSTLQSVSR

SEQ ID NO: 9043 - protein, 29 aa, artificial
  peptide fold or domain or sub-domain
ISYSQTALQNDAEHIQRLANLEGLTAHAN

SEQ ID NO: 9044 - protein, 27 aa, artificial
  peptide fold or domain or sub-domain
ISYTELQQALSQMGYNLSPQFTQLLVS

SEQ ID NO: 9045 - protein, 25 aa, artificial
  peptide fold or domain or sub-domain
ITAAEMRDLKIKHFGVNEDSDVLSF

SEQ ID NO: 9046 - protein, 21 aa, artificial
  peptide fold or domain or sub-domain
ITAANIEALAGITLTEEEKAK

SEQ ID NO: 9047 - protein, 21 aa, artificial
  peptide fold or domain or sub-domain
ITADLLKQLGWWDELTEAEKK

SEQ ID NO: 9048 - protein, 20 aa, artificial
  peptide fold or domain or sub-domain
ITADSKDKALVRADKNKKNV

SEQ ID NO: 9049 - protein, 20 aa, artificial
  peptide fold or domain or sub-domain
ITADTLEQAIERAGTKHGNK

SEQ ID NO: 9050 - protein, 25 aa, artificial
  peptide fold or domain or sub-domain
ITAELLDEVGDSGVVDIVDRFAHPL

SEQ ID NO: 9051 - protein, 24 aa, artificial
  peptide fold or domain or sub-domain
ITAVLTEAVENQDLADDLDKETAV

SEQ ID NO: 9052 - protein, 20 aa, artificial
  peptide fold or domain or sub-domain
ITAVSKLLKNLYLCGGSAAT

SEQ ID NO: 9053 - protein, 23 aa, artificial
  peptide fold or domain or sub-domain
ITCRGAQRLAQETGNADFAVDTW

SEQ ID NO: 9054 - protein, 27 aa, artificial
  peptide fold or domain or sub-domain
ITDAMADVTKIGTASAAHLNGIDFAGK

SEQ ID NO: 9055 - protein, 24 aa, artificial
  peptide fold or domain or sub-domain
ITDANTRVAEMLAGGIDMMVEVPP

SEQ ID NO: 9056 - protein, 29 aa, artificial
  peptide fold or domain or sub-domain
ITDKHDKYSALKRVKDPKLKLNKVYKVCK

SEQ ID NO: 9057 - protein, 30 aa, artificial
  peptide fold or domain or sub-domain
ITDKIPMKDFSTAMARLQSGEASKILMYPN

SEQ ID NO: 9058 - protein, 24 aa, artificial
  peptide fold or domain or sub-domain
ITEDFLQSVGVTKGASHKLALCID

SEQ ID NO: 9059 - protein, 26 aa, artificial
  peptide fold or domain or sub-domain
ITENEFKYIAKEFGDYDDELAEKVFR

SEQ ID NO: 9060 - protein, 24 aa, artificial
  peptide fold or domain or sub-domain
ITENEIHEFLTGKISQEKRLRGGI

SEQ ID NO: 9061 - protein, 28 aa, artificial
  peptide fold or domain or sub-domain
ITESGLGKPGELRELRDSGYRGFLMGES

SEQ ID NO: 9062 - protein, 27 aa, artificial
  peptide fold or domain or sub-domain
ITEVSQDGNDFTWTQSIPHWTWTNTFS

SEQ ID NO: 9063 - protein, 21 aa, artificial
  peptide fold or domain or sub-domain
ITEVTETGLRTLEKEYEFDII

SEQ ID NO: 9064 - protein, 26 aa, artificial
  peptide fold or domain or sub-domain
ITEVTRIGYIPVYGALEIVETINPHL

SEQ ID NO: 9065 - protein, 29 aa, artificial
  peptide fold or domain or sub-domain
ITFTADYHEMNPQTHGILKAILEKQAFQQ

SEQ ID NO: 9066 - protein, 20 aa, artificial
  peptide fold or domain or sub-domain
ITGDEIALDQNSLSEAQVFD

SEQ ID NO: 9067 - protein, 30 aa, artificial
  peptide fold or domain or sub-domain
ITGHYPLRDIDSVMGRMQSFQEIKPVLLPQ

SEQ ID NO: 9068 - protein, 21 aa, artificial
  peptide fold or domain or sub-domain
ITGKVCKSLNKTLGMQIAIVL

SEQ ID NO: 9069 - protein, 26 aa, artificial
  peptide fold or domain or sub-domain
ITGSSEIENYPGVKEVVSGLDFMQPW

SEQ ID NO: 9070 - protein, 28 aa, artificial
  peptide fold or domain or sub-domain
ITGVIDPEEGVWRYSPHYQVRDLPVAPM

SEQ ID NO: 9071 - protein, 23 aa, artificial
  peptide fold or domain or sub-domain
ITHADLSEKVNLSPSACHRRVQR

SEQ ID NO: 9072 - protein, 21 aa, artificial
  peptide fold or domain or sub-domain
ITHKEIGSITCIHRVTVTNVI

SEQ ID NO: 9073 - protein, 23 aa, artificial
  peptide fold or domain or sub-domain
ITHPKSTSHRALSKEELKALGIS

SEQ ID NO: 9074 - protein, 23 aa, artificial
  peptide fold or domain or sub-domain
ITHPWTTTHGRMQPEEKLAANIR

SEQ ID NO: 9075 - protein, 30 aa, artificial
  peptide fold or domain or sub-domain
ITHQVPFSEINKAFDYMLKGESIRCMITME

SEQ ID NO: 9076 - protein, 30 aa, artificial
  peptide fold or domain or sub-domain
ITHRLPLKEANKALELMESREALKVILYPE

SEQ ID NO: 9077 - protein, 30 aa, artificial
  peptide fold or domain or sub-domain
ITHRLRLEDVGDAFAALGRGDVIRQVICYD

SEQ ID NO: 9078 - protein, 30 aa, artificial
  peptide fold or domain or sub-domain
ITHTLPLSRGEEAFALARDGAAMKVLLHPE

SEQ ID NO: 9079 - protein, 22 aa, artificial
  peptide fold or domain or sub-domain
ITHVELTYDNRTVDQVRISDRF

SEQ ID NO: 9080 - protein, 25 aa, artificial
  peptide fold or domain or sub-domain
ITIAEIQKQQGGITAAFSETVISQW

SEQ ID NO: 9081 - protein, 20 aa, artificial
  peptide fold or domain or sub-domain
ITIAENKMAIHSELEAKEAE

SEQ ID NO: 9082 - protein, 25 aa, artificial
  peptide fold or domain or sub-domain
ITIASVQRSQGGVAGAFKNNALYDW

SEQ ID NO: 9083 - protein, 26 aa, artificial
  peptide fold or domain or sub-domain
ITIDELEKAMQKCGQKPTKLELRLIM

SEQ ID NO: 9084 - protein, 29 aa, artificial
  peptide fold or domain or sub-domain
ITIIITKNEEYVQEGCLIANSVEQALEMA

SEQ ID NO: 9085 - protein, 30 aa, artificial
  peptide fold or domain or sub-domain
ITILKKSDSQNDWWTGRVNGREGIFPANYV

SEQ ID NO: 9086 - protein, 21 aa, artificial
  peptide fold or domain or sub-domain
ITIRRRSELAEQLCLSERQVK

SEQ ID NO: 9087 - protein, 26 aa, artificial
  peptide fold or domain or sub-domain
ITIVELRQGLKLQSAEAAAQLEEVVA

SEQ ID NO: 9088 - protein, 23 aa, artificial
  peptide fold or domain or sub-domain
ITKAEHNKRVKRYKKDGIKHSYS

SEQ ID NO: 9089 - protein, 26 aa, artificial
  peptide fold or domain or sub-domain
ITKEEVEIAMKEHGMGDEANAKDLIS

SEQ ID NO: 9090 - protein, 24 aa, artificial
  peptide fold or domain or sub-domain
ITKELTELSLANNRTGVRDYFAAR

SEQ ID NO: 9091 - protein, 26 aa, artificial
  peptide fold or domain or sub-domain
ITKEQLKKGLEKDGLKLPYNFDLLLD

SEQ ID NO: 9092 - protein, 21 aa, artificial
  peptide fold or domain or sub-domain
ITKSALAKMTIGEDHPLFSQV

SEQ ID NO: 9093 - protein, 26 aa, artificial
  peptide fold or domain or sub-domain
ITKVNRTSLLEIINAPDFSSIITPKS

SEQ ID NO: 9094 - protein, 26 aa, artificial
  peptide fold or domain or sub-domain
ITLAQEIKQHLTLGHDIGEYRHLRRF

SEQ ID NO: 9095 - protein, 28 aa, artificial
  peptide fold or domain or sub-domain
ITLEAAGRSREVLNDLRQSSDPAILQQT

SEQ ID NO: 9096 - protein, 22 aa, artificial
  peptide fold or domain or sub-domain
ITLEMGKLLREAKGEVALAASI

SEQ ID NO: 9097 - protein, 25 aa, artificial
  peptide fold or domain or sub-domain
ITLENLNAMLAGDLEPATGFMMGKL

SEQ ID NO: 9098 - protein, 27 aa, artificial
  peptide fold or domain or sub-domain
ITLESLQTAITLALRQTPNTLVQLNKL

SEQ ID NO: 9099 - protein, 29 aa, artificial
  peptide fold or domain or sub-domain
ITLILGVLGDKQVDEMVEEITRGVDKVVI

SEQ ID NO: 9100 - protein, 22 aa, artificial
  peptide fold or domain or sub-domain
ITLKSYIECNRPQPAHRFLFLK

SEQ ID NO: 9101 - protein, 28 aa, artificial
  peptide fold or domain or sub-domain
ITLNTHGLKYDVINWTSSMIGNVSSSNG

SEQ ID NO: 9102 - protein, 22 aa, artificial
  peptide fold or domain or sub-domain
ITLPELVSALRIPEAKAGCVHS

SEQ ID NO: 9103 - protein, 20 aa, artificial
  peptide fold or domain or sub-domain
ITLSAGSGLRVSGGSLTVAT

SEQ ID NO: 9104 - protein, 22 aa, artificial
  peptide fold or domain or sub-domain
ITLSQLADALNINKAKSHGLFR

SEQ ID NO: 9105 - protein, 22 aa, artificial
  peptide fold or domain or sub-domain
ITLSWIPGDNGGSSIRGYILQY

SEQ ID NO: 9106 - protein, 25 aa, artificial
  peptide fold or domain or sub-domain
ITLTTDVQYKEASTKDMLYVTYEQL

SEQ ID NO: 9107 - protein, 26 aa, artificial
  peptide fold or domain or sub-domain
ITNDWPDNVSVFSNRVETYQAITKDG

SEQ ID NO: 9108 - protein, 30 aa, artificial
  peptide fold or domain or sub-domain
ITNFMTIKQMLLEEGYHFSSDTDTEVIVVL

SEQ ID NO: 9109 - protein, 24 aa, artificial
  peptide fold or domain or sub-domain
ITNQAAVYFEKGDYNKCRELCEKA

SEQ ID NO: 9110 - protein, 25 aa, artificial
  peptide fold or domain or sub-domain
ITNYDGWKSQASLVVPEQGCYCQLN

SEQ ID NO: 9111 - protein, 30 aa, artificial
  peptide fold or domain or sub-domain
ITNYYTIRERLEIKGYQFKTNNDSECIVVY

SEQ ID NO: 9112 - protein, 26 aa, artificial
  peptide fold or domain or sub-domain
ITPAETEKWKTSFTNLIKNDDGRKAF

SEQ ID NO: 9113 - protein, 21 aa, artificial
  peptide fold or domain or sub-domain
ITPDEARGIVPGLTMKDCLIA

SEQ ID NO: 9114 - protein, 21 aa, artificial
  peptide fold or domain or sub-domain
ITPEEAKEIVPLLDISEVIAA

SEQ ID NO: 9115 - protein, 26 aa, artificial
  peptide fold or domain or sub-domain
ITPEELRLNQCLQQTGLKGSIEPLLE

SEQ ID NO: 9116 - protein, 29 aa, artificial
  peptide fold or domain or sub-domain
ITPNETESAKITGIQIKDKSSLAANAEKL

SEQ ID NO: 9117 - protein, 29 aa, artificial
  peptide fold or domain or sub-domain
ITPNTHEAGLLLGSTPRTLADARVAAANL

SEQ ID NO: 9118 - protein, 29 aa, artificial
  peptide fold or domain or sub-domain
ITPRQRAWSAYNRYRGVDIGVSSGGTIIE

SEQ ID NO: 9119 - protein, 26 aa, artificial
  peptide fold or domain or sub-domain
ITPSMTPSEMQKGIAGTLLPGDNEAL

SEQ ID NO: 9120 - protein, 27 aa, artificial
  peptide fold or domain or sub-domain
ITPVDDTQLKNVDQLALNQLRPEFQKT

SEQ ID NO: 9121 - protein, 24 aa, artificial
  peptide fold or domain or sub-domain
ITQDITYSQESGLAHSKLNKEIVA

SEQ ID NO: 9122 - protein, 29 aa, artificial
  peptide fold or domain or sub-domain
ITQIEQLDEGWWSGTNADGQSGLFPANYC

SEQ ID NO: 9123 - protein, 21 aa, artificial
  peptide fold or domain or sub-domain
ITQQDLADLVGASRSFVSTLI

SEQ ID NO: 9124 - protein, 26 aa, artificial
  peptide fold or domain or sub-domain
ITQQEIQNVLGVGMDFDSETWTKIVA

SEQ ID NO: 9125 - protein, 21 aa, artificial
  peptide fold or domain or sub-domain
ITQQEISEMVGMTRESINKQL

SEQ ID NO: 9126 - protein, 27 aa, artificial
  peptide fold or domain or sub-domain
ITRAVQRRAFVRSMKNAQIDVDIESLI

SEQ ID NO: 9127 - protein, 26 aa, artificial
  peptide fold or domain or sub-domain
ITRDQLMESAERYGKSPYGRHLKGIA

SEQ ID NO: 9128 - protein, 22 aa, artificial
  peptide fold or domain or sub-domain
ITREAGKPIPEAMGAEILVVQD

SEQ ID NO: 9129 - protein, 23 aa, artificial
  peptide fold or domain or sub-domain
ITREEVDKTTVRCPHAATAAKMA

SEQ ID NO: 9130 - protein, 28 aa, artificial
  peptide fold or domain or sub-domain
ITRFQKNGMIQVDGKEISIIDLDQMQKL

SEQ ID NO: 9131 - protein, 25 aa, artificial
  peptide fold or domain or sub-domain
ITRGLLDGLREKGQIDVVSDLAYPL

SEQ ID NO: 9132 - protein, 29 aa, artificial
  peptide fold or domain or sub-domain
ITRKSTKRLMNETENKEMKTILNGKQLAI

SEQ ID NO: 9133 - protein, 26 aa, artificial
  peptide fold or domain or sub-domain
ITRNPDSTPALFAMHVESLIREENLR

SEQ ID NO: 9134 - protein, 21 aa, artificial
  peptide fold or domain or sub-domain
ITRQEIGQIVGCSRETVGRIL

SEQ ID NO: 9135 - protein, 21 aa, artificial
  peptide fold or domain or sub-domain
ITRQNISEMTGTTLHTVSRLL

SEQ ID NO: 9136 - protein, 20 aa, artificial
  peptide fold or domain or sub-domain
ITSALLNLGYKSQLVDQFVS

SEQ ID NO: 9137 - protein, 23 aa, artificial
  peptide fold or domain or sub-domain
ITSATEPLLARLCGSQRFARDTH

SEQ ID NO: 9138 - protein, 23 aa, artificial
  peptide fold or domain or sub-domain
ITSEEADRRRAESTIARRKDVYL

SEQ ID NO: 9139 - protein, 24 aa, artificial
  peptide fold or domain or sub-domain
ITSRLTRRARDAGRTSARDYLDSR

SEQ ID NO: 9140 - protein, 24 aa, artificial
  peptide fold or domain or sub-domain
ITSYLQMVLANKGKVDADAYAASR

SEQ ID NO: 9141 - protein, 27 aa, artificial
  peptide fold or domain or sub-domain
ITSYYVDNNQYFTAPLGNYSDNFKINF

SEQ ID NO: 9142 - protein, 26 aa, artificial
  peptide fold or domain or sub-domain
ITTAGGERKLDLAWELGADYTIDHYK

SEQ ID NO: 9143 - protein, 24 aa, artificial
  peptide fold or domain or sub-domain
ITTDIKHSQDKQLVNTAFNPFITA

SEQ ID NO: 9144 - protein, 22 aa, artificial
  peptide fold or domain or sub-domain
ITTDMLYKQYPNLDASQREDEI

SEQ ID NO: 9145 - protein, 22 aa, artificial
  peptide fold or domain or sub-domain
ITTQELEDRWPDLTPDEREDKI

SEQ ID NO: 9146 - protein, 26 aa, artificial
  peptide fold or domain or sub-domain
ITTSSSAYVIDTNAPNQLKFTVSRSS

SEQ ID NO: 9147 - protein, 26 aa, artificial
  peptide fold or domain or sub-domain
ITTVGSEAQRDASLRLGADLAIEYRN

SEQ ID NO: 9148 - protein, 27 aa, artificial
  peptide fold or domain or sub-domain
ITVDEIPEDQFPLLLHWHYLNIYRYQI

SEQ ID NO: 9149 - protein, 29 aa, artificial
  peptide fold or domain or sub-domain
ITVDELKAVLSSLGLKQGKTLDDCKKMIK

SEQ ID NO: 9150 - protein, 26 aa, artificial
  peptide fold or domain or sub-domain
ITVEELKHMFGAGNKIPSETWTKLME

SEQ ID NO: 9151 - protein, 20 aa, artificial
  peptide fold or domain or sub-domain
ITVETRDQAEERADGGRLNT

SEQ ID NO: 9152 - protein, 30 aa, artificial
  peptide fold or domain or sub-domain
ITVFSVVGMDSDWLMGERGNQKGKVPITYL

SEQ ID NO: 9153 - protein, 29 aa, artificial
  peptide fold or domain or sub-domain
ITVIAGILADKDYAAMADRLTAAFSTVYL

SEQ ID NO: 9154 - protein, 22 aa, artificial
  peptide fold or domain or sub-domain
ITVKWIFNKQQLKSAKNVFLSE

SEQ ID NO: 9155 - protein, 21 aa, artificial
  peptide fold or domain or sub-domain
ITVLVLGILAPLGVIDAEALS

SEQ ID NO: 9156 - protein, 26 aa, artificial
  peptide fold or domain or sub-domain
ITWRKINGNIPKKARLRKSQAVLEIP

SEQ ID NO: 9157 - protein, 26 aa, artificial
  peptide fold or domain or sub-domain
ITWVFNNSILPVHYDHANGHSQLVIE

SEQ ID NO: 9158 - protein, 29 aa, artificial
  peptide fold or domain or sub-domain
ITWVMGMLSTKEHDQIFQHLLRPGDRLLL

SEQ ID NO: 9159 - protein, 21 aa, artificial
  peptide fold or domain or sub-domain
ITYCQKAISLNPNNEQTYLNL

SEQ ID NO: 9160 - protein, 26 aa, artificial
  peptide fold or domain or sub-domain
ITYEELKMGLNRHGSKLSETEVKQLM

SEQ ID NO: 9161 - protein, 29 aa, artificial
  peptide fold or domain or sub-domain
ITYFFKGNCYYRYEDKTNKLSQCSPVTEW

SEQ ID NO: 9162 - protein, 23 aa, artificial
  peptide fold or domain or sub-domain
ITYPYTQTHADIPDDIRKRLGVT

SEQ ID NO: 9163 - protein, 29 aa, artificial
  peptide fold or domain or sub-domain
ITYSQSALRSVQQDVSEISASEGLDAHAK

SEQ ID NO: 9164 - protein, 30 aa, artificial
  peptide fold or domain or sub-domain
ITYTTRSLRPKEAAAVNARHVDFDEMLRES

SEQ ID NO: 9165 - protein, 22 aa, artificial
  peptide fold or domain or sub-domain
ITYTWSADSMESDHVISNELVY

SEQ ID NO: 9166 - protein, 28 aa, artificial
  peptide fold or domain or sub-domain
ITYVKDDKSAEEVVEEVKKHGVDALAIK

SEQ ID NO: 9167 - protein, 28 aa, artificial
  peptide fold or domain or sub-domain
IVAARDPGKGEAAAAKLRDAGLDAQFLK

SEQ ID NO: 9168 - protein, 29 aa, artificial
  peptide fold or domain or sub-domain
IVAVATRDSEHRASSFAKNHCAPCKPKAY

SEQ ID NO: 9169 - protein, 25 aa, artificial
  peptide fold or domain or sub-domain
IVAVDDPRLAAEVDSFGGQARLTSV

SEQ ID NO: 9170 - protein, 28 aa, artificial
  peptide fold or domain or sub-domain
IVCSFERTQGLTDTYWDIETVNSKLKER

SEQ ID NO: 9171 - protein, 24 aa, artificial
  peptide fold or domain or sub-domain
IVCSSIQPLQGYGVIGLHEGRLSP

SEQ ID NO: 9172 - protein, 29 aa, artificial
  peptide fold or domain or sub-domain
IVCVSRAQEEGWLKGVCNQRTGLFPINYV

SEQ ID NO: 9173 - protein, 30 aa, artificial
  peptide fold or domain or sub-domain
IVDADERRKFVMENGGIFSTTLDSEIFIHY

SEQ ID NO: 9174 - protein, 24 aa, artificial
  peptide fold or domain or sub-domain
IVDATVRLANLKSGGLDLIERVLA

SEQ ID NO: 9175 - protein, 25 aa, artificial
  peptide fold or domain or sub-domain
IVDDALDRMAEAGRVDLVAELAFPL

SEQ ID NO: 9176 - protein, 25 aa, artificial
  peptide fold or domain or sub-domain
IVDEAIDAVIDRGHMDLIEDFAFRL

SEQ ID NO: 9177 - protein, 25 aa, artificial
  peptide fold or domain or sub-domain
IVDEILDGVEAKGTVNVVAEIADLI

SEQ ID NO: 9178 - protein, 29 aa, artificial
  peptide fold or domain or sub-domain
IVDQFQQLVNPLRPIPRQITTLTGITDAM

SEQ ID NO: 9179 - protein, 25 aa, artificial
  peptide fold or domain or sub-domain
IVDQLLDAAAARGAIELIGEFAYPL

SEQ ID NO: 9180 - protein, 24 aa, artificial
  peptide fold or domain or sub-domain
IVDSCKHCEECEDGLENYCDHMTG

SEQ ID NO: 9181 - protein, 24 aa, artificial
  peptide fold or domain or sub-domain
IVDSCMSCNACKDGYEQFCGSLSL

SEQ ID NO: 9182 - protein, 22 aa, artificial
  peptide fold or domain or sub-domain
IVEEHGKNYSDAIGEIQRGRET

SEQ ID NO: 9183 - protein, 25 aa, artificial
  peptide fold or domain or sub-domain
IVEETVKETRSRGAKKMTPYHVKRT

SEQ ID NO: 9184 - protein, 26 aa, artificial
  peptide fold or domain or sub-domain
IVELASKQLGLEPTNESAIDIADNDE

SEQ ID NO: 9185 - protein, 24 aa, artificial
  peptide fold or domain or sub-domain
IVEMQYLYEEGDSLVCMNQETFEQ

SEQ ID NO: 9186 - protein, 21 aa, artificial
  peptide fold or domain or sub-domain
IVETKHGIMSIDDAIKNNLGG

SEQ ID NO: 9187 - protein, 27 aa, artificial
  peptide fold or domain or sub-domain
IVFLDREEKNPVYSFQHKLDWTDRIRY

SEQ ID NO: 9188 - protein, 26 aa, artificial
  peptide fold or domain or sub-domain
IVFSTSDNPRDVQSCYQLGVSAYLLK

SEQ ID NO: 9189 - protein, 25 aa, artificial
  peptide fold or domain or sub-domain
IVGANFEEIGRMRGVDPYDAVLDIL

SEQ ID NO: 9190 - protein, 30 aa, artificial
  peptide fold or domain or sub-domain
IVGCCYDFNEMFRDFDHVAVLSDAARKKFE

SEQ ID NO: 9191 - protein, 24 aa, artificial
  peptide fold or domain or sub-domain
IVGGAPYRYDEQLYLQAGADAWAA

SEQ ID NO: 9192 - protein, 27 aa, artificial
  peptide fold or domain or sub-domain
IVGGLAKVAKGEDPFDAAAVLTQLQAL

SEQ ID NO: 9193 - protein, 24 aa, artificial
  peptide fold or domain or sub-domain
IVGNNLCNCLYGGGSSITNNMMCA

SEQ ID NO: 9194 - protein, 24 aa, artificial
  peptide fold or domain or sub-domain
IVHADEVIGMAEHPTKAFSQKPNS

SEQ ID NO: 9195 - protein, 24 aa, artificial
  peptide fold or domain or sub-domain
IVHCPQTVTFNEHAVEAIKGKPQS

SEQ ID NO: 9196 - protein, 24 aa, artificial
  peptide fold or domain or sub-domain
IVHELVKDTQDGRWQQAKEKQLNA

SEQ ID NO: 9197 - protein, 26 aa, artificial
  peptide fold or domain or sub-domain
IVHELVKDTQDGRWQQAKEKQLNALE

SEQ ID NO: 9198 - protein, 26 aa, artificial
  peptide fold or domain or sub-domain
IVHTGRELTAVETERLENLAAAIVLK

SEQ ID NO: 9199 - protein, 25 aa, artificial
  peptide fold or domain or sub-domain
IVIALSQKATDASFEQILEIANRMS

SEQ ID NO: 9200 - protein, 29 aa, artificial
  peptide fold or domain or sub-domain
IVIEIDLNLLNFLKKYSFYSKLIVFCQDA

SEQ ID NO: 9201 - protein, 26 aa, artificial
  peptide fold or domain or sub-domain
IVISGAGVMADVVEALRLGASDYLIK

SEQ ID NO: 9202 - protein, 28 aa, artificial
  peptide fold or domain or sub-domain
IVISGSTSSQKLFANMVAQSIALAKGRE

SEQ ID NO: 9203 - protein, 23 aa, artificial
  peptide fold or domain or sub-domain
IVLPWKEEGYMNVKLSGRNLPDV

SEQ ID NO: 9204 - protein, 25 aa, artificial
  peptide fold or domain or sub-domain
IVLQALYEQDLAGHNAEDVLKRLLT

SEQ ID NO: 9205 - protein, 26 aa, artificial
  peptide fold or domain or sub-domain
IVLTEDPAFVPIINSLGIDVVINPRL

SEQ ID NO: 9206 - protein, 26 aa, artificial
  peptide fold or domain or sub-domain
IVLTGHGSLDSAIEGIRYGIFDYLLK

SEQ ID NO: 9207 - protein, 26 aa, artificial
  peptide fold or domain or sub-domain
IVLTTSSDERDIARCYLFGANTYVCK

SEQ ID NO: 9208 - protein, 30 aa, artificial
  peptide fold or domain or sub-domain
IVLVQDDTDGSGWTEGELNGQTGMFPTSYV

SEQ ID NO: 9209 - protein, 29 aa, artificial
  peptide fold or domain or sub-domain
IVMENGLPNVKAVATAITDTNDNDGVARY

SEQ ID NO: 9210 - protein, 29 aa, artificial
  peptide fold or domain or sub-domain
IVMGNGHEDLKKLANYVTKDVSEDGIYHG

SEQ ID NO: 9211 - protein, 30 aa, artificial
  peptide fold or domain or sub-domain
IVNADELRDSMKKEGITFQSDSDTEVMLAE

SEQ ID NO: 9212 - protein, 27 aa, artificial
  peptide fold or domain or sub-domain
IVNQDPRRGIGHEKVLTKLELDYQART

SEQ ID NO: 9213 - protein, 28 aa, artificial
  peptide fold or domain or sub-domain
IVNYLEWVQDASNFFWTPEEIERAIDLR

SEQ ID NO: 9214 - protein, 23 aa, artificial
  peptide fold or domain or sub-domain
IVPASPFWFNAWTRKEMFASCFT

SEQ ID NO: 9215 - protein, 30 aa, artificial
  peptide fold or domain or sub-domain
IVPKNVSKKDYKAIAKELSISEDYIKQQMD

SEQ ID NO: 9216 - protein, 29 aa, artificial
  peptide fold or domain or sub-domain
IVPNESEASLLTGIKVNSIESARKAAKSL

SEQ ID NO: 9217 - protein, 23 aa, artificial
  peptide fold or domain or sub-domain
IVPPTPVMLFAGTESRSYASCFL

SEQ ID NO: 9218 - protein, 27 aa, artificial
  peptide fold or domain or sub-domain
IVPVEGGYLYDFHYPNVVDFRRAVQVA

SEQ ID NO: 9219 - protein, 22 aa, artificial
  peptide fold or domain or sub-domain
IVPYTSRPPRVLEEDGKSYWFI

SEQ ID NO: 9220 - protein, 20 aa, artificial
  peptide fold or domain or sub-domain
IVQALIGLGWQRQESAAAVE

SEQ ID NO: 9221 - protein, 28 aa, artificial
  peptide fold or domain or sub-domain
IVQDAAKFMNHAKRQKLSVRDIDMSLKV

SEQ ID NO: 9222 - protein, 24 aa, artificial
  peptide fold or domain or sub-domain
IVQQIMGANPNLSLEQAQQIAQEQ

SEQ ID NO: 9223 - protein, 27 aa, artificial
  peptide fold or domain or sub-domain
IVRLTEAGLLRHEWREGVSMTPKGRQA

SEQ ID NO: 9224 - protein, 24 aa, artificial
  peptide fold or domain or sub-domain
IVRNIAAGSITKKYPMKEGTIFES

SEQ ID NO: 9225 - protein, 25 aa, artificial
  peptide fold or domain or sub-domain
IVRSALDIRNWKSNQKNSGCLPLER

SEQ ID NO: 9226 - protein, 22 aa, artificial
  peptide fold or domain or sub-domain
IVSGTMVRKMLSEGKTLPDHFG

SEQ ID NO: 9227 - protein, 25 aa, artificial
  peptide fold or domain or sub-domain
IVSSDGDHILKEAERYQAETLKRPS

SEQ ID NO: 9228 - protein, 26 aa, artificial
  peptide fold or domain or sub-domain
IVSSKSHAGEKLSRVHPDLLNILDLR

SEQ ID NO: 9229 - protein, 25 aa, artificial
  peptide fold or domain or sub-domain
IVSTDGGLIAEEAKNFGVEVVLRPA

SEQ ID NO: 9230 - protein, 25 aa, artificial
  peptide fold or domain or sub-domain
IVSTDSEEIAAVAREWGCPVLKRPD

SEQ ID NO: 9231 - protein, 25 aa, artificial
  peptide fold or domain or sub-domain
IVSTDSLEYKYIAEKYGAEVILRTK

SEQ ID NO: 9232 - protein, 22 aa, artificial
  peptide fold or domain or sub-domain
IVSTKGSSNNGFMNGEVEGMGS

SEQ ID NO: 9233 - protein, 21 aa, artificial
  peptide fold or domain or sub-domain
IVSTTRGIMTLEIALQLGLGG

SEQ ID NO: 9234 - protein, 28 aa, artificial
  peptide fold or domain or sub-domain
IVSYYEWIQGREAQFMTEDQVFERLFDK

SEQ ID NO: 9235 - protein, 28 aa, artificial
  peptide fold or domain or sub-domain
IVTARNLEAGEKVAAAIVEEGNSASAVR

SEQ ID NO: 9236 - protein, 23 aa, artificial
  peptide fold or domain or sub-domain
IVTDGSDTDYYDDNTPALDGGLG

SEQ ID NO: 9237 - protein, 26 aa, artificial
  peptide fold or domain or sub-domain
IVTEIDPICALQALMEGLQVLTLEDV

SEQ ID NO: 9238 - protein, 30 aa, artificial
  peptide fold or domain or sub-domain
IVTNMLIGINSMKATDIGVRNTSGKALDIS

SEQ ID NO: 9239 - protein, 26 aa, artificial
  peptide fold or domain or sub-domain
IVTSSSSEKIEKAIRYGAKHGYDYNA

SEQ ID NO: 9240 - protein, 27 aa, artificial
  peptide fold or domain or sub-domain
IVVQTRVYLDAIRWPFEQSTKKWMQWN

SEQ ID NO: 9241 - protein, 25 aa, artificial
  peptide fold or domain or sub-domain
IVVTDNNEIYSLVNKNGIEVLLTKK

SEQ ID NO: 9242 - protein, 20 aa, artificial
  peptide fold or domain or sub-domain
IVVTNNSEQYPMLKGVRFAP

SEQ ID NO: 9243 - protein, 28 aa, artificial
  peptide fold or domain or sub-domain
IVYMLGPENGDASSLDFELEYVASRPQL

SEQ ID NO: 9244 - protein, 26 aa, artificial
  peptide fold or domain or sub-domain
IVYTGRDLTPQQERDLKRRVEAVIVK

SEQ ID NO: 9245 - protein, 26 aa, artificial
  peptide fold or domain or sub-domain
IVYTGRNMTRDEEAELMKYSRSIIIK

SEQ ID NO: 9246 - protein, 24 aa, artificial
  peptide fold or domain or sub-domain
IWADKNTDLNEKGSWGQQVWHKAP

SEQ ID NO: 9247 - protein, 24 aa, artificial
  peptide fold or domain or sub-domain
IWEEAECRKAYERHVPIEKTQLCA

SEQ ID NO: 9248 - protein, 24 aa, artificial
  peptide fold or domain or sub-domain
IWEHEACRQAYEKDLNITNVYMCA

SEQ ID NO: 9249 - protein, 26 aa, artificial
  peptide fold or domain or sub-domain
IWELEGTGARTTINVSGSRTIADADC

SEQ ID NO: 9250 - protein, 25 aa, artificial
  peptide fold or domain or sub-domain
IWFKHSSLLGEMPQERRLDTLCELN

SEQ ID NO: 9251 - protein, 30 aa, artificial
  peptide fold or domain or sub-domain
IWGSYSIDEYACQEAFDRNPEKVLGFHEKR

SEQ ID NO: 9252 - protein, 28 aa, artificial
  peptide fold or domain or sub-domain
IWICKAMVEGGISPSTSQARRDIQAGSV

SEQ ID NO: 9253 - protein, 20 aa, artificial
  peptide fold or domain or sub-domain
IWKYRENASTIAYCEDAANM

SEQ ID NO: 9254 - protein, 23 aa, artificial
  peptide fold or domain or sub-domain
IWLGSKDSMEERIVPQYGIRLET

SEQ ID NO: 9255 - protein, 23 aa, artificial
  peptide fold or domain or sub-domain
IWLRHFFSDWCHDPMTISGEAFE

SEQ ID NO: 9256 - protein, 27 aa, artificial
  peptide fold or domain or sub-domain
IWRRAGGRLHLNEAVSFLSLPELVNYH

SEQ ID NO: 9257 - protein, 20 aa, artificial
  peptide fold or domain or sub-domain
IWSVNPQLSNVQVWWRLYHS

SEQ ID NO: 9258 - protein, 30 aa, artificial
  peptide fold or domain or sub-domain
IWTRNRPIPFDGFVASQEARDESWRRRFAM

SEQ ID NO: 9259 - protein, 28 aa, artificial
  peptide fold or domain or sub-domain
IWVARLFTLAGLTPSNAEARRLIQNRGL

SEQ ID NO: 9260 - protein, 22 aa, artificial
  peptide fold or domain or sub-domain
IWYQFFHEDVLLMKTKSTSERK

SEQ ID NO: 9261 - protein, 24 aa, artificial
  peptide fold or domain or sub-domain
IYADWFHVNEFPASYEESADFEEA

SEQ ID NO: 9262 - protein, 23 aa, artificial
  peptide fold or domain or sub-domain
IYAFNHGMAPDTPIYQQASHSKG

SEQ ID NO: 9263 - protein, 22 aa, artificial
  peptide fold or domain or sub-domain
IYAIKEGLGQSFTSKVKGAWSS

SEQ ID NO: 9264 - protein, 22 aa, artificial
  peptide fold or domain or sub-domain
IYAMEWTPTALKFYYDNELFKV

SEQ ID NO: 9265 - protein, 28 aa, artificial
  peptide fold or domain or sub-domain
IYAPMRAALRRALEELAPEDPAHRRLRL

SEQ ID NO: 9266 - protein, 25 aa, artificial
  peptide fold or domain or sub-domain
IYARLISKEAIRLLEQNGVSYNYRE

SEQ ID NO: 9267 - protein, 26 aa, artificial
  peptide fold or domain or sub-domain
IYATSEADRDYKENAVDGDENTIWHS

SEQ ID NO: 9268 - protein, 21 aa, artificial
  peptide fold or domain or sub-domain
IYAVLSAEGPPHERVFVVSCH

SEQ ID NO: 9269 - protein, 24 aa, artificial
  peptide fold or domain or sub-domain
IYAVPIEGWVQIITVICLVELASF

SEQ ID NO: 9270 - protein, 21 aa, artificial
  peptide fold or domain or sub-domain
IYCINQVQGQAHDQIFIMNCQ

SEQ ID NO: 9271 - protein, 30 aa, artificial
  peptide fold or domain or sub-domain
IYDDNQRPSGVPDRFSGSIDDSANSASLTI

SEQ ID NO: 9272 - protein, 28 aa, artificial
  peptide fold or domain or sub-domain
IYDILKHELDNVGQDSAVALRQLSAICD

SEQ ID NO: 9273 - protein, 24 aa, artificial
  peptide fold or domain or sub-domain
IYDWWIAAYGDEGYSIDADPGVAS

SEQ ID NO: 9274 - protein, 24 aa, artificial
  peptide fold or domain or sub-domain
IYDWYKSKSLIKSAMIDDDPGVNA

SEQ ID NO: 9275 - protein, 25 aa, artificial
  peptide fold or domain or sub-domain
IYESTLKDNGDLIGEQIKVLANEKV

SEQ ID NO: 9276 - protein, 22 aa, artificial
  peptide fold or domain or sub-domain
IYGCEVNQNEIIWYVDGVEVAR

SEQ ID NO: 9277 - protein, 24 aa, artificial
  peptide fold or domain or sub-domain
IYGDVDVTYFNYQFGQIPKLPESY

SEQ ID NO: 9278 - protein, 30 aa, artificial
  peptide fold or domain or sub-domain
IYGPTDDKLAEAKTDKLREQIIDKYLMPNL

SEQ ID NO: 9279 - protein, 26 aa, artificial
  peptide fold or domain or sub-domain
IYGTATASSGNADVAIDNNAGTRWES

SEQ ID NO: 9280 - protein, 28 aa, artificial
  peptide fold or domain or sub-domain
IYHINDNLFYDYNIPKHEGSYNAYLRLM

SEQ ID NO: 9281 - protein, 30 aa, artificial
  peptide fold or domain or sub-domain
IYHNRSPLEAETEARAHARYVDKDTLLRES

SEQ ID NO: 9282 - protein, 24 aa, artificial
  peptide fold or domain or sub-domain
IYHTDQVITMDEQPALGLRRKREA

SEQ ID NO: 9283 - protein, 25 aa, artificial
  peptide fold or domain or sub-domain
IYIDDFTLQYFGSKKQYERYRKKCT

SEQ ID NO: 9284 - protein, 29 aa, artificial
  peptide fold or domain or sub-domain
IYILFGALGDKSLAGMLPELNQLATHLVL

SEQ ID NO: 9285 - protein, 23 aa, artificial
  peptide fold or domain or sub-domain
IYKGDYLKELFRRYGDIEEAPPP

SEQ ID NO: 9286 - protein, 26 aa, artificial
  peptide fold or domain or sub-domain
IYLALNDHSVSLLDRRHFDVIRTIPY

SEQ ID NO: 9287 - protein, 24 aa, artificial
  peptide fold or domain or sub-domain
IYLGGDSLEYKKPHPEPLQHCLSF

SEQ ID NO: 9288 - protein, 30 aa, artificial
  peptide fold or domain or sub-domain
IYLKEYKGKMYTFDSPACLWIFEQEPERYA

SEQ ID NO: 9289 - protein, 24 aa, artificial
  peptide fold or domain or sub-domain
IYMDSARSLSEGRKYRKEICVQRP

SEQ ID NO: 9290 - protein, 30 aa, artificial
  peptide fold or domain or sub-domain
IYNDTKRMSEAEEEEYGATFVSLDRLLSDS

SEQ ID NO: 9291 - protein, 30 aa, artificial
  peptide fold or domain or sub-domain
IYNHKALRESESLKSHKYHTGSDCEVLAHL

SEQ ID NO: 9292 - protein, 30 aa, artificial
  peptide fold or domain or sub-domain
IYNYRELRPSLQRRGHRFATDCDTEIIVHA

SEQ ID NO: 9293 - protein, 26 aa, artificial
  peptide fold or domain or sub-domain
IYPEKIIWDIGGIAPKPCHEILKDTI

SEQ ID NO: 9294 - protein, 25 aa, artificial
  peptide fold or domain or sub-domain
IYQRHKDELGELDKMARWNRLAELN

SEQ ID NO: 9295 - protein, 24 aa, artificial
  peptide fold or domain or sub-domain
IYRELAYGSFLRRYQGWVKELKPL

SEQ ID NO: 9296 - protein, 21 aa, artificial
  peptide fold or domain or sub-domain
IYRLIKREGASHSSTFTVLVK

SEQ ID NO: 9297 - protein, 27 aa, artificial
  peptide fold or domain or sub-domain
IYRTATGFGFAEPYNLYGSLKELVLHY

SEQ ID NO: 9298 - protein, 21 aa, artificial
  peptide fold or domain or sub-domain
IYRTKSESGPDHAKTFQVVVR

SEQ ID NO: 9299 - protein, 24 aa, artificial
  peptide fold or domain or sub-domain
IYSAKRFKGLRLYEYARKNISVQI

SEQ ID NO: 9300 - protein, 28 aa, artificial
  peptide fold or domain or sub-domain
IYSDVLRKERRGDYLGATVQVIPHITNA

SEQ ID NO: 9301 - protein, 26 aa, artificial
  peptide fold or domain or sub-domain
IYSGILLEREGEKGKLPNISRSSYEM

SEQ ID NO: 9302 - protein, 26 aa, artificial
  peptide fold or domain or sub-domain
IYSMVERGHRTYPGTPFDMPVYETDC

SEQ ID NO: 9303 - protein, 24 aa, artificial
  peptide fold or domain or sub-domain
IYSQESICNELGISRTPVREALIE

SEQ ID NO: 9304 - protein, 22 aa, artificial
  peptide fold or domain or sub-domain
IYSVEWNSSIVKWFVNGNQYFE

SEQ ID NO: 9305 - protein, 20 aa, artificial
  peptide fold or domain or sub-domain
IYSYFVKAGLSKLTNSINEF

SEQ ID NO: 9306 - protein, 23 aa, artificial
  peptide fold or domain or sub-domain
IYSYTSHLSASKQDPIDDKVREL

SEQ ID NO: 9307 - protein, 30 aa, artificial
  peptide fold or domain or sub-domain
IYTHGDRSDQCEKSPEAGSPTQSCVYNLPK

SEQ ID NO: 9308 - protein, 27 aa, artificial
  peptide fold or domain or sub-domain
IYVSSSRIGFGVSNICDNNISTYWQSN

SEQ ID NO: 9309 - protein, 26 aa, artificial
  peptide fold or domain or sub-domain
IYWYRPDGARKLEDDWHDPDNQCFAV

SEQ ID NO: 9310 - protein, 24 aa, artificial
  peptide fold or domain or sub-domain
IYYIGKGATSWEGYAGRKDVPGTT

SEQ ID NO: 9311 - protein, 24 aa, artificial
  peptide fold or domain or sub-domain
IYYVGNGASSFQGDEFARGEPGTE

SEQ ID NO: 9312 - protein, 26 aa, artificial
  peptide fold or domain or sub-domain
KAADFEMATAVNAAVLGLNQTISDAV

SEQ ID NO: 9313 - protein, 22 aa, artificial
  peptide fold or domain or sub-domain
KAAETIDAWNAEDRYTDAYYLH

SEQ ID NO: 9314 - protein, 21 aa, artificial
  peptide fold or domain or sub-domain
KAAMLAARDAVRAVDPDTYFY

SEQ ID NO: 9315 - protein, 29 aa, artificial
  peptide fold or domain or sub-domain
KAARLARAKELLEQVQLDPEKHVRRINRL

SEQ ID NO: 9316 - protein, 25 aa, artificial
  peptide fold or domain or sub-domain
KAASIQAIKECWGVTMDLDDIKCIW

SEQ ID NO: 9317 - protein, 24 aa, artificial
  peptide fold or domain or sub-domain
KAAVLTDGHEFDHPEHVAHVALAH

SEQ ID NO: 9318 - protein, 20 aa, artificial
  peptide fold or domain or sub-domain
KAAVSTASPAVNSAYNAMMM

SEQ ID NO: 9319 - protein, 23 aa, artificial
  peptide fold or domain or sub-domain
KAAYKKTAADMRFYTPEGLEAAA

SEQ ID NO: 9320 - protein, 22 aa, artificial
  peptide fold or domain or sub-domain
KADHDLLKKIEKIRRLLVEGQK

SEQ ID NO: 9321 - protein, 28 aa, artificial
  peptide fold or domain or sub-domain
KADHDLLKKIEKIRRLLVEGQKLYRSAD

SEQ ID NO: 9322 - protein, 30 aa, artificial
  peptide fold or domain or sub-domain
KADLKKETDPLRKRVLDGRQLALKVSANSV

SEQ ID NO: 9323 - protein, 23 aa, artificial
  peptide fold or domain or sub-domain
KADPGWRNAMRRRGLTDKDIELV

SEQ ID NO: 9324 - protein, 30 aa, artificial
  peptide fold or domain or sub-domain
KADPQHFRLIRHVYSRLGINFEYDRENVYV

SEQ ID NO: 9325 - protein, 30 aa, artificial
  peptide fold or domain or sub-domain
KAECLEAFQNSDWFGRLDARAHLVARTVLQ

SEQ ID NO: 9326 - protein, 24 aa, artificial
  peptide fold or domain or sub-domain
KAEEAGNLMLQGKFDDAYQLHQMG

SEQ ID NO: 9327 - protein, 28 aa, artificial
  peptide fold or domain or sub-domain
KAEIIKYEDLIKLGSEKAVKDAGLMKLV

SEQ ID NO: 9328 - protein, 25 aa, artificial
  peptide fold or domain or sub-domain
KAEPQAPWIMPMNAKYWEKETKKQR

SEQ ID NO: 9329 - protein, 24 aa, artificial
  peptide fold or domain or sub-domain
KAEQKWALFPDRSIRPYSDRDLCL

SEQ ID NO: 9330 - protein, 27 aa, artificial
  peptide fold or domain or sub-domain
KAETEIDEFCRQNAEKPDIYKFALLLV

SEQ ID NO: 9331 - protein, 29 aa, artificial
  peptide fold or domain or sub-domain
KAETGATDEDVEQLMSHDLPERHEAKCLR

SEQ ID NO: 9332 - protein, 26 aa, artificial
  peptide fold or domain or sub-domain
KAEVHLINTRNGPIQIASLPWLRRSS

SEQ ID NO: 9333 - protein, 24 aa, artificial
  peptide fold or domain or sub-domain
KAFDLSADALAKVRAEGLQVATSA

SEQ ID NO: 9334 - protein, 30 aa, artificial
  peptide fold or domain or sub-domain
KAFLAPLPIEKIPMVGKKTTEILHQAGIFD

SEQ ID NO: 9335 - protein, 25 aa, artificial
  peptide fold or domain or sub-domain
KAFLRALVDYTSDSAEKRRLQELCS

SEQ ID NO: 9336 - protein, 25 aa, artificial
  peptide fold or domain or sub-domain
KAFQALFALNANPDADENQLFQQLL

SEQ ID NO: 9337 - protein, 21 aa, artificial
  peptide fold or domain or sub-domain
KAFVEHYYSTFDTNRVGLAGL

SEQ ID NO: 9338 - protein, 23 aa, artificial
  peptide fold or domain or sub-domain
KAGAHYKLATPDTPLEIATRNGL

SEQ ID NO: 9339 - protein, 30 aa, artificial
  peptide fold or domain or sub-domain
KAHILCCNLMLVEVIPKEPLSFSVFHYKNP

SEQ ID NO: 9340 - protein, 30 aa, artificial
  peptide fold or domain or sub-domain
KAHIQVNKMTLQDLSDQTNGNRFSLCSIDP

SEQ ID NO: 9341 - protein, 28 aa, artificial
  peptide fold or domain or sub-domain
KAHSTALTAELAKKNGYEEPLGDLQTVT

SEQ ID NO: 9342 - protein, 23 aa, artificial
  peptide fold or domain or sub-domain
KAIAAYSIACQVSSMNVRACFKT

SEQ ID NO: 9343 - protein, 29 aa, artificial
  peptide fold or domain or sub-domain
KAILTNNGDKNFVTNKILSQFLNIKPPSV

SEQ ID NO: 9344 - protein, 29 aa, artificial
  peptide fold or domain or sub-domain
KAILVEPEFNPKMAEVIASEAGCEVVEID

SEQ ID NO: 9345 - protein, 23 aa, artificial
  peptide fold or domain or sub-domain
KAIQSTLMKALADPTAKTNTALS

SEQ ID NO: 9346 - protein, 26 aa, artificial
  peptide fold or domain or sub-domain
KAITTYVGENPLFTQHLFHGEFEVEF

SEQ ID NO: 9347 - protein, 24 aa, artificial
  peptide fold or domain or sub-domain
KAIVDHREKKKTEDREDLIDVLLK

SEQ ID NO: 9348 - protein, 29 aa, artificial
  peptide fold or domain or sub-domain
KAIYLLQQQVGAVTTTLLGEQRGSRPASV

SEQ ID NO: 9349 - protein, 29 aa, artificial
  peptide fold or domain or sub-domain
KAIYLLSRESIDVSITELSKKMNVSKPTS

SEQ ID NO: 9350 - protein, 27 aa, artificial
  peptide fold or domain or sub-domain
KAKFWECDGIDDCGDKTDEETCVKCKE

SEQ ID NO: 9351 - protein, 26 aa, artificial
  peptide fold or domain or sub-domain
KAKLIHSKDKKGFDDFREGKIDVLIG

SEQ ID NO: 9352 - protein, 23 aa, artificial
  peptide fold or domain or sub-domain
KAKQLPALDDEFAKDVDEEVETL

SEQ ID NO: 9353 - protein, 24 aa, artificial
  peptide fold or domain or sub-domain
KALARVAEQAKGEGDINEHCDPQD

SEQ ID NO: 9354 - protein, 24 aa, artificial
  peptide fold or domain or sub-domain
KALCLPHDSVKFEDSISVFAPIGS

SEQ ID NO: 9355 - protein, 25 aa, artificial
  peptide fold or domain or sub-domain
KALDIDKNAVKAYRHNFGDYVEQAD

SEQ ID NO: 9356 - protein, 22 aa, artificial
  peptide fold or domain or sub-domain
KALDTSQPGTNALDRNKHGIQR

SEQ ID NO: 9357 - protein, 28 aa, artificial
  peptide fold or domain or sub-domain
KALFDIKYKFMGKKIKGAPIFYIDELQK

SEQ ID NO: 9358 - protein, 29 aa, artificial
  peptide fold or domain or sub-domain
KALFSEPGVDNKLLTSLSKDLNLTLRSLN

SEQ ID NO: 9359 - protein, 27 aa, artificial
  peptide fold or domain or sub-domain
KALGQLAATAKRNHVDFVYAISPGPTV

SEQ ID NO: 9360 - protein, 30 aa, artificial
  peptide fold or domain or sub-domain
KALKEHLEPLISKLKETGCELKTGNDYIKI

SEQ ID NO: 9361 - protein, 22 aa, artificial
  peptide fold or domain or sub-domain
KALLNYCLLQHGKLQGPTRFAT

SEQ ID NO: 9362 - protein, 29 aa, artificial
  peptide fold or domain or sub-domain
KALLTEPGIKDKRVEQISSDLNLSLEEIN

SEQ ID NO: 9363 - protein, 30 aa, artificial
  peptide fold or domain or sub-domain
KALMKTERNESKRKQMDIRQMALKLTANSM

SEQ ID NO: 9364 - protein, 30 aa, artificial
  peptide fold or domain or sub-domain
KALPAQEAILSDATKDDESRWKALAFVIHL

SEQ ID NO: 9365 - protein, 25 aa, artificial
  peptide fold or domain or sub-domain
KALQALFQIDVSDIAVNEAIEHALD

SEQ ID NO: 9366 - protein, 26 aa, artificial
  peptide fold or domain or sub-domain
KALTEKLEGVDLSSLAQLHRSLSTYQ

SEQ ID NO: 9367 - protein, 28 aa, artificial
  peptide fold or domain or sub-domain
KALTLRGFKYNIENIDVRKGEARCISNI

SEQ ID NO: 9368 - protein, 30 aa, artificial
  peptide fold or domain or sub-domain
KALWLKSPSEVTKEEYKEFYQHLTHDWNEP

SEQ ID NO: 9369 - protein, 23 aa, artificial
  peptide fold or domain or sub-domain
KAMAALEIAENVADVSVEGCFVE

SEQ ID NO: 9370 - protein, 26 aa, artificial
  peptide fold or domain or sub-domain
KANQESLMQLNRGVCLDQESFEGFVR

SEQ ID NO: 9371 - protein, 22 aa, artificial
  peptide fold or domain or sub-domain
KANRLGDLPDDYILPYRADAAM

SEQ ID NO: 9372 - protein, 26 aa, artificial
  peptide fold or domain or sub-domain
KAPFQASSPQDLRLFYEKNKILMPNP

SEQ ID NO: 9373 - protein, 25 aa, artificial
  peptide fold or domain or sub-domain
KAPFRQRKEKVKREEVERRVREDQE

SEQ ID NO: 9374 - protein, 26 aa, artificial
  peptide fold or domain or sub-domain
KAPKMVGDVAIYGIDSVPKSKIPLFD

SEQ ID NO: 9375 - protein, 28 aa, artificial
  peptide fold or domain or sub-domain
KAQAEVRAALKGKTDWDVDDVQELKYMK

SEQ ID NO: 9376 - protein, 24 aa, artificial
  peptide fold or domain or sub-domain
KAQAYGVVETQNNLVKGIEEKPKY

SEQ ID NO: 9377 - protein, 21 aa, artificial
  peptide fold or domain or sub-domain
KAQILSAWERIKALNPDIYFF

SEQ ID NO: 9378 - protein, 28 aa, artificial
  peptide fold or domain or sub-domain
KAQSEVRETFKGQDKLTEDDVAKLSYLQ

SEQ ID NO: 9379 - protein, 21 aa, artificial
  peptide fold or domain or sub-domain
KARARMVSSFDLENTQPEWAL

SEQ ID NO: 9380 - protein, 29 aa, artificial
  peptide fold or domain or sub-domain
KARNEASEYKYRYGMPMLVSVLAKPWQDM

SEQ ID NO: 9381 - protein, 29 aa, artificial
  peptide fold or domain or sub-domain
KARSEASEFLYSNGYNVNAETLCRNICDK

SEQ ID NO: 9382 - protein, 28 aa, artificial
  peptide fold or domain or sub-domain
KARSEIDEKIGKDRLIDESDIAVLPYLQ

SEQ ID NO: 9383 - protein, 29 aa, artificial
  peptide fold or domain or sub-domain
KARVETQNHWFTYNETMTVESVTQAVSNL

SEQ ID NO: 9384 - protein, 27 aa, artificial
  peptide fold or domain or sub-domain
KARWIAQVLSGTQPSGDAAKRVLALLA

SEQ ID NO: 9385 - protein, 22 aa, artificial
  peptide fold or domain or sub-domain
KASDLARVWFEENRYQDYLYLH

SEQ ID NO: 9386 - protein, 24 aa, artificial
  peptide fold or domain or sub-domain
KASLQHTYMEGEDYVFMDMSTYEE

SEQ ID NO: 9387 - protein, 27 aa, artificial
  peptide fold or domain or sub-domain
KATCDISECPEGMMCSRLTNKCDCKID

SEQ ID NO: 9388 - protein, 24 aa, artificial
  peptide fold or domain or sub-domain
KATDIIGKRFEEGRYFVSDLIMAG

SEQ ID NO: 9389 - protein, 29 aa, artificial
  peptide fold or domain or sub-domain
KATIELTETDSGLKIIIRDEKSGAKSTIY

SEQ ID NO: 9390 - protein, 27 aa, artificial
  peptide fold or domain or sub-domain
KATIVAGSTDVGLWVTKMMRDISPVVF

SEQ ID NO: 9391 - protein, 20 aa, artificial
  peptide fold or domain or sub-domain
KATRDATFHISKNSTKPVKM

SEQ ID NO: 9392 - protein, 27 aa, artificial
  peptide fold or domain or sub-domain
KATVLAGGTDLLVQIKESVRKPEQVIN

SEQ ID NO: 9393 - protein, 21 aa, artificial
  peptide fold or domain or sub-domain
KAVEILSQEKNIPVEEILKVL

SEQ ID NO: 9394 - protein, 26 aa, artificial
  peptide fold or domain or sub-domain
KAVGSYFTPNPDAARLYSEGKLEVEL

SEQ ID NO: 9395 - protein, 24 aa, artificial
  peptide fold or domain or sub-domain
KAYFKSFDNMDMSEIKQSPKLRAH

SEQ ID NO: 9396 - protein, 25 aa, artificial
  peptide fold or domain or sub-domain
KAYKPTAADKIDSAVLIADDWLLTP

SEQ ID NO: 9397 - protein, 26 aa, artificial
  peptide fold or domain or sub-domain
KAYKYNEWEKVFGYDSFLTQHTSTYT

SEQ ID NO: 9398 - protein, 27 aa, artificial
  peptide fold or domain or sub-domain
KAYMKEVLAKLADNNPSRVDAFKKDAA

SEQ ID NO: 9399 - protein, 28 aa, artificial
  peptide fold or domain or sub-domain
KAYMPKNGAKALKKYAYKILKHSGGNGA

SEQ ID NO: 9400 - protein, 22 aa, artificial
  peptide fold or domain or sub-domain
KAYTSNMVRAILKKRDSINVAS

SEQ ID NO: 9401 - protein, 20 aa, artificial
  peptide fold or domain or sub-domain
KCAVQKAISIGQLDERRLNN

SEQ ID NO: 9402 - protein, 20 aa, artificial
  peptide fold or domain or sub-domain
KCEENYFSCPSGRCILNTWI

SEQ ID NO: 9403 - protein, 25 aa, artificial
  peptide fold or domain or sub-domain
KCFFIEEMNLSQYTTTNYDIKKNIR

SEQ ID NO: 9404 - protein, 28 aa, artificial
  peptide fold or domain or sub-domain
KCHEEIDRVFGNKNCLEYEDRERMPYTQ

SEQ ID NO: 9405 - protein, 26 aa, artificial
  peptide fold or domain or sub-domain
KCIVFDRPQVVENLSGSNNLTYVGGD

SEQ ID NO: 9406 - protein, 22 aa, artificial
  peptide fold or domain or sub-domain
KCLQSISEMHDDDSSDLLHWPN

SEQ ID NO: 9407 - protein, 25 aa, artificial
  peptide fold or domain or sub-domain
KCPVCNHLLSKEGNTFKCENNHTFD

SEQ ID NO: 9408 - protein, 29 aa, artificial
  peptide fold or domain or sub-domain
KCREIAGKFAFEKGVEIPVSYLSHKIADV

SEQ ID NO: 9409 - protein, 23 aa, artificial
  peptide fold or domain or sub-domain
KCRLLSGSCQPNKNGRWFCKKCR

SEQ ID NO: 9410 - protein, 26 aa, artificial
  peptide fold or domain or sub-domain
KCSVLDLAHVVAKAPTHTDVQFIAGD

SEQ ID NO: 9411 - protein, 26 aa, artificial
  peptide fold or domain or sub-domain
KCSVLDLPNVIDTITVDGIIEYIAGD

SEQ ID NO: 9412 - protein, 26 aa, artificial
  peptide fold or domain or sub-domain
KCSVMDLNHVIERVIKNPKLDYVAGD

SEQ ID NO: 9413 - protein, 26 aa, artificial
  peptide fold or domain or sub-domain
KCTSQFDGIPFMDAEVWLVPYHEPAI

SEQ ID NO: 9414 - protein, 21 aa, artificial
  peptide fold or domain or sub-domain
KCVELLNSPKLEVKEQAIWTL

SEQ ID NO: 9415 - protein, 22 aa, artificial
  peptide fold or domain or sub-domain
KCVQCKAPCKTCKSDQICLSCV

SEQ ID NO: 9416 - protein, 24 aa, artificial
  peptide fold or domain or sub-domain
KDAFKQIVQTKMGLSAEASAKYMD

SEQ ID NO: 9417 - protein, 26 aa, artificial
  peptide fold or domain or sub-domain
KDALEYAELAEMESDEDSLNDARAQL

SEQ ID NO: 9418 - protein, 24 aa, artificial
  peptide fold or domain or sub-domain
KDALNTDSPEHLCALIDFAIAMRQ

SEQ ID NO: 9419 - protein, 26 aa, artificial
  peptide fold or domain or sub-domain
KDAQTQLERLKADTPGKTLIRQLRNQ

SEQ ID NO: 9420 - protein, 21 aa, artificial
  peptide fold or domain or sub-domain
KDAYYYEQIRKPLSQRDLVMV

SEQ ID NO: 9421 - protein, 27 aa, artificial
  peptide fold or domain or sub-domain
KDDKFDSVSDEEYLFDELCIKGFREYS

SEQ ID NO: 9422 - protein, 27 aa, artificial
  peptide fold or domain or sub-domain
KDEGPRALPPGVHRLAHVRELPALLDR

SEQ ID NO: 9423 - protein, 28 aa, artificial
  peptide fold or domain or sub-domain
KDEWRYWQADLLLERGREAEAKEILHQL

SEQ ID NO: 9424 - protein, 27 aa, artificial
  peptide fold or domain or sub-domain
KDFDKRYVTLRVKLLGPIVLPVRKAVL

SEQ ID NO: 9425 - protein, 23 aa, artificial
  peptide fold or domain or sub-domain
KDFGPGFVNYEDNQDRISKAQLD

SEQ ID NO: 9426 - protein, 26 aa, artificial
  peptide fold or domain or sub-domain
KDFIDLVYSDERVRLNFTKEDILSWV

SEQ ID NO: 9427 - protein, 30 aa, artificial
  peptide fold or domain or sub-domain
KDFIRKLPIGKFFGVGRVTKNKLNNIGVFK

SEQ ID NO: 9428 - protein, 26 aa, artificial
  peptide fold or domain or sub-domain
KDFLEELLNDKDVTKALSKAEICEKF

SEQ ID NO: 9429 - protein, 24 aa, artificial
  peptide fold or domain or sub-domain
KDFQARRADIQYRPERHESAEHLH

SEQ ID NO: 9430 - protein, 23 aa, artificial
  peptide fold or domain or sub-domain
KDGILYDRIIHVVQRGDALYNLA

SEQ ID NO: 9431 - protein, 25 aa, artificial
  peptide fold or domain or sub-domain
KDHAWDVLRMIVMREPSDIEARAFE

SEQ ID NO: 9432 - protein, 27 aa, artificial
  peptide fold or domain or sub-domain
KDHRKIIDEGFGLIHAVGKGSNHGPRL

SEQ ID NO: 9433 - protein, 27 aa, artificial
  peptide fold or domain or sub-domain
KDIGYIFKEKFAKAVGQGCVEIGSQRY

SEQ ID NO: 9434 - protein, 22 aa, artificial
  peptide fold or domain or sub-domain
KDISNTPMRDEFLRTGAIHDDF

SEQ ID NO: 9435 - protein, 27 aa, artificial
  peptide fold or domain or sub-domain
KDITAVDFSVRPFVLKSGKETFTCDAC

SEQ ID NO: 9436 - protein, 30 aa, artificial
  peptide fold or domain or sub-domain
KDKIQKNEFDEEYSRLEHEQKSIKVLANSH

SEQ ID NO: 9437 - protein, 23 aa, artificial
  peptide fold or domain or sub-domain
KDKSKVQQTMANDDYTFDTTNVY

SEQ ID NO: 9438 - protein, 26 aa, artificial
  peptide fold or domain or sub-domain
KDLAELAEMISDSDDRDFLATINAEL

SEQ ID NO: 9439 - protein, 23 aa, artificial
  peptide fold or domain or sub-domain
KDLASGPFFGFNQPGAKSSAGMV

SEQ ID NO: 9440 - protein, 21 aa, artificial
  peptide fold or domain or sub-domain
KDLFFNKYNYNSKFLSTIKSY

SEQ ID NO: 9441 - protein, 29 aa, artificial
  peptide fold or domain or sub-domain
KDLHLLLVAPKVAKLPKDLVMRVIEDIMD

SEQ ID NO: 9442 - protein, 26 aa, artificial
  peptide fold or domain or sub-domain
KDLIEVIGEVRGRRSDFFMTARLCLP

SEQ ID NO: 9443 - protein, 22 aa, artificial
  peptide fold or domain or sub-domain
KDLILHMRNLLIIKVSQNPYEV

SEQ ID NO: 9444 - protein, 30 aa, artificial
  peptide fold or domain or sub-domain
KDLLHSIIQGSKDGPFASCTPEDFIVDNCK

SEQ ID NO: 9445 - protein, 27 aa, artificial
  peptide fold or domain or sub-domain
KDLTFENKFFSLKFNENGTFDLIHKGT

SEQ ID NO: 9446 - protein, 26 aa, artificial
  peptide fold or domain or sub-domain
KDLTSHYSHSAHNDNIYSFIKLYSKR

SEQ ID NO: 9447 - protein, 28 aa, artificial
  peptide fold or domain or sub-domain
KDMNDMAVSRANNNGSDGQGDDLGSLLQ

SEQ ID NO: 9448 - protein, 26 aa, artificial
  peptide fold or domain or sub-domain
KDNAELIELGEAEGDDEIVADAEAAL

SEQ ID NO: 9449 - protein, 22 aa, artificial
  peptide fold or domain or sub-domain
KDNDLLVPITASLYVPGRLISP

SEQ ID NO: 9450 - protein, 22 aa, artificial
  peptide fold or domain or sub-domain
KDNTILAPISQSIYVDATICDV

SEQ ID NO: 9451 - protein, 30 aa, artificial
  peptide fold or domain or sub-domain
KDPEGQAFLNNYLPNILNLGRVNGKLEGMP

SEQ ID NO: 9452 - protein, 24 aa, artificial
  peptide fold or domain or sub-domain
KDPSNGNNIQIRVGGWKAARVEFT

SEQ ID NO: 9453 - protein, 27 aa, artificial
  peptide fold or domain or sub-domain
KDQKSYVRDIMCPQTKRKLTYKEALEK

SEQ ID NO: 9454 - protein, 28 aa, artificial
  peptide fold or domain or sub-domain
KDQLSDLLRLTWPEEYGDSSAEEVEEMM

SEQ ID NO: 9455 - protein, 26 aa, artificial
  peptide fold or domain or sub-domain
KDRKDAEELIQSEKDEEMHSMLKEEI

SEQ ID NO: 9456 - protein, 20 aa, artificial
  peptide fold or domain or sub-domain
KDRRVMIERFNTEHRWRKRG

SEQ ID NO: 9457 - protein, 30 aa, artificial
  peptide fold or domain or sub-domain
KDSSQFYANRVMKEFKGKDDLQIEWVRSYL

SEQ ID NO: 9458 - protein, 29 aa, artificial
  peptide fold or domain or sub-domain
KDTSAHVRAEIINMGVNGTRFLLISPWGK

SEQ ID NO: 9459 - protein, 20 aa, artificial
  peptide fold or domain or sub-domain
KDTSEMPFRLSKTKTKAVQM

SEQ ID NO: 9460 - protein, 21 aa, artificial
  peptide fold or domain or sub-domain
KDTSLPDGPKAEGMLFGDGSP

SEQ ID NO: 9461 - protein, 29 aa, artificial
  peptide fold or domain or sub-domain
KDVEPVLYFEKFLVLDKGVCESDQIDSYK

SEQ ID NO: 9462 - protein, 25 aa, artificial
  peptide fold or domain or sub-domain
KDVIGDHFPSIVASQTVDGKLVAMP

SEQ ID NO: 9463 - protein, 21 aa, artificial
  peptide fold or domain or sub-domain
KDVMVYALEQIRKIDENTLFY

SEQ ID NO: 9464 - protein, 20 aa, artificial
  peptide fold or domain or sub-domain
KDVPVEQVTHADREQTKKVV

SEQ ID NO: 9465 - protein, 28 aa, artificial
  peptide fold or domain or sub-domain
KDVVIDLVGYRRFGHNEMDEPSITNPVP

SEQ ID NO: 9466 - protein, 24 aa, artificial
  peptide fold or domain or sub-domain
KDVYILLKGKEDSGSQHSDFQGRI

SEQ ID NO: 9467 - protein, 23 aa, artificial
  peptide fold or domain or sub-domain
KDWSQVEQNPFFCPDPDKIDALD

SEQ ID NO: 9468 - protein, 28 aa, artificial
  peptide fold or domain or sub-domain
KDYIALNEDLSSWTAADTAAQITQRKWE

SEQ ID NO: 9469 - protein, 27 aa, artificial
  peptide fold or domain or sub-domain
KDYMKSIKGKLEEQRPERVKPFMTGAA

SEQ ID NO: 9470 - protein, 25 aa, artificial
  peptide fold or domain or sub-domain
KDYRCVRADEYSLYAKNENTGVVVV

SEQ ID NO: 9471 - protein, 23 aa, artificial
  peptide fold or domain or sub-domain
KDYVFHHKENFNEDPTPGMMKVY

SEQ ID NO: 9472 - protein, 30 aa, artificial
  peptide fold or domain or sub-domain
KEAAEFFTNRVIKEYEEKDTVHLAWKKALM

SEQ ID NO: 9473 - protein, 29 aa, artificial
  peptide fold or domain or sub-domain
KEACNQLWRWVYYYNPKTKKREVSRGIKN

SEQ ID NO: 9474 - protein, 21 aa, artificial
  peptide fold or domain or sub-domain
KEAFSKAFGTGIGRQLSFQDI

SEQ ID NO: 9475 - protein, 27 aa, artificial
  peptide fold or domain or sub-domain
KEAILKDIPSFDRLIQSGDYAPIREWL

SEQ ID NO: 9476 - protein, 20 aa, artificial
  peptide fold or domain or sub-domain
KEAKCGRQHGEAQVKIWRHS

SEQ ID NO: 9477 - protein, 30 aa, artificial
  peptide fold or domain or sub-domain
KEALIKKADLDEYAPVTSGIVGKKVSAADL

SEQ ID NO: 9478 - protein, 27 aa, artificial
  peptide fold or domain or sub-domain
KEALKIAFGFNEPNGNLQYQGKDITEF

SEQ ID NO: 9479 - protein, 29 aa, artificial
  peptide fold or domain or sub-domain
KECFEQLKKQLTLQPDEKKTSNLSILHAA

SEQ ID NO: 9480 - protein, 25 aa, artificial
  peptide fold or domain or sub-domain
KEEEFDRLMCQERGFTNDRIKSGIQ

SEQ ID NO: 9481 - protein, 21 aa, artificial
  peptide fold or domain or sub-domain
KEEGLPTVETEEEGYVSGHKH

SEQ ID NO: 9482 - protein, 22 aa, artificial
  peptide fold or domain or sub-domain
KEEKVKGADPEDPSKESKISDL

SEQ ID NO: 9483 - protein, 29 aa, artificial
  peptide fold or domain or sub-domain
KEESKKRIERRLREVWEKLTGSTEIPGVE

SEQ ID NO: 9484 - protein, 25 aa, artificial
  peptide fold or domain or sub-domain
KEFETQISTLNEWEIENIKSLIKLV

SEQ ID NO: 9485 - protein, 28 aa, artificial
  peptide fold or domain or sub-domain
KEFMALDLDRVIHISSRPETEAIAHKWN

SEQ ID NO: 9486 - protein, 30 aa, artificial
  peptide fold or domain or sub-domain
KEGAENLRRATTDLGRSLGPVELLLRGSSR

SEQ ID NO: 9487 - protein, 21 aa, artificial
  peptide fold or domain or sub-domain
KEGETIYKLIGPVLLKQEKAE

SEQ ID NO: 9488 - protein, 28 aa, artificial
  peptide fold or domain or sub-domain
KEIEAEIKHDIMALVKAITEATGCRWVH

SEQ ID NO: 9489 - protein, 30 aa, artificial
  peptide fold or domain or sub-domain
KEIIEQGIDLFNKKPKRGIQYLQEQGMLGT

SEQ ID NO: 9490 - protein, 24 aa, artificial
  peptide fold or domain or sub-domain
KEIKLHELNGPNEQPQDLIEYYLA

SEQ ID NO: 9491 - protein, 29 aa, artificial
  peptide fold or domain or sub-domain
KEILFTCIKTKALEDMLDLLGAMPVTELT

SEQ ID NO: 9492 - protein, 27 aa, artificial
  peptide fold or domain or sub-domain
KEISDVNLEGKEKLVTAKDTDYYAKAV

SEQ ID NO: 9493 - protein, 22 aa, artificial
  peptide fold or domain or sub-domain
KEITLYKDNKFLLTSFKDESID

SEQ ID NO: 9494 - protein, 24 aa, artificial
  peptide fold or domain or sub-domain
KEIVEETKKKFGWPLEEFYVPEEA

SEQ ID NO: 9495 - protein, 29 aa, artificial
  peptide fold or domain or sub-domain
KEIYELEEMKGHARVTDIINDFNISPGTI

SEQ ID NO: 9496 - protein, 30 aa, artificial
  peptide fold or domain or sub-domain
KEKFFMRKVQINDKDDTNEYKHAFEIILKD

SEQ ID NO: 9497 - protein, 30 aa, artificial
  peptide fold or domain or sub-domain
KEKFVPIEKQSIAYMGEHLTLSENRIILDP

SEQ ID NO: 9498 - protein, 20 aa, artificial
  peptide fold or domain or sub-domain
KEKIEKKLMSRYHDKNVCVL

SEQ ID NO: 9499 - protein, 22 aa, artificial
  peptide fold or domain or sub-domain
KEKKRFDLLCEGFLILKKLISR

SEQ ID NO: 9500 - protein, 26 aa, artificial
  peptide fold or domain or sub-domain
KEKLTKVMKSMGKNPKAEQLQQMMSD

SEQ ID NO: 9501 - protein, 20 aa, artificial
  peptide fold or domain or sub-domain
KEKMMAELIENEQEHLLSDM

SEQ ID NO: 9502 - protein, 28 aa, artificial
  peptide fold or domain or sub-domain
KEKNKKWRTSILCKGITLQKLIEDGFLL

SEQ ID NO: 9503 - protein, 20 aa, artificial
  peptide fold or domain or sub-domain
KEKSQLSSQLEDARRSLEEE

SEQ ID NO: 9504 - protein, 23 aa, artificial
  peptide fold or domain or sub-domain
KEKVLPELDDDFAQAVNSRFDAL

SEQ ID NO: 9505 - protein, 30 aa, artificial
  peptide fold or domain or sub-domain
KEKYFMRRVDINDRPDSDDLKNSFELAPRM

SEQ ID NO: 9506 - protein, 29 aa, artificial
  peptide fold or domain or sub-domain
KELASLHDKHMNRPTLDDSSEEEHAIEIT

SEQ ID NO: 9507 - protein, 26 aa, artificial
  peptide fold or domain or sub-domain
KELETELDGEQKQHVETVKTLRKNER

SEQ ID NO: 9508 - protein, 28 aa, artificial
  peptide fold or domain or sub-domain
KELIAYDYQMGTFIPTTPEAQVAAQVWN

SEQ ID NO: 9509 - protein, 26 aa, artificial
  peptide fold or domain or sub-domain
KELIYAEINNSVADDLQNERIRVAID

SEQ ID NO: 9510 - protein, 29 aa, artificial
  peptide fold or domain or sub-domain
KELKDNYKPEIKASHILVKDEATAKKVKE

SEQ ID NO: 9511 - protein, 26 aa, artificial
  peptide fold or domain or sub-domain
KELKRGLRRIDHPMKNAENMLGDVFK

SEQ ID NO: 9512 - protein, 28 aa, artificial
  peptide fold or domain or sub-domain
KELLVFDKERAEYVPVTEEAEMVAHLWN

SEQ ID NO: 9513 - protein, 27 aa, artificial
  peptide fold or domain or sub-domain
KELQDKNAHEEQKQLFQRCANMMAYIQ

SEQ ID NO: 9514 - protein, 28 aa, artificial
  peptide fold or domain or sub-domain
KELSIENAKYPLKDYNLSFGDSRTVSNE

SEQ ID NO: 9515 - protein, 28 aa, artificial
  peptide fold or domain or sub-domain
KENARNVKIHSPDFDGMDPDEAAERYLK

SEQ ID NO: 9516 - protein, 24 aa, artificial
  peptide fold or domain or sub-domain
KENIAGPLRWVHGMPRIDAERRTT

SEQ ID NO: 9517 - protein, 30 aa, artificial
  peptide fold or domain or sub-domain
KEPDEDYLKSYVYDDNDGRGPYQTVALVAG

SEQ ID NO: 9518 - protein, 29 aa, artificial
  peptide fold or domain or sub-domain
KEPRSNGGSPIQGYIIEKRRHDKPDFERV

SEQ ID NO: 9519 - protein, 24 aa, artificial
  peptide fold or domain or sub-domain
KERKKNGIELPSKVVEELRLIGDQ

SEQ ID NO: 9520 - protein, 28 aa, artificial
  peptide fold or domain or sub-domain
KERQKDWKASIRIGRSSLRTHMEALTID

SEQ ID NO: 9521 - protein, 28 aa, artificial
  peptide fold or domain or sub-domain
KESGTVEKVTSTHIEIRNDRGYLDRYKL

SEQ ID NO: 9522 - protein, 20 aa, artificial
  peptide fold or domain or sub-domain
KESREQPRHWSAPEVFGSRA

SEQ ID NO: 9523 - protein, 27 aa, artificial
  peptide fold or domain or sub-domain
KEVFLVDFSELEQGPEGLAEADVQGLI

SEQ ID NO: 9524 - protein, 28 aa, artificial
  peptide fold or domain or sub-domain
KEVMMFDKVRVVYVPATQEVLTMTQQWN

SEQ ID NO: 9525 - protein, 21 aa, artificial
  peptide fold or domain or sub-domain
KEVTGVGENYIDTKVDTYNVR

SEQ ID NO: 9526 - protein, 23 aa, artificial
  peptide fold or domain or sub-domain
KEWAENAVFLSIIGDFNFWDKAA

SEQ ID NO: 9527 - protein, 23 aa, artificial
  peptide fold or domain or sub-domain
KEWAPGAEGVFLTGDFNGWNPFS

SEQ ID NO: 9528 - protein, 26 aa, artificial
  peptide fold or domain or sub-domain
KEWLIDPQRNGSSLFIPGSSIKAREA

SEQ ID NO: 9529 - protein, 27 aa, artificial
  peptide fold or domain or sub-domain
KEYAGKLNEHYKKNLPDKVAEFQDKFQ

SEQ ID NO: 9530 - protein, 29 aa, artificial
  peptide fold or domain or sub-domain
KEYDSRIGAMQRAEYRARHILVDKEDVAK

SEQ ID NO: 9531 - protein, 24 aa, artificial
  peptide fold or domain or sub-domain
KEYKENGIPLSQEIINELRKTGEK

SEQ ID NO: 9532 - protein, 23 aa, artificial
  peptide fold or domain or sub-domain
KEYWTEKGRRLGIPESLVSSVLT

SEQ ID NO: 9533 - protein, 24 aa, artificial
  peptide fold or domain or sub-domain
KFAAQLIPLKDYCSKSGCSVFKTY

SEQ ID NO: 9534 - protein, 20 aa, artificial
  peptide fold or domain or sub-domain
KFAMQRDLGIFPTQLPQYLQ

SEQ ID NO: 9535 - protein, 30 aa, artificial
  peptide fold or domain or sub-domain
KFDFVYKDKEKKFHKVRDLTPQKFFCDFVG

SEQ ID NO: 9536 - protein, 30 aa, artificial
  peptide fold or domain or sub-domain
KFDLEFKDDDGNYKLDQNITPLDFFHNYFE

SEQ ID NO: 9537 - protein, 26 aa, artificial
  peptide fold or domain or sub-domain
KFDLPTSDADAATTGIAVRPVLLRKG

SEQ ID NO: 9538 - protein, 24 aa, artificial
  peptide fold or domain or sub-domain
KFEDIPAGTLGSWAALPQAGWAQI

SEQ ID NO: 9539 - protein, 27 aa, artificial
  peptide fold or domain or sub-domain
KFEDYGLRADVVQDPLPMYTFRVLSRI

SEQ ID NO: 9540 - protein, 20 aa, artificial
  peptide fold or domain or sub-domain
KFEEAEKKFPEQMNNFWHHP

SEQ ID NO: 9541 - protein, 30 aa, artificial
  peptide fold or domain or sub-domain
KFEERLKIPAPDPSTLFDDVYSETTWVIEE

SEQ ID NO: 9542 - protein, 24 aa, artificial
  peptide fold or domain or sub-domain
KFFFKNNNKKILLDPDTEISFYDY

SEQ ID NO: 9543 - protein, 20 aa, artificial
  peptide fold or domain or sub-domain
KFFKKEIKNDPEVLQLDEEG

SEQ ID NO: 9544 - protein, 20 aa, artificial
  peptide fold or domain or sub-domain
KFGSCADFRHFLKDNIIDVA

SEQ ID NO: 9545 - protein, 23 aa, artificial
  peptide fold or domain or sub-domain
KFIAQDAGTKVEYGEDTQEGQWG

SEQ ID NO: 9546 - protein, 30 aa, artificial
  peptide fold or domain or sub-domain
KFIDPKSGTLAEHFNADWSPILENGKFVFE

SEQ ID NO: 9547 - protein, 30 aa, artificial
  peptide fold or domain or sub-domain
KFIEGMIDNSIQLRGLKKMEMCKKLQSLGF

SEQ ID NO: 9548 - protein, 27 aa, artificial
  peptide fold or domain or sub-domain
KFIEVIRAFFAGAKTISKDFIARITEV

SEQ ID NO: 9549 - protein, 30 aa, artificial
  peptide fold or domain or sub-domain
KFIKMIIEKELTVTNKPRNAIIQELENLGF

SEQ ID NO: 9550 - protein, 30 aa, artificial
  peptide fold or domain or sub-domain
KFILAIVNNELIVNKKKKKVLVEELYRKGY

SEQ ID NO: 9551 - protein, 30 aa, artificial
  peptide fold or domain or sub-domain
KFINMVIDDKITIKGKQKAELVKEIASNPD

SEQ ID NO: 9552 - protein, 30 aa, artificial
  peptide fold or domain or sub-domain
KFITLVVNGTLEIRNARKKGVLNKLKELGL

SEQ ID NO: 9553 - protein, 29 aa, artificial
  peptide fold or domain or sub-domain
KFKEWSDALATSLGRGPDLRTQREMSEYF

SEQ ID NO: 9554 - protein, 30 aa, artificial
  peptide fold or domain or sub-domain
KFKLPIQKETWETWWTEYWQATWIPEWEFV

SEQ ID NO: 9555 - protein, 26 aa, artificial
  peptide fold or domain or sub-domain
KFKSGNGINVSGKTVNGRREITFELA

SEQ ID NO: 9556 - protein, 26 aa, artificial
  peptide fold or domain or sub-domain
KFLADLTLEEFKAFSALFEADIYQAI

SEQ ID NO: 9557 - protein, 24 aa, artificial
  peptide fold or domain or sub-domain
KFLCKLSALRQNIAQVMNLTPTDI

SEQ ID NO: 9558 - protein, 28 aa, artificial
  peptide fold or domain or sub-domain
KFNELKLHDKSEYPHDVNASEAQRDFAR

SEQ ID NO: 9559 - protein, 28 aa, artificial
  peptide fold or domain or sub-domain
KFNELNDLLKSKGSWDGGDQGLLNEWQG

SEQ ID NO: 9560 - protein, 27 aa, artificial
  peptide fold or domain or sub-domain
KFNHKNSTHNGIKSIYKSFGAKCIFNT

SEQ ID NO: 9561 - protein, 21 aa, artificial
  peptide fold or domain or sub-domain
KFNNNAGWTNLRFDEPGLLSQ

SEQ ID NO: 9562 - protein, 21 aa, artificial
  peptide fold or domain or sub-domain
KFNNNAGYVSQTDNPYSSLAQ

SEQ ID NO: 9563 - protein, 21 aa, artificial
  peptide fold or domain or sub-domain
KFNSNSGWTPNDGDVWAEAMQ

SEQ ID NO: 9564 - protein, 21 aa, artificial
  peptide fold or domain or sub-domain
KFPYKQGRLPNDIEMAKQLQG

SEQ ID NO: 9565 - protein, 25 aa, artificial
  peptide fold or domain or sub-domain
KFQASPEAYESAIKAQDKDALMDML

SEQ ID NO: 9566 - protein, 25 aa, artificial
  peptide fold or domain or sub-domain
KFQGAPDTYTPAILNKDSDKLMELL

SEQ ID NO: 9567 - protein, 25 aa, artificial
  peptide fold or domain or sub-domain
KFQKETEKFVALIKAGDRKEIDEAI

SEQ ID NO: 9568 - protein, 25 aa, artificial
  peptide fold or domain or sub-domain
KFQSDIPLYTKLIKSKDVEGIMKNI

SEQ ID NO: 9569 - protein, 27 aa, artificial
  peptide fold or domain or sub-domain
KFRDLVLSRGAASDYSNAFEELRGRSK

SEQ ID NO: 9570 - protein, 24 aa, artificial
  peptide fold or domain or sub-domain
KFRDYYIWAAHDEPRPGSGWRHLS

SEQ ID NO: 9571 - protein, 24 aa, artificial
  peptide fold or domain or sub-domain
KFSAVKVSGRRAYEYARDNKKIII

SEQ ID NO: 9572 - protein, 24 aa, artificial
  peptide fold or domain or sub-domain
KFSAYIKNSNPALNDNLEKGLLKA

SEQ ID NO: 9573 - protein, 21 aa, artificial
  peptide fold or domain or sub-domain
KFSDEYLTKQWRYPIELHGIG

SEQ ID NO: 9574 - protein, 29 aa, artificial
  peptide fold or domain or sub-domain
KFSDEYLTKQWRYPIELHGIGKYGNDSYR

SEQ ID NO: 9575 - protein, 24 aa, artificial
  peptide fold or domain or sub-domain
KFSDIPDGLGAISKVPNAGWIQIL

SEQ ID NO: 9576 - protein, 24 aa, artificial
  peptide fold or domain or sub-domain
KFTAQILSVSGDVIQLMDMRDYKT

SEQ ID NO: 9577 - protein, 29 aa, artificial
  peptide fold or domain or sub-domain
KFVDEGIKTLEDLRKNEDKLNHHQRIGLK

SEQ ID NO: 9578 - protein, 30 aa, artificial
  peptide fold or domain or sub-domain
KFVEHFRQGHIDFLAATDDTLTKTCVKLGL

SEQ ID NO: 9579 - protein, 28 aa, artificial
  peptide fold or domain or sub-domain
KFVFCNGLVLHRLQCLRGFGEWLDSIKD

SEQ ID NO: 9580 - protein, 26 aa, artificial
  peptide fold or domain or sub-domain
KFVGAHIGTCPEAQEQYNAGTLEVEF

SEQ ID NO: 9581 - protein, 27 aa, artificial
  peptide fold or domain or sub-domain
KFVGPTLGPVEASDGQSFTTEFTFEGC

SEQ ID NO: 9582 - protein, 26 aa, artificial
  peptide fold or domain or sub-domain
KFVTDICKDIDRTYNLPDGSSIYEIR

SEQ ID NO: 9583 - protein, 30 aa, artificial
  peptide fold or domain or sub-domain
KFWLVDSKGLITNSRDLNSLDKFKVPFIRK

SEQ ID NO: 9584 - protein, 30 aa, artificial
  peptide fold or domain or sub-domain
KGDGGDGIANIKSRSDYILTKLDGERQKSI

SEQ ID NO: 9585 - protein, 30 aa, artificial
  peptide fold or domain or sub-domain
KGDKKDNVASVKVRSDFWFTRVEGERTPSM

SEQ ID NO: 9586 - protein, 22 aa, artificial
  peptide fold or domain or sub-domain
KGDTQIIDSGAGVLANAANSAG

SEQ ID NO: 9587 - protein, 30 aa, artificial
  peptide fold or domain or sub-domain
KGEQVIKIFKSLDFNVVKTGIRYGTVTLII

SEQ ID NO: 9588 - protein, 26 aa, artificial
  peptide fold or domain or sub-domain
KGEYKDDFKRMLEEQGEEYVDGMEWW

SEQ ID NO: 9589 - protein, 28 aa, artificial
  peptide fold or domain or sub-domain
KGFDHVAELAMSGDLAQPAKIVSACEDF

SEQ ID NO: 9590 - protein, 25 aa, artificial
  peptide fold or domain or sub-domain
KGIEKLVKRSLTGDLDGEPDSDLLR

SEQ ID NO: 9591 - protein, 28 aa, artificial
  peptide fold or domain or sub-domain
KGIFDINPRLFGLKIRDVEVMDVEKVEE

SEQ ID NO: 9592 - protein, 29 aa, artificial
  peptide fold or domain or sub-domain
KGIKASQLKVNLSNSGIVCDVRDPDVIRV

SEQ ID NO: 9593 - protein, 26 aa, artificial
  peptide fold or domain or sub-domain
KGINFDLPHVIEDAPSYPGVEHVGGD

SEQ ID NO: 9594 - protein, 22 aa, artificial
  peptide fold or domain or sub-domain
KGKEIYIPLGSGVAIRGKIENP

SEQ ID NO: 9595 - protein, 22 aa, artificial
  peptide fold or domain or sub-domain
KGKEVLIPVGATAQIKAKSEGV

SEQ ID NO: 9596 - protein, 27 aa, artificial
  peptide fold or domain or sub-domain
KGKRGKSLAEITLDSVLAGDVTMEDLR

SEQ ID NO: 9597 - protein, 27 aa, artificial
  peptide fold or domain or sub-domain
KGKRIGEILHFLHQEVLHERVSNTKEA

SEQ ID NO: 9598 - protein, 27 aa, artificial
  peptide fold or domain or sub-domain
KGKWIKILLEEVEYLVVSKQLPNEKKI

SEQ ID NO: 9599 - protein, 22 aa, artificial
  peptide fold or domain or sub-domain
KGLAEFIIMCDKIDDSKKAFLM

SEQ ID NO: 9600 - protein, 26 aa, artificial
  peptide fold or domain or sub-domain
KGLAFEAIKEAKSGNIDKARECIEKS

SEQ ID NO: 9601 - protein, 26 aa, artificial
  peptide fold or domain or sub-domain
KGLAFQAIQQAKAGEFAEAESSLNEA

SEQ ID NO: 9602 - protein, 26 aa, artificial
  peptide fold or domain or sub-domain
KGLAKGAFETIRAKEGNVFDNPEYKG

SEQ ID NO: 9603 - protein, 25 aa, artificial
  peptide fold or domain or sub-domain
KGLDSVVAMFHNRKETITFKKLKPA

SEQ ID NO: 9604 - protein, 20 aa, artificial
  peptide fold or domain or sub-domain
KGLFAAQLAETKLIDLFVNV

SEQ ID NO: 9605 - protein, 25 aa, artificial
  peptide fold or domain or sub-domain
KGLKATTHHQCLELLKELEPTLTVT

SEQ ID NO: 9606 - protein, 30 aa, artificial
  peptide fold or domain or sub-domain
KGLKYNQATPTFHQWRDARQVYGLNFASKE

SEQ ID NO: 9607 - protein, 29 aa, artificial
  peptide fold or domain or sub-domain
KGLLAEIGFNDSRMQQIAKDIGLPIKKLD

SEQ ID NO: 9608 - protein, 20 aa, artificial
  peptide fold or domain or sub-domain
KGLSQSEVTSEDREHAKRIV

SEQ ID NO: 9609 - protein, 28 aa, artificial
  peptide fold or domain or sub-domain
KGLTLSGVKWPICDKNVSFGSSLTLSNR

SEQ ID NO: 9610 - protein, 25 aa, artificial
  peptide fold or domain or sub-domain
KGLYDDLQRMSQWSGASISETIKSY

SEQ ID NO: 9611 - protein, 24 aa, artificial
  peptide fold or domain or sub-domain
KGMDGVSASYTKGEFFLPDLMLAG

SEQ ID NO: 9612 - protein, 27 aa, artificial
  peptide fold or domain or sub-domain
KGMDLVKKAIVPDVALGAHTASLGLAF

SEQ ID NO: 9613 - protein, 24 aa, artificial
  peptide fold or domain or sub-domain
KGMIGALDKFENKEYYLSEVIVCT

SEQ ID NO: 9614 - protein, 24 aa, artificial
  peptide fold or domain or sub-domain
KGMSIVSDMYENGKAFVPNLMVSA

SEQ ID NO: 9615 - protein, 24 aa, artificial
  peptide fold or domain or sub-domain
KGNFANASRLLIGQDDPDRGALLR

SEQ ID NO: 9616 - protein, 24 aa, artificial
  peptide fold or domain or sub-domain
KGNQLWEYDPVKLTLQHVNSNQCL

SEQ ID NO: 9617 - protein, 22 aa, artificial
  peptide fold or domain or sub-domain
KGNTSLYDHNNNTSDYSKNGAG

SEQ ID NO: 9618 - protein, 27 aa, artificial
  peptide fold or domain or sub-domain
KGPEHLAQFQPDFMLEKMSDLLAIVRD

SEQ ID NO: 9619 - protein, 25 aa, artificial
  peptide fold or domain or sub-domain
KGPEHLVRAALGDAGTDMALYERCL

SEQ ID NO: 9620 - protein, 27 aa, artificial
  peptide fold or domain or sub-domain
KGPGLGETLRSLETLWIDSCFSLDREA

SEQ ID NO: 9621 - protein, 27 aa, artificial
  peptide fold or domain or sub-domain
KGPMVGEVMREIELWWIDQDFIEDKFS

SEQ ID NO: 9622 - protein, 20 aa, artificial
  peptide fold or domain or sub-domain
KGPSEYPNWDWRNTASWQQI

SEQ ID NO: 9623 - protein, 30 aa, artificial
  peptide fold or domain or sub-domain
KGRIFLDRCRVVNVRDGKMFGHTIKNSLRI

SEQ ID NO: 9624 - protein, 30 aa, artificial
  peptide fold or domain or sub-domain
KGRIYIANVTNMISSTENGYSLTLTYKGDG

SEQ ID NO: 9625 - protein, 25 aa, artificial
  peptide fold or domain or sub-domain
KGRKCTAYPAVKLNVVLGGGTWLEP

SEQ ID NO: 9626 - protein, 24 aa, artificial
  peptide fold or domain or sub-domain
KGRLELVANSLQTDELTNVFEKVS

SEQ ID NO: 9627 - protein, 24 aa, artificial
  peptide fold or domain or sub-domain
KGRLEQIGASSKIDELNETIEQID

SEQ ID NO: 9628 - protein, 24 aa, artificial
  peptide fold or domain or sub-domain
KGRLEQIGERLGDRELFEALSTLS

SEQ ID NO: 9629 - protein, 24 aa, artificial
  peptide fold or domain or sub-domain
KGRLLQISQEYNLPELEEATGALD

SEQ ID NO: 9630 - protein, 27 aa, artificial
  peptide fold or domain or sub-domain
KGRPYLEALEPDLIIDSMEQLGDWIEA

SEQ ID NO: 9631 - protein, 26 aa, artificial
  peptide fold or domain or sub-domain
KGSIIQLANGELKKVEDLKTEDFIQS

SEQ ID NO: 9632 - protein, 30 aa, artificial
  peptide fold or domain or sub-domain
KGTAEISSANYPARNYGIKAGMFVREAKAR

SEQ ID NO: 9633 - protein, 20 aa, artificial
  peptide fold or domain or sub-domain
KGTHKDYFYVNEKTLVEVKM

SEQ ID NO: 9634 - protein, 28 aa, artificial
  peptide fold or domain or sub-domain
KGVFDESEQGTNQNGGFGLLSELTGMMG

SEQ ID NO: 9635 - protein, 29 aa, artificial
  peptide fold or domain or sub-domain
KGVTTFRIENGEVKVVESVEGDTCVNAPP

SEQ ID NO: 9636 - protein, 28 aa, artificial
  peptide fold or domain or sub-domain
KGVYLIKRYYEGDIELKTTSDFAKAVFE

SEQ ID NO: 9637 - protein, 22 aa, artificial
  peptide fold or domain or sub-domain
KGYDRKTKKSSSLKGASGKGDN

SEQ ID NO: 9638 - protein, 24 aa, artificial
  peptide fold or domain or sub-domain
KGYGFFIHKYLWEEYRRFGNGHGH

SEQ ID NO: 9639 - protein, 27 aa, artificial
  peptide fold or domain or sub-domain
KGYMKKMADYLQQNHPEKLDQFKVDAT

SEQ ID NO: 9640 - protein, 25 aa, artificial
  peptide fold or domain or sub-domain
KGYPTTVRKVLALDFDDKDYIESIA

SEQ ID NO: 9641 - protein, 21 aa, artificial
  peptide fold or domain or sub-domain
KGYYHTQGNKIVDESGKEAAF

SEQ ID NO: 9642 - protein, 22 aa, artificial
  peptide fold or domain or sub-domain
KHADDLLPTDIPANVYEGLKAS

SEQ ID NO: 9643 - protein, 28 aa, artificial
  peptide fold or domain or sub-domain
KHAGVASSVTSEKIIIRTAEGGHDEYLL

SEQ ID NO: 9644 - protein, 20 aa, artificial
  peptide fold or domain or sub-domain
KHAIVQSLLSIKSPERTSLA

SEQ ID NO: 9645 - protein, 20 aa, artificial
  peptide fold or domain or sub-domain
KHALIQTLINIRDSKKANMA

SEQ ID NO: 9646 - protein, 20 aa, artificial
  peptide fold or domain or sub-domain
KHALVQSLVHLIQPHKFPKP

SEQ ID NO: 9647 - protein, 29 aa, artificial
  peptide fold or domain or sub-domain
KHENFRVILKKYEDTDLFREDATFRVVPG

SEQ ID NO: 9648 - protein, 20 aa, artificial
  peptide fold or domain or sub-domain
KHEPFDRAEIERIRSAEGWV

SEQ ID NO: 9649 - protein, 22 aa, artificial
  peptide fold or domain or sub-domain
KHIMAARAKLGAVSKAHAIAMA

SEQ ID NO: 9650 - protein, 23 aa, artificial
  peptide fold or domain or sub-domain
KHKFNRSGLKGQGVDYLEWLENL

SEQ ID NO: 9651 - protein, 29 aa, artificial
  peptide fold or domain or sub-domain
KHKFNRSGLKGQGVDYLEWLENLLTYLKS

SEQ ID NO: 9652 - protein, 21 aa, artificial
  peptide fold or domain or sub-domain
KHKMINYITKKGNSALARTLL

SEQ ID NO: 9653 - protein, 26 aa, artificial
  peptide fold or domain or sub-domain
KHLKDIISQVDEVKQYFNPSQLDEIF

SEQ ID NO: 9654 - protein, 30 aa, artificial
  peptide fold or domain or sub-domain
KHLKLISLNTIRLVIDISDSPRAFGLLLRG

SEQ ID NO: 9655 - protein, 21 aa, artificial
  peptide fold or domain or sub-domain
KHLLGAEADRNTAAYNNAPVG

SEQ ID NO: 9656 - protein, 20 aa, artificial
  peptide fold or domain or sub-domain
KHLLSPQRAPERLIQLAEGN

SEQ ID NO: 9657 - protein, 25 aa, artificial
  peptide fold or domain or sub-domain
KHMLNKISTSGHTEEEFKERFHATL

SEQ ID NO: 9658 - protein, 25 aa, artificial
  peptide fold or domain or sub-domain
KHRIYPMAEREPAPTVTTLPDDILH

SEQ ID NO: 9659 - protein, 23 aa, artificial
  peptide fold or domain or sub-domain
KHSLKLRSLRQGYTPTVKSSANF

SEQ ID NO: 9660 - protein, 20 aa, artificial
  peptide fold or domain or sub-domain
KHTAKDESEKQRMKSKGGIV

SEQ ID NO: 9661 - protein, 27 aa, artificial
  peptide fold or domain or sub-domain
KHTHHASETPKKQTYHASKAPKKHTIK

SEQ ID NO: 9662 - protein, 29 aa, artificial
  peptide fold or domain or sub-domain
KHVELLNGRLKQTTDKYDSDLIKERIAYL

SEQ ID NO: 9663 - protein, 23 aa, artificial
  peptide fold or domain or sub-domain
KIADETIGTTVDEILPYLEEKGH

SEQ ID NO: 9664 - protein, 23 aa, artificial
  peptide fold or domain or sub-domain
KIADGFKIICKSDDGIVSGIENE

SEQ ID NO: 9665 - protein, 23 aa, artificial
  peptide fold or domain or sub-domain
KIADIMENKSVAWVRKTFGIEND

SEQ ID NO: 9666 - protein, 30 aa, artificial
  peptide fold or domain or sub-domain
KIAFIKCTELFNENPKLGVKQLATDGFIKD

SEQ ID NO: 9667 - protein, 29 aa, artificial
  peptide fold or domain or sub-domain
KIAFNAKEVLKQHATHCINEPDLALIKPL

SEQ ID NO: 9668 - protein, 20 aa, artificial
  peptide fold or domain or sub-domain
KIALESKNTIGKQVSSSTIR

SEQ ID NO: 9669 - protein, 24 aa, artificial
  peptide fold or domain or sub-domain
KIAPYVNAMREGIARLLEVQPECV

SEQ ID NO: 9670 - protein, 22 aa, artificial
  peptide fold or domain or sub-domain
KIARQLRAKLNATNRTQTVAVA

SEQ ID NO: 9671 - protein, 26 aa, artificial
  peptide fold or domain or sub-domain
KIASVHFAATEKSKERLIKMGEDSWR

SEQ ID NO: 9672 - protein, 23 aa, artificial
  peptide fold or domain or sub-domain
KIATEEDAKTLDELREFLKKVDH

SEQ ID NO: 9673 - protein, 27 aa, artificial
  peptide fold or domain or sub-domain
KIAWNLMRMNSLKSKEKYVELAKKIAD

SEQ ID NO: 9674 - protein, 22 aa, artificial
  peptide fold or domain or sub-domain
KIAYNTVGESMAFYIAQKYGIP

SEQ ID NO: 9675 - protein, 25 aa, artificial
  peptide fold or domain or sub-domain
KICANVFCGAGRECAVTEKGEPTCL

SEQ ID NO: 9676 - protein, 25 aa, artificial
  peptide fold or domain or sub-domain
KIDIANNYGLDKEDWDDRIAWFDKN

SEQ ID NO: 9677 - protein, 23 aa, artificial
  peptide fold or domain or sub-domain
KIDKQLVKDDKKLSKLVNNEEMN

SEQ ID NO: 9678 - protein, 29 aa, artificial
  peptide fold or domain or sub-domain
KIDLSSEPDKHRDYKFTKWMTKNMGLQGI

SEQ ID NO: 9679 - protein, 24 aa, artificial
  peptide fold or domain or sub-domain
KIDPKLVPNLADVYPYAISDKIVG

SEQ ID NO: 9680 - protein, 23 aa, artificial
  peptide fold or domain or sub-domain
KIDRSALQYDDGVHPSPKDYGNF

SEQ ID NO: 9681 - protein, 22 aa, artificial
  peptide fold or domain or sub-domain
KIDSFLKEKQHNLCSWEISRAE

SEQ ID NO: 9682 - protein, 30 aa, artificial
  peptide fold or domain or sub-domain
KIEAKTGAQRKLIDYRKAVPAPYNTEKVPG

SEQ ID NO: 9683 - protein, 29 aa, artificial
  peptide fold or domain or sub-domain
KIELTYSYNSLEPYIDEETVKIHYTKHLQ

SEQ ID NO: 9684 - protein, 25 aa, artificial
  peptide fold or domain or sub-domain
KIEYKGCGLFHIKPDLRSPPNPVKV

SEQ ID NO: 9685 - protein, 25 aa, artificial
  peptide fold or domain or sub-domain
KIEYLTNVRNAIFTFNYAYVYNPVD

SEQ ID NO: 9686 - protein, 23 aa, artificial
  peptide fold or domain or sub-domain
KIFAKDSVVEEINVLYGKERKVS

SEQ ID NO: 9687 - protein, 30 aa, artificial
  peptide fold or domain or sub-domain
KIFCGRYSSAELKLRLEQYRSPLIEIVTFS

SEQ ID NO: 9688 - protein, 29 aa, artificial
  peptide fold or domain or sub-domain
KIFFFKDRFFWLKVSERPKTSVNLISSLW

SEQ ID NO: 9689 - protein, 30 aa, artificial
  peptide fold or domain or sub-domain
KIFGIEFSPRVLRELVPIVEERRNIVPILG

SEQ ID NO: 9690 - protein, 30 aa, artificial
  peptide fold or domain or sub-domain
KIFLMDRRGLILQSYEANSTPAQHVYAKSD

SEQ ID NO: 9691 - protein, 26 aa, artificial
  peptide fold or domain or sub-domain
KIFQCDKYVKVFHKFSSSNSQKIRHT

SEQ ID NO: 9692 - protein, 23 aa, artificial
  peptide fold or domain or sub-domain
KIFSIPELKTLADKYDKSVAQVV

SEQ ID NO: 9693 - protein, 29 aa, artificial
  peptide fold or domain or sub-domain
KIFVAIAASDNFWNNSLYYNHDKIVVCNG

SEQ ID NO: 9694 - protein, 23 aa, artificial
  peptide fold or domain or sub-domain
KIGDMIKGKTAGEIAQLFDIKDV

SEQ ID NO: 9695 - protein, 20 aa, artificial
  peptide fold or domain or sub-domain
KIGDTDLAGMSSEQVAQVLR

SEQ ID NO: 9696 - protein, 24 aa, artificial
  peptide fold or domain or sub-domain
KIGIKCGDRYRVPMLPAEHFVFME

SEQ ID NO: 9697 - protein, 22 aa, artificial
  peptide fold or domain or sub-domain
KIGITGYGKAEKKQIQQMVQKF

SEQ ID NO: 9698 - protein, 24 aa, artificial
  peptide fold or domain or sub-domain
KIGLRKQEMRQYIAQLLHLNTNRV

SEQ ID NO: 9699 - protein, 24 aa, artificial
  peptide fold or domain or sub-domain
KIGPHREEIRASIARVCSVPVSRV

SEQ ID NO: 9700 - protein, 28 aa, artificial
  peptide fold or domain or sub-domain
KIHEEINQVIGTHRTPRVDDRAKMPYTD

SEQ ID NO: 9701 - protein, 24 aa, artificial
  peptide fold or domain or sub-domain
KIHEMTTAYLNGDIEKARDMQLEL

SEQ ID NO: 9702 - protein, 26 aa, artificial
  peptide fold or domain or sub-domain
KIHEMTTAYLNGDIEKARDMQLELNP

SEQ ID NO: 9703 - protein, 25 aa, artificial
  peptide fold or domain or sub-domain
KIHLANKMGKDKLSMEDREAYVDQN

SEQ ID NO: 9704 - protein, 25 aa, artificial
  peptide fold or domain or sub-domain
KIHLSNLFGFDKLPLKDRVAFTESH

SEQ ID NO: 9705 - protein, 26 aa, artificial
  peptide fold or domain or sub-domain
KIHYNATALSNLIEDQADEFLQKIDQ

SEQ ID NO: 9706 - protein, 28 aa, artificial
  peptide fold or domain or sub-domain
KIIARIRGFENTEMLYTAGADVVVSEKR

SEQ ID NO: 9707 - protein, 28 aa, artificial
  peptide fold or domain or sub-domain
KIIARVSNPDHEEAFKKVGIDHVISPER

SEQ ID NO: 9708 - protein, 26 aa, artificial
  peptide fold or domain or sub-domain
KIIDENGRLTIEPVKGLTTKEGREKM

SEQ ID NO: 9709 - protein, 23 aa, artificial
  peptide fold or domain or sub-domain
KIIDIANLGILLVNSPHSEWQKH

SEQ ID NO: 9710 - protein, 29 aa, artificial
  peptide fold or domain or sub-domain
KIIFELGGTKKKVSNKQIALSLDIAAGSV

SEQ ID NO: 9711 - protein, 20 aa, artificial
  peptide fold or domain or sub-domain
KIIFSQQNPSDVSEGNRGRT

SEQ ID NO: 9712 - protein, 27 aa, artificial
  peptide fold or domain or sub-domain
KIIGAMKRQGAEGDFRSNLHQGGSATA

SEQ ID NO: 9713 - protein, 20 aa, artificial
  peptide fold or domain or sub-domain
KIININRKKSGSNYQQQLLS

SEQ ID NO: 9714 - protein, 24 aa, artificial
  peptide fold or domain or sub-domain
KIIPHVPKMKLFMSKLLGMDASAI

SEQ ID NO: 9715 - protein, 25 aa, artificial
  peptide fold or domain or sub-domain
KIIQALYTLELRDVDTDSAANWLLT

SEQ ID NO: 9716 - protein, 29 aa, artificial
  peptide fold or domain or sub-domain
KIIQELVLYKGYATLADISRSLNVKRQSV

SEQ ID NO: 9717 - protein, 29 aa, artificial
  peptide fold or domain or sub-domain
KIITDNGTNLNNKMMKELCDDFKIEHHNS

SEQ ID NO: 9718 - protein, 26 aa, artificial
  peptide fold or domain or sub-domain
KIIVQDLPVYVKQAPTVDGVEFMVHD

SEQ ID NO: 9719 - protein, 29 aa, artificial
  peptide fold or domain or sub-domain
KIIYELSERDEKISNKQIAEKMSVSAPAV

SEQ ID NO: 9720 - protein, 24 aa, artificial
  peptide fold or domain or sub-domain
KIKEMIRDFKDGRINKAIQLNKEL

SEQ ID NO: 9721 - protein, 26 aa, artificial
  peptide fold or domain or sub-domain
KIKEMIRDFKDGRINKAIQLNKELGP

SEQ ID NO: 9722 - protein, 23 aa, artificial
  peptide fold or domain or sub-domain
KIKIPGKKTMYIHEILNSRRKMF

SEQ ID NO: 9723 - protein, 24 aa, artificial
  peptide fold or domain or sub-domain
KIKMQFLYALEDNYIFMNTQNYEQ

SEQ ID NO: 9724 - protein, 24 aa, artificial
  peptide fold or domain or sub-domain
KIKPFVEIMKKNLSNTLKIDNSFI

SEQ ID NO: 9725 - protein, 24 aa, artificial
  peptide fold or domain or sub-domain
KIKQLFANNYSWAQRMKEENSTYF

SEQ ID NO: 9726 - protein, 29 aa, artificial
  peptide fold or domain or sub-domain
KIKTNNDLAYASSQFQQFCHMWNIQHSTG

SEQ ID NO: 9727 - protein, 29 aa, artificial
  peptide fold or domain or sub-domain
KILDSIIKKKGYARVKDVSEIMGLNPSSV

SEQ ID NO: 9728 - protein, 20 aa, artificial
  peptide fold or domain or sub-domain
KILFLSKGKKELGAEYANRA

SEQ ID NO: 9729 - protein, 24 aa, artificial
  peptide fold or domain or sub-domain
KILPFREEIRKSIAGILKIEKEQI

SEQ ID NO: 9730 - protein, 23 aa, artificial
  peptide fold or domain or sub-domain
KILSKGEQRINGKKYYVENDLYD

SEQ ID NO: 9731 - protein, 24 aa, artificial
  peptide fold or domain or sub-domain
KILSYIFLMRSNIASDLNIKIEKI

SEQ ID NO: 9732 - protein, 26 aa, artificial
  peptide fold or domain or sub-domain
KILTEIQNALLQGSRTSIIIELTNQF

SEQ ID NO: 9733 - protein, 26 aa, artificial
  peptide fold or domain or sub-domain
KIMEDNRLISSGKYSGQSVTQARENI

SEQ ID NO: 9734 - protein, 25 aa, artificial
  peptide fold or domain or sub-domain
KIMFIYSNKEPILNETVPNRFSPES

SEQ ID NO: 9735 - protein, 30 aa, artificial
  peptide fold or domain or sub-domain
KIMHNSDFPASLDTSDEWIRSHTGIGSRYI

SEQ ID NO: 9736 - protein, 29 aa, artificial
  peptide fold or domain or sub-domain
KIMIAVNHDDPFFHNMPVSKDVRILNCDG

SEQ ID NO: 9737 - protein, 26 aa, artificial
  peptide fold or domain or sub-domain
KINNQLRRNEQNGAAAHVIAEDVKLL

SEQ ID NO: 9738 - protein, 26 aa, artificial
  peptide fold or domain or sub-domain
KINNYLRGVNDSLDGIDPKIIEDIKS

SEQ ID NO: 9739 - protein, 23 aa, artificial
  peptide fold or domain or sub-domain
KIPENFYLVSSSENCLICSIYNK

SEQ ID NO: 9740 - protein, 22 aa, artificial
  peptide fold or domain or sub-domain
KIPNDVEEGLLKNIELGELMDT

SEQ ID NO: 9741 - protein, 23 aa, artificial
  peptide fold or domain or sub-domain
KIPSVVFGSGINEELLMKAFGLS

SEQ ID NO: 9742 - protein, 25 aa, artificial
  peptide fold or domain or sub-domain
KIQAMHDKIAEFMPDLANYPVARTR

SEQ ID NO: 9743 - protein, 28 aa, artificial
  peptide fold or domain or sub-domain
KIQEELDIVVGSDRMVTESDLVHLKYLR

SEQ ID NO: 9744 - protein, 23 aa, artificial
  peptide fold or domain or sub-domain
KIQFPGKKIINVEKIISSKKHWF

SEQ ID NO: 9745 - protein, 24 aa, artificial
  peptide fold or domain or sub-domain
KIQKYKKQILNCIAKICNISPTQI

SEQ ID NO: 9746 - protein, 22 aa, artificial
  peptide fold or domain or sub-domain
KIQSLVKTATNPTMKKAYTSCV

SEQ ID NO: 9747 - protein, 25 aa, artificial
  peptide fold or domain or sub-domain
KIRDGKEQALFLKKIVTLNKEVPMK

SEQ ID NO: 9748 - protein, 27 aa, artificial
  peptide fold or domain or sub-domain
KIRPSVQKAAAAGAAGGELYEKTADEN

SEQ ID NO: 9749 - protein, 30 aa, artificial
  peptide fold or domain or sub-domain
KIRQNDEVNSSNIDVGVTEIPYERLELISK

SEQ ID NO: 9750 - protein, 21 aa, artificial
  peptide fold or domain or sub-domain
KIRSALAEGFAVPAKEDNFSA

SEQ ID NO: 9751 - protein, 25 aa, artificial
  peptide fold or domain or sub-domain
KIRTYLLSTGLTKVNDLQHRSKEFV

SEQ ID NO: 9752 - protein, 20 aa, artificial
  peptide fold or domain or sub-domain
KIRVYIIVDKRTREGETIKS

SEQ ID NO: 9753 - protein, 27 aa, artificial
  peptide fold or domain or sub-domain
KISHGQYAENNGKRVSYQDACRARGAV

SEQ ID NO: 9754 - protein, 30 aa, artificial
  peptide fold or domain or sub-domain
KISINSKALEDMDFISKAANRFGSQCIVCS

SEQ ID NO: 9755 - protein, 24 aa, artificial
  peptide fold or domain or sub-domain
KISNIRKNIIKNISTVLNIDESQI

SEQ ID NO: 9756 - protein, 24 aa, artificial
  peptide fold or domain or sub-domain
KISPHKETIRSNLSKLLGADPSVV

SEQ ID NO: 9757 - protein, 23 aa, artificial
  peptide fold or domain or sub-domain
KISPQYGYGEEGCIFKNVPKNAN

SEQ ID NO: 9758 - protein, 24 aa, artificial
  peptide fold or domain or sub-domain
KISPYKDAMAKIVADILGIPLHKV

SEQ ID NO: 9759 - protein, 22 aa, artificial
  peptide fold or domain or sub-domain
KISSAQALQARAAGIEPRPEMN

SEQ ID NO: 9760 - protein, 25 aa, artificial
  peptide fold or domain or sub-domain
KISTCIITGGVPAPSAACKISGCTF

SEQ ID NO: 9761 - protein, 22 aa, artificial
  peptide fold or domain or sub-domain
KITAVVMNDGCWGMIKGSQKAA

SEQ ID NO: 9762 - protein, 20 aa, artificial
  peptide fold or domain or sub-domain
KITDYVGKSKKAIARQKGRV

SEQ ID NO: 9763 - protein, 30 aa, artificial
  peptide fold or domain or sub-domain
KITINSLLYKDLNIVKKIISEIGSQAVVAS

SEQ ID NO: 9764 - protein, 30 aa, artificial
  peptide fold or domain or sub-domain
KITLKQIAEEFLKVHNITLDRKKISLEGEI

SEQ ID NO: 9765 - protein, 24 aa, artificial
  peptide fold or domain or sub-domain
KITPLKDRITKSLSNLLNLPLDCI

SEQ ID NO: 9766 - protein, 30 aa, artificial
  peptide fold or domain or sub-domain
KITTLESANKKRLHQYVKVFLNGNWLGVTR

SEQ ID NO: 9767 - protein, 28 aa, artificial
  peptide fold or domain or sub-domain
KIVARCEENNLADKFYRAGANYVVNPSF

SEQ ID NO: 9768 - protein, 30 aa, artificial
  peptide fold or domain or sub-domain
KIVGIDLNSEKFTLAKDFGCTECWNPKELD

SEQ ID NO: 9769 - protein, 27 aa, artificial
  peptide fold or domain or sub-domain
KIVGLKNDLTGGSRGIRIMPDMHIDDL

SEQ ID NO: 9770 - protein, 30 aa, artificial
  peptide fold or domain or sub-domain
KIVIGTSAILYPNKFKKWLKNYGSKNFVLS

SEQ ID NO: 9771 - protein, 24 aa, artificial
  peptide fold or domain or sub-domain
KIVNEHRHVFEPDHPRDIIDLYLK

SEQ ID NO: 9772 - protein, 24 aa, artificial
  peptide fold or domain or sub-domain
KIVNEHSATYDKDNIRDITDSLID

SEQ ID NO: 9773 - protein, 22 aa, artificial
  peptide fold or domain or sub-domain
KIVPGRGDNSYGIHTAMLSGIP

SEQ ID NO: 9774 - protein, 30 aa, artificial
  peptide fold or domain or sub-domain
KIYMVDIDGLLTTTRKVGNLEGHKVNYAKD

SEQ ID NO: 9775 - protein, 24 aa, artificial
  peptide fold or domain or sub-domain
KIYSANDVLRPKPFPDVYLYAAEQ

SEQ ID NO: 9776 - protein, 25 aa, artificial
  peptide fold or domain or sub-domain
KKAAETLKNLEPFNKFTAEEAYRKL

SEQ ID NO: 9777 - protein, 22 aa, artificial
  peptide fold or domain or sub-domain
KKALTGNGKAAKEQVAFMVKRL

SEQ ID NO: 9778 - protein, 23 aa, artificial
  peptide fold or domain or sub-domain
KKAMISHAKRKKHLASSNTCKNG

SEQ ID NO: 9779 - protein, 30 aa, artificial
  peptide fold or domain or sub-domain
KKARIRMLFLSPSQDEYYMIAAGNSLALNR

SEQ ID NO: 9780 - protein, 21 aa, artificial
  peptide fold or domain or sub-domain
KKAYKFGGDQVAFTPEEMKSL

SEQ ID NO: 9781 - protein, 23 aa, artificial
  peptide fold or domain or sub-domain
KKDIPWLLNIVEVLKGNEHKVAD

SEQ ID NO: 9782 - protein, 29 aa, artificial
  peptide fold or domain or sub-domain
KKDTSGRVSKLLSMVGINEELAKHKPSEL

SEQ ID NO: 9783 - protein, 24 aa, artificial
  peptide fold or domain or sub-domain
KKEFRRLGDVSPANIPNNRKLNGH

SEQ ID NO: 9784 - protein, 30 aa, artificial
  peptide fold or domain or sub-domain
KKEIVEAIDAFNVNPKVGIQKFLSGGLIKD

SEQ ID NO: 9785 - protein, 20 aa, artificial
  peptide fold or domain or sub-domain
KKEMMKKIFEQEQERLFYEI

SEQ ID NO: 9786 - protein, 22 aa, artificial
  peptide fold or domain or sub-domain
KKEWVRSLQEKQDWQTILANGA

SEQ ID NO: 9787 - protein, 29 aa, artificial
  peptide fold or domain or sub-domain
KKFLGFDEFGGDKPSAELLQVALAKTGII

SEQ ID NO: 9788 - protein, 21 aa, artificial
  peptide fold or domain or sub-domain
KKFMDVYYDVMDRKREKIGFL

SEQ ID NO: 9789 - protein, 24 aa, artificial
  peptide fold or domain or sub-domain
KKFPALPGTTPDFPDGNGINNETG

SEQ ID NO: 9790 - protein, 26 aa, artificial
  peptide fold or domain or sub-domain
KKHECPYCHRLFSQATHLEVHVRSHI

SEQ ID NO: 9791 - protein, 24 aa, artificial
  peptide fold or domain or sub-domain
KKHFKTFDGDHFAAMKATGMGKAH

SEQ ID NO: 9792 - protein, 24 aa, artificial
  peptide fold or domain or sub-domain
KKHGYTVEVQFDGDNTMHYTNWTH

SEQ ID NO: 9793 - protein, 30 aa, artificial
  peptide fold or domain or sub-domain
KKIIIKGASKFNEKPKAGLGYLEAQGIIKD

SEQ ID NO: 9794 - protein, 30 aa, artificial
  peptide fold or domain or sub-domain
KKIISDGLLLFEKSPKKGVEFFIEKELCTS

SEQ ID NO: 9795 - protein, 24 aa, artificial
  peptide fold or domain or sub-domain
KKINEHKDAFCGETVKDLVDALLK

SEQ ID NO: 9796 - protein, 28 aa, artificial
  peptide fold or domain or sub-domain
KKISDPLGKKYWPLYSGRDQARRPMLWD

SEQ ID NO: 9797 - protein, 27 aa, artificial
  peptide fold or domain or sub-domain
KKIVEILKKPPLTRLQSQLVQLQKATE

SEQ ID NO: 9798 - protein, 22 aa, artificial
  peptide fold or domain or sub-domain
KKIYNGDYYRQGRIAKMPVKWI

SEQ ID NO: 9799 - protein, 27 aa, artificial
  peptide fold or domain or sub-domain
KKKEIRVGEICIGCGICESICPVSQNG

SEQ ID NO: 9800 - protein, 23 aa, artificial
  peptide fold or domain or sub-domain
KKKIFPELDEAFISELGADVKTP

SEQ ID NO: 9801 - protein, 20 aa, artificial
  peptide fold or domain or sub-domain
KKLEEDERLTSKLKIKPADL

SEQ ID NO: 9802 - protein, 24 aa, artificial
  peptide fold or domain or sub-domain
KKLEEQKRIEEQKRIEEQKKLEEQ

SEQ ID NO: 9803 - protein, 27 aa, artificial
  peptide fold or domain or sub-domain
KKLEIDSLKQAFEEQNLSDATIKTSKL

SEQ ID NO: 9804 - protein, 30 aa, artificial
  peptide fold or domain or sub-domain
KKLFMLSDVVVTDLQDTSTHKNIISIVNQN

SEQ ID NO: 9805 - protein, 20 aa, artificial
  peptide fold or domain or sub-domain
KKLMRDLNLNSYKNENVEII

SEQ ID NO: 9806 - protein, 23 aa, artificial
  peptide fold or domain or sub-domain
KKMFSFLKDSNVPLDQNPKLKIH

SEQ ID NO: 9807 - protein, 30 aa, artificial
  peptide fold or domain or sub-domain
KKMRDMFSKLHALLPQLPPKADKSTIVDEA

SEQ ID NO: 9808 - protein, 25 aa, artificial
  peptide fold or domain or sub-domain
KKMVDVVRYEEIDITELSLPNMYAE

SEQ ID NO: 9809 - protein, 24 aa, artificial
  peptide fold or domain or sub-domain
KKNAQVLSIANNEVQLMDSETFET

SEQ ID NO: 9810 - protein, 25 aa, artificial
  peptide fold or domain or sub-domain
KKQFYRDLFQIDPDTGRSLIRTQSR

SEQ ID NO: 9811 - protein, 30 aa, artificial
  peptide fold or domain or sub-domain
KKQLQEAIQKFNYKPKEGIKILLSSHFIAS

SEQ ID NO: 9812 - protein, 29 aa, artificial
  peptide fold or domain or sub-domain
KKQVEDELKAIFPKFEETEKIRSLGIVAM

SEQ ID NO: 9813 - protein, 29 aa, artificial
  peptide fold or domain or sub-domain
KKRASESLEKLESVMNFTEFVRAFSVFGT

SEQ ID NO: 9814 - protein, 23 aa, artificial
  peptide fold or domain or sub-domain
KKRDLPLIDDEFAQDISDKYNTL

SEQ ID NO: 9815 - protein, 27 aa, artificial
  peptide fold or domain or sub-domain
KKRRSLVAYLKRTNIEEYFRVTKDLRL

SEQ ID NO: 9816 - protein, 24 aa, artificial
  peptide fold or domain or sub-domain
KKRTSLGIEIPAPLFSKLKQIADE

SEQ ID NO: 9817 - protein, 21 aa, artificial
  peptide fold or domain or sub-domain
KKSIEIGGEKIILDGDQYEYM

SEQ ID NO: 9818 - protein, 30 aa, artificial
  peptide fold or domain or sub-domain
KKSIKVSYLGLEDSVDNDPCKFVLSCRGSS

SEQ ID NO: 9819 - protein, 20 aa, artificial
  peptide fold or domain or sub-domain
KKTAFYRDNNSSALNDPDKL

SEQ ID NO: 9820 - protein, 28 aa, artificial
  peptide fold or domain or sub-domain
KKTAVKSALAVAAAAAALTTNVSAKDFS

SEQ ID NO: 9821 - protein, 26 aa, artificial
  peptide fold or domain or sub-domain
KKTEINEALKKIDPDLGGTLFVSNSS

SEQ ID NO: 9822 - protein, 21 aa, artificial
  peptide fold or domain or sub-domain
KKTLNLIFKKLKKINPNIILH

SEQ ID NO: 9823 - protein, 30 aa, artificial
  peptide fold or domain or sub-domain
KKTNDAPSNTIYRKDKELCLYIYKNPISYS

SEQ ID NO: 9824 - protein, 21 aa, artificial
  peptide fold or domain or sub-domain
KKVALKVIAANLSEEEIKGLK

SEQ ID NO: 9825 - protein, 30 aa, artificial
  peptide fold or domain or sub-domain
KKVHINKDDIVAYSPILEKYVGKDITLKAL

SEQ ID NO: 9826 - protein, 22 aa, artificial
  peptide fold or domain or sub-domain
KKVIDQQNGLYRCEKCDTEFPN

SEQ ID NO: 9827 - protein, 29 aa, artificial
  peptide fold or domain or sub-domain
KKVKIIFSGESSCQQGDILFLEDAINENF

SEQ ID NO: 9828 - protein, 22 aa, artificial
  peptide fold or domain or sub-domain
KKVNLDHENNWRCEKCDRSYAT

SEQ ID NO: 9829 - protein, 29 aa, artificial
  peptide fold or domain or sub-domain
KKVRIIDPGDSRFLVGEEVDKEELEEEIQ

SEQ ID NO: 9830 - protein, 22 aa, artificial
  peptide fold or domain or sub-domain
KKVTEALDSGYWCEGCQRKYEE

SEQ ID NO: 9831 - protein, 22 aa, artificial
  peptide fold or domain or sub-domain
KKVTNNGDGTWRCEKCDKCVDE

SEQ ID NO: 9832 - protein, 22 aa, artificial
  peptide fold or domain or sub-domain
KKVTRSGTNRWLCDRCNQESDE

SEQ ID NO: 9833 - protein, 23 aa, artificial
  peptide fold or domain or sub-domain
KKVVHLDVRGNMVKLNDGSQITF

SEQ ID NO: 9834 - protein, 22 aa, artificial
  peptide fold or domain or sub-domain
KKVVMEDGGCYRCERCNMTYED

SEQ ID NO: 9835 - protein, 22 aa, artificial
  peptide fold or domain or sub-domain
KKVVQVDPEQWLCEHCEKSSLR

SEQ ID NO: 9836 - protein, 20 aa, artificial
  peptide fold or domain or sub-domain
KKYASRLETSARLGFLWSIV

SEQ ID NO: 9837 - protein, 22 aa, artificial
  peptide fold or domain or sub-domain
KKYATGKGNADKDTVMLTVAKR

SEQ ID NO: 9838 - protein, 21 aa, artificial
  peptide fold or domain or sub-domain
KKYQTYGGKNIIFEKDEVDEV

SEQ ID NO: 9839 - protein, 27 aa, artificial
  peptide fold or domain or sub-domain
KKYTVNLMAKLNESNQSRVAVLKSKLP

SEQ ID NO: 9840 - protein, 22 aa, artificial
  peptide fold or domain or sub-domain
KLAFTGNGRAGKDQMLRTARML

SEQ ID NO: 9841 - protein, 26 aa, artificial
  peptide fold or domain or sub-domain
KLAHIHLANDEFAKRRLMQLGEDEKS

SEQ ID NO: 9842 - protein, 24 aa, artificial
  peptide fold or domain or sub-domain
KLAPHVPGMVANLAADLGIAPGRC

SEQ ID NO: 9843 - protein, 24 aa, artificial
  peptide fold or domain or sub-domain
KLAPYLKQMQEIIATSCACQISDI

SEQ ID NO: 9844 - protein, 24 aa, artificial
  peptide fold or domain or sub-domain
KLASSETREAMAARCREADIAGYS

SEQ ID NO: 9845 - protein, 22 aa, artificial
  peptide fold or domain or sub-domain
KLAVAGSGHAKKDEVLEAVMRE

SEQ ID NO: 9846 - protein, 21 aa, artificial
  peptide fold or domain or sub-domain
KLAYANTQTLDKSITYTYTPI

SEQ ID NO: 9847 - protein, 22 aa, artificial
  peptide fold or domain or sub-domain
KLCDGQVEQSFSRNVLDIVGFE

SEQ ID NO: 9848 - protein, 23 aa, artificial
  peptide fold or domain or sub-domain
KLCSKGDNIATLTLDKADENKVK

SEQ ID NO: 9849 - protein, 21 aa, artificial
  peptide fold or domain or sub-domain
KLCYHYGGEPVIFTKDEMQTI

SEQ ID NO: 9850 - protein, 30 aa, artificial
  peptide fold or domain or sub-domain
KLDDNLDTLLPDLFSSIDKNTLQKITIDTL

SEQ ID NO: 9851 - protein, 30 aa, artificial
  peptide fold or domain or sub-domain
KLDDPVSLHLPNVIIDNPWAETDPVRVKDL

SEQ ID NO: 9852 - protein, 29 aa, artificial
  peptide fold or domain or sub-domain
KLDKMSGSFPLIVRSSAVGEDSDNSSAAG

SEQ ID NO: 9853 - protein, 22 aa, artificial
  peptide fold or domain or sub-domain
KLDLNIRLDDNSTEALYFNNQT

SEQ ID NO: 9854 - protein, 22 aa, artificial
  peptide fold or domain or sub-domain
KLEDGVAEGSFGMHCASMCGIP

SEQ ID NO: 9855 - protein, 30 aa, artificial
  peptide fold or domain or sub-domain
KLEITKNERWHSMDSQGQGGPRTIFGKTMY

SEQ ID NO: 9856 - protein, 25 aa, artificial
  peptide fold or domain or sub-domain
KLEKHREEALLSRRLVSFREDVPVE

SEQ ID NO: 9857 - protein, 27 aa, artificial
  peptide fold or domain or sub-domain
KLELIDYKGKVITANETCHKDLFWACR

SEQ ID NO: 9858 - protein, 30 aa, artificial
  peptide fold or domain or sub-domain
KLEMNKAVQKFNFKPEHCVKHLIAVQYMEN

SEQ ID NO: 9859 - protein, 22 aa, artificial
  peptide fold or domain or sub-domain
KLEPGGSAHSFGIQVARLGGMP

SEQ ID NO: 9860 - protein, 27 aa, artificial
  peptide fold or domain or sub-domain
KLEPSAGQQVDTIWPHRFLGSDQYLSN

SEQ ID NO: 9861 - protein, 23 aa, artificial
  peptide fold or domain or sub-domain
KLFDAGQPVVAPSVWKGAASTVK

SEQ ID NO: 9862 - protein, 28 aa, artificial
  peptide fold or domain or sub-domain
KLFEEISSVVGSTSELSLHTLNDLRYLD

SEQ ID NO: 9863 - protein, 27 aa, artificial
  peptide fold or domain or sub-domain
KLFFFSGRQVWVYTGASVLGPRRLDKL

SEQ ID NO: 9864 - protein, 29 aa, artificial
  peptide fold or domain or sub-domain
KLGDQGTYRCVATNSAGQETSEIKLDILV

SEQ ID NO: 9865 - protein, 27 aa, artificial
  peptide fold or domain or sub-domain
KLGGGHGGHNGLKDIISKLGNNPNFHR

SEQ ID NO: 9866 - protein, 26 aa, artificial
  peptide fold or domain or sub-domain
KLGKTWEDFEKSFEKFKEGSLQLLCG

SEQ ID NO: 9867 - protein, 24 aa, artificial
  peptide fold or domain or sub-domain
KLGPLRADIAASVAELLGLPAGEV

SEQ ID NO: 9868 - protein, 25 aa, artificial
  peptide fold or domain or sub-domain
KLGYTGDNKDKAIFEFLRSMSGGEI

SEQ ID NO: 9869 - protein, 30 aa, artificial
  peptide fold or domain or sub-domain
KLHGGDTLEEFVQALADLDEAKTVDLTKKR

SEQ ID NO: 9870 - protein, 27 aa, artificial
  peptide fold or domain or sub-domain
KLHGGNLSTLHDCVARDILPTELGGEG

SEQ ID NO: 9871 - protein, 21 aa, artificial
  peptide fold or domain or sub-domain
KLHSFQNIWQLSAFFEERHCL

SEQ ID NO: 9872 - protein, 26 aa, artificial
  peptide fold or domain or sub-domain
KLIAISDANELKGFDSQCIEEWDPIL

SEQ ID NO: 9873 - protein, 26 aa, artificial
  peptide fold or domain or sub-domain
KLICGHIGLEPRLNKLTVENKLASYM

SEQ ID NO: 9874 - protein, 22 aa, artificial
  peptide fold or domain or sub-domain
KLICPSQNTQTVILPADIIRQK

SEQ ID NO: 9875 - protein, 20 aa, artificial
  peptide fold or domain or sub-domain
KLIEMLPEEEVRNHLKTNWD

SEQ ID NO: 9876 - protein, 25 aa, artificial
  peptide fold or domain or sub-domain
KLINGKDSAILCKEIATINCEVEIE

SEQ ID NO: 9877 - protein, 27 aa, artificial
  peptide fold or domain or sub-domain
KLINNLDNLQQYISKEYLEEKYNGECS

SEQ ID NO: 9878 - protein, 27 aa, artificial
  peptide fold or domain or sub-domain
KLINWGIQGQDYYVKNGKMYKTAQQIQ

SEQ ID NO: 9879 - protein, 22 aa, artificial
  peptide fold or domain or sub-domain
KLISFLQNELNVNKIRFPETSG

SEQ ID NO: 9880 - protein, 23 aa, artificial
  peptide fold or domain or sub-domain
KLITSEDVAADGHNLTPTQIYAY

SEQ ID NO: 9881 - protein, 30 aa, artificial
  peptide fold or domain or sub-domain
KLITYTSDDIRSISPVAQQHVQTGMTIGQL

SEQ ID NO: 9882 - protein, 24 aa, artificial
  peptide fold or domain or sub-domain
KLIWPQFRAIPDSSLMNAVELRRH

SEQ ID NO: 9883 - protein, 24 aa, artificial
  peptide fold or domain or sub-domain
KLKAHIPSMQQVLAEVMGIDADDI

SEQ ID NO: 9884 - protein, 24 aa, artificial
  peptide fold or domain or sub-domain
KLKDFKQAMQSNIAHTLDLDEFRI

SEQ ID NO: 9885 - protein, 27 aa, artificial
  peptide fold or domain or sub-domain
KLKDFVYSSGNSVDLMNQYKKFRGEEP

SEQ ID NO: 9886 - protein, 28 aa, artificial
  peptide fold or domain or sub-domain
KLKEELNTYIGKERCVNESDINKLVYLH

SEQ ID NO: 9887 - protein, 24 aa, artificial
  peptide fold or domain or sub-domain
KLKEQEEMLNKGFKERADLLSEEI

SEQ ID NO: 9888 - protein, 28 aa, artificial
  peptide fold or domain or sub-domain
KLKHIVKVKENGKQVIKEEDLNSLYVLK

SEQ ID NO: 9889 - protein, 20 aa, artificial
  peptide fold or domain or sub-domain
KLKPIRRERRRSSDSGPKAP

SEQ ID NO: 9890 - protein, 27 aa, artificial
  peptide fold or domain or sub-domain
KLKQHIYAAGGSRDPEELYKAFRGKMP

SEQ ID NO: 9891 - protein, 22 aa, artificial
  peptide fold or domain or sub-domain
KLKRGFAERSYGLFVAETLDFP

SEQ ID NO: 9892 - protein, 26 aa, artificial
  peptide fold or domain or sub-domain
KLKSSVQRTLRKDLLDTYPLLNNYID

SEQ ID NO: 9893 - protein, 28 aa, artificial
  peptide fold or domain or sub-domain
KLKTELNEVSKEGRVFEESDTGKCPYLN

SEQ ID NO: 9894 - protein, 25 aa, artificial
  peptide fold or domain or sub-domain
KLKTGKENAYLSRQLAEIMINVPIK

SEQ ID NO: 9895 - protein, 25 aa, artificial
  peptide fold or domain or sub-domain
KLLAEKNNADLSYTLATIKTDVELN

SEQ ID NO: 9896 - protein, 26 aa, artificial
  peptide fold or domain or sub-domain
KLLAERFIELGHLSEKHTHEFRNLLK

SEQ ID NO: 9897 - protein, 23 aa, artificial
  peptide fold or domain or sub-domain
KLLDDKKLCEVAKKYNKTPAQIL

SEQ ID NO: 9898 - protein, 25 aa, artificial
  peptide fold or domain or sub-domain
KLLDSEENVKFSHDLSCMVTDLPLD

SEQ ID NO: 9899 - protein, 22 aa, artificial
  peptide fold or domain or sub-domain
KLLDVKEDVYRAEGGKMPIKWL

SEQ ID NO: 9900 - protein, 27 aa, artificial
  peptide fold or domain or sub-domain
KLLDYCVPVLFNNEEPDPNKATKFEEL

SEQ ID NO: 9901 - protein, 22 aa, artificial
  peptide fold or domain or sub-domain
KLLGEGSSSKTMRKVKKAIIEK

SEQ ID NO: 9902 - protein, 30 aa, artificial
  peptide fold or domain or sub-domain
KLLIEEGKRKFKISPKRGIEFFLKIGATER

SEQ ID NO: 9903 - protein, 26 aa, artificial
  peptide fold or domain or sub-domain
KLLLAEDRQIFAYLRKLEEETAIVIV

SEQ ID NO: 9904 - protein, 23 aa, artificial
  peptide fold or domain or sub-domain
KLLNDFNIEAETDDGVLMALSHK

SEQ ID NO: 9905 - protein, 27 aa, artificial
  peptide fold or domain or sub-domain
KLLYSRMGEVTADDGTVLPIAATFAGA

SEQ ID NO: 9906 - protein, 30 aa, artificial
  peptide fold or domain or sub-domain
KLMFKQVPLLEIDGKNLIGSECVLRYVCNK

SEQ ID NO: 9907 - protein, 20 aa, artificial
  peptide fold or domain or sub-domain
KLMNVGSGLQIRQLLFAGAK

SEQ ID NO: 9908 - protein, 26 aa, artificial
  peptide fold or domain or sub-domain
KLNENLKKQIRIGSPEHIISEMSTVL

SEQ ID NO: 9909 - protein, 29 aa, artificial
  peptide fold or domain or sub-domain
KLNFSLLEDISDDLDFCSKLAKEESMIIL

SEQ ID NO: 9910 - protein, 20 aa, artificial
  peptide fold or domain or sub-domain
KLNGLYPFRVNSAQRTPVQM

SEQ ID NO: 9911 - protein, 21 aa, artificial
  peptide fold or domain or sub-domain
KLNLNSYKSLRHKKKLPCRGQ

SEQ ID NO: 9912 - protein, 22 aa, artificial
  peptide fold or domain or sub-domain
KLNVAIINNGYLGLVRQLQQLF

SEQ ID NO: 9913 - protein, 23 aa, artificial
  peptide fold or domain or sub-domain
KLPEGFTRTASSKDCGYAVVENT

SEQ ID NO: 9914 - protein, 23 aa, artificial
  peptide fold or domain or sub-domain
KLPKNFKVIASSTNSKFAIVENK

SEQ ID NO: 9915 - protein, 26 aa, artificial
  peptide fold or domain or sub-domain
KLPWQNIYADTKDEKYEKIKAMKQQY

SEQ ID NO: 9916 - protein, 26 aa, artificial
  peptide fold or domain or sub-domain
KLPWQTFHNVNEKEKVKIVGQMKSQI

SEQ ID NO: 9917 - protein, 26 aa, artificial
  peptide fold or domain or sub-domain
KLPWTELRHTDRTERTRAIAAAKENL

SEQ ID NO: 9918 - protein, 24 aa, artificial
  peptide fold or domain or sub-domain
KLQDLAEARGIDPEKLSKGLLLKE

SEQ ID NO: 9919 - protein, 28 aa, artificial
  peptide fold or domain or sub-domain
KLQEEIDAVLPNKAPPTYDTVLQMEYLD

SEQ ID NO: 9920 - protein, 24 aa, artificial
  peptide fold or domain or sub-domain
KLQEQEQLLKEGFQKESRIMKNEI

SEQ ID NO: 9921 - protein, 24 aa, artificial
  peptide fold or domain or sub-domain
KLQEQNAMRIAGLKSNVDALQREI

SEQ ID NO: 9922 - protein, 25 aa, artificial
  peptide fold or domain or sub-domain
KLQLIKGNLSLQKYDRVFEMIEEMV

SEQ ID NO: 9923 - protein, 28 aa, artificial
  peptide fold or domain or sub-domain
KLQSEVRQVVKDKHNITDDDIEKMHYLK

SEQ ID NO: 9924 - protein, 22 aa, artificial
  peptide fold or domain or sub-domain
KLQSIIDGGVDPRSKLAYRSCV

SEQ ID NO: 9925 - protein, 28 aa, artificial
  peptide fold or domain or sub-domain
KLQWRYWYARALIATDDLEHGQDVMNEL

SEQ ID NO: 9926 - protein, 27 aa, artificial
  peptide fold or domain or sub-domain
KLRDNADNSIYSSNLNTDYAGMLGKGR

SEQ ID NO: 9927 - protein, 23 aa, artificial
  peptide fold or domain or sub-domain
KLRKLRSDSIVYSLNPDQDAEIK

SEQ ID NO: 9928 - protein, 28 aa, artificial
  peptide fold or domain or sub-domain
KLRRSGVSADLCERLKRHQLETCQDVLS

SEQ ID NO: 9929 - protein, 22 aa, artificial
  peptide fold or domain or sub-domain
KLRWLRWLAERGDWQPFVKYYD

SEQ ID NO: 9930 - protein, 22 aa, artificial
  peptide fold or domain or sub-domain
KLSDVERGIYDRGEYTEYYQFH

SEQ ID NO: 9931 - protein, 24 aa, artificial
  peptide fold or domain or sub-domain
KLSELAQARGGDNKYIQESLMVIK

SEQ ID NO: 9932 - protein, 24 aa, artificial
  peptide fold or domain or sub-domain
KLSPYKEAMERRLGEVMEVSRQRI

SEQ ID NO: 9933 - protein, 26 aa, artificial
  peptide fold or domain or sub-domain
KLTDTIEPVEIKGVRFYPVPFADPAT

SEQ ID NO: 9934 - protein, 27 aa, artificial
  peptide fold or domain or sub-domain
KLTITQEGNKFTVKESSAFRNIEVVFE

SEQ ID NO: 9935 - protein, 29 aa, artificial
  peptide fold or domain or sub-domain
KLTNSKIFLNWEHVKAMENESEVTGYKVV

SEQ ID NO: 9936 - protein, 22 aa, artificial
  peptide fold or domain or sub-domain
KLTQQLKELTAKTLPGHLVPTE

SEQ ID NO: 9937 - protein, 29 aa, artificial
  peptide fold or domain or sub-domain
KLTSLSQINPPTDGDGFYTNGGYNSAYGK

SEQ ID NO: 9938 - protein, 26 aa, artificial
  peptide fold or domain or sub-domain
KLVALSQEEDMKSFNSVCLDKSNPLV

SEQ ID NO: 9939 - protein, 27 aa, artificial
  peptide fold or domain or sub-domain
KLVCKIDDNLVADEAKRSGKTRAMIAM

SEQ ID NO: 9940 - protein, 28 aa, artificial
  peptide fold or domain or sub-domain
KLVDQGEGFYQDGSYIDHTNVAYTGAYG

SEQ ID NO: 9941 - protein, 30 aa, artificial
  peptide fold or domain or sub-domain
KLVESAEKKAVFLREAIGRLGLEMAEAIWA

SEQ ID NO: 9942 - protein, 25 aa, artificial
  peptide fold or domain or sub-domain
KLVIGTSENVIPLIVPVLPEATYWR

SEQ ID NO: 9943 - protein, 25 aa, artificial
  peptide fold or domain or sub-domain
KLVKISKKNPKATFEVAQKLTSEVT

SEQ ID NO: 9944 - protein, 21 aa, artificial
  peptide fold or domain or sub-domain
KLVKYLKGGNQTATVIALCSM

SEQ ID NO: 9945 - protein, 22 aa, artificial
  peptide fold or domain or sub-domain
KLVMTGDGKADKKEVEKAVRKI

SEQ ID NO: 9946 - protein, 22 aa, artificial
  peptide fold or domain or sub-domain
KLVPSLSLTSNAAECALRHGIP

SEQ ID NO: 9947 - protein, 30 aa, artificial
  peptide fold or domain or sub-domain
KLVQENILNMQQIRPFSYQKDKLSCVELEF

SEQ ID NO: 9948 - protein, 22 aa, artificial
  peptide fold or domain or sub-domain
KLVRGLCSRSFGFKVAQLAQIP

SEQ ID NO: 9949 - protein, 27 aa, artificial
  peptide fold or domain or sub-domain
KLVSDKQTHSQANMNDEEWHDYICEQN

SEQ ID NO: 9950 - protein, 27 aa, artificial
  peptide fold or domain or sub-domain
KLWCLGVEGVTYTEENGVIKYSDELVN

SEQ ID NO: 9951 - protein, 28 aa, artificial
  peptide fold or domain or sub-domain
KLYSKYFPDFDFSRSRYSVPDITVSHGI

SEQ ID NO: 9952 - protein, 26 aa, artificial
  peptide fold or domain or sub-domain
KMAHTHFVSNSEAQERLVQLGEAKSS

SEQ ID NO: 9953 - protein, 22 aa, artificial
  peptide fold or domain or sub-domain
KMARGRCPKSYGFNVARLSGLK

SEQ ID NO: 9954 - protein, 24 aa, artificial
  peptide fold or domain or sub-domain
KMEGPWRKRKIPVIPVSRIVECLE

SEQ ID NO: 9955 - protein, 25 aa, artificial
  peptide fold or domain or sub-domain
KMEPRAPWMANMDQDYWERNTRNTK

SEQ ID NO: 9956 - protein, 22 aa, artificial
  peptide fold or domain or sub-domain
KMFDYGSSSANMDVYGSPEPLD

SEQ ID NO: 9957 - protein, 30 aa, artificial
  peptide fold or domain or sub-domain
KMFELSGIDIQSQAAYELACKGTIRPADNR

SEQ ID NO: 9958 - protein, 20 aa, artificial
  peptide fold or domain or sub-domain
KMIEPESVGDNLRQQAKQIC

SEQ ID NO: 9959 - protein, 30 aa, artificial
  peptide fold or domain or sub-domain
KMIFGQVPCLLSGDEEIVQSGAIIRHLARL

SEQ ID NO: 9960 - protein, 21 aa, artificial
  peptide fold or domain or sub-domain
KMINNYCHVEGQSVTRPLRSL

SEQ ID NO: 9961 - protein, 29 aa, artificial
  peptide fold or domain or sub-domain
KMKATDAEIDAYIAQHPDLDAKQNRGKAE

SEQ ID NO: 9962 - protein, 24 aa, artificial
  peptide fold or domain or sub-domain
KMKRKDGFEIDKNLYNQLKEICNE

SEQ ID NO: 9963 - protein, 24 aa, artificial
  peptide fold or domain or sub-domain
KMKTIRQEIEKDPSLDQYDVMSKL

SEQ ID NO: 9964 - protein, 26 aa, artificial
  peptide fold or domain or sub-domain
KMLEELSLKEFHQFNENIQDDIYEAI

SEQ ID NO: 9965 - protein, 21 aa, artificial
  peptide fold or domain or sub-domain
KMLSGNLRLLELNTGRKARVI

SEQ ID NO: 9966 - protein, 24 aa, artificial
  peptide fold or domain or sub-domain
KMQTVLEHNKRWSNEKKESDPSFF

SEQ ID NO: 9967 - protein, 24 aa, artificial
  peptide fold or domain or sub-domain
KMRLLRQLRENNQDIKPHDVISKL

SEQ ID NO: 9968 - protein, 24 aa, artificial
  peptide fold or domain or sub-domain
KMRPHIDAMRAKIAEDLQCDIEQV

SEQ ID NO: 9969 - protein, 26 aa, artificial
  peptide fold or domain or sub-domain
KMSHLHFTATEEYKKRVIQLGEQPKR

SEQ ID NO: 9970 - protein, 30 aa, artificial
  peptide fold or domain or sub-domain
KNAAQFWSDRVIKQYKETNASAVAWAKSFI

SEQ ID NO: 9971 - protein, 28 aa, artificial
  peptide fold or domain or sub-domain
KNARHFTALQEGRTAPGWPLLTFATVQG

SEQ ID NO: 9972 - protein, 29 aa, artificial
  peptide fold or domain or sub-domain
KNAYHGDSMGCMSVSDPMAIHGTQFSGYY

SEQ ID NO: 9973 - protein, 30 aa, artificial
  peptide fold or domain or sub-domain
KNEISRCCEKFNSDPSNFLDILKNSFLFSS

SEQ ID NO: 9974 - protein, 20 aa, artificial
  peptide fold or domain or sub-domain
KNGLGELSEVLGPDYVEQDK

SEQ ID NO: 9975 - protein, 23 aa, artificial
  peptide fold or domain or sub-domain
KNGLGELSEVLGPDYVEQDKAKR

SEQ ID NO: 9976 - protein, 28 aa, artificial
  peptide fold or domain or sub-domain
KNGLGELSEVLGPDYVEQDKAKRLFLYR

SEQ ID NO: 9977 - protein, 22 aa, artificial
  peptide fold or domain or sub-domain
KNGPTAGESHVTTRVMGTYGYA

SEQ ID NO: 9978 - protein, 25 aa, artificial
  peptide fold or domain or sub-domain
KNGSLFKCAPPLRDAAAVERMWEYV

SEQ ID NO: 9979 - protein, 24 aa, artificial
  peptide fold or domain or sub-domain
KNHDRRIPIPGYDAYGVGEYEAWP

SEQ ID NO: 9980 - protein, 28 aa, artificial
  peptide fold or domain or sub-domain
KNHGRGNDRWRARASIMPEPQHSQLQVH

SEQ ID NO: 9981 - protein, 23 aa, artificial
  peptide fold or domain or sub-domain
KNHKENTHGVWFTELEGNYNYQA

SEQ ID NO: 9982 - protein, 28 aa, artificial
  peptide fold or domain or sub-domain
KNIILSSQPGTDDRVTWVKSVDEAIAAC

SEQ ID NO: 9983 - protein, 29 aa, artificial
  peptide fold or domain or sub-domain
KNIILTRNKDYKQDKCLIINSTQDILNFA

SEQ ID NO: 9984 - protein, 20 aa, artificial
  peptide fold or domain or sub-domain
KNILLSQLEERKLTSLLFDL

SEQ ID NO: 9985 - protein, 21 aa, artificial
  peptide fold or domain or sub-domain
KNILSQIVDIDGIWEGTRDFA

SEQ ID NO: 9986 - protein, 26 aa, artificial
  peptide fold or domain or sub-domain
KNIMAFQPPEKNGDGNFIKSTYLVQK

SEQ ID NO: 9987 - protein, 30 aa, artificial
  peptide fold or domain or sub-domain
KNINHRFSVLGSLVPSRGKVLDKVSLLDDT

SEQ ID NO: 9988 - protein, 29 aa, artificial
  peptide fold or domain or sub-domain
KNIVLSHHPTSLPDSVVGVGSLSELQAIF

SEQ ID NO: 9989 - protein, 29 aa, artificial
  peptide fold or domain or sub-domain
KNIVLTSRSDVQYPNAKIIHHIDTIKQWN

SEQ ID NO: 9990 - protein, 28 aa, artificial
  peptide fold or domain or sub-domain
KNKDELKKRLIKRNTDTIIQLEKRLQNA

SEQ ID NO: 9991 - protein, 30 aa, artificial
  peptide fold or domain or sub-domain
KNKKKAFLDMLIDKKDEGGLGYEDIREEVD

SEQ ID NO: 9992 - protein, 29 aa, artificial
  peptide fold or domain or sub-domain
KNKKKYFYLKNIKKENFCIKFSISTQKEE

SEQ ID NO: 9993 - protein, 29 aa, artificial
  peptide fold or domain or sub-domain
KNKSANIYLEKIVKEKSKYKIFVNVNKKQ

SEQ ID NO: 9994 - protein, 24 aa, artificial
  peptide fold or domain or sub-domain
KNKVHYNLWDEDAKLGMEHIELAK

SEQ ID NO: 9995 - protein, 30 aa, artificial
  peptide fold or domain or sub-domain
KNLENYKNPDNDPNGAWINDNPSAKSGNMK

SEQ ID NO: 9996 - protein, 29 aa, artificial
  peptide fold or domain or sub-domain
KNMITLLELGGNNSKMEDFEDFMVKVGAV

SEQ ID NO: 9997 - protein, 26 aa, artificial
  peptide fold or domain or sub-domain
KNNAQIRKLKLDGAAPINIQDTLDVL

SEQ ID NO: 9998 - protein, 24 aa, artificial
  peptide fold or domain or sub-domain
KNNGNLNLARMRRFRATIDRCELH

SEQ ID NO: 9999 - protein, 27 aa, artificial
  peptide fold or domain or sub-domain
KNNKNDLFLGTNDIRYKNIETNTLPNG

SEQ ID NO: 10000 - protein, 27 aa, artificial
  peptide fold or domain or sub-domain
KNNTLGQIKWEQMVFLGNPEYGVELQP

SEQ ID NO: 10001 - protein, 24 aa, artificial
  peptide fold or domain or sub-domain
KNPGFPTWEKLLEDPIVRGTQEKP

SEQ ID NO: 10002 - protein, 30 aa, artificial
  peptide fold or domain or sub-domain
KNPQHTVPTLEDDGHYIWDSHAIIAYLVSK

SEQ ID NO: 10003 - protein, 24 aa, artificial
  peptide fold or domain or sub-domain
KNPVHTDVMMEIDPSKINHIELAK

SEQ ID NO: 10004 - protein, 29 aa, artificial
  peptide fold or domain or sub-domain
KNQFDWDKRVLLIEEGICRLEEGTLAGTT

SEQ ID NO: 10005 - protein, 22 aa, artificial
  peptide fold or domain or sub-domain
KNQYIFDKYGLKAIEQYFPPYP

SEQ ID NO: 10006 - protein, 24 aa, artificial
  peptide fold or domain or sub-domain
KNRAWMSFGDELNVAMFKMGHAKS

SEQ ID NO: 10007 - protein, 29 aa, artificial
  peptide fold or domain or sub-domain
KNSNQIKILGNQGSFLTKGPSKLNDRADS

SEQ ID NO: 10008 - protein, 29 aa, artificial
  peptide fold or domain or sub-domain
KNSYHGETVGALSVSDVGLYRAPYSTMLF

SEQ ID NO: 10009 - protein, 25 aa, artificial
  peptide fold or domain or sub-domain
KNTDLNEKGSWGQQVWHKAPNGEYF

SEQ ID NO: 10010 - protein, 24 aa, artificial
  peptide fold or domain or sub-domain
KNTQSTQQMKTQFENDFNKLQTSF

SEQ ID NO: 10011 - protein, 22 aa, artificial
  peptide fold or domain or sub-domain
KNTVFYKDNEAIGSPASESVLH

SEQ ID NO: 10012 - protein, 22 aa, artificial
  peptide fold or domain or sub-domain
KNTVFYKNGHNVQGFSLSNQYG

SEQ ID NO: 10013 - protein, 27 aa, artificial
  peptide fold or domain or sub-domain
KNVILVDHNEFSQAVEGIEQARILEII

SEQ ID NO: 10014 - protein, 20 aa, artificial
  peptide fold or domain or sub-domain
KNVLEKELKENDAERLFYDI

SEQ ID NO: 10015 - protein, 28 aa, artificial
  peptide fold or domain or sub-domain
KNWRKVLNPEEQKLMPVMPPVVQLLFKH

SEQ ID NO: 10016 - protein, 30 aa, artificial
  peptide fold or domain or sub-domain
KNWVNEHLRESGLQVNILHLSPQVIEFHED

SEQ ID NO: 10017 - protein, 26 aa, artificial
  peptide fold or domain or sub-domain
KNYKCSICGLAFAKAVYLKNHARIHT

SEQ ID NO: 10018 - protein, 27 aa, artificial
  peptide fold or domain or sub-domain
KNYMQKILKYLEEKKPDRVDVFKTKAQ

SEQ ID NO: 10019 - protein, 30 aa, artificial
  peptide fold or domain or sub-domain
KNYPEHAREMLLWEESPQQFVPPAEHLEPI

SEQ ID NO: 10020 - protein, 28 aa, artificial
  peptide fold or domain or sub-domain
KPAFLHLKTVRLYGHAGADVPTTYLTRA

SEQ ID NO: 10021 - protein, 23 aa, artificial
  peptide fold or domain or sub-domain
KPALSRLAHFLPPDFNLTPFDIT

SEQ ID NO: 10022 - protein, 27 aa, artificial
  peptide fold or domain or sub-domain
KPAQKAFIGFEGVKGKKKMSAAEAVKE

SEQ ID NO: 10023 - protein, 30 aa, artificial
  peptide fold or domain or sub-domain
KPASVSAIKIDGKRAHERVRDGEVVDIPAR

SEQ ID NO: 10024 - protein, 23 aa, artificial
  peptide fold or domain or sub-domain
KPCKKNNVCNFDKNGYVSCKKCR

SEQ ID NO: 10025 - protein, 22 aa, artificial
  peptide fold or domain or sub-domain
KPCRGVTPSSFGVAIGREAGLP

SEQ ID NO: 10026 - protein, 30 aa, artificial
  peptide fold or domain or sub-domain
KPDVLLGDFDSIESEHLEYYMKQNVEILKF

SEQ ID NO: 10027 - protein, 25 aa, artificial
  peptide fold or domain or sub-domain
KPDYFEFNSDWRSNRTNKTLFEVLN

SEQ ID NO: 10028 - protein, 30 aa, artificial
  peptide fold or domain or sub-domain
KPDYVVGDFDSLTDETKAYYKEMGVNIVFD

SEQ ID NO: 10029 - protein, 20 aa, artificial
  peptide fold or domain or sub-domain
KPELLKQLKEHEQDDLFETI

SEQ ID NO: 10030 - protein, 30 aa, artificial
  peptide fold or domain or sub-domain
KPEQLVYKGRLYTFDSDVSKWIFELDPERY

SEQ ID NO: 10031 - protein, 26 aa, artificial
  peptide fold or domain or sub-domain
KPFACDICGRKFARSDERKRHRDIQH

SEQ ID NO: 10032 - protein, 28 aa, artificial
  peptide fold or domain or sub-domain
KPFDEALKEARLVESDPQQAEILAHHRV

SEQ ID NO: 10033 - protein, 26 aa, artificial
  peptide fold or domain or sub-domain
KPFGCMYCPRFFRQRTILNQHLRIHT

SEQ ID NO: 10034 - protein, 26 aa, artificial
  peptide fold or domain or sub-domain
KPFKCSQCDSGLPRKTSLVSNLRTNS

SEQ ID NO: 10035 - protein, 27 aa, artificial
  peptide fold or domain or sub-domain
KPFNDKKYFHPYCNVTEWENATNIQDC

SEQ ID NO: 10036 - protein, 26 aa, artificial
  peptide fold or domain or sub-domain
KPFQCRICMRNFSRSDHLTTHIRTHT

SEQ ID NO: 10037 - protein, 24 aa, artificial
  peptide fold or domain or sub-domain
KPFQKCIIEGQETGSIRRDLAPDL

SEQ ID NO: 10038 - protein, 26 aa, artificial
  peptide fold or domain or sub-domain
KPFSCDQCNMRFIQKYHMERHKRTHS

SEQ ID NO: 10039 - protein, 26 aa, artificial
  peptide fold or domain or sub-domain
KPFSCPLCPKAFTKKHHLKTHLNYHT

SEQ ID NO: 10040 - protein, 23 aa, artificial
  peptide fold or domain or sub-domain
KPFSEIAREIDMSSATVHDRVSR

SEQ ID NO: 10041 - protein, 26 aa, artificial
  peptide fold or domain or sub-domain
KPFTCEVCLKSYTQFSNLCRHKRMHA

SEQ ID NO: 10042 - protein, 26 aa, artificial
  peptide fold or domain or sub-domain
KPFTCTQCGKCFSQSSNLNQHMRIHT

SEQ ID NO: 10043 - protein, 26 aa, artificial
  peptide fold or domain or sub-domain
KPFTCTQCGKSFNCSSLLNKHMKIHT

SEQ ID NO: 10044 - protein, 26 aa, artificial
  peptide fold or domain or sub-domain
KPFVCQYCGKGFHQKIDMKIHSYTHT

SEQ ID NO: 10045 - protein, 29 aa, artificial
  peptide fold or domain or sub-domain
KPGLLHKVAHRLQEAGIICDKREPGVVRV

SEQ ID NO: 10046 - protein, 25 aa, artificial
  peptide fold or domain or sub-domain
KPGTTQDILQMPRDGPEIRALRGSR

SEQ ID NO: 10047 - protein, 27 aa, artificial
  peptide fold or domain or sub-domain
KPHASVGTHGYMAPEVLQKGVAYDSSA

SEQ ID NO: 10048 - protein, 26 aa, artificial
  peptide fold or domain or sub-domain
KPHICEHCSAAFRSSYHLRRHVLIHT

SEQ ID NO: 10049 - protein, 26 aa, artificial
  peptide fold or domain or sub-domain
KPHKCNECGKRFSRKMLLKQHMRTHS

SEQ ID NO: 10050 - protein, 26 aa, artificial
  peptide fold or domain or sub-domain
KPHKCPECDKSFRSSSDLVRHQGVHT

SEQ ID NO: 10051 - protein, 26 aa, artificial
  peptide fold or domain or sub-domain
KPISCSICGKSFKRHAEYIRHQKIHT

SEQ ID NO: 10052 - protein, 22 aa, artificial
  peptide fold or domain or sub-domain
KPISGGRVRRSIAAGEPWEHLV

SEQ ID NO: 10053 - protein, 28 aa, artificial
  peptide fold or domain or sub-domain
KPITEIAGRLNIPDESVLSYGHTIAKLD

SEQ ID NO: 10054 - protein, 28 aa, artificial
  peptide fold or domain or sub-domain
KPIWCDRGCKYVDSFNELSFERRNGYGY

SEQ ID NO: 10055 - protein, 30 aa, artificial
  peptide fold or domain or sub-domain
KPIWKKDKKELKDDDYNEFYKATFHDWNDP

SEQ ID NO: 10056 - protein, 30 aa, artificial
  peptide fold or domain or sub-domain
KPIWQRPSKEVEEDEYKAFYKSFSKESDDP

SEQ ID NO: 10057 - protein, 30 aa, artificial
  peptide fold or domain or sub-domain
KPIWTRSPKDVSETAYNDFFKTTFGEFLDP

SEQ ID NO: 10058 - protein, 26 aa, artificial
  peptide fold or domain or sub-domain
KPLEDLPLSELQKFSQVIDEDVYPIL

SEQ ID NO: 10059 - protein, 27 aa, artificial
  peptide fold or domain or sub-domain
KPLPQAVLPHPVQQTIQEKAISDVVNP

SEQ ID NO: 10060 - protein, 30 aa, artificial
  peptide fold or domain or sub-domain
KPLWMKAAKDVTKEEYTEFFRSLSKTQDTP

SEQ ID NO: 10061 - protein, 30 aa, artificial
  peptide fold or domain or sub-domain
KPLWTLNKNAISEEEHKEFYQFLSKSYDTP

SEQ ID NO: 10062 - protein, 30 aa, artificial
  peptide fold or domain or sub-domain
KPLWTRNPSDITQEEYNAFYKSISNDWEDP

SEQ ID NO: 10063 - protein, 30 aa, artificial
  peptide fold or domain or sub-domain
KPNFIVGDFDSIDENILNYYRKNNINLNAF

SEQ ID NO: 10064 - protein, 26 aa, artificial
  peptide fold or domain or sub-domain
KPPFDGNNHIQLFHNIVRDTELKFPE

SEQ ID NO: 10065 - protein, 26 aa, artificial
  peptide fold or domain or sub-domain
KPPIFKMIEGFNAVDERELHKSFNMG

SEQ ID NO: 10066 - protein, 22 aa, artificial
  peptide fold or domain or sub-domain
KPQEALVCISSALYVMGEIVPS

SEQ ID NO: 10067 - protein, 27 aa, artificial
  peptide fold or domain or sub-domain
KPQGYYSWHHGAVQYENGRFTVPKGVG

SEQ ID NO: 10068 - protein, 27 aa, artificial
  peptide fold or domain or sub-domain
KPSCMEEGIQALAALGYPKSSAERMIA

SEQ ID NO: 10069 - protein, 23 aa, artificial
  peptide fold or domain or sub-domain
KPSDAELKRTLTEEQYQVTQNSA

SEQ ID NO: 10070 - protein, 23 aa, artificial
  peptide fold or domain or sub-domain
KPSKEEIKKKLSKDEYRVTQNNE

SEQ ID NO: 10071 - protein, 21 aa, artificial
  peptide fold or domain or sub-domain
KPSKFEDAPLEDNKEYGAYYY

SEQ ID NO: 10072 - protein, 28 aa, artificial
  peptide fold or domain or sub-domain
KPSLIACRTRIGKGAASMEGSHKTHGAA

SEQ ID NO: 10073 - protein, 22 aa, artificial
  peptide fold or domain or sub-domain
KPSPGLEHFLKSCDRDITNDVT

SEQ ID NO: 10074 - protein, 28 aa, artificial
  peptide fold or domain or sub-domain
KPTAIICHTVKGKGLPAAESNADWHHKN

SEQ ID NO: 10075 - protein, 28 aa, artificial
  peptide fold or domain or sub-domain
KPTPDIVYGSDFLRFLPGSMMELAYCVN

SEQ ID NO: 10076 - protein, 28 aa, artificial
  peptide fold or domain or sub-domain
KPVCILLHTEMGNGVDFMMHTHAWHGKA

SEQ ID NO: 10077 - protein, 28 aa, artificial
  peptide fold or domain or sub-domain
KPVFGDRDKTIHDDVMGISQERRTGYAW

SEQ ID NO: 10078 - protein, 28 aa, artificial
  peptide fold or domain or sub-domain
KPVFINIRTVIGVGTSTAGTAMAHHGAF

SEQ ID NO: 10079 - protein, 30 aa, artificial
  peptide fold or domain or sub-domain
KPVIMAEYGADTLEGLHLVICGASSLGLLF

SEQ ID NO: 10080 - protein, 28 aa, artificial
  peptide fold or domain or sub-domain
KPVMELARGLGIQEDEVELYGKYKAKIS

SEQ ID NO: 10081 - protein, 28 aa, artificial
  peptide fold or domain or sub-domain
KPVSQLAKEIGLLPEELEVYGRSKAKVR

SEQ ID NO: 10082 - protein, 25 aa, artificial
  peptide fold or domain or sub-domain
KPVYPVLEAMGEWTAESLDAAIRAH

SEQ ID NO: 10083 - protein, 26 aa, artificial
  peptide fold or domain or sub-domain
KPYCCAACGRAFACHSSLAAHEKLHS

SEQ ID NO: 10084 - protein, 26 aa, artificial
  peptide fold or domain or sub-domain
KPYDYNECGTSFIWSSYLIQHKKTHT

SEQ ID NO: 10085 - protein, 26 aa, artificial
  peptide fold or domain or sub-domain
KPYECADCGKAFRGRSHFFRHLRTHT

SEQ ID NO: 10086 - protein, 26 aa, artificial
  peptide fold or domain or sub-domain
KPYECNICKVRFTRQDKLKVHMRKHT

SEQ ID NO: 10087 - protein, 26 aa, artificial
  peptide fold or domain or sub-domain
KPYHCPACGRSFNQRSILNRHQKTQH

SEQ ID NO: 10088 - protein, 26 aa, artificial
  peptide fold or domain or sub-domain
KPYKCEECGNAFNESPNCTTHKRIIE

SEQ ID NO: 10089 - protein, 26 aa, artificial
  peptide fold or domain or sub-domain
KPYKGEHCVKSFSWSSHLQINQRAHA

SEQ ID NO: 10090 - protein, 26 aa, artificial
  peptide fold or domain or sub-domain
KPYQCEYCLQYFSRTDRVLKHKRMCH

SEQ ID NO: 10091 - protein, 20 aa, artificial
  peptide fold or domain or sub-domain
KQAEMVKSLGDLWAGHPRGP

SEQ ID NO: 10092 - protein, 21 aa, artificial
  peptide fold or domain or sub-domain
KQCFFSDCNHVDEPECGVKEA

SEQ ID NO: 10093 - protein, 30 aa, artificial
  peptide fold or domain or sub-domain
KQDMKDAEEEEVRSELDARQSSYKVLINCF

SEQ ID NO: 10094 - protein, 30 aa, artificial
  peptide fold or domain or sub-domain
KQEIQKGVELFKKNPEKGVSFFLKANIIQD

SEQ ID NO: 10095 - protein, 29 aa, artificial
  peptide fold or domain or sub-domain
KQELSDFIKSKPTEYYQKFKIVVEDGRVY

SEQ ID NO: 10096 - protein, 22 aa, artificial
  peptide fold or domain or sub-domain
KQERNVKPTVEQLKRAVDDLTQ

SEQ ID NO: 10097 - protein, 28 aa, artificial
  peptide fold or domain or sub-domain
KQERNVKPTVEQLKRAVDDLTQSTNSIH

SEQ ID NO: 10098 - protein, 29 aa, artificial
  peptide fold or domain or sub-domain
KQFIGLAEFGGNNMTCDDLEWALSRVGAV

SEQ ID NO: 10099 - protein, 30 aa, artificial
  peptide fold or domain or sub-domain
KQGFLNEENLKSIVPVTKLKSKAPHWTNRI

SEQ ID NO: 10100 - protein, 29 aa, artificial
  peptide fold or domain or sub-domain
KQGYHGNTLFALSVGGMKPRKQPYEGVFS

SEQ ID NO: 10101 - protein, 26 aa, artificial
  peptide fold or domain or sub-domain
KQHIYKALDYIKNGTCERCEEEIQLA

SEQ ID NO: 10102 - protein, 27 aa, artificial
  peptide fold or domain or sub-domain
KQHPLWTRRAARKAEYEAANPGKRYGV

SEQ ID NO: 10103 - protein, 26 aa, artificial
  peptide fold or domain or sub-domain
KQIEDSKLLIQEESDAELKEMAREEL

SEQ ID NO: 10104 - protein, 29 aa, artificial
  peptide fold or domain or sub-domain
KQILIIDEGDTQLLPGTEITINNFKKANL

SEQ ID NO: 10105 - protein, 29 aa, artificial
  peptide fold or domain or sub-domain
KQIVTLMTVGGPRMSMLDLDKILVEVGAV

SEQ ID NO: 10106 - protein, 30 aa, artificial
  peptide fold or domain or sub-domain
KQIWRIEGSNKVPVDPATYGQFYGGDSYII

SEQ ID NO: 10107 - protein, 22 aa, artificial
  peptide fold or domain or sub-domain
KQKLFQEDNGLPVHLKGGATDN

SEQ ID NO: 10108 - protein, 26 aa, artificial
  peptide fold or domain or sub-domain
KQLDEAHSMQKNENDPEMRALVEEEA

SEQ ID NO: 10109 - protein, 27 aa, artificial
  peptide fold or domain or sub-domain
KQMTSQDYSVSVQNEDGSHSEVKKTLY

SEQ ID NO: 10110 - protein, 20 aa, artificial
  peptide fold or domain or sub-domain
KQNHSYWLLERLKSGDLDLC

SEQ ID NO: 10111 - protein, 26 aa, artificial
  peptide fold or domain or sub-domain
KQNPCTACGKSLEINSSVINHQYMHT

SEQ ID NO: 10112 - protein, 22 aa, artificial
  peptide fold or domain or sub-domain
KQPDEFTGSDLHPDTLGRLRSE

SEQ ID NO: 10113 - protein, 30 aa, artificial
  peptide fold or domain or sub-domain
KQRFNVVTSNYIAREYGIKKMMLINEATKL

SEQ ID NO: 10114 - protein, 22 aa, artificial
  peptide fold or domain or sub-domain
KQSLTGYGRADKQAVQAAVARE

SEQ ID NO: 10115 - protein, 28 aa, artificial
  peptide fold or domain or sub-domain
KQTIINLYENNKQNDKKIIKKLKKSGRF

SEQ ID NO: 10116 - protein, 22 aa, artificial
  peptide fold or domain or sub-domain
KQTVVGIGSAEKSQVQHMVRTL

SEQ ID NO: 10117 - protein, 27 aa, artificial
  peptide fold or domain or sub-domain
KQVDLKPDEYKRDKLEALGIENNTISS

SEQ ID NO: 10118 - protein, 22 aa, artificial
  peptide fold or domain or sub-domain
KQVEEFAKNYIEKDLTDEDKKI

SEQ ID NO: 10119 - protein, 26 aa, artificial
  peptide fold or domain or sub-domain
KQVFPLHDADGKTTAIICAIPFVRPR

SEQ ID NO: 10120 - protein, 27 aa, artificial
  peptide fold or domain or sub-domain
KQVILTDHNEFQQSIADIREVEVVEVV

SEQ ID NO: 10121 - protein, 21 aa, artificial
  peptide fold or domain or sub-domain
KQWGEDLISSWNKNDWIRLPN

SEQ ID NO: 10122 - protein, 29 aa, artificial
  peptide fold or domain or sub-domain
KQYIGPLELRGDKLTAEELEFMLGQAGAV

SEQ ID NO: 10123 - protein, 26 aa, artificial
  peptide fold or domain or sub-domain
KQYMCHVCSKAFFQAANLKAHLRVHS

SEQ ID NO: 10124 - protein, 24 aa, artificial
  peptide fold or domain or sub-domain
KQYQKSEKLIQEEINKYTQEIHTI

SEQ ID NO: 10125 - protein, 29 aa, artificial
  peptide fold or domain or sub-domain
KRADIASAPLSALLKGMLHEKIPRFGARP

SEQ ID NO: 10126 - protein, 26 aa, artificial
  peptide fold or domain or sub-domain
KRALCEYIRMKSNGFMDASFRLCKLM

SEQ ID NO: 10127 - protein, 24 aa, artificial
  peptide fold or domain or sub-domain
KRANARRLEALGVEVREMDVASDA

SEQ ID NO: 10128 - protein, 29 aa, artificial
  peptide fold or domain or sub-domain
KRCLERLKQQMPLGADCARYTTLSLLRRA

SEQ ID NO: 10129 - protein, 27 aa, artificial
  peptide fold or domain or sub-domain
KRFETFEDEISVKDAPPQRVTQRYAQG

SEQ ID NO: 10130 - protein, 30 aa, artificial
  peptide fold or domain or sub-domain
KRGFLAQEELLPKRVINLYQMTPEMWEERI

SEQ ID NO: 10131 - protein, 29 aa, artificial
  peptide fold or domain or sub-domain
KRGFSGRSLGALSFTWEPKYREPFGDAVD

SEQ ID NO: 10132 - protein, 30 aa, artificial
  peptide fold or domain or sub-domain
KRGGVVLAACPLAKQKGVVNASRLWEAQEK

SEQ ID NO: 10133 - protein, 22 aa, artificial
  peptide fold or domain or sub-domain
KRGTAREGNAYKCPRCSTDAIE

SEQ ID NO: 10134 - protein, 26 aa, artificial
  peptide fold or domain or sub-domain
KRHLVNTERLWEASKVALGDIAEVYG

SEQ ID NO: 10135 - protein, 25 aa, artificial
  peptide fold or domain or sub-domain
KRIDQITAIFIGQNRSCVVPELIKN

SEQ ID NO: 10136 - protein, 29 aa, artificial
  peptide fold or domain or sub-domain
KRIELIKKQIANTDSDFDREKGEERIARL

SEQ ID NO: 10137 - protein, 25 aa, artificial
  peptide fold or domain or sub-domain
KRIIEEACGKTRVAFFTSEYELITE

SEQ ID NO: 10138 - protein, 29 aa, artificial
  peptide fold or domain or sub-domain
KRIQEIIEQLDVTTSEYEKEKLNERLAKL

SEQ ID NO: 10139 - protein, 24 aa, artificial
  peptide fold or domain or sub-domain
KRIQESKANISENNLTSYIDALVF

SEQ ID NO: 10140 - protein, 21 aa, artificial
  peptide fold or domain or sub-domain
KRKTGSYVGRRHVMGMPVKGQ

SEQ ID NO: 10141 - protein, 25 aa, artificial
  peptide fold or domain or sub-domain
KRLDELDYFPCSCPVCSKYTPQELR

SEQ ID NO: 10142 - protein, 24 aa, artificial
  peptide fold or domain or sub-domain
KRLGQVLADMGDMVQIMDLETYDT

SEQ ID NO: 10143 - protein, 30 aa, artificial
  peptide fold or domain or sub-domain
KRLIRELDIADVPGIGNITAEKLKKLGINK

SEQ ID NO: 10144 - protein, 25 aa, artificial
  peptide fold or domain or sub-domain
KRLSEDTYSRTITAHIAKDGYWYIH

SEQ ID NO: 10145 - protein, 28 aa, artificial
  peptide fold or domain or sub-domain
KRLTFEKLMIDPVRREVTLNSQAVPLTA

SEQ ID NO: 10146 - protein, 30 aa, artificial
  peptide fold or domain or sub-domain
KRLYRIGLNLFNINPDKGIQFLISRGFIPD

SEQ ID NO: 10147 - protein, 30 aa, artificial
  peptide fold or domain or sub-domain
KRLYWGVNGTAKTPMRKLFLDEAKQGMTTP

SEQ ID NO: 10148 - protein, 22 aa, artificial
  peptide fold or domain or sub-domain
KRMTFKDAMEKYGSDKPDLRFG

SEQ ID NO: 10149 - protein, 24 aa, artificial
  peptide fold or domain or sub-domain
KRNMTICYTEGDDIIFMDSNDFEQ

SEQ ID NO: 10150 - protein, 27 aa, artificial
  peptide fold or domain or sub-domain
KRPDLAARTRNPDVLFQAHSAALGLQF

SEQ ID NO: 10151 - protein, 25 aa, artificial
  peptide fold or domain or sub-domain
KRPFEGRSQDVLSENIKKAQPKYYV

SEQ ID NO: 10152 - protein, 30 aa, artificial
  peptide fold or domain or sub-domain
KRPVALSLHDKLKPQMMHVVSYTLGKDLHI

SEQ ID NO: 10153 - protein, 25 aa, artificial
  peptide fold or domain or sub-domain
KRPYNGKNRQEIRDQIIAKQVILTD

SEQ ID NO: 10154 - protein, 22 aa, artificial
  peptide fold or domain or sub-domain
KRQECPEGQTEDPDTDNCVSCT

SEQ ID NO: 10155 - protein, 30 aa, artificial
  peptide fold or domain or sub-domain
KRQLVIAAEHFNRKPNDAIEYLKNNNLYSP

SEQ ID NO: 10156 - protein, 26 aa, artificial
  peptide fold or domain or sub-domain
KRQQEATLEAERGVSLSNADLDRFIR

SEQ ID NO: 10157 - protein, 30 aa, artificial
  peptide fold or domain or sub-domain
KRRAFLDLLLSVTDDEGNRLSHEDIREEVD

SEQ ID NO: 10158 - protein, 24 aa, artificial
  peptide fold or domain or sub-domain
KRREEELLIRQGSAQQAKLYAAQI

SEQ ID NO: 10159 - protein, 24 aa, artificial
  peptide fold or domain or sub-domain
KRREEPTFKNVFNKLKRITGFQSG

SEQ ID NO: 10160 - protein, 30 aa, artificial
  peptide fold or domain or sub-domain
KRRLMIGADHFNRDPKKGLEFLQGTHLLPD

SEQ ID NO: 10161 - protein, 24 aa, artificial
  peptide fold or domain or sub-domain
KRRRAEGIELDEKLLERILGIARE

SEQ ID NO: 10162 - protein, 29 aa, artificial
  peptide fold or domain or sub-domain
KRRRHIKEILKNMPSGTRKSQLEIRQLAL

SEQ ID NO: 10163 - protein, 29 aa, artificial
  peptide fold or domain or sub-domain
KRSFFALRDQIPELENNEKAPKVVILKKA

SEQ ID NO: 10164 - protein, 29 aa, artificial
  peptide fold or domain or sub-domain
KRSLIEYLNSYHLKDIDELITKSVEEVNF

SEQ ID NO: 10165 - protein, 21 aa, artificial
  peptide fold or domain or sub-domain
KRSQIYGSRQIILEKEETEEL

SEQ ID NO: 10166 - protein, 28 aa, artificial
  peptide fold or domain or sub-domain
KRTEQIAEWYAARGLDPNSVSLEQKQAA

SEQ ID NO: 10167 - protein, 22 aa, artificial
  peptide fold or domain or sub-domain
KRVAVRRYAEAGDDAAVRRVTD

SEQ ID NO: 10168 - protein, 30 aa, artificial
  peptide fold or domain or sub-domain
KRVHYAATDLLAYAPITKTHLDKGMRIGEL

SEQ ID NO: 10169 - protein, 30 aa, artificial
  peptide fold or domain or sub-domain
KRVMWSEDDLMAVSPFTTRRLIEGATLREL

SEQ ID NO: 10170 - protein, 29 aa, artificial
  peptide fold or domain or sub-domain
KRVNVLESGDTTLLPGELCERARFEAENR

SEQ ID NO: 10171 - protein, 30 aa, artificial
  peptide fold or domain or sub-domain
KRVVEVIFDDNSELWTVRTDKGDSVTTRFV

SEQ ID NO: 10172 - protein, 20 aa, artificial
  peptide fold or domain or sub-domain
KRWCYLSSPFVDKRSKDLIE

SEQ ID NO: 10173 - protein, 30 aa, artificial
  peptide fold or domain or sub-domain
KRWLMLGTEKFNENPREGIAKLTEHNLLGG

SEQ ID NO: 10174 - protein, 26 aa, artificial
  peptide fold or domain or sub-domain
KRYHCKECGKAFSQNTGLILHQRIHT

SEQ ID NO: 10175 - protein, 26 aa, artificial
  peptide fold or domain or sub-domain
KRYKYKKCEKTFSMCSAYHQHGEIHG

SEQ ID NO: 10176 - protein, 29 aa, artificial
  peptide fold or domain or sub-domain
KSAANAFFGWMQPSSIADRRRAEERLFRT

SEQ ID NO: 10177 - protein, 29 aa, artificial
  peptide fold or domain or sub-domain
KSAEQIQQEWDTNPRWKDVTRTYSAEDVV

SEQ ID NO: 10178 - protein, 25 aa, artificial
  peptide fold or domain or sub-domain
KSALLALAAYASDPNEADRLKYLAS

SEQ ID NO: 10179 - protein, 28 aa, artificial
  peptide fold or domain or sub-domain
KSAVEAVQKETGSAADNDAESKSEGDMF

SEQ ID NO: 10180 - protein, 29 aa, artificial
  peptide fold or domain or sub-domain
KSCCSCCPVGCAKCSQGCICKEASDKCSC

SEQ ID NO: 10181 - protein, 26 aa, artificial
  peptide fold or domain or sub-domain
KSDAMLAIEAAKKGDFDVADEQIKNA

SEQ ID NO: 10182 - protein, 23 aa, artificial
  peptide fold or domain or sub-domain
KSDISNAVASSFTYDFLLDVVPK

SEQ ID NO: 10183 - protein, 21 aa, artificial
  peptide fold or domain or sub-domain
KSDLRTDVSTLVELSNHRQTP

SEQ ID NO: 10184 - protein, 23 aa, artificial
  peptide fold or domain or sub-domain
KSDLTAAVKTSEMFDFLVYIVPR

SEQ ID NO: 10185 - protein, 23 aa, artificial
  peptide fold or domain or sub-domain
KSDSRWQEAMKKRGITDFDQVQV

SEQ ID NO: 10186 - protein, 22 aa, artificial
  peptide fold or domain or sub-domain
KSEDELLGSDVDDNLRLELCTT

SEQ ID NO: 10187 - protein, 27 aa, artificial
  peptide fold or domain or sub-domain
KSFDRRNNQVKILQGNGSYQTLQWEAL

SEQ ID NO: 10188 - protein, 27 aa, artificial
  peptide fold or domain or sub-domain
KSFGSYVAEVADVRMREDGTVKVERVT

SEQ ID NO: 10189 - protein, 26 aa, artificial
  peptide fold or domain or sub-domain
KSFKELTPELQSLAGRKGCMLSKMFQ

SEQ ID NO: 10190 - protein, 26 aa, artificial
  peptide fold or domain or sub-domain
KSFLREALEYAKNKEYDKAELTIQES

SEQ ID NO: 10191 - protein, 22 aa, artificial
  peptide fold or domain or sub-domain
KSFNNYFVTNTEYEDSLKYQIL

SEQ ID NO: 10192 - protein, 29 aa, artificial
  peptide fold or domain or sub-domain
KSFPEVVGKTVDQAREYFTLHYPQYNVYF

SEQ ID NO: 10193 - protein, 20 aa, artificial
  peptide fold or domain or sub-domain
KSFTSLRECATYLGINPGTL

SEQ ID NO: 10194 - protein, 21 aa, artificial
  peptide fold or domain or sub-domain
KSFVEFDGKELVFTNKELAKI

SEQ ID NO: 10195 - protein, 21 aa, artificial
  peptide fold or domain or sub-domain
KSGIESALAKVRAVRSNVYFY

SEQ ID NO: 10196 - protein, 30 aa, artificial
  peptide fold or domain or sub-domain
KSGYLAGDKLLPQRVLEQHKLNKDQWEERI

SEQ ID NO: 10197 - protein, 25 aa, artificial
  peptide fold or domain or sub-domain
KSHAEYFLWALRGERPGEREVRALD

SEQ ID NO: 10198 - protein, 22 aa, artificial
  peptide fold or domain or sub-domain
KSIDELNKTDINNNYLNSIKHH

SEQ ID NO: 10199 - protein, 22 aa, artificial
  peptide fold or domain or sub-domain
KSIEQLASSSPQGELSPHRLTQ

SEQ ID NO: 10200 - protein, 28 aa, artificial
  peptide fold or domain or sub-domain
KSIGRILYAAGLASSTTEGHKLAAAQGC

SEQ ID NO: 10201 - protein, 20 aa, artificial
  peptide fold or domain or sub-domain
KSIICSRKDKSEDEQKAYLQ

SEQ ID NO: 10202 - protein, 20 aa, artificial
  peptide fold or domain or sub-domain
KSILEERIKNEGLEFVLYNI

SEQ ID NO: 10203 - protein, 30 aa, artificial
  peptide fold or domain or sub-domain
KSINGRIEDLKIMLFKENKKVSKSHTLQKC

SEQ ID NO: 10204 - protein, 26 aa, artificial
  peptide fold or domain or sub-domain
KSIRSVIADFDYDYALDTGTGLFLFR

SEQ ID NO: 10205 - protein, 24 aa, artificial
  peptide fold or domain or sub-domain
KSKFDRFIEGDSTQLTNKQVEGLH

SEQ ID NO: 10206 - protein, 30 aa, artificial
  peptide fold or domain or sub-domain
KSKLMTTDMGITEHIEGDETKFAVWTGRSP

SEQ ID NO: 10207 - protein, 29 aa, artificial
  peptide fold or domain or sub-domain
KSKVHHIGSALHQLYQESITSGSGVHRVA

SEQ ID NO: 10208 - protein, 26 aa, artificial
  peptide fold or domain or sub-domain
KSLAIEALRDVRSGKYEEGKSKLNEA

SEQ ID NO: 10209 - protein, 28 aa, artificial
  peptide fold or domain or sub-domain
KSLAYICASDSDTIQILDLATEEVIGEL

SEQ ID NO: 10210 - protein, 25 aa, artificial
  peptide fold or domain or sub-domain
KSLKELQEMDKDDESLIKYKKTLLG

SEQ ID NO: 10211 - protein, 24 aa, artificial
  peptide fold or domain or sub-domain
KSLLQVIFANSDAALNHTSHTQPA

SEQ ID NO: 10212 - protein, 25 aa, artificial
  peptide fold or domain or sub-domain
KSLTEHRYFGDPSYTTRIQRIMESY

SEQ ID NO: 10213 - protein, 22 aa, artificial
  peptide fold or domain or sub-domain
KSLWYEELIRREAWPEIINTLS

SEQ ID NO: 10214 - protein, 30 aa, artificial
  peptide fold or domain or sub-domain
KSMNFLDQILTIQRPDGTNFVDDEVSDHLY

SEQ ID NO: 10215 - protein, 26 aa, artificial
  peptide fold or domain or sub-domain
KSNAVRILMDHAGYDESTALAHVRDD

SEQ ID NO: 10216 - protein, 26 aa, artificial
  peptide fold or domain or sub-domain
KSNGYLKKYEQEGAPGHIVRDYEQLL

SEQ ID NO: 10217 - protein, 30 aa, artificial
  peptide fold or domain or sub-domain
KSNLEGGIRMFNQSPKRGMAALIKSGFVAS

SEQ ID NO: 10218 - protein, 24 aa, artificial
  peptide fold or domain or sub-domain
KSNSIINKRWAAKFNAFISTAELR

SEQ ID NO: 10219 - protein, 25 aa, artificial
  peptide fold or domain or sub-domain
KSNTDIWSFLKRKYNLKESVSSLIE

SEQ ID NO: 10220 - protein, 29 aa, artificial
  peptide fold or domain or sub-domain
KSPENMLSFPSKQADIFYRDWRILGTDYL

SEQ ID NO: 10221 - protein, 28 aa, artificial
  peptide fold or domain or sub-domain
KSQMDLEERLRKRKTDSEQAIQIRLQNS

SEQ ID NO: 10222 - protein, 26 aa, artificial
  peptide fold or domain or sub-domain
KSQQEGEMIKLKGSGLKGNNLSNFIR

SEQ ID NO: 10223 - protein, 28 aa, artificial
  peptide fold or domain or sub-domain
KSREVVEQEYRDQGKDPATLDYVVPFKV

SEQ ID NO: 10224 - protein, 26 aa, artificial
  peptide fold or domain or sub-domain
KSRIEKKLNDQDKRLKEAERQIEGFK

SEQ ID NO: 10225 - protein, 26 aa, artificial
  peptide fold or domain or sub-domain
KSSFIEAIQLAKAGNLKEAKIKVEEA

SEQ ID NO: 10226 - protein, 26 aa, artificial
  peptide fold or domain or sub-domain
KSSKCKECGKTFKHSSYLIHQRTCTG

SEQ ID NO: 10227 - protein, 28 aa, artificial
  peptide fold or domain or sub-domain
KSTEEARKELQAAGKSPEDLERLLPHKV

SEQ ID NO: 10228 - protein, 28 aa, artificial
  peptide fold or domain or sub-domain
KSTLKDWKRAIRLGGIMLRKMMDSGQID

SEQ ID NO: 10229 - protein, 25 aa, artificial
  peptide fold or domain or sub-domain
KSTLRAFAHCCTDPVQKEELLRILR

SEQ ID NO: 10230 - protein, 27 aa, artificial
  peptide fold or domain or sub-domain
KSTLVAGGTDLALSVTQNLATIDKLVY

SEQ ID NO: 10231 - protein, 30 aa, artificial
  peptide fold or domain or sub-domain
KSTMEAAISEFNRNSVKGVEYLIANKLVER

SEQ ID NO: 10232 - protein, 21 aa, artificial
  peptide fold or domain or sub-domain
KSVDEVCAYYCVQTSRIRRIE

SEQ ID NO: 10233 - protein, 20 aa, artificial
  peptide fold or domain or sub-domain
KSVEEVGRIIGIPQSTVKTR

SEQ ID NO: 10234 - protein, 25 aa, artificial
  peptide fold or domain or sub-domain
KSVLRALAESTTNEEEKKRLLYLAT

SEQ ID NO: 10235 - protein, 30 aa, artificial
  peptide fold or domain or sub-domain
KSVQNLANLVEFGAKEPYMEGVNPFIKSNK

SEQ ID NO: 10236 - protein, 23 aa, artificial
  peptide fold or domain or sub-domain
KSVTTGEPVASASHILIRLNPAD

SEQ ID NO: 10237 - protein, 28 aa, artificial
  peptide fold or domain or sub-domain
KSYLELVHLLLEGRLPEESEMETLERKI

SEQ ID NO: 10238 - protein, 27 aa, artificial
  peptide fold or domain or sub-domain
KSYLKAIKERLQKTVPDKLPLLESQVN

SEQ ID NO: 10239 - protein, 27 aa, artificial
  peptide fold or domain or sub-domain
KSYMKSVKDKLQETKPADSELFQKNVQ

SEQ ID NO: 10240 - protein, 20 aa, artificial
  peptide fold or domain or sub-domain
KSYQEIVEITSKSLSSVESI

SEQ ID NO: 10241 - protein, 25 aa, artificial
  peptide fold or domain or sub-domain
KSYRSAKLDKDVPIEYRDSNARWYA

SEQ ID NO: 10242 - protein, 23 aa, artificial
  peptide fold or domain or sub-domain
KSYTDIARELGTSESSIRKRVKK

SEQ ID NO: 10243 - protein, 30 aa, artificial
  peptide fold or domain or sub-domain
KTALFSCVKAFNYKPKIGIAKAIESGFIKD

SEQ ID NO: 10244 - protein, 20 aa, artificial
  peptide fold or domain or sub-domain
KTARDIRNELQLSASKRTIL

SEQ ID NO: 10245 - protein, 20 aa, artificial
  peptide fold or domain or sub-domain
KTATDYATAVGVNANIGNIL

SEQ ID NO: 10246 - protein, 27 aa, artificial
  peptide fold or domain or sub-domain
KTATNKTLDDFTLENVLSNKVTAQDMR

SEQ ID NO: 10247 - protein, 29 aa, artificial
  peptide fold or domain or sub-domain
KTATQMDPYASDYEKKIAIDGWFTLTMPD

SEQ ID NO: 10248 - protein, 21 aa, artificial
  peptide fold or domain or sub-domain
KTCQQGLPRSVSELEGLPGIG

SEQ ID NO: 10249 - protein, 29 aa, artificial
  peptide fold or domain or sub-domain
KTCQQGLPRSVSELEGLPGIGAYTARAIA

SEQ ID NO: 10250 - protein, 25 aa, artificial
  peptide fold or domain or sub-domain
KTCRDVFCPGSSTCVVDQTNNAYCV

SEQ ID NO: 10251 - protein, 20 aa, artificial
  peptide fold or domain or sub-domain
KTCSAIVREYQNMHLDERGW

SEQ ID NO: 10252 - protein, 20 aa, artificial
  peptide fold or domain or sub-domain
KTCTRIKQELGLQVSAKTVS

SEQ ID NO: 10253 - protein, 24 aa, artificial
  peptide fold or domain or sub-domain
KTDDPADREAMLAAYAAAQVSGAA

SEQ ID NO: 10254 - protein, 23 aa, artificial
  peptide fold or domain or sub-domain
KTDIATCIYNTEIFDFLMDIIPK

SEQ ID NO: 10255 - protein, 27 aa, artificial
  peptide fold or domain or sub-domain
KTDTYEAPEHCDATVNSVTELNPVSML

SEQ ID NO: 10256 - protein, 30 aa, artificial
  peptide fold or domain or sub-domain
KTEFIRCAEAFNKKPKNGVPMLIEKNFIRS

SEQ ID NO: 10257 - protein, 27 aa, artificial
  peptide fold or domain or sub-domain
KTEITVNGDTYTVKRIFPNQTTTNTFT

SEQ ID NO: 10258 - protein, 30 aa, artificial
  peptide fold or domain or sub-domain
KTEMWPLPVGSMFGVGSRMKHHLNRMGIST

SEQ ID NO: 10259 - protein, 28 aa, artificial
  peptide fold or domain or sub-domain
KTEQQAFDELIASNMPTEQAKALAKHKA

SEQ ID NO: 10260 - protein, 28 aa, artificial
  peptide fold or domain or sub-domain
KTFIDTAHLLIWGHWPSTAEAETLQQRL

SEQ ID NO: 10261 - protein, 26 aa, artificial
  peptide fold or domain or sub-domain
KTFKETLLEDPEVTKYLTEEEIEKAL

SEQ ID NO: 10262 - protein, 20 aa, artificial
  peptide fold or domain or sub-domain
KTFPTPDGQGHTSYAQLLEQ

SEQ ID NO: 10263 - protein, 26 aa, artificial
  peptide fold or domain or sub-domain
KTFRENLEADPEVSGRVSKDILDQAF

SEQ ID NO: 10264 - protein, 25 aa, artificial
  peptide fold or domain or sub-domain
KTFTEVMLMQILGRTPRPVDMRIAD

SEQ ID NO: 10265 - protein, 24 aa, artificial
  peptide fold or domain or sub-domain
KTFYLRNNQLVAGYLQGPNVNLEE

SEQ ID NO: 10266 - protein, 22 aa, artificial
  peptide fold or domain or sub-domain
KTGDELKVTEISDNVYDSLKEN

SEQ ID NO: 10267 - protein, 28 aa, artificial
  peptide fold or domain or sub-domain
KTIARISEIEYKDVFERLGVDVVVSPEL

SEQ ID NO: 10268 - protein, 27 aa, artificial
  peptide fold or domain or sub-domain
KTICELGYGAGMHAPGRRGVEEQLKVG

SEQ ID NO: 10269 - protein, 25 aa, artificial
  peptide fold or domain or sub-domain
KTIEEIMAADQEDESLRRYKEALLG

SEQ ID NO: 10270 - protein, 26 aa, artificial
  peptide fold or domain or sub-domain
KTIESSKIILAQEKDEELISLAKKEI

SEQ ID NO: 10271 - protein, 29 aa, artificial
  peptide fold or domain or sub-domain
KTIFDIQREQGRVSTTVLAERLRNSPASV

SEQ ID NO: 10272 - protein, 29 aa, artificial
  peptide fold or domain or sub-domain
KTIFLEENVSPKVSETLAKEVGAKVKIID

SEQ ID NO: 10273 - protein, 23 aa, artificial
  peptide fold or domain or sub-domain
KTIGKRLEQIGVPNEETYRRQWR

SEQ ID NO: 10274 - protein, 25 aa, artificial
  peptide fold or domain or sub-domain
KTIHEIKNDQNCINSFYNNFIELYY

SEQ ID NO: 10275 - protein, 27 aa, artificial
  peptide fold or domain or sub-domain
KTIPQPGEEYFQPDGPIMSCGDFDNWG

SEQ ID NO: 10276 - protein, 29 aa, artificial
  peptide fold or domain or sub-domain
KTIVLTRDNELQLDDAEILHSRDEVLALA

SEQ ID NO: 10277 - protein, 28 aa, artificial
  peptide fold or domain or sub-domain
KTKDKVLAEMLKNNIDAEKAKNLTPHRH

SEQ ID NO: 10278 - protein, 28 aa, artificial
  peptide fold or domain or sub-domain
KTKEEVEAEFVKAGKSLDEVKEVVPFKV

SEQ ID NO: 10279 - protein, 29 aa, artificial
  peptide fold or domain or sub-domain
KTKEGATDEDVEGFVNDKMPESRTQKCLA

SEQ ID NO: 10280 - protein, 22 aa, artificial
  peptide fold or domain or sub-domain
KTLFAYMSNTQNSIDASLRVSS

SEQ ID NO: 10281 - protein, 28 aa, artificial
  peptide fold or domain or sub-domain
KTLFQLLKAEAEATYEALAEAGQRVYAL

SEQ ID NO: 10282 - protein, 21 aa, artificial
  peptide fold or domain or sub-domain
KTLHVIGDMYGLSKERIRQVQ

SEQ ID NO: 10283 - protein, 26 aa, artificial
  peptide fold or domain or sub-domain
KTLLEVCLEDSLILSYFSKQELENVL

SEQ ID NO: 10284 - protein, 26 aa, artificial
  peptide fold or domain or sub-domain
KTMPIIVISAKPGQDIKIKVLKLGAD

SEQ ID NO: 10285 - protein, 26 aa, artificial
  peptide fold or domain or sub-domain
KTNLILKDTIMKGGSKLIIQEYEKAL

SEQ ID NO: 10286 - protein, 26 aa, artificial
  peptide fold or domain or sub-domain
KTNNLIKRHDKRATAPHIIQEMCQLL

SEQ ID NO: 10287 - protein, 22 aa, artificial
  peptide fold or domain or sub-domain
KTPVGLARDWKVSVKEAKDTLK

SEQ ID NO: 10288 - protein, 23 aa, artificial
  peptide fold or domain or sub-domain
KTQEDYELMWKTLASGRNWHGEF

SEQ ID NO: 10289 - protein, 21 aa, artificial
  peptide fold or domain or sub-domain
KTQIEVAKMLGISQVQVSRIE

SEQ ID NO: 10290 - protein, 22 aa, artificial
  peptide fold or domain or sub-domain
KTQVPPDFAKQPADGPDRKAYV

SEQ ID NO: 10291 - protein, 29 aa, artificial
  peptide fold or domain or sub-domain
KTRLECQRYYLNMDQPAPVDYIAKYVARI

SEQ ID NO: 10292 - protein, 24 aa, artificial
  peptide fold or domain or sub-domain
KTRLEDIGDDGKRQNMNEATEHLE

SEQ ID NO: 10293 - protein, 24 aa, artificial
  peptide fold or domain or sub-domain
KTRLEGLEADNKNPETANAIEYLE

SEQ ID NO: 10294 - protein, 30 aa, artificial
  peptide fold or domain or sub-domain
KTSAALAQTLGVTRGSVNKYLRELRESGHI

SEQ ID NO: 10295 - protein, 27 aa, artificial
  peptide fold or domain or sub-domain
KTTITQIIKHAETGYGTAYVYFKNKDD

SEQ ID NO: 10296 - protein, 27 aa, artificial
  peptide fold or domain or sub-domain
KTTRDFYVDGPVLSAADWDNFKDWEGT

SEQ ID NO: 10297 - protein, 25 aa, artificial
  peptide fold or domain or sub-domain
KTTTLLEDRILTTRNGHTTSTTQSS

SEQ ID NO: 10298 - protein, 28 aa, artificial
  peptide fold or domain or sub-domain
KTVAILRSPDAEKKMRRVGVDILLSPYR

SEQ ID NO: 10299 - protein, 26 aa, artificial
  peptide fold or domain or sub-domain
KTVDEEGKLLVEPFKGLYFREANRAI

SEQ ID NO: 10300 - protein, 25 aa, artificial
  peptide fold or domain or sub-domain
KTVEEYKNLDADDEALRKWKDSLGL

SEQ ID NO: 10301 - protein, 28 aa, artificial
  peptide fold or domain or sub-domain
KTVHYNPTSTKHFSFSVGAVPRALQPQL

SEQ ID NO: 10302 - protein, 28 aa, artificial
  peptide fold or domain or sub-domain
KTVHYYAELGQCSVFPATDAPEQFISQV

SEQ ID NO: 10303 - protein, 29 aa, artificial
  peptide fold or domain or sub-domain
KTVKILGTNHVEGIQFEDGEVVDCDLIVM

SEQ ID NO: 10304 - protein, 30 aa, artificial
  peptide fold or domain or sub-domain
KTVKMWDLSGNFFLSEDDIGKNRAAACVAK

SEQ ID NO: 10305 - protein, 28 aa, artificial
  peptide fold or domain or sub-domain
KTVLAVSDSKNLNKIKMVHPDIILSPQL

SEQ ID NO: 10306 - protein, 22 aa, artificial
  peptide fold or domain or sub-domain
KTVNELRGSDIAPHALPVLERS

SEQ ID NO: 10307 - protein, 24 aa, artificial
  peptide fold or domain or sub-domain
KTVQEHYQDFDKNSVRDITGALFK

SEQ ID NO: 10308 - protein, 30 aa, artificial
  peptide fold or domain or sub-domain
KTVVIEPGDLVENSPVTAAAVGAPMTLGQI

SEQ ID NO: 10309 - protein, 27 aa, artificial
  peptide fold or domain or sub-domain
KTVVQNGYLSGHHAPGHQDPQAAYLVA

SEQ ID NO: 10310 - protein, 27 aa, artificial
  peptide fold or domain or sub-domain
KTWADIEKRKQEIATFNQENRWKKKGL

SEQ ID NO: 10311 - protein, 27 aa, artificial
  peptide fold or domain or sub-domain
KTYAFKGDYVWTVSDSGPGPLFRVSAL

SEQ ID NO: 10312 - protein, 28 aa, artificial
  peptide fold or domain or sub-domain
KTYATAKTNELLKKDGKATSTEIIKTGK

SEQ ID NO: 10313 - protein, 30 aa, artificial
  peptide fold or domain or sub-domain
KTYQITADSILDYAPVFKDKVGTEVSLKEA

SEQ ID NO: 10314 - protein, 28 aa, artificial
  peptide fold or domain or sub-domain
KTYSTKMTDSILAKENKPRAKYTFDNNK

SEQ ID NO: 10315 - protein, 24 aa, artificial
  peptide fold or domain or sub-domain
KVAELHDAWFEGDIKRAQDLHFEL

SEQ ID NO: 10316 - protein, 26 aa, artificial
  peptide fold or domain or sub-domain
KVAELHDAWFEGDIKRAQDLHFELME

SEQ ID NO: 10317 - protein, 23 aa, artificial
  peptide fold or domain or sub-domain
KVAHTSYKRIYGEYPPTKLLVSE

SEQ ID NO: 10318 - protein, 30 aa, artificial
  peptide fold or domain or sub-domain
KVALNTITPQNQEFIRKAVARFGSERIIVA

SEQ ID NO: 10319 - protein, 26 aa, artificial
  peptide fold or domain or sub-domain
KVAMKALGFDLPKNEILGLLNTHGTQ

SEQ ID NO: 10320 - protein, 22 aa, artificial
  peptide fold or domain or sub-domain
KVAQALQQLYSTESYHDYFLLH

SEQ ID NO: 10321 - protein, 30 aa, artificial
  peptide fold or domain or sub-domain
KVAVFNRTYARTEKLMNEHGGEGEFYPAKT

SEQ ID NO: 10322 - protein, 22 aa, artificial
  peptide fold or domain or sub-domain
KVDDLTETLQQSGDYSRAYFIH

SEQ ID NO: 10323 - protein, 21 aa, artificial
  peptide fold or domain or sub-domain
KVDGLPDAEPQPGQPYVSGSN

SEQ ID NO: 10324 - protein, 30 aa, artificial
  peptide fold or domain or sub-domain
KVDVIYAKQLFKNKPNDGVAYMIKTDLCSN

SEQ ID NO: 10325 - protein, 26 aa, artificial
  peptide fold or domain or sub-domain
KVELVSAKNKKGLELFEKGEIDYLVG

SEQ ID NO: 10326 - protein, 25 aa, artificial
  peptide fold or domain or sub-domain
KVETNKELITFSKFLATIKIDVPIQ

SEQ ID NO: 10327 - protein, 28 aa, artificial
  peptide fold or domain or sub-domain
KVEVIPFERYVEFGSLKKAREAGAVETH

SEQ ID NO: 10328 - protein, 28 aa, artificial
  peptide fold or domain or sub-domain
KVEVISWNQLYELKSLQEAKKQGLVRLR

SEQ ID NO: 10329 - protein, 30 aa, artificial
  peptide fold or domain or sub-domain
KVFLNTYAIENPWIIKEISRETGSANLVIA

SEQ ID NO: 10330 - protein, 30 aa, artificial
  peptide fold or domain or sub-domain
KVFMVDRFGLLTDKMPNLLPFQTKLVQKRE

SEQ ID NO: 10331 - protein, 24 aa, artificial
  peptide fold or domain or sub-domain
KVGPHAVAMRERIADLLAIELDAV

SEQ ID NO: 10332 - protein, 27 aa, artificial
  peptide fold or domain or sub-domain
KVHCFINHPDVYEVAKKEGITRAVASM

SEQ ID NO: 10333 - protein, 25 aa, artificial
  peptide fold or domain or sub-domain
KVHLANVYGFDKASLQERQDFADEN

SEQ ID NO: 10334 - protein, 28 aa, artificial
  peptide fold or domain or sub-domain
KVHRLGLDEDIVTRLTRHKILTCQDLLT

SEQ ID NO: 10335 - protein, 25 aa, artificial
  peptide fold or domain or sub-domain
KVHSSNMYGNDKISFEDRVKWVDEH

SEQ ID NO: 10336 - protein, 24 aa, artificial
  peptide fold or domain or sub-domain
KVHTRSRKAEKDKRLKGAISCSSP

SEQ ID NO: 10337 - protein, 26 aa, artificial
  peptide fold or domain or sub-domain
KVIASHIGTNPETGRRMISGEMDVVL

SEQ ID NO: 10338 - protein, 29 aa, artificial
  peptide fold or domain or sub-domain
KVIDDNQAPDGLVPIFIQPSTGHFHTQNI

SEQ ID NO: 10339 - protein, 29 aa, artificial
  peptide fold or domain or sub-domain
KVIFIQPQTSTQSAQAVAEEIGGEVVAVD

SEQ ID NO: 10340 - protein, 30 aa, artificial
  peptide fold or domain or sub-domain
KVIGFDVDHEKTDMLKNGFSYISHIKSSEV

SEQ ID NO: 10341 - protein, 30 aa, artificial
  peptide fold or domain or sub-domain
KVIGRVSNPELVAQVVSFYIEYSPEYLCDF

SEQ ID NO: 10342 - protein, 30 aa, artificial
  peptide fold or domain or sub-domain
KVIGVGGGGGNAVNHMAKNNVEGVEFICAN

SEQ ID NO: 10343 - protein, 24 aa, artificial
  peptide fold or domain or sub-domain
KVIGVVRRLPRARERFAELLGDPA

SEQ ID NO: 10344 - protein, 28 aa, artificial
  peptide fold or domain or sub-domain
KVIIVALSDNRGWDEVLHLRDGIGEEQL

SEQ ID NO: 10345 - protein, 25 aa, artificial
  peptide fold or domain or sub-domain
KVITYKEFNHPNIEVVKNEKELIKK

SEQ ID NO: 10346 - protein, 29 aa, artificial
  peptide fold or domain or sub-domain
KVIVVIAENDCWFAQLPLAENSKIKVVIG

SEQ ID NO: 10347 - protein, 29 aa, artificial
  peptide fold or domain or sub-domain
KVIYFEEIASSKVADTLASEIGAKTEVLN

SEQ ID NO: 10348 - protein, 22 aa, artificial
  peptide fold or domain or sub-domain
KVKDGAVDDSYGIQVAKLADLP

SEQ ID NO: 10349 - protein, 25 aa, artificial
  peptide fold or domain or sub-domain
KVKFRFDDELQADAALVKSVGEIKA

SEQ ID NO: 10350 - protein, 30 aa, artificial
  peptide fold or domain or sub-domain
KVKQKEDFHFIGVGPAGREVPIDAADYVGG

SEQ ID NO: 10351 - protein, 22 aa, artificial
  peptide fold or domain or sub-domain
KVKSELDKKKTNDNIIGTIHWI

SEQ ID NO: 10352 - protein, 23 aa, artificial
  peptide fold or domain or sub-domain
KVKSKYAYGSQGKAEYNIPGNAD

SEQ ID NO: 10353 - protein, 28 aa, artificial
  peptide fold or domain or sub-domain
KVKTEISQAIEPNRKFEDSDIENLPYMQ

SEQ ID NO: 10354 - protein, 26 aa, artificial
  peptide fold or domain or sub-domain
KVKTHLQNLIALEPEIAEGLLSSIDI

SEQ ID NO: 10355 - protein, 26 aa, artificial
  peptide fold or domain or sub-domain
KVLADDKQALAIEKDPEMVVMLEEGI

SEQ ID NO: 10356 - protein, 26 aa, artificial
  peptide fold or domain or sub-domain
KVLFEGLESYYKGGSTVLLDAYSDRA

SEQ ID NO: 10357 - protein, 20 aa, artificial
  peptide fold or domain or sub-domain
KVLLRGELIVDGDRWLGRAG

SEQ ID NO: 10358 - protein, 24 aa, artificial
  peptide fold or domain or sub-domain
KVLTELLDQCRTAGNLPKSTKPEA

SEQ ID NO: 10359 - protein, 23 aa, artificial
  peptide fold or domain or sub-domain
KVLTNPTMIQIADKYQKTPAQVC

SEQ ID NO: 10360 - protein, 30 aa, artificial
  peptide fold or domain or sub-domain
KVLVNSAFYNRPEILTDISSKFGRQAVVFS

SEQ ID NO: 10361 - protein, 21 aa, artificial
  peptide fold or domain or sub-domain
KVLYEKCIELNPNHINAHFAR

SEQ ID NO: 10362 - protein, 27 aa, artificial
  peptide fold or domain or sub-domain
KVLYVAPTGKDTNAGSIKQPLKTLKRA

SEQ ID NO: 10363 - protein, 30 aa, artificial
  peptide fold or domain or sub-domain
KVMLNTAFFSGSGLLQEAVKIYGSQSLGVS

SEQ ID NO: 10364 - protein, 22 aa, artificial
  peptide fold or domain or sub-domain
KVNDTDVTNMTHTDAVNLLRAA

SEQ ID NO: 10365 - protein, 20 aa, artificial
  peptide fold or domain or sub-domain
KVNEADVSKATHQDAVLELL

SEQ ID NO: 10366 - protein, 23 aa, artificial
  peptide fold or domain or sub-domain
KVNEKDSVVNGHETVRIANAKDK

SEQ ID NO: 10367 - protein, 22 aa, artificial
  peptide fold or domain or sub-domain
KVNGASLKGLSQQEVISALRGT

SEQ ID NO: 10368 - protein, 20 aa, artificial
  peptide fold or domain or sub-domain
KVNGIVVVEADHYQAVQVLK

SEQ ID NO: 10369 - protein, 23 aa, artificial
  peptide fold or domain or sub-domain
KVNSETNLDKEKIKSLEKELANQ

SEQ ID NO: 10370 - protein, 30 aa, artificial
  peptide fold or domain or sub-domain
KVNVMGPVVSISGRPNNMPDQFMGCEVTKR

SEQ ID NO: 10371 - protein, 23 aa, artificial
  peptide fold or domain or sub-domain
KVPDGFEITATSGSCPISAMADP

SEQ ID NO: 10372 - protein, 23 aa, artificial
  peptide fold or domain or sub-domain
KVPEGFKVVGHTNVCPVAAMANT

SEQ ID NO: 10373 - protein, 28 aa, artificial
  peptide fold or domain or sub-domain
KVQAEIREHVGDKGIVTYDDLEALVYMK

SEQ ID NO: 10374 - protein, 28 aa, artificial
  peptide fold or domain or sub-domain
KVQEEIRGLSGKKDFLDEDDIQKFSYLR

SEQ ID NO: 10375 - protein, 28 aa, artificial
  peptide fold or domain or sub-domain
KVQEELDTVIAPGELPSWRDRNRMPYTE

SEQ ID NO: 10376 - protein, 23 aa, artificial
  peptide fold or domain or sub-domain
KVRDDKTIKAIAKKYGCAPSQII

SEQ ID NO: 10377 - protein, 27 aa, artificial
  peptide fold or domain or sub-domain
KVRLEHADLINDLWSARHPGSLKLIQM

SEQ ID NO: 10378 - protein, 25 aa, artificial
  peptide fold or domain or sub-domain
KVRRGKVIAEIAAVSRLGQGKMPQS

SEQ ID NO: 10379 - protein, 28 aa, artificial
  peptide fold or domain or sub-domain
KVSDDKLPNKATLIEAVKEYPYFIHDSY

SEQ ID NO: 10380 - protein, 28 aa, artificial
  peptide fold or domain or sub-domain
KVSEHAWRTGGAPSGRGATMFAAIKSDI

SEQ ID NO: 10381 - protein, 20 aa, artificial
  peptide fold or domain or sub-domain
KVSEIFEQKRENFFREQEQK

SEQ ID NO: 10382 - protein, 26 aa, artificial
  peptide fold or domain or sub-domain
KVSFLNAGALKQGGSISAQQTGLLVM

SEQ ID NO: 10383 - protein, 30 aa, artificial
  peptide fold or domain or sub-domain
KVSINTAAVENPSLITQIAQTFGSQAVVVA

SEQ ID NO: 10384 - protein, 25 aa, artificial
  peptide fold or domain or sub-domain
KVSLVIFSSTGKMTEFSSSPLEIIL

SEQ ID NO: 10385 - protein, 20 aa, artificial
  peptide fold or domain or sub-domain
KVSNRARITERMEANEDDIY

SEQ ID NO: 10386 - protein, 28 aa, artificial
  peptide fold or domain or sub-domain
KVSVNLLANGEKVKTLDVTSETNWKYEF

SEQ ID NO: 10387 - protein, 30 aa, artificial
  peptide fold or domain or sub-domain
KVSVWTRSQKEIEIFNEKLKEQPKFNGLDA

SEQ ID NO: 10388 - protein, 30 aa, artificial
  peptide fold or domain or sub-domain
KVSVYNRTAQRTEEFVKNRVTNEEIEPHYD

SEQ ID NO: 10389 - protein, 22 aa, artificial
  peptide fold or domain or sub-domain
KVSWWRASGLSSNHQVLGNQLR

SEQ ID NO: 10390 - protein, 20 aa, artificial
  peptide fold or domain or sub-domain
KVTAVLLEQRRSLEGEVIEK

SEQ ID NO: 10391 - protein, 27 aa, artificial
  peptide fold or domain or sub-domain
KVTCMIDNERTKELSKELGITRAAAAM

SEQ ID NO: 10392 - protein, 30 aa, artificial
  peptide fold or domain or sub-domain
KVTLPIGSSGKPSEIEQPALDTFATAPWFQ

SEQ ID NO: 10393 - protein, 30 aa, artificial
  peptide fold or domain or sub-domain
KVTLSEKKYFAEAKMRNHFAVIDEPIKAGG

SEQ ID NO: 10394 - protein, 30 aa, artificial
  peptide fold or domain or sub-domain
KVTWLGEQRYVGVSESGHQILIDNSSVKIG

SEQ ID NO: 10395 - protein, 27 aa, artificial
  peptide fold or domain or sub-domain
KVVCRLNLPKVREIARRDETTRSAAQI

SEQ ID NO: 10396 - protein, 25 aa, artificial
  peptide fold or domain or sub-domain
KVVPEQDWMKQTDAEFCEKERENLF

SEQ ID NO: 10397 - protein, 29 aa, artificial
  peptide fold or domain or sub-domain
KVVVAVSGDDPWWPTLSVSRHPRIQTVNG

SEQ ID NO: 10398 - protein, 24 aa, artificial
  peptide fold or domain or sub-domain
KVVYQFYDNEEQLEDQNALYEGRV

SEQ ID NO: 10399 - protein, 28 aa, artificial
  peptide fold or domain or sub-domain
KVYELDYLKVDLSAHTTEVAGKTVNLTQ

SEQ ID NO: 10400 - protein, 28 aa, artificial
  peptide fold or domain or sub-domain
KVYIGEEDKDFLYNSELSLSDAIFGEFF

SEQ ID NO: 10401 - protein, 21 aa, artificial
  peptide fold or domain or sub-domain
KWFPWMQNHQGWWANYWQSLK

SEQ ID NO: 10402 - protein, 27 aa, artificial
  peptide fold or domain or sub-domain
KWFVANGYKIGNYPPGYQDTQKTMIAA

SEQ ID NO: 10403 - protein, 27 aa, artificial
  peptide fold or domain or sub-domain
KWIGWINTHSGVPKYAEEFKGRFAFSL

SEQ ID NO: 10404 - protein, 24 aa, artificial
  peptide fold or domain or sub-domain
KWNDNCPSWNTVDPEVRANLTERQ

SEQ ID NO: 10405 - protein, 24 aa, artificial
  peptide fold or domain or sub-domain
KWRWRKRMEAAGKPTDKPNLVCGP

SEQ ID NO: 10406 - protein, 23 aa, artificial
  peptide fold or domain or sub-domain
KWSGQRLDLEQNPTVSESAADNM

SEQ ID NO: 10407 - protein, 23 aa, artificial
  peptide fold or domain or sub-domain
KWSSVLADTTQTKAKRLQALSFV

SEQ ID NO: 10408 - protein, 29 aa, artificial
  peptide fold or domain or sub-domain
KYAELGESARVAVRSSATAEDLPDASFAG

SEQ ID NO: 10409 - protein, 24 aa, artificial
  peptide fold or domain or sub-domain
KYCAKRIGGRRAYDMARNKEEVEL

SEQ ID NO: 10410 - protein, 26 aa, artificial
  peptide fold or domain or sub-domain
KYDSGIPPYSRASLKGYQWLKDKILS

SEQ ID NO: 10411 - protein, 21 aa, artificial
  peptide fold or domain or sub-domain
KYELKKASGPDHDRTFWFSVS

SEQ ID NO: 10412 - protein, 24 aa, artificial
  peptide fold or domain or sub-domain
KYGDFISNLNAECNDLYQQISDMI

SEQ ID NO: 10413 - protein, 27 aa, artificial
  peptide fold or domain or sub-domain
KYGDRVCRIVSNHVPRDYTEEVVHEAF

SEQ ID NO: 10414 - protein, 27 aa, artificial
  peptide fold or domain or sub-domain
KYGIGHNGHNGVKSIINTFEKKKPFIQ

SEQ ID NO: 10415 - protein, 29 aa, artificial
  peptide fold or domain or sub-domain
KYHLFKGEYSVAFTATDTSIALNRVTQSW

SEQ ID NO: 10416 - protein, 22 aa, artificial
  peptide fold or domain or sub-domain
KYIERLDGSKVNLAFVKNRSDI

SEQ ID NO: 10417 - protein, 29 aa, artificial
  peptide fold or domain or sub-domain
KYIFFEALANVKTAEVLANEAGLQVLTLY

SEQ ID NO: 10418 - protein, 22 aa, artificial
  peptide fold or domain or sub-domain
KYIIRDNGSKYDLRHVRKNSEK

SEQ ID NO: 10419 - protein, 22 aa, artificial
  peptide fold or domain or sub-domain
KYIIRHDDRQIDLSQMRNRSEA

SEQ ID NO: 10420 - protein, 22 aa, artificial
  peptide fold or domain or sub-domain
KYIIWGDAQRLDLCYVKKRTDQ

SEQ ID NO: 10421 - protein, 29 aa, artificial
  peptide fold or domain or sub-domain
KYILFETFSTPKVASVIQKETGTKVLRLN

SEQ ID NO: 10422 - protein, 30 aa, artificial
  peptide fold or domain or sub-domain
KYIVRDDTTRDTFWWADKGKGKNDNKPLSP

SEQ ID NO: 10423 - protein, 27 aa, artificial
  peptide fold or domain or sub-domain
KYKDMILAPCATVAGDDMLSNFLGREA

SEQ ID NO: 10424 - protein, 23 aa, artificial
  peptide fold or domain or sub-domain
KYKDVPELTDEIANELDSEANTV

SEQ ID NO: 10425 - protein, 25 aa, artificial
  peptide fold or domain or sub-domain
KYLANPEKYKKLILARDIKGIENEI

SEQ ID NO: 10426 - protein, 27 aa, artificial
  peptide fold or domain or sub-domain
KYLASSRSAGEILEFKGKAVLVEELTH

SEQ ID NO: 10427 - protein, 27 aa, artificial
  peptide fold or domain or sub-domain
KYLCGNTSVGKNISSYEKSLSSKKLPK

SEQ ID NO: 10428 - protein, 25 aa, artificial
  peptide fold or domain or sub-domain
KYLIATEFLYSSYSSEKNLPEVMHS

SEQ ID NO: 10429 - protein, 24 aa, artificial
  peptide fold or domain or sub-domain
KYLINNERIHPVTNSVLMAYDMYE

SEQ ID NO: 10430 - protein, 29 aa, artificial
  peptide fold or domain or sub-domain
KYLKFRQEKKVPKSFWEKFIIKAYNSEPI

SEQ ID NO: 10431 - protein, 30 aa, artificial
  peptide fold or domain or sub-domain
KYMPGDNVVSGIKGFEAEFRNSETSFHLRK

SEQ ID NO: 10432 - protein, 21 aa, artificial
  peptide fold or domain or sub-domain
KYNIINEYGPDHNKKFEVGVK

SEQ ID NO: 10433 - protein, 21 aa, artificial
  peptide fold or domain or sub-domain
KYNNNDGFINDVDSQLNSISQ

SEQ ID NO: 10434 - protein, 21 aa, artificial
  peptide fold or domain or sub-domain
KYNNNNGDEIIPTNTLEEIML

SEQ ID NO: 10435 - protein, 22 aa, artificial
  peptide fold or domain or sub-domain
KYNSKLNIIFKSLLINKNLFII

SEQ ID NO: 10436 - protein, 21 aa, artificial
  peptide fold or domain or sub-domain
KYNTNAGWVNDFQDPSNEAAQ

SEQ ID NO: 10437 - protein, 24 aa, artificial
  peptide fold or domain or sub-domain
KYPVLTDLWEKERADQIQHIELAD

SEQ ID NO: 10438 - protein, 20 aa, artificial
  peptide fold or domain or sub-domain
KYQAALEKAQKESTATHKKG

SEQ ID NO: 10439 - protein, 24 aa, artificial
  peptide fold or domain or sub-domain
KYQNKVSKYKEIFAYISNNTGLNV

SEQ ID NO: 10440 - protein, 27 aa, artificial
  peptide fold or domain or sub-domain
KYRRTVLEPGGAQPAAELVKNFLGRPY

SEQ ID NO: 10441 - protein, 23 aa, artificial
  peptide fold or domain or sub-domain
KYSPSNVKISDNPNTYDYMNKRV

SEQ ID NO: 10442 - protein, 27 aa, artificial
  peptide fold or domain or sub-domain
KYSYGHSGHNGLRHIIKEFNTKVNFYR

SEQ ID NO: 10443 - protein, 26 aa, artificial
  peptide fold or domain or sub-domain
KYTCEICGFTTNNKISLRMHHRRVHE

SEQ ID NO: 10444 - protein, 21 aa, artificial
  peptide fold or domain or sub-domain
KYTDFPDYETDHSRSYIVGRY

SEQ ID NO: 10445 - protein, 30 aa, artificial
  peptide fold or domain or sub-domain
KYTISLLKAGITSNNSDPSLRTITLTSSQP

SEQ ID NO: 10446 - protein, 29 aa, artificial
  peptide fold or domain or sub-domain
KYTLLYRDINIPLLPMEQLIVPADTTMTL

SEQ ID NO: 10447 - protein, 29 aa, artificial
  peptide fold or domain or sub-domain
KYVEVTDPGDSRLLEGQVLEKWDVEALNE

SEQ ID NO: 10448 - protein, 22 aa, artificial
  peptide fold or domain or sub-domain
KYVIRDSGDRIDLRYSKRAGDI

SEQ ID NO: 10449 - protein, 27 aa, artificial
  peptide fold or domain or sub-domain
LAAALKYLGYSAHDTDEAHWQQAKTLI

SEQ ID NO: 10450 - protein, 28 aa, artificial
  peptide fold or domain or sub-domain
LAACAEMLWRDKPMEWRVKRLTELGFQV

SEQ ID NO: 10451 - protein, 25 aa, artificial
  peptide fold or domain or sub-domain
LAADRDPESVETHRHHYPGLTLDYD

SEQ ID NO: 10452 - protein, 26 aa, artificial
  peptide fold or domain or sub-domain
LAAEARRLGKDPVQHVVDLLKSGQLK

SEQ ID NO: 10453 - protein, 28 aa, artificial
  peptide fold or domain or sub-domain
LAAELRQELKESSGQRKIRALRRLEVVE

SEQ ID NO: 10454 - protein, 22 aa, artificial
  peptide fold or domain or sub-domain
LAAFAIEAVNRGKIKADLQYGN

SEQ ID NO: 10455 - protein, 30 aa, artificial
  peptide fold or domain or sub-domain
LAAFAIEAVNRGKIKADLQYGNADGIARLL

SEQ ID NO: 10456 - protein, 28 aa, artificial
  peptide fold or domain or sub-domain
LAAFDDNPKPFGEVFHGVPVFPTTRLGE

SEQ ID NO: 10457 - protein, 27 aa, artificial
  peptide fold or domain or sub-domain
LAAGLDLRPVRGKNGLEITPTTTIAEL

SEQ ID NO: 10458 - protein, 27 aa, artificial
  peptide fold or domain or sub-domain
LAAGQLDKGFSVNETDPAKMAEVKDLL

SEQ ID NO: 10459 - protein, 24 aa, artificial
  peptide fold or domain or sub-domain
LAAGYDEIHELLKNNNLKALLEKD

SEQ ID NO: 10460 - protein, 23 aa, artificial
  peptide fold or domain or sub-domain
LAAIPFNTLADHYGERLAREQLA

SEQ ID NO: 10461 - protein, 26 aa, artificial
  peptide fold or domain or sub-domain
LAAIVDVVRYSQGNNSCQTATPAFFG

SEQ ID NO: 10462 - protein, 20 aa, artificial
  peptide fold or domain or sub-domain
LAAIVRDLKITKTQAKKRIK

SEQ ID NO: 10463 - protein, 22 aa, artificial
  peptide fold or domain or sub-domain
LAAKSIMTYHLEHDIARHLKMA

SEQ ID NO: 10464 - protein, 26 aa, artificial
  peptide fold or domain or sub-domain
LAALLKAGILVGDLQDLIANKIGSVF

SEQ ID NO: 10465 - protein, 28 aa, artificial
  peptide fold or domain or sub-domain
LAALPDGKRFEGRFKAAYGVDPDQKAPS

SEQ ID NO: 10466 - protein, 29 aa, artificial
  peptide fold or domain or sub-domain
LAALVSGTPEKLKTYGEQYGIPETHRYSY

SEQ ID NO: 10467 - protein, 23 aa, artificial
  peptide fold or domain or sub-domain
LAANLPEVNDEFAALFGITEGGL

SEQ ID NO: 10468 - protein, 28 aa, artificial
  peptide fold or domain or sub-domain
LAANLTLLYPGLPLAARMAAAREDGFAG

SEQ ID NO: 10469 - protein, 23 aa, artificial
  peptide fold or domain or sub-domain
LAAQHAAIEGDGAITTDAAQEAI

SEQ ID NO: 10470 - protein, 28 aa, artificial
  peptide fold or domain or sub-domain
LAAQLRAKMIEKGAKSDQRLLRRIEIVE

SEQ ID NO: 10471 - protein, 23 aa, artificial
  peptide fold or domain or sub-domain
LAAQLSQSADGSHRVTQQHVAQA

SEQ ID NO: 10472 - protein, 25 aa, artificial
  peptide fold or domain or sub-domain
LAARAWACAQSHNRCIILDMDIAEA

SEQ ID NO: 10473 - protein, 20 aa, artificial
  peptide fold or domain or sub-domain
LAARDPAEATAYLAGLDGIG

SEQ ID NO: 10474 - protein, 29 aa, artificial
  peptide fold or domain or sub-domain
LAASVPETKQFHARHILVKSEAEAKSVID

SEQ ID NO: 10475 - protein, 29 aa, artificial
  peptide fold or domain or sub-domain
LAATAKESMTKSDSKKGYIENQLKFDRET

SEQ ID NO: 10476 - protein, 28 aa, artificial
  peptide fold or domain or sub-domain
LAAVIGQSLQKRGLTEHDSDDIALEVMQ

SEQ ID NO: 10477 - protein, 29 aa, artificial
  peptide fold or domain or sub-domain
LAAYGLVSFQKGGSSSDPLKTSEGWSQFT

SEQ ID NO: 10478 - protein, 25 aa, artificial
  peptide fold or domain or sub-domain
LACDIRNDSIMTHRHHFGGCSYECD

SEQ ID NO: 10479 - protein, 26 aa, artificial
  peptide fold or domain or sub-domain
LACPFPVDDSINEWPDTPKGLRDVIE

SEQ ID NO: 10480 - protein, 25 aa, artificial
  peptide fold or domain or sub-domain
LADDLVARLVAAGGGDLLTDVAEPL

SEQ ID NO: 10481 - protein, 25 aa, artificial
  peptide fold or domain or sub-domain
LADELLDQVQAHGTMDLVQDYAYPL

SEQ ID NO: 10482 - protein, 22 aa, artificial
  peptide fold or domain or sub-domain
LADEPLKIGTREIPYAVGMKKS

SEQ ID NO: 10483 - protein, 28 aa, artificial
  peptide fold or domain or sub-domain
LADFAARGFIRLEARSVVILDMDRMRNR

SEQ ID NO: 10484 - protein, 22 aa, artificial
  peptide fold or domain or sub-domain
LADGLVDDGKVLCPKHNSKFCI

SEQ ID NO: 10485 - protein, 27 aa, artificial
  peptide fold or domain or sub-domain
LADHIQHGEAMNWEADLLGWMTELETA

SEQ ID NO: 10486 - protein, 28 aa, artificial
  peptide fold or domain or sub-domain
LADHKKIMVQSRLNGRAKHFGLKNVSEY

SEQ ID NO: 10487 - protein, 28 aa, artificial
  peptide fold or domain or sub-domain
LADHKRDMVYNRLVRRLRALGLDDFGRY

SEQ ID NO: 10488 - protein, 24 aa, artificial
  peptide fold or domain or sub-domain
LADLGIDYKPAISRAVALANATNN

SEQ ID NO: 10489 - protein, 25 aa, artificial
  peptide fold or domain or sub-domain
LADRIRKHTSVPVVQETTELDMMVR

SEQ ID NO: 10490 - protein, 24 aa, artificial
  peptide fold or domain or sub-domain
LADSCLSCELCRRGYEMNCPNVKL

SEQ ID NO: 10491 - protein, 22 aa, artificial
  peptide fold or domain or sub-domain
LADVIHPGVPAEQRQGAIDGIL

SEQ ID NO: 10492 - protein, 21 aa, artificial
  peptide fold or domain or sub-domain
LADVSVGTSLRFVSLRYFNAA

SEQ ID NO: 10493 - protein, 21 aa, artificial
  peptide fold or domain or sub-domain
LADYRAAYGFGAFCLRYFNAS

SEQ ID NO: 10494 - protein, 27 aa, artificial
  peptide fold or domain or sub-domain
LAEAASDGLSLGADTDPAEFRAGLLAL

SEQ ID NO: 10495 - protein, 21 aa, artificial
  peptide fold or domain or sub-domain
LAEAVGYTGKAVEVAFRIAPR

SEQ ID NO: 10496 - protein, 21 aa, artificial
  peptide fold or domain or sub-domain
LAEAVRDAYNARRGRPDACVV

SEQ ID NO: 10497 - protein, 27 aa, artificial
  peptide fold or domain or sub-domain
LAEECEILCDVEMVRQGITKRMISRLP

SEQ ID NO: 10498 - protein, 25 aa, artificial
  peptide fold or domain or sub-domain
LAEEEELVRLYLHESTLKPLLEATE

SEQ ID NO: 10499 - protein, 25 aa, artificial
  peptide fold or domain or sub-domain
LAEEHDRTIHYLSPSTLPHLESLLI

SEQ ID NO: 10500 - protein, 25 aa, artificial
  peptide fold or domain or sub-domain
LAEEKGRVDVYLHPSSEQRVIETCH

SEQ ID NO: 10501 - protein, 21 aa, artificial
  peptide fold or domain or sub-domain
LAEFCEKNLAFSAISLRYFNP

SEQ ID NO: 10502 - protein, 22 aa, artificial
  peptide fold or domain or sub-domain
LAEGDLEEVTVICPCHGSEFDV

SEQ ID NO: 10503 - protein, 22 aa, artificial
  peptide fold or domain or sub-domain
LAEGKFDGRVLMCRAHQWTFDA

SEQ ID NO: 10504 - protein, 25 aa, artificial
  peptide fold or domain or sub-domain
LAEKSAVVTAEKKRKTVNLDHLRIA

SEQ ID NO: 10505 - protein, 23 aa, artificial
  peptide fold or domain or sub-domain
LAELAFRFENIEDASVFYRNLYG

SEQ ID NO: 10506 - protein, 24 aa, artificial
  peptide fold or domain or sub-domain
LAELAHREYQAGDFEAAERHCMQL

SEQ ID NO: 10507 - protein, 23 aa, artificial
  peptide fold or domain or sub-domain
LAELLGEAKFYSITYRLFKLPPG

SEQ ID NO: 10508 - protein, 29 aa, artificial
  peptide fold or domain or sub-domain
LAEQMCGTLGKMAEIGINYLSMNRPTDTL

SEQ ID NO: 10509 - protein, 25 aa, artificial
  peptide fold or domain or sub-domain
LAERLKAKLPDATPKELAKLVNKRS

SEQ ID NO: 10510 - protein, 26 aa, artificial
  peptide fold or domain or sub-domain
LAERWQAFQRRELNVEDFRELSRDLE

SEQ ID NO: 10511 - protein, 29 aa, artificial
  peptide fold or domain or sub-domain
LAESAMQERPTAPDQVQQAAWQALGQDFV

SEQ ID NO: 10512 - protein, 26 aa, artificial
  peptide fold or domain or sub-domain
LAEVFSSDAGYVAPYTEFNDAILDYP

SEQ ID NO: 10513 - protein, 23 aa, artificial
  peptide fold or domain or sub-domain
LAFAIFHGRGVPRDDAEGIRRLR

SEQ ID NO: 10514 - protein, 25 aa, artificial
  peptide fold or domain or sub-domain
LAFDINENAVETYNKNIGNHCEKLD

SEQ ID NO: 10515 - protein, 30 aa, artificial
  peptide fold or domain or sub-domain
LAFEGEVFGKPVDAAEAVARWQRMRGKWAE

SEQ ID NO: 10516 - protein, 29 aa, artificial
  peptide fold or domain or sub-domain
LAFEIDKSLIEHLKNEIKDLHFELRDQDF

SEQ ID NO: 10517 - protein, 23 aa, artificial
  peptide fold or domain or sub-domain
LAGAIAICPDEAGRAPLIKNLFE

SEQ ID NO: 10518 - protein, 28 aa, artificial
  peptide fold or domain or sub-domain
LAGASNAVAQRFYRGLSKREIHDLQRRI

SEQ ID NO: 10519 - protein, 23 aa, artificial
  peptide fold or domain or sub-domain
LAGEAADGNEAAAALKASLLFLG

SEQ ID NO: 10520 - protein, 24 aa, artificial
  peptide fold or domain or sub-domain
LAGELLASTLNDEPVDKSMISHLL

SEQ ID NO: 10521 - protein, 25 aa, artificial
  peptide fold or domain or sub-domain
LAGFDKETLSTAFNVSVSELEEFLS

SEQ ID NO: 10522 - protein, 26 aa, artificial
  peptide fold or domain or sub-domain
LAGFDKETLSTAFNVSVSELEEFLSP

SEQ ID NO: 10523 - protein, 26 aa, artificial
  peptide fold or domain or sub-domain
LAGFDPNMLAEALGVRRQVVIDIQEN

SEQ ID NO: 10524 - protein, 26 aa, artificial
  peptide fold or domain or sub-domain
LAGLAQLLSTNKENPYKVKAYRRAAA

SEQ ID NO: 10525 - protein, 20 aa, artificial
  peptide fold or domain or sub-domain
LAGNGLLGKRIGKKGAGADF

SEQ ID NO: 10526 - protein, 26 aa, artificial
  peptide fold or domain or sub-domain
LAGTGRSAVENRRCDPMIQGGRIAEG

SEQ ID NO: 10527 - protein, 23 aa, artificial
  peptide fold or domain or sub-domain
LAGVTSLIDGLPREVLAAAFGVD

SEQ ID NO: 10528 - protein, 24 aa, artificial
  peptide fold or domain or sub-domain
LAGWKRKGWRKADGKLVLNAEWWQ

SEQ ID NO: 10529 - protein, 23 aa, artificial
  peptide fold or domain or sub-domain
LAGWVRTTWHLYLEPLPEDVRPA

SEQ ID NO: 10530 - protein, 24 aa, artificial
  peptide fold or domain or sub-domain
LAHAAIVDKTGRVYPADTPLSAVD

SEQ ID NO: 10531 - protein, 23 aa, artificial
  peptide fold or domain or sub-domain
LAHLRDLLLVKLEAGAQVLGLPA

SEQ ID NO: 10532 - protein, 30 aa, artificial
  peptide fold or domain or sub-domain
LAHRGSNGELPEETAPAYMRAIEEGADFIE

SEQ ID NO: 10533 - protein, 28 aa, artificial
  peptide fold or domain or sub-domain
LAHRLGRLREHYPWIAEEGFEYFTARIE

SEQ ID NO: 10534 - protein, 23 aa, artificial
  peptide fold or domain or sub-domain
LAHTCNSNFSQVSESTQLDQSSQ

SEQ ID NO: 10535 - protein, 23 aa, artificial
  peptide fold or domain or sub-domain
LAHVRSVADEAGLPPTLAETLFE

SEQ ID NO: 10536 - protein, 25 aa, artificial
  peptide fold or domain or sub-domain
LAIDHDQPSIDTHRANFPGDSLCVD

SEQ ID NO: 10537 - protein, 25 aa, artificial
  peptide fold or domain or sub-domain
LAIEDVFNTPYLSRRIANLFPSRSI

SEQ ID NO: 10538 - protein, 28 aa, artificial
  peptide fold or domain or sub-domain
LAIGQLLKQAGLVPSTSEALRNIEQGGV

SEQ ID NO: 10539 - protein, 22 aa, artificial
  peptide fold or domain or sub-domain
LAIGYNRAQVAETLSISEHTLR

SEQ ID NO: 10540 - protein, 24 aa, artificial
  peptide fold or domain or sub-domain
LAIIYEKGRGVAQDYNQAIEWHTK

SEQ ID NO: 10541 - protein, 25 aa, artificial
  peptide fold or domain or sub-domain
LAIKALYQLDLLGDKAETEIDEFCR

SEQ ID NO: 10542 - protein, 22 aa, artificial
  peptide fold or domain or sub-domain
LAILASVVGGDFTPAAKDAWTK

SEQ ID NO: 10543 - protein, 23 aa, artificial
  peptide fold or domain or sub-domain
LAILYYKGLGVDRDYAETVRLLK

SEQ ID NO: 10544 - protein, 24 aa, artificial
  peptide fold or domain or sub-domain
LAILYYKGLGVDRDYAETVRLLKE

SEQ ID NO: 10545 - protein, 30 aa, artificial
  peptide fold or domain or sub-domain
LAISKGNSVRRSRWIQSLLDFYGVNLFKAE

SEQ ID NO: 10546 - protein, 26 aa, artificial
  peptide fold or domain or sub-domain
LAITSSDEKADKLKELGAEAVVNYTT

SEQ ID NO: 10547 - protein, 25 aa, artificial
  peptide fold or domain or sub-domain
LAKAAINDGMNMDTESAYKYEADIF

SEQ ID NO: 10548 - protein, 23 aa, artificial
  peptide fold or domain or sub-domain
LAKAKKRLQENMQGYNLSFMDVK

SEQ ID NO: 10549 - protein, 24 aa, artificial
  peptide fold or domain or sub-domain
LAKAKQLAQEKGVKITTVQSNLAD

SEQ ID NO: 10550 - protein, 22 aa, artificial
  peptide fold or domain or sub-domain
LAKAPPTVVLRNEDYGRIDRLL

SEQ ID NO: 10551 - protein, 25 aa, artificial
  peptide fold or domain or sub-domain
LAKDCINKALETTLAQGMAYEQRTF

SEQ ID NO: 10552 - protein, 25 aa, artificial
  peptide fold or domain or sub-domain
LAKDTSFHTVASKKKTMSKRDVETA

SEQ ID NO: 10553 - protein, 25 aa, artificial
  peptide fold or domain or sub-domain
LAKEAVARAWDTLLQQGLDFERRNF

SEQ ID NO: 10554 - protein, 25 aa, artificial
  peptide fold or domain or sub-domain
LAKECRLHQLRYRKRMTVDTAARII

SEQ ID NO: 10555 - protein, 25 aa, artificial
  peptide fold or domain or sub-domain
LAKECRLYYLRNGERISVSAASKLL

SEQ ID NO: 10556 - protein, 21 aa, artificial
  peptide fold or domain or sub-domain
LAKELGINNPYIYENDEEVVK

SEQ ID NO: 10557 - protein, 21 aa, artificial
  peptide fold or domain or sub-domain
LAKFVNILMVDGKKSTAESIV

SEQ ID NO: 10558 - protein, 20 aa, artificial
  peptide fold or domain or sub-domain
LAKGGAGPLRSLLLSLNMML

SEQ ID NO: 10559 - protein, 28 aa, artificial
  peptide fold or domain or sub-domain
LAKMPGGPAFAARFTQKYGAPVQLYAPY

SEQ ID NO: 10560 - protein, 28 aa, artificial
  peptide fold or domain or sub-domain
LAKMSQQEFITVEGRRITILNREALENL

SEQ ID NO: 10561 - protein, 24 aa, artificial
  peptide fold or domain or sub-domain
LAKPGVLERFLDNKEDIAKLRKCF

SEQ ID NO: 10562 - protein, 25 aa, artificial
  peptide fold or domain or sub-domain
LAKQVRNQTSCQVDEEASELDLLVK

SEQ ID NO: 10563 - protein, 21 aa, artificial
  peptide fold or domain or sub-domain
LALAEPPSSLDALRQATETTL

SEQ ID NO: 10564 - protein, 23 aa, artificial
  peptide fold or domain or sub-domain
LALCYQDGKGVDQDWNKAINLYQ

SEQ ID NO: 10565 - protein, 24 aa, artificial
  peptide fold or domain or sub-domain
LALCYQDGKGVDQDWNKAINLYQQ

SEQ ID NO: 10566 - protein, 28 aa, artificial
  peptide fold or domain or sub-domain
LALDPSMYRDDLTLEEMVYKTAELGYEY

SEQ ID NO: 10567 - protein, 24 aa, artificial
  peptide fold or domain or sub-domain
LALELSLDFLKAVSEFRYEYKEQE

SEQ ID NO: 10568 - protein, 24 aa, artificial
  peptide fold or domain or sub-domain
LALGGTVENTPPCLAQVGAIAPTE

SEQ ID NO: 10569 - protein, 28 aa, artificial
  peptide fold or domain or sub-domain
LALIDLLTETSLVASKGDAKRAFAEGSI

SEQ ID NO: 10570 - protein, 26 aa, artificial
  peptide fold or domain or sub-domain
LALKQIEKCIEGSIIGDQLIKACDAF

SEQ ID NO: 10571 - protein, 25 aa, artificial
  peptide fold or domain or sub-domain
LALLIEENSKVPVYQRKLKDLQNQY

SEQ ID NO: 10572 - protein, 25 aa, artificial
  peptide fold or domain or sub-domain
LALLVSKAVEDEGAYANLALNKLLE

SEQ ID NO: 10573 - protein, 23 aa, artificial
  peptide fold or domain or sub-domain
LALMYERGQGVVKNLEKAIFWYR

SEQ ID NO: 10574 - protein, 24 aa, artificial
  peptide fold or domain or sub-domain
LALMYERGQGVVKNLEKAIFWYRT

SEQ ID NO: 10575 - protein, 25 aa, artificial
  peptide fold or domain or sub-domain
LALNKWGNIAADDDTQSTNMPGVFA

SEQ ID NO: 10576 - protein, 25 aa, artificial
  peptide fold or domain or sub-domain
LALQALFQMDIAGTDPDTAVAQALT

SEQ ID NO: 10577 - protein, 25 aa, artificial
  peptide fold or domain or sub-domain
LALQGIYQWQVTGGNARDIGMQLQQ

SEQ ID NO: 10578 - protein, 27 aa, artificial
  peptide fold or domain or sub-domain
LALRIEDAAISGRLDEAVSLLQPLAAE

SEQ ID NO: 10579 - protein, 26 aa, artificial
  peptide fold or domain or sub-domain
LALRIRDYIKKGVPAYQAFLKVQTHL

SEQ ID NO: 10580 - protein, 25 aa, artificial
  peptide fold or domain or sub-domain
LALRKRFFVDALGWDIPHDATVEMD

SEQ ID NO: 10581 - protein, 25 aa, artificial
  peptide fold or domain or sub-domain
LAMQGLYQRHFSKTPISDIEAEFMV

SEQ ID NO: 10582 - protein, 29 aa, artificial
  peptide fold or domain or sub-domain
LANAIINQGHNIVNVGLGYLCLNRESASL

SEQ ID NO: 10583 - protein, 23 aa, artificial
  peptide fold or domain or sub-domain
LANNADKYEEMGEAEQFMFQMAR

SEQ ID NO: 10584 - protein, 25 aa, artificial
  peptide fold or domain or sub-domain
LANNIELHRLNTKKAPRVQMCISML

SEQ ID NO: 10585 - protein, 27 aa, artificial
  peptide fold or domain or sub-domain
LAPAQPPIQAPAAAPMAAPQVRMANVA

SEQ ID NO: 10586 - protein, 29 aa, artificial
  peptide fold or domain or sub-domain
LAPKDMLSHPHVQSDIYFTDWRLLKQEYV

SEQ ID NO: 10587 - protein, 28 aa, artificial
  peptide fold or domain or sub-domain
LAPVKKALLVGRLARRLRELGMHGYGEY

SEQ ID NO: 10588 - protein, 24 aa, artificial
  peptide fold or domain or sub-domain
LAQESSATAAFTSGQVDINDLIPA

SEQ ID NO: 10589 - protein, 23 aa, artificial
  peptide fold or domain or sub-domain
LAQLYDSGIGTQQDPKKAREVMT

SEQ ID NO: 10590 - protein, 24 aa, artificial
  peptide fold or domain or sub-domain
LAQLYDSGIGTQQDPKKAREVMTQ

SEQ ID NO: 10591 - protein, 28 aa, artificial
  peptide fold or domain or sub-domain
LAQVMKCEDVFEYKDDSAIKAAGKLMQK

SEQ ID NO: 10592 - protein, 25 aa, artificial
  peptide fold or domain or sub-domain
LAQYLDPQAKLFCSFLDEGIVAKFK

SEQ ID NO: 10593 - protein, 23 aa, artificial
  peptide fold or domain or sub-domain
LARAIGHVRDENARLLLVGNLYE

SEQ ID NO: 10594 - protein, 22 aa, artificial
  peptide fold or domain or sub-domain
LARDVIGKSDKVDDMAKILKED

SEQ ID NO: 10595 - protein, 30 aa, artificial
  peptide fold or domain or sub-domain
LARESAKEEHLRSIAQGLDLDYTDLLLRMR

SEQ ID NO: 10596 - protein, 23 aa, artificial
  peptide fold or domain or sub-domain
LARNLSKAMDDNDREDALLYYHL

SEQ ID NO: 10597 - protein, 20 aa, artificial
  peptide fold or domain or sub-domain
LARQAEVRQTSMEDLQRYGD

SEQ ID NO: 10598 - protein, 30 aa, artificial
  peptide fold or domain or sub-domain
LARRAGSNELVPALAADEREFVRRAAFALI

SEQ ID NO: 10599 - protein, 26 aa, artificial
  peptide fold or domain or sub-domain
LASASSDERLERLKPFGMDHGINYRR

SEQ ID NO: 10600 - protein, 25 aa, artificial
  peptide fold or domain or sub-domain
LASEIDKAARDTILSNRPNMALIGD

SEQ ID NO: 10601 - protein, 23 aa, artificial
  peptide fold or domain or sub-domain
LASILSCCEDESSQLVILENLFD

SEQ ID NO: 10602 - protein, 25 aa, artificial
  peptide fold or domain or sub-domain
LASKLGCDSARDVVAAMRARSAEEI

SEQ ID NO: 10603 - protein, 27 aa, artificial
  peptide fold or domain or sub-domain
LASLAGQMGKDVGRNARFLRKTIQRLQ

SEQ ID NO: 10604 - protein, 27 aa, artificial
  peptide fold or domain or sub-domain
LASLTKDLRKAFQQGDLQEAKILLAKM

SEQ ID NO: 10605 - protein, 28 aa, artificial
  peptide fold or domain or sub-domain
LASYSERAARTGDPETFNRVHLEIGKSA

SEQ ID NO: 10606 - protein, 26 aa, artificial
  peptide fold or domain or sub-domain
LATAGTPEKRAYLRGMGITHVMDSRS

SEQ ID NO: 10607 - protein, 26 aa, artificial
  peptide fold or domain or sub-domain
LATDDEKEAEIVEYRGMYIDDNILHQ

SEQ ID NO: 10608 - protein, 26 aa, artificial
  peptide fold or domain or sub-domain
LATGTRIEKLEELKEKFNNIKILKFD

SEQ ID NO: 10609 - protein, 25 aa, artificial
  peptide fold or domain or sub-domain
LATIVGCGTDGTMIKCLKSRPARQI

SEQ ID NO: 10610 - protein, 28 aa, artificial
  peptide fold or domain or sub-domain
LATMATAWATPGSEHFADAGLLAAIRAG

SEQ ID NO: 10611 - protein, 25 aa, artificial
  peptide fold or domain or sub-domain
LATQGLYQWLLSNASSGEIDAQLRG

SEQ ID NO: 10612 - protein, 20 aa, artificial
  peptide fold or domain or sub-domain
LATRGVLARDKGAGAAPTDY

SEQ ID NO: 10613 - protein, 23 aa, artificial
  peptide fold or domain or sub-domain
LATRGVLARDKGAGAAPTDYVVS

SEQ ID NO: 10614 - protein, 28 aa, artificial
  peptide fold or domain or sub-domain
LATRGVLARDKGAGAAPTDYVVSLLEVW

SEQ ID NO: 10615 - protein, 30 aa, artificial
  peptide fold or domain or sub-domain
LATVIEEDEENLKEMTKSELISYIKTMQDT

SEQ ID NO: 10616 - protein, 25 aa, artificial
  peptide fold or domain or sub-domain
LATYSYRHGSGKEKKVLTYSDLANT

SEQ ID NO: 10617 - protein, 30 aa, artificial
  peptide fold or domain or sub-domain
LAVAGRNQRLAARLASLSEQQHKVIPFGFT

SEQ ID NO: 10618 - protein, 24 aa, artificial
  peptide fold or domain or sub-domain
LAVARAHAKRDPSLSRGGKLTYLS

SEQ ID NO: 10619 - protein, 25 aa, artificial
  peptide fold or domain or sub-domain
LAVDSCSDAISTYQKNFIGVPVITD

SEQ ID NO: 10620 - protein, 20 aa, artificial
  peptide fold or domain or sub-domain
LAVECIKDAEMRAGGSHGNK

SEQ ID NO: 10621 - protein, 28 aa, artificial
  peptide fold or domain or sub-domain
LAVFLKENNLNEIPLGKTQIDGNKIFVI

SEQ ID NO: 10622 - protein, 29 aa, artificial
  peptide fold or domain or sub-domain
LAVGNAKEEVKAIADKIIGNAKKNGVAEF

SEQ ID NO: 10623 - protein, 21 aa, artificial
  peptide fold or domain or sub-domain
LAVKLVASLNARSRCTQSTDI

SEQ ID NO: 10624 - protein, 23 aa, artificial
  peptide fold or domain or sub-domain
LAVLDADGGGKGANYTSAAQWFR

SEQ ID NO: 10625 - protein, 24 aa, artificial
  peptide fold or domain or sub-domain
LAVLDADGGGKGANYTSAAQWFRK

SEQ ID NO: 10626 - protein, 28 aa, artificial
  peptide fold or domain or sub-domain
LAVPPEAGPVDWGHDSSTAFWIDRYREQ

SEQ ID NO: 10627 - protein, 25 aa, artificial
  peptide fold or domain or sub-domain
LAVQAIYSWQLSQNSFSDIEAQFLT

SEQ ID NO: 10628 - protein, 25 aa, artificial
  peptide fold or domain or sub-domain
LAVRERDGRRARLACDDEPYCLELL

SEQ ID NO: 10629 - protein, 25 aa, artificial
  peptide fold or domain or sub-domain
LAVRIMKRAVKMCPQLTDGKEIEHL

SEQ ID NO: 10630 - protein, 27 aa, artificial
  peptide fold or domain or sub-domain
LAVTDIRASTGFYDYEAKYSEGGSIHV

SEQ ID NO: 10631 - protein, 28 aa, artificial
  peptide fold or domain or sub-domain
LAVTVPHAMPLVKEYAHYTTERQAGLGA

SEQ ID NO: 10632 - protein, 27 aa, artificial
  peptide fold or domain or sub-domain
LAVVLNYLGRDPRSAKPADLAAASDLL

SEQ ID NO: 10633 - protein, 26 aa, artificial
  peptide fold or domain or sub-domain
LAWASAQAKALSKHQDFDSAVQLVEN

SEQ ID NO: 10634 - protein, 26 aa, artificial
  peptide fold or domain or sub-domain
LAWFNESGLPMAGTDWHRCGPLIAAL

SEQ ID NO: 10635 - protein, 26 aa, artificial
  peptide fold or domain or sub-domain
LAWFSGHGGEMVNNDWHDESRRTLGM

SEQ ID NO: 10636 - protein, 24 aa, artificial
  peptide fold or domain or sub-domain
LAWMFEVGRGVPKDIVRSYFWNAV

SEQ ID NO: 10637 - protein, 25 aa, artificial
  peptide fold or domain or sub-domain
LAYADRLEGVDAFDTDTVETELRDL

SEQ ID NO: 10638 - protein, 30 aa, artificial
  peptide fold or domain or sub-domain
LAYDPYVLPSQAEAVGGTLVENLDYLLAES

SEQ ID NO: 10639 - protein, 30 aa, artificial
  peptide fold or domain or sub-domain
LAYDPYVSEERMRSMNVERAGSLEEIFEEA

SEQ ID NO: 10640 - protein, 29 aa, artificial
  peptide fold or domain or sub-domain
LAYEIDQDMVNILNQQISSKNFVLINKDF

SEQ ID NO: 10641 - protein, 25 aa, artificial
  peptide fold or domain or sub-domain
LAYKEAKQADKLRSEWSDDKGHYFG

SEQ ID NO: 10642 - protein, 21 aa, artificial
  peptide fold or domain or sub-domain
LAYLASRDKEAYRKLIDTLGL

SEQ ID NO: 10643 - protein, 21 aa, artificial
  peptide fold or domain or sub-domain
LAYLFKKNTGLYERVLTKLGI

SEQ ID NO: 10644 - protein, 24 aa, artificial
  peptide fold or domain or sub-domain
LAYLSEIQPVQRALNLAEMMITYI

SEQ ID NO: 10645 - protein, 27 aa, artificial
  peptide fold or domain or sub-domain
LCADIEGMIRNNEVQALGPRVAALRAE

SEQ ID NO: 10646 - protein, 26 aa, artificial
  peptide fold or domain or sub-domain
LCAFDRNFLAQAFNVDHDIIRKIQRV

SEQ ID NO: 10647 - protein, 23 aa, artificial
  peptide fold or domain or sub-domain
LCAPEYAYGVTGNPNKIPPNSAV

SEQ ID NO: 10648 - protein, 28 aa, artificial
  peptide fold or domain or sub-domain
LCEGIIVSVNNYKIIVMDDKNRYLHYYL

SEQ ID NO: 10649 - protein, 22 aa, artificial
  peptide fold or domain or sub-domain
LCGYGLGLRFKVWLLRHEQADV

SEQ ID NO: 10650 - protein, 22 aa, artificial
  peptide fold or domain or sub-domain
LCGYRYGAEMVELLLALESGNV

SEQ ID NO: 10651 - protein, 25 aa, artificial
  peptide fold or domain or sub-domain
LCHELINAFPKDAPFDLLSSYCTQV

SEQ ID NO: 10652 - protein, 28 aa, artificial
  peptide fold or domain or sub-domain
LCHWLAQEGILTEPAWRQRDLDGYVRMH

SEQ ID NO: 10653 - protein, 27 aa, artificial
  peptide fold or domain or sub-domain
LCKEMETIAREGSLEEASERILGITIE

SEQ ID NO: 10654 - protein, 27 aa, artificial
  peptide fold or domain or sub-domain
LCKLLETKGRNNNLEGCVELGSQLRQE

SEQ ID NO: 10655 - protein, 27 aa, artificial
  peptide fold or domain or sub-domain
LCKNILDKFGSFEEFAKNASRKWLISQ

SEQ ID NO: 10656 - protein, 25 aa, artificial
  peptide fold or domain or sub-domain
LCLTGTEPPAHVSPDATISVQGQDF

SEQ ID NO: 10657 - protein, 26 aa, artificial
  peptide fold or domain or sub-domain
LCLVNNQAFHPVQEALDVDVMIDPRA

SEQ ID NO: 10658 - protein, 28 aa, artificial
  peptide fold or domain or sub-domain
LCMEEYVIEPKSVQFLIQHGFNFNQQYA

SEQ ID NO: 10659 - protein, 27 aa, artificial
  peptide fold or domain or sub-domain
LCMMLEGEVVNGTGRNAYLEGYKVAGK

SEQ ID NO: 10660 - protein, 25 aa, artificial
  peptide fold or domain or sub-domain
LCPKENIERRKLLYACRNCEYFSYA

SEQ ID NO: 10661 - protein, 25 aa, artificial
  peptide fold or domain or sub-domain
LCQCFQLVNQRKLPFFFKEDFTLVS

SEQ ID NO: 10662 - protein, 27 aa, artificial
  peptide fold or domain or sub-domain
LCRELESKVKNNEVQEVLSLAQRIQAT

SEQ ID NO: 10663 - protein, 27 aa, artificial
  peptide fold or domain or sub-domain
LCREVEDLAGAGDLAGAEALFAQVEDE

SEQ ID NO: 10664 - protein, 27 aa, artificial
  peptide fold or domain or sub-domain
LCRKLGALALTGDTAGAAGLVSEIEAE

SEQ ID NO: 10665 - protein, 21 aa, artificial
  peptide fold or domain or sub-domain
LCRPRRVEMANLLNLTERQIK

SEQ ID NO: 10666 - protein, 23 aa, artificial
  peptide fold or domain or sub-domain
LCSLMGGLADQKDFMLLSHNLLE

SEQ ID NO: 10667 - protein, 24 aa, artificial
  peptide fold or domain or sub-domain
LCTYHVNKLRNEGRFDGPAWAEAR

SEQ ID NO: 10668 - protein, 29 aa, artificial
  peptide fold or domain or sub-domain
LCVELTDTALNGATEQDRMAAWGGLYQHL

SEQ ID NO: 10669 - protein, 22 aa, artificial
  peptide fold or domain or sub-domain
LCVTACEKFASNNESAAKMIKE

SEQ ID NO: 10670 - protein, 22 aa, artificial
  peptide fold or domain or sub-domain
LCYQGMEKFGEECKIATYLKKE

SEQ ID NO: 10671 - protein, 27 aa, artificial
  peptide fold or domain or sub-domain
LDADPEVRRPLANTGNTGGWAPSGSLF

SEQ ID NO: 10672 - protein, 26 aa, artificial
  peptide fold or domain or sub-domain
LDAFYAIMQATSARAGFAIHSPAYYA

SEQ ID NO: 10673 - protein, 29 aa, artificial
  peptide fold or domain or sub-domain
LDAIIYYERYVVIQPGVAEGLSQLDLLSE

SEQ ID NO: 10674 - protein, 21 aa, artificial
  peptide fold or domain or sub-domain
LDAKEIRRRFPTLNPSNDEVA

SEQ ID NO: 10675 - protein, 23 aa, artificial
  peptide fold or domain or sub-domain
LDALGRVISESPPDQWEARCGLA

SEQ ID NO: 10676 - protein, 25 aa, artificial
  peptide fold or domain or sub-domain
LDAMFADGSIEAYTKKEALQLEKER

SEQ ID NO: 10677 - protein, 27 aa, artificial
  peptide fold or domain or sub-domain
LDANRRVEKIKICDLNNRCAERSLEVL

SEQ ID NO: 10678 - protein, 21 aa, artificial
  peptide fold or domain or sub-domain
LDAQGIMARWPEIRVPDNYIG

SEQ ID NO: 10679 - protein, 25 aa, artificial
  peptide fold or domain or sub-domain
LDARKAAMLTEAAHDDTSRVDTEQR

SEQ ID NO: 10680 - protein, 21 aa, artificial
  peptide fold or domain or sub-domain
LDARQAQELMPIATFDDAALI

SEQ ID NO: 10681 - protein, 26 aa, artificial
  peptide fold or domain or sub-domain
LDARWEQWYAAPIEREEVRALMNDTR

SEQ ID NO: 10682 - protein, 27 aa, artificial
  peptide fold or domain or sub-domain
LDCAFMFDDDDREKMSSEPMVKYLRPA

SEQ ID NO: 10683 - protein, 30 aa, artificial
  peptide fold or domain or sub-domain
LDCDRELSQRAGCSINDLVASAGWQEFRAR

SEQ ID NO: 10684 - protein, 25 aa, artificial
  peptide fold or domain or sub-domain
LDDAGMSELHQQWKGLKGPTDVLSW

SEQ ID NO: 10685 - protein, 27 aa, artificial
  peptide fold or domain or sub-domain
LDDAQIGEIGMHAILAVAQGSHEPPRF

SEQ ID NO: 10686 - protein, 24 aa, artificial
  peptide fold or domain or sub-domain
LDDDETTAGIHLSTLVEFVFAMRD

SEQ ID NO: 10687 - protein, 23 aa, artificial
  peptide fold or domain or sub-domain
LDDFADDHGYTGRSEVVREASRN

SEQ ID NO: 10688 - protein, 22 aa, artificial
  peptide fold or domain or sub-domain
LDDILDRSIETGCLHQQFKQRS

SEQ ID NO: 10689 - protein, 30 aa, artificial
  peptide fold or domain or sub-domain
LDDIVPYLTAHYHGHPPSPEDIAYMRERCQ

SEQ ID NO: 10690 - protein, 25 aa, artificial
  peptide fold or domain or sub-domain
LDDLFESERINDRPKAERIQLASER

SEQ ID NO: 10691 - protein, 24 aa, artificial
  peptide fold or domain or sub-domain
LDDQYSRFSLENNFLLQHNIRKSK

SEQ ID NO: 10692 - protein, 21 aa, artificial
  peptide fold or domain or sub-domain
LDDSWYLGGAPWEATKMYTDE

SEQ ID NO: 10693 - protein, 20 aa, artificial
  peptide fold or domain or sub-domain
LDDYCRRSRSNEEGRFASLL

SEQ ID NO: 10694 - protein, 23 aa, artificial
  peptide fold or domain or sub-domain
LDEDKEFFLRSRGVRREYLSQLL

SEQ ID NO: 10695 - protein, 29 aa, artificial
  peptide fold or domain or sub-domain
LDEDLIVSRMRELGVEEEVIENFSIDVLN

SEQ ID NO: 10696 - protein, 25 aa, artificial
  peptide fold or domain or sub-domain
LDEEKERVPLYLLNEIMSPLMRTCE

SEQ ID NO: 10697 - protein, 25 aa, artificial
  peptide fold or domain or sub-domain
LDEEQVRSDRYLHYSSTKKAMKECE

SEQ ID NO: 10698 - protein, 26 aa, artificial
  peptide fold or domain or sub-domain
LDEFFKTYTTMAERHGITHRPIEYFQ

SEQ ID NO: 10699 - protein, 29 aa, artificial
  peptide fold or domain or sub-domain
LDEHNELMRQALAIKDSKKRFAAIWTLCK

SEQ ID NO: 10700 - protein, 23 aa, artificial
  peptide fold or domain or sub-domain
LDEHSEDIESLARADRFLYEISK

SEQ ID NO: 10701 - protein, 23 aa, artificial
  peptide fold or domain or sub-domain
LDEKSLNYLRTRGISLDEAQVML

SEQ ID NO: 10702 - protein, 23 aa, artificial
  peptide fold or domain or sub-domain
LDELIHRDHPDGPVDREQLVAFA

SEQ ID NO: 10703 - protein, 22 aa, artificial
  peptide fold or domain or sub-domain
LDENLEISLNEDSPEIELKQII

SEQ ID NO: 10704 - protein, 22 aa, artificial
  peptide fold or domain or sub-domain
LDEPTYIYPLPWRYYAELGIRR

SEQ ID NO: 10705 - protein, 24 aa, artificial
  peptide fold or domain or sub-domain
LDEQLGRVSKEKNLLLIHNLKRIR

SEQ ID NO: 10706 - protein, 24 aa, artificial
  peptide fold or domain or sub-domain
LDEREVQDYVKERVVKYKQLAGGV

SEQ ID NO: 10707 - protein, 23 aa, artificial
  peptide fold or domain or sub-domain
LDETAMFYMQSRGIPKKEAKALL

SEQ ID NO: 10708 - protein, 22 aa, artificial
  peptide fold or domain or sub-domain
LDEVIHPGVQGERREAQKQAIQ

SEQ ID NO: 10709 - protein, 20 aa, artificial
  peptide fold or domain or sub-domain
LDEYCRRSRSSEEGRFAALL

SEQ ID NO: 10710 - protein, 26 aa, artificial
  peptide fold or domain or sub-domain
LDFAQIHKDDILRAGGKGANLGEMTA

SEQ ID NO: 10711 - protein, 30 aa, artificial
  peptide fold or domain or sub-domain
LDFLRDKPVGMIWGVGKAFAAKLESDGIRT

SEQ ID NO: 10712 - protein, 26 aa, artificial
  peptide fold or domain or sub-domain
LDFPDLVDLTLDEKGENGVGELSSEY

SEQ ID NO: 10713 - protein, 24 aa, artificial
  peptide fold or domain or sub-domain
LDFSKIPNTANVDPKFPSYGYDVG

SEQ ID NO: 10714 - protein, 23 aa, artificial
  peptide fold or domain or sub-domain
LDGAEENGIELPFSCHSGSCSSC

SEQ ID NO: 10715 - protein, 26 aa, artificial
  peptide fold or domain or sub-domain
LDGCYSILKLDEFTTHLPDIVQRAFD

SEQ ID NO: 10716 - protein, 22 aa, artificial
  peptide fold or domain or sub-domain
LDGELVGAMRDAPLTPRQQDAL

SEQ ID NO: 10717 - protein, 29 aa, artificial
  peptide fold or domain or sub-domain
LDGIAAVLDFPEWAGRNLDALYDCLTDLS

SEQ ID NO: 10718 - protein, 26 aa, artificial
  peptide fold or domain or sub-domain
LDGIYSLKELLIEYPEYDCFTRLAFP

SEQ ID NO: 10719 - protein, 28 aa, artificial
  peptide fold or domain or sub-domain
LDGNIKRVLIRYYSININNKYIEKLLWK

SEQ ID NO: 10720 - protein, 21 aa, artificial
  peptide fold or domain or sub-domain
LDGNPLCENYCTSKQYIDSAM

SEQ ID NO: 10721 - protein, 21 aa, artificial
  peptide fold or domain or sub-domain
LDGNPLCIKYNKCHDYIQAVK

SEQ ID NO: 10722 - protein, 21 aa, artificial
  peptide fold or domain or sub-domain
LDGNSLCDTFRDQSTYISAIR

SEQ ID NO: 10723 - protein, 28 aa, artificial
  peptide fold or domain or sub-domain
LDGNVKRVLKRWHGQPDASDKALWLLAQ

SEQ ID NO: 10724 - protein, 25 aa, artificial
  peptide fold or domain or sub-domain
LDGQESSQGKIRCNQCNASYNSSKF

SEQ ID NO: 10725 - protein, 26 aa, artificial
  peptide fold or domain or sub-domain
LDGVEVTEKVIDLVAHPLGWEPDFLK

SEQ ID NO: 10726 - protein, 20 aa, artificial
  peptide fold or domain or sub-domain
LDGYAATMHFSREEQVEIAK

SEQ ID NO: 10727 - protein, 25 aa, artificial
  peptide fold or domain or sub-domain
LDHAANFLYMLQGTIPSQQAQQIVN

SEQ ID NO: 10728 - protein, 27 aa, artificial
  peptide fold or domain or sub-domain
LDHDQQKELGMGALIGVAKGAAEPAKF

SEQ ID NO: 10729 - protein, 21 aa, artificial
  peptide fold or domain or sub-domain
LDHETRKREYPQLDIPKDALA

SEQ ID NO: 10730 - protein, 23 aa, artificial
  peptide fold or domain or sub-domain
LDHKEFKARVKEYARNKNIHYYF

SEQ ID NO: 10731 - protein, 24 aa, artificial
  peptide fold or domain or sub-domain
LDHKKYGFSDQPTFEKSAEYKLLR

SEQ ID NO: 10732 - protein, 21 aa, artificial
  peptide fold or domain or sub-domain
LDHKQYVHRNNNITTCIQDML

SEQ ID NO: 10733 - protein, 21 aa, artificial
  peptide fold or domain or sub-domain
LDHQDAAESLGVSPSRVSQMH

SEQ ID NO: 10734 - protein, 27 aa, artificial
  peptide fold or domain or sub-domain
LDHRMGTSEKDRPCETCGKNLADCLGH

SEQ ID NO: 10735 - protein, 24 aa, artificial
  peptide fold or domain or sub-domain
LDIDEVIATIRAAVAVNHEIQLYG

SEQ ID NO: 10736 - protein, 20 aa, artificial
  peptide fold or domain or sub-domain
LDIIDLIDKKTNTKTDFDTI

SEQ ID NO: 10737 - protein, 22 aa, artificial
  peptide fold or domain or sub-domain
LDILSIMLRSNNFSDSNLVDQL

SEQ ID NO: 10738 - protein, 26 aa, artificial
  peptide fold or domain or sub-domain
LDIQRFEALLDQMPACDYRTYLSGIA

SEQ ID NO: 10739 - protein, 30 aa, artificial
  peptide fold or domain or sub-domain
LDIWKGEGDQWKKLTKDLYGHFETSKCYVC

SEQ ID NO: 10740 - protein, 27 aa, artificial
  peptide fold or domain or sub-domain
LDIYQARKLIAEGVVDGGMIPKVQCCV

SEQ ID NO: 10741 - protein, 25 aa, artificial
  peptide fold or domain or sub-domain
LDKFIAENVGLTRSQATKAIRQSAV

SEQ ID NO: 10742 - protein, 27 aa, artificial
  peptide fold or domain or sub-domain
LDKKQLSQMQNDIEPRYLQKKYQGQLD

SEQ ID NO: 10743 - protein, 23 aa, artificial
  peptide fold or domain or sub-domain
LDKLQESLGFTGRSEIVRAGIRT

SEQ ID NO: 10744 - protein, 30 aa, artificial
  peptide fold or domain or sub-domain
LDKLTRAREEAKKEGNQPFQHAIKIIMNSM

SEQ ID NO: 10745 - protein, 26 aa, artificial
  peptide fold or domain or sub-domain
LDKLVDEIGVGYVRDRGSVSDYILSE

SEQ ID NO: 10746 - protein, 23 aa, artificial
  peptide fold or domain or sub-domain
LDKLVIDRGFNNRSALLAEIIQR

SEQ ID NO: 10747 - protein, 21 aa, artificial
  peptide fold or domain or sub-domain
LDKNYVRLLGGVGPAVARARA

SEQ ID NO: 10748 - protein, 28 aa, artificial
  peptide fold or domain or sub-domain
LDKQMMAKSLEKFSKGFGVVGKAIDAAS

SEQ ID NO: 10749 - protein, 28 aa, artificial
  peptide fold or domain or sub-domain
LDKSDKGQKFAERYRAEYKRDPLTYAAA

SEQ ID NO: 10750 - protein, 22 aa, artificial
  peptide fold or domain or sub-domain
LDKSLAELEASINMTQKPQSVA

SEQ ID NO: 10751 - protein, 23 aa, artificial
  peptide fold or domain or sub-domain
LDKYVGDNHFTNRSQAIRHLIAN

SEQ ID NO: 10752 - protein, 24 aa, artificial
  peptide fold or domain or sub-domain
LDLDALDILKHVSKREFEELMCAD

SEQ ID NO: 10753 - protein, 30 aa, artificial
  peptide fold or domain or sub-domain
LDLDTALIEKIGRSIPDYFEKYGEAAFREQ

SEQ ID NO: 10754 - protein, 22 aa, artificial
  peptide fold or domain or sub-domain
LDLLLEMVKSGQMDETDVQAEV

SEQ ID NO: 10755 - protein, 22 aa, artificial
  peptide fold or domain or sub-domain
LDLLLKFSDIEKLSDRDIREEV

SEQ ID NO: 10756 - protein, 20 aa, artificial
  peptide fold or domain or sub-domain
LDLQLRKTHPESPFLFPKLL

SEQ ID NO: 10757 - protein, 29 aa, artificial
  peptide fold or domain or sub-domain
LDLQNLNEETKSTHSTKILRGLRDRMESN

SEQ ID NO: 10758 - protein, 24 aa, artificial
  peptide fold or domain or sub-domain
LDLTKLSNYADLYPLAKKTDGWGA

SEQ ID NO: 10759 - protein, 27 aa, artificial
  peptide fold or domain or sub-domain
LDLTNEAKGFYDQNTKENISYQELLKC

SEQ ID NO: 10760 - protein, 27 aa, artificial
  peptide fold or domain or sub-domain
LDLVELRAAVQETGISLSNEVCNLMAI

SEQ ID NO: 10761 - protein, 25 aa, artificial
  peptide fold or domain or sub-domain
LDLVKQDGDIAYFRCSRDHHNIVLY

SEQ ID NO: 10762 - protein, 24 aa, artificial
  peptide fold or domain or sub-domain
LDMDIQEILNYISRKEFEPLLRVD

SEQ ID NO: 10763 - protein, 28 aa, artificial
  peptide fold or domain or sub-domain
LDMMPNGSDFARRYKARFGTEVLNYAPY

SEQ ID NO: 10764 - protein, 23 aa, artificial
  peptide fold or domain or sub-domain
LDMQSYETRQKEYAFKGQKHFYF

SEQ ID NO: 10765 - protein, 26 aa, artificial
  peptide fold or domain or sub-domain
LDMSEVSAAHAELAGGKMAHLCELAN

SEQ ID NO: 10766 - protein, 29 aa, artificial
  peptide fold or domain or sub-domain
LDMSPRSLEKVLYFVAYVVIDPGDTPLVK

SEQ ID NO: 10767 - protein, 24 aa, artificial
  peptide fold or domain or sub-domain
LDMVTAHNKLIGPGLGEGPMWWLL

SEQ ID NO: 10768 - protein, 23 aa, artificial
  peptide fold or domain or sub-domain
LDNESLFYLRSRGLTEVAARNLL

SEQ ID NO: 10769 - protein, 30 aa, artificial
  peptide fold or domain or sub-domain
LDNFTDIRSELISQGIKLSSETDSELIAQL

SEQ ID NO: 10770 - protein, 21 aa, artificial
  peptide fold or domain or sub-domain
LDNGEFKRYNENQDEIRKRVF

SEQ ID NO: 10771 - protein, 20 aa, artificial
  peptide fold or domain or sub-domain
LDNIAETRNMSREDLKGMED

SEQ ID NO: 10772 - protein, 24 aa, artificial
  peptide fold or domain or sub-domain
LDNLAHTSQNCEYKKSRFPALIQR

SEQ ID NO: 10773 - protein, 23 aa, artificial
  peptide fold or domain or sub-domain
LDNLLCRLRLDRPDDMAELSGEL

SEQ ID NO: 10774 - protein, 28 aa, artificial
  peptide fold or domain or sub-domain
LDNNEIERLNGASTREQIKQLIKDNVII

SEQ ID NO: 10775 - protein, 21 aa, artificial
  peptide fold or domain or sub-domain
LDNNPLCGTMRSSVEYVRKVR

SEQ ID NO: 10776 - protein, 27 aa, artificial
  peptide fold or domain or sub-domain
LDNREEQDKYTLFENGTFFRHFDRVTL

SEQ ID NO: 10777 - protein, 23 aa, artificial
  peptide fold or domain or sub-domain
LDNRIIKNGYSSRSELVRDMIRE

SEQ ID NO: 10778 - protein, 24 aa, artificial
  peptide fold or domain or sub-domain
LDNVAAPLVLAKKMRRADARDKAR

SEQ ID NO: 10779 - protein, 24 aa, artificial
  peptide fold or domain or sub-domain
LDNVAIGPHRVRGKSRTEAREIAT

SEQ ID NO: 10780 - protein, 24 aa, artificial
  peptide fold or domain or sub-domain
LDNVLAGPCIVGRKRKRDVVERGK

SEQ ID NO: 10781 - protein, 24 aa, artificial
  peptide fold or domain or sub-domain
LDNVTVAPIKVKARPRRQVEDYAI

SEQ ID NO: 10782 - protein, 21 aa, artificial
  peptide fold or domain or sub-domain
LDPAEFATRFPTQRLREGDTA

SEQ ID NO: 10783 - protein, 27 aa, artificial
  peptide fold or domain or sub-domain
LDPAMGPTNDTDTCKSCGQQSIRCPGH

SEQ ID NO: 10784 - protein, 29 aa, artificial
  peptide fold or domain or sub-domain
LDPDDLKRFLEVEQKMINVTKEYCLDIVD

SEQ ID NO: 10785 - protein, 27 aa, artificial
  peptide fold or domain or sub-domain
LDPDSISITLTSSDAHKLGVVQNNVPR

SEQ ID NO: 10786 - protein, 29 aa, artificial
  peptide fold or domain or sub-domain
LDPEEMELELIDFGAEEVFEDEEGIHIYA

SEQ ID NO: 10787 - protein, 20 aa, artificial
  peptide fold or domain or sub-domain
LDPEGRDVSVPGYVEADGDN

SEQ ID NO: 10788 - protein, 27 aa, artificial
  peptide fold or domain or sub-domain
LDPNDVAPTLFAMDMEHLFVVDNGGLR

SEQ ID NO: 10789 - protein, 28 aa, artificial
  peptide fold or domain or sub-domain
LDPNETNKIANANSCQLIRKLIEDGLII

SEQ ID NO: 10790 - protein, 24 aa, artificial
  peptide fold or domain or sub-domain
LDPQKIPNMANLYDNAVYSDHTIF

SEQ ID NO: 10791 - protein, 24 aa, artificial
  peptide fold or domain or sub-domain
LDPSIVTNLANLYPKARFSEYGVI

SEQ ID NO: 10792 - protein, 30 aa, artificial
  peptide fold or domain or sub-domain
LDPTLIQVEFIPKLARILDIKVQTLSKLLA

SEQ ID NO: 10793 - protein, 28 aa, artificial
  peptide fold or domain or sub-domain
LDPTQMDKISKVKTREGIRELIAQGLIK

SEQ ID NO: 10794 - protein, 25 aa, artificial
  peptide fold or domain or sub-domain
LDPVAEDHDVTYLRADARHHCLALI

SEQ ID NO: 10795 - protein, 27 aa, artificial
  peptide fold or domain or sub-domain
LDQDAMAELGMGCALAVGRGSCMSNYT

SEQ ID NO: 10796 - protein, 22 aa, artificial
  peptide fold or domain or sub-domain
LDQDELQKTDINEISIDKLKNN

SEQ ID NO: 10797 - protein, 26 aa, artificial
  peptide fold or domain or sub-domain
LDQFYDILSRTAERKGFSVHPLVYFQ

SEQ ID NO: 10798 - protein, 27 aa, artificial
  peptide fold or domain or sub-domain
LDQRMGTVDKEFFCTTDMGSFLESPGY

SEQ ID NO: 10799 - protein, 29 aa, artificial
  peptide fold or domain or sub-domain
LDRARLPQQPGSAQEVQPAAWSALGIDAV

SEQ ID NO: 10800 - protein, 25 aa, artificial
  peptide fold or domain or sub-domain
LDRFFNNKLAAPLPEIPPDVVTECR

SEQ ID NO: 10801 - protein, 26 aa, artificial
  peptide fold or domain or sub-domain
LDRFHEIMVTTGKRDNFLVRHREYFK

SEQ ID NO: 10802 - protein, 26 aa, artificial
  peptide fold or domain or sub-domain
LDRIADMLQIKDENPFKIRAYRKAAD

SEQ ID NO: 10803 - protein, 24 aa, artificial
  peptide fold or domain or sub-domain
LDRLKEVAVRDNLSITPVECSWWT

SEQ ID NO: 10804 - protein, 20 aa, artificial
  peptide fold or domain or sub-domain
LDRRAEQYGLNTQELADLQS

SEQ ID NO: 10805 - protein, 27 aa, artificial
  peptide fold or domain or sub-domain
LDRRLGVCDSLSVCETCGKRIEECSGH

SEQ ID NO: 10806 - protein, 27 aa, artificial
  peptide fold or domain or sub-domain
LDRTARDVDDTTCGGTAEDNNVFGEGR

SEQ ID NO: 10807 - protein, 25 aa, artificial
  peptide fold or domain or sub-domain
LDSATFLSIVKREITPQQAFFQGKA

SEQ ID NO: 10808 - protein, 30 aa, artificial
  peptide fold or domain or sub-domain
LDSDFLIEQKFNQKVSEIFEQKRENFFREQ

SEQ ID NO: 10809 - protein, 27 aa, artificial
  peptide fold or domain or sub-domain
LDSDSIEQLIQSGTLMGGMRLKVEQAL

SEQ ID NO: 10810 - protein, 25 aa, artificial
  peptide fold or domain or sub-domain
LDSEPAQKINQEYRNHSYIPDVTSF

SEQ ID NO: 10811 - protein, 26 aa, artificial
  peptide fold or domain or sub-domain
LDSIAAYLEYGGVHKHGTKWAFRTGS

SEQ ID NO: 10812 - protein, 26 aa, artificial
  peptide fold or domain or sub-domain
LDSLQKWLHQQTKDSIEASTRFAEIL

SEQ ID NO: 10813 - protein, 23 aa, artificial
  peptide fold or domain or sub-domain
LDSLSQRRGYNNRSEAIRDILRS

SEQ ID NO: 10814 - protein, 27 aa, artificial
  peptide fold or domain or sub-domain
LDSNEVRAALLSSGYQVSEQTFQALMR

SEQ ID NO: 10815 - protein, 27 aa, artificial
  peptide fold or domain or sub-domain
LDSRLGAHRADAQCSSCGGTLKTCGGH

SEQ ID NO: 10816 - protein, 24 aa, artificial
  peptide fold or domain or sub-domain
LDSTICNKPFAGAKDCSIKKTKAL

SEQ ID NO: 10817 - protein, 28 aa, artificial
  peptide fold or domain or sub-domain
LDSVPAAKTMAGNFKKAFGSDVQGYGIM

SEQ ID NO: 10818 - protein, 29 aa, artificial
  peptide fold or domain or sub-domain
LDTKDLMMFLEAEQGVAHINEEISLEIIH

SEQ ID NO: 10819 - protein, 22 aa, artificial
  peptide fold or domain or sub-domain
LDTLLAAEADGQIDHQGICDEV

SEQ ID NO: 10820 - protein, 24 aa, artificial
  peptide fold or domain or sub-domain
LDTSKIPNYKHLVDRARISPYHIG

SEQ ID NO: 10821 - protein, 24 aa, artificial
  peptide fold or domain or sub-domain
LDTTQIGTLVGQGQVSGSLMPALL

SEQ ID NO: 10822 - protein, 22 aa, artificial
  peptide fold or domain or sub-domain
LDVHRKDYVNPAFKKINPQHTV

SEQ ID NO: 10823 - protein, 25 aa, artificial
  peptide fold or domain or sub-domain
LDVLEKEFENNMAFLQKIFILKDTY

SEQ ID NO: 10824 - protein, 23 aa, artificial
  peptide fold or domain or sub-domain
LDVMVAERGLPSRSQMIAELIRH

SEQ ID NO: 10825 - protein, 28 aa, artificial
  peptide fold or domain or sub-domain
LDVRQEDVHLNTEFMLIERIGPVGGRMH

SEQ ID NO: 10826 - protein, 25 aa, artificial
  peptide fold or domain or sub-domain
LDVVEASGVLSRDELARIMTARRPM

SEQ ID NO: 10827 - protein, 23 aa, artificial
  peptide fold or domain or sub-domain
LDVVLATDTIKEKQKAKMMEIAA

SEQ ID NO: 10828 - protein, 24 aa, artificial
  peptide fold or domain or sub-domain
LDVWASNGFVNNRKKPLKHISKWK

SEQ ID NO: 10829 - protein, 27 aa, artificial
  peptide fold or domain or sub-domain
LDVYELKSAIQTAGLPVNEQILHLMAL

SEQ ID NO: 10830 - protein, 26 aa, artificial
  peptide fold or domain or sub-domain
LDWESVLAADAATVGGKAWHLARLKQ

SEQ ID NO: 10831 - protein, 26 aa, artificial
  peptide fold or domain or sub-domain
LDWFSRQGEPMSKSLWSESMGRSLCV

SEQ ID NO: 10832 - protein, 26 aa, artificial
  peptide fold or domain or sub-domain
LDWNADRMIFSVDGVEHYTYSPNVKN

SEQ ID NO: 10833 - protein, 26 aa, artificial
  peptide fold or domain or sub-domain
LDWTPELSAFYANGELVETKTYGIPD

SEQ ID NO: 10834 - protein, 26 aa, artificial
  peptide fold or domain or sub-domain
LDWTPKETVWYVDGTEVATISFQTPR

SEQ ID NO: 10835 - protein, 25 aa, artificial
  peptide fold or domain or sub-domain
LDYASNFLYMLTEKEPDPFAAKVFD

SEQ ID NO: 10836 - protein, 23 aa, artificial
  peptide fold or domain or sub-domain
LDYFDFGGGSAGELGENRSLHAH

SEQ ID NO: 10837 - protein, 26 aa, artificial
  peptide fold or domain or sub-domain
LDYIAKTLGIGSVFMDNNSVVFQVSS

SEQ ID NO: 10838 - protein, 21 aa, artificial
  peptide fold or domain or sub-domain
LDYLKKKNVTTYRELIKALGI

SEQ ID NO: 10839 - protein, 23 aa, artificial
  peptide fold or domain or sub-domain
LDYVHATARVKAAGPGADLGEAA

SEQ ID NO: 10840 - protein, 27 aa, artificial
  peptide fold or domain or sub-domain
LEAAIRQRLFNRAFKREVSAMQPQAMT

SEQ ID NO: 10841 - protein, 27 aa, artificial
  peptide fold or domain or sub-domain
LEAEAAAVGYQDPSTAKPLAVFEAMRK

SEQ ID NO: 10842 - protein, 25 aa, artificial
  peptide fold or domain or sub-domain
LEAEARYYQFTWGRPMTTRAMANLL

SEQ ID NO: 10843 - protein, 27 aa, artificial
  peptide fold or domain or sub-domain
LEAFELRNVMRTIGFHVSNMIYKAIAC

SEQ ID NO: 10844 - protein, 21 aa, artificial
  peptide fold or domain or sub-domain
LEAFEQPFLNHRPWHMGGVRR

SEQ ID NO: 10845 - protein, 21 aa, artificial
  peptide fold or domain or sub-domain
LEAFSKNGFIFGGQEYEIDAL

SEQ ID NO: 10846 - protein, 24 aa, artificial
  peptide fold or domain or sub-domain
LEAIALQSRSAVYKPKHFPFLIMK

SEQ ID NO: 10847 - protein, 30 aa, artificial
  peptide fold or domain or sub-domain
LEAKLKKSPVRKYFPSFNGPNEVTAVKAFF

SEQ ID NO: 10848 - protein, 25 aa, artificial
  peptide fold or domain or sub-domain
LEALFASPEIEERPKKEQVRLKHEL

SEQ ID NO: 10849 - protein, 25 aa, artificial
  peptide fold or domain or sub-domain
LEALHADNPEFLTPSARRNEMIQRL

SEQ ID NO: 10850 - protein, 27 aa, artificial
  peptide fold or domain or sub-domain
LEALLIEKGVIGSDSVDAVLEHFATMA

SEQ ID NO: 10851 - protein, 25 aa, artificial
  peptide fold or domain or sub-domain
LEALRAGDGINDYSKKMQSSLNREY

SEQ ID NO: 10852 - protein, 25 aa, artificial
  peptide fold or domain or sub-domain
LEAMEQTGGFEGRTKKEILMLTREM

SEQ ID NO: 10853 - protein, 20 aa, artificial
  peptide fold or domain or sub-domain
LEAMKRDLGLNAEQATVRVA

SEQ ID NO: 10854 - protein, 21 aa, artificial
  peptide fold or domain or sub-domain
LEANTKRQVSICTICQVNCKL

SEQ ID NO: 10855 - protein, 27 aa, artificial
  peptide fold or domain or sub-domain
LEAQAATGGIVDLLSRERYSVHKAMER

SEQ ID NO: 10856 - protein, 27 aa, artificial
  peptide fold or domain or sub-domain
LEAQACTGGIIHPTTGQKLSLQDAVSQ

SEQ ID NO: 10857 - protein, 26 aa, artificial
  peptide fold or domain or sub-domain
LEAQHTLMEFISMMHSQSLARFNWML

SEQ ID NO: 10858 - protein, 23 aa, artificial
  peptide fold or domain or sub-domain
LECMHRTLDENRERFVERYGSEL

SEQ ID NO: 10859 - protein, 23 aa, artificial
  peptide fold or domain or sub-domain
LECPGNNDCPITPANRNMCKSCR

SEQ ID NO: 10860 - protein, 23 aa, artificial
  peptide fold or domain or sub-domain
LEDDEIFYLQSRGIDANDARKLL

SEQ ID NO: 10861 - protein, 23 aa, artificial
  peptide fold or domain or sub-domain
LEDFIIRKGIPDRSKIFQIALRN

SEQ ID NO: 10862 - protein, 29 aa, artificial
  peptide fold or domain or sub-domain
LEDVAQAVEGIPSLWCVPATIDLAGAEIE

SEQ ID NO: 10863 - protein, 27 aa, artificial
  peptide fold or domain or sub-domain
LEDVAVCMDLDTRTTSSLWKDKAAVEI

SEQ ID NO: 10864 - protein, 25 aa, artificial
  peptide fold or domain or sub-domain
LEDVLSSADANAYTKKERLELQRER

SEQ ID NO: 10865 - protein, 20 aa, artificial
  peptide fold or domain or sub-domain
LEDYINDRQYDSRGRFGELL

SEQ ID NO: 10866 - protein, 27 aa, artificial
  peptide fold or domain or sub-domain
LEEDKLEELGMRTLLCVGQGSDSPSKV

SEQ ID NO: 10867 - protein, 27 aa, artificial
  peptide fold or domain or sub-domain
LEEEESHADFNVTHIAANTLENFCRWQ

SEQ ID NO: 10868 - protein, 23 aa, artificial
  peptide fold or domain or sub-domain
LEEEEYARRKEFYIATGQRHYYF

SEQ ID NO: 10869 - protein, 25 aa, artificial
  peptide fold or domain or sub-domain
LEEEGDRVITYLDHSTQKPLIACVE

SEQ ID NO: 10870 - protein, 22 aa, artificial
  peptide fold or domain or sub-domain
LEEGALCHGRIICPWHKGTFDA

SEQ ID NO: 10871 - protein, 30 aa, artificial
  peptide fold or domain or sub-domain
LEEGTAGALALAGLDEVGNPTTTIDQVDIS

SEQ ID NO: 10872 - protein, 23 aa, artificial
  peptide fold or domain or sub-domain
LEEHKHELDRMAKADRFLYDMSS

SEQ ID NO: 10873 - protein, 25 aa, artificial
  peptide fold or domain or sub-domain
LEEKEKLDHLGSTSKKEEASMKREI

SEQ ID NO: 10874 - protein, 20 aa, artificial
  peptide fold or domain or sub-domain
LEEKYPAYGNLVPRDIATRE

SEQ ID NO: 10875 - protein, 22 aa, artificial
  peptide fold or domain or sub-domain
LEELAARAGPEYRIEVEESLVS

SEQ ID NO: 10876 - protein, 23 aa, artificial
  peptide fold or domain or sub-domain
LEELAERTRISNRSRLVSDAIMA

SEQ ID NO: 10877 - protein, 26 aa, artificial
  peptide fold or domain or sub-domain
LEELAHMGILSGSVDAMVQAHLGAVF

SEQ ID NO: 10878 - protein, 28 aa, artificial
  peptide fold or domain or sub-domain
LEEMAKQVTNPSSRYYQDETVVRTVRDS

SEQ ID NO: 10879 - protein, 26 aa, artificial
  peptide fold or domain or sub-domain
LEEQINSNTIPGLKWLNKEKKIFQIP

SEQ ID NO: 10880 - protein, 24 aa, artificial
  peptide fold or domain or sub-domain
LEEQWKRSVQEHSILQGPDFAGMR

SEQ ID NO: 10881 - protein, 24 aa, artificial
  peptide fold or domain or sub-domain
LEETYGVIRNYDVPLRLGNLGAPQ

SEQ ID NO: 10882 - protein, 28 aa, artificial
  peptide fold or domain or sub-domain
LEEVKSAIQSDQRVVIAAVNGPRSVVIS

SEQ ID NO: 10883 - protein, 25 aa, artificial
  peptide fold or domain or sub-domain
LEEVTEQFHGDASKEGHTMRIFMIV

SEQ ID NO: 10884 - protein, 29 aa, artificial
  peptide fold or domain or sub-domain
LEFETPIAVAFVDSLEDKNAKALIATSAK

SEQ ID NO: 10885 - protein, 21 aa, artificial
  peptide fold or domain or sub-domain
LEFLTNLLMKDGKKAQAQRFI

SEQ ID NO: 10886 - protein, 28 aa, artificial
  peptide fold or domain or sub-domain
LEFNYFDSCNQKSSHEFENYPQELNKKV

SEQ ID NO: 10887 - protein, 24 aa, artificial
  peptide fold or domain or sub-domain
LEFTPSDVVKAKLGVEMEPYKILY

SEQ ID NO: 10888 - protein, 21 aa, artificial
  peptide fold or domain or sub-domain
LEGDEINKRWPGITVPENYNA

SEQ ID NO: 10889 - protein, 27 aa, artificial
  peptide fold or domain or sub-domain
LEGKEDGVKKDTKWASKICGIDEKTIK

SEQ ID NO: 10890 - protein, 27 aa, artificial
  peptide fold or domain or sub-domain
LEGLPYIVSREHLFVKGALYNEARKIA

SEQ ID NO: 10891 - protein, 21 aa, artificial
  peptide fold or domain or sub-domain
LEGNPFCNCFLDHFEYISTIH

SEQ ID NO: 10892 - protein, 21 aa, artificial
  peptide fold or domain or sub-domain
LEGNPVCCARWYRAHVFSYVA

SEQ ID NO: 10893 - protein, 27 aa, artificial
  peptide fold or domain or sub-domain
LEGSASVIVDSEMVAHGVIRSALPAEN

SEQ ID NO: 10894 - protein, 28 aa, artificial
  peptide fold or domain or sub-domain
LEGVINQESNVDHLFDQRHIMMRGTRAS

SEQ ID NO: 10895 - protein, 24 aa, artificial
  peptide fold or domain or sub-domain
LEGWLSRDWRKTNGQEVRNRELWE

SEQ ID NO: 10896 - protein, 23 aa, artificial
  peptide fold or domain or sub-domain
LEHGGGVAYAIAKACAGDAGLYT

SEQ ID NO: 10897 - protein, 30 aa, artificial
  peptide fold or domain or sub-domain
LEIWCVYNKQLISIPKSSFGKFHSGNAYLV

SEQ ID NO: 10898 - protein, 30 aa, artificial
  peptide fold or domain or sub-domain
LEIWRIENFEPVIYPKTNYGKFYTGDSFIV

SEQ ID NO: 10899 - protein, 27 aa, artificial
  peptide fold or domain or sub-domain
LEKAFKHKRLEKALEVPISQEIYEQLK

SEQ ID NO: 10900 - protein, 23 aa, artificial
  peptide fold or domain or sub-domain
LEKAMMMLTEEGVDRQQAHAVIR

SEQ ID NO: 10901 - protein, 28 aa, artificial
  peptide fold or domain or sub-domain
LEKAMVRDNNFPFYNKNRVISLMLQMVR

SEQ ID NO: 10902 - protein, 24 aa, artificial
  peptide fold or domain or sub-domain
LEKARVLAEQADVSIEFEQADLIN

SEQ ID NO: 10903 - protein, 28 aa, artificial
  peptide fold or domain or sub-domain
LEKELLEEMKHPSRARRAKARKRLEVVR

SEQ ID NO: 10904 - protein, 23 aa, artificial
  peptide fold or domain or sub-domain
LEKEPIFSLMTRGISERNAREIM

SEQ ID NO: 10905 - protein, 27 aa, artificial
  peptide fold or domain or sub-domain
LEKGCKIYCDTNMIVNGLSKPALAKYN

SEQ ID NO: 10906 - protein, 22 aa, artificial
  peptide fold or domain or sub-domain
LEKGKIEGDCIRCPWHGSMFRL

SEQ ID NO: 10907 - protein, 28 aa, artificial
  peptide fold or domain or sub-domain
LEKGSRVKNIAVKILPPDVYEAFSKYVD

SEQ ID NO: 10908 - protein, 24 aa, artificial
  peptide fold or domain or sub-domain
LEKIINKAIANHEVTEGINSKWTA

SEQ ID NO: 10909 - protein, 30 aa, artificial
  peptide fold or domain or sub-domain
LEKKICEYIRSYYKDDISYFETGFPITIEN

SEQ ID NO: 10910 - protein, 28 aa, artificial
  peptide fold or domain or sub-domain
LEKMPGGADFLAKYQKRFNQGIKFDAPF

SEQ ID NO: 10911 - protein, 20 aa, artificial
  peptide fold or domain or sub-domain
LEKNNLKSINDNVVSTAATV

SEQ ID NO: 10912 - protein, 28 aa, artificial
  peptide fold or domain or sub-domain
LEKTAAGREFLKKYHDTYHTDPQVYGVN

SEQ ID NO: 10913 - protein, 20 aa, artificial
  peptide fold or domain or sub-domain
LEKTDAALYKKYRNYGKPQN

SEQ ID NO: 10914 - protein, 27 aa, artificial
  peptide fold or domain or sub-domain
LEKVADAFEFDTLKNNSFNKDRALVEL

SEQ ID NO: 10915 - protein, 24 aa, artificial
  peptide fold or domain or sub-domain
LEKVLDICPNSKYNPEEFPGIICR

SEQ ID NO: 10916 - protein, 24 aa, artificial
  peptide fold or domain or sub-domain
LEKWQKNNWLKSDKTPVENQDLWK

SEQ ID NO: 10917 - protein, 29 aa, artificial
  peptide fold or domain or sub-domain
LEKYKKEVLATVNDDTPQDDIDYIMEDLK

SEQ ID NO: 10918 - protein, 26 aa, artificial
  peptide fold or domain or sub-domain
LELELKDNQSLASNFLLQLQQLFLML

SEQ ID NO: 10919 - protein, 26 aa, artificial
  peptide fold or domain or sub-domain
LELFKRTLNCGRIIEKSGQPDILEFV

SEQ ID NO: 10920 - protein, 24 aa, artificial
  peptide fold or domain or sub-domain
LELLGLCAYKNNQIEQAIAYYQKS

SEQ ID NO: 10921 - protein, 30 aa, artificial
  peptide fold or domain or sub-domain
LELLRPLPVSRIWGIGQKTEQSLDKLGIKT

SEQ ID NO: 10922 - protein, 20 aa, artificial
  peptide fold or domain or sub-domain
LELNQVKSEVDRKIAEKDEE

SEQ ID NO: 10923 - protein, 26 aa, artificial
  peptide fold or domain or sub-domain
LELREFVDSLSPNRKINISKIREKLK

SEQ ID NO: 10924 - protein, 20 aa, artificial
  peptide fold or domain or sub-domain
LELSANTQNINIDVLQGYGD

SEQ ID NO: 10925 - protein, 21 aa, artificial
  peptide fold or domain or sub-domain
LELSVVKDHLELSPSALSKQV

SEQ ID NO: 10926 - protein, 25 aa, artificial
  peptide fold or domain or sub-domain
LELTPKNNIKANPRNFQTNLPTIYA

SEQ ID NO: 10927 - protein, 27 aa, artificial
  peptide fold or domain or sub-domain
LEMAFTFEQRERSRLRFPLPDGREAAF

SEQ ID NO: 10928 - protein, 27 aa, artificial
  peptide fold or domain or sub-domain
LEMNTLGQLSIENGRKFENLLQVVDHY

SEQ ID NO: 10929 - protein, 20 aa, artificial
  peptide fold or domain or sub-domain
LEMTLLALGYTQTEIQQAIA

SEQ ID NO: 10930 - protein, 24 aa, artificial
  peptide fold or domain or sub-domain
LENIVKGPIKVQKRPRAEAEAQAL

SEQ ID NO: 10931 - protein, 23 aa, artificial
  peptide fold or domain or sub-domain
LENLRIAMSLNFSDEYLSTHKDE

SEQ ID NO: 10932 - protein, 24 aa, artificial
  peptide fold or domain or sub-domain
LENLTIGPVKLLGRSKEQAEKKAM

SEQ ID NO: 10933 - protein, 24 aa, artificial
  peptide fold or domain or sub-domain
LENLVEAPVVVGGITRDAAERIAR

SEQ ID NO: 10934 - protein, 29 aa, artificial
  peptide fold or domain or sub-domain
LENPVIPNIEYSDEYLRKYTHFRFRNKQF

SEQ ID NO: 10935 - protein, 25 aa, artificial
  peptide fold or domain or sub-domain
LENTVKYLCEYDSIDKVRNSFFKNL

SEQ ID NO: 10936 - protein, 24 aa, artificial
  peptide fold or domain or sub-domain
LENVALSLIKIQKWEKNHAYDYSI

SEQ ID NO: 10937 - protein, 24 aa, artificial
  peptide fold or domain or sub-domain
LENVMEAPIQVLGLSKHDARERAL

SEQ ID NO: 10938 - protein, 24 aa, artificial
  peptide fold or domain or sub-domain
LENVREALVSVKKMPRHEADIIAK

SEQ ID NO: 10939 - protein, 24 aa, artificial
  peptide fold or domain or sub-domain
LENVSDKIKNCELNTKRFPGAVYR

SEQ ID NO: 10940 - protein, 24 aa, artificial
  peptide fold or domain or sub-domain
LENVTLAPMRVRRWPREKAEKKAL

SEQ ID NO: 10941 - protein, 21 aa, artificial
  peptide fold or domain or sub-domain
LEPGTPAAGYESLGISAPFTR

SEQ ID NO: 10942 - protein, 27 aa, artificial
  peptide fold or domain or sub-domain
LEPIGLKMGLNTETASSLWKDQVLIEA

SEQ ID NO: 10943 - protein, 30 aa, artificial
  peptide fold or domain or sub-domain
LEPMQLKPKEWPAALARLSLFIKVPADKLE

SEQ ID NO: 10944 - protein, 20 aa, artificial
  peptide fold or domain or sub-domain
LEPSDFRRCGFTSRKGEYIR

SEQ ID NO: 10945 - protein, 25 aa, artificial
  peptide fold or domain or sub-domain
LEPVYNEKGEIKVFRCSNPACDYEE

SEQ ID NO: 10946 - protein, 20 aa, artificial
  peptide fold or domain or sub-domain
LEPVYRAGETYCIPPDISRD

SEQ ID NO: 10947 - protein, 24 aa, artificial
  peptide fold or domain or sub-domain
LEQAKYNAAQAMVDIRFVRGDVHH

SEQ ID NO: 10948 - protein, 20 aa, artificial
  peptide fold or domain or sub-domain
LEQDDLSGRFKDESAKEGQR

SEQ ID NO: 10949 - protein, 22 aa, artificial
  peptide fold or domain or sub-domain
LEQFSRWNLPHEALQGILSWYG

SEQ ID NO: 10950 - protein, 25 aa, artificial
  peptide fold or domain or sub-domain
LEQKDYDWFESKYPGWNEKFGAFWR

SEQ ID NO: 10951 - protein, 24 aa, artificial
  peptide fold or domain or sub-domain
LEQLAERLTMAEYNPDQFPGLILR

SEQ ID NO: 10952 - protein, 28 aa, artificial
  peptide fold or domain or sub-domain
LEQMAQVVENPDSAYYHDRSLIDLVRKG

SEQ ID NO: 10953 - protein, 25 aa, artificial
  peptide fold or domain or sub-domain
LEQNRKQATTYEEFKTYLKQGGYVA

SEQ ID NO: 10954 - protein, 23 aa, artificial
  peptide fold or domain or sub-domain
LEQSDFYHKDRLGLKMLHNAGRI

SEQ ID NO: 10955 - protein, 29 aa, artificial
  peptide fold or domain or sub-domain
LEQSKVSSESIKNLQIGNFDDDERLKEYL

SEQ ID NO: 10956 - protein, 27 aa, artificial
  peptide fold or domain or sub-domain
LEQVHGKDVLKLTGEPYASKRADASYS

SEQ ID NO: 10957 - protein, 27 aa, artificial
  peptide fold or domain or sub-domain
LEQVHGNEVVTITSVDEQARVADASIT

SEQ ID NO: 10958 - protein, 27 aa, artificial
  peptide fold or domain or sub-domain
LEQVHGTEIVPAVDSLQAPCRADASWT

SEQ ID NO: 10959 - protein, 21 aa, artificial
  peptide fold or domain or sub-domain
LERAQGDYQRYRGTALEASAR

SEQ ID NO: 10960 - protein, 23 aa, artificial
  peptide fold or domain or sub-domain
LEREAGEFFSSSAVTTRQISLAQ

SEQ ID NO: 10961 - protein, 25 aa, artificial
  peptide fold or domain or sub-domain
LEREDAYVEKFDIVRDKKSIRETVQ

SEQ ID NO: 10962 - protein, 21 aa, artificial
  peptide fold or domain or sub-domain
LERHEDEEEISRRGLDGPFYT

SEQ ID NO: 10963 - protein, 23 aa, artificial
  peptide fold or domain or sub-domain
LERKPSKIWKGVNGEEITTTFWA

SEQ ID NO: 10964 - protein, 23 aa, artificial
  peptide fold or domain or sub-domain
LERLITLGKAHHLDAHYITRLFQ

SEQ ID NO: 10965 - protein, 27 aa, artificial
  peptide fold or domain or sub-domain
LERQDTCKDLIDPCTSEKVSLTDMVQR

SEQ ID NO: 10966 - protein, 26 aa, artificial
  peptide fold or domain or sub-domain
LESALSLIWQGKSGAYDYSDLLPLKG

SEQ ID NO: 10967 - protein, 24 aa, artificial
  peptide fold or domain or sub-domain
LESCRIRCKERGLHLNLYEGSLQQ

SEQ ID NO: 10968 - protein, 26 aa, artificial
  peptide fold or domain or sub-domain
LESESKELDETQSKLDDESKELDATE

SEQ ID NO: 10969 - protein, 30 aa, artificial
  peptide fold or domain or sub-domain
LESFISPTLLSNMREKDLRKAISYHLKKIQ

SEQ ID NO: 10970 - protein, 28 aa, artificial
  peptide fold or domain or sub-domain
LESHDMGYQTMRVPWSPENALQQPYLRR

SEQ ID NO: 10971 - protein, 20 aa, artificial
  peptide fold or domain or sub-domain
LESLGVWSSVEGKVAQAENV

SEQ ID NO: 10972 - protein, 27 aa, artificial
  peptide fold or domain or sub-domain
LESLLIEKGLVDPAAMDLVVQTYEHKV

SEQ ID NO: 10973 - protein, 24 aa, artificial
  peptide fold or domain or sub-domain
LESLTPIASIHDRISRWKALTGKS

SEQ ID NO: 10974 - protein, 25 aa, artificial
  peptide fold or domain or sub-domain
LESMEESGLIDLRPKQEASALRREL

SEQ ID NO: 10975 - protein, 27 aa, artificial
  peptide fold or domain or sub-domain
LESMLIEQGILTTSMIDRMAEIYENEV

SEQ ID NO: 10976 - protein, 25 aa, artificial
  peptide fold or domain or sub-domain
LESNHERGGFQQFPKKEAAVARKQL

SEQ ID NO: 10977 - protein, 23 aa, artificial
  peptide fold or domain or sub-domain
LESVSAQGQKAGIGGNYGEEFFQ

SEQ ID NO: 10978 - protein, 24 aa, artificial
  peptide fold or domain or sub-domain
LETAQEARRAIKEGDLRDDIDPDV

SEQ ID NO: 10979 - protein, 25 aa, artificial
  peptide fold or domain or sub-domain
LETATDLLRMLSGELPPAAHAAALN

SEQ ID NO: 10980 - protein, 25 aa, artificial
  peptide fold or domain or sub-domain
LETDCPFLPPQPFRGKRNEPKYLKY

SEQ ID NO: 10981 - protein, 22 aa, artificial
  peptide fold or domain or sub-domain
LETIKEALGDTFNEELRLAWTA

SEQ ID NO: 10982 - protein, 27 aa, artificial
  peptide fold or domain or sub-domain
LETIKKQITDFGEKIAEGDFSTIMQWL

SEQ ID NO: 10983 - protein, 29 aa, artificial
  peptide fold or domain or sub-domain
LETMRQLRSRVLKDRELCSGPSKLCQALA

SEQ ID NO: 10984 - protein, 26 aa, artificial
  peptide fold or domain or sub-domain
LETPVSSLLNLLDGKNDEIPNIIQQL

SEQ ID NO: 10985 - protein, 23 aa, artificial
  peptide fold or domain or sub-domain
LETRRQWAAEQGMDADDTEDVFR

SEQ ID NO: 10986 - protein, 20 aa, artificial
  peptide fold or domain or sub-domain
LETYCKQKYPEQQGRFAKLL

SEQ ID NO: 10987 - protein, 23 aa, artificial
  peptide fold or domain or sub-domain
LETYCNQTNKYHKTEFQIAHKRL

SEQ ID NO: 10988 - protein, 24 aa, artificial
  peptide fold or domain or sub-domain
LEVARGKAQRTGSRVTFYQHDISN

SEQ ID NO: 10989 - protein, 20 aa, artificial
  peptide fold or domain or sub-domain
LEVEDNDGRYPNTEIKQMVF

SEQ ID NO: 10990 - protein, 22 aa, artificial
  peptide fold or domain or sub-domain
LEVLRQALGKQYTPEVAEAWNK

SEQ ID NO: 10991 - protein, 26 aa, artificial
  peptide fold or domain or sub-domain
LEVNGNHAIKISDNLGKNMGDPATVK

SEQ ID NO: 10992 - protein, 20 aa, artificial
  peptide fold or domain or sub-domain
LEVNPVIPLKSTDQGLALAL

SEQ ID NO: 10993 - protein, 29 aa, artificial
  peptide fold or domain or sub-domain
LEVRIATLGHLQRGGAPSFLDRLIGLRMG

SEQ ID NO: 10994 - protein, 24 aa, artificial
  peptide fold or domain or sub-domain
LEVRVREDKVLFIVESVVLRRYLL

SEQ ID NO: 10995 - protein, 22 aa, artificial
  peptide fold or domain or sub-domain
LEVVAEEFASDFPPETQRAWAK

SEQ ID NO: 10996 - protein, 20 aa, artificial
  peptide fold or domain or sub-domain
LEVVEEVEDPATQISLEEAK

SEQ ID NO: 10997 - protein, 30 aa, artificial
  peptide fold or domain or sub-domain
LEVWYVNGKVKTPLPKEDIGKLYSGDCYLV

SEQ ID NO: 10998 - protein, 26 aa, artificial
  peptide fold or domain or sub-domain
LEWDAKYMYFYMDNRLTQIMHVGFKA

SEQ ID NO: 10999 - protein, 26 aa, artificial
  peptide fold or domain or sub-domain
LEWNEDVIRFFIDGFMFREVENTHWH

SEQ ID NO: 11000 - protein, 26 aa, artificial
  peptide fold or domain or sub-domain
LEWNEKRMRVYVDDPRYTLSYFEFPK

SEQ ID NO: 11001 - protein, 26 aa, artificial
  peptide fold or domain or sub-domain
LEWSKDNTSFYIDDILVVSQDMSSCN

SEQ ID NO: 11002 - protein, 26 aa, artificial
  peptide fold or domain or sub-domain
LEWTPDVVRWQVDGVTVREDFATDSQ

SEQ ID NO: 11003 - protein, 26 aa, artificial
  peptide fold or domain or sub-domain
LEWTPSELSISVNDNTYFTMDITDPN

SEQ ID NO: 11004 - protein, 25 aa, artificial
  peptide fold or domain or sub-domain
LEYESRRAQKFLHVSSLPKLRKECE

SEQ ID NO: 11005 - protein, 26 aa, artificial
  peptide fold or domain or sub-domain
LEYGLSNHPEPEHNAIVRVDFDDPRI

SEQ ID NO: 11006 - protein, 26 aa, artificial
  peptide fold or domain or sub-domain
LEYLMSQLNTGTITNSKNMSYWTTTR

SEQ ID NO: 11007 - protein, 29 aa, artificial
  peptide fold or domain or sub-domain
LFAALVVPIFTSTDTTVLRRAQKELTQLL

SEQ ID NO: 11008 - protein, 24 aa, artificial
  peptide fold or domain or sub-domain
LFADMCRAALQGDIALARELNDRL

SEQ ID NO: 11009 - protein, 26 aa, artificial
  peptide fold or domain or sub-domain
LFADMCRAALQGDIALARELNDRLIP

SEQ ID NO: 11010 - protein, 23 aa, artificial
  peptide fold or domain or sub-domain
LFAEQNLTERPKLVEEVYGWMSA

SEQ ID NO: 11011 - protein, 22 aa, artificial
  peptide fold or domain or sub-domain
LFAFVQDLHQAGIFTDSDLPDF

SEQ ID NO: 11012 - protein, 22 aa, artificial
  peptide fold or domain or sub-domain
LFAMGSEEGGSERNVQLGGSFI

SEQ ID NO: 11013 - protein, 28 aa, artificial
  peptide fold or domain or sub-domain
LFAPNLLLDRNQGKCVEGMVEIFDMLLA

SEQ ID NO: 11014 - protein, 20 aa, artificial
  peptide fold or domain or sub-domain
LFAQNPKLKRTEVEDMLKKT

SEQ ID NO: 11015 - protein, 22 aa, artificial
  peptide fold or domain or sub-domain
LFAYMSNTQNSIDASLRVSSLL

SEQ ID NO: 11016 - protein, 30 aa, artificial
  peptide fold or domain or sub-domain
LFDGLRVKRMNSSKTLPSFFTNEKRARSFG

SEQ ID NO: 11017 - protein, 21 aa, artificial
  peptide fold or domain or sub-domain
LFDLISYSPFEDLMNFPFPKN

SEQ ID NO: 11018 - protein, 25 aa, artificial
  peptide fold or domain or sub-domain
LFDSVAMQYNVLKTAISGKQGLGAS

SEQ ID NO: 11019 - protein, 28 aa, artificial
  peptide fold or domain or sub-domain
LFEAIQNAIKTSKCFSIAANRYHNGFDE

SEQ ID NO: 11020 - protein, 25 aa, artificial
  peptide fold or domain or sub-domain
LFEEALNSPDPKEGLRTLIDPKLGE

SEQ ID NO: 11021 - protein, 26 aa, artificial
  peptide fold or domain or sub-domain
LFEGKDGVTVTSKSENGKHTVTFTLA

SEQ ID NO: 11022 - protein, 20 aa, artificial
  peptide fold or domain or sub-domain
LFEKFKDDINAAFGSLDVLK

SEQ ID NO: 11023 - protein, 21 aa, artificial
  peptide fold or domain or sub-domain
LFELIEYRRTFGEMGGAVKAM

SEQ ID NO: 11024 - protein, 26 aa, artificial
  peptide fold or domain or sub-domain
LFETKVFDIKGERLRVIAVPYLYLER

SEQ ID NO: 11025 - protein, 20 aa, artificial
  peptide fold or domain or sub-domain
LFETVHGGASVGFMADLDMQ

SEQ ID NO: 11026 - protein, 21 aa, artificial
  peptide fold or domain or sub-domain
LFFLPEFGLTMAEIPAEKKNE

SEQ ID NO: 11027 - protein, 21 aa, artificial
  peptide fold or domain or sub-domain
LFFSPEVNCTFAELATSEKKK

SEQ ID NO: 11028 - protein, 21 aa, artificial
  peptide fold or domain or sub-domain
LFIDPQSGLHSAQLSRDEKNA

SEQ ID NO: 11029 - protein, 25 aa, artificial
  peptide fold or domain or sub-domain
LFIEDIEKDPRFGRRNISQYNNKSL

SEQ ID NO: 11030 - protein, 23 aa, artificial
  peptide fold or domain or sub-domain
LFIGFPNSMESTTVPSAGFDFST

SEQ ID NO: 11031 - protein, 23 aa, artificial
  peptide fold or domain or sub-domain
LFIGTGREIDQRALAAKPYRQAT

SEQ ID NO: 11032 - protein, 20 aa, artificial
  peptide fold or domain or sub-domain
LFIPDEAAAAACQSVLGRAC

SEQ ID NO: 11033 - protein, 25 aa, artificial
  peptide fold or domain or sub-domain
LFLAQEIIRKKRDGHALSDEEIRFF

SEQ ID NO: 11034 - protein, 22 aa, artificial
  peptide fold or domain or sub-domain
LFLEFLSESPDGQRCLAAFEEF

SEQ ID NO: 11035 - protein, 25 aa, artificial
  peptide fold or domain or sub-domain
LFLGGPPLVKMATGEESTAEELGGA

SEQ ID NO: 11036 - protein, 30 aa, artificial
  peptide fold or domain or sub-domain
LFLKLVIQGVIGLSNKSKETLVSDLKKNNI

SEQ ID NO: 11037 - protein, 26 aa, artificial
  peptide fold or domain or sub-domain
LFLTVHSDAEMVNQVFSIGADDFVSK

SEQ ID NO: 11038 - protein, 26 aa, artificial
  peptide fold or domain or sub-domain
LFMIKKELGFGVVRKQDSVRNTRCYR

SEQ ID NO: 11039 - protein, 28 aa, artificial
  peptide fold or domain or sub-domain
LFNDMMRKVKTLSSYTGRDQGFLNSYYP

SEQ ID NO: 11040 - protein, 29 aa, artificial
  peptide fold or domain or sub-domain
LFNFYKDEQERFTREEERQAQHILLEDKS

SEQ ID NO: 11041 - protein, 29 aa, artificial
  peptide fold or domain or sub-domain
LFNSLMPQVDLSTPDGRARLSTLALPLIS

SEQ ID NO: 11042 - protein, 21 aa, artificial
  peptide fold or domain or sub-domain
LFNTSKGILDHKECLTENVGG

SEQ ID NO: 11043 - protein, 25 aa, artificial
  peptide fold or domain or sub-domain
LFQEEYRSRRYLGPSTNDLLIDSCE

SEQ ID NO: 11044 - protein, 22 aa, artificial
  peptide fold or domain or sub-domain
LFQIVKELHPIYSASSRFGNLL

SEQ ID NO: 11045 - protein, 22 aa, artificial
  peptide fold or domain or sub-domain
LFQLLMENSEPITAASRLAQIL

SEQ ID NO: 11046 - protein, 21 aa, artificial
  peptide fold or domain or sub-domain
LFQPEGEARTFAQMAPHEKDA

SEQ ID NO: 11047 - protein, 27 aa, artificial
  peptide fold or domain or sub-domain
LFRALDGKGLVPDGYVEGWKKTFEEDF

SEQ ID NO: 11048 - protein, 29 aa, artificial
  peptide fold or domain or sub-domain
LFRDGRPVEAILGQTSNGRQLLTVDDWAD

SEQ ID NO: 11049 - protein, 21 aa, artificial
  peptide fold or domain or sub-domain
LFREKTLARPDGEAVYKHEIL

SEQ ID NO: 11050 - protein, 22 aa, artificial
  peptide fold or domain or sub-domain
LFRHLQKAYNPQAASERYASII

SEQ ID NO: 11051 - protein, 23 aa, artificial
  peptide fold or domain or sub-domain
LFRNVEGTWLWINNSPVSFVNWN

SEQ ID NO: 11052 - protein, 24 aa, artificial
  peptide fold or domain or sub-domain
LFSALAAATKAMKGNIEKLSDIRE

SEQ ID NO: 11053 - protein, 20 aa, artificial
  peptide fold or domain or sub-domain
LFSANPDWSAAQVAETIRTN

SEQ ID NO: 11054 - protein, 20 aa, artificial
  peptide fold or domain or sub-domain
LFSEIQERFPAEYRLRGEDI

SEQ ID NO: 11055 - protein, 22 aa, artificial
  peptide fold or domain or sub-domain
LFSHLIATFGTAEATSRFAHLL

SEQ ID NO: 11056 - protein, 22 aa, artificial
  peptide fold or domain or sub-domain
LFSIVKEVRLSPTPNVCYGHIL

SEQ ID NO: 11057 - protein, 24 aa, artificial
  peptide fold or domain or sub-domain
LFSSVLAAAQALNGNIENLAEAEA

SEQ ID NO: 11058 - protein, 22 aa, artificial
  peptide fold or domain or sub-domain
LFTAGCVTVEEDGVREIYAGAL

SEQ ID NO: 11059 - protein, 22 aa, artificial
  peptide fold or domain or sub-domain
LFTCITQKIGIPTGVQKYGSLL

SEQ ID NO: 11060 - protein, 28 aa, artificial
  peptide fold or domain or sub-domain
LFTMAKAYRLRDGNLENNQLMLNDIMTA

SEQ ID NO: 11061 - protein, 28 aa, artificial
  peptide fold or domain or sub-domain
LFTMAQAYQLPKSDLYQSVELLDVITEG

SEQ ID NO: 11062 - protein, 26 aa, artificial
  peptide fold or domain or sub-domain
LFTSGYTDNAIVHSGRLDEGIELLSK

SEQ ID NO: 11063 - protein, 29 aa, artificial
  peptide fold or domain or sub-domain
LFVASSIDTEIELSKRGFKVLSLFSAIQP

SEQ ID NO: 11064 - protein, 23 aa, artificial
  peptide fold or domain or sub-domain
LFVGAQDRMEMEKVPQAGYEIKG

SEQ ID NO: 11065 - protein, 23 aa, artificial
  peptide fold or domain or sub-domain
LFVGTEKGLEKELVPREGFELVT

SEQ ID NO: 11066 - protein, 23 aa, artificial
  peptide fold or domain or sub-domain
LFVGTKRKMDAETLERYGFKGVA

SEQ ID NO: 11067 - protein, 23 aa, artificial
  peptide fold or domain or sub-domain
LFVGTWKGIEARVLPKTGYRLEC

SEQ ID NO: 11068 - protein, 21 aa, artificial
  peptide fold or domain or sub-domain
LFVIPEYHKTFGELNLTVKRA

SEQ ID NO: 11069 - protein, 22 aa, artificial
  peptide fold or domain or sub-domain
LFVIRNDGKRIALQFVRRSADI

SEQ ID NO: 11070 - protein, 21 aa, artificial
  peptide fold or domain or sub-domain
LFVKNDYEKSFAEIDEAVKNR

SEQ ID NO: 11071 - protein, 23 aa, artificial
  peptide fold or domain or sub-domain
LFVSSDQKLSWLGKTPVNYVAWA

SEQ ID NO: 11072 - protein, 21 aa, artificial
  peptide fold or domain or sub-domain
LFWLSELKMSSAEMSKEEKNK

SEQ ID NO: 11073 - protein, 21 aa, artificial
  peptide fold or domain or sub-domain
LFYCPELDKVFAEASAEEKAS

SEQ ID NO: 11074 - protein, 30 aa, artificial
  peptide fold or domain or sub-domain
LFYDPYLSDGVERALGLQRVSTLQDLLFHS

SEQ ID NO: 11075 - protein, 21 aa, artificial
  peptide fold or domain or sub-domain
LFYPEGMDKSFGELSTSEKNR

SEQ ID NO: 11076 - protein, 27 aa, artificial
  peptide fold or domain or sub-domain
LGAALKFLGYSANTTQLQQIDQAAQVL

SEQ ID NO: 11077 - protein, 27 aa, artificial
  peptide fold or domain or sub-domain
LGACLKKLSLSFNATDPAQLQRAEHEA

SEQ ID NO: 11078 - protein, 23 aa, artificial
  peptide fold or domain or sub-domain
LGACYENGYGVKQNRSSAIELYR

SEQ ID NO: 11079 - protein, 24 aa, artificial
  peptide fold or domain or sub-domain
LGACYENGYGVKQNRSSAIELYRM

SEQ ID NO: 11080 - protein, 27 aa, artificial
  peptide fold or domain or sub-domain
LGADEMYALGMHSFLSVSKGSDEPEKL

SEQ ID NO: 11081 - protein, 24 aa, artificial
  peptide fold or domain or sub-domain
LGADQVGSLLSSGRATGTLVPVLG

SEQ ID NO: 11082 - protein, 23 aa, artificial
  peptide fold or domain or sub-domain
LGAELAAQEGQSAAALAACRTLA

SEQ ID NO: 11083 - protein, 28 aa, artificial
  peptide fold or domain or sub-domain
LGAHTFGFAWDCVAEDAIERLAAAGYRT

SEQ ID NO: 11084 - protein, 28 aa, artificial
  peptide fold or domain or sub-domain
LGANLWNSFPRVPFTDILDVMKDTGFIG

SEQ ID NO: 11085 - protein, 27 aa, artificial
  peptide fold or domain or sub-domain
LGATNPANALAGTLRADYADSLTENGT

SEQ ID NO: 11086 - protein, 20 aa, artificial
  peptide fold or domain or sub-domain
LGCQYEPFMPEHCRREYVSL

SEQ ID NO: 11087 - protein, 28 aa, artificial
  peptide fold or domain or sub-domain
LGCSVRNAHRSARKVARYVTFRSGGRGA

SEQ ID NO: 11088 - protein, 27 aa, artificial
  peptide fold or domain or sub-domain
LGCVFPELLARNGVKFGEAVWFKAGSQ

SEQ ID NO: 11089 - protein, 24 aa, artificial
  peptide fold or domain or sub-domain
LGDDVEGTKFKEYFYHDPKTPEDR

SEQ ID NO: 11090 - protein, 24 aa, artificial
  peptide fold or domain or sub-domain
LGDFYENGKYVKKDLRKAAQYYSK

SEQ ID NO: 11091 - protein, 28 aa, artificial
  peptide fold or domain or sub-domain
LGDKSDNDIDGDGVTNGPFTSGNYNDPS

SEQ ID NO: 11092 - protein, 26 aa, artificial
  peptide fold or domain or sub-domain
LGDLENPPKYSTIYSDELGVSLPVFK

SEQ ID NO: 11093 - protein, 25 aa, artificial
  peptide fold or domain or sub-domain
LGDMEGMKFEEAEKKFPEQMNNFWH

SEQ ID NO: 11094 - protein, 27 aa, artificial
  peptide fold or domain or sub-domain
LGDNWKQELTKFISPDQLPVEFGGTMT

SEQ ID NO: 11095 - protein, 25 aa, artificial
  peptide fold or domain or sub-domain
LGDPPDYEQPPENALGPQARKQGRK

SEQ ID NO: 11096 - protein, 26 aa, artificial
  peptide fold or domain or sub-domain
LGDQELLHTYPGNVSTIQGRDGRKNV

SEQ ID NO: 11097 - protein, 28 aa, artificial
  peptide fold or domain or sub-domain
LGDSKQYLVRSRLSPLVTKFKLASLSDL

SEQ ID NO: 11098 - protein, 28 aa, artificial
  peptide fold or domain or sub-domain
LGDVCDPDIDNDGVLNEADNCDNTVAGA

SEQ ID NO: 11099 - protein, 25 aa, artificial
  peptide fold or domain or sub-domain
LGDWEGHLYDEIAARHPELHGQFWS

SEQ ID NO: 11100 - protein, 25 aa, artificial
  peptide fold or domain or sub-domain
LGDWEGKTHDEIRQMDPIAFDHFWN

SEQ ID NO: 11101 - protein, 30 aa, artificial
  peptide fold or domain or sub-domain
LGDWEGKTHDEIRQMDPIAFDHFWQAPHLY

SEQ ID NO: 11102 - protein, 23 aa, artificial
  peptide fold or domain or sub-domain
LGDYHYYGLGTSVDFETAASHYR

SEQ ID NO: 11103 - protein, 24 aa, artificial
  peptide fold or domain or sub-domain
LGDYHYYGLGTSVDFETAASHYRM

SEQ ID NO: 11104 - protein, 21 aa, artificial
  peptide fold or domain or sub-domain
LGEAGFPDDGDTSQGIKEPIG

SEQ ID NO: 11105 - protein, 22 aa, artificial
  peptide fold or domain or sub-domain
LGEKAAEYADEDGRKTVQGEDV

SEQ ID NO: 11106 - protein, 27 aa, artificial
  peptide fold or domain or sub-domain
LGEKELKKLGMGALLGVAQGSVRPPRL

SEQ ID NO: 11107 - protein, 24 aa, artificial
  peptide fold or domain or sub-domain
LGELPAAPAWLKRHSLPASDYVLP

SEQ ID NO: 11108 - protein, 22 aa, artificial
  peptide fold or domain or sub-domain
LGEMERDALLGHGCIFLLHEKM

SEQ ID NO: 11109 - protein, 28 aa, artificial
  peptide fold or domain or sub-domain
LGEMERDCLIGYGASMLLLERLMISSDA

SEQ ID NO: 11110 - protein, 22 aa, artificial
  peptide fold or domain or sub-domain
LGEMEVWALEAFGASYTLQELL

SEQ ID NO: 11111 - protein, 30 aa, artificial
  peptide fold or domain or sub-domain
LGEMPGYLADIRAGRVTSQAILDEITNNYR

SEQ ID NO: 11112 - protein, 23 aa, artificial
  peptide fold or domain or sub-domain
LGEQLQQLEVPAQTRITWLEGLA

SEQ ID NO: 11113 - protein, 29 aa, artificial
  peptide fold or domain or sub-domain
LGETILWLSAHPAVVRAFLAAAFHNPEPY

SEQ ID NO: 11114 - protein, 26 aa, artificial
  peptide fold or domain or sub-domain
LGFDGGDFPPREQIGGKGWSIAHMSA

SEQ ID NO: 11115 - protein, 27 aa, artificial
  peptide fold or domain or sub-domain
LGFIVQEFVHLPGQVFSNKVAVDAFFQ

SEQ ID NO: 11116 - protein, 23 aa, artificial
  peptide fold or domain or sub-domain
LGFMYATGIGFNVSQAKALVYYT

SEQ ID NO: 11117 - protein, 24 aa, artificial
  peptide fold or domain or sub-domain
LGFMYATGIGFNVSQAKALVYYTM

SEQ ID NO: 11118 - protein, 28 aa, artificial
  peptide fold or domain or sub-domain
LGFNEATCMRNSTLAQDVVLAERFGYDY

SEQ ID NO: 11119 - protein, 28 aa, artificial
  peptide fold or domain or sub-domain
LGFPGHIATDADAPSPFAALGNILKEAA

SEQ ID NO: 11120 - protein, 26 aa, artificial
  peptide fold or domain or sub-domain
LGFTDPLATELATSGGKGASLAKSAQ

SEQ ID NO: 11121 - protein, 26 aa, artificial
  peptide fold or domain or sub-domain
LGFTLLRENLYTLCGPEEYELAKMLT

SEQ ID NO: 11122 - protein, 25 aa, artificial
  peptide fold or domain or sub-domain
LGGGRTAQKEDSLFLFKSKFSKKTL

SEQ ID NO: 11123 - protein, 25 aa, artificial
  peptide fold or domain or sub-domain
LGGGTDSEKNNPLLFFKSGFSAATY

SEQ ID NO: 11124 - protein, 25 aa, artificial
  peptide fold or domain or sub-domain
LGGGTTRNEDDSLLAYKRSFSNRQT

SEQ ID NO: 11125 - protein, 25 aa, artificial
  peptide fold or domain or sub-domain
LGGIESESTDDSLYVFKHVFVKDAP

SEQ ID NO: 11126 - protein, 24 aa, artificial
  peptide fold or domain or sub-domain
LGGQCGHCDYCRRGDFVNCLDQPL

SEQ ID NO: 11127 - protein, 22 aa, artificial
  peptide fold or domain or sub-domain
LGGTFFEYMIYRHSFDEFLRRI

SEQ ID NO: 11128 - protein, 27 aa, artificial
  peptide fold or domain or sub-domain
LGGTFFEYMIYRHSFDEFLRRIESFGL

SEQ ID NO: 11129 - protein, 22 aa, artificial
  peptide fold or domain or sub-domain
LGGTLFEICATEGYYQQLLDYI

SEQ ID NO: 11130 - protein, 27 aa, artificial
  peptide fold or domain or sub-domain
LGGTLFEICATEGYYQQLLDYIVEKEL

SEQ ID NO: 11131 - protein, 22 aa, artificial
  peptide fold or domain or sub-domain
LGGTLLEVCAAQGRIPELTRWA

SEQ ID NO: 11132 - protein, 27 aa, artificial
  peptide fold or domain or sub-domain
LGGTLLEVCAAQGRIPELTRWAHRIGV

SEQ ID NO: 11133 - protein, 22 aa, artificial
  peptide fold or domain or sub-domain
LGGYSLGIDEKIRRLRNDGIEI

SEQ ID NO: 11134 - protein, 23 aa, artificial
  peptide fold or domain or sub-domain
LGHLYQTGKGVKKNHQLAFSWIR

SEQ ID NO: 11135 - protein, 30 aa, artificial
  peptide fold or domain or sub-domain
LGHRGYSAKYLENTLEAFMKAIEAGANGVE

SEQ ID NO: 11136 - protein, 26 aa, artificial
  peptide fold or domain or sub-domain
LGHTSQEVGEALENDPAKAEQIFSAL

SEQ ID NO: 11137 - protein, 26 aa, artificial
  peptide fold or domain or sub-domain
LGIDATELVKKKEQKSEVANQIMNNT

SEQ ID NO: 11138 - protein, 29 aa, artificial
  peptide fold or domain or sub-domain
LGIDIFPSTSKSQKLIEKKEKNSLIGHSN

SEQ ID NO: 11139 - protein, 23 aa, artificial
  peptide fold or domain or sub-domain
LGIIIWRSFDDKIRSSVASNLID

SEQ ID NO: 11140 - protein, 30 aa, artificial
  peptide fold or domain or sub-domain
LGIKEADGSIAALHSVNDLDVTKFADNAAD

SEQ ID NO: 11141 - protein, 23 aa, artificial
  peptide fold or domain or sub-domain
LGILYARGIGIEQNLAESYKWFS

SEQ ID NO: 11142 - protein, 23 aa, artificial
  peptide fold or domain or sub-domain
LGIMYLDGMGVNKDFAKAKYWIG

SEQ ID NO: 11143 - protein, 28 aa, artificial
  peptide fold or domain or sub-domain
LGINEKSLPFQMSWRDKLNLAKKHGFSF

SEQ ID NO: 11144 - protein, 27 aa, artificial
  peptide fold or domain or sub-domain
LGISLKRLGYSMNSKNKNEISKASSAL

SEQ ID NO: 11145 - protein, 28 aa, artificial
  peptide fold or domain or sub-domain
LGITVANGNAAVAAKAKWQTSRSGGNGA

SEQ ID NO: 11146 - protein, 23 aa, artificial
  peptide fold or domain or sub-domain
LGIYVYIKKRLLEANMKKDSEII

SEQ ID NO: 11147 - protein, 20 aa, artificial
  peptide fold or domain or sub-domain
LGKAIVKREGNSSQNWQRFY

SEQ ID NO: 11148 - protein, 28 aa, artificial
  peptide fold or domain or sub-domain
LGKEEGIGRVTISRLKSAGIETVEDLVL

SEQ ID NO: 11149 - protein, 25 aa, artificial
  peptide fold or domain or sub-domain
LGKEEIDRLEQSKNEAPHLREAQKT

SEQ ID NO: 11150 - protein, 20 aa, artificial
  peptide fold or domain or sub-domain
LGKEVAEVTATERRNAKAIN

SEQ ID NO: 11151 - protein, 25 aa, artificial
  peptide fold or domain or sub-domain
LGKIPLEEIEQKGIHEKIIKLRYKS

SEQ ID NO: 11152 - protein, 23 aa, artificial
  peptide fold or domain or sub-domain
LGKLVTHQLADGEIDRAELISTA

SEQ ID NO: 11153 - protein, 30 aa, artificial
  peptide fold or domain or sub-domain
LGKMEGMAFTDVEATYPAEFDAFRNHPDQY

SEQ ID NO: 11154 - protein, 23 aa, artificial
  peptide fold or domain or sub-domain
LGKMLDPGFVGDLFGPSGPSSAD

SEQ ID NO: 11155 - protein, 26 aa, artificial
  peptide fold or domain or sub-domain
LGKSAEEIARLSEYDKNEYNKIFDEV

SEQ ID NO: 11156 - protein, 26 aa, artificial
  peptide fold or domain or sub-domain
LGKTAQEIGLTMRDDSEAGTAIFQAA

SEQ ID NO: 11157 - protein, 29 aa, artificial
  peptide fold or domain or sub-domain
LGKTKVAEELVNGLRESKFADVKELKCYV

SEQ ID NO: 11158 - protein, 30 aa, artificial
  peptide fold or domain or sub-domain
LGKWEGMNHDLIDNYYKEEIDNFWNNPKLY

SEQ ID NO: 11159 - protein, 24 aa, artificial
  peptide fold or domain or sub-domain
LGLAREKAKSRGRNIRFFVGDAEN

SEQ ID NO: 11160 - protein, 23 aa, artificial
  peptide fold or domain or sub-domain
LGLAYEHGLGVPVDYEKSVYWNR

SEQ ID NO: 11161 - protein, 24 aa, artificial
  peptide fold or domain or sub-domain
LGLAYEHGLGVPVDYEKSVYWNRL

SEQ ID NO: 11162 - protein, 29 aa, artificial
  peptide fold or domain or sub-domain
LGLEDSVDNDPCKFVLSCRGSSERFTLQA

SEQ ID NO: 11163 - protein, 20 aa, artificial
  peptide fold or domain or sub-domain
LGLEKLTTCGLSKRKAEYVL

SEQ ID NO: 11164 - protein, 30 aa, artificial
  peptide fold or domain or sub-domain
LGLELRSAKGKNDGSVGDKRYFTCKPNHGV

SEQ ID NO: 11165 - protein, 23 aa, artificial
  peptide fold or domain or sub-domain
LGLLHRIAMVQLSPAALGNDMAA

SEQ ID NO: 11166 - protein, 23 aa, artificial
  peptide fold or domain or sub-domain
LGLLYADGKGITADKEKAILWSK

SEQ ID NO: 11167 - protein, 24 aa, artificial
  peptide fold or domain or sub-domain
LGLLYADGKGITADKEKAILWSKK

SEQ ID NO: 11168 - protein, 20 aa, artificial
  peptide fold or domain or sub-domain
LGLRTGDIREKLLQNELDIG

SEQ ID NO: 11169 - protein, 26 aa, artificial
  peptide fold or domain or sub-domain
LGLSRDDFNTFMPDYTMYDLVDGNPF

SEQ ID NO: 11170 - protein, 24 aa, artificial
  peptide fold or domain or sub-domain
LGLWYKYGHGGPISHTEAYKWLIK

SEQ ID NO: 11171 - protein, 26 aa, artificial
  peptide fold or domain or sub-domain
LGMAHIIANYPGMGNDITGMELLESM

SEQ ID NO: 11172 - protein, 27 aa, artificial
  peptide fold or domain or sub-domain
LGMALQTLGFDKNTKDPAQLAKARAKL

SEQ ID NO: 11173 - protein, 28 aa, artificial
  peptide fold or domain or sub-domain
LGMAVANAASFVREHAHGITRARGGEGA

SEQ ID NO: 11174 - protein, 24 aa, artificial
  peptide fold or domain or sub-domain
LGMKIVGDLYERNERFVTDMLKAA

SEQ ID NO: 11175 - protein, 27 aa, artificial
  peptide fold or domain or sub-domain
LGMLVQEVVHLPNAAFSEPNPLKAIYA

SEQ ID NO: 11176 - protein, 26 aa, artificial
  peptide fold or domain or sub-domain
LGMSRDDSGQFLPIYQQQEIFARNPF

SEQ ID NO: 11177 - protein, 26 aa, artificial
  peptide fold or domain or sub-domain
LGNASLHKILSQPTSSPKNMQVWDTV

SEQ ID NO: 11178 - protein, 27 aa, artificial
  peptide fold or domain or sub-domain
LGNDWKQHLKENIGEEVLFERWGGTRK

SEQ ID NO: 11179 - protein, 27 aa, artificial
  peptide fold or domain or sub-domain
LGNKYHSKLLEVIDASELPEFFGGACT

SEQ ID NO: 11180 - protein, 23 aa, artificial
  peptide fold or domain or sub-domain
LGNMYFSGIGVKRDFKMANKYFN

SEQ ID NO: 11181 - protein, 24 aa, artificial
  peptide fold or domain or sub-domain
LGNMYFSGIGVKRDFKMANKYFNL

SEQ ID NO: 11182 - protein, 28 aa, artificial
  peptide fold or domain or sub-domain
LGNPGQVASGSFSEAVNASNGQVRVWRS

SEQ ID NO: 11183 - protein, 28 aa, artificial
  peptide fold or domain or sub-domain
LGNVFDSNDDGDDFLDFEDQLPLDATEH

SEQ ID NO: 11184 - protein, 24 aa, artificial
  peptide fold or domain or sub-domain
LGNVIEAPMHVKRQSLREATERGR

SEQ ID NO: 11185 - protein, 22 aa, artificial
  peptide fold or domain or sub-domain
LGNVSEDGKHVICPCHNAKFEL

SEQ ID NO: 11186 - protein, 22 aa, artificial
  peptide fold or domain or sub-domain
LGPAATTLAIPAEWREAWGVRR

SEQ ID NO: 11187 - protein, 27 aa, artificial
  peptide fold or domain or sub-domain
LGPAESQREAPQSARTQGGTDGPRHSG

SEQ ID NO: 11188 - protein, 29 aa, artificial
  peptide fold or domain or sub-domain
LGPETVSMMQKHEAQGTYNHPEYLAAVTI

SEQ ID NO: 11189 - protein, 30 aa, artificial
  peptide fold or domain or sub-domain
LGPFAASVMKRPHLSFCGVDELAFVVCKLD

SEQ ID NO: 11190 - protein, 27 aa, artificial
  peptide fold or domain or sub-domain
LGPTDSKKGEPGKVRRIYGEDIMKNAA

SEQ ID NO: 11191 - protein, 23 aa, artificial
  peptide fold or domain or sub-domain
LGQALSPDFVQSVFGVQGLQQIA

SEQ ID NO: 11192 - protein, 23 aa, artificial
  peptide fold or domain or sub-domain
LGQASPPDLIQNLFNMPSLAHLQ

SEQ ID NO: 11193 - protein, 23 aa, artificial
  peptide fold or domain or sub-domain
LGQAVSPQIINDLYGVDNLEDLD

SEQ ID NO: 11194 - protein, 22 aa, artificial
  peptide fold or domain or sub-domain
LGQGVVDEGKMVCPWHGWQFDL

SEQ ID NO: 11195 - protein, 25 aa, artificial
  peptide fold or domain or sub-domain
LGQLDSIEAKWEKAGPEEQLEAAAI

SEQ ID NO: 11196 - protein, 23 aa, artificial
  peptide fold or domain or sub-domain
LGQMHAVGLGMMRSCPTAVELFK

SEQ ID NO: 11197 - protein, 24 aa, artificial
  peptide fold or domain or sub-domain
LGQMHAVGLGMMRSCPTAVELFKN

SEQ ID NO: 11198 - protein, 26 aa, artificial
  peptide fold or domain or sub-domain
LGQNAAYLGELKDKNEQAFEEVFQNA

SEQ ID NO: 11199 - protein, 27 aa, artificial
  peptide fold or domain or sub-domain
LGQQIQSPDLPAWEDNVGEWIEEMKEE

SEQ ID NO: 11200 - protein, 26 aa, artificial
  peptide fold or domain or sub-domain
LGQRWDKVFANEIGVEEFKLLAVETR

SEQ ID NO: 11201 - protein, 30 aa, artificial
  peptide fold or domain or sub-domain
LGQWQGKTGDEIKMLFPEQYGYYWNEPEKF

SEQ ID NO: 11202 - protein, 24 aa, artificial
  peptide fold or domain or sub-domain
LGRCEMVGKQFGVHKLWFRQMEID

SEQ ID NO: 11203 - protein, 28 aa, artificial
  peptide fold or domain or sub-domain
LGRFQKSGMLAVKGKYITIENNDALAQL

SEQ ID NO: 11204 - protein, 28 aa, artificial
  peptide fold or domain or sub-domain
LGRGYYWLGRAAEAGGGGNASSYYNQAA

SEQ ID NO: 11205 - protein, 23 aa, artificial
  peptide fold or domain or sub-domain
LGRLAGHRLFSGDESRWAMVELC

SEQ ID NO: 11206 - protein, 30 aa, artificial
  peptide fold or domain or sub-domain
LGRLVDLREEARRRGAGEEQEAIKWILVSG

SEQ ID NO: 11207 - protein, 23 aa, artificial
  peptide fold or domain or sub-domain
LGRLYKEGKGVNRNTTTAYNWYL

SEQ ID NO: 11208 - protein, 24 aa, artificial
  peptide fold or domain or sub-domain
LGRLYKEGKGVNRNTTTAYNWYLK

SEQ ID NO: 11209 - protein, 29 aa, artificial
  peptide fold or domain or sub-domain
LGRNTKIWDNIDEFRPERHLPADELSRVE

SEQ ID NO: 11210 - protein, 26 aa, artificial
  peptide fold or domain or sub-domain
LGRRARESGQEPGDWIAEQLGSGAVD

SEQ ID NO: 11211 - protein, 25 aa, artificial
  peptide fold or domain or sub-domain
LGRTCKPDGQWRRWNTREEAEARQR

SEQ ID NO: 11212 - protein, 30 aa, artificial
  peptide fold or domain or sub-domain
LGRYPVTSVRVNRLPDTEKEQGAFELSAQG

SEQ ID NO: 11213 - protein, 29 aa, artificial
  peptide fold or domain or sub-domain
LGSDASGNKRLTDIGLVIKKIVQDHLSKN

SEQ ID NO: 11214 - protein, 24 aa, artificial
  peptide fold or domain or sub-domain
LGSEKDLSELFEVSKQTLRETINA

SEQ ID NO: 11215 - protein, 22 aa, artificial
  peptide fold or domain or sub-domain
LGSIIENSGGQPRPDDFVVDNC

SEQ ID NO: 11216 - protein, 24 aa, artificial
  peptide fold or domain or sub-domain
LGSMKDMISHGVPLGSLDAAVDMV

SEQ ID NO: 11217 - protein, 28 aa, artificial
  peptide fold or domain or sub-domain
LGSRGYQTWVKARESGSYAAFSPVLTEW

SEQ ID NO: 11218 - protein, 27 aa, artificial
  peptide fold or domain or sub-domain
LGSSYQKELLKQIPAENLPVKFGGKSE

SEQ ID NO: 11219 - protein, 22 aa, artificial
  peptide fold or domain or sub-domain
LGSYLSTTGKRRRWGDYLEAAT

SEQ ID NO: 11220 - protein, 25 aa, artificial
  peptide fold or domain or sub-domain
LGTEWKFAQDHLHESSRDRLIKTCE

SEQ ID NO: 11221 - protein, 27 aa, artificial
  peptide fold or domain or sub-domain
LGTGGVLAPPRTATFHGRDLFAPAAIY

SEQ ID NO: 11222 - protein, 24 aa, artificial
  peptide fold or domain or sub-domain
LGTLHEKGLGASKDVDAARRYYMQ

SEQ ID NO: 11223 - protein, 29 aa, artificial
  peptide fold or domain or sub-domain
LGVAHQAKARELADKFGYVEPHLWTGIGR

SEQ ID NO: 11224 - protein, 26 aa, artificial
  peptide fold or domain or sub-domain
LGVDANTLMSLKEEDPNEFTKITQSI

SEQ ID NO: 11225 - protein, 28 aa, artificial
  peptide fold or domain or sub-domain
LGVEEVYRELLNRNVRISKATVYRSVEL

SEQ ID NO: 11226 - protein, 25 aa, artificial
  peptide fold or domain or sub-domain
LGVEGLSEYIKTIGLYNSKAKNVIE

SEQ ID NO: 11227 - protein, 24 aa, artificial
  peptide fold or domain or sub-domain
LGVEGVKTYIKTIGLYNSKAENII

SEQ ID NO: 11228 - protein, 20 aa, artificial
  peptide fold or domain or sub-domain
LGVENLASIIKNERKSEYLI

SEQ ID NO: 11229 - protein, 26 aa, artificial
  peptide fold or domain or sub-domain
LGVHPPQIRNPKLWPSKPARFSESLE

SEQ ID NO: 11230 - protein, 23 aa, artificial
  peptide fold or domain or sub-domain
LGVLYMTGDPSIQDGKKAIYWYE

SEQ ID NO: 11231 - protein, 24 aa, artificial
  peptide fold or domain or sub-domain
LGVLYMTGDPSIQDGKKAIYWYEK

SEQ ID NO: 11232 - protein, 24 aa, artificial
  peptide fold or domain or sub-domain
LGVMYDKGEGVTKDAKEAVKWYRK

SEQ ID NO: 11233 - protein, 23 aa, artificial
  peptide fold or domain or sub-domain
LGVMYNNGEGVTKDAKEAVKWYR

SEQ ID NO: 11234 - protein, 29 aa, artificial
  peptide fold or domain or sub-domain
LGVNRVARELGIKPPAIYKHLDGNLALRR

SEQ ID NO: 11235 - protein, 27 aa, artificial
  peptide fold or domain or sub-domain
LGVTAIERAGSDWRVRTDARDFVVPTV

SEQ ID NO: 11236 - protein, 26 aa, artificial
  peptide fold or domain or sub-domain
LGVTQKIENYPGVPGPLSGYELLKIM

SEQ ID NO: 11237 - protein, 26 aa, artificial
  peptide fold or domain or sub-domain
LGVVDEMDKRTMVRALDLGVNDVISR

SEQ ID NO: 11238 - protein, 29 aa, artificial
  peptide fold or domain or sub-domain
LGVVTSYQSEMLAIDAGIRLTTLSQDPEL

SEQ ID NO: 11239 - protein, 30 aa, artificial
  peptide fold or domain or sub-domain
LGVWTKHTSKRIIQDCVAIGKEEGNWLVKP

SEQ ID NO: 11240 - protein, 27 aa, artificial
  peptide fold or domain or sub-domain
LGWVFPEFWHLPSEVFSNTSPLAALGQ

SEQ ID NO: 11241 - protein, 25 aa, artificial
  peptide fold or domain or sub-domain
LGYAGNLESEKELLEFFQQIPASKL

SEQ ID NO: 11242 - protein, 29 aa, artificial
  peptide fold or domain or sub-domain
LGYDTSSRTGASRFEVWDDAKTDAYVIET

SEQ ID NO: 11243 - protein, 23 aa, artificial
  peptide fold or domain or sub-domain
LGYFRDLMAVAVGCEASLMRYAA

SEQ ID NO: 11244 - protein, 23 aa, artificial
  peptide fold or domain or sub-domain
LGYKQYAGKGVVKNEKQAVKTFE

SEQ ID NO: 11245 - protein, 27 aa, artificial
  peptide fold or domain or sub-domain
LGYLLPGDSAENFEQLTPLMQFCLPIV

SEQ ID NO: 11246 - protein, 20 aa, artificial
  peptide fold or domain or sub-domain
LGYLRSRFALSAAELKPVER

SEQ ID NO: 11247 - protein, 23 aa, artificial
  peptide fold or domain or sub-domain
LGYMHEQGLGMKKDIHLAKRCYD

SEQ ID NO: 11248 - protein, 23 aa, artificial
  peptide fold or domain or sub-domain
LGYMYEMEQGAVGGNAEAAKWYR

SEQ ID NO: 11249 - protein, 21 aa, artificial
  peptide fold or domain or sub-domain
LGYPGEIQDDLLVRWFWWAMA

SEQ ID NO: 11250 - protein, 25 aa, artificial
  peptide fold or domain or sub-domain
LGYRCTGRTLRDRDSEASVAEVRRP

SEQ ID NO: 11251 - protein, 23 aa, artificial
  peptide fold or domain or sub-domain
LGYRSWAGVGVPNSCETALDFYR

SEQ ID NO: 11252 - protein, 22 aa, artificial
  peptide fold or domain or sub-domain
LGYYRWGRVRQQQLCDREASPV

SEQ ID NO: 11253 - protein, 28 aa, artificial
  peptide fold or domain or sub-domain
LHAANGATDWRGWPAAWRRPAAALAAGC

SEQ ID NO: 11254 - protein, 20 aa, artificial
  peptide fold or domain or sub-domain
LHACVQGGASIHFVQPFSIE

SEQ ID NO: 11255 - protein, 22 aa, artificial
  peptide fold or domain or sub-domain
LHAEDILEMYPDLPRKQRETMI

SEQ ID NO: 11256 - protein, 25 aa, artificial
  peptide fold or domain or sub-domain
LHAEIISEHAIEVLQNSNIEYEYQE

SEQ ID NO: 11257 - protein, 27 aa, artificial
  peptide fold or domain or sub-domain
LHAIALPRADERRLLSLPVRRAALIRE

SEQ ID NO: 11258 - protein, 28 aa, artificial
  peptide fold or domain or sub-domain
LHALCTDVSRQVLWADKPRSMLDWKALF

SEQ ID NO: 11259 - protein, 25 aa, artificial
  peptide fold or domain or sub-domain
LHALISTDRLRIEPAARKREVLSFI

SEQ ID NO: 11260 - protein, 23 aa, artificial
  peptide fold or domain or sub-domain
LHALVAQCETEPERIRLTQTLWE

SEQ ID NO: 11261 - protein, 28 aa, artificial
  peptide fold or domain or sub-domain
LHAMLSDISNQCEFGGEKRDINTWKMIF

SEQ ID NO: 11262 - protein, 28 aa, artificial
  peptide fold or domain or sub-domain
LHAMLSEIADNAWWNGQQYPMEFWKEYY

SEQ ID NO: 11263 - protein, 26 aa, artificial
  peptide fold or domain or sub-domain
LHAPQTSLGWFDGRAVLDRRSHTLPL

SEQ ID NO: 11264 - protein, 23 aa, artificial
  peptide fold or domain or sub-domain
LHAQGWDHETSAEDADEMEAYET

SEQ ID NO: 11265 - protein, 20 aa, artificial
  peptide fold or domain or sub-domain
LHAYVSIHHPHDRLMFPRML

SEQ ID NO: 11266 - protein, 24 aa, artificial
  peptide fold or domain or sub-domain
LHDAPRVISQAMRVASALREAEGS

SEQ ID NO: 11267 - protein, 28 aa, artificial
  peptide fold or domain or sub-domain
LHDGKKELVRTRLGRRLREGNFRSFSEY

SEQ ID NO: 11268 - protein, 28 aa, artificial
  peptide fold or domain or sub-domain
LHDLKDEKVIGVIDNKIMIYNPQYLEEY

SEQ ID NO: 11269 - protein, 24 aa, artificial
  peptide fold or domain or sub-domain
LHDNAVCRKKYGHAVSIRSGHMCA

SEQ ID NO: 11270 - protein, 21 aa, artificial
  peptide fold or domain or sub-domain
LHDRYGSNLACGYNKFSGNLG

SEQ ID NO: 11271 - protein, 21 aa, artificial
  peptide fold or domain or sub-domain
LHDWEILRGLAHAISGEPVQA

SEQ ID NO: 11272 - protein, 25 aa, artificial
  peptide fold or domain or sub-domain
LHEAQADSDVLAYRMDEHQRRIIVK

SEQ ID NO: 11273 - protein, 27 aa, artificial
  peptide fold or domain or sub-domain
LHEDEAHSLIDKKIINGGMLPKVFACI

SEQ ID NO: 11274 - protein, 20 aa, artificial
  peptide fold or domain or sub-domain
LHENSFNEQFTELDLRMLVF

SEQ ID NO: 11275 - protein, 23 aa, artificial
  peptide fold or domain or sub-domain
LHFCGFKDKTEREQELMRRKEEE

SEQ ID NO: 11276 - protein, 22 aa, artificial
  peptide fold or domain or sub-domain
LHFNPYNASPVCDEQKNDAYCQ

SEQ ID NO: 11277 - protein, 21 aa, artificial
  peptide fold or domain or sub-domain
LHGNKLCRNYRLPSEYVRAVK

SEQ ID NO: 11278 - protein, 22 aa, artificial
  peptide fold or domain or sub-domain
LHHNVMVPFGKMAFFPGRLIHT

SEQ ID NO: 11279 - protein, 29 aa, artificial
  peptide fold or domain or sub-domain
LHIIEKKPDGWWLAKDAEGVEGLIPRTYL

SEQ ID NO: 11280 - protein, 29 aa, artificial
  peptide fold or domain or sub-domain
LHIISKDEEQWWTARNGAGQTGQIPVPYV

SEQ ID NO: 11281 - protein, 28 aa, artificial
  peptide fold or domain or sub-domain
LHISEIAKDLNINPLHYDLYGKYKAKVL

SEQ ID NO: 11282 - protein, 30 aa, artificial
  peptide fold or domain or sub-domain
LHIWISENRKMVPVPEGAYGNFFEEHCYVI

SEQ ID NO: 11283 - protein, 27 aa, artificial
  peptide fold or domain or sub-domain
LHKLANLKLIKYEKYGVIMLEKAGTEL

SEQ ID NO: 11284 - protein, 27 aa, artificial
  peptide fold or domain or sub-domain
LHKLNNQSYINYRRYGEIVLTDQGCLK

SEQ ID NO: 11285 - protein, 20 aa, artificial
  peptide fold or domain or sub-domain
LHKPSNENEKIMLNQKNAIY

SEQ ID NO: 11286 - protein, 25 aa, artificial
  peptide fold or domain or sub-domain
LHKQEEEGLWKKLPKKEVVQLKRKR

SEQ ID NO: 11287 - protein, 27 aa, artificial
  peptide fold or domain or sub-domain
LHKSLECDGVKHCSDGSDENHCSELNQ

SEQ ID NO: 11288 - protein, 23 aa, artificial
  peptide fold or domain or sub-domain
LHKVREVATAHGLDPHEIERIYR

SEQ ID NO: 11289 - protein, 23 aa, artificial
  peptide fold or domain or sub-domain
LHLAGYDHEFEDKNSKEMFEKQK

SEQ ID NO: 11290 - protein, 24 aa, artificial
  peptide fold or domain or sub-domain
LHLLAVLENLAGRNDIAIQLLNQV

SEQ ID NO: 11291 - protein, 23 aa, artificial
  peptide fold or domain or sub-domain
LHLLEFDHEQSDAYEYVTLTIQE

SEQ ID NO: 11292 - protein, 23 aa, artificial
  peptide fold or domain or sub-domain
LHLLGWDHPNEEQLAAMLTQQER

SEQ ID NO: 11293 - protein, 23 aa, artificial
  peptide fold or domain or sub-domain
LHLLGYDHAEPDEEREMFTLQRR

SEQ ID NO: 11294 - protein, 23 aa, artificial
  peptide fold or domain or sub-domain
LHLLGYDHERSEDEAQQQEAREI

SEQ ID NO: 11295 - protein, 23 aa, artificial
  peptide fold or domain or sub-domain
LHLLGYDHSNNSNKIEEMEILEI

SEQ ID NO: 11296 - protein, 23 aa, artificial
  peptide fold or domain or sub-domain
LHLLGYDHTRSQAAEDEMFGLQD

SEQ ID NO: 11297 - protein, 26 aa, artificial
  peptide fold or domain or sub-domain
LHLLPHHLKDFNKWPSFPPTIREVID

SEQ ID NO: 11298 - protein, 23 aa, artificial
  peptide fold or domain or sub-domain
LHLMGYKHETNDFQKEGMLILQE

SEQ ID NO: 11299 - protein, 23 aa, artificial
  peptide fold or domain or sub-domain
LHLNGMDHSDNSPEQEMLKFQEE

SEQ ID NO: 11300 - protein, 29 aa, artificial
  peptide fold or domain or sub-domain
LHLVFGVVGDKDRGPMMRALLPECASVQL

SEQ ID NO: 11301 - protein, 23 aa, artificial
  peptide fold or domain or sub-domain
LHLVGHDHEQGRGEAARMADKTM

SEQ ID NO: 11302 - protein, 29 aa, artificial
  peptide fold or domain or sub-domain
LHLVMGIMEDKDIAGIFRRLLPLAETAIF

SEQ ID NO: 11303 - protein, 25 aa, artificial
  peptide fold or domain or sub-domain
LHMYNASSPLFRNVVFNNSQEQTIE

SEQ ID NO: 11304 - protein, 29 aa, artificial
  peptide fold or domain or sub-domain
LHNNRELTKFSLEYRYMITSLDRTHAGFY

SEQ ID NO: 11305 - protein, 25 aa, artificial
  peptide fold or domain or sub-domain
LHNYHWYVTGPHFFTLHEKFEEFYN

SEQ ID NO: 11306 - protein, 24 aa, artificial
  peptide fold or domain or sub-domain
LHPAEREELAALPEDRLAAAFARL

SEQ ID NO: 11307 - protein, 23 aa, artificial
  peptide fold or domain or sub-domain
LHPNQVLKERGLMKKKGFPESYD

SEQ ID NO: 11308 - protein, 27 aa, artificial
  peptide fold or domain or sub-domain
LHPQAPVMLKVSKNLNKFVEGKEHLYR

SEQ ID NO: 11309 - protein, 26 aa, artificial
  peptide fold or domain or sub-domain
LHQEWQRFMRREIDADGFRELAKRIE

SEQ ID NO: 11310 - protein, 27 aa, artificial
  peptide fold or domain or sub-domain
LHQLCDILANNYAFSERIPTLLQHLPN

SEQ ID NO: 11311 - protein, 21 aa, artificial
  peptide fold or domain or sub-domain
LHSPTSQGVVFNKDSFAAERR

SEQ ID NO: 11312 - protein, 25 aa, artificial
  peptide fold or domain or sub-domain
LHVDIPQPGVVACRIDAHQRRLIVR

SEQ ID NO: 11313 - protein, 23 aa, artificial
  peptide fold or domain or sub-domain
LHVIGYTHHGYDDEGEEIFDLQR

SEQ ID NO: 11314 - protein, 30 aa, artificial
  peptide fold or domain or sub-domain
LHVLGPKNIRGATRITDELTGASWLPMGYV

SEQ ID NO: 11315 - protein, 25 aa, artificial
  peptide fold or domain or sub-domain
LHVYDGVLRFYDGPAIESNIYNRWF

SEQ ID NO: 11316 - protein, 26 aa, artificial
  peptide fold or domain or sub-domain
LHWFDEHGKPMSMDRWNDPQHRVVQL

SEQ ID NO: 11317 - protein, 20 aa, artificial
  peptide fold or domain or sub-domain
LHYENIPAEHQPQHLSYQEH

SEQ ID NO: 11318 - protein, 29 aa, artificial
  peptide fold or domain or sub-domain
LHYHAWAQLTDALRDGKAKSAEAATGTLA

SEQ ID NO: 11319 - protein, 29 aa, artificial
  peptide fold or domain or sub-domain
LHYKMFESLPETFANGHSNATKSVGVNHF

SEQ ID NO: 11320 - protein, 26 aa, artificial
  peptide fold or domain or sub-domain
LIAAAELDAHATSGGIPGLAPDEHSA

SEQ ID NO: 11321 - protein, 23 aa, artificial
  peptide fold or domain or sub-domain
LIADLMHRKGIYGCLSNVSSVAG

SEQ ID NO: 11322 - protein, 28 aa, artificial
  peptide fold or domain or sub-domain
LIADLMHRKGIYGCLSNVSSVAGYGASI

SEQ ID NO: 11323 - protein, 27 aa, artificial
  peptide fold or domain or sub-domain
LIADYNDDKDHWYHHYGEVNNWDDEWQ

SEQ ID NO: 11324 - protein, 25 aa, artificial
  peptide fold or domain or sub-domain
LIAEAKLYKMRTGRNIPPLACATLL

SEQ ID NO: 11325 - protein, 22 aa, artificial
  peptide fold or domain or sub-domain
LIAESGSTVLKANIELGAAQGI

SEQ ID NO: 11326 - protein, 28 aa, artificial
  peptide fold or domain or sub-domain
LIAKTYEDLKKLEEKCNEEEKEFIKQKI

SEQ ID NO: 11327 - protein, 24 aa, artificial
  peptide fold or domain or sub-domain
LIANKKCLRDSEYTQLGPTMFCAG

SEQ ID NO: 11328 - protein, 23 aa, artificial
  peptide fold or domain or sub-domain
LIANTIARKRLYEMNVVISDTAE

SEQ ID NO: 11329 - protein, 28 aa, artificial
  peptide fold or domain or sub-domain
LIANTIARKRLYEMNVVISDTAEYGNYL

SEQ ID NO: 11330 - protein, 24 aa, artificial
  peptide fold or domain or sub-domain
LIAQEQKRILEMGITGPEGHALSR

SEQ ID NO: 11331 - protein, 20 aa, artificial
  peptide fold or domain or sub-domain
LIATLETLGFETHEIRDALQ

SEQ ID NO: 11332 - protein, 24 aa, artificial
  peptide fold or domain or sub-domain
LIDCHDSFTVDEVLDRSLFRRKEA

SEQ ID NO: 11333 - protein, 20 aa, artificial
  peptide fold or domain or sub-domain
LIDGVENKAAIGFNFPLSRE

SEQ ID NO: 11334 - protein, 24 aa, artificial
  peptide fold or domain or sub-domain
LIDLDLCNSTQWYNGRVQPTNVCA

SEQ ID NO: 11335 - protein, 23 aa, artificial
  peptide fold or domain or sub-domain
LIDPEYAYGRSCLIGRVPPNATV

SEQ ID NO: 11336 - protein, 26 aa, artificial
  peptide fold or domain or sub-domain
LIDRTVAGVQHLCPDLSIQLLTRVDR

SEQ ID NO: 11337 - protein, 25 aa, artificial
  peptide fold or domain or sub-domain
LIDRTYEITLQSGAKTLNSFHLKQC

SEQ ID NO: 11338 - protein, 22 aa, artificial
  peptide fold or domain or sub-domain
LIDSKGLMGRLKREEEIPPWFT

SEQ ID NO: 11339 - protein, 20 aa, artificial
  peptide fold or domain or sub-domain
LIDSVDGGASVSYMHPLSRP

SEQ ID NO: 11340 - protein, 24 aa, artificial
  peptide fold or domain or sub-domain
LIDTYSIVRDYTNNLVIGNLGAVN

SEQ ID NO: 11341 - protein, 29 aa, artificial
  peptide fold or domain or sub-domain
LIDYARHVANMENANSTEFVPDCKYPVVA

SEQ ID NO: 11342 - protein, 20 aa, artificial
  peptide fold or domain or sub-domain
LIECIKARHCGNPRRLGQLF

SEQ ID NO: 11343 - protein, 25 aa, artificial
  peptide fold or domain or sub-domain
LIEFEGLRIDLDSREVIAFDNPLPL

SEQ ID NO: 11344 - protein, 25 aa, artificial
  peptide fold or domain or sub-domain
LIEHYNKNPNFVQPSIFHTQVLEEL

SEQ ID NO: 11345 - protein, 25 aa, artificial
  peptide fold or domain or sub-domain
LIEKNTNFNKTGLANRLKVHEDVEF

SEQ ID NO: 11346 - protein, 25 aa, artificial
  peptide fold or domain or sub-domain
LIELIETGELRIVPAHRRNEILALL

SEQ ID NO: 11347 - protein, 30 aa, artificial
  peptide fold or domain or sub-domain
LIEQPISRINRGGQVRLNQRTPAPIMADES

SEQ ID NO: 11348 - protein, 29 aa, artificial
  peptide fold or domain or sub-domain
LIEYARNAMGFTDADHQKSNPRASMPLIT

SEQ ID NO: 11349 - protein, 27 aa, artificial
  peptide fold or domain or sub-domain
LIFDCADEERLGSSKEFLDKGPITVNI

SEQ ID NO: 11350 - protein, 27 aa, artificial
  peptide fold or domain or sub-domain
LIFDDMLYLSMSTNCEKYFSSFFNKTV

SEQ ID NO: 11351 - protein, 29 aa, artificial
  peptide fold or domain or sub-domain
LIFELGGDEVKVNNKQIVSGLDVSAASVS

SEQ ID NO: 11352 - protein, 25 aa, artificial
  peptide fold or domain or sub-domain
LIFKYVARMPALSEQSLLRITKSMT

SEQ ID NO: 11353 - protein, 28 aa, artificial
  peptide fold or domain or sub-domain
LIGEMGLHTKISNIFAARNIITAKDALS

SEQ ID NO: 11354 - protein, 29 aa, artificial
  peptide fold or domain or sub-domain
LIGFMLRQFELARSVQLRPYNAIAFSGPI

SEQ ID NO: 11355 - protein, 24 aa, artificial
  peptide fold or domain or sub-domain
LIGGNLPAQDHDALRELGFRGIFP

SEQ ID NO: 11356 - protein, 21 aa, artificial
  peptide fold or domain or sub-domain
LIGNPLHQQHASTGNWRREVV

SEQ ID NO: 11357 - protein, 30 aa, artificial
  peptide fold or domain or sub-domain
LIHCNEKSLNDDSSIITVQFQNQQKNYYLH

SEQ ID NO: 11358 - protein, 20 aa, artificial
  peptide fold or domain or sub-domain
LIHDLNNLYKNDFNFYNDKN

SEQ ID NO: 11359 - protein, 26 aa, artificial
  peptide fold or domain or sub-domain
LIHEVEKLEKEKLISEDELKRGKKDA

SEQ ID NO: 11360 - protein, 30 aa, artificial
  peptide fold or domain or sub-domain
LIHFVNQTKSMRLEYLLLDQEIMQIGFLTK

SEQ ID NO: 11361 - protein, 26 aa, artificial
  peptide fold or domain or sub-domain
LIHLKDGGLLIGDINEMMTSRLGAIF

SEQ ID NO: 11362 - protein, 30 aa, artificial
  peptide fold or domain or sub-domain
LIHSCSQRENPQVYVTAVGDFGEEAKIGIN

SEQ ID NO: 11363 - protein, 30 aa, artificial
  peptide fold or domain or sub-domain
LIHSDLERTSILDEEIIVKIGENIEKYYIK

SEQ ID NO: 11364 - protein, 30 aa, artificial
  peptide fold or domain or sub-domain
LIHSSAVDRDGADFSFPMYHGLKEHTVYVK

SEQ ID NO: 11365 - protein, 30 aa, artificial
  peptide fold or domain or sub-domain
LIHSSQMKPKKYDLNFNIQTSTTKEEFFVK

SEQ ID NO: 11366 - protein, 25 aa, artificial
  peptide fold or domain or sub-domain
LIIDDTRDDPRWIAVNAQQRAVRSV

SEQ ID NO: 11367 - protein, 22 aa, artificial
  peptide fold or domain or sub-domain
LIIEAFETESLENAVATHIKRE

SEQ ID NO: 11368 - protein, 23 aa, artificial
  peptide fold or domain or sub-domain
LIIGGEQGHVSDGGISIAGVGPG

SEQ ID NO: 11369 - protein, 22 aa, artificial
  peptide fold or domain or sub-domain
LIIIHTEWNDFKNINFKKDVKN

SEQ ID NO: 11370 - protein, 26 aa, artificial
  peptide fold or domain or sub-domain
LIISPPQSRNLSVWPSVPSEFRQIVE

SEQ ID NO: 11371 - protein, 26 aa, artificial
  peptide fold or domain or sub-domain
LIITALDDDHSIESAFSAGATDYIPK

SEQ ID NO: 11372 - protein, 26 aa, artificial
  peptide fold or domain or sub-domain
LIITAYGREEVLGEIPSEIIDGVLLK

SEQ ID NO: 11373 - protein, 21 aa, artificial
  peptide fold or domain or sub-domain
LIKILCKTDSTDDMKLILECI

SEQ ID NO: 11374 - protein, 27 aa, artificial
  peptide fold or domain or sub-domain
LIKILCKTDSTDDMKLILECILTRSEM

SEQ ID NO: 11375 - protein, 25 aa, artificial
  peptide fold or domain or sub-domain
LIKKTNTVAEEKKSKSVNLSHLHEC

SEQ ID NO: 11376 - protein, 24 aa, artificial
  peptide fold or domain or sub-domain
LIKLFERRLQKQGRKDPMAHNESR

SEQ ID NO: 11377 - protein, 25 aa, artificial
  peptide fold or domain or sub-domain
LIKRLINKGGEVPMDIGLEWECTAA

SEQ ID NO: 11378 - protein, 25 aa, artificial
  peptide fold or domain or sub-domain
LIKTVVNYGNDAPILSGLTLESLGW

SEQ ID NO: 11379 - protein, 24 aa, artificial
  peptide fold or domain or sub-domain
LIKWEEARAKRKDTNDWQDFLDSR

SEQ ID NO: 11380 - protein, 26 aa, artificial
  peptide fold or domain or sub-domain
LILALNRRGVLFLDPNTHETMQHWPF

SEQ ID NO: 11381 - protein, 26 aa, artificial
  peptide fold or domain or sub-domain
LILGVNSEGIMLIKPDDKFVLNEYRY

SEQ ID NO: 11382 - protein, 25 aa, artificial
  peptide fold or domain or sub-domain
LILIHKNGEINKYTKKEQVELKKKT

SEQ ID NO: 11383 - protein, 26 aa, artificial
  peptide fold or domain or sub-domain
LILISGTHLKNSEILKKYGFIGFIAK

SEQ ID NO: 11384 - protein, 23 aa, artificial
  peptide fold or domain or sub-domain
LILNADRQFRWVDGSTLHYAPWA

SEQ ID NO: 11385 - protein, 26 aa, artificial
  peptide fold or domain or sub-domain
LILSSNPQRGDAEHFRQAGADAFLSK

SEQ ID NO: 11386 - protein, 25 aa, artificial
  peptide fold or domain or sub-domain
LILTCDNYDQAKLSARLEKHPMNDL

SEQ ID NO: 11387 - protein, 29 aa, artificial
  peptide fold or domain or sub-domain
LILVIGMLKDKEVDKMLNIITPVADVIIT

SEQ ID NO: 11388 - protein, 26 aa, artificial
  peptide fold or domain or sub-domain
LIMQPVQLRKRHLFPKLPLPFRDTLD

SEQ ID NO: 11389 - protein, 20 aa, artificial
  peptide fold or domain or sub-domain
LINANKDIKAYQNFGVKVFT

SEQ ID NO: 11390 - protein, 20 aa, artificial
  peptide fold or domain or sub-domain
LINANRNQTRYAEFGFTVLS

SEQ ID NO: 11391 - protein, 21 aa, artificial
  peptide fold or domain or sub-domain
LINILSENSDPQDINIICDFL

SEQ ID NO: 11392 - protein, 27 aa, artificial
  peptide fold or domain or sub-domain
LINILSENSDPQDINIICDFLLTKEEK

SEQ ID NO: 11393 - protein, 29 aa, artificial
  peptide fold or domain or sub-domain
LINNASPENMDIIKTDRRFKGLIYLFGDY

SEQ ID NO: 11394 - protein, 23 aa, artificial
  peptide fold or domain or sub-domain
LINQVNAQIAGKTVRAPLVQSVV

SEQ ID NO: 11395 - protein, 29 aa, artificial
  peptide fold or domain or sub-domain
LIPNEVEAAALTALPVRDPAEAEAAARVL

SEQ ID NO: 11396 - protein, 28 aa, artificial
  peptide fold or domain or sub-domain
LIPSWSNNQELQNEIWENVVKKYGMLLD

SEQ ID NO: 11397 - protein, 21 aa, artificial
  peptide fold or domain or sub-domain
LIQINALRGRRIKMGYPSKGQ

SEQ ID NO: 11398 - protein, 23 aa, artificial
  peptide fold or domain or sub-domain
LIQLPNKKPLSPKVLLNGKNPFI

SEQ ID NO: 11399 - protein, 26 aa, artificial
  peptide fold or domain or sub-domain
LIQTNEIENWPGNYNSISGIKLMERM

SEQ ID NO: 11400 - protein, 21 aa, artificial
  peptide fold or domain or sub-domain
LIQWNGSKWTGNDIPDFGNAA

SEQ ID NO: 11401 - protein, 25 aa, artificial
  peptide fold or domain or sub-domain
LIQYIEEHPDFIQPESRKNEMLNNF

SEQ ID NO: 11402 - protein, 26 aa, artificial
  peptide fold or domain or sub-domain
LIREKVPRSLDGDSPLTEAVVDFLDD

SEQ ID NO: 11403 - protein, 29 aa, artificial
  peptide fold or domain or sub-domain
LIRQIRAWQHATQTGEVCPAGWRPGKKTL

SEQ ID NO: 11404 - protein, 21 aa, artificial
  peptide fold or domain or sub-domain
LIRSKLKTINAENLAFSIVPL

SEQ ID NO: 11405 - protein, 23 aa, artificial
  peptide fold or domain or sub-domain
LIRVILSGIRSPAAADIGFMPAF

SEQ ID NO: 11406 - protein, 20 aa, artificial
  peptide fold or domain or sub-domain
LISCNRNAAQYQRMTPFVFP

SEQ ID NO: 11407 - protein, 29 aa, artificial
  peptide fold or domain or sub-domain
LISDMQWIDPQDRVIEPLNNIPGHSKPPM

SEQ ID NO: 11408 - protein, 23 aa, artificial
  peptide fold or domain or sub-domain
LISDNFLNNVNDIKLSKNQLQKI

SEQ ID NO: 11409 - protein, 28 aa, artificial
  peptide fold or domain or sub-domain
LISDVNEEKLQKTTRELLDEGYEVSLYR

SEQ ID NO: 11410 - protein, 24 aa, artificial
  peptide fold or domain or sub-domain
LISHEACSSNKVYEALLDNGMFCA

SEQ ID NO: 11411 - protein, 24 aa, artificial
  peptide fold or domain or sub-domain
LISHRECQQPHYYGSEVTTKMLCA

SEQ ID NO: 11412 - protein, 29 aa, artificial
  peptide fold or domain or sub-domain
LISLVPRLFDEDSGLEGAMEARAELFAYI

SEQ ID NO: 11413 - protein, 24 aa, artificial
  peptide fold or domain or sub-domain
LISNEKCQEWLPEYSISKNMICAG

SEQ ID NO: 11414 - protein, 24 aa, artificial
  peptide fold or domain or sub-domain
LISQDDCKNKYYDSTRVTDNMVCA

SEQ ID NO: 11415 - protein, 24 aa, artificial
  peptide fold or domain or sub-domain
LISQSRCMSRNVYGNRMDDSMMCA

SEQ ID NO: 11416 - protein, 26 aa, artificial
  peptide fold or domain or sub-domain
LISQVGNPAYPGLIWLNEEKTKLCIP

SEQ ID NO: 11417 - protein, 24 aa, artificial
  peptide fold or domain or sub-domain
LISTKKCNSSCMYNGEITSRMLCA

SEQ ID NO: 11418 - protein, 23 aa, artificial
  peptide fold or domain or sub-domain
LISTRGDEIYLNKELFDQAVGET

SEQ ID NO: 11419 - protein, 28 aa, artificial
  peptide fold or domain or sub-domain
LISYQREYGLTADGICGPETLRSLYFLS

SEQ ID NO: 11420 - protein, 29 aa, artificial
  peptide fold or domain or sub-domain
LITLAESLERQGQLDSVGGFAYLAELSKN

SEQ ID NO: 11421 - protein, 23 aa, artificial
  peptide fold or domain or sub-domain
LITRLYKKEIIKRYKSENIYFYS

SEQ ID NO: 11422 - protein, 21 aa, artificial
  peptide fold or domain or sub-domain
LITYLRSASSDDEMQNKLTGL

SEQ ID NO: 11423 - protein, 27 aa, artificial
  peptide fold or domain or sub-domain
LITYLRSASSDDEMQNKLTGLLTPSEV

SEQ ID NO: 11424 - protein, 26 aa, artificial
  peptide fold or domain or sub-domain
LITYPEDQRQLKFWPENPSGFRETLH

SEQ ID NO: 11425 - protein, 22 aa, artificial
  peptide fold or domain or sub-domain
LIVANRVDDNILQYKYKVFTTD

SEQ ID NO: 11426 - protein, 20 aa, artificial
  peptide fold or domain or sub-domain
LIVCRDEDQVAVLPVLNQVR

SEQ ID NO: 11427 - protein, 23 aa, artificial
  peptide fold or domain or sub-domain
LIVDLMYEGGIANMNYSISNNAE

SEQ ID NO: 11428 - protein, 28 aa, artificial
  peptide fold or domain or sub-domain
LIVDLMYEGGIANMNYSISNNAEYGEYV

SEQ ID NO: 11429 - protein, 26 aa, artificial
  peptide fold or domain or sub-domain
LIVGQEELRKVSDYDVMLLRGKVLPL

SEQ ID NO: 11430 - protein, 29 aa, artificial
  peptide fold or domain or sub-domain
LIVNELELDAAARALDLKAGSITDLASTV

SEQ ID NO: 11431 - protein, 29 aa, artificial
  peptide fold or domain or sub-domain
LIVRDIANQERGMYLISAATPPEMYELYA

SEQ ID NO: 11432 - protein, 20 aa, artificial
  peptide fold or domain or sub-domain
LIVSSNPLKIEEAKNTTIIP

SEQ ID NO: 11433 - protein, 26 aa, artificial
  peptide fold or domain or sub-domain
LIVTALEDESCVDEAFAAGASDYISK

SEQ ID NO: 11434 - protein, 25 aa, artificial
  peptide fold or domain or sub-domain
LIVTYSQRVPQATFEQVEEISHHFA

SEQ ID NO: 11435 - protein, 26 aa, artificial
  peptide fold or domain or sub-domain
LIWEPGRIIWTLDGRNVFETDKFSPD

SEQ ID NO: 11436 - protein, 24 aa, artificial
  peptide fold or domain or sub-domain
LIYASEVIENNEAPVAAIKKKKNS

SEQ ID NO: 11437 - protein, 30 aa, artificial
  peptide fold or domain or sub-domain
LIYCTKKRKYHYQKEVDVLINGKYLPLYVC

SEQ ID NO: 11438 - protein, 27 aa, artificial
  peptide fold or domain or sub-domain
LIYDYNPDIVGKLVKSKKSPLNSEGVR

SEQ ID NO: 11439 - protein, 21 aa, artificial
  peptide fold or domain or sub-domain
LIYEGTHRRAIYVKGAHRDFK

SEQ ID NO: 11440 - protein, 28 aa, artificial
  peptide fold or domain or sub-domain
LKAAQRRYGIEPDGVAGGATWEALLRRS

SEQ ID NO: 11441 - protein, 28 aa, artificial
  peptide fold or domain or sub-domain
LKAEFDDAGWMDWPDDIRTREPAAMERY

SEQ ID NO: 11442 - protein, 23 aa, artificial
  peptide fold or domain or sub-domain
LKAFSGDVSKLSLADSFLYGLIQ

SEQ ID NO: 11443 - protein, 27 aa, artificial
  peptide fold or domain or sub-domain
LKAGAAILTDTAMAAAAVSPMARRTGA

SEQ ID NO: 11444 - protein, 27 aa, artificial
  peptide fold or domain or sub-domain
LKAGCPVVTDVPVVAAALDQTRLAHLG

SEQ ID NO: 11445 - protein, 27 aa, artificial
  peptide fold or domain or sub-domain
LKAGRGIVTDTTMALSGIAKPRLERFG

SEQ ID NO: 11446 - protein, 24 aa, artificial
  peptide fold or domain or sub-domain
LKAIQRIMTQQGKLSAEDAGVFIS

SEQ ID NO: 11447 - protein, 27 aa, artificial
  peptide fold or domain or sub-domain
LKALANRGFVNYSPYSPITLTAAGRRL

SEQ ID NO: 11448 - protein, 28 aa, artificial
  peptide fold or domain or sub-domain
LKALTGAHVNLSEYLGQTIDHGGRLIVP

SEQ ID NO: 11449 - protein, 26 aa, artificial
  peptide fold or domain or sub-domain
LKAMPEEVLSAAYRMDRTEVRQIMRN

SEQ ID NO: 11450 - protein, 26 aa, artificial
  peptide fold or domain or sub-domain
LKAMPQEVVMNAYNISMREAHELRWN

SEQ ID NO: 11451 - protein, 20 aa, artificial
  peptide fold or domain or sub-domain
LKCAEILQNMQAYHQNELDF

SEQ ID NO: 11452 - protein, 26 aa, artificial
  peptide fold or domain or sub-domain
LKCLIDYFSCGRLARKRDVYEYQVSK

SEQ ID NO: 11453 - protein, 25 aa, artificial
  peptide fold or domain or sub-domain
LKDEEIRCRKYLHPSSYTKVIHECQ

SEQ ID NO: 11454 - protein, 23 aa, artificial
  peptide fold or domain or sub-domain
LKDGTKTAYYGDNDDQLGGVGKA

SEQ ID NO: 11455 - protein, 27 aa, artificial
  peptide fold or domain or sub-domain
LKDGVIADFEVTEAMLKHFINKLNVKG

SEQ ID NO: 11456 - protein, 22 aa, artificial
  peptide fold or domain or sub-domain
LKDHVTFNNGGLNRPNYLSKLL

SEQ ID NO: 11457 - protein, 29 aa, artificial
  peptide fold or domain or sub-domain
LKDLIAYLEEKPDMAEHLAAVRAYREEFG

SEQ ID NO: 11458 - protein, 21 aa, artificial
  peptide fold or domain or sub-domain
LKDNHIAFSGGITSAVSTVRG

SEQ ID NO: 11459 - protein, 29 aa, artificial
  peptide fold or domain or sub-domain
LKDNHSMVSQNFLELIDIKSKETKSLEFT

SEQ ID NO: 11460 - protein, 21 aa, artificial
  peptide fold or domain or sub-domain
LKDNHVDFAGGIDKAINRAKD

SEQ ID NO: 11461 - protein, 29 aa, artificial
  peptide fold or domain or sub-domain
LKDQETLRQAEVENFAHVRASDGGVMEYT

SEQ ID NO: 11462 - protein, 21 aa, artificial
  peptide fold or domain or sub-domain
LKDTHLAYAGNLKELISTARE

SEQ ID NO: 11463 - protein, 25 aa, artificial
  peptide fold or domain or sub-domain
LKDVPAGFFIGYGKSFVTKRKSVIA

SEQ ID NO: 11464 - protein, 28 aa, artificial
  peptide fold or domain or sub-domain
LKDYAMRFGQTKTAKDLGVYQSAINKAI

SEQ ID NO: 11465 - protein, 20 aa, artificial
  peptide fold or domain or sub-domain
LKEALRTKIVCGKKDAFFSR

SEQ ID NO: 11466 - protein, 28 aa, artificial
  peptide fold or domain or sub-domain
LKEANDTLPWQEWDQGLALREGAVLKQQ

SEQ ID NO: 11467 - protein, 27 aa, artificial
  peptide fold or domain or sub-domain
LKEAWQRKRLQKALRCQVNVSVLEVLQ

SEQ ID NO: 11468 - protein, 26 aa, artificial
  peptide fold or domain or sub-domain
LKEDAKGCLQKSFRILNEAKKLANDV

SEQ ID NO: 11469 - protein, 25 aa, artificial
  peptide fold or domain or sub-domain
LKEEEDRVELYLHASTRTKLVPTCD

SEQ ID NO: 11470 - protein, 28 aa, artificial
  peptide fold or domain or sub-domain
LKEFQTDHNLPATGIADRQTLNKIKEVV

SEQ ID NO: 11471 - protein, 26 aa, artificial
  peptide fold or domain or sub-domain
LKEFYDLNCVGKRKIGVPCHPWKFFK

SEQ ID NO: 11472 - protein, 27 aa, artificial
  peptide fold or domain or sub-domain
LKEGCTIICDSEMVRAGIYSRPVLERN

SEQ ID NO: 11473 - protein, 26 aa, artificial
  peptide fold or domain or sub-domain
LKEIASEVGYGYVVSRNNMSDYVITQ

SEQ ID NO: 11474 - protein, 26 aa, artificial
  peptide fold or domain or sub-domain
LKEIKSFFKVGDYRESEDFCYYRARS

SEQ ID NO: 11475 - protein, 20 aa, artificial
  peptide fold or domain or sub-domain
LKEKYPDWTPAQIVTRIEQT

SEQ ID NO: 11476 - protein, 23 aa, artificial
  peptide fold or domain or sub-domain
LKELGQSETENRMLTNSYNVVIK

SEQ ID NO: 11477 - protein, 26 aa, artificial
  peptide fold or domain or sub-domain
LKEQIMRQAELAGLDLQEDDINQLIG

SEQ ID NO: 11478 - protein, 23 aa, artificial
  peptide fold or domain or sub-domain
LKETNIYIEDRLGLKKMDDQNKI

SEQ ID NO: 11479 - protein, 29 aa, artificial
  peptide fold or domain or sub-domain
LKEYLKIVELKPKTPNTITNPRVLKRELE

SEQ ID NO: 11480 - protein, 24 aa, artificial
  peptide fold or domain or sub-domain
LKFAQNKIVASGYKERWTGLQADF

SEQ ID NO: 11481 - protein, 24 aa, artificial
  peptide fold or domain or sub-domain
LKFFYDAAQKGARAQRVTMPMFNA

SEQ ID NO: 11482 - protein, 28 aa, artificial
  peptide fold or domain or sub-domain
LKFGLMQLDKQTYHPVGAWDSKEHLSQA

SEQ ID NO: 11483 - protein, 30 aa, artificial
  peptide fold or domain or sub-domain
LKFKNGTKNRILKETGIDVWNWLKRPEGEI

SEQ ID NO: 11484 - protein, 21 aa, artificial
  peptide fold or domain or sub-domain
LKFLRRTRYDSFEKVCKELGI

SEQ ID NO: 11485 - protein, 28 aa, artificial
  peptide fold or domain or sub-domain
LKGADEDMVDMCLATMSQRAAETIRDEM

SEQ ID NO: 11486 - protein, 28 aa, artificial
  peptide fold or domain or sub-domain
LKGAHGGLPWNRWPLPLRKREEKALREA

SEQ ID NO: 11487 - protein, 20 aa, artificial
  peptide fold or domain or sub-domain
LKGALKTKVETNKELITFSK

SEQ ID NO: 11488 - protein, 28 aa, artificial
  peptide fold or domain or sub-domain
LKGARETTAAAFFANMTQRAGDLLREEI

SEQ ID NO: 11489 - protein, 28 aa, artificial
  peptide fold or domain or sub-domain
LKGASDELKEKIFKNMSKRAAALLKDEL

SEQ ID NO: 11490 - protein, 26 aa, artificial
  peptide fold or domain or sub-domain
LKGFEVEVLRPGFGVPREVVESIKST

SEQ ID NO: 11491 - protein, 23 aa, artificial
  peptide fold or domain or sub-domain
LKGFNGDKARLGNAEKFLLQLLE

SEQ ID NO: 11492 - protein, 28 aa, artificial
  peptide fold or domain or sub-domain
LKGIDAELKTSLLKALPKRMSSAIETQI

SEQ ID NO: 11493 - protein, 25 aa, artificial
  peptide fold or domain or sub-domain
LKGIEAEVLASSFNIPVEHLQHFLH

SEQ ID NO: 11494 - protein, 26 aa, artificial
  peptide fold or domain or sub-domain
LKGIEAEVLASSFNIPVEHLQHFLHL

SEQ ID NO: 11495 - protein, 26 aa, artificial
  peptide fold or domain or sub-domain
LKGMADIYEDALRDQYRAKQYAAAAS

SEQ ID NO: 11496 - protein, 28 aa, artificial
  peptide fold or domain or sub-domain
LKGSDGRVFAALAAVMSPTAARRMKDDL

SEQ ID NO: 11497 - protein, 28 aa, artificial
  peptide fold or domain or sub-domain
LKGSDITLQQAIKRSMPQRMVKALEDDM

SEQ ID NO: 11498 - protein, 28 aa, artificial
  peptide fold or domain or sub-domain
LKGTDKNFRELILSSVASRVRRVVEHEL

SEQ ID NO: 11499 - protein, 28 aa, artificial
  peptide fold or domain or sub-domain
LKGTEALLRRSIYAVMPKRQAQQLEAIT

SEQ ID NO: 11500 - protein, 28 aa, artificial
  peptide fold or domain or sub-domain
LKGTSEQLRNHMLSCMSQRGADMLREDM

SEQ ID NO: 11501 - protein, 28 aa, artificial
  peptide fold or domain or sub-domain
LKGVDDAISDAIYRNQSSRAAEALREEM

SEQ ID NO: 11502 - protein, 23 aa, artificial
  peptide fold or domain or sub-domain
LKGYKGDKQVLGECEQFFMELMK

SEQ ID NO: 11503 - protein, 28 aa, artificial
  peptide fold or domain or sub-domain
LKHLKEIQALKEHTHLIIIHDPEKLKEV

SEQ ID NO: 11504 - protein, 28 aa, artificial
  peptide fold or domain or sub-domain
LKIAKEEIKEKLFTCMSSNRKEMILEEL

SEQ ID NO: 11505 - protein, 24 aa, artificial
  peptide fold or domain or sub-domain
LKIASENAVNRGLHVDFVLGDVYN

SEQ ID NO: 11506 - protein, 28 aa, artificial
  peptide fold or domain or sub-domain
LKICPAQAHEAVKEYVHYVTIHTGGNSA

SEQ ID NO: 11507 - protein, 28 aa, artificial
  peptide fold or domain or sub-domain
LKIDWIIERYQLPQSYQRMPDFRRRFLQ

SEQ ID NO: 11508 - protein, 29 aa, artificial
  peptide fold or domain or sub-domain
LKILNMEDDMNWYRAELDSREGLIPSNYI

SEQ ID NO: 11509 - protein, 29 aa, artificial
  peptide fold or domain or sub-domain
LKINEEELKVLTGLNDLKEESILKACQEF

SEQ ID NO: 11510 - protein, 29 aa, artificial
  peptide fold or domain or sub-domain
LKIRQLDHMIQNAEKELSRQTLKERKHRL

SEQ ID NO: 11511 - protein, 22 aa, artificial
  peptide fold or domain or sub-domain
LKISWYEDDKIMQDEKTTHLTL

SEQ ID NO: 11512 - protein, 25 aa, artificial
  peptide fold or domain or sub-domain
LKITLDNAYMEKCDENILWLDYKNI

SEQ ID NO: 11513 - protein, 29 aa, artificial
  peptide fold or domain or sub-domain
LKIVEEALEAVKNATNEQDLANRFKEFGK

SEQ ID NO: 11514 - protein, 30 aa, artificial
  peptide fold or domain or sub-domain
LKIWHVRNRNKFEISQSEFGLFYNQSCYLV

SEQ ID NO: 11515 - protein, 25 aa, artificial
  peptide fold or domain or sub-domain
LKIYARNVKTGQYLAALYGYAYINS

SEQ ID NO: 11516 - protein, 23 aa, artificial
  peptide fold or domain or sub-domain
LKIYLTAYYKYSQSKLDPKYNDQ

SEQ ID NO: 11517 - protein, 26 aa, artificial
  peptide fold or domain or sub-domain
LKKAERIENYYGFSEAINGERLLAEG

SEQ ID NO: 11518 - protein, 20 aa, artificial
  peptide fold or domain or sub-domain
LKKAGLDESGLNVVSRGVTV

SEQ ID NO: 11519 - protein, 27 aa, artificial
  peptide fold or domain or sub-domain
LKKAIKSKALNKAFKIDVPDEVYDNLL

SEQ ID NO: 11520 - protein, 26 aa, artificial
  peptide fold or domain or sub-domain
LKKEIAKNKKSKAWTSDDCYKAEAEM

SEQ ID NO: 11521 - protein, 23 aa, artificial
  peptide fold or domain or sub-domain
LKKEPGHPWKWSNGKEFNNWFNV

SEQ ID NO: 11522 - protein, 25 aa, artificial
  peptide fold or domain or sub-domain
LKKERERVAHYLHSSSEPKLVEKVQ

SEQ ID NO: 11523 - protein, 21 aa, artificial
  peptide fold or domain or sub-domain
LKKKDLATFLGTTPESISRKL

SEQ ID NO: 11524 - protein, 27 aa, artificial
  peptide fold or domain or sub-domain
LKKLASLNLIDYEPYQGAVLTPAGEKI

SEQ ID NO: 11525 - protein, 27 aa, artificial
  peptide fold or domain or sub-domain
LKKLKDKNLVSYEKYGKIFLTSKGKKY

SEQ ID NO: 11526 - protein, 21 aa, artificial
  peptide fold or domain or sub-domain
LKKMEEKGIAPNVKAARRMLE

SEQ ID NO: 11527 - protein, 25 aa, artificial
  peptide fold or domain or sub-domain
LKKNKPQFQEIVSSTKTFTEEAETF

SEQ ID NO: 11528 - protein, 23 aa, artificial
  peptide fold or domain or sub-domain
LKKVAATLQVPVNDLNADLIQVA

SEQ ID NO: 11529 - protein, 25 aa, artificial
  peptide fold or domain or sub-domain
LKKYFAENSNFLFPKKIENEILNNF

SEQ ID NO: 11530 - protein, 21 aa, artificial
  peptide fold or domain or sub-domain
LKKYHGLHWPCPDENDMGGQS

SEQ ID NO: 11531 - protein, 29 aa, artificial
  peptide fold or domain or sub-domain
LKKYQNEVISKASETMSGEDLEYIKEDLR

SEQ ID NO: 11532 - protein, 25 aa, artificial
  peptide fold or domain or sub-domain
LKLEELETFPCSCPACTRHDPDDVR

SEQ ID NO: 11533 - protein, 24 aa, artificial
  peptide fold or domain or sub-domain
LKLFPKFSGISQGDLAGSPAVAAH

SEQ ID NO: 11534 - protein, 28 aa, artificial
  peptide fold or domain or sub-domain
LKLKFPGKAWHQWEESYRLRKPEALEAV

SEQ ID NO: 11535 - protein, 23 aa, artificial
  peptide fold or domain or sub-domain
LKLLDQLTLLGEEEITYNWVWEL

SEQ ID NO: 11536 - protein, 21 aa, artificial
  peptide fold or domain or sub-domain
LKLLSMGTDKKREDRIVEVVN

SEQ ID NO: 11537 - protein, 25 aa, artificial
  peptide fold or domain or sub-domain
LKLNAKAYELEMKRKPSTHSMARLL

SEQ ID NO: 11538 - protein, 20 aa, artificial
  peptide fold or domain or sub-domain
LKLRTIGEILNTTEETAKNT

SEQ ID NO: 11539 - protein, 29 aa, artificial
  peptide fold or domain or sub-domain
LKLTKQSNSVSNAQGQVTATLTSTVAVEN

SEQ ID NO: 11540 - protein, 26 aa, artificial
  peptide fold or domain or sub-domain
LKLVESKSIGSLSQKSTTPLLDIVIK

SEQ ID NO: 11541 - protein, 24 aa, artificial
  peptide fold or domain or sub-domain
LKLVYPRHSAAEGETVSILAPVGS

SEQ ID NO: 11542 - protein, 23 aa, artificial
  peptide fold or domain or sub-domain
LKMAKNRTGQWVDGATFTKSFGM

SEQ ID NO: 11543 - protein, 25 aa, artificial
  peptide fold or domain or sub-domain
LKMLVREQDYAIASRLCGSSVELVQ

SEQ ID NO: 11544 - protein, 29 aa, artificial
  peptide fold or domain or sub-domain
LKMRQLADRLGAGAMSLYWHVENKEMVFD

SEQ ID NO: 11545 - protein, 28 aa, artificial
  peptide fold or domain or sub-domain
LKNFYQGAWWLDWPAEIKNRDTRALNKI

SEQ ID NO: 11546 - protein, 28 aa, artificial
  peptide fold or domain or sub-domain
LKNKAEIKRNIENGGAYINNKRISLVDS

SEQ ID NO: 11547 - protein, 23 aa, artificial
  peptide fold or domain or sub-domain
LKNLTILGEKHFLNKKYIESLFS

SEQ ID NO: 11548 - protein, 28 aa, artificial
  peptide fold or domain or sub-domain
LKNLVDEKASIMRTRGKWKKIGKYYFFP

SEQ ID NO: 11549 - protein, 21 aa, artificial
  peptide fold or domain or sub-domain
LKNNPCRSRYKDSQQFISEVR

SEQ ID NO: 11550 - protein, 27 aa, artificial
  peptide fold or domain or sub-domain
LKNRFDQNKYNGKQPMFNMGIPVSRWI

SEQ ID NO: 11551 - protein, 23 aa, artificial
  peptide fold or domain or sub-domain
LKNRTTTLKELSGSYNWTATDSH

SEQ ID NO: 11552 - protein, 20 aa, artificial
  peptide fold or domain or sub-domain
LKNSIIDSLFERKMYQPGTR

SEQ ID NO: 11553 - protein, 26 aa, artificial
  peptide fold or domain or sub-domain
LKNWGWFDVQNAEQTYDSAVATADKY

SEQ ID NO: 11554 - protein, 20 aa, artificial
  peptide fold or domain or sub-domain
LKPGVQKKFAGQWDNIYLYR

SEQ ID NO: 11555 - protein, 20 aa, artificial
  peptide fold or domain or sub-domain
LKPKLREKLAEHENLAKISK

SEQ ID NO: 11556 - protein, 22 aa, artificial
  peptide fold or domain or sub-domain
LKPSVEHGILDKGIYEGWIGAA

SEQ ID NO: 11557 - protein, 27 aa, artificial
  peptide fold or domain or sub-domain
LKQAIKGKRLQKALEQNIPEGVLEKIR

SEQ ID NO: 11558 - protein, 20 aa, artificial
  peptide fold or domain or sub-domain
LKQANPGLSPNQLRAKLNEN

SEQ ID NO: 11559 - protein, 28 aa, artificial
  peptide fold or domain or sub-domain
LKQEYGMRTWTEWPAPLAARDPDALAQA

SEQ ID NO: 11560 - protein, 23 aa, artificial
  peptide fold or domain or sub-domain
LKQHYIDLKDRPFFPGLVKYMNS

SEQ ID NO: 11561 - protein, 27 aa, artificial
  peptide fold or domain or sub-domain
LKQLHTDIIYKVEDDFINFQEGDGLIS

SEQ ID NO: 11562 - protein, 25 aa, artificial
  peptide fold or domain or sub-domain
LKQLPTGSGVSYGHRFIAQRPTLIA

SEQ ID NO: 11563 - protein, 25 aa, artificial
  peptide fold or domain or sub-domain
LKQLREEQLAADFGVERKEMQRMIG

SEQ ID NO: 11564 - protein, 26 aa, artificial
  peptide fold or domain or sub-domain
LKQLREEQLAADFGVERKEMQRMIGS

SEQ ID NO: 11565 - protein, 27 aa, artificial
  peptide fold or domain or sub-domain
LKQLRERFAQQYQDQDLEAATSAVRKM

SEQ ID NO: 11566 - protein, 25 aa, artificial
  peptide fold or domain or sub-domain
LKQMSEDGTFDVLPKKEVALLTKEM

SEQ ID NO: 11567 - protein, 20 aa, artificial
  peptide fold or domain or sub-domain
LKQRDPAETNVQLREEMRKN

SEQ ID NO: 11568 - protein, 27 aa, artificial
  peptide fold or domain or sub-domain
LKQWSDSFVEAFESQKFDDAVKCIQRM

SEQ ID NO: 11569 - protein, 23 aa, artificial
  peptide fold or domain or sub-domain
LKRDDREQWVWTDKSELDFVNWQ

SEQ ID NO: 11570 - protein, 21 aa, artificial
  peptide fold or domain or sub-domain
LKRFDKAAYDAFTEGNEDSLS

SEQ ID NO: 11571 - protein, 21 aa, artificial
  peptide fold or domain or sub-domain
LKRQELANLAGTSRENITRIL

SEQ ID NO: 11572 - protein, 28 aa, artificial
  peptide fold or domain or sub-domain
LKSAPDDLKQKFMGNMSQRASEQFMEEM

SEQ ID NO: 11573 - protein, 20 aa, artificial
  peptide fold or domain or sub-domain
LKSASHLGADFKKAYLYSSL

SEQ ID NO: 11574 - protein, 27 aa, artificial
  peptide fold or domain or sub-domain
LKSDYRPTLLQVIDPNRLPACYGGKIT

SEQ ID NO: 11575 - protein, 25 aa, artificial
  peptide fold or domain or sub-domain
LKSEKLSKDLAARGMLAYVETVQRK

SEQ ID NO: 11576 - protein, 26 aa, artificial
  peptide fold or domain or sub-domain
LKSELQALKKEGFSPEELAALESELQ

SEQ ID NO: 11577 - protein, 23 aa, artificial
  peptide fold or domain or sub-domain
LKSFQGDKDKMANADRFYSFLLV

SEQ ID NO: 11578 - protein, 20 aa, artificial
  peptide fold or domain or sub-domain
LKSHDPNLSASRIETLLTQS

SEQ ID NO: 11579 - protein, 28 aa, artificial
  peptide fold or domain or sub-domain
LKSILADRAWWHWPQTLRDQDTEALATT

SEQ ID NO: 11580 - protein, 20 aa, artificial
  peptide fold or domain or sub-domain
LKSLDQSLQPDAICKIIQET

SEQ ID NO: 11581 - protein, 23 aa, artificial
  peptide fold or domain or sub-domain
LKSLEFNRSIEARGVKFSDLACI

SEQ ID NO: 11582 - protein, 28 aa, artificial
  peptide fold or domain or sub-domain
LKSLMERDFEATRNMQRKLVVVHDEVDL

SEQ ID NO: 11583 - protein, 28 aa, artificial
  peptide fold or domain or sub-domain
LKSQYQWSNWESWPIVDQSPTPELLEKV

SEQ ID NO: 11584 - protein, 22 aa, artificial
  peptide fold or domain or sub-domain
LKSYIECNRPQPAHRFLFLKIM

SEQ ID NO: 11585 - protein, 28 aa, artificial
  peptide fold or domain or sub-domain
LKTANAEVETKFFKNMSKRIGETVREER

SEQ ID NO: 11586 - protein, 30 aa, artificial
  peptide fold or domain or sub-domain
LKTEGLQPFVDNLLKNKDTIEARLLQLQTI

SEQ ID NO: 11587 - protein, 26 aa, artificial
  peptide fold or domain or sub-domain
LKTILGPELAAAFGVSEGTMKDVVDA

SEQ ID NO: 11588 - protein, 22 aa, artificial
  peptide fold or domain or sub-domain
LKTKIYNDLETSKKEIIFKKIN

SEQ ID NO: 11589 - protein, 27 aa, artificial
  peptide fold or domain or sub-domain
LKTLSEAGLAEYMKYEGVSLTQAGRTL

SEQ ID NO: 11590 - protein, 29 aa, artificial
  peptide fold or domain or sub-domain
LKTPPYPLDALEPYMSRRTLEVHWGKHHR

SEQ ID NO: 11591 - protein, 22 aa, artificial
  peptide fold or domain or sub-domain
LKTRIDSKRTGPEKRMLYPKVL

SEQ ID NO: 11592 - protein, 29 aa, artificial
  peptide fold or domain or sub-domain
LKTRQLAEEIRTTSCLETKKRLIKSTNRL

SEQ ID NO: 11593 - protein, 21 aa, artificial
  peptide fold or domain or sub-domain
LKTRSVDVRRDPAEVLAGART

SEQ ID NO: 11594 - protein, 28 aa, artificial
  peptide fold or domain or sub-domain
LKTRVMELMADKDESVRWESLRAVGEWL

SEQ ID NO: 11595 - protein, 25 aa, artificial
  peptide fold or domain or sub-domain
LKTTLLMYGENPDEPTSSARFFNNL

SEQ ID NO: 11596 - protein, 24 aa, artificial
  peptide fold or domain or sub-domain
LKTVALHARNAEYNPKRFAAVIMR

SEQ ID NO: 11597 - protein, 24 aa, artificial
  peptide fold or domain or sub-domain
LKTVIAAAQNSGEVRNDIPADILA

SEQ ID NO: 11598 - protein, 20 aa, artificial
  peptide fold or domain or sub-domain
LKTVVDDGASIGFLPPLEQK

SEQ ID NO: 11599 - protein, 20 aa, artificial
  peptide fold or domain or sub-domain
LKVCMEGLTKNPEAFSSSYE

SEQ ID NO: 11600 - protein, 29 aa, artificial
  peptide fold or domain or sub-domain
LKVFGDKDADGFYRGESGGRTGYIPCNMV

SEQ ID NO: 11601 - protein, 27 aa, artificial
  peptide fold or domain or sub-domain
LKVFHNLSGEEVVFEGVKMKPYKTEVV

SEQ ID NO: 11602 - protein, 21 aa, artificial
  peptide fold or domain or sub-domain
LKVFNSFDSNHDKKIDFKDFK

SEQ ID NO: 11603 - protein, 25 aa, artificial
  peptide fold or domain or sub-domain
LKVLEPGHYISYGRTFCCQQATRVA

SEQ ID NO: 11604 - protein, 25 aa, artificial
  peptide fold or domain or sub-domain
LKVLREDTGSAELTADGKTVLIVLV

SEQ ID NO: 11605 - protein, 20 aa, artificial
  peptide fold or domain or sub-domain
LKVQVGRNHANEPQLFSSLL

SEQ ID NO: 11606 - protein, 27 aa, artificial
  peptide fold or domain or sub-domain
LKVTTKKDIDQYVDKDNCLKIWGGNDD

SEQ ID NO: 11607 - protein, 29 aa, artificial
  peptide fold or domain or sub-domain
LKVVEDGILKLRNAGNEQDLGIQYKALKP

SEQ ID NO: 11608 - protein, 30 aa, artificial
  peptide fold or domain or sub-domain
LKVWLVDNGSVTLLCTEEQEQLYNGDCYII

SEQ ID NO: 11609 - protein, 25 aa, artificial
  peptide fold or domain or sub-domain
LKVYQKTNMFSKLSMKTHSIIDKKK

SEQ ID NO: 11610 - protein, 30 aa, artificial
  peptide fold or domain or sub-domain
LKWDVNKQNILRIHKSQTSGQEKVILKFHL

SEQ ID NO: 11611 - protein, 20 aa, artificial
  peptide fold or domain or sub-domain
LKWEEIATIGIIRARAQTII

SEQ ID NO: 11612 - protein, 25 aa, artificial
  peptide fold or domain or sub-domain
LKWIETGETVGYGQTWQAPRRSLIA

SEQ ID NO: 11613 - protein, 25 aa, artificial
  peptide fold or domain or sub-domain
LKWVEPGTSISYARRFTAPDRRLVA

SEQ ID NO: 11614 - protein, 24 aa, artificial
  peptide fold or domain or sub-domain
LKYALKERWNRRKEPAFDKWVIEE

SEQ ID NO: 11615 - protein, 28 aa, artificial
  peptide fold or domain or sub-domain
LKYKFNFISWNSWNKDIKLRKNEEIEKY

SEQ ID NO: 11616 - protein, 21 aa, artificial
  peptide fold or domain or sub-domain
LKYLFVKDPLGYNNLIIQLGI

SEQ ID NO: 11617 - protein, 29 aa, artificial
  peptide fold or domain or sub-domain
LKYWSLQDTTKLPGGTGMMGSFKSYKDLD

SEQ ID NO: 11618 - protein, 22 aa, artificial
  peptide fold or domain or sub-domain
LLAGNLSSETLQAYEQKGLYGT

SEQ ID NO: 11619 - protein, 28 aa, artificial
  peptide fold or domain or sub-domain
LLAGRKRDDAVAAALKLQAEGLPVEAIQ

SEQ ID NO: 11620 - protein, 27 aa, artificial
  peptide fold or domain or sub-domain
LLAGWGIEGTHYEKTEEGGVRRLEPFT

SEQ ID NO: 11621 - protein, 29 aa, artificial
  peptide fold or domain or sub-domain
LLAKYQSQLSSAGDDKAKAQAAIAVEVAE

SEQ ID NO: 11622 - protein, 29 aa, artificial
  peptide fold or domain or sub-domain
LLALLSNPSAREALEACSVDLVALRQELE

SEQ ID NO: 11623 - protein, 27 aa, artificial
  peptide fold or domain or sub-domain
LLANFGVEGKTWDMVDGEPVYKPEVLE

SEQ ID NO: 11624 - protein, 28 aa, artificial
  peptide fold or domain or sub-domain
LLANGLSCNRDQIEDPEVRRVINRVFNE

SEQ ID NO: 11625 - protein, 20 aa, artificial
  peptide fold or domain or sub-domain
LLAQGRLAEMVGPGALEIDR

SEQ ID NO: 11626 - protein, 28 aa, artificial
  peptide fold or domain or sub-domain
LLAQGRLAEMVGPGALEIDRFMRTVNLR

SEQ ID NO: 11627 - protein, 29 aa, artificial
  peptide fold or domain or sub-domain
LLASGLDVSSLKSLQTGDFSNGDRVKCLV

SEQ ID NO: 11628 - protein, 27 aa, artificial
  peptide fold or domain or sub-domain
LLASHEPESSSSRHDHSSHTRYLPTPL

SEQ ID NO: 11629 - protein, 29 aa, artificial
  peptide fold or domain or sub-domain
LLASNLAQFLTQEQYAAEMSKAIAFEIIQ

SEQ ID NO: 11630 - protein, 28 aa, artificial
  peptide fold or domain or sub-domain
LLATGLHVHRNSAHSAGVGAIFDRVLTE

SEQ ID NO: 11631 - protein, 26 aa, artificial
  peptide fold or domain or sub-domain
LLDCCDNDKHPGMHWLDEEKTLVRLP

SEQ ID NO: 11632 - protein, 23 aa, artificial
  peptide fold or domain or sub-domain
LLDDFRFLPGGRILAGAGSGHRV

SEQ ID NO: 11633 - protein, 23 aa, artificial
  peptide fold or domain or sub-domain
LLDIYYKNVEITEEILKNVIDNN

SEQ ID NO: 11634 - protein, 28 aa, artificial
  peptide fold or domain or sub-domain
LLDKCKELNLLVYEDLVANCPELLLMLE

SEQ ID NO: 11635 - protein, 25 aa, artificial
  peptide fold or domain or sub-domain
LLDLYENNPGFIMPAERRNEIVSFV

SEQ ID NO: 11636 - protein, 24 aa, artificial
  peptide fold or domain or sub-domain
LLDQERCNSDVSYNGTLTDNMICA

SEQ ID NO: 11637 - protein, 25 aa, artificial
  peptide fold or domain or sub-domain
LLDWVKEYPADSQRFSMIVDPRLRN

SEQ ID NO: 11638 - protein, 20 aa, artificial
  peptide fold or domain or sub-domain
LLDYTMCNYPQQTEKFGQLL

SEQ ID NO: 11639 - protein, 25 aa, artificial
  peptide fold or domain or sub-domain
LLEEQRRVQVYLHESTQDELARKCE

SEQ ID NO: 11640 - protein, 25 aa, artificial
  peptide fold or domain or sub-domain
LLEFYNANPEFVMPKEVYRGIVDEV

SEQ ID NO: 11641 - protein, 24 aa, artificial
  peptide fold or domain or sub-domain
LLELDMGLKNTAFEPEKHMALFVY

SEQ ID NO: 11642 - protein, 21 aa, artificial
  peptide fold or domain or sub-domain
LLENPLCKHFDDNTAYVSEVR

SEQ ID NO: 11643 - protein, 26 aa, artificial
  peptide fold or domain or sub-domain
LLEPPSPKEFWEKYARDGIPVLFRGM

SEQ ID NO: 11644 - protein, 29 aa, artificial
  peptide fold or domain or sub-domain
LLERTDREPQVFKDIDSRLPELIQRLNKQ

SEQ ID NO: 11645 - protein, 30 aa, artificial
  peptide fold or domain or sub-domain
LLETINKDIGNFRFGGYINCQQYEQIRSSI

SEQ ID NO: 11646 - protein, 25 aa, artificial
  peptide fold or domain or sub-domain
LLEYHPNTQLTSEYPRLRNLTDEDL

SEQ ID NO: 11647 - protein, 24 aa, artificial
  peptide fold or domain or sub-domain
LLGAGFQDASGGDPSKGKVNMAQQ

SEQ ID NO: 11648 - protein, 28 aa, artificial
  peptide fold or domain or sub-domain
LLGARDTHAGEAKAAELRAEGLDVRPIA

SEQ ID NO: 11649 - protein, 22 aa, artificial
  peptide fold or domain or sub-domain
LLGGDVSSGKITCEKHGGKFEL

SEQ ID NO: 11650 - protein, 27 aa, artificial
  peptide fold or domain or sub-domain
LLGKRKIQDLVSQVDAQGKLDPEVEDL

SEQ ID NO: 11651 - protein, 30 aa, artificial
  peptide fold or domain or sub-domain
LLGLMLEARALEREGNGLVLTTQEIIDECK

SEQ ID NO: 11652 - protein, 28 aa, artificial
  peptide fold or domain or sub-domain
LLGNDYIIPRHCPELAEMNRVSVRILDE

SEQ ID NO: 11653 - protein, 27 aa, artificial
  peptide fold or domain or sub-domain
LLGRDGGTPRSPEWAAEITGIPPTRIR

SEQ ID NO: 11654 - protein, 27 aa, artificial
  peptide fold or domain or sub-domain
LLGRSDGVPKSPAWAEQISGIAAADLV

SEQ ID NO: 11655 - protein, 27 aa, artificial
  peptide fold or domain or sub-domain
LLGTYSNDSLKLFHHNGSISNWNNLKE

SEQ ID NO: 11656 - protein, 24 aa, artificial
  peptide fold or domain or sub-domain
LLGYQRFKAEGLVNPNTGTPIPNA

SEQ ID NO: 11657 - protein, 28 aa, artificial
  peptide fold or domain or sub-domain
LLHDIVKCEREGSFLGKTLQINPHIIDE

SEQ ID NO: 11658 - protein, 27 aa, artificial
  peptide fold or domain or sub-domain
LLHSSNMASLHKHVDQSCLPTNLEGSC

SEQ ID NO: 11659 - protein, 27 aa, artificial
  peptide fold or domain or sub-domain
LLHTVCGSPAYVAPEILTIKGYDGAKT

SEQ ID NO: 11660 - protein, 26 aa, artificial
  peptide fold or domain or sub-domain
LLIAINKHGVSLIHPSSKDILVTHPF

SEQ ID NO: 11661 - protein, 26 aa, artificial
  peptide fold or domain or sub-domain
LLIAINRTGFHLIDPHTKEVLQSYSY

SEQ ID NO: 11662 - protein, 25 aa, artificial
  peptide fold or domain or sub-domain
LLIAIRPDVSEKKEGRFTISFNKSA

SEQ ID NO: 11663 - protein, 30 aa, artificial
  peptide fold or domain or sub-domain
LLIESISKKAEFLRHVAQELQLERVLVEVE

SEQ ID NO: 11664 - protein, 25 aa, artificial
  peptide fold or domain or sub-domain
LLIQNLEEDKRYNLNVKYKFEANSL

SEQ ID NO: 11665 - protein, 30 aa, artificial
  peptide fold or domain or sub-domain
LLIQSSQREQTSGRLNASLDKSSGRSTLYI

SEQ ID NO: 11666 - protein, 30 aa, artificial
  peptide fold or domain or sub-domain
LLIRENEKEKWKERLKVTFDTTLKQSLFHI

SEQ ID NO: 11667 - protein, 26 aa, artificial
  peptide fold or domain or sub-domain
LLITARSRPEDIENGFRAGANDYLTK

SEQ ID NO: 11668 - protein, 25 aa, artificial
  peptide fold or domain or sub-domain
LLKHFQENPDFVEPDFRRNEMLKIL

SEQ ID NO: 11669 - protein, 25 aa, artificial
  peptide fold or domain or sub-domain
LLKKACQVTQSRNAKTMTTSHLKQC

SEQ ID NO: 11670 - protein, 21 aa, artificial
  peptide fold or domain or sub-domain
LLKKELEETGALTGDPSHQIF

SEQ ID NO: 11671 - protein, 29 aa, artificial
  peptide fold or domain or sub-domain
LLKKGQQSLEKAKETEKKSAEQYLKIMSK

SEQ ID NO: 11672 - protein, 22 aa, artificial
  peptide fold or domain or sub-domain
LLKLLTFEYGKSRADIAYSNLL

SEQ ID NO: 11673 - protein, 27 aa, artificial
  peptide fold or domain or sub-domain
LLKLRDQGYIDYMPYEGAALTEEGRAE

SEQ ID NO: 11674 - protein, 29 aa, artificial
  peptide fold or domain or sub-domain
LLKTDNGPAYTSQKFQQFCRQMDVTHLTG

SEQ ID NO: 11675 - protein, 28 aa, artificial
  peptide fold or domain or sub-domain
LLKTTVVPTRERYPWSDGELVNTMKLEK

SEQ ID NO: 11676 - protein, 25 aa, artificial
  peptide fold or domain or sub-domain
LLKYFHDHPNCIVPEFRRREVIKTV

SEQ ID NO: 11677 - protein, 30 aa, artificial
  peptide fold or domain or sub-domain
LLLDGALQGKPHTVDKTIERWKQQRGKTAE

SEQ ID NO: 11678 - protein, 28 aa, artificial
  peptide fold or domain or sub-domain
LLLGNDRLIPRNCPELEVGRVAVRILDE

SEQ ID NO: 11679 - protein, 24 aa, artificial
  peptide fold or domain or sub-domain
LLLLGAVYYQLREFDMCIAKNEEA

SEQ ID NO: 11680 - protein, 27 aa, artificial
  peptide fold or domain or sub-domain
LLLSAGIEGIDYTMENGKLVFTETGIK

SEQ ID NO: 11681 - protein, 22 aa, artificial
  peptide fold or domain or sub-domain
LLLSIDDGNGQGMTDQQVRDEV

SEQ ID NO: 11682 - protein, 26 aa, artificial
  peptide fold or domain or sub-domain
LLLTASLMELHDENSFKVRSIQNAGF

SEQ ID NO: 11683 - protein, 25 aa, artificial
  peptide fold or domain or sub-domain
LLMGHKVSQLISRLRGVPQGVDLPS

SEQ ID NO: 11684 - protein, 27 aa, artificial
  peptide fold or domain or sub-domain
LLMPDDPRAPVNQPRYAAVDRTQLPLA

SEQ ID NO: 11685 - protein, 26 aa, artificial
  peptide fold or domain or sub-domain
LLMTGRNSSHEKAIGLDAGADDYLVK

SEQ ID NO: 11686 - protein, 20 aa, artificial
  peptide fold or domain or sub-domain
LLNALPEEVIQHTFNLKSQQ

SEQ ID NO: 11687 - protein, 26 aa, artificial
  peptide fold or domain or sub-domain
LLNAVSSGLYRGLCWIDPDRRIFRIP

SEQ ID NO: 11688 - protein, 30 aa, artificial
  peptide fold or domain or sub-domain
LLNDFNIEAETDDGVLMALSHKNYPLYSVQ

SEQ ID NO: 11689 - protein, 21 aa, artificial
  peptide fold or domain or sub-domain
LLNGISNITAFDIEQIKGMNS

SEQ ID NO: 11690 - protein, 27 aa, artificial
  peptide fold or domain or sub-domain
LLNLDNVQGIHDLYPANEIECVQLFDI

SEQ ID NO: 11691 - protein, 30 aa, artificial
  peptide fold or domain or sub-domain
LLNLQGNSLCQEEGIQERLAEMLPSVSSIL

SEQ ID NO: 11692 - protein, 25 aa, artificial
  peptide fold or domain or sub-domain
LLNNQKEIAKTFSFLAKIKTDIELD

SEQ ID NO: 11693 - protein, 22 aa, artificial
  peptide fold or domain or sub-domain
LLNYCLLQHGKLQGPTRFATIL

SEQ ID NO: 11694 - protein, 23 aa, artificial
  peptide fold or domain or sub-domain
LLNYDGDINMLDPAENFVKVLLT

SEQ ID NO: 11695 - protein, 25 aa, artificial
  peptide fold or domain or sub-domain
LLPADKNTNEIARIRLVEPGTQVDS

SEQ ID NO: 11696 - protein, 23 aa, artificial
  peptide fold or domain or sub-domain
LLPFGNEGLSYDQLLVDPRVRAH

SEQ ID NO: 11697 - protein, 26 aa, artificial
  peptide fold or domain or sub-domain
LLPGDGVEDGVPVVYDYSGPGQHRVR

SEQ ID NO: 11698 - protein, 30 aa, artificial
  peptide fold or domain or sub-domain
LLPHIQFQINKQNSFYIGDTKQFGTYSRNG

SEQ ID NO: 11699 - protein, 28 aa, artificial
  peptide fold or domain or sub-domain
LLPILRGENKTNNRDSSTLGLLAHIQAR

SEQ ID NO: 11700 - protein, 23 aa, artificial
  peptide fold or domain or sub-domain
LLPRKDRTQYPLSEKMFLSEESE

SEQ ID NO: 11701 - protein, 21 aa, artificial
  peptide fold or domain or sub-domain
LLPTDPIGGKTGINYTNIFNT

SEQ ID NO: 11702 - protein, 26 aa, artificial
  peptide fold or domain or sub-domain
LLPWEAEKLLANPVKVQESKEKHMKD

SEQ ID NO: 11703 - protein, 26 aa, artificial
  peptide fold or domain or sub-domain
LLPWQNFSCQTRQEKFLKILEAKQKF

SEQ ID NO: 11704 - protein, 20 aa, artificial
  peptide fold or domain or sub-domain
LLQAKPDLTPAQVKEALTRT

SEQ ID NO: 11705 - protein, 23 aa, artificial
  peptide fold or domain or sub-domain
LLQAKVRNGDVNAKQEKIIIQVA

SEQ ID NO: 11706 - protein, 23 aa, artificial
  peptide fold or domain or sub-domain
LLQFKGDRSGLPDADLFMLLLAN

SEQ ID NO: 11707 - protein, 25 aa, artificial
  peptide fold or domain or sub-domain
LLQHIADNPDFVQPEAFKNELKQML

SEQ ID NO: 11708 - protein, 20 aa, artificial
  peptide fold or domain or sub-domain
LLQKFPNAKPWQIRKLLENT

SEQ ID NO: 11709 - protein, 28 aa, artificial
  peptide fold or domain or sub-domain
LLQKHGINVADIKKLKSVGICTIKGIQM

SEQ ID NO: 11710 - protein, 25 aa, artificial
  peptide fold or domain or sub-domain
LLQRSAQENPSPEAQATLGTVQRLL

SEQ ID NO: 11711 - protein, 25 aa, artificial
  peptide fold or domain or sub-domain
LLQYLENNPSLIKPDAQRKELLNLL

SEQ ID NO: 11712 - protein, 27 aa, artificial
  peptide fold or domain or sub-domain
LLRCRRVVTDVTMVETGLKREVLRQLE

SEQ ID NO: 11713 - protein, 25 aa, artificial
  peptide fold or domain or sub-domain
LLRFYDENPDWIQPAHRMNEVRNWV

SEQ ID NO: 11714 - protein, 29 aa, artificial
  peptide fold or domain or sub-domain
LLRITKAAIVNYKAKVVLPANWQPGQDVI

SEQ ID NO: 11715 - protein, 29 aa, artificial
  peptide fold or domain or sub-domain
LLRLLCALQEVDRAGALTPESWQPGQPTV

SEQ ID NO: 11716 - protein, 29 aa, artificial
  peptide fold or domain or sub-domain
LLRLVEALQVTDGGGGVAPEGWESGEPLL

SEQ ID NO: 11717 - protein, 26 aa, artificial
  peptide fold or domain or sub-domain
LLRRCLEILFKTKDLSTVKKEFQNVC

SEQ ID NO: 11718 - protein, 24 aa, artificial
  peptide fold or domain or sub-domain
LLRSFIDPMRRGIANHLNLPVGRV

SEQ ID NO: 11719 - protein, 29 aa, artificial
  peptide fold or domain or sub-domain
LLSAGPLLVPATGEHLTLQQAFQQNLISS

SEQ ID NO: 11720 - protein, 24 aa, artificial
  peptide fold or domain or sub-domain
LLSEATCSQPEVYGVNITEGMFCA

SEQ ID NO: 11721 - protein, 24 aa, artificial
  peptide fold or domain or sub-domain
LLSEKEISVRFDVSRQPVREAFIK

SEQ ID NO: 11722 - protein, 29 aa, artificial
  peptide fold or domain or sub-domain
LLSENHPDEFFAVRSSAIGEDAANASFAG

SEQ ID NO: 11723 - protein, 27 aa, artificial
  peptide fold or domain or sub-domain
LLSGVGPESYLSSLNIPVVLSHPYVGQ

SEQ ID NO: 11724 - protein, 27 aa, artificial
  peptide fold or domain or sub-domain
LLSGVGPKDELQQVNVRTVHNLPGVGK

SEQ ID NO: 11725 - protein, 28 aa, artificial
  peptide fold or domain or sub-domain
LLSIGRHLGREVAKSHGLGPLVDRILHE

SEQ ID NO: 11726 - protein, 20 aa, artificial
  peptide fold or domain or sub-domain
LLSMGNLSSWVGSKALSSDI

SEQ ID NO: 11727 - protein, 23 aa, artificial
  peptide fold or domain or sub-domain
LLSMGNLSSWVGSKALSSDIAMH

SEQ ID NO: 11728 - protein, 26 aa, artificial
  peptide fold or domain or sub-domain
LLSMIDIYEASITNQQELLKAIKATT

SEQ ID NO: 11729 - protein, 23 aa, artificial
  peptide fold or domain or sub-domain
LLSPISFEKNAAVVQSLEAMILR

SEQ ID NO: 11730 - protein, 24 aa, artificial
  peptide fold or domain or sub-domain
LLSRETRQGLAALFGDDASRVPLA

SEQ ID NO: 11731 - protein, 30 aa, artificial
  peptide fold or domain or sub-domain
LLSRWWDAYRKQLGLKDFSPKSQDAVALQQ

SEQ ID NO: 11732 - protein, 21 aa, artificial
  peptide fold or domain or sub-domain
LLSSDERATLIAEKIDDAAFH

SEQ ID NO: 11733 - protein, 29 aa, artificial
  peptide fold or domain or sub-domain
LLSTPKPDLSNAAYILDLLPRLQNQYSAQ

SEQ ID NO: 11734 - protein, 22 aa, artificial
  peptide fold or domain or sub-domain
LLSWAAEFGLATDAAARARLDA

SEQ ID NO: 11735 - protein, 24 aa, artificial
  peptide fold or domain or sub-domain
LLSWMNRRNYQCPICQSGISRENV

SEQ ID NO: 11736 - protein, 22 aa, artificial
  peptide fold or domain or sub-domain
LLTALKDKYGVSQGMAVFNQLK

SEQ ID NO: 11737 - protein, 28 aa, artificial
  peptide fold or domain or sub-domain
LLTARSEEKGQKAARALAEQGLPVSFLW

SEQ ID NO: 11738 - protein, 30 aa, artificial
  peptide fold or domain or sub-domain
LLTELAPGVEVEEVQSKTGANFTVAKQLEL

SEQ ID NO: 11739 - protein, 27 aa, artificial
  peptide fold or domain or sub-domain
LLTFTGSGPVGWDMKARAGKKKVVMEL

SEQ ID NO: 11740 - protein, 23 aa, artificial
  peptide fold or domain or sub-domain
LLTYTGDKGNCEQLFQYLQEVVK

SEQ ID NO: 11741 - protein, 30 aa, artificial
  peptide fold or domain or sub-domain
LLVAADTQRPAAREQLRLLGEKVGVPVLEV

SEQ ID NO: 11742 - protein, 30 aa, artificial
  peptide fold or domain or sub-domain
LLVDSTGKKIAACKAMIKELGLENVIALHS

SEQ ID NO: 11743 - protein, 26 aa, artificial
  peptide fold or domain or sub-domain
LLVGPRYGISHVINTKTNLVALLADF

SEQ ID NO: 11744 - protein, 22 aa, artificial
  peptide fold or domain or sub-domain
LLVIGAPHAVYRDLEPAVPVVD

SEQ ID NO: 11745 - protein, 30 aa, artificial
  peptide fold or domain or sub-domain
LLVLSEAEMVKRPNYGSEIYENREMQEKVA

SEQ ID NO: 11746 - protein, 25 aa, artificial
  peptide fold or domain or sub-domain
LLVNDVEKDSRVGMKNRPRFKSKSL

SEQ ID NO: 11747 - protein, 25 aa, artificial
  peptide fold or domain or sub-domain
LLVRYTKKVPQVSTPTLVEVSRNLG

SEQ ID NO: 11748 - protein, 23 aa, artificial
  peptide fold or domain or sub-domain
LLVTDRKHGNPEHTAESTSDAEA

SEQ ID NO: 11749 - protein, 25 aa, artificial
  peptide fold or domain or sub-domain
LLVYQGKGKFAIRADKKSNPVVRTV

SEQ ID NO: 11750 - protein, 28 aa, artificial
  peptide fold or domain or sub-domain
LLWPERVMERNDAEILGYRIIFDRIINE

SEQ ID NO: 11751 - protein, 27 aa, artificial
  peptide fold or domain or sub-domain
LLYLRIQIILTSENPSQQDLKEALDIC

SEQ ID NO: 11752 - protein, 26 aa, artificial
  peptide fold or domain or sub-domain
LMADLDEERGQAAARELPNALFQRTD

SEQ ID NO: 11753 - protein, 24 aa, artificial
  peptide fold or domain or sub-domain
LMAEAALCESFDASRTVLREAVKM

SEQ ID NO: 11754 - protein, 20 aa, artificial
  peptide fold or domain or sub-domain
LMAHMPIDVVAKNFGIPQQH

SEQ ID NO: 11755 - protein, 28 aa, artificial
  peptide fold or domain or sub-domain
LMAMRNPDKAQKTLNGLTMKGLDVVPMK

SEQ ID NO: 11756 - protein, 28 aa, artificial
  peptide fold or domain or sub-domain
LMDFSNRGWIARDGRSIIIFQPGMLIRR

SEQ ID NO: 11757 - protein, 21 aa, artificial
  peptide fold or domain or sub-domain
LMDIGCYRGLRHRRGLPVRGQ

SEQ ID NO: 11758 - protein, 30 aa, artificial
  peptide fold or domain or sub-domain
LMDTYAEKKDVSKKEGAIGIFTNQLITRKE

SEQ ID NO: 11759 - protein, 20 aa, artificial
  peptide fold or domain or sub-domain
LMDYVTKSSPDINDKFNKLI

SEQ ID NO: 11760 - protein, 25 aa, artificial
  peptide fold or domain or sub-domain
LMEAGTTDNGDLFRIDSRAWRIAVQ

SEQ ID NO: 11761 - protein, 20 aa, artificial
  peptide fold or domain or sub-domain
LMEALEILGYSRSEVLPAIM

SEQ ID NO: 11762 - protein, 20 aa, artificial
  peptide fold or domain or sub-domain
LMEVAQKSHPEDTRRVPSLL

SEQ ID NO: 11763 - protein, 26 aa, artificial
  peptide fold or domain or sub-domain
LMFPILMLTAKDEEFDKVLGLELGAD

SEQ ID NO: 11764 - protein, 20 aa, artificial
  peptide fold or domain or sub-domain
LMGKHPELSSQQIRALLVEQ

SEQ ID NO: 11765 - protein, 28 aa, artificial
  peptide fold or domain or sub-domain
LMGTRNLKNGEAVCAQHAQEGLDIRPVQ

SEQ ID NO: 11766 - protein, 27 aa, artificial
  peptide fold or domain or sub-domain
LMGVSDGIPKDAAWASGVCGCSAGSIR

SEQ ID NO: 11767 - protein, 24 aa, artificial
  peptide fold or domain or sub-domain
LMHELCVAAVAGDARRAMELQFKL

SEQ ID NO: 11768 - protein, 26 aa, artificial
  peptide fold or domain or sub-domain
LMHELCVAAVAGDARRAMELQFKLLP

SEQ ID NO: 11769 - protein, 25 aa, artificial
  peptide fold or domain or sub-domain
LMIEESAHCYSLNCSAPICSYRWFV

SEQ ID NO: 11770 - protein, 29 aa, artificial
  peptide fold or domain or sub-domain
LMISFTSDDMTTRVKVPPTAQNGLIKISW

SEQ ID NO: 11771 - protein, 24 aa, artificial
  peptide fold or domain or sub-domain
LMKEMYEAFVEGNIERAREMHHRL

SEQ ID NO: 11772 - protein, 26 aa, artificial
  peptide fold or domain or sub-domain
LMKEMYEAFVEGNIERAREMHHRLTP

SEQ ID NO: 11773 - protein, 29 aa, artificial
  peptide fold or domain or sub-domain
LMKLPFNPQDMSPFLSEEAIKYHYSKHHA

SEQ ID NO: 11774 - protein, 28 aa, artificial
  peptide fold or domain or sub-domain
LMKRSIGKCKGCKNEVLISDMRSHTGNC

SEQ ID NO: 11775 - protein, 29 aa, artificial
  peptide fold or domain or sub-domain
LMLIESTRDSLCFTVTHYKHSKQQYSIQA

SEQ ID NO: 11776 - protein, 29 aa, artificial
  peptide fold or domain or sub-domain
LMLLDTAKDPLLFSVLHFKHPKQPHTVQA

SEQ ID NO: 11777 - protein, 30 aa, artificial
  peptide fold or domain or sub-domain
LMLLDVEKCSNRDTFGVERFETNSIQERAR

SEQ ID NO: 11778 - protein, 26 aa, artificial
  peptide fold or domain or sub-domain
LMLTAKDEEFDKVLGLELGADDYMTK

SEQ ID NO: 11779 - protein, 29 aa, artificial
  peptide fold or domain or sub-domain
LMNAAKERCNVRYKRDFTAEQIRELTLEY

SEQ ID NO: 11780 - protein, 26 aa, artificial
  peptide fold or domain or sub-domain
LMNLVVLTMAETGNNLESVINSLSGE

SEQ ID NO: 11781 - protein, 23 aa, artificial
  peptide fold or domain or sub-domain
LMSFNGDLSALNDADRFMVMMVQ

SEQ ID NO: 11782 - protein, 29 aa, artificial
  peptide fold or domain or sub-domain
LMSNVDAAYEVAERGTAYFFKGPHYWITR

SEQ ID NO: 11783 - protein, 27 aa, artificial
  peptide fold or domain or sub-domain
LMSPGGAQPVNKEVVEQKAYKENEVIK

SEQ ID NO: 11784 - protein, 30 aa, artificial
  peptide fold or domain or sub-domain
LMTAETMGCPQTAEGYDDFVRNTYAPMIAE

SEQ ID NO: 11785 - protein, 23 aa, artificial
  peptide fold or domain or sub-domain
LMTGPGLRKFVENDDLVTAERIA

SEQ ID NO: 11786 - protein, 24 aa, artificial
  peptide fold or domain or sub-domain
LMTSGLTMWFHFNSMTLLMIGLTT

SEQ ID NO: 11787 - protein, 28 aa, artificial
  peptide fold or domain or sub-domain
LMVEESHAMPLNDPSVHNPFGVGYTTVN

SEQ ID NO: 11788 - protein, 30 aa, artificial
  peptide fold or domain or sub-domain
LMVLKREHSGPGWWLCSLHGRQGIAPANRL

SEQ ID NO: 11789 - protein, 29 aa, artificial
  peptide fold or domain or sub-domain
LMVQLKDQSIYCCYVNELNMVVAAFTLQS

SEQ ID NO: 11790 - protein, 24 aa, artificial
  peptide fold or domain or sub-domain
LMVSKEDVAAGRPAPDMINHIMTA

SEQ ID NO: 11791 - protein, 25 aa, artificial
  peptide fold or domain or sub-domain
LNAFRRESLEAAFKVRSEDIERMFS

SEQ ID NO: 11792 - protein, 26 aa, artificial
  peptide fold or domain or sub-domain
LNAFRRESLEAAFKVRSEDIERMFSR

SEQ ID NO: 11793 - protein, 27 aa, artificial
  peptide fold or domain or sub-domain
LNAHLDELQAAFNKADYSGARETLMRL

SEQ ID NO: 11794 - protein, 27 aa, artificial
  peptide fold or domain or sub-domain
LNAIRSVGNRYFKADQFVRANRRYKKA

SEQ ID NO: 11795 - protein, 26 aa, artificial
  peptide fold or domain or sub-domain
LNALPEEVIQHTFNLKSQQARQIKNN

SEQ ID NO: 11796 - protein, 20 aa, artificial
  peptide fold or domain or sub-domain
LNALYRSEPALHARDCAPEG

SEQ ID NO: 11797 - protein, 29 aa, artificial
  peptide fold or domain or sub-domain
LNAPEKLDQLPHTKKWLELMESVRERVLS

SEQ ID NO: 11798 - protein, 27 aa, artificial
  peptide fold or domain or sub-domain
LNAQKAFVGIEDPMTREVLSVGEAVEK

SEQ ID NO: 11799 - protein, 26 aa, artificial
  peptide fold or domain or sub-domain
LNDDAAAHNHHCVAAAEAQGGTGVNQ

SEQ ID NO: 11800 - protein, 24 aa, artificial
  peptide fold or domain or sub-domain
LNDEAIAKAIKPCGLYNNKTKNIR

SEQ ID NO: 11801 - protein, 25 aa, artificial
  peptide fold or domain or sub-domain
LNDEAIAKAIKPCGLYNNKTKNIRK

SEQ ID NO: 11802 - protein, 28 aa, artificial
  peptide fold or domain or sub-domain
LNDLLRGELSRLGVDPAHSLEIVVAICK

SEQ ID NO: 11803 - protein, 24 aa, artificial
  peptide fold or domain or sub-domain
LNDNVLERMKVTNGARKKIAQSIE

SEQ ID NO: 11804 - protein, 29 aa, artificial
  peptide fold or domain or sub-domain
LNDPAYLKTGLEPAISAKTLDFHFNGHHK

SEQ ID NO: 11805 - protein, 23 aa, artificial
  peptide fold or domain or sub-domain
LNDQSVHALGHDAGDARFAWDSY

SEQ ID NO: 11806 - protein, 23 aa, artificial
  peptide fold or domain or sub-domain
LNDVAVEGFAKKTGNPRFAYDSY

SEQ ID NO: 11807 - protein, 22 aa, artificial
  peptide fold or domain or sub-domain
LNDVVYLLRHSSAVSHQQQLLL

SEQ ID NO: 11808 - protein, 21 aa, artificial
  peptide fold or domain or sub-domain
LNDWDAAAGAQTTIEGARKRI

SEQ ID NO: 11809 - protein, 28 aa, artificial
  peptide fold or domain or sub-domain
LNDWKRAGTISRISGYYCLEQMDFLEKA

SEQ ID NO: 11810 - protein, 27 aa, artificial
  peptide fold or domain or sub-domain
LNEAAVVPFVSGQLNNLELALSLASRG

SEQ ID NO: 11811 - protein, 23 aa, artificial
  peptide fold or domain or sub-domain
LNEADVANRLWLDKQEGEENFYL

SEQ ID NO: 11812 - protein, 22 aa, artificial
  peptide fold or domain or sub-domain
LNEAEFDGTIITCPLHYWTWDL

SEQ ID NO: 11813 - protein, 27 aa, artificial
  peptide fold or domain or sub-domain
LNECEQKLKKAHESQDWETAAMLTVEL

SEQ ID NO: 11814 - protein, 23 aa, artificial
  peptide fold or domain or sub-domain
LNEDIVGEFACQEGRGFLAWDNF

SEQ ID NO: 11815 - protein, 22 aa, artificial
  peptide fold or domain or sub-domain
LNEDLETLRIASHLSPEELNLC

SEQ ID NO: 11816 - protein, 25 aa, artificial
  peptide fold or domain or sub-domain
LNEEEERLEHYLDGCTRHQLIVTVE

SEQ ID NO: 11817 - protein, 27 aa, artificial
  peptide fold or domain or sub-domain
LNEEQCKELKMGSYLAVAAASANPPHF

SEQ ID NO: 11818 - protein, 25 aa, artificial
  peptide fold or domain or sub-domain
LNEERERCGTTLSIMTTDKIASVVE

SEQ ID NO: 11819 - protein, 28 aa, artificial
  peptide fold or domain or sub-domain
LNEFAHKGLIRLRRGEIRILDTAGLNKY

SEQ ID NO: 11820 - protein, 25 aa, artificial
  peptide fold or domain or sub-domain
LNERLKESIEAGAPQLIIEDLWDLL

SEQ ID NO: 11821 - protein, 28 aa, artificial
  peptide fold or domain or sub-domain
LNESKASLVYSRLSKHIRNLGLKGFRDY

SEQ ID NO: 11822 - protein, 23 aa, artificial
  peptide fold or domain or sub-domain
LNETANRFIKAIGMTDIDESTSK

SEQ ID NO: 11823 - protein, 21 aa, artificial
  peptide fold or domain or sub-domain
LNFLKKDLSIITLLRASYITQ

SEQ ID NO: 11824 - protein, 29 aa, artificial
  peptide fold or domain or sub-domain
LNFVLTRDKNYSAEGATVIYDLKEVAQHL

SEQ ID NO: 11825 - protein, 28 aa, artificial
  peptide fold or domain or sub-domain
LNGASHDQVYNALRMTNLPRNGVDAESA

SEQ ID NO: 11826 - protein, 24 aa, artificial
  peptide fold or domain or sub-domain
LNGERWDRSALVPGTLTQAILIHE

SEQ ID NO: 11827 - protein, 21 aa, artificial
  peptide fold or domain or sub-domain
LNGQKGPGLETLSPAKARQVL

SEQ ID NO: 11828 - protein, 27 aa, artificial
  peptide fold or domain or sub-domain
LNGQQIADLVKQGVIEKGMKVKVEAAL

SEQ ID NO: 11829 - protein, 27 aa, artificial
  peptide fold or domain or sub-domain
LNGRQKIAALYIPESSQVIGLDAAKQL

SEQ ID NO: 11830 - protein, 26 aa, artificial
  peptide fold or domain or sub-domain
LNGSVGPRYTTWFGTYSSARFNKVAG

SEQ ID NO: 11831 - protein, 23 aa, artificial
  peptide fold or domain or sub-domain
LNHDTLQGLIRQTGNERFGHDAY

SEQ ID NO: 11832 - protein, 24 aa, artificial
  peptide fold or domain or sub-domain
LNHFPWFKEIPFDDLPENARFKTH

SEQ ID NO: 11833 - protein, 20 aa, artificial
  peptide fold or domain or sub-domain
LNHYLNDKRKHEYTVWSMLL

SEQ ID NO: 11834 - protein, 21 aa, artificial
  peptide fold or domain or sub-domain
LNIFFQGLTSRGKKKLSISIF

SEQ ID NO: 11835 - protein, 28 aa, artificial
  peptide fold or domain or sub-domain
LNIKEILVKKGEKLPEELEKVLKVYVSE

SEQ ID NO: 11836 - protein, 29 aa, artificial
  peptide fold or domain or sub-domain
LNIKTKQLEEIVYYVSYVVIDPGKTEFKP

SEQ ID NO: 11837 - protein, 26 aa, artificial
  peptide fold or domain or sub-domain
LNILPREIKRRNKWPKSPHDLREITE

SEQ ID NO: 11838 - protein, 20 aa, artificial
  peptide fold or domain or sub-domain
LNILPSEVTKEQRRLAKTVN

SEQ ID NO: 11839 - protein, 20 aa, artificial
  peptide fold or domain or sub-domain
LNINWGNGIKVDEQKVTLKT

SEQ ID NO: 11840 - protein, 26 aa, artificial
  peptide fold or domain or sub-domain
LNITEEKAIEKASKIWKNVNKINLIK

SEQ ID NO: 11841 - protein, 21 aa, artificial
  peptide fold or domain or sub-domain
LNITGCRELNHNPEVFGGIME

SEQ ID NO: 11842 - protein, 29 aa, artificial
  peptide fold or domain or sub-domain
LNIVITSDQNYQLADASIVHSCEQAIAVA

SEQ ID NO: 11843 - protein, 29 aa, artificial
  peptide fold or domain or sub-domain
LNIVLSHREGYAPPGCLVARDLAAALELA

SEQ ID NO: 11844 - protein, 29 aa, artificial
  peptide fold or domain or sub-domain
LNIVLTTTPHQLPDSVTAVTSTTAAVAEA

SEQ ID NO: 11845 - protein, 25 aa, artificial
  peptide fold or domain or sub-domain
LNKALSRRVPKLSTSQVKEMVEARS

SEQ ID NO: 11846 - protein, 28 aa, artificial
  peptide fold or domain or sub-domain
LNKIEPILKQFPQVSIANYNSPTQIVLA

SEQ ID NO: 11847 - protein, 26 aa, artificial
  peptide fold or domain or sub-domain
LNKIKNYFEVGVVRHSNSRGNILCYR

SEQ ID NO: 11848 - protein, 28 aa, artificial
  peptide fold or domain or sub-domain
LNKKFKGKMWNTWQKEYKFREKKFIEEA

SEQ ID NO: 11849 - protein, 29 aa, artificial
  peptide fold or domain or sub-domain
LNKNDPRVQLILKSPSSSFRLNHLSELCS

SEQ ID NO: 11850 - protein, 29 aa, artificial
  peptide fold or domain or sub-domain
LNKNVFYLKFLIYYKYFFSNIKYKQYFYY

SEQ ID NO: 11851 - protein, 29 aa, artificial
  peptide fold or domain or sub-domain
LNKPQGCVCSNDDYPTIYQFFDYPLAGKL

SEQ ID NO: 11852 - protein, 22 aa, artificial
  peptide fold or domain or sub-domain
LNKSDLVSTVAEKVGVSRLAVQ

SEQ ID NO: 11853 - protein, 29 aa, artificial
  peptide fold or domain or sub-domain
LNKSDLVSTVAEKVGVSRLAVQTVLDEAV

SEQ ID NO: 11854 - protein, 21 aa, artificial
  peptide fold or domain or sub-domain
LNLGIRYVKPEDIEFAKEKNF

SEQ ID NO: 11855 - protein, 21 aa, artificial
  peptide fold or domain or sub-domain
LNLHEIALVLDLTPPRICQLH

SEQ ID NO: 11856 - protein, 24 aa, artificial
  peptide fold or domain or sub-domain
LNLIETKIQDVDYNPDQFPGLVYR

SEQ ID NO: 11857 - protein, 24 aa, artificial
  peptide fold or domain or sub-domain
LNLLARAFPDCLTEQQLSEWQDQR

SEQ ID NO: 11858 - protein, 25 aa, artificial
  peptide fold or domain or sub-domain
LNLNVAYHLLNQGKFNNSSTIIALQ

SEQ ID NO: 11859 - protein, 26 aa, artificial
  peptide fold or domain or sub-domain
LNLPSLEDYVEDEKIAQNGNCFLTDE

SEQ ID NO: 11860 - protein, 30 aa, artificial
  peptide fold or domain or sub-domain
LNLQKFINLVSKIDDGDDLPIEQIEFIFNS

SEQ ID NO: 11861 - protein, 29 aa, artificial
  peptide fold or domain or sub-domain
LNLQVAALRSVLYYEKYIVIDANDTDLEP

SEQ ID NO: 11862 - protein, 26 aa, artificial
  peptide fold or domain or sub-domain
LNLSDSAAGDISLTGGKGANLHRLSA

SEQ ID NO: 11863 - protein, 27 aa, artificial
  peptide fold or domain or sub-domain
LNLTLSSDQRRVFRGKRKSDCNQELQL

SEQ ID NO: 11864 - protein, 22 aa, artificial
  peptide fold or domain or sub-domain
LNLWEREQLQADFLKLNPQHTV

SEQ ID NO: 11865 - protein, 21 aa, artificial
  peptide fold or domain or sub-domain
LNMGTGNINRSTYTETEEAGL

SEQ ID NO: 11866 - protein, 24 aa, artificial
  peptide fold or domain or sub-domain
LNMSDGEVRKLVSQKRWDELKNSD

SEQ ID NO: 11867 - protein, 24 aa, artificial
  peptide fold or domain or sub-domain
LNNCTLAITEVFKKSKEEAQTIAR

SEQ ID NO: 11868 - protein, 24 aa, artificial
  peptide fold or domain or sub-domain
LNNLANIKREQGNIEEAVRLYRKA

SEQ ID NO: 11869 - protein, 25 aa, artificial
  peptide fold or domain or sub-domain
LNNTINSQSSNGYQTNQFLGNIEFL

SEQ ID NO: 11870 - protein, 28 aa, artificial
  peptide fold or domain or sub-domain
LNPAEIIIPSDASEATHRLIQSIANARC

SEQ ID NO: 11871 - protein, 30 aa, artificial
  peptide fold or domain or sub-domain
LNPFAKMPGFQDGESLHIKSRAIAKYILRK

SEQ ID NO: 11872 - protein, 30 aa, artificial
  peptide fold or domain or sub-domain
LNPFGQIPALVDGDEVLFESRAINRYIASK

SEQ ID NO: 11873 - protein, 30 aa, artificial
  peptide fold or domain or sub-domain
LNPLGRIPAFRDGDLKLADSSVICQYLEER

SEQ ID NO: 11874 - protein, 30 aa, artificial
  peptide fold or domain or sub-domain
LNPMKQVPALKIDGITIVQSLAIMEYLEET

SEQ ID NO: 11875 - protein, 20 aa, artificial
  peptide fold or domain or sub-domain
LNPQQLRQIGVSGRKASYLH

SEQ ID NO: 11876 - protein, 30 aa, artificial
  peptide fold or domain or sub-domain
LNPYCGHCEVCLTGHMNLCISPETRRSKSD

SEQ ID NO: 11877 - protein, 24 aa, artificial
  peptide fold or domain or sub-domain
LNQDMKLYMKNREKDKLTVVRMVK

SEQ ID NO: 11878 - protein, 25 aa, artificial
  peptide fold or domain or sub-domain
LNQEDDRCQLYLNSSTKTPLATCCE

SEQ ID NO: 11879 - protein, 21 aa, artificial
  peptide fold or domain or sub-domain
LNQEDIARMVGATRETVSHSL

SEQ ID NO: 11880 - protein, 25 aa, artificial
  peptide fold or domain or sub-domain
LNQEGERLMRYLEQSTKKQLMAVLD

SEQ ID NO: 11881 - protein, 20 aa, artificial
  peptide fold or domain or sub-domain
LNQERKDGRFPTSEFENMQR

SEQ ID NO: 11882 - protein, 28 aa, artificial
  peptide fold or domain or sub-domain
LNQFARQGVIRFEQRTLIVCRPDTLAEY

SEQ ID NO: 11883 - protein, 20 aa, artificial
  peptide fold or domain or sub-domain
LNQFYKDHRCLWEIDTSYDG

SEQ ID NO: 11884 - protein, 27 aa, artificial
  peptide fold or domain or sub-domain
LNQIHSTVVVNAAEALGGTPDADASVD

SEQ ID NO: 11885 - protein, 29 aa, artificial
  peptide fold or domain or sub-domain
LNQINPVNSRSLNITWESVKEQGNFLLKF

SEQ ID NO: 11886 - protein, 23 aa, artificial
  peptide fold or domain or sub-domain
LNQNHLFYLMAKGVKKAEAIKLI

SEQ ID NO: 11887 - protein, 27 aa, artificial
  peptide fold or domain or sub-domain
LNQVHGNACVSVDASSEQNQSVDASTT

SEQ ID NO: 11888 - protein, 23 aa, artificial
  peptide fold or domain or sub-domain
LNQVVETGEYNSRSEATRDALRA

SEQ ID NO: 11889 - protein, 23 aa, artificial
  peptide fold or domain or sub-domain
LNREAARLQQIISAEVGTPITSA

SEQ ID NO: 11890 - protein, 25 aa, artificial
  peptide fold or domain or sub-domain
LNRLMKYYGEEPMDKESKNNFFNYF

SEQ ID NO: 11891 - protein, 21 aa, artificial
  peptide fold or domain or sub-domain
LNRNDGIALMAGDTVLGAVRE

SEQ ID NO: 11892 - protein, 25 aa, artificial
  peptide fold or domain or sub-domain
LNRRTGCDKATSPLECLRTLPYQQL

SEQ ID NO: 11893 - protein, 23 aa, artificial
  peptide fold or domain or sub-domain
LNRVQSLAQSLGLDPQDIESLYQ

SEQ ID NO: 11894 - protein, 23 aa, artificial
  peptide fold or domain or sub-domain
LNSAQFDERAEAYSREKNKHYYF

SEQ ID NO: 11895 - protein, 28 aa, artificial
  peptide fold or domain or sub-domain
LNSFKRAGAIDVDRQQITVLDRNKLEDL

SEQ ID NO: 11896 - protein, 25 aa, artificial
  peptide fold or domain or sub-domain
LNSLMTFFGENPKDATARNTFFYKF

SEQ ID NO: 11897 - protein, 30 aa, artificial
  peptide fold or domain or sub-domain
LNSNIVLLKWMIAEGYGDRRTLERRIQGME

SEQ ID NO: 11898 - protein, 27 aa, artificial
  peptide fold or domain or sub-domain
LNSTYYKELVETKVIKDGMLPKLHNCF

SEQ ID NO: 11899 - protein, 20 aa, artificial
  peptide fold or domain or sub-domain
LNSVRLASTQEVPPGHNTNP

SEQ ID NO: 11900 - protein, 27 aa, artificial
  peptide fold or domain or sub-domain
LNSYEMRLAIEKAGIKLSNKVTQVLVA

SEQ ID NO: 11901 - protein, 29 aa, artificial
  peptide fold or domain or sub-domain
LNTDGRRILFSKGGSIYIFNPDTEKIEKI

SEQ ID NO: 11902 - protein, 23 aa, artificial
  peptide fold or domain or sub-domain
LNTETSQAMINLTKNPRFVWDSY

SEQ ID NO: 11903 - protein, 29 aa, artificial
  peptide fold or domain or sub-domain
LNTIKNASDSDGQDLLFTNQLKEHPTDFS

SEQ ID NO: 11904 - protein, 26 aa, artificial
  peptide fold or domain or sub-domain
LNTLRIYIINQNSASSRCAVIYGRIL

SEQ ID NO: 11905 - protein, 29 aa, artificial
  peptide fold or domain or sub-domain
LNTREQDVHKKLQHMTGLNRLRQVAKMAE

SEQ ID NO: 11906 - protein, 26 aa, artificial
  peptide fold or domain or sub-domain
LNTTADLLDVLGQEPFRASAYRGAAR

SEQ ID NO: 11907 - protein, 21 aa, artificial
  peptide fold or domain or sub-domain
LNTYTKAINLDATNPVFYCNR

SEQ ID NO: 11908 - protein, 26 aa, artificial
  peptide fold or domain or sub-domain
LNVLSRQIEDSTLPESEQVRIVRSAG

SEQ ID NO: 11909 - protein, 20 aa, artificial
  peptide fold or domain or sub-domain
LNVVIDEGQTYPQKQPLSQQ

SEQ ID NO: 11910 - protein, 26 aa, artificial
  peptide fold or domain or sub-domain
LNVVKNYFGCGRLMPKPGQEHLTLYV

SEQ ID NO: 11911 - protein, 26 aa, artificial
  peptide fold or domain or sub-domain
LNVVSTRNMNAKSGSSSAKLLDACLT

SEQ ID NO: 11912 - protein, 26 aa, artificial
  peptide fold or domain or sub-domain
LNWLSLKFDAFDYLATLENSGIADHS

SEQ ID NO: 11913 - protein, 26 aa, artificial
  peptide fold or domain or sub-domain
LNYNPSQGVSNSGAQDEEIHKQIVIE

SEQ ID NO: 11914 - protein, 28 aa, artificial
  peptide fold or domain or sub-domain
LNYSKSEKEALYLQNELSKKGYSVLAYK

SEQ ID NO: 11915 - protein, 21 aa, artificial
  peptide fold or domain or sub-domain
LNYVKKQSESRYSSLVTKLGI

SEQ ID NO: 11916 - protein, 29 aa, artificial
  peptide fold or domain or sub-domain
LNYYTVWKQFGGLPEFYNIPQGYTVEKRE

SEQ ID NO: 11917 - protein, 30 aa, artificial
  peptide fold or domain or sub-domain
LPACFDVTAWSETREIMGIRHRQWDLEGVQ

SEQ ID NO: 11918 - protein, 29 aa, artificial
  peptide fold or domain or sub-domain
LPADEASLESFRKHSALEDSFIQRRIKVL

SEQ ID NO: 11919 - protein, 25 aa, artificial
  peptide fold or domain or sub-domain
LPADEVFAGMLNSRANNAATLIGLQ

SEQ ID NO: 11920 - protein, 23 aa, artificial
  peptide fold or domain or sub-domain
LPADIAQQITLLSNAEVMRMKRA

SEQ ID NO: 11921 - protein, 24 aa, artificial
  peptide fold or domain or sub-domain
LPADQLENLDEWPEEALHKDTYFL

SEQ ID NO: 11922 - protein, 29 aa, artificial
  peptide fold or domain or sub-domain
LPADTGAKFGELLGKGDFGGAIGAVDDAL

SEQ ID NO: 11923 - protein, 29 aa, artificial
  peptide fold or domain or sub-domain
LPADVRDALDRHEAAGTTTDPEYLAATQV

SEQ ID NO: 11924 - protein, 21 aa, artificial
  peptide fold or domain or sub-domain
LPAEFNAEGDVAAFMANLSQL

SEQ ID NO: 11925 - protein, 23 aa, artificial
  peptide fold or domain or sub-domain
LPAENDYSLEARMKRTLFYGLHQ

SEQ ID NO: 11926 - protein, 24 aa, artificial
  peptide fold or domain or sub-domain
LPAERELSELIGVTRTTLREVLQR

SEQ ID NO: 11927 - protein, 26 aa, artificial
  peptide fold or domain or sub-domain
LPAFKRITQQTADRLHYHDKSLDFYE

SEQ ID NO: 11928 - protein, 26 aa, artificial
  peptide fold or domain or sub-domain
LPAFYELLKVTSERDHFKVRSFSYFS

SEQ ID NO: 11929 - protein, 29 aa, artificial
  peptide fold or domain or sub-domain
LPAGIAAVYQRNTDNKAVFIRAGRMWIYD

SEQ ID NO: 11930 - protein, 26 aa, artificial
  peptide fold or domain or sub-domain
LPAIFSWLYKEGALSEQEMVSSFNCG

SEQ ID NO: 11931 - protein, 21 aa, artificial
  peptide fold or domain or sub-domain
LPAKEVAKILETSVSRVSQLK

SEQ ID NO: 11932 - protein, 26 aa, artificial
  peptide fold or domain or sub-domain
LPAKLANPGVPMLYGEYSLYYNDDVW

SEQ ID NO: 11933 - protein, 29 aa, artificial
  peptide fold or domain or sub-domain
LPAKYRDAIKKYGSSGSYENPEYQEAVNY

SEQ ID NO: 11934 - protein, 30 aa, artificial
  peptide fold or domain or sub-domain
LPAMKEIKFLLPKPALSLRELRPAQWVALV

SEQ ID NO: 11935 - protein, 21 aa, artificial
  peptide fold or domain or sub-domain
LPAPCLKAKTVEEFFVELEKN

SEQ ID NO: 11936 - protein, 21 aa, artificial
  peptide fold or domain or sub-domain
LPARLENVPTETLNSGKDVIG

SEQ ID NO: 11937 - protein, 20 aa, artificial
  peptide fold or domain or sub-domain
LPASALETIGIARDIAPAIV

SEQ ID NO: 11938 - protein, 26 aa, artificial
  peptide fold or domain or sub-domain
LPASILVHENSYQPLDKGALAQYDEQ

SEQ ID NO: 11939 - protein, 20 aa, artificial
  peptide fold or domain or sub-domain
LPASPEATLAAQEAFRLDVM

SEQ ID NO: 11940 - protein, 25 aa, artificial
  peptide fold or domain or sub-domain
LPATLTNIYKELSNDCGVCNATTHG

SEQ ID NO: 11941 - protein, 30 aa, artificial
  peptide fold or domain or sub-domain
LPAWEDLPFAEVKAQFPEDYRRWQEAPETL

SEQ ID NO: 11942 - protein, 21 aa, artificial
  peptide fold or domain or sub-domain
LPCKDANDCLTAGIDAATIKA

SEQ ID NO: 11943 - protein, 21 aa, artificial
  peptide fold or domain or sub-domain
LPCKDANECHLNGHDREIMEQ

SEQ ID NO: 11944 - protein, 20 aa, artificial
  peptide fold or domain or sub-domain
LPDANVPPHLAHLYESRTKS

SEQ ID NO: 11945 - protein, 30 aa, artificial
  peptide fold or domain or sub-domain
LPDDFTLAASSATCQVQGFYHKTRPIYATQ

SEQ ID NO: 11946 - protein, 24 aa, artificial
  peptide fold or domain or sub-domain
LPDEAAILAAMRTKQIDFALLNDP

SEQ ID NO: 11947 - protein, 30 aa, artificial
  peptide fold or domain or sub-domain
LPDFAITAVATDDGEIMAIENEKEQIYGLQ

SEQ ID NO: 11948 - protein, 22 aa, artificial
  peptide fold or domain or sub-domain
LPDGEDPDTLVRKEGKEAFEAR

SEQ ID NO: 11949 - protein, 20 aa, artificial
  peptide fold or domain or sub-domain
LPDIAKKQLFTQEELVQVKR

SEQ ID NO: 11950 - protein, 27 aa, artificial
  peptide fold or domain or sub-domain
LPDKLFDHYKHHLDSWQRDLLQEDKLN

SEQ ID NO: 11951 - protein, 29 aa, artificial
  peptide fold or domain or sub-domain
LPDLPYEKESFKPHFTLETFDYHHGKHHN

SEQ ID NO: 11952 - protein, 29 aa, artificial
  peptide fold or domain or sub-domain
LPDMPYAYGALKPAMPGEILTLHRSKHHT

SEQ ID NO: 11953 - protein, 30 aa, artificial
  peptide fold or domain or sub-domain
LPDQDLVTLSRYIRDEDGIVLGSSSALNVA

SEQ ID NO: 11954 - protein, 30 aa, artificial
  peptide fold or domain or sub-domain
LPDQLVGDLDSIEEGVLNWVQKNEVAIKQF

SEQ ID NO: 11955 - protein, 29 aa, artificial
  peptide fold or domain or sub-domain
LPDSIQSIIRTNEKNKTFSNEEYKDAVAL

SEQ ID NO: 11956 - protein, 30 aa, artificial
  peptide fold or domain or sub-domain
LPDVIVGDFDSLRDNVRQWYEDHGVLVKHD

SEQ ID NO: 11957 - protein, 24 aa, artificial
  peptide fold or domain or sub-domain
LPEADHMRLHLQAVLPDYMIPAAY

SEQ ID NO: 11958 - protein, 23 aa, artificial
  peptide fold or domain or sub-domain
LPEDALFYACQRGLDRRDALAMI

SEQ ID NO: 11959 - protein, 29 aa, artificial
  peptide fold or domain or sub-domain
LPEEDLISRPRNASDIQFQDWRRLGSEGL

SEQ ID NO: 11960 - protein, 20 aa, artificial
  peptide fold or domain or sub-domain
LPEEPNTSEESKLVSTLDNL

SEQ ID NO: 11961 - protein, 30 aa, artificial
  peptide fold or domain or sub-domain
LPEETVRLASEAGFKPVPTGMEHGTITVVV

SEQ ID NO: 11962 - protein, 30 aa, artificial
  peptide fold or domain or sub-domain
LPEFVSGDFDSIRPEVKEYYTKKGCDLIST

SEQ ID NO: 11963 - protein, 30 aa, artificial
  peptide fold or domain or sub-domain
LPEGFEVVATSSNAPFAFIADEKRKYYAVQ

SEQ ID NO: 11964 - protein, 30 aa, artificial
  peptide fold or domain or sub-domain
LPEGFTRTASSKDCGYAVVENTSKKIFGIQ

SEQ ID NO: 11965 - protein, 29 aa, artificial
  peptide fold or domain or sub-domain
LPEIPYLNSGIKNFMSVPSLKQHVKLHQE

SEQ ID NO: 11966 - protein, 29 aa, artificial
  peptide fold or domain or sub-domain
LPEKIDAVYEAPQEEKAVFFAGNEYWIYS

SEQ ID NO: 11967 - protein, 20 aa, artificial
  peptide fold or domain or sub-domain
LPEKIRNAIENNIEDFELSR

SEQ ID NO: 11968 - protein, 22 aa, artificial
  peptide fold or domain or sub-domain
LPEKLSKETEDERIKSALRVCG

SEQ ID NO: 11969 - protein, 21 aa, artificial
  peptide fold or domain or sub-domain
LPEMHPPDLRLPIERLRQQFF

SEQ ID NO: 11970 - protein, 20 aa, artificial
  peptide fold or domain or sub-domain
LPENPDSSLTARDAFTLDII

SEQ ID NO: 11971 - protein, 27 aa, artificial
  peptide fold or domain or sub-domain
LPETDLGLLRAAGAASPTVLRALSQRW

SEQ ID NO: 11972 - protein, 30 aa, artificial
  peptide fold or domain or sub-domain
LPEVLEVTATTDDGVIMGVRHKKYTVEGVQ

SEQ ID NO: 11973 - protein, 26 aa, artificial
  peptide fold or domain or sub-domain
LPEVTDDGKIRLGLVTDDKTGAMIAG

SEQ ID NO: 11974 - protein, 25 aa, artificial
  peptide fold or domain or sub-domain
LPFAANYLYMVTGAEPSAAQVRAIE

SEQ ID NO: 11975 - protein, 25 aa, artificial
  peptide fold or domain or sub-domain
LPFDDQSGTIPNVGGRINGSPNEYV

SEQ ID NO: 11976 - protein, 29 aa, artificial
  peptide fold or domain or sub-domain
LPFEIKDFMKKTEALRLQYRYLDLRSFQM

SEQ ID NO: 11977 - protein, 29 aa, artificial
  peptide fold or domain or sub-domain
LPFEIKRAFKSNEKVRFEYKFLDHRNDEV

SEQ ID NO: 11978 - protein, 29 aa, artificial
  peptide fold or domain or sub-domain
LPFEVATSKEIREEVRLKYRYLDLRNRKV

SEQ ID NO: 11979 - protein, 29 aa, artificial
  peptide fold or domain or sub-domain
LPFLIRDDDNSKEETKLQYRFLDLRKPIN

SEQ ID NO: 11980 - protein, 30 aa, artificial
  peptide fold or domain or sub-domain
LPFLSGLKIGDLHGVGKVTEQTLQKHGFNT

SEQ ID NO: 11981 - protein, 21 aa, artificial
  peptide fold or domain or sub-domain
LPFMERLALSLEMKGGYGAML

SEQ ID NO: 11982 - protein, 29 aa, artificial
  peptide fold or domain or sub-domain
LPFPVEEETHVSEETKLKYRYIDLRRESM

SEQ ID NO: 11983 - protein, 27 aa, artificial
  peptide fold or domain or sub-domain
LPFSQTVVAHIAKDGHYYIHPDINQNR

SEQ ID NO: 11984 - protein, 29 aa, artificial
  peptide fold or domain or sub-domain
LPFTLDDYVDVAENLRLKHRYLDLRRTPL

SEQ ID NO: 11985 - protein, 24 aa, artificial
  peptide fold or domain or sub-domain
LPGDAEMIAMFGVSRPVLRESVKT

SEQ ID NO: 11986 - protein, 27 aa, artificial
  peptide fold or domain or sub-domain
LPGLAQRDGEGPLLMRYHPMILFRHRV

SEQ ID NO: 11987 - protein, 29 aa, artificial
  peptide fold or domain or sub-domain
LPGNLDAAVYSPRTQWIHFFKGDKVWRYI

SEQ ID NO: 11988 - protein, 24 aa, artificial
  peptide fold or domain or sub-domain
LPGQRELAQQFGTSLAGVREAISV

SEQ ID NO: 11989 - protein, 28 aa, artificial
  peptide fold or domain or sub-domain
LPGSISPLTGLIKNANIQVINGHALQAD

SEQ ID NO: 11990 - protein, 21 aa, artificial
  peptide fold or domain or sub-domain
LPGTKITERYPQFKFDDKWTA

SEQ ID NO: 11991 - protein, 25 aa, artificial
  peptide fold or domain or sub-domain
LPHAANFLWQLTGNKPDDQIARDLD

SEQ ID NO: 11992 - protein, 29 aa, artificial
  peptide fold or domain or sub-domain
LPHDEKEIEVVSKQTQISSEKLKDRIDSL

SEQ ID NO: 11993 - protein, 22 aa, artificial
  peptide fold or domain or sub-domain
LPHDELHRTDVAQHALDDFLTS

SEQ ID NO: 11994 - protein, 29 aa, artificial
  peptide fold or domain or sub-domain
LPHEEQGVAQLARDTGRTVEEIRAQIADL

SEQ ID NO: 11995 - protein, 29 aa, artificial
  peptide fold or domain or sub-domain
LPHEKNDIQLLAKQLQRFPVTIAKQIERL

SEQ ID NO: 11996 - protein, 27 aa, artificial
  peptide fold or domain or sub-domain
LPHKRSKHAKKASYVTVQNESGGTTDG

SEQ ID NO: 11997 - protein, 27 aa, artificial
  peptide fold or domain or sub-domain
LPHKTSLPGKDPKKQHNVCTDCYKILH

SEQ ID NO: 11998 - protein, 21 aa, artificial
  peptide fold or domain or sub-domain
LPHRELSSLSGMARETVTRVL

SEQ ID NO: 11999 - protein, 29 aa, artificial
  peptide fold or domain or sub-domain
LPHTDAEIDDLAGKIGKTSAEIKARIESL

SEQ ID NO: 12000 - protein, 29 aa, artificial
  peptide fold or domain or sub-domain
LPIAYLPYQPSKLTDIIPTFWEKLGINTV

SEQ ID NO: 12001 - protein, 28 aa, artificial
  peptide fold or domain or sub-domain
LPIDCVKNVIRPKNDAMMLSADTPTFVT

SEQ ID NO: 12002 - protein, 29 aa, artificial
  peptide fold or domain or sub-domain
LPIDPLGRLESGMDNRLNARALDMRNQKT

SEQ ID NO: 12003 - protein, 25 aa, artificial
  peptide fold or domain or sub-domain
LPIEALEELIKPAGMYRQRARNLKA

SEQ ID NO: 12004 - protein, 25 aa, artificial
  peptide fold or domain or sub-domain
LPIFDIATINEDPDQVANINEPFSK

SEQ ID NO: 12005 - protein, 26 aa, artificial
  peptide fold or domain or sub-domain
LPIFISESAGMEASGDGPLNVKAWQE

SEQ ID NO: 12006 - protein, 28 aa, artificial
  peptide fold or domain or sub-domain
LPISKVKRIGKVDPESILTSNMAYVATA

SEQ ID NO: 12007 - protein, 28 aa, artificial
  peptide fold or domain or sub-domain
LPISRVRAICRTVPTITLLSAEAPLLIS

SEQ ID NO: 12008 - protein, 28 aa, artificial
  peptide fold or domain or sub-domain
LPISRVRLIMKSSPDVSCINQDALFLTT

SEQ ID NO: 12009 - protein, 28 aa, artificial
  peptide fold or domain or sub-domain
LPIVRINTIMKSSSEAENISRESSLMMT

SEQ ID NO: 12010 - protein, 21 aa, artificial
  peptide fold or domain or sub-domain
LPKAVIEKHPESWTQVGNFVS

SEQ ID NO: 12011 - protein, 21 aa, artificial
  peptide fold or domain or sub-domain
LPKELLLEEDVERFLGALEGW

SEQ ID NO: 12012 - protein, 20 aa, artificial
  peptide fold or domain or sub-domain
LPKETDESHRTRALLEGDIF

SEQ ID NO: 12013 - protein, 26 aa, artificial
  peptide fold or domain or sub-domain
LPKFATVVALTENRKGVALRNENYFH

SEQ ID NO: 12014 - protein, 21 aa, artificial
  peptide fold or domain or sub-domain
LPKFDQFSSAREYREAINRIY

SEQ ID NO: 12015 - protein, 29 aa, artificial
  peptide fold or domain or sub-domain
LPKGEQAAIKEAETTGNYDSLAYQAANAH

SEQ ID NO: 12016 - protein, 21 aa, artificial
  peptide fold or domain or sub-domain
LPKGFSDGKSADEFMAMLPQL

SEQ ID NO: 12017 - protein, 27 aa, artificial
  peptide fold or domain or sub-domain
LPKGGHGGHNGMRSIIDRLKGSRDFPR

SEQ ID NO: 12018 - protein, 20 aa, artificial
  peptide fold or domain or sub-domain
LPKGVQAKINANLDMLHLSR

SEQ ID NO: 12019 - protein, 23 aa, artificial
  peptide fold or domain or sub-domain
LPKGVYDQSVMTEELVRLYVGQW

SEQ ID NO: 12020 - protein, 21 aa, artificial
  peptide fold or domain or sub-domain
LPKHVVEAKGQDWVKIGNIVT

SEQ ID NO: 12021 - protein, 20 aa, artificial
  peptide fold or domain or sub-domain
LPKKYRTKFDQHIELARRCK

SEQ ID NO: 12022 - protein, 29 aa, artificial
  peptide fold or domain or sub-domain
LPKLKYALNALSPHISEETLNFHYNKHHA

SEQ ID NO: 12023 - protein, 28 aa, artificial
  peptide fold or domain or sub-domain
LPKSNIYVTFNFVYQLGVAGDIMKSKFL

SEQ ID NO: 12024 - protein, 29 aa, artificial
  peptide fold or domain or sub-domain
LPKTDEEIAEVARVLTIDPAELRQRVDAL

SEQ ID NO: 12025 - protein, 23 aa, artificial
  peptide fold or domain or sub-domain
LPKVVQRLQHALPSLNLTTSDVQ

SEQ ID NO: 12026 - protein, 24 aa, artificial
  peptide fold or domain or sub-domain
LPKWKKNDFKTSNSQPVKNLDLIN

SEQ ID NO: 12027 - protein, 24 aa, artificial
  peptide fold or domain or sub-domain
LPKWKRNGWKNSRGLDVANWEHFK

SEQ ID NO: 12028 - protein, 27 aa, artificial
  peptide fold or domain or sub-domain
LPLADINQYIEHGDIYGGMIPKVLDAK

SEQ ID NO: 12029 - protein, 23 aa, artificial
  peptide fold or domain or sub-domain
LPLAIAKAQGVWITDVENNQYLD

SEQ ID NO: 12030 - protein, 27 aa, artificial
  peptide fold or domain or sub-domain
LPLALRYIGRDPMHPSAQDYAAAQAML

SEQ ID NO: 12031 - protein, 28 aa, artificial
  peptide fold or domain or sub-domain
LPLARIKKIMKLDEDVKMISAEAPVLFA

SEQ ID NO: 12032 - protein, 28 aa, artificial
  peptide fold or domain or sub-domain
LPLARTKRIVNQDDDVSLVSVAAYAAIN

SEQ ID NO: 12033 - protein, 28 aa, artificial
  peptide fold or domain or sub-domain
LPLARVKALVKADPDVTLAGQEAIFILA

SEQ ID NO: 12034 - protein, 27 aa, artificial
  peptide fold or domain or sub-domain
LPLASARSVGAEVQFAGKNYKVVELTE

SEQ ID NO: 12035 - protein, 29 aa, artificial
  peptide fold or domain or sub-domain
LPLDPTGKVKAELDTRLNNRFMDLRRPEV

SEQ ID NO: 12036 - protein, 28 aa, artificial
  peptide fold or domain or sub-domain
LPLDSNHVNTEEARLKYRYLDLRRPEMA

SEQ ID NO: 12037 - protein, 29 aa, artificial
  peptide fold or domain or sub-domain
LPLDVQETINRCEENGTTDSEEFAAAIEV

SEQ ID NO: 12038 - protein, 27 aa, artificial
  peptide fold or domain or sub-domain
LPLEEKSVAIEVRGADGKLSRVEHKVY

SEQ ID NO: 12039 - protein, 27 aa, artificial
  peptide fold or domain or sub-domain
LPLEKIFENFYEEHDPGEQKEYIEGTV

SEQ ID NO: 12040 - protein, 26 aa, artificial
  peptide fold or domain or sub-domain
LPLFYKLYLQTAKRNGFLPGSYRHFS

SEQ ID NO: 12041 - protein, 24 aa, artificial
  peptide fold or domain or sub-domain
LPLGEGRGEGARTGSLFPYSLSDE

SEQ ID NO: 12042 - protein, 29 aa, artificial
  peptide fold or domain or sub-domain
LPLGQIIERPTHGSEIRFPTWQALKQDYI

SEQ ID NO: 12043 - protein, 25 aa, artificial
  peptide fold or domain or sub-domain
LPLHARLARAWQTDAPGADLLRRAL

SEQ ID NO: 12044 - protein, 20 aa, artificial
  peptide fold or domain or sub-domain
LPLKEIAQVLHLKEGTVKAH

SEQ ID NO: 12045 - protein, 28 aa, artificial
  peptide fold or domain or sub-domain
LPLLPGVNANERTRLKYRYIDLRSDKLQ

SEQ ID NO: 12046 - protein, 28 aa, artificial
  peptide fold or domain or sub-domain
LPLSKIKKIFKMDPDYLAASQSAVYATG

SEQ ID NO: 12047 - protein, 28 aa, artificial
  peptide fold or domain or sub-domain
LPLSRVKTIVKTVPAVSLVTSEALISVG

SEQ ID NO: 12048 - protein, 28 aa, artificial
  peptide fold or domain or sub-domain
LPLTRVKKIIAVDPDITVCSNNAAFVIT

SEQ ID NO: 12049 - protein, 25 aa, artificial
  peptide fold or domain or sub-domain
LPLTRWNTADANSLTMHSGVKNIFS

SEQ ID NO: 12050 - protein, 24 aa, artificial
  peptide fold or domain or sub-domain
LPLWKQRSWKKVEGIFKENTELIQ

SEQ ID NO: 12051 - protein, 30 aa, artificial
  peptide fold or domain or sub-domain
LPNAILGDLDSIRPDTQHFFTCKGVAVHLR

SEQ ID NO: 12052 - protein, 29 aa, artificial
  peptide fold or domain or sub-domain
LPNDQSTIEKIAKSLSKSVESVKNKIAQL

SEQ ID NO: 12053 - protein, 24 aa, artificial
  peptide fold or domain or sub-domain
LPNDYGRILRREGKIYSIIEAKDI

SEQ ID NO: 12054 - protein, 24 aa, artificial
  peptide fold or domain or sub-domain
LPNETMPPKWLTPHTLGLGNKVAV

SEQ ID NO: 12055 - protein, 29 aa, artificial
  peptide fold or domain or sub-domain
LPNGLEAAYEFADRDEVRFFKGNKYWAVQ

SEQ ID NO: 12056 - protein, 29 aa, artificial
  peptide fold or domain or sub-domain
LPNLPYAKTGIAPLFNEEQMTYHYDKHHK

SEQ ID NO: 12057 - protein, 20 aa, artificial
  peptide fold or domain or sub-domain
LPNMPKNEVAWKSLSQMDIL

SEQ ID NO: 12058 - protein, 20 aa, artificial
  peptide fold or domain or sub-domain
LPNQLQKLLNNQKEIAKTFS

SEQ ID NO: 12059 - protein, 30 aa, artificial
  peptide fold or domain or sub-domain
LPNQTINALTAAHIKAIPTGIKHGTITALV

SEQ ID NO: 12060 - protein, 29 aa, artificial
  peptide fold or domain or sub-domain
LPNRIDAAYEHPSHDLIFIFRGRKFWALN

SEQ ID NO: 12061 - protein, 21 aa, artificial
  peptide fold or domain or sub-domain
LPNSFKKIKNKKIFLKKLKEL

SEQ ID NO: 12062 - protein, 30 aa, artificial
  peptide fold or domain or sub-domain
LPNYIIGDLDSLSEKVYKYYRKNKVTIIKQ

SEQ ID NO: 12063 - protein, 24 aa, artificial
  peptide fold or domain or sub-domain
LPPERKLSEKLMVSRSAVRDAIKK

SEQ ID NO: 12064 - protein, 24 aa, artificial
  peptide fold or domain or sub-domain
LPPERVLCVELGLKRSDLRQALGV

SEQ ID NO: 12065 - protein, 24 aa, artificial
  peptide fold or domain or sub-domain
LPPERVMLDEYSVGRGTLRESLRF

SEQ ID NO: 12066 - protein, 24 aa, artificial
  peptide fold or domain or sub-domain
LPPEVEIAKHLGIGRAKVREALTG

SEQ ID NO: 12067 - protein, 25 aa, artificial
  peptide fold or domain or sub-domain
LPPGYIKGQNKQVKDFESEYSMLSS

SEQ ID NO: 12068 - protein, 27 aa, artificial
  peptide fold or domain or sub-domain
LPPGYPGHPKDADQICNRPISQPKAPR

SEQ ID NO: 12069 - protein, 23 aa, artificial
  peptide fold or domain or sub-domain
LPPIRDRLNRDLKKAKLSLKETV

SEQ ID NO: 12070 - protein, 30 aa, artificial
  peptide fold or domain or sub-domain
LPPKFKILARSETCPIEAMKHEELPIYGVQ

SEQ ID NO: 12071 - protein, 29 aa, artificial
  peptide fold or domain or sub-domain
LPPNIEAAAVSLNDGDFYFFKGGRCWRFR

SEQ ID NO: 12072 - protein, 29 aa, artificial
  peptide fold or domain or sub-domain
LPPQDMLSRPRNEQEMIYRDFKVLGTEYV

SEQ ID NO: 12073 - protein, 26 aa, artificial
  peptide fold or domain or sub-domain
LPPVFGWMAETGGIAEAEMLKTFNCG

SEQ ID NO: 12074 - protein, 24 aa, artificial
  peptide fold or domain or sub-domain
LPPVHPHEADVQHGRICVLAPVGS

SEQ ID NO: 12075 - protein, 23 aa, artificial
  peptide fold or domain or sub-domain
LPQCGECTSCLNSEGNFCIQFKQ

SEQ ID NO: 12076 - protein, 24 aa, artificial
  peptide fold or domain or sub-domain
LPQERDLIDTFKAAKGTVREAMKA

SEQ ID NO: 12077 - protein, 28 aa, artificial
  peptide fold or domain or sub-domain
LPQGKRLMLEGRLHKRVRALNFSDLNEY

SEQ ID NO: 12078 - protein, 21 aa, artificial
  peptide fold or domain or sub-domain
LPQGQDPDSYIRAHGRQGLQE

SEQ ID NO: 12079 - protein, 20 aa, artificial
  peptide fold or domain or sub-domain
LPQKFIEPIRSSIDQLRISY

SEQ ID NO: 12080 - protein, 29 aa, artificial
  peptide fold or domain or sub-domain
LPQTEIDFMHECEKNNDYDNKRYQDDVQI

SEQ ID NO: 12081 - protein, 20 aa, artificial
  peptide fold or domain or sub-domain
LPQVLGNNAESFNALTPDLL

SEQ ID NO: 12082 - protein, 30 aa, artificial
  peptide fold or domain or sub-domain
LPRAIVGDLDSIKPHVKKYYEEKGVEISQN

SEQ ID NO: 12083 - protein, 29 aa, artificial
  peptide fold or domain or sub-domain
LPREELVARPAGLDDTRFSAWRALGMDYL

SEQ ID NO: 12084 - protein, 30 aa, artificial
  peptide fold or domain or sub-domain
LPREFVITAESEDGTIMGIEHSKEPVAAVQ

SEQ ID NO: 12085 - protein, 21 aa, artificial
  peptide fold or domain or sub-domain
LPRHVIERRGDRWTQPEHLVA

SEQ ID NO: 12086 - protein, 26 aa, artificial
  peptide fold or domain or sub-domain
LPRIFYQIMMAGEIPPEEMKKVFNLG

SEQ ID NO: 12087 - protein, 29 aa, artificial
  peptide fold or domain or sub-domain
LPRKLDSVFEEPLSKKLFFFSGRQVWVYT

SEQ ID NO: 12088 - protein, 24 aa, artificial
  peptide fold or domain or sub-domain
LPRQEVLVEQFNVSLVSLREALRI

SEQ ID NO: 12089 - protein, 25 aa, artificial
  peptide fold or domain or sub-domain
LPRSLVNIFKEMATDLGVSINATDG

SEQ ID NO: 12090 - protein, 25 aa, artificial
  peptide fold or domain or sub-domain
LPRTEVINMLEREEINNAASVIGLQ

SEQ ID NO: 12091 - protein, 24 aa, artificial
  peptide fold or domain or sub-domain
LPSAGELCEEYEVSRTVIREATTT

SEQ ID NO: 12092 - protein, 21 aa, artificial
  peptide fold or domain or sub-domain
LPSDFDATGPLDDFLARLPQV

SEQ ID NO: 12093 - protein, 24 aa, artificial
  peptide fold or domain or sub-domain
LPSEIHIMEAEGVSRTVVRDALSR

SEQ ID NO: 12094 - protein, 23 aa, artificial
  peptide fold or domain or sub-domain
LPSELVEATTFLSDAEVKKLKGV

SEQ ID NO: 12095 - protein, 24 aa, artificial
  peptide fold or domain or sub-domain
LPSEPGSMRRLMTALVDFVKAMRV

SEQ ID NO: 12096 - protein, 24 aa, artificial
  peptide fold or domain or sub-domain
LPSERELMAFFNVGRPSVREALAA

SEQ ID NO: 12097 - protein, 24 aa, artificial
  peptide fold or domain or sub-domain
LPSEREMAQLFSVSRETIRGAVSH

SEQ ID NO: 12098 - protein, 28 aa, artificial
  peptide fold or domain or sub-domain
LPSFNRNELDLARRLDNRLLDLRNAGSG

SEQ ID NO: 12099 - protein, 28 aa, artificial
  peptide fold or domain or sub-domain
LPSGHSDLLEERIRNSGISDEYITPMFS

SEQ ID NO: 12100 - protein, 29 aa, artificial
  peptide fold or domain or sub-domain
LPSGPNAGFRWGGNGKLYLFKGFRFYEFD

SEQ ID NO: 12101 - protein, 29 aa, artificial
  peptide fold or domain or sub-domain
LPSGVDAAYEIPEEDKILLFKGNEFWVVR

SEQ ID NO: 12102 - protein, 21 aa, artificial
  peptide fold or domain or sub-domain
LPSIINYTSKKPIVGWEAQKQ

SEQ ID NO: 12103 - protein, 29 aa, artificial
  peptide fold or domain or sub-domain
LPSIINYTSKKPIVGWEAQKQAINDPKNT

SEQ ID NO: 12104 - protein, 29 aa, artificial
  peptide fold or domain or sub-domain
LPSLPYAYDALEPHFDKQTMEIHHTKHHQ

SEQ ID NO: 12105 - protein, 24 aa, artificial
  peptide fold or domain or sub-domain
LPSLRSFAASADVSMMTVREAIRI

SEQ ID NO: 12106 - protein, 24 aa, artificial
  peptide fold or domain or sub-domain
LPSSQVGALTAQGNLSGGLVPSLA

SEQ ID NO: 12107 - protein, 27 aa, artificial
  peptide fold or domain or sub-domain
LPSTSLQDLFHHADSDKELQAQDTFRT

SEQ ID NO: 12108 - protein, 21 aa, artificial
  peptide fold or domain or sub-domain
LPSVVALSSSGVQVGFAAKSR

SEQ ID NO: 12109 - protein, 29 aa, artificial
  peptide fold or domain or sub-domain
LPSVVALSSSGVQVGFAAKSRLNDPETIV

SEQ ID NO: 12110 - protein, 21 aa, artificial
  peptide fold or domain or sub-domain
LPSVVHYQQQGHSVGYDARTN

SEQ ID NO: 12111 - protein, 29 aa, artificial
  peptide fold or domain or sub-domain
LPSVVHYQQQGHSVGYDARTNAALDTANT

SEQ ID NO: 12112 - protein, 28 aa, artificial
  peptide fold or domain or sub-domain
LPSVVRGQIALSAANIDKSWIGTDVHEL

SEQ ID NO: 12113 - protein, 24 aa, artificial
  peptide fold or domain or sub-domain
LPTEHVLAKTFGVSRSVIREAIAQ

SEQ ID NO: 12114 - protein, 24 aa, artificial
  peptide fold or domain or sub-domain
LPTERALAEQFATNRNTIRKALDD

SEQ ID NO: 12115 - protein, 29 aa, artificial
  peptide fold or domain or sub-domain
LPTFRMFGMTKFYKHNPSVPDDEVTPEYL

SEQ ID NO: 12116 - protein, 30 aa, artificial
  peptide fold or domain or sub-domain
LPTGYKTIATSDNSPYCGIVHETKPIYGIQ

SEQ ID NO: 12117 - protein, 21 aa, artificial
  peptide fold or domain or sub-domain
LPTKLVQEKGDQWTRAENIAT

SEQ ID NO: 12118 - protein, 29 aa, artificial
  peptide fold or domain or sub-domain
LPTSLNAALYYPRNGKTYFFKGSQYWRFR

SEQ ID NO: 12119 - protein, 30 aa, artificial
  peptide fold or domain or sub-domain
LPTSLRTIAAAEDRSIMAIRHLTRPVYGLQ

SEQ ID NO: 12120 - protein, 29 aa, artificial
  peptide fold or domain or sub-domain
LPTSREVLEDIAKRIGKPLEHVRNRVSAL

SEQ ID NO: 12121 - protein, 23 aa, artificial
  peptide fold or domain or sub-domain
LPTSYVVKGTFLAEAEVRRLKSK

SEQ ID NO: 12122 - protein, 29 aa, artificial
  peptide fold or domain or sub-domain
LPTTRSGQRELAEALDLPVSDVTRRVEAM

SEQ ID NO: 12123 - protein, 22 aa, artificial
  peptide fold or domain or sub-domain
LPTVAQTYAIPHELTGKYALRR

SEQ ID NO: 12124 - protein, 20 aa, artificial
  peptide fold or domain or sub-domain
LPVAPDTSLATKGVVHVDVI

SEQ ID NO: 12125 - protein, 28 aa, artificial
  peptide fold or domain or sub-domain
LPVAVPDAHWFTLQHAAYIAKRPGGAGA

SEQ ID NO: 12126 - protein, 23 aa, artificial
  peptide fold or domain or sub-domain
LPVDLVAKTLLTDEATVDKIRAN

SEQ ID NO: 12127 - protein, 24 aa, artificial
  peptide fold or domain or sub-domain
LPVDRIPNMANLMPRFNYGGYATG

SEQ ID NO: 12128 - protein, 20 aa, artificial
  peptide fold or domain or sub-domain
LPVEELASLGVIRTRVRAIQ

SEQ ID NO: 12129 - protein, 30 aa, artificial
  peptide fold or domain or sub-domain
LPVNFRIIGTSDDQEIMAVEDVGRQLYGVQ

SEQ ID NO: 12130 - protein, 28 aa, artificial
  peptide fold or domain or sub-domain
LPVVDPVQADLETRLNSRFMDLRKRNIS

SEQ ID NO: 12131 - protein, 20 aa, artificial
  peptide fold or domain or sub-domain
LPVVTRVGSSGNHLVQIREQ

SEQ ID NO: 12132 - protein, 26 aa, artificial
  peptide fold or domain or sub-domain
LPWMLDRYRSLLAERGFGATPPELVQ

SEQ ID NO: 12133 - protein, 20 aa, artificial
  peptide fold or domain or sub-domain
LPYEEIAETTGMPLSMVRNK

SEQ ID NO: 12134 - protein, 26 aa, artificial
  peptide fold or domain or sub-domain
LPYVGTVVDAPFGKLDRKAFYGEPDI

SEQ ID NO: 12135 - protein, 25 aa, artificial
  peptide fold or domain or sub-domain
LPYVSPEIRNLRSELLLDPSFRAIP

SEQ ID NO: 12136 - protein, 26 aa, artificial
  peptide fold or domain or sub-domain
LQAIKQYREALEYVKLPVLAKILEDE

SEQ ID NO: 12137 - protein, 26 aa, artificial
  peptide fold or domain or sub-domain
LQAIVLFIATELVHKDDKKVLNQIFR

SEQ ID NO: 12138 - protein, 20 aa, artificial
  peptide fold or domain or sub-domain
LQALDETILDEAQHRRVVSA

SEQ ID NO: 12139 - protein, 23 aa, artificial
  peptide fold or domain or sub-domain
LQALLAERDPSSDVDHEEILQMF

SEQ ID NO: 12140 - protein, 28 aa, artificial
  peptide fold or domain or sub-domain
LQALLDPKAKITALRGQWVEVKKLPTFV

SEQ ID NO: 12141 - protein, 24 aa, artificial
  peptide fold or domain or sub-domain
LQANMQVKRPWEDYLNQAQQALAQ

SEQ ID NO: 12142 - protein, 20 aa, artificial
  peptide fold or domain or sub-domain
LQASDDTEALERLQSFEGIG

SEQ ID NO: 12143 - protein, 25 aa, artificial
  peptide fold or domain or sub-domain
LQAVVRTPDRLSLRVDEKAYRIDVR

SEQ ID NO: 12144 - protein, 20 aa, artificial
  peptide fold or domain or sub-domain
LQAVVSKHHPENPNLQRDLL

SEQ ID NO: 12145 - protein, 21 aa, artificial
  peptide fold or domain or sub-domain
LQAYDKAIAINPNYAYAWNGK

SEQ ID NO: 12146 - protein, 20 aa, artificial
  peptide fold or domain or sub-domain
LQAYIATHSPGTPAKFGELL

SEQ ID NO: 12147 - protein, 27 aa, artificial
  peptide fold or domain or sub-domain
LQAYKWSYAQMQPSLPLQFLVWVTFPL

SEQ ID NO: 12148 - protein, 20 aa, artificial
  peptide fold or domain or sub-domain
LQCIAAMQSMQKMHQDERQW

SEQ ID NO: 12149 - protein, 22 aa, artificial
  peptide fold or domain or sub-domain
LQCPQDIDLYVKNKCTCNPDED

SEQ ID NO: 12150 - protein, 23 aa, artificial
  peptide fold or domain or sub-domain
LQDAILRLGPNFGGAKLNSTLLF

SEQ ID NO: 12151 - protein, 20 aa, artificial
  peptide fold or domain or sub-domain
LQDDVRGLVKELNETLLELT

SEQ ID NO: 12152 - protein, 20 aa, artificial
  peptide fold or domain or sub-domain
LQDHDLNAHPSDSRRIGKIL

SEQ ID NO: 12153 - protein, 20 aa, artificial
  peptide fold or domain or sub-domain
LQDLFLIETDFTFNQSKQQA

SEQ ID NO: 12154 - protein, 20 aa, artificial
  peptide fold or domain or sub-domain
LQDYELSQRHEEPWRTGKLL

SEQ ID NO: 12155 - protein, 20 aa, artificial
  peptide fold or domain or sub-domain
LQDYVQKTYSEDTYRLARIL

SEQ ID NO: 12156 - protein, 21 aa, artificial
  peptide fold or domain or sub-domain
LQEAEDGILLPRPEPQYQKYA

SEQ ID NO: 12157 - protein, 28 aa, artificial
  peptide fold or domain or sub-domain
LQEGIVLNASSLKIHIKDLFNREIVYYL

SEQ ID NO: 12158 - protein, 23 aa, artificial
  peptide fold or domain or sub-domain
LQEIRARGEDLAGAERFAATIGD

SEQ ID NO: 12159 - protein, 30 aa, artificial
  peptide fold or domain or sub-domain
LQEKVPKSDIRQYFTDFTGDHTLVRDVQFF

SEQ ID NO: 12160 - protein, 22 aa, artificial
  peptide fold or domain or sub-domain
LQELVDAGVFGEDEVANYPNAD

SEQ ID NO: 12161 - protein, 23 aa, artificial
  peptide fold or domain or sub-domain
LQESTLYTQDRLGLKAMDKAGQL

SEQ ID NO: 12162 - protein, 25 aa, artificial
  peptide fold or domain or sub-domain
LQEYIQENPDLIRPEGYRNEVLAML

SEQ ID NO: 12163 - protein, 22 aa, artificial
  peptide fold or domain or sub-domain
LQFAFYINGNTVREFSLSKRYR

SEQ ID NO: 12164 - protein, 21 aa, artificial
  peptide fold or domain or sub-domain
LQFFSSDDIYSRGVHWYMNQF

SEQ ID NO: 12165 - protein, 22 aa, artificial
  peptide fold or domain or sub-domain
LQFLDVVLATDTIKEKQKAKMM

SEQ ID NO: 12166 - protein, 21 aa, artificial
  peptide fold or domain or sub-domain
LQFTKMYYHLMETDRRGLSQF

SEQ ID NO: 12167 - protein, 20 aa, artificial
  peptide fold or domain or sub-domain
LQGDLKAAIERDFGSVDNFK

SEQ ID NO: 12168 - protein, 25 aa, artificial
  peptide fold or domain or sub-domain
LQGFSRNTLEAAFNAEFNEIRRVLL

SEQ ID NO: 12169 - protein, 28 aa, artificial
  peptide fold or domain or sub-domain
LQGIIDPSARITRMRGQWIEREGIHFMP

SEQ ID NO: 12170 - protein, 25 aa, artificial
  peptide fold or domain or sub-domain
LQGKTIAEIAKLWNKDPIDTVFDIL

SEQ ID NO: 12171 - protein, 25 aa, artificial
  peptide fold or domain or sub-domain
LQGLTVAEAAALLGLPESEAARSLL

SEQ ID NO: 12172 - protein, 24 aa, artificial
  peptide fold or domain or sub-domain
LQHDYGATEPGRFRRYRAGDWPIG

SEQ ID NO: 12173 - protein, 25 aa, artificial
  peptide fold or domain or sub-domain
LQILESEYLENQGFHQKIQKIRESY

SEQ ID NO: 12174 - protein, 25 aa, artificial
  peptide fold or domain or sub-domain
LQIQPATGGNRLRFYCPTCPYVCPV

SEQ ID NO: 12175 - protein, 25 aa, artificial
  peptide fold or domain or sub-domain
LQITYTDEGQTWLSSNGRAAELVLL

SEQ ID NO: 12176 - protein, 23 aa, artificial
  peptide fold or domain or sub-domain
LQKELPKIDDEFAKSIAGEESNL

SEQ ID NO: 12177 - protein, 25 aa, artificial
  peptide fold or domain or sub-domain
LQKEQKNKIWKNLPKKEGIARLKEK

SEQ ID NO: 12178 - protein, 29 aa, artificial
  peptide fold or domain or sub-domain
LQKIAITEELVDGMRRGEFPDDHDLQCYT

SEQ ID NO: 12179 - protein, 24 aa, artificial
  peptide fold or domain or sub-domain
LQKKAEHQVGEDGFLLKIKLGHYA

SEQ ID NO: 12180 - protein, 28 aa, artificial
  peptide fold or domain or sub-domain
LQKLALAYGTKGSTLYQDDKLAATIIDG

SEQ ID NO: 12181 - protein, 20 aa, artificial
  peptide fold or domain or sub-domain
LQKLCKIHQPENPQHFACLL

SEQ ID NO: 12182 - protein, 25 aa, artificial
  peptide fold or domain or sub-domain
LQKLDRVAKALSFASKAEEVDEVLG

SEQ ID NO: 12183 - protein, 26 aa, artificial
  peptide fold or domain or sub-domain
LQKLDRVAKALSFASKAEEVDEVLGS

SEQ ID NO: 12184 - protein, 21 aa, artificial
  peptide fold or domain or sub-domain
LQKLVDDKLCLSYTQGSTTYS

SEQ ID NO: 12185 - protein, 21 aa, artificial
  peptide fold or domain or sub-domain
LQKSVQHKWPTNTTMRTRVVS

SEQ ID NO: 12186 - protein, 21 aa, artificial
  peptide fold or domain or sub-domain
LQLFGPPPNHLPSVTEARATI

SEQ ID NO: 12187 - protein, 24 aa, artificial
  peptide fold or domain or sub-domain
LQLLATIAAQKKNFSEAVELFDQA

SEQ ID NO: 12188 - protein, 20 aa, artificial
  peptide fold or domain or sub-domain
LQLLMSVFSNVDRKEEQGLT

SEQ ID NO: 12189 - protein, 25 aa, artificial
  peptide fold or domain or sub-domain
LQLPDISGLDLLRLIAQEGYDVPVI

SEQ ID NO: 12190 - protein, 27 aa, artificial
  peptide fold or domain or sub-domain
LQLPLTAEERTVLRGRRCSDCGLSLLL

SEQ ID NO: 12191 - protein, 21 aa, artificial
  peptide fold or domain or sub-domain
LQLPSVDFYNHRVEVEKGVLA

SEQ ID NO: 12192 - protein, 26 aa, artificial
  peptide fold or domain or sub-domain
LQMPILLMTGRNSSHEKAIGLDAGAD

SEQ ID NO: 12193 - protein, 29 aa, artificial
  peptide fold or domain or sub-domain
LQMSSDYRELGRARFGLRGAIQKAGTWQK

SEQ ID NO: 12194 - protein, 24 aa, artificial
  peptide fold or domain or sub-domain
LQNAKTLEEYHNTVLRGTFATVKS

SEQ ID NO: 12195 - protein, 23 aa, artificial
  peptide fold or domain or sub-domain
LQNATERFSKLVTGYNWTLDDTY

SEQ ID NO: 12196 - protein, 22 aa, artificial
  peptide fold or domain or sub-domain
LQNFSTRAYGTDGNREAGAYLS

SEQ ID NO: 12197 - protein, 27 aa, artificial
  peptide fold or domain or sub-domain
LQNGCTIFTDTEMARSGIPLRRMTPLG

SEQ ID NO: 12198 - protein, 24 aa, artificial
  peptide fold or domain or sub-domain
LQNIMMAPVLVMKENKAEVENRAR

SEQ ID NO: 12199 - protein, 25 aa, artificial
  peptide fold or domain or sub-domain
LQNLTLDSHIGYNMTFTTKRDSVIA

SEQ ID NO: 12200 - protein, 28 aa, artificial
  peptide fold or domain or sub-domain
LQNQSESIWEEAKEKADFETFRPNLEKL

SEQ ID NO: 12201 - protein, 28 aa, artificial
  peptide fold or domain or sub-domain
LQNTSQAIREKFFKNMSHTESNELTLNL

SEQ ID NO: 12202 - protein, 24 aa, artificial
  peptide fold or domain or sub-domain
LQNVAESLITVWKEPKSAALKHAE

SEQ ID NO: 12203 - protein, 24 aa, artificial
  peptide fold or domain or sub-domain
LQNVMCGPKRILGQDETTARKLAL

SEQ ID NO: 12204 - protein, 24 aa, artificial
  peptide fold or domain or sub-domain
LQNVMEAPLHVQRRDRKECHAEAE

SEQ ID NO: 12205 - protein, 28 aa, artificial
  peptide fold or domain or sub-domain
LQPIVDGEAPADGKDGSTAQLVGYVIAN

SEQ ID NO: 12206 - protein, 26 aa, artificial
  peptide fold or domain or sub-domain
LQPLADDIKMISGRRVVHVRGEYLPL

SEQ ID NO: 12207 - protein, 24 aa, artificial
  peptide fold or domain or sub-domain
LQPLINGTSQSNLLVGTDGSETLK

SEQ ID NO: 12208 - protein, 23 aa, artificial
  peptide fold or domain or sub-domain
LQPYKDFIEVLPKLTGYHDQDLL

SEQ ID NO: 12209 - protein, 30 aa, artificial
  peptide fold or domain or sub-domain
LQQFRKEHTGPDRLTYELKKEANWIESRIE

SEQ ID NO: 12210 - protein, 27 aa, artificial
  peptide fold or domain or sub-domain
LQQGAPVITDVEMVRAGIAKKQLAQLG

SEQ ID NO: 12211 - protein, 23 aa, artificial
  peptide fold or domain or sub-domain
LQQHYSEKVGKPYFKEIETYMME

SEQ ID NO: 12212 - protein, 25 aa, artificial
  peptide fold or domain or sub-domain
LQQIEPQAMELAFAAPRKEVEELFN

SEQ ID NO: 12213 - protein, 20 aa, artificial
  peptide fold or domain or sub-domain
LQQVAEEGPLSQERVHELAR

SEQ ID NO: 12214 - protein, 27 aa, artificial
  peptide fold or domain or sub-domain
LQRGAPVLCDARMVSEGITRKRLSAQN

SEQ ID NO: 12215 - protein, 27 aa, artificial
  peptide fold or domain or sub-domain
LQRGATIYADSNMIRSGLSVARLQQIH

SEQ ID NO: 12216 - protein, 26 aa, artificial
  peptide fold or domain or sub-domain
LQRLKEGGMLKGDVEEMLEAGVSGVF

SEQ ID NO: 12217 - protein, 27 aa, artificial
  peptide fold or domain or sub-domain
LQRPQRPLADEWQVLGQHDRTPALTRE

SEQ ID NO: 12218 - protein, 27 aa, artificial
  peptide fold or domain or sub-domain
LQRRIAQCKQHLGEEHLAKWGYYERLM

SEQ ID NO: 12219 - protein, 25 aa, artificial
  peptide fold or domain or sub-domain
LQRWLRGNPQAITPEPFHHVVLQWL

SEQ ID NO: 12220 - protein, 28 aa, artificial
  peptide fold or domain or sub-domain
LQSIEGVGPKTLEKLRELGVTSVEHLAE

SEQ ID NO: 12221 - protein, 20 aa, artificial
  peptide fold or domain or sub-domain
LQSIVSQNRPDKPEFMQELL

SEQ ID NO: 12222 - protein, 21 aa, artificial
  peptide fold or domain or sub-domain
LQSKYDPRDASKSTLRASPDT

SEQ ID NO: 12223 - protein, 22 aa, artificial
  peptide fold or domain or sub-domain
LQSLAQLDKIYQENGRKVIMDN

SEQ ID NO: 12224 - protein, 22 aa, artificial
  peptide fold or domain or sub-domain
LQSLPQGFELYGDKKFKAIIGN

SEQ ID NO: 12225 - protein, 22 aa, artificial
  peptide fold or domain or sub-domain
LQSTSQLDDVYGVKEAQTLRAS

SEQ ID NO: 12226 - protein, 23 aa, artificial
  peptide fold or domain or sub-domain
LQSVRDQAPQYRLDPDLAARFFS

SEQ ID NO: 12227 - protein, 25 aa, artificial
  peptide fold or domain or sub-domain
LQSWIETSGVVSESEGVKKKLKEWF

SEQ ID NO: 12228 - protein, 22 aa, artificial
  peptide fold or domain or sub-domain
LQSYIKGQQRRPRDRFLYAKLL

SEQ ID NO: 12229 - protein, 27 aa, artificial
  peptide fold or domain or sub-domain
LQTAGKLVADNYASAELGAKMATKLSG

SEQ ID NO: 12230 - protein, 22 aa, artificial
  peptide fold or domain or sub-domain
LQTISQLRAVYGRDTTRAILGN

SEQ ID NO: 12231 - protein, 28 aa, artificial
  peptide fold or domain or sub-domain
LQTLQHLFTRQLVTAVERGGLALTANGY

SEQ ID NO: 12232 - protein, 20 aa, artificial
  peptide fold or domain or sub-domain
LQTVLAQNHPQHPDILRELL

SEQ ID NO: 12233 - protein, 24 aa, artificial
  peptide fold or domain or sub-domain
LQTVQRILATEGDMELDEAGDVIG

SEQ ID NO: 12234 - protein, 29 aa, artificial
  peptide fold or domain or sub-domain
LQTYFEENQEQFEQITARHILVEDEETAN

SEQ ID NO: 12235 - protein, 22 aa, artificial
  peptide fold or domain or sub-domain
LQTYIRCRHPPPGSHLLYAKMI

SEQ ID NO: 12236 - protein, 24 aa, artificial
  peptide fold or domain or sub-domain
LQVAADHAKAGGLSIGYLQAVGEN

SEQ ID NO: 12237 - protein, 24 aa, artificial
  peptide fold or domain or sub-domain
LQVAKLHALESGIQVDYVQETVEE

SEQ ID NO: 12238 - protein, 25 aa, artificial
  peptide fold or domain or sub-domain
LQVAKRSGKALHLRSDNRAHTLCYY

SEQ ID NO: 12239 - protein, 28 aa, artificial
  peptide fold or domain or sub-domain
LQVPEEYLKPYDFIQDKNRHHYAGMVSL

SEQ ID NO: 12240 - protein, 20 aa, artificial
  peptide fold or domain or sub-domain
LQVQAEAEGLADAEERCDQL

SEQ ID NO: 12241 - protein, 29 aa, artificial
  peptide fold or domain or sub-domain
LQVQDVPDSKYVQHAILLVSPKKRLLCSA

SEQ ID NO: 12242 - protein, 26 aa, artificial
  peptide fold or domain or sub-domain
LQVQPEEERRLEFWPEHPAALRGLLE

SEQ ID NO: 12243 - protein, 30 aa, artificial
  peptide fold or domain or sub-domain
LQVWRVESLDLVPVPESLYGSFYSGDAYLV

SEQ ID NO: 12244 - protein, 27 aa, artificial
  peptide fold or domain or sub-domain
LQWRSQLAQILAPIPPLAWLVTALISG

SEQ ID NO: 12245 - protein, 28 aa, artificial
  peptide fold or domain or sub-domain
LQYAMFDSDVGHFVGFTPSGDMNAKRWN

SEQ ID NO: 12246 - protein, 22 aa, artificial
  peptide fold or domain or sub-domain
LQYKWRGPNVIDHPGVKLTISE

SEQ ID NO: 12247 - protein, 21 aa, artificial
  peptide fold or domain or sub-domain
LQYLAKKDIQRFRALVDRLGI

SEQ ID NO: 12248 - protein, 20 aa, artificial
  peptide fold or domain or sub-domain
LQYPFEPFFPESCKIECQKL

SEQ ID NO: 12249 - protein, 28 aa, artificial
  peptide fold or domain or sub-domain
LRAAIRTGLEAEPGSRDFVLAAVLGLID

SEQ ID NO: 12250 - protein, 23 aa, artificial
  peptide fold or domain or sub-domain
LRAAVQQGSEKGVPAELVETLFH

SEQ ID NO: 12251 - protein, 26 aa, artificial
  peptide fold or domain or sub-domain
LRADWQKLKRREISKEEFKVLYDRMG

SEQ ID NO: 12252 - protein, 22 aa, artificial
  peptide fold or domain or sub-domain
LRAEALAGSLGTHPRATLRLLR

SEQ ID NO: 12253 - protein, 30 aa, artificial
  peptide fold or domain or sub-domain
LRAEIGARTRIGREVAPLLERGDLAPDSLM

SEQ ID NO: 12254 - protein, 30 aa, artificial
  peptide fold or domain or sub-domain
LRAEIKSGSENGTMIQNMIKEGKIVPSEVT

SEQ ID NO: 12255 - protein, 27 aa, artificial
  peptide fold or domain or sub-domain
LRAERLRDALCDIGFQLSTDIMNCLIQ

SEQ ID NO: 12256 - protein, 22 aa, artificial
  peptide fold or domain or sub-domain
LRAEVAKVESEMSDLLEIEVDV

SEQ ID NO: 12257 - protein, 30 aa, artificial
  peptide fold or domain or sub-domain
LRAEVAQGTHLGKIAENFMQRGELVPDSLI

SEQ ID NO: 12258 - protein, 23 aa, artificial
  peptide fold or domain or sub-domain
LRAFTEERAKLSNADQFYVLLLD

SEQ ID NO: 12259 - protein, 27 aa, artificial
  peptide fold or domain or sub-domain
LRAGIGPVGHLKDMGIPVLTGLPGVGQ

SEQ ID NO: 12260 - protein, 21 aa, artificial
  peptide fold or domain or sub-domain
LRAIYSDELIDSENPEYGTKR

SEQ ID NO: 12261 - protein, 26 aa, artificial
  peptide fold or domain or sub-domain
LRALKHHGGASPARVAEPDREALVRG

SEQ ID NO: 12262 - protein, 26 aa, artificial
  peptide fold or domain or sub-domain
LRALKYHGGIEVKDVQTPNTQAVLGG

SEQ ID NO: 12263 - protein, 30 aa, artificial
  peptide fold or domain or sub-domain
LRAMVASGSELGKKLKATMDAGKLVSDEMV

SEQ ID NO: 12264 - protein, 22 aa, artificial
  peptide fold or domain or sub-domain
LRAQLARTLDSKRMQELFPAYP

SEQ ID NO: 12265 - protein, 25 aa, artificial
  peptide fold or domain or sub-domain
LRARYHHFIETRGWKLPNTRGLEFD

SEQ ID NO: 12266 - protein, 28 aa, artificial
  peptide fold or domain or sub-domain
LRASLPKVQDDLNPIRVLSILQRITDQD

SEQ ID NO: 12267 - protein, 29 aa, artificial
  peptide fold or domain or sub-domain
LRAVASRNKDTADAFATEFDIELALQDYY

SEQ ID NO: 12268 - protein, 25 aa, artificial
  peptide fold or domain or sub-domain
LRAVPVDVIKASYGVNEEEAKRIKF

SEQ ID NO: 12269 - protein, 26 aa, artificial
  peptide fold or domain or sub-domain
LRAVPVDVIKASYGVNEEEAKRIKFS

SEQ ID NO: 12270 - protein, 23 aa, artificial
  peptide fold or domain or sub-domain
LRAVVQRMRDSGLDEDGAYDQIR

SEQ ID NO: 12271 - protein, 28 aa, artificial
  peptide fold or domain or sub-domain
LRAWAGRNWVRLEHGAIVVLDTDALREL

SEQ ID NO: 12272 - protein, 25 aa, artificial
  peptide fold or domain or sub-domain
LRAWLDSVDRSYWRPNTLLFTQNWL

SEQ ID NO: 12273 - protein, 21 aa, artificial
  peptide fold or domain or sub-domain
LRDAAHASDLKALSLRYFNPI

SEQ ID NO: 12274 - protein, 30 aa, artificial
  peptide fold or domain or sub-domain
LRDAIVGAPDVDPAEMFDTVYADITPELAR

SEQ ID NO: 12275 - protein, 24 aa, artificial
  peptide fold or domain or sub-domain
LRDDHVLDAVLPPDIPIPSIAEVQ

SEQ ID NO: 12276 - protein, 21 aa, artificial
  peptide fold or domain or sub-domain
LRDFDISRLSSISSDDYDNLN

SEQ ID NO: 12277 - protein, 24 aa, artificial
  peptide fold or domain or sub-domain
LRDFGAVLLDGNGAVLHFLEKPGV

SEQ ID NO: 12278 - protein, 27 aa, artificial
  peptide fold or domain or sub-domain
LRDGCRIVVDAKMVKAGIYNKNLLDRC

SEQ ID NO: 12279 - protein, 29 aa, artificial
  peptide fold or domain or sub-domain
LRDGSSFESSDHVRVLPGVTLGMTVKMSE

SEQ ID NO: 12280 - protein, 22 aa, artificial
  peptide fold or domain or sub-domain
LRDHVTYNAEAQKKQHYFSRLL

SEQ ID NO: 12281 - protein, 21 aa, artificial
  peptide fold or domain or sub-domain
LRDIADARENFRYIALRYFNV

SEQ ID NO: 12282 - protein, 28 aa, artificial
  peptide fold or domain or sub-domain
LRDKYEGLPLHLWPEYTWGKNQIERMAV

SEQ ID NO: 12283 - protein, 30 aa, artificial
  peptide fold or domain or sub-domain
LRDNMLRGTEIGVLAKAFIDQGKLIPDDVM

SEQ ID NO: 12284 - protein, 25 aa, artificial
  peptide fold or domain or sub-domain
LRDSIRQTRPDASPELLTQLTDQRA

SEQ ID NO: 12285 - protein, 24 aa, artificial
  peptide fold or domain or sub-domain
LRDVFSESAQKLGHQPAALAAAVY

SEQ ID NO: 12286 - protein, 25 aa, artificial
  peptide fold or domain or sub-domain
LRDVSVFGQRWGFDAATINSRYNDL

SEQ ID NO: 12287 - protein, 23 aa, artificial
  peptide fold or domain or sub-domain
LRDYSGDLSKLGSAERFLKAVLD

SEQ ID NO: 12288 - protein, 30 aa, artificial
  peptide fold or domain or sub-domain
LREAIEAGTETGAKARFYIEKGILVPDQVV

SEQ ID NO: 12289 - protein, 28 aa, artificial
  peptide fold or domain or sub-domain
LREEHDLLPWWQWPTAERDREPAALEAA

SEQ ID NO: 12290 - protein, 25 aa, artificial
  peptide fold or domain or sub-domain
LREEIRLYEMTNKVKPSVRFVASLL

SEQ ID NO: 12291 - protein, 25 aa, artificial
  peptide fold or domain or sub-domain
LREELMRWNKRLTGSRFLKGIIAPG

SEQ ID NO: 12292 - protein, 30 aa, artificial
  peptide fold or domain or sub-domain
LREFVSDSSGRRSMYNYSLEKIVEENLGYP

SEQ ID NO: 12293 - protein, 26 aa, artificial
  peptide fold or domain or sub-domain
LREIAALLKTQRANPFRYQAYFHAAN

SEQ ID NO: 12294 - protein, 21 aa, artificial
  peptide fold or domain or sub-domain
LREIGGHLGINGTLGVMKHLD

SEQ ID NO: 12295 - protein, 22 aa, artificial
  peptide fold or domain or sub-domain
LREKVTAKVGPELAADLYVNSS

SEQ ID NO: 12296 - protein, 25 aa, artificial
  peptide fold or domain or sub-domain
LREPIMQVFFEISGSRVHYSCPIIG

SEQ ID NO: 12297 - protein, 28 aa, artificial
  peptide fold or domain or sub-domain
LREQVDTDLRATPLSRTQLLAVSVRLLD

SEQ ID NO: 12298 - protein, 26 aa, artificial
  peptide fold or domain or sub-domain
LREQVRRRYEIANPEASPEEIEQGVD

SEQ ID NO: 12299 - protein, 26 aa, artificial
  peptide fold or domain or sub-domain
LRERRVASWAVSFERLLQDPVGVRYF

SEQ ID NO: 12300 - protein, 28 aa, artificial
  peptide fold or domain or sub-domain
LRERYQGASWNTWPTEISHCQPEAIAKT

SEQ ID NO: 12301 - protein, 27 aa, artificial
  peptide fold or domain or sub-domain
LRETNPAYSKPGTIRGESCIQGGRNIT

SEQ ID NO: 12302 - protein, 30 aa, artificial
  peptide fold or domain or sub-domain
LREVSEQNTKSGIEIKSKLAAGELISDAIM

SEQ ID NO: 12303 - protein, 28 aa, artificial
  peptide fold or domain or sub-domain
LREVTTADLRLSGMPRRKVLALLTRLLD

SEQ ID NO: 12304 - protein, 26 aa, artificial
  peptide fold or domain or sub-domain
LREYAQRTALRGGNPYRAKAYSRAAD

SEQ ID NO: 12305 - protein, 22 aa, artificial
  peptide fold or domain or sub-domain
LREYPDMPVPKKVKDYYNKVVA

SEQ ID NO: 12306 - protein, 28 aa, artificial
  peptide fold or domain or sub-domain
LRFAQDFTLDERLARECHCTELYTHCIQ

SEQ ID NO: 12307 - protein, 30 aa, artificial
  peptide fold or domain or sub-domain
LRFINGTLYCGSDGGIYTSTDGGASFTSIT

SEQ ID NO: 12308 - protein, 29 aa, artificial
  peptide fold or domain or sub-domain
LRFSPGYPEVSPRNKNGQGIKQLGLFIND

SEQ ID NO: 12309 - protein, 28 aa, artificial
  peptide fold or domain or sub-domain
LRGAGDELRNHFLSAMSRNRATEIMDMM

SEQ ID NO: 12310 - protein, 28 aa, artificial
  peptide fold or domain or sub-domain
LRGASKELRDLFLAALPQRSRDMLVEEM

SEQ ID NO: 12311 - protein, 26 aa, artificial
  peptide fold or domain or sub-domain
LRGFSKNILEASLNTKYETIEKVLLE

SEQ ID NO: 12312 - protein, 29 aa, artificial
  peptide fold or domain or sub-domain
LRGIVTGSPEKIPRWQRRYDIPDSNVYSY

SEQ ID NO: 12313 - protein, 25 aa, artificial
  peptide fold or domain or sub-domain
LRGLPLDVIQNSFQVSRDEAQRLKY

SEQ ID NO: 12314 - protein, 27 aa, artificial
  peptide fold or domain or sub-domain
LRGQQLEEAGLHLMYNVGRGSRYEPYL

SEQ ID NO: 12315 - protein, 28 aa, artificial
  peptide fold or domain or sub-domain
LRGSAAELRESILASIGARQRRMIESDL

SEQ ID NO: 12316 - protein, 21 aa, artificial
  peptide fold or domain or sub-domain
LRHCKIAIKLCPNYAEAWHNL

SEQ ID NO: 12317 - protein, 20 aa, artificial
  peptide fold or domain or sub-domain
LRHPTSFIDTTSKPGYIRDS

SEQ ID NO: 12318 - protein, 24 aa, artificial
  peptide fold or domain or sub-domain
LRHTETLVQMTDKPSEAVRRARGS

SEQ ID NO: 12319 - protein, 25 aa, artificial
  peptide fold or domain or sub-domain
LRIDDLRQDARFVPVLPGEALARSA

SEQ ID NO: 12320 - protein, 25 aa, artificial
  peptide fold or domain or sub-domain
LRIDMVVDLWYARQPWNGPSRQEVV

SEQ ID NO: 12321 - protein, 25 aa, artificial
  peptide fold or domain or sub-domain
LRIDQCVDYWYHKAPWADYDNAKVS

SEQ ID NO: 12322 - protein, 25 aa, artificial
  peptide fold or domain or sub-domain
LRIFSREILEAVFNTRSEQLDELPG

SEQ ID NO: 12323 - protein, 26 aa, artificial
  peptide fold or domain or sub-domain
LRIFSREILEAVFNTRSEQLDELPGG

SEQ ID NO: 12324 - protein, 27 aa, artificial
  peptide fold or domain or sub-domain
LRILGDKLIEDGFEAREAEAMALLCTN

SEQ ID NO: 12325 - protein, 29 aa, artificial
  peptide fold or domain or sub-domain
LRISGSGNPNDGAARDWGNGAGVHPENAV

SEQ ID NO: 12326 - protein, 29 aa, artificial
  peptide fold or domain or sub-domain
LRITQNDDPDDGAPLLDNNSRPGLPEHQV

SEQ ID NO: 12327 - protein, 27 aa, artificial
  peptide fold or domain or sub-domain
LRIYENKIPTLRTGRHGILYVKDNQLY

SEQ ID NO: 12328 - protein, 26 aa, artificial
  peptide fold or domain or sub-domain
LRKDWGRLIQRDLTPAEFRELYKRID

SEQ ID NO: 12329 - protein, 30 aa, artificial
  peptide fold or domain or sub-domain
LRKEIAAKSEVGRKAEAVVASGGLVSDELM

SEQ ID NO: 12330 - protein, 23 aa, artificial
  peptide fold or domain or sub-domain
LRKGRGQPWVWKEDSIFKPKIAE

SEQ ID NO: 12331 - protein, 30 aa, artificial
  peptide fold or domain or sub-domain
LRKLGVPPLRVWRHRARSVRARLLSQGGRA

SEQ ID NO: 12332 - protein, 27 aa, artificial
  peptide fold or domain or sub-domain
LRKLSEKSFINYIKYQGVTLTKKGKKE

SEQ ID NO: 12333 - protein, 27 aa, artificial
  peptide fold or domain or sub-domain
LRKLTEQGLVSHAPYQGARLTAEGERV

SEQ ID NO: 12334 - protein, 26 aa, artificial
  peptide fold or domain or sub-domain
LRKMIETQAIQGLHWIDKERQIVKIP

SEQ ID NO: 12335 - protein, 22 aa, artificial
  peptide fold or domain or sub-domain
LRKYLVAEYGFKVGMNRFSLIL

SEQ ID NO: 12336 - protein, 27 aa, artificial
  peptide fold or domain or sub-domain
LRLAQRKNRLARALKARVDEAVYEQLR

SEQ ID NO: 12337 - protein, 22 aa, artificial
  peptide fold or domain or sub-domain
LRLGLLTKEYVTCPWHDAKFDI

SEQ ID NO: 12338 - protein, 21 aa, artificial
  peptide fold or domain or sub-domain
LRLIEQELQRELVNEERDALL

SEQ ID NO: 12339 - protein, 24 aa, artificial
  peptide fold or domain or sub-domain
LRLLATVAAQRKNFPEAEELFDQA

SEQ ID NO: 12340 - protein, 29 aa, artificial
  peptide fold or domain or sub-domain
LRLNSDQDPNNKSPVEARNGQAPVAEDKM

SEQ ID NO: 12341 - protein, 24 aa, artificial
  peptide fold or domain or sub-domain
LRLPYETAVHLANAGQFSELLQYD

SEQ ID NO: 12342 - protein, 24 aa, artificial
  peptide fold or domain or sub-domain
LRLRGETSEDSVCDLVEFAFAMKQ

SEQ ID NO: 12343 - protein, 25 aa, artificial
  peptide fold or domain or sub-domain
LRLSINRDLYDKGNKEAVYVDYPNI

SEQ ID NO: 12344 - protein, 25 aa, artificial
  peptide fold or domain or sub-domain
LRLSLLNRQISVAKFCSMDIYSMAS

SEQ ID NO: 12345 - protein, 20 aa, artificial
  peptide fold or domain or sub-domain
LRLSMNRSPFVFKKKQRQYE

SEQ ID NO: 12346 - protein, 29 aa, artificial
  peptide fold or domain or sub-domain
LRLSPHGEPNTATKLAANNGKAGLDQRQI

SEQ ID NO: 12347 - protein, 23 aa, artificial
  peptide fold or domain or sub-domain
LRLYAGEPAQLGPAEQFMRAIID

SEQ ID NO: 12348 - protein, 20 aa, artificial
  peptide fold or domain or sub-domain
LRLYARRRRPSQPYMFPRML

SEQ ID NO: 12349 - protein, 25 aa, artificial
  peptide fold or domain or sub-domain
LRMLDRQVLAASLNVSSVTIDGLLG

SEQ ID NO: 12350 - protein, 30 aa, artificial
  peptide fold or domain or sub-domain
LRNAVSQNTPLGQEIKSYLDQGKLLPDQLV

SEQ ID NO: 12351 - protein, 28 aa, artificial
  peptide fold or domain or sub-domain
LRNFQEKFGLPVDGLAGAKTKQMLVKAT

SEQ ID NO: 12352 - protein, 20 aa, artificial
  peptide fold or domain or sub-domain
LRNIDATAFSALSDEDKGDY

SEQ ID NO: 12353 - protein, 20 aa, artificial
  peptide fold or domain or sub-domain
LRNTPSFKERNGGNHDPSRM

SEQ ID NO: 12354 - protein, 24 aa, artificial
  peptide fold or domain or sub-domain
LRNVSLAQVRTLGRSAEEADARSL

SEQ ID NO: 12355 - protein, 28 aa, artificial
  peptide fold or domain or sub-domain
LRNYLGPPLVKQPIHAPQEVAWSFEDAA

SEQ ID NO: 12356 - protein, 30 aa, artificial
  peptide fold or domain or sub-domain
LRPLAAQRLGRPELSQAGLQAVVRAVMGAD

SEQ ID NO: 12357 - protein, 24 aa, artificial
  peptide fold or domain or sub-domain
LRPSGGAVRMDEEPAAALRSRPDA

SEQ ID NO: 12358 - protein, 21 aa, artificial
  peptide fold or domain or sub-domain
LRPSTVNELESGSYDEVGERI

SEQ ID NO: 12359 - protein, 30 aa, artificial
  peptide fold or domain or sub-domain
LRQEIRKGSELGRRVATYVSRGLLVPDDVV

SEQ ID NO: 12360 - protein, 28 aa, artificial
  peptide fold or domain or sub-domain
LRQHFKMTSWIEWPEAYRYRDFEALTLF

SEQ ID NO: 12361 - protein, 21 aa, artificial
  peptide fold or domain or sub-domain
LRQNPIVDKYISNEAFYTYVT

SEQ ID NO: 12362 - protein, 27 aa, artificial
  peptide fold or domain or sub-domain
LRQRRPLVVDVRMVAAGIQAGLAAQGI

SEQ ID NO: 12363 - protein, 21 aa, artificial
  peptide fold or domain or sub-domain
LRRAEYGDERYPEIAAFFDEI

SEQ ID NO: 12364 - protein, 27 aa, artificial
  peptide fold or domain or sub-domain
LRRHLAKHQYTPEWAAKVTGVKADVIT

SEQ ID NO: 12365 - protein, 28 aa, artificial
  peptide fold or domain or sub-domain
LRRQFSYLPWWEWPSAFSSRNQNELGLW

SEQ ID NO: 12366 - protein, 27 aa, artificial
  peptide fold or domain or sub-domain
LRRRAPTSRKMSERDLVGILEDPRVAH

SEQ ID NO: 12367 - protein, 28 aa, artificial
  peptide fold or domain or sub-domain
LRRRVARDLKAEAGELAFSLAALTMLID

SEQ ID NO: 12368 - protein, 28 aa, artificial
  peptide fold or domain or sub-domain
LRRRVEKDMRRRKLDRLTTSAIATRLID

SEQ ID NO: 12369 - protein, 21 aa, artificial
  peptide fold or domain or sub-domain
LRRVGVGPGRGGYRRSIEATR

SEQ ID NO: 12370 - protein, 22 aa, artificial
  peptide fold or domain or sub-domain
LRRWWKSSGFTDLNFTRERVTE

SEQ ID NO: 12371 - protein, 22 aa, artificial
  peptide fold or domain or sub-domain
LRRYLESIYPGCEARSVFLKLM

SEQ ID NO: 12372 - protein, 23 aa, artificial
  peptide fold or domain or sub-domain
LRRYTGDISLLSPPSSFFYRLVQ

SEQ ID NO: 12373 - protein, 27 aa, artificial
  peptide fold or domain or sub-domain
LRSAFKRAVETGTGTNAQIDGLRVAGK

SEQ ID NO: 12374 - protein, 20 aa, artificial
  peptide fold or domain or sub-domain
LRSANPDLNNDQIGDIILGA

SEQ ID NO: 12375 - protein, 27 aa, artificial
  peptide fold or domain or sub-domain
LRSEFEKDEQIQLKPEKIRPKIIEGMI

SEQ ID NO: 12376 - protein, 27 aa, artificial
  peptide fold or domain or sub-domain
LRSGVALVTDVAMTALGLADDPRRPPD

SEQ ID NO: 12377 - protein, 27 aa, artificial
  peptide fold or domain or sub-domain
LRSKEKGLNVSDSVGVRFSGNGDMLGF

SEQ ID NO: 12378 - protein, 30 aa, artificial
  peptide fold or domain or sub-domain
LRSLVHEGERYQFCSDGCCDIFKNEPVKYI

SEQ ID NO: 12379 - protein, 30 aa, artificial
  peptide fold or domain or sub-domain
LRSQIAKGTQLGLEAKKIMDQGGLVSDDIM

SEQ ID NO: 12380 - protein, 20 aa, artificial
  peptide fold or domain or sub-domain
LRSSRRLGSRFGRAFLAASL

SEQ ID NO: 12381 - protein, 27 aa, artificial
  peptide fold or domain or sub-domain
LRSYLEGVVTGGTATGTFIEGYHIGGK

SEQ ID NO: 12382 - protein, 20 aa, artificial
  peptide fold or domain or sub-domain
LRSYLKLRRPHEVLLLPKVL

SEQ ID NO: 12383 - protein, 25 aa, artificial
  peptide fold or domain or sub-domain
LRTEQKTEGFNRLPKRDAAVLKRQL

SEQ ID NO: 12384 - protein, 20 aa, artificial
  peptide fold or domain or sub-domain
LRTLIMKNHPNEASIFTKLL

SEQ ID NO: 12385 - protein, 25 aa, artificial
  peptide fold or domain or sub-domain
LRTLMGPELSAAFGVSEDTLRRAVD

SEQ ID NO: 12386 - protein, 26 aa, artificial
  peptide fold or domain or sub-domain
LRTLNLTSLSIAFGVDEETMRRFIEA

SEQ ID NO: 12387 - protein, 24 aa, artificial
  peptide fold or domain or sub-domain
LRTRFGVMSLDGSKVDEFREKGEL

SEQ ID NO: 12388 - protein, 23 aa, artificial
  peptide fold or domain or sub-domain
LRTVYCNKTFPTTKAKVLFLQQS

SEQ ID NO: 12389 - protein, 25 aa, artificial
  peptide fold or domain or sub-domain
LRVADVARHPVAIGFPSGHPRFDTF

SEQ ID NO: 12390 - protein, 27 aa, artificial
  peptide fold or domain or sub-domain
LRVAKQKKRLARSLRCPIPEEIFTTLA

SEQ ID NO: 12391 - protein, 24 aa, artificial
  peptide fold or domain or sub-domain
LRVAVRNLEARGLSVRLHKADVKE

SEQ ID NO: 12392 - protein, 26 aa, artificial
  peptide fold or domain or sub-domain
LRVDEKEFHTIGGQEVLKLRDSVLPL

SEQ ID NO: 12393 - protein, 29 aa, artificial
  peptide fold or domain or sub-domain
LRVDTQTILTIQNHVITKNHRMSITHAEK

SEQ ID NO: 12394 - protein, 25 aa, artificial
  peptide fold or domain or sub-domain
LRVEARYYKTITGDSMPVKSVATLA

SEQ ID NO: 12395 - protein, 26 aa, artificial
  peptide fold or domain or sub-domain
LRVEPEDERNFAKWPSHPESFRDVLN

SEQ ID NO: 12396 - protein, 26 aa, artificial
  peptide fold or domain or sub-domain
LRVFPKEKQRLSLWPENPSDFSDTLE

SEQ ID NO: 12397 - protein, 25 aa, artificial
  peptide fold or domain or sub-domain
LRVFSNDILVAALNTPRDRLERFFD

SEQ ID NO: 12398 - protein, 26 aa, artificial
  peptide fold or domain or sub-domain
LRVFSNDILVAALNTPRDRLERFFDQ

SEQ ID NO: 12399 - protein, 23 aa, artificial
  peptide fold or domain or sub-domain
LRVHYAADQNSPFFGGLLKLFSS

SEQ ID NO: 12400 - protein, 26 aa, artificial
  peptide fold or domain or sub-domain
LRVKELCMKLDASYDHEPGEALYQIK

SEQ ID NO: 12401 - protein, 29 aa, artificial
  peptide fold or domain or sub-domain
LRVLGYNHNGEWCEAQTKNGQGWVPSNYI

SEQ ID NO: 12402 - protein, 26 aa, artificial
  peptide fold or domain or sub-domain
LRVPVIVLTARQELEARLRSFGLGAV

SEQ ID NO: 12403 - protein, 29 aa, artificial
  peptide fold or domain or sub-domain
LRVTPNADPNDGSRIHDNNSLLEADERQI

SEQ ID NO: 12404 - protein, 30 aa, artificial
  peptide fold or domain or sub-domain
LRVWHVSEFARHELSSVSHGQFHKEDTYVI

SEQ ID NO: 12405 - protein, 25 aa, artificial
  peptide fold or domain or sub-domain
LRVYNGDLKSYKSNSVATDIYNKWL

SEQ ID NO: 12406 - protein, 27 aa, artificial
  peptide fold or domain or sub-domain
LRYILEKTVTEGTGQLAQVPGYRVGGK

SEQ ID NO: 12407 - protein, 24 aa, artificial
  peptide fold or domain or sub-domain
LRYKARNCPHVLNHEDQMQWETYR

SEQ ID NO: 12408 - protein, 30 aa, artificial
  peptide fold or domain or sub-domain
LRYLAMRQRNNLLCNGLSLKSLAETVLNFP

SEQ ID NO: 12409 - protein, 25 aa, artificial
  peptide fold or domain or sub-domain
LRYLPREIKRLVFPSSAEEIEATLE

SEQ ID NO: 12410 - protein, 26 aa, artificial
  peptide fold or domain or sub-domain
LRYLPREIKRLVFPSSAEEIEATLEA

SEQ ID NO: 12411 - protein, 22 aa, artificial
  peptide fold or domain or sub-domain
LRYSFFKDGHTLQSGWTSSKFT

SEQ ID NO: 12412 - protein, 23 aa, artificial
  peptide fold or domain or sub-domain
LSAAEVAEKVELSQSPCWRRIHR

SEQ ID NO: 12413 - protein, 29 aa, artificial
  peptide fold or domain or sub-domain
LSAANLLQFLHKEQKELTADEDTTKRLIQ

SEQ ID NO: 12414 - protein, 28 aa, artificial
  peptide fold or domain or sub-domain
LSADDVFAMLRETHPSNGIATVYRTLEL

SEQ ID NO: 12415 - protein, 28 aa, artificial
  peptide fold or domain or sub-domain
LSADKQYLVESRLLPLARRLSLGGIGEL

SEQ ID NO: 12416 - protein, 28 aa, artificial
  peptide fold or domain or sub-domain
LSAEDLYNHLLSRNSPISLSTIYRTLKL

SEQ ID NO: 12417 - protein, 24 aa, artificial
  peptide fold or domain or sub-domain
LSAEGISRVNMGYLYFGSPKDYTT

SEQ ID NO: 12418 - protein, 27 aa, artificial
  peptide fold or domain or sub-domain
LSAERAVTGYTDPYTGQQISLFQAMKK

SEQ ID NO: 12419 - protein, 25 aa, artificial
  peptide fold or domain or sub-domain
LSAFSKNFLEASYDSPYDEIEQTLL

SEQ ID NO: 12420 - protein, 22 aa, artificial
  peptide fold or domain or sub-domain
LSAHIEKRYPYHTTSQRMTRAL

SEQ ID NO: 12421 - protein, 23 aa, artificial
  peptide fold or domain or sub-domain
LSAIHSRCDDLEARKLLLDNLMD

SEQ ID NO: 12422 - protein, 21 aa, artificial
  peptide fold or domain or sub-domain
LSAKQINSRWHGFRLPDHLMG

SEQ ID NO: 12423 - protein, 23 aa, artificial
  peptide fold or domain or sub-domain
LSALTEARDKDGGLSENELVSTA

SEQ ID NO: 12424 - protein, 20 aa, artificial
  peptide fold or domain or sub-domain
LSAPEVAEVMGLSVEAVKSR

SEQ ID NO: 12425 - protein, 26 aa, artificial
  peptide fold or domain or sub-domain
LSAPLREEPWFDRQTHFGGQHDTEFL

SEQ ID NO: 12426 - protein, 23 aa, artificial
  peptide fold or domain or sub-domain
LSAPTPNYVNLGTKLRGFASCCL

SEQ ID NO: 12427 - protein, 28 aa, artificial
  peptide fold or domain or sub-domain
LSARPAGKEFERRYKARFHQDVVLLGPQ

SEQ ID NO: 12428 - protein, 28 aa, artificial
  peptide fold or domain or sub-domain
LSARQIYDRLNQAGKDIGHTSVYQNLEA

SEQ ID NO: 12429 - protein, 21 aa, artificial
  peptide fold or domain or sub-domain
LSASERAELASLLNVTDTQVK

SEQ ID NO: 12430 - protein, 20 aa, artificial
  peptide fold or domain or sub-domain
LSASLIKEIVILGGDSSGLI

SEQ ID NO: 12431 - protein, 27 aa, artificial
  peptide fold or domain or sub-domain
LSASLKEGPVKASRGIRILADTTLDEI

SEQ ID NO: 12432 - protein, 23 aa, artificial
  peptide fold or domain or sub-domain
LSAVTSRLESPQHRASLMGNMAE

SEQ ID NO: 12433 - protein, 29 aa, artificial
  peptide fold or domain or sub-domain
LSAYRRGTLPDTLHFEGHRRIPSVIAVAD

SEQ ID NO: 12434 - protein, 28 aa, artificial
  peptide fold or domain or sub-domain
LSCILTNKNGGSKYMIIDKAYAGKVYID

SEQ ID NO: 12435 - protein, 29 aa, artificial
  peptide fold or domain or sub-domain
LSCQDLRLFLETEQGMVGVTTDNCETLIE

SEQ ID NO: 12436 - protein, 25 aa, artificial
  peptide fold or domain or sub-domain
LSDAALAQLHDEQFSDPSLTDTITL

SEQ ID NO: 12437 - protein, 23 aa, artificial
  peptide fold or domain or sub-domain
LSDACVAACVEAGFDERWVYDSY

SEQ ID NO: 12438 - protein, 25 aa, artificial
  peptide fold or domain or sub-domain
LSDADFASLVSGKANAQRLFMGGKL

SEQ ID NO: 12439 - protein, 20 aa, artificial
  peptide fold or domain or sub-domain
LSDALASLGYSELEIEEALS

SEQ ID NO: 12440 - protein, 21 aa, artificial
  peptide fold or domain or sub-domain
LSDARSKQFETAYQARYNSLP

SEQ ID NO: 12441 - protein, 25 aa, artificial
  peptide fold or domain or sub-domain
LSDEDFMEVVLGKLDPQKAFFSGRL

SEQ ID NO: 12442 - protein, 28 aa, artificial
  peptide fold or domain or sub-domain
LSDFVTKIGQARVARALGCKPASIAKAL

SEQ ID NO: 12443 - protein, 22 aa, artificial
  peptide fold or domain or sub-domain
LSDGYLEDGCIECPLHQARFDI

SEQ ID NO: 12444 - protein, 30 aa, artificial
  peptide fold or domain or sub-domain
LSDKHYFPPEIDFTDVGYTTFWSESLEAVD

SEQ ID NO: 12445 - protein, 28 aa, artificial
  peptide fold or domain or sub-domain
LSDKKKALISSRLSKRLRKTHLQSLGEY

SEQ ID NO: 12446 - protein, 28 aa, artificial
  peptide fold or domain or sub-domain
LSDLDLLPDETVKKLEEKGIVTVEDFIY

SEQ ID NO: 12447 - protein, 28 aa, artificial
  peptide fold or domain or sub-domain
LSDLEGVGPVTKKKLEDSGVHSMMDLVV

SEQ ID NO: 12448 - protein, 23 aa, artificial
  peptide fold or domain or sub-domain
LSDLIAVQEEGDRLTEDELMSLA

SEQ ID NO: 12449 - protein, 26 aa, artificial
  peptide fold or domain or sub-domain
LSDLPAAVIASSYAISMEEAAELKNG

SEQ ID NO: 12450 - protein, 30 aa, artificial
  peptide fold or domain or sub-domain
LSDMKLPGLSVYRKKAGALRTRMLKSSGWA

SEQ ID NO: 12451 - protein, 27 aa, artificial
  peptide fold or domain or sub-domain
LSDPDEVARRWGKRKNKPKMNYEKLSR

SEQ ID NO: 12452 - protein, 24 aa, artificial
  peptide fold or domain or sub-domain
LSDQEMLRYNRQIILRGFDFDGQE

SEQ ID NO: 12453 - protein, 28 aa, artificial
  peptide fold or domain or sub-domain
LSDSKTHMAYARLAKRVRSRGLRSFADY

SEQ ID NO: 12454 - protein, 22 aa, artificial
  peptide fold or domain or sub-domain
LSDTVQSTPSNTATTFAFQRCG

SEQ ID NO: 12455 - protein, 24 aa, artificial
  peptide fold or domain or sub-domain
LSEAENKFRSQGLKPRLACQDISN

SEQ ID NO: 12456 - protein, 20 aa, artificial
  peptide fold or domain or sub-domain
LSEAIENRAKDGDSQARIAT

SEQ ID NO: 12457 - protein, 20 aa, artificial
  peptide fold or domain or sub-domain
LSEALISLGFTDAEAAAAIA

SEQ ID NO: 12458 - protein, 21 aa, artificial
  peptide fold or domain or sub-domain
LSEDEIARLKGINEDLSLEEV

SEQ ID NO: 12459 - protein, 26 aa, artificial
  peptide fold or domain or sub-domain
LSEDEIARLKGINEDLSLEEVAEIYL

SEQ ID NO: 12460 - protein, 24 aa, artificial
  peptide fold or domain or sub-domain
LSEDGVLERFIGKPREARDIRASF

SEQ ID NO: 12461 - protein, 23 aa, artificial
  peptide fold or domain or sub-domain
LSEEELPIFRSFMDDKFYYNRLK

SEQ ID NO: 12462 - protein, 25 aa, artificial
  peptide fold or domain or sub-domain
LSEEVSRSNNYLDNHTKKFLLETLN

SEQ ID NO: 12463 - protein, 26 aa, artificial
  peptide fold or domain or sub-domain
LSEEYRRVVKIQGTRKALKIVPVYAD

SEQ ID NO: 12464 - protein, 28 aa, artificial
  peptide fold or domain or sub-domain
LSEFKKKGYIEMKGKSISVANENGLKKV

SEQ ID NO: 12465 - protein, 24 aa, artificial
  peptide fold or domain or sub-domain
LSEFLEADLRDVALDKPFPMDRLP

SEQ ID NO: 12466 - protein, 24 aa, artificial
  peptide fold or domain or sub-domain
LSEFLSEAKEAGEIRESVHAERTA

SEQ ID NO: 12467 - protein, 26 aa, artificial
  peptide fold or domain or sub-domain
LSEFYKLYKETSKRDKFTIHSEEYIQ

SEQ ID NO: 12468 - protein, 22 aa, artificial
  peptide fold or domain or sub-domain
LSEGFVDGETIECWAHGAKFCL

SEQ ID NO: 12469 - protein, 23 aa, artificial
  peptide fold or domain or sub-domain
LSEHYAHLSSKPFFQRVKDSMMA

SEQ ID NO: 12470 - protein, 23 aa, artificial
  peptide fold or domain or sub-domain
LSEIKSESTEKRIKTIQYNTSKK

SEQ ID NO: 12471 - protein, 24 aa, artificial
  peptide fold or domain or sub-domain
LSEKEIEELIYPVGFYRVKAKQLK

SEQ ID NO: 12472 - protein, 25 aa, artificial
  peptide fold or domain or sub-domain
LSEKEIEELIYPVGFYRVKAKQLKE

SEQ ID NO: 12473 - protein, 23 aa, artificial
  peptide fold or domain or sub-domain
LSELKEEYDDLAESEQFGVVMGT

SEQ ID NO: 12474 - protein, 24 aa, artificial
  peptide fold or domain or sub-domain
LSENDVIAFAKAKISIHKQLRGGV

SEQ ID NO: 12475 - protein, 28 aa, artificial
  peptide fold or domain or sub-domain
LSESGLYTYDDLQRVKRAGATGVLVGES

SEQ ID NO: 12476 - protein, 30 aa, artificial
  peptide fold or domain or sub-domain
LSESNIAQDVADKWIASGDELKMSAGWSCY

SEQ ID NO: 12477 - protein, 26 aa, artificial
  peptide fold or domain or sub-domain
LSESVLENLEKMAREMGLSKSAMISV

SEQ ID NO: 12478 - protein, 30 aa, artificial
  peptide fold or domain or sub-domain
LSETTFAQEVAERYMKSDLDLVQSAGLSTY

SEQ ID NO: 12479 - protein, 22 aa, artificial
  peptide fold or domain or sub-domain
LSEWCREMGILSEGVWDEDKLE

SEQ ID NO: 12480 - protein, 28 aa, artificial
  peptide fold or domain or sub-domain
LSFAPNNAHDCAKNAANHITVRRGGEGA

SEQ ID NO: 12481 - protein, 28 aa, artificial
  peptide fold or domain or sub-domain
LSFAPRDCAKSIIQRVDVHLEHNGGKGA

SEQ ID NO: 12482 - protein, 26 aa, artificial
  peptide fold or domain or sub-domain
LSFEEMTQWSLSLERLLSSKNGIKVF

SEQ ID NO: 12483 - protein, 22 aa, artificial
  peptide fold or domain or sub-domain
LSFEKGEHKSAEVMSMNPRGQL

SEQ ID NO: 12484 - protein, 29 aa, artificial
  peptide fold or domain or sub-domain
LSFENFFQFLITEQHEQVDRQTAWSYFIK

SEQ ID NO: 12485 - protein, 24 aa, artificial
  peptide fold or domain or sub-domain
LSFFVGQDCSTWDLDAPPPPLPPL

SEQ ID NO: 12486 - protein, 25 aa, artificial
  peptide fold or domain or sub-domain
LSFTDTIFLLHQGRLPNSNERRLLD

SEQ ID NO: 12487 - protein, 22 aa, artificial
  peptide fold or domain or sub-domain
LSGAFKEFGDDAAEAEKLIDGR

SEQ ID NO: 12488 - protein, 28 aa, artificial
  peptide fold or domain or sub-domain
LSGAPADACSTAQKAVGYICKCNGGRGA

SEQ ID NO: 12489 - protein, 24 aa, artificial
  peptide fold or domain or sub-domain
LSGDVSQEAVNLKDGDYNQLYPFD

SEQ ID NO: 12490 - protein, 20 aa, artificial
  peptide fold or domain or sub-domain
LSGEEMAQRLSLSRTAIWKA

SEQ ID NO: 12491 - protein, 25 aa, artificial
  peptide fold or domain or sub-domain
LSGFDEDVLATVFKAHADEVGDMLS

SEQ ID NO: 12492 - protein, 26 aa, artificial
  peptide fold or domain or sub-domain
LSGFDEDVLATVFKAHADEVGDMLSS

SEQ ID NO: 12493 - protein, 26 aa, artificial
  peptide fold or domain or sub-domain
LSGFDTELLAESMRVSPDIARKLQGR

SEQ ID NO: 12494 - protein, 25 aa, artificial
  peptide fold or domain or sub-domain
LSGFEPAILETAFNESRTVVEEIFS

SEQ ID NO: 12495 - protein, 26 aa, artificial
  peptide fold or domain or sub-domain
LSGFEPAILETAFNESRTVVEEIFSK

SEQ ID NO: 12496 - protein, 25 aa, artificial
  peptide fold or domain or sub-domain
LSGFRDNLLAQAFGIDTRLARKLQN

SEQ ID NO: 12497 - protein, 26 aa, artificial
  peptide fold or domain or sub-domain
LSGFSSDRLARALGIRNCTASRLQGK

SEQ ID NO: 12498 - protein, 25 aa, artificial
  peptide fold or domain or sub-domain
LSGFSSEFLAQTFNTEEDTAKRLRS

SEQ ID NO: 12499 - protein, 26 aa, artificial
  peptide fold or domain or sub-domain
LSGFSSEFLAQTFNTEEDTAKRLRSP

SEQ ID NO: 12500 - protein, 26 aa, artificial
  peptide fold or domain or sub-domain
LSGFTLEFLEHAFSVDKQIAKNLQGE

SEQ ID NO: 12501 - protein, 20 aa, artificial
  peptide fold or domain or sub-domain
LSGGELLTPGTPPRPGSSYE

SEQ ID NO: 12502 - protein, 22 aa, artificial
  peptide fold or domain or sub-domain
LSGGRIEDNMVVCPCHEVGFDM

SEQ ID NO: 12503 - protein, 29 aa, artificial
  peptide fold or domain or sub-domain
LSGHQNTIIFEQAGYLHTLDLKTNNTKRL

SEQ ID NO: 12504 - protein, 23 aa, artificial
  peptide fold or domain or sub-domain
LSGIAKRLNKENKGLNLTSSDAN

SEQ ID NO: 12505 - protein, 27 aa, artificial
  peptide fold or domain or sub-domain
LSGNILKDFQSFENFKQEVTREWLLDQ

SEQ ID NO: 12506 - protein, 26 aa, artificial
  peptide fold or domain or sub-domain
LSGNPADEILVLHDPKGDAELIVCAV

SEQ ID NO: 12507 - protein, 26 aa, artificial
  peptide fold or domain or sub-domain
LSGQHSLSCRMNACVLCRMEQHVARA

SEQ ID NO: 12508 - protein, 25 aa, artificial
  peptide fold or domain or sub-domain
LSGRDLEEIAAERGKSKYDVVPELQ

SEQ ID NO: 12509 - protein, 27 aa, artificial
  peptide fold or domain or sub-domain
LSGYINEFSRNAAWPDNSSWMEVLKKV

SEQ ID NO: 12510 - protein, 25 aa, artificial
  peptide fold or domain or sub-domain
LSHAANFLYMLHGEEPPKEWEKAMD

SEQ ID NO: 12511 - protein, 25 aa, artificial
  peptide fold or domain or sub-domain
LSHGANFLYMIKGSKPDPLDAEVME

SEQ ID NO: 12512 - protein, 23 aa, artificial
  peptide fold or domain or sub-domain
LSHLAHDPDADPALTDLEIAGIG

SEQ ID NO: 12513 - protein, 25 aa, artificial
  peptide fold or domain or sub-domain
LSHNYNYGPAGRAIGVDLLANPDLV

SEQ ID NO: 12514 - protein, 23 aa, artificial
  peptide fold or domain or sub-domain
LSHPAKMSHAAMPKEERLRRGIT

SEQ ID NO: 12515 - protein, 21 aa, artificial
  peptide fold or domain or sub-domain
LSHQAIAEAIGSTRVTVTRLL

SEQ ID NO: 12516 - protein, 29 aa, artificial
  peptide fold or domain or sub-domain
LSHSGIDVLWNFKDKEIKPSSKYKIEAHG

SEQ ID NO: 12517 - protein, 24 aa, artificial
  peptide fold or domain or sub-domain
LSIAPEINFSDVTADCESPNEAKE

SEQ ID NO: 12518 - protein, 26 aa, artificial
  peptide fold or domain or sub-domain
LSIDEIRDLFGNQIGISEKVWREMLT

SEQ ID NO: 12519 - protein, 30 aa, artificial
  peptide fold or domain or sub-domain
LSIDGKIIGKPESKQHAFDIWSTLSGRRHD

SEQ ID NO: 12520 - protein, 30 aa, artificial
  peptide fold or domain or sub-domain
LSIDGRLYGKPQSVANARQQWQSMAGRAGQ

SEQ ID NO: 12521 - protein, 29 aa, artificial
  peptide fold or domain or sub-domain
LSIRKLAAELGVSPKSLYHYFPTKEDLLQ

SEQ ID NO: 12522 - protein, 29 aa, artificial
  peptide fold or domain or sub-domain
LSIRQLGRGSHRKFEIASRNGLEKYILQA

SEQ ID NO: 12523 - protein, 26 aa, artificial
  peptide fold or domain or sub-domain
LSISKEDIQRVQDRDVIVIRGEVIPV

SEQ ID NO: 12524 - protein, 20 aa, artificial
  peptide fold or domain or sub-domain
LSKAVADKRITEEQKEAAFA

SEQ ID NO: 12525 - protein, 26 aa, artificial
  peptide fold or domain or sub-domain
LSKAYLTSDELPSPTPIRSPNFFRDN

SEQ ID NO: 12526 - protein, 29 aa, artificial
  peptide fold or domain or sub-domain
LSKDEAKYVFTEAKKGELDDPLFNQFMEK

SEQ ID NO: 12527 - protein, 23 aa, artificial
  peptide fold or domain or sub-domain
LSKEINKFKLIDSNKASQLASKL

SEQ ID NO: 12528 - protein, 25 aa, artificial
  peptide fold or domain or sub-domain
LSKFISAHPEMAAVFGFSGASDPGV

SEQ ID NO: 12529 - protein, 27 aa, artificial
  peptide fold or domain or sub-domain
LSKIANEINKCFETGEINKAKENIIKM

SEQ ID NO: 12530 - protein, 21 aa, artificial
  peptide fold or domain or sub-domain
LSKKSIDDNNKLKTNPKELIT

SEQ ID NO: 12531 - protein, 25 aa, artificial
  peptide fold or domain or sub-domain
LSKQAINRGMQCDIDTALAFESEAF

SEQ ID NO: 12532 - protein, 30 aa, artificial
  peptide fold or domain or sub-domain
LSKRKDSRVWEEDLLAKDQAIFQRLGWFLR

SEQ ID NO: 12533 - protein, 24 aa, artificial
  peptide fold or domain or sub-domain
LSKVAEEMVNAIYEKDRFPGVRLK

SEQ ID NO: 12534 - protein, 26 aa, artificial
  peptide fold or domain or sub-domain
LSLADVTPDMASACGTKSTNLATMRN

SEQ ID NO: 12535 - protein, 20 aa, artificial
  peptide fold or domain or sub-domain
LSLAELTALLGYSEQDILHN

SEQ ID NO: 12536 - protein, 25 aa, artificial
  peptide fold or domain or sub-domain
LSLDDLDSLIAGDLNPTMAFMTGKI

SEQ ID NO: 12537 - protein, 24 aa, artificial
  peptide fold or domain or sub-domain
LSLDHLPEFNKSKRYPRAAQYALF

SEQ ID NO: 12538 - protein, 29 aa, artificial
  peptide fold or domain or sub-domain
LSLEDLEFALIDYGLEELEEVEDKIIIRG

SEQ ID NO: 12539 - protein, 28 aa, artificial
  peptide fold or domain or sub-domain
LSLEEKIKLLEPIGEELIHKDELINLLK

SEQ ID NO: 12540 - protein, 24 aa, artificial
  peptide fold or domain or sub-domain
LSLEEVVAFFSRKRVAKYKYPEHI

SEQ ID NO: 12541 - protein, 22 aa, artificial
  peptide fold or domain or sub-domain
LSLIHEIKIDRITGNMDKQKLG

SEQ ID NO: 12542 - protein, 28 aa, artificial
  peptide fold or domain or sub-domain
LSLNTATVRKQGDLVAIIDACAKHGIRA

SEQ ID NO: 12543 - protein, 29 aa, artificial
  peptide fold or domain or sub-domain
LSLPDLVKLMCDHDESVVARAVHRAYMLS

SEQ ID NO: 12544 - protein, 21 aa, artificial
  peptide fold or domain or sub-domain
LSLQDAVSQGVIDQDMATRLK

SEQ ID NO: 12545 - protein, 23 aa, artificial
  peptide fold or domain or sub-domain
LSLREQKFKKATEMYGTEVIKFT

SEQ ID NO: 12546 - protein, 25 aa, artificial
  peptide fold or domain or sub-domain
LSLRYQVFKQRLEWDLVVENNLESD

SEQ ID NO: 12547 - protein, 23 aa, artificial
  peptide fold or domain or sub-domain
LSLSEQELDRTCSSNSQDVVRFT

SEQ ID NO: 12548 - protein, 21 aa, artificial
  peptide fold or domain or sub-domain
LSLTERSQIAHALKLSEVQVK

SEQ ID NO: 12549 - protein, 28 aa, artificial
  peptide fold or domain or sub-domain
LSLVDLLVTSKIEPSKRQAREDVQNGAI

SEQ ID NO: 12550 - protein, 29 aa, artificial
  peptide fold or domain or sub-domain
LSLVIGILDDKNREDILRKYTGIFERVIV

SEQ ID NO: 12551 - protein, 20 aa, artificial
  peptide fold or domain or sub-domain
LSMEEIAAALRISLSGAKMR

SEQ ID NO: 12552 - protein, 27 aa, artificial
  peptide fold or domain or sub-domain
LSMESAIERLREGRLSADTAYYLQHIV

SEQ ID NO: 12553 - protein, 21 aa, artificial
  peptide fold or domain or sub-domain
LSMKDANELLVAGREQEIVTA

SEQ ID NO: 12554 - protein, 29 aa, artificial
  peptide fold or domain or sub-domain
LSMPLLGKHLGVGVTSIYWYFRKKDDLLN

SEQ ID NO: 12555 - protein, 29 aa, artificial
  peptide fold or domain or sub-domain
LSMRKVGASLGVEAMSLYNHIANKSDILA

SEQ ID NO: 12556 - protein, 29 aa, artificial
  peptide fold or domain or sub-domain
LSMRRLAQELKTGHASLYAHVGNRDELLD

SEQ ID NO: 12557 - protein, 29 aa, artificial
  peptide fold or domain or sub-domain
LSMRRVANVVHMGSATLYRFYPSQEHLLF

SEQ ID NO: 12558 - protein, 25 aa, artificial
  peptide fold or domain or sub-domain
LSNAANQNALTEKRKTIQPKDIDKA

SEQ ID NO: 12559 - protein, 26 aa, artificial
  peptide fold or domain or sub-domain
LSNGVLVLETFFGCTTQEAADLVNDV

SEQ ID NO: 12560 - protein, 23 aa, artificial
  peptide fold or domain or sub-domain
LSNHYRQLRMKPFYSDLVQYMTS

SEQ ID NO: 12561 - protein, 30 aa, artificial
  peptide fold or domain or sub-domain
LSNISTISEIARKAGDGAIVQFLEDFIAEQ

SEQ ID NO: 12562 - protein, 25 aa, artificial
  peptide fold or domain or sub-domain
LSNLNPAATRVTFGVGSKVAEKLFT

SEQ ID NO: 12563 - protein, 26 aa, artificial
  peptide fold or domain or sub-domain
LSNLNPAATRVTFGVGSKVAEKLFTS

SEQ ID NO: 12564 - protein, 28 aa, artificial
  peptide fold or domain or sub-domain
LSNQMQAEVQSSSGQRRKKATKRLRVVE

SEQ ID NO: 12565 - protein, 21 aa, artificial
  peptide fold or domain or sub-domain
LSNTYASIGRGTGQKAEITTN

SEQ ID NO: 12566 - protein, 27 aa, artificial
  peptide fold or domain or sub-domain
LSNVVGEMVEKGQIPIKEARELVKHVS

SEQ ID NO: 12567 - protein, 23 aa, artificial
  peptide fold or domain or sub-domain
LSNYLASGSEDPYQIPEVRRRLY

SEQ ID NO: 12568 - protein, 21 aa, artificial
  peptide fold or domain or sub-domain
LSPAETKTLYPLMNVDDLYGT

SEQ ID NO: 12569 - protein, 21 aa, artificial
  peptide fold or domain or sub-domain
LSPEDTQKLFPLLDPSAFVGA

SEQ ID NO: 12570 - protein, 25 aa, artificial
  peptide fold or domain or sub-domain
LSPGYPDSYPNLQMCAWSISVEKGY

SEQ ID NO: 12571 - protein, 29 aa, artificial
  peptide fold or domain or sub-domain
LSPNETELSRLTGMPTETFEQISQAVAKC

SEQ ID NO: 12572 - protein, 28 aa, artificial
  peptide fold or domain or sub-domain
LSPQEIITNSRELAQQNPFKKPIKALEE

SEQ ID NO: 12573 - protein, 21 aa, artificial
  peptide fold or domain or sub-domain
LSPRQVKEKYPYINTDGLLMA

SEQ ID NO: 12574 - protein, 29 aa, artificial
  peptide fold or domain or sub-domain
LSQADLEDFLREEQFEEGDIQHHAKQLIE

SEQ ID NO: 12575 - protein, 20 aa, artificial
  peptide fold or domain or sub-domain
LSQCLNLITKPEESDGLANN

SEQ ID NO: 12576 - protein, 26 aa, artificial
  peptide fold or domain or sub-domain
LSQDPGGDPDRYRLCAEDFIRNRGVR

SEQ ID NO: 12577 - protein, 26 aa, artificial
  peptide fold or domain or sub-domain
LSQEAEEKGVSVSDHIVQQLTDGDLQ

SEQ ID NO: 12578 - protein, 27 aa, artificial
  peptide fold or domain or sub-domain
LSQEALARELVSGTIAPLTMFKALRMR

SEQ ID NO: 12579 - protein, 20 aa, artificial
  peptide fold or domain or sub-domain
LSQEQMAELRQNKQASPYRN

SEQ ID NO: 12580 - protein, 28 aa, artificial
  peptide fold or domain or sub-domain
LSQFKKEGSIHIDKKKIIIKDLNKLSEW

SEQ ID NO: 12581 - protein, 25 aa, artificial
  peptide fold or domain or sub-domain
LSQFSEDVLQAAFNSSKAVLDPMLV

SEQ ID NO: 12582 - protein, 26 aa, artificial
  peptide fold or domain or sub-domain
LSQFSEDVLQAAFNSSKAVLDPMLVS

SEQ ID NO: 12583 - protein, 20 aa, artificial
  peptide fold or domain or sub-domain
LSQHSKAHHPSQPVRFGKLL

SEQ ID NO: 12584 - protein, 21 aa, artificial
  peptide fold or domain or sub-domain
LSQKSIGEITGVHHVTVSRVL

SEQ ID NO: 12585 - protein, 23 aa, artificial
  peptide fold or domain or sub-domain
LSQLVWHLIEKQTQNKYGLICID

SEQ ID NO: 12586 - protein, 28 aa, artificial
  peptide fold or domain or sub-domain
LSQMDRDGIIKLGKDKILIKDLEELRKM

SEQ ID NO: 12587 - protein, 25 aa, artificial
  peptide fold or domain or sub-domain
LSQQCTLHEIRHKRRITVAAASKIL

SEQ ID NO: 12588 - protein, 20 aa, artificial
  peptide fold or domain or sub-domain
LSQREIAEHLQSPLGTIKTR

SEQ ID NO: 12589 - protein, 23 aa, artificial
  peptide fold or domain or sub-domain
LSQRKQEALKLGISPNLVRDILR

SEQ ID NO: 12590 - protein, 21 aa, artificial
  peptide fold or domain or sub-domain
LSQTDIASILGASRPKVNRAI

SEQ ID NO: 12591 - protein, 21 aa, artificial
  peptide fold or domain or sub-domain
LSQTEMAQMIGSGREPVNRCL

SEQ ID NO: 12592 - protein, 22 aa, artificial
  peptide fold or domain or sub-domain
LSQVSTTNPKSWLLTLTNFYNR

SEQ ID NO: 12593 - protein, 26 aa, artificial
  peptide fold or domain or sub-domain
LSRAEIIEGINRTGCSPTIGIDALLD

SEQ ID NO: 12594 - protein, 23 aa, artificial
  peptide fold or domain or sub-domain
LSRDLGQPWKWVNGTEWTNCFPI

SEQ ID NO: 12595 - protein, 21 aa, artificial
  peptide fold or domain or sub-domain
LSREDIANIIGTATESAIRLL

SEQ ID NO: 12596 - protein, 22 aa, artificial
  peptide fold or domain or sub-domain
LSREEGKPLAEGKGEVYRAGQF

SEQ ID NO: 12597 - protein, 25 aa, artificial
  peptide fold or domain or sub-domain
LSRESYTYTAQSKKKTIQKRDVDMA

SEQ ID NO: 12598 - protein, 25 aa, artificial
  peptide fold or domain or sub-domain
LSREVEETPEEERSGKEWFARLREY

SEQ ID NO: 12599 - protein, 21 aa, artificial
  peptide fold or domain or sub-domain
LSRKDAAKNIGTSPMTVTRYL

SEQ ID NO: 12600 - protein, 26 aa, artificial
  peptide fold or domain or sub-domain
LSRKEFREHFVRLGFDKKSVQDALFR

SEQ ID NO: 12601 - protein, 23 aa, artificial
  peptide fold or domain or sub-domain
LSRLLAAQRAAGEPDHEAVVSMA

SEQ ID NO: 12602 - protein, 23 aa, artificial
  peptide fold or domain or sub-domain
LSRLVIEQIKPGHLSRLEAIHMV

SEQ ID NO: 12603 - protein, 25 aa, artificial
  peptide fold or domain or sub-domain
LSRPTMDRSLAAKMYIEQYYINAQQ

SEQ ID NO: 12604 - protein, 23 aa, artificial
  peptide fold or domain or sub-domain
LSRQIAKHRDNGTFDRASMVSLA

SEQ ID NO: 12605 - protein, 23 aa, artificial
  peptide fold or domain or sub-domain
LSRVRQLSLTAGGDTELAEEVWR

SEQ ID NO: 12606 - protein, 22 aa, artificial
  peptide fold or domain or sub-domain
LSRYHSLDIHREGINHRVYLSW

SEQ ID NO: 12607 - protein, 30 aa, artificial
  peptide fold or domain or sub-domain
LSSAEYLGNRVMQANKNTDPQHTEWVKTFY

SEQ ID NO: 12608 - protein, 23 aa, artificial
  peptide fold or domain or sub-domain
LSSALSQASQRVVLHSPEFEDAL

SEQ ID NO: 12609 - protein, 28 aa, artificial
  peptide fold or domain or sub-domain
LSSEEIYDLVKRKYPEIGLATVYRTLQL

SEQ ID NO: 12610 - protein, 21 aa, artificial
  peptide fold or domain or sub-domain
LSSEELKQRFPNIRLPRGEVG

SEQ ID NO: 12611 - protein, 22 aa, artificial
  peptide fold or domain or sub-domain
LSSFEAESRLRARGVSARDQRG

SEQ ID NO: 12612 - protein, 26 aa, artificial
  peptide fold or domain or sub-domain
LSSFSKGVQRAAFKISEEKLEKLLGK

SEQ ID NO: 12613 - protein, 27 aa, artificial
  peptide fold or domain or sub-domain
LSSGAISDFEMTKTFMGTLISGLLGRF

SEQ ID NO: 12614 - protein, 22 aa, artificial
  peptide fold or domain or sub-domain
LSSGVLIGETVTCPWHGWTYNV

SEQ ID NO: 12615 - protein, 26 aa, artificial
  peptide fold or domain or sub-domain
LSSKIMSQLDQGLSLEQGWNTCLDTI

SEQ ID NO: 12616 - protein, 22 aa, artificial
  peptide fold or domain or sub-domain
LSSKSAERVLLEADLSRKRRKE

SEQ ID NO: 12617 - protein, 29 aa, artificial
  peptide fold or domain or sub-domain
LSSLSGRDFELVQLKSEFNFTNAYPRREW

SEQ ID NO: 12618 - protein, 25 aa, artificial
  peptide fold or domain or sub-domain
LSSNLTIFSMNSGRNPRVVMAVNII

SEQ ID NO: 12619 - protein, 20 aa, artificial
  peptide fold or domain or sub-domain
LSSSSIKQVAMFGGCIKGLV

SEQ ID NO: 12620 - protein, 24 aa, artificial
  peptide fold or domain or sub-domain
LSSSYEKTRDLISKREWSKLLEYD

SEQ ID NO: 12621 - protein, 26 aa, artificial
  peptide fold or domain or sub-domain
LSSTAQELGELKENDIDAYSEKFSEA

SEQ ID NO: 12622 - protein, 24 aa, artificial
  peptide fold or domain or sub-domain
LSSVYQDEYEDVPGSYGYITIAHE

SEQ ID NO: 12623 - protein, 24 aa, artificial
  peptide fold or domain or sub-domain
LSSWSGIDLSAYPPDGPLPPLPDE

SEQ ID NO: 12624 - protein, 22 aa, artificial
  peptide fold or domain or sub-domain
LSTAEAKEIHFASGGSDNFREE

SEQ ID NO: 12625 - protein, 22 aa, artificial
  peptide fold or domain or sub-domain
LSTAQAEWDLREAGIPAKAQKG

SEQ ID NO: 12626 - protein, 25 aa, artificial
  peptide fold or domain or sub-domain
LSTDTLDKLITGRMGPLMAFSTGRL

SEQ ID NO: 12627 - protein, 26 aa, artificial
  peptide fold or domain or sub-domain
LSTEEATRWADSFDVLLSHKFGVMAH

SEQ ID NO: 12628 - protein, 25 aa, artificial
  peptide fold or domain or sub-domain
LSTENLKKLLRGQLNPMTAVMMGKI

SEQ ID NO: 12629 - protein, 22 aa, artificial
  peptide fold or domain or sub-domain
LSTGFLSEQGVTCPLHLSVFNL

SEQ ID NO: 12630 - protein, 27 aa, artificial
  peptide fold or domain or sub-domain
LSTGVHKNGQAQSLLDAFCRYQAHMNP

SEQ ID NO: 12631 - protein, 22 aa, artificial
  peptide fold or domain or sub-domain
LSTKEAKSLIFKKNGFKVLKKE

SEQ ID NO: 12632 - protein, 21 aa, artificial
  peptide fold or domain or sub-domain
LSTKQIAERLNIKQAKVGTTQ

SEQ ID NO: 12633 - protein, 22 aa, artificial
  peptide fold or domain or sub-domain
LSTLAVHLPNDFTPAVHASLDK

SEQ ID NO: 12634 - protein, 25 aa, artificial
  peptide fold or domain or sub-domain
LSTLDEDFNGHSVYLEKLKLMKQNY

SEQ ID NO: 12635 - protein, 23 aa, artificial
  peptide fold or domain or sub-domain
LSTLLVNTPNEDDARELTTILVS

SEQ ID NO: 12636 - protein, 22 aa, artificial
  peptide fold or domain or sub-domain
LSTLTGQSKEKALQEVDLSVQR

SEQ ID NO: 12637 - protein, 21 aa, artificial
  peptide fold or domain or sub-domain
LSTMLKAKKALNSLTLERDGV

SEQ ID NO: 12638 - protein, 23 aa, artificial
  peptide fold or domain or sub-domain
LSTMVQARDEGDRLSEAELLMMG

SEQ ID NO: 12639 - protein, 21 aa, artificial
  peptide fold or domain or sub-domain
LSTPDRLDLAETLGLSQLQVK

SEQ ID NO: 12640 - protein, 20 aa, artificial
  peptide fold or domain or sub-domain
LSTQMLTNTVDTRISRSTIR

SEQ ID NO: 12641 - protein, 30 aa, artificial
  peptide fold or domain or sub-domain
LSTRSSSGVKFGSSFGPGRVSTAADGSLQL

SEQ ID NO: 12642 - protein, 22 aa, artificial
  peptide fold or domain or sub-domain
LSTVEARGYLFEQGGYRQIKKA

SEQ ID NO: 12643 - protein, 30 aa, artificial
  peptide fold or domain or sub-domain
LSTVLESSLEGKSKAELIALIKSYQEGQPT

SEQ ID NO: 12644 - protein, 22 aa, artificial
  peptide fold or domain or sub-domain
LSTVQAIQMLKTNNKKKGKILQ

SEQ ID NO: 12645 - protein, 22 aa, artificial
  peptide fold or domain or sub-domain
LSTYGLAQQLKIAPREAEALKN

SEQ ID NO: 12646 - protein, 27 aa, artificial
  peptide fold or domain or sub-domain
LSTYLAEGTTNEVFLPFGVRQVIERRI

SEQ ID NO: 12647 - protein, 27 aa, artificial
  peptide fold or domain or sub-domain
LSVADAQALIRDGTISGGMIPKVETCI

SEQ ID NO: 12648 - protein, 24 aa, artificial
  peptide fold or domain or sub-domain
LSVAPEISFEEIAATHKNPEEVRE

SEQ ID NO: 12649 - protein, 28 aa, artificial
  peptide fold or domain or sub-domain
LSVAVADAHPLLIPRADYVTRIAGGRGA

SEQ ID NO: 12650 - protein, 28 aa, artificial
  peptide fold or domain or sub-domain
LSVCPLDADHEVKPRVDYISKFNGGQGC

SEQ ID NO: 12651 - protein, 24 aa, artificial
  peptide fold or domain or sub-domain
LSVDEIGEMIRDCGLWKSKAKNIQ

SEQ ID NO: 12652 - protein, 25 aa, artificial
  peptide fold or domain or sub-domain
LSVDEIGEMIRDCGLWKSKAKNIQG

SEQ ID NO: 12653 - protein, 26 aa, artificial
  peptide fold or domain or sub-domain
LSVDSSDYKLVKETPVLYIRDKLIPT

SEQ ID NO: 12654 - protein, 30 aa, artificial
  peptide fold or domain or sub-domain
LSVDSVHKKIVFQQHVARQLKLQGFEARAC

SEQ ID NO: 12655 - protein, 29 aa, artificial
  peptide fold or domain or sub-domain
LSVERLVTFLQHQQREEEAGPALALSLIE

SEQ ID NO: 12656 - protein, 24 aa, artificial
  peptide fold or domain or sub-domain
LSVGGDTLPVKKPDPAPLLHAMEK

SEQ ID NO: 12657 - protein, 21 aa, artificial
  peptide fold or domain or sub-domain
LSVGKRMELSKALKLTETQIK

SEQ ID NO: 12658 - protein, 25 aa, artificial
  peptide fold or domain or sub-domain
LSVLADEFKSDPVYCQKIDDLLTTH

SEQ ID NO: 12659 - protein, 20 aa, artificial
  peptide fold or domain or sub-domain
LSVLVDDMPPAVWEGHRSKV

SEQ ID NO: 12660 - protein, 28 aa, artificial
  peptide fold or domain or sub-domain
LSVLVDDMPPAVWEGHRSKVPLYQRDSS

SEQ ID NO: 12661 - protein, 29 aa, artificial
  peptide fold or domain or sub-domain
LSVRAVAVRLGTSAGSLYRHIASRDELVA

SEQ ID NO: 12662 - protein, 29 aa, artificial
  peptide fold or domain or sub-domain
LSVSGVSQESLRKVRNREHVDDPKLWEHA

SEQ ID NO: 12663 - protein, 23 aa, artificial
  peptide fold or domain or sub-domain
LSVTGGRITEQGVALLLSGGAHG

SEQ ID NO: 12664 - protein, 25 aa, artificial
  peptide fold or domain or sub-domain
LSWIAVNKAAQQTREKWDEEKNLNQ

SEQ ID NO: 12665 - protein, 20 aa, artificial
  peptide fold or domain or sub-domain
LSYEEIAAIMDCPVGTVRSR

SEQ ID NO: 12666 - protein, 30 aa, artificial
  peptide fold or domain or sub-domain
LSYELIEMSADLTANGYLSESDVQQIRHQI

SEQ ID NO: 12667 - protein, 27 aa, artificial
  peptide fold or domain or sub-domain
LSYGFHIPPRTSTAESATKLKSGLPAE

SEQ ID NO: 12668 - protein, 27 aa, artificial
  peptide fold or domain or sub-domain
LSYKVNVTTGTQVAAGNPEVSAARVEE

SEQ ID NO: 12669 - protein, 21 aa, artificial
  peptide fold or domain or sub-domain
LSYLCREDVSRYNKLLNNLGI

SEQ ID NO: 12670 - protein, 21 aa, artificial
  peptide fold or domain or sub-domain
LSYLKNTDIVRYRQILKDLDI

SEQ ID NO: 12671 - protein, 21 aa, artificial
  peptide fold or domain or sub-domain
LSYMRNSNGAGYQELIANLGL

SEQ ID NO: 12672 - protein, 23 aa, artificial
  peptide fold or domain or sub-domain
LSYREIAKELGVAVGTVYNRIKR

SEQ ID NO: 12673 - protein, 25 aa, artificial
  peptide fold or domain or sub-domain
LSYSANFLYMMTGKLPSSLEEQIFD

SEQ ID NO: 12674 - protein, 26 aa, artificial
  peptide fold or domain or sub-domain
LSYTDLIVPRGRDNKLAIDMVINFIR

SEQ ID NO: 12675 - protein, 28 aa, artificial
  peptide fold or domain or sub-domain
LTAAEVLEIVSKYTDKLNFSTVYRNLET

SEQ ID NO: 12676 - protein, 27 aa, artificial
  peptide fold or domain or sub-domain
LTAALKRKAFGRAFRGKAGQVDPSQLG

SEQ ID NO: 12677 - protein, 28 aa, artificial
  peptide fold or domain or sub-domain
LTACPKDSVQEILEISNFISSKNGGDGA

SEQ ID NO: 12678 - protein, 28 aa, artificial
  peptide fold or domain or sub-domain
LTADEVHSRAVDKLPEISRATVYNTLGE

SEQ ID NO: 12679 - protein, 24 aa, artificial
  peptide fold or domain or sub-domain
LTADQVAEFVADNAAPYKKLRGGV

SEQ ID NO: 12680 - protein, 28 aa, artificial
  peptide fold or domain or sub-domain
LTAEETAERIKKKEPRISVATIYRNLNL

SEQ ID NO: 12681 - protein, 27 aa, artificial
  peptide fold or domain or sub-domain
LTAGRVDELFADGTISGGMLPKIKSAL

SEQ ID NO: 12682 - protein, 28 aa, artificial
  peptide fold or domain or sub-domain
LTAKNVLSALNDDYPGLSFDTIYRNLSL

SEQ ID NO: 12683 - protein, 28 aa, artificial
  peptide fold or domain or sub-domain
LTAKSAAIWAAAKEKNCFADYAPTLEEI

SEQ ID NO: 12684 - protein, 23 aa, artificial
  peptide fold or domain or sub-domain
LTALLEAVEDGDRLSEGELIAMV

SEQ ID NO: 12685 - protein, 28 aa, artificial
  peptide fold or domain or sub-domain
LTALLREKVSLRDHLDAPFRVEGGWGIA

SEQ ID NO: 12686 - protein, 23 aa, artificial
  peptide fold or domain or sub-domain
LTAMGELANMLGSGYYNYDRFQT

SEQ ID NO: 12687 - protein, 28 aa, artificial
  peptide fold or domain or sub-domain
LTAMGELANMLGSGYYNYDRFQTMTGAP

SEQ ID NO: 12688 - protein, 23 aa, artificial
  peptide fold or domain or sub-domain
LTATISQLDTPEHRRVLLANLLE

SEQ ID NO: 12689 - protein, 23 aa, artificial
  peptide fold or domain or sub-domain
LTAVLQVMQTHALAEPAAFALIR

SEQ ID NO: 12690 - protein, 21 aa, artificial
  peptide fold or domain or sub-domain
LTAVNTGDKKTDPGCSSDIRR

SEQ ID NO: 12691 - protein, 28 aa, artificial
  peptide fold or domain or sub-domain
LTAWEEQGLVKSGRQKVTVTEPHQLLML

SEQ ID NO: 12692 - protein, 20 aa, artificial
  peptide fold or domain or sub-domain
LTCEDMDQALNRSGGKAGNK

SEQ ID NO: 12693 - protein, 25 aa, artificial
  peptide fold or domain or sub-domain
LTCLYAEYSGDEIFTAKIQDLSKKY

SEQ ID NO: 12694 - protein, 26 aa, artificial
  peptide fold or domain or sub-domain
LTCNSEEREYPCQNAIDGSNTTSWRS

SEQ ID NO: 12695 - protein, 20 aa, artificial
  peptide fold or domain or sub-domain
LTCRTGEQALVRSDPAGRDF

SEQ ID NO: 12696 - protein, 27 aa, artificial
  peptide fold or domain or sub-domain
LTDADGNSISMIRDSSNTISGDDKYDS

SEQ ID NO: 12697 - protein, 25 aa, artificial
  peptide fold or domain or sub-domain
LTDEAYTNAKLDKRKNVLYKDLSRA

SEQ ID NO: 12698 - protein, 24 aa, artificial
  peptide fold or domain or sub-domain
LTDEGVLGKYISDAEKKSSLLKTF

SEQ ID NO: 12699 - protein, 28 aa, artificial
  peptide fold or domain or sub-domain
LTDEKRSLLVGRLQKMLRTSKIATFQDY

SEQ ID NO: 12700 - protein, 27 aa, artificial
  peptide fold or domain or sub-domain
LTDGMQQVVNKTHKEDIYRSYANLIGK

SEQ ID NO: 12701 - protein, 25 aa, artificial
  peptide fold or domain or sub-domain
LTDHLIDQFAQTGSADLIHEFAFPL

SEQ ID NO: 12702 - protein, 28 aa, artificial
  peptide fold or domain or sub-domain
LTDLPGVGPSTAEKLVEAGYIDFMKIAT

SEQ ID NO: 12703 - protein, 30 aa, artificial
  peptide fold or domain or sub-domain
LTDMTMPPLRAWRKKARAVLASAKRRGGAH

SEQ ID NO: 12704 - protein, 23 aa, artificial
  peptide fold or domain or sub-domain
LTDVEKRASRAGVDPAFAHAFFQ

SEQ ID NO: 12705 - protein, 30 aa, artificial
  peptide fold or domain or sub-domain
LTEAALSDALQQLGRCEMVGKQFGVHKLWF

SEQ ID NO: 12706 - protein, 24 aa, artificial
  peptide fold or domain or sub-domain
LTEAEIFGHIRQLGLAKTKARNVH

SEQ ID NO: 12707 - protein, 25 aa, artificial
  peptide fold or domain or sub-domain
LTEAEIFGHIRQLGLAKTKARNVHK

SEQ ID NO: 12708 - protein, 29 aa, artificial
  peptide fold or domain or sub-domain
LTEFDMAGTPAYVTDGKCHYKDGTIAGAA

SEQ ID NO: 12709 - protein, 22 aa, artificial
  peptide fold or domain or sub-domain
LTEHIISVGYSLEGRYAALSLI

SEQ ID NO: 12710 - protein, 27 aa, artificial
  peptide fold or domain or sub-domain
LTEKECEDLIERGIISRGMIPKIRSSL

SEQ ID NO: 12711 - protein, 24 aa, artificial
  peptide fold or domain or sub-domain
LTEKELLDWAHPKIANYKHFRGGI

SEQ ID NO: 12712 - protein, 26 aa, artificial
  peptide fold or domain or sub-domain
LTELANFEKNVSQAIHKYNAYRKAAS

SEQ ID NO: 12713 - protein, 21 aa, artificial
  peptide fold or domain or sub-domain
LTERRRQQLSSELGLNEAQIK

SEQ ID NO: 12714 - protein, 26 aa, artificial
  peptide fold or domain or sub-domain
LTETIKTEELLTLPANEVLWRLYHEE

SEQ ID NO: 12715 - protein, 28 aa, artificial
  peptide fold or domain or sub-domain
LTEVEGVGRTLAMRLYRAGYHSVRDLAE

SEQ ID NO: 12716 - protein, 21 aa, artificial
  peptide fold or domain or sub-domain
LTEYLPPSQIDDVEIKDPSTY

SEQ ID NO: 12717 - protein, 30 aa, artificial
  peptide fold or domain or sub-domain
LTEYLPPSQIDDVEIKDPSTYMVDEQITDL

SEQ ID NO: 12718 - protein, 24 aa, artificial
  peptide fold or domain or sub-domain
LTFADLTAYLDRQQVAKQYYPERL

SEQ ID NO: 12719 - protein, 21 aa, artificial
  peptide fold or domain or sub-domain
LTFKYARDFLDTTDSTLSKHI

SEQ ID NO: 12720 - protein, 20 aa, artificial
  peptide fold or domain or sub-domain
LTFLVGHGLHIQNSKLQLNL

SEQ ID NO: 12721 - protein, 27 aa, artificial
  peptide fold or domain or sub-domain
LTFNKPSYTVTGSGGGGTHMYHWSENR

SEQ ID NO: 12722 - protein, 25 aa, artificial
  peptide fold or domain or sub-domain
LTFSEAIYLLLKGELPSEAEAKMMD

SEQ ID NO: 12723 - protein, 25 aa, artificial
  peptide fold or domain or sub-domain
LTFSENFFHMCFGKVPEKEIVKAFD

SEQ ID NO: 12724 - protein, 21 aa, artificial
  peptide fold or domain or sub-domain
LTFTDLQRSLRIGKGSLKNHL

SEQ ID NO: 12725 - protein, 27 aa, artificial
  peptide fold or domain or sub-domain
LTFVTKLSVTHYVPKSHLLEHQGGTDT

SEQ ID NO: 12726 - protein, 27 aa, artificial
  peptide fold or domain or sub-domain
LTGAKDGVVKSPEWAEKITHVPAQTIR

SEQ ID NO: 12727 - protein, 22 aa, artificial
  peptide fold or domain or sub-domain
LTGFGGGIEIKKFLLKHEGVKI

SEQ ID NO: 12728 - protein, 25 aa, artificial
  peptide fold or domain or sub-domain
LTGGRTAAPDDPLLLFKRSNANGTA

SEQ ID NO: 12729 - protein, 27 aa, artificial
  peptide fold or domain or sub-domain
LTGIRQSGNHFYQLGRYHEARAKYRKA

SEQ ID NO: 12730 - protein, 25 aa, artificial
  peptide fold or domain or sub-domain
LTGKTLAEVAAMRGKSPEETAMDLV

SEQ ID NO: 12731 - protein, 21 aa, artificial
  peptide fold or domain or sub-domain
LTGNPCLVEDSNDVQIAAAVT

SEQ ID NO: 12732 - protein, 25 aa, artificial
  peptide fold or domain or sub-domain
LTGRVVNDIAAERGQDPFHCLVEIC

SEQ ID NO: 12733 - protein, 21 aa, artificial
  peptide fold or domain or sub-domain
LTGSELHRRYPAYRLPKDHLA

SEQ ID NO: 12734 - protein, 22 aa, artificial
  peptide fold or domain or sub-domain
LTGYAGGLPRKQQLLELEGALL

SEQ ID NO: 12735 - protein, 22 aa, artificial
  peptide fold or domain or sub-domain
LTGYHWGLTRKRAILGWEAGQV

SEQ ID NO: 12736 - protein, 21 aa, artificial
  peptide fold or domain or sub-domain
LTHDDLGSLVGASRVMVTNVM

SEQ ID NO: 12737 - protein, 30 aa, artificial
  peptide fold or domain or sub-domain
LTHEDKGAVLIDLTKFNKKLGKAIVQKSDG

SEQ ID NO: 12738 - protein, 26 aa, artificial
  peptide fold or domain or sub-domain
LTHKHSSHCDTYVDGERKRDCPFCIV

SEQ ID NO: 12739 - protein, 26 aa, artificial
  peptide fold or domain or sub-domain
LTIEEITAGLNKLDSKQSKEIESIIS

SEQ ID NO: 12740 - protein, 25 aa, artificial
  peptide fold or domain or sub-domain
LTIFGKTWKAHSVKSLGISDDENAE

SEQ ID NO: 12741 - protein, 22 aa, artificial
  peptide fold or domain or sub-domain
LTIFKEALGADFTPEHCKSWEK

SEQ ID NO: 12742 - protein, 29 aa, artificial
  peptide fold or domain or sub-domain
LTIPKAVQYLCSQDEKYQAIGAYYIQHTC

SEQ ID NO: 12743 - protein, 26 aa, artificial
  peptide fold or domain or sub-domain
LTISEIFQCLKVNDNEFDRELYFLLK

SEQ ID NO: 12744 - protein, 21 aa, artificial
  peptide fold or domain or sub-domain
LTISGRSLPCNKPYDISLKAG

SEQ ID NO: 12745 - protein, 22 aa, artificial
  peptide fold or domain or sub-domain
LTKAELAELLFERVGLNKREAK

SEQ ID NO: 12746 - protein, 29 aa, artificial
  peptide fold or domain or sub-domain
LTKAELAELLFERVGLNKREAKDIVDTFF

SEQ ID NO: 12747 - protein, 20 aa, artificial
  peptide fold or domain or sub-domain
LTKAQRTKIESDLENLNISL

SEQ ID NO: 12748 - protein, 24 aa, artificial
  peptide fold or domain or sub-domain
LTKARESSKAQNLDIDFIETNVLF

SEQ ID NO: 12749 - protein, 29 aa, artificial
  peptide fold or domain or sub-domain
LTKDHLELNNILKLEKEKKFNAVLEKIKK

SEQ ID NO: 12750 - protein, 30 aa, artificial
  peptide fold or domain or sub-domain
LTKDKKKIALLESWENSPSSLQRRAFWYYQ

SEQ ID NO: 12751 - protein, 22 aa, artificial
  peptide fold or domain or sub-domain
LTKDQLIADIAESIAAPKATAK

SEQ ID NO: 12752 - protein, 22 aa, artificial
  peptide fold or domain or sub-domain
LTKECGRSKSTLLHNGYDIHVC

SEQ ID NO: 12753 - protein, 22 aa, artificial
  peptide fold or domain or sub-domain
LTKKDLIATLSYETGFSRRDTE

SEQ ID NO: 12754 - protein, 29 aa, artificial
  peptide fold or domain or sub-domain
LTKKDLIATLSYETGFSRRDTENMVDVLT

SEQ ID NO: 12755 - protein, 27 aa, artificial
  peptide fold or domain or sub-domain
LTKKTLEKLKEAIPQDQLEKKYLGTAE

SEQ ID NO: 12756 - protein, 27 aa, artificial
  peptide fold or domain or sub-domain
LTKLLAAQLSSGSDEDALLAADQVRKL

SEQ ID NO: 12757 - protein, 29 aa, artificial
  peptide fold or domain or sub-domain
LTKLPFAYDGLSPALRSLTMETHYSKHYL

SEQ ID NO: 12758 - protein, 22 aa, artificial
  peptide fold or domain or sub-domain
LTKNEMMTMLYNQLNISRKECV

SEQ ID NO: 12759 - protein, 22 aa, artificial
  peptide fold or domain or sub-domain
LTKSDMIEHLMSHLNLTRQEGR

SEQ ID NO: 12760 - protein, 29 aa, artificial
  peptide fold or domain or sub-domain
LTKSDMIEHLMSHLNLTRQEGRCLVENFF

SEQ ID NO: 12761 - protein, 27 aa, artificial
  peptide fold or domain or sub-domain
LTLADLDRRIQAGAITGGMKWKAWAIQ

SEQ ID NO: 12762 - protein, 21 aa, artificial
  peptide fold or domain or sub-domain
LTLAEIGNVLGVTESRVSQIH

SEQ ID NO: 12763 - protein, 26 aa, artificial
  peptide fold or domain or sub-domain
LTLEEVKKGLHNFQQESWGEVIQILK

SEQ ID NO: 12764 - protein, 26 aa, artificial
  peptide fold or domain or sub-domain
LTLEEVLQWAQSFENLMATKYGPVVY

SEQ ID NO: 12765 - protein, 20 aa, artificial
  peptide fold or domain or sub-domain
LTLKCLTPLTTTGGSLQLKV

SEQ ID NO: 12766 - protein, 22 aa, artificial
  peptide fold or domain or sub-domain
LTLKTRIDSKRTGPEKRMLYPK

SEQ ID NO: 12767 - protein, 29 aa, artificial
  peptide fold or domain or sub-domain
LTLLEFLDFLQEEQKERDCTSELALELID

SEQ ID NO: 12768 - protein, 23 aa, artificial
  peptide fold or domain or sub-domain
LTLLMVMLRDVQGSSPGVRQLAA

SEQ ID NO: 12769 - protein, 20 aa, artificial
  peptide fold or domain or sub-domain
LTLPLAAGLQNTDGGMGVKL

SEQ ID NO: 12770 - protein, 22 aa, artificial
  peptide fold or domain or sub-domain
LTLQSYIKGQQRRPRDRFLYAK

SEQ ID NO: 12771 - protein, 25 aa, artificial
  peptide fold or domain or sub-domain
LTLRAHEYKIEYKRPIPISALVNYM

SEQ ID NO: 12772 - protein, 25 aa, artificial
  peptide fold or domain or sub-domain
LTLRAWIHTEDNKRRTLQRNDIAMA

SEQ ID NO: 12773 - protein, 29 aa, artificial
  peptide fold or domain or sub-domain
LTLRGDRVVYVAGGRAGVVRLGGGEHRRP

SEQ ID NO: 12774 - protein, 22 aa, artificial
  peptide fold or domain or sub-domain
LTLSELTEELSIKPSKSPFLQR

SEQ ID NO: 12775 - protein, 20 aa, artificial
  peptide fold or domain or sub-domain
LTLSLGNGLEFSNQAVAIKA

SEQ ID NO: 12776 - protein, 26 aa, artificial
  peptide fold or domain or sub-domain
LTLSSHPQREHVSELKGAGVSGYLSK

SEQ ID NO: 12777 - protein, 21 aa, artificial
  peptide fold or domain or sub-domain
LTLVQISQRMGISRERVRQVE

SEQ ID NO: 12778 - protein, 25 aa, artificial
  peptide fold or domain or sub-domain
LTMDERGRLVHDPETRQTSVPWVFA

SEQ ID NO: 12779 - protein, 27 aa, artificial
  peptide fold or domain or sub-domain
LTMIAERLGLDISCTDSLWRDRTLVEM

SEQ ID NO: 12780 - protein, 29 aa, artificial
  peptide fold or domain or sub-domain
LTMRRLAQAMDVQAGALYRYFAAKQDLLT

SEQ ID NO: 12781 - protein, 25 aa, artificial
  peptide fold or domain or sub-domain
LTMRSWLHAQESKRVTLQKSNVDAA

SEQ ID NO: 12782 - protein, 22 aa, artificial
  peptide fold or domain or sub-domain
LTMWVKKWGLSDIGFGREKTTY

SEQ ID NO: 12783 - protein, 26 aa, artificial
  peptide fold or domain or sub-domain
LTMYPKSKGNLKAWPQNPSNFSEIVD

SEQ ID NO: 12784 - protein, 30 aa, artificial
  peptide fold or domain or sub-domain
LTNAQSLRCELEKSGAIFSSNSDTEILMHL

SEQ ID NO: 12785 - protein, 27 aa, artificial
  peptide fold or domain or sub-domain
LTNESLWRHPVSRTFHGRDIYAPVGAR

SEQ ID NO: 12786 - protein, 23 aa, artificial
  peptide fold or domain or sub-domain
LTNFGATFLQYGIITPDVSRKIS

SEQ ID NO: 12787 - protein, 30 aa, artificial
  peptide fold or domain or sub-domain
LTNFLPLRRFYESRGFKFRSSIDTEVIAVS

SEQ ID NO: 12788 - protein, 20 aa, artificial
  peptide fold or domain or sub-domain
LTNMLQAQGGYKDDKAWSYV

SEQ ID NO: 12789 - protein, 23 aa, artificial
  peptide fold or domain or sub-domain
LTNNIADALKNNKVNIGTIKASL

SEQ ID NO: 12790 - protein, 27 aa, artificial
  peptide fold or domain or sub-domain
LTNPAYQLANPSATFHGRDLFSPAAAH

SEQ ID NO: 12791 - protein, 25 aa, artificial
  peptide fold or domain or sub-domain
LTNQLLADVRGREEIDLVQDFSYPL

SEQ ID NO: 12792 - protein, 21 aa, artificial
  peptide fold or domain or sub-domain
LTNQLYNYLQTKYHPNLKTIQ

SEQ ID NO: 12793 - protein, 23 aa, artificial
  peptide fold or domain or sub-domain
LTNVELARRVHLSPSPCLARVKA

SEQ ID NO: 12794 - protein, 27 aa, artificial
  peptide fold or domain or sub-domain
LTPAQADALTQENVLIDGMRVKVDAAF

SEQ ID NO: 12795 - protein, 28 aa, artificial
  peptide fold or domain or sub-domain
LTPAQKQHLLEKLAEDIMCPEELHALLH

SEQ ID NO: 12796 - protein, 27 aa, artificial
  peptide fold or domain or sub-domain
LTPEEAEKLVKSEEVRGGMKRKLLMAS

SEQ ID NO: 12797 - protein, 24 aa, artificial
  peptide fold or domain or sub-domain
LTPEELQEEIRECGLYRNKSKSIL

SEQ ID NO: 12798 - protein, 25 aa, artificial
  peptide fold or domain or sub-domain
LTPEELQEEIRECGLYRNKSKSILE

SEQ ID NO: 12799 - protein, 27 aa, artificial
  peptide fold or domain or sub-domain
LTPHPGEFFRMTGVPVNELQKKRAEYA

SEQ ID NO: 12800 - protein, 20 aa, artificial
  peptide fold or domain or sub-domain
LTPKGACLAINKNVSEWTAR

SEQ ID NO: 12801 - protein, 20 aa, artificial
  peptide fold or domain or sub-domain
LTPKTRQSLEAFREMMPLVR

SEQ ID NO: 12802 - protein, 27 aa, artificial
  peptide fold or domain or sub-domain
LTPLHPDLPSATVTTLPDDILHYSEPR

SEQ ID NO: 12803 - protein, 29 aa, artificial
  peptide fold or domain or sub-domain
LTPNEKEIEALSKDFFGEFLTVEKAAEKF

SEQ ID NO: 12804 - protein, 29 aa, artificial
  peptide fold or domain or sub-domain
LTPNETEAQLIAGCAINSIEDAEKASTLI

SEQ ID NO: 12805 - protein, 29 aa, artificial
  peptide fold or domain or sub-domain
LTPNETEARVALGLPPDDPRSNREIANLL

SEQ ID NO: 12806 - protein, 29 aa, artificial
  peptide fold or domain or sub-domain
LTPNETELAFLSKSKIETIEDIRKASKYL

SEQ ID NO: 12807 - protein, 29 aa, artificial
  peptide fold or domain or sub-domain
LTPNETELETLIGRNINSEENLVEAAKTL

SEQ ID NO: 12808 - protein, 29 aa, artificial
  peptide fold or domain or sub-domain
LTPNETETEELTGLKVSSVDEARTASGKL

SEQ ID NO: 12809 - protein, 23 aa, artificial
  peptide fold or domain or sub-domain
LTPPRQRLQQYVSGLELTNEMVY

SEQ ID NO: 12810 - protein, 24 aa, artificial
  peptide fold or domain or sub-domain
LTPSSVYADLYGIAKVNGEGTSVG

SEQ ID NO: 12811 - protein, 20 aa, artificial
  peptide fold or domain or sub-domain
LTPTDLADIKMTVKKSEYII

SEQ ID NO: 12812 - protein, 21 aa, artificial
  peptide fold or domain or sub-domain
LTQANLKSDSVVDFYKTLIED

SEQ ID NO: 12813 - protein, 26 aa, artificial
  peptide fold or domain or sub-domain
LTQEVKRVSTVPVYVKLSPNVSDIVE

SEQ ID NO: 12814 - protein, 30 aa, artificial
  peptide fold or domain or sub-domain
LTQFGPFIESISGITDQSNDVFEDAAKAFS

SEQ ID NO: 12815 - protein, 25 aa, artificial
  peptide fold or domain or sub-domain
LTQRTLQRNGEQSPERMLELVIQEN

SEQ ID NO: 12816 - protein, 26 aa, artificial
  peptide fold or domain or sub-domain
LTQRWDDWFADPIDLADARELVTDTR

SEQ ID NO: 12817 - protein, 22 aa, artificial
  peptide fold or domain or sub-domain
LTRADITDMLYHEVGLSRADSA

SEQ ID NO: 12818 - protein, 29 aa, artificial
  peptide fold or domain or sub-domain
LTRADITDMLYHEVGLSRADSAKMIEQML

SEQ ID NO: 12819 - protein, 21 aa, artificial
  peptide fold or domain or sub-domain
  misc_feature (6)..(6): Xaa can be any naturally occurring amino acid
LTRARXIEIASALSLNETQVK

SEQ ID NO: 12820 - protein, 21 aa, artificial
  peptide fold or domain or sub-domain
LTRDNFSQHIPNVNLPEGNEA

SEQ ID NO: 12821 - protein, 21 aa, artificial
  peptide fold or domain or sub-domain
LTREEMANFIGVTRETMSRKL

SEQ ID NO: 12822 - protein, 21 aa, artificial
  peptide fold or domain or sub-domain
LTRERRLEISRSVHLTDRQVK

SEQ ID NO: 12823 - protein, 25 aa, artificial
  peptide fold or domain or sub-domain
LTREYVLERYGGKMGEVHKKSVSLV

SEQ ID NO: 12824 - protein, 22 aa, artificial
  peptide fold or domain or sub-domain
LTRKEIAEELTGQLGYSQNICS

SEQ ID NO: 12825 - protein, 29 aa, artificial
  peptide fold or domain or sub-domain
LTRKEIAEELTGQLGYSQNICSEIVDSFL

SEQ ID NO: 12826 - protein, 30 aa, artificial
  peptide fold or domain or sub-domain
LTRLGYVYGNLMVNLHLKNQKLVERGIRIV

SEQ ID NO: 12827 - protein, 29 aa, artificial
  peptide fold or domain or sub-domain
LTRMDLSEAVFREVGLSRNESAQLVETVL

SEQ ID NO: 12828 - protein, 29 aa, artificial
  peptide fold or domain or sub-domain
LTRRCRELAASADDWMGEVADLVVRLEQQ

SEQ ID NO: 12829 - protein, 22 aa, artificial
  peptide fold or domain or sub-domain
LTRVKSIIASKKLGGDQVELID

SEQ ID NO: 12830 - protein, 26 aa, artificial
  peptide fold or domain or sub-domain
LTSANRSSEQSTLNVGEFEKLWPALG

SEQ ID NO: 12831 - protein, 22 aa, artificial
  peptide fold or domain or sub-domain
LTSATAESELHARGIHGKKNKA

SEQ ID NO: 12832 - protein, 20 aa, artificial
  peptide fold or domain or sub-domain
LTSIHQLSSEERENFLDAHD

SEQ ID NO: 12833 - protein, 27 aa, artificial
  peptide fold or domain or sub-domain
LTSKTMEELQKKQMITGGMIPKVNSAL

SEQ ID NO: 12834 - protein, 28 aa, artificial
  peptide fold or domain or sub-domain
LTSQSVLAWRNAKKSNSFQQFAPFLDRV

SEQ ID NO: 12835 - protein, 29 aa, artificial
  peptide fold or domain or sub-domain
LTSSKAGSYSVDASLEVDKNIHQSVTITV

SEQ ID NO: 12836 - protein, 22 aa, artificial
  peptide fold or domain or sub-domain
LTSSNVLRRFNIGSEVIQIEFL

SEQ ID NO: 12837 - protein, 22 aa, artificial
  peptide fold or domain or sub-domain
LTSVAAEQMLRNLGLKPAKIKA

SEQ ID NO: 12838 - protein, 22 aa, artificial
  peptide fold or domain or sub-domain
LTSVEAGRVLRSSGISIEKRAA

SEQ ID NO: 12839 - protein, 22 aa, artificial
  peptide fold or domain or sub-domain
LTSYEAKGEVMAGGGSRDFGRH

SEQ ID NO: 12840 - protein, 26 aa, artificial
  peptide fold or domain or sub-domain
LTTAEMSEFMSKSTKYSDKEIEYLIS

SEQ ID NO: 12841 - protein, 30 aa, artificial
  peptide fold or domain or sub-domain
LTTAKSLRKELMQKGVGFFIDSDVEVITQL

SEQ ID NO: 12842 - protein, 20 aa, artificial
  peptide fold or domain or sub-domain
LTTDNEELALARVDEKRCHK

SEQ ID NO: 12843 - protein, 20 aa, artificial
  peptide fold or domain or sub-domain
LTTDNLQQSLDRSGDNHENK

SEQ ID NO: 12844 - protein, 20 aa, artificial
  peptide fold or domain or sub-domain
LTTENDAQAWTRAKRSEGDK

SEQ ID NO: 12845 - protein, 22 aa, artificial
  peptide fold or domain or sub-domain
LTTFEAKGQRLREGQSGGYRER

SEQ ID NO: 12846 - protein, 22 aa, artificial
  peptide fold or domain or sub-domain
LTTFEAKHIARQQGHKGHYKSD

SEQ ID NO: 12847 - protein, 22 aa, artificial
  peptide fold or domain or sub-domain
LTTKEAEEILSRSGVPPRKRRG

SEQ ID NO: 12848 - protein, 22 aa, artificial
  peptide fold or domain or sub-domain
LTTKQAQTFLLDLGISFKKRQK

SEQ ID NO: 12849 - protein, 22 aa, artificial
  peptide fold or domain or sub-domain
LTTMAAEKMLIAADVSRQKRKK

SEQ ID NO: 12850 - protein, 27 aa, artificial
  peptide fold or domain or sub-domain
LTTMMEGVVEDGTASVAKMDGTKVAAK

SEQ ID NO: 12851 - protein, 25 aa, artificial
  peptide fold or domain or sub-domain
LTTRAGYITSYSKRKVIKKDDIVKA

SEQ ID NO: 12852 - protein, 28 aa, artificial
  peptide fold or domain or sub-domain
LTTRAQQIWRKSREENDFSQWLPMLKEL

SEQ ID NO: 12853 - protein, 22 aa, artificial
  peptide fold or domain or sub-domain
LTTREAWQHMNPASSLKKAKAD

SEQ ID NO: 12854 - protein, 29 aa, artificial
  peptide fold or domain or sub-domain
LTTRKLAQKLGIEQPTLYWHVKNKRALLD

SEQ ID NO: 12855 - protein, 30 aa, artificial
  peptide fold or domain or sub-domain
LTTSERGTSDINLSDICPRFPVATLAKSDS

SEQ ID NO: 12856 - protein, 22 aa, artificial
  peptide fold or domain or sub-domain
LTTTDAKARLFELGGFKALTKG

SEQ ID NO: 12857 - protein, 26 aa, artificial
  peptide fold or domain or sub-domain
LTTTTDVENFPGFPEGILGVELTDKF

SEQ ID NO: 12858 - protein, 22 aa, artificial
  peptide fold or domain or sub-domain
LTTVAAHQVLNAGEVSLKKKME

SEQ ID NO: 12859 - protein, 22 aa, artificial
  peptide fold or domain or sub-domain
LTTVAANRTMYEMGIKKSKKKL

SEQ ID NO: 12860 - protein, 22 aa, artificial
  peptide fold or domain or sub-domain
LTTVGASKSDAVRDIYIGTLDA

SEQ ID NO: 12861 - protein, 26 aa, artificial
  peptide fold or domain or sub-domain
LTTVKNREKSDFCYSLGADEVVQYSK

SEQ ID NO: 12862 - protein, 22 aa, artificial
  peptide fold or domain or sub-domain
LTTVQAERSLRESQLTRKKRSK

SEQ ID NO: 12863 - protein, 29 aa, artificial
  peptide fold or domain or sub-domain
LTVADLQRFLTEEQGFENVDLKKAEQILT

SEQ ID NO: 12864 - protein, 30 aa, artificial
  peptide fold or domain or sub-domain
LTVAEVCGYRLRLHFDGYSECHDFWVNANS

SEQ ID NO: 12865 - protein, 25 aa, artificial
  peptide fold or domain or sub-domain
LTVEDLIAVSARTLSVGDALTQGKL

SEQ ID NO: 12866 - protein, 27 aa, artificial
  peptide fold or domain or sub-domain
LTVELRFDERQKSRHKTQTTCGKDLGW

SEQ ID NO: 12867 - protein, 20 aa, artificial
  peptide fold or domain or sub-domain
LTVENEQQALVRADPQQKNK

SEQ ID NO: 12868 - protein, 20 aa, artificial
  peptide fold or domain or sub-domain
LTVEQLLPLGFSNAKARYLI

SEQ ID NO: 12869 - protein, 29 aa, artificial
  peptide fold or domain or sub-domain
LTVFQRTFETLRNVSSKSDLQNTYQKFQK

SEQ ID NO: 12870 - protein, 26 aa, artificial
  peptide fold or domain or sub-domain
LTVLDKSGVLHDPNGLDLNELRRLAF

SEQ ID NO: 12871 - protein, 25 aa, artificial
  peptide fold or domain or sub-domain
LTVLSRDDTTVHLACRGEAADITLV

SEQ ID NO: 12872 - protein, 26 aa, artificial
  peptide fold or domain or sub-domain
LTVNKMEEAADEARAQMKDSPISKEL

SEQ ID NO: 12873 - protein, 25 aa, artificial
  peptide fold or domain or sub-domain
LTVQAQTESTIYLACPLDRHSVVLE

SEQ ID NO: 12874 - protein, 26 aa, artificial
  peptide fold or domain or sub-domain
LTVTPDDIRQVRGQDVIVLRDRTIPI

SEQ ID NO: 12875 - protein, 29 aa, artificial
  peptide fold or domain or sub-domain
LTVVVVSPEDTFADKVQTAFPQVRVWKNG

SEQ ID NO: 12876 - protein, 24 aa, artificial
  peptide fold or domain or sub-domain
LTWDYGSGKFTEVAGAVVFEPAPF

SEQ ID NO: 12877 - protein, 26 aa, artificial
  peptide fold or domain or sub-domain
LTWLKDGHPLELSDIVQEDGHLIRIS

SEQ ID NO: 12878 - protein, 26 aa, artificial
  peptide fold or domain or sub-domain
LTWLKDGRPLADGLRVLQGGEVLRVA

SEQ ID NO: 12879 - protein, 25 aa, artificial
  peptide fold or domain or sub-domain
LTWTAADSEAQVTKSKWDALGAMNQ

SEQ ID NO: 12880 - protein, 25 aa, artificial
  peptide fold or domain or sub-domain
LTWVAPVRQAVPTKLRWDQDRADNQ

SEQ ID NO: 12881 - protein, 26 aa, artificial
  peptide fold or domain or sub-domain
LTWYQPSGAVADSNYWNNTSNYAIAY

SEQ ID NO: 12882 - protein, 29 aa, artificial
  peptide fold or domain or sub-domain
LTWYVGILTTKDVQGILSTLLRPGDCFFA

SEQ ID NO: 12883 - protein, 24 aa, artificial
  peptide fold or domain or sub-domain
LTYLEGRSEQTIARAKAAGMVPVG

SEQ ID NO: 12884 - protein, 25 aa, artificial
  peptide fold or domain or sub-domain
LTYQECMDLVAQGKLADAKTLIALQ

SEQ ID NO: 12885 - protein, 27 aa, artificial
  peptide fold or domain or sub-domain
LTYQVQTGGIVHSNPAKRLTVDEAVQC

SEQ ID NO: 12886 - protein, 22 aa, artificial
  peptide fold or domain or sub-domain
LTYVWKITGREIFTGPKVLIPK

SEQ ID NO: 12887 - protein, 23 aa, artificial
  peptide fold or domain or sub-domain
LVADLLHYKGVEGLRKHISNTAE

SEQ ID NO: 12888 - protein, 28 aa, artificial
  peptide fold or domain or sub-domain
LVADLLHYKGVEGLRKHISNTAEFGAIK

SEQ ID NO: 12889 - protein, 26 aa, artificial
  peptide fold or domain or sub-domain
LVADTDTERVAHAVALGHTAVALEDV

SEQ ID NO: 12890 - protein, 27 aa, artificial
  peptide fold or domain or sub-domain
LVAEAAAMGYLDPHSGTILSAGQAVNK

SEQ ID NO: 12891 - protein, 28 aa, artificial
  peptide fold or domain or sub-domain
LVAEKMSMIQSRLRHRLKAVGIDTFPSY

SEQ ID NO: 12892 - protein, 27 aa, artificial
  peptide fold or domain or sub-domain
LVAGVGGEIADEGEPEEHEALRYPAWV

SEQ ID NO: 12893 - protein, 28 aa, artificial
  peptide fold or domain or sub-domain
LVAHFLFEEAAMQVAKYGGYGAHKAAHE

SEQ ID NO: 12894 - protein, 29 aa, artificial
  peptide fold or domain or sub-domain
LVAIASRRPGAAAETLAKYAPHQQGVRCY

SEQ ID NO: 12895 - protein, 30 aa, artificial
  peptide fold or domain or sub-domain
LVAMSRVSRIQAIGLVDELRRLPDQLARAG

SEQ ID NO: 12896 - protein, 29 aa, artificial
  peptide fold or domain or sub-domain
LVANEVEAALFADCDVQTPEDAAHAARLL

SEQ ID NO: 12897 - protein, 27 aa, artificial
  peptide fold or domain or sub-domain
LVASFKRGVITGKHGYTVNVDLAFEEV

SEQ ID NO: 12898 - protein, 29 aa, artificial
  peptide fold or domain or sub-domain
LVAVADAFPAAAEAIAGAYGCEVRTIDAI

SEQ ID NO: 12899 - protein, 29 aa, artificial
  peptide fold or domain or sub-domain
LVAVGSRRQQTADAFGERFGIPRRRRYSS

SEQ ID NO: 12900 - protein, 30 aa, artificial
  peptide fold or domain or sub-domain
LVCTSHSPVEGWNKIIIQYHSGLTQDFYVK

SEQ ID NO: 12901 - protein, 30 aa, artificial
  peptide fold or domain or sub-domain
LVDACLNRIGDFLRFIDLTDQDVTKLEVRL

SEQ ID NO: 12902 - protein, 30 aa, artificial
  peptide fold or domain or sub-domain
LVDAKQKRKEVLHEGVGLSTDTDSELIAQM

SEQ ID NO: 12903 - protein, 27 aa, artificial
  peptide fold or domain or sub-domain
LVDIYEDMLENQCDNKEDILNKALELC

SEQ ID NO: 12904 - protein, 29 aa, artificial
  peptide fold or domain or sub-domain
LVDKICDQLFDLIRLGMEEYSLNTPSTDI

SEQ ID NO: 12905 - protein, 27 aa, artificial
  peptide fold or domain or sub-domain
LVDQGEGFYQDGSYIDHTNVAYTGAFG

SEQ ID NO: 12906 - protein, 28 aa, artificial
  peptide fold or domain or sub-domain
LVDSLIERNIFNENKWKETDFKEYAALS

SEQ ID NO: 12907 - protein, 22 aa, artificial
  peptide fold or domain or sub-domain
LVDWMNRHGLLEDSRWANGIRH

SEQ ID NO: 12908 - protein, 29 aa, artificial
  peptide fold or domain or sub-domain
LVEAFSGNGRVQEVVLAGGEPIPADLVIV

SEQ ID NO: 12909 - protein, 26 aa, artificial
  peptide fold or domain or sub-domain
LVEDSANDVGTGVQKARKLIERDQVS

SEQ ID NO: 12910 - protein, 25 aa, artificial
  peptide fold or domain or sub-domain
LVEISGNDEYTHVVVFNNESHMIAS

SEQ ID NO: 12911 - protein, 30 aa, artificial
  peptide fold or domain or sub-domain
LVEKVKTVSIKKHFPDFRGDPHRLEDVQRY

SEQ ID NO: 12912 - protein, 22 aa, artificial
  peptide fold or domain or sub-domain
LVELAALEKDKFTPQYHKAALK

SEQ ID NO: 12913 - protein, 27 aa, artificial
  peptide fold or domain or sub-domain
LVESIINTYENLENFKTNASREWLLNI

SEQ ID NO: 12914 - protein, 28 aa, artificial
  peptide fold or domain or sub-domain
LVESLIRRGIVSRQQWFYCDRSEYGYFT

SEQ ID NO: 12915 - protein, 24 aa, artificial
  peptide fold or domain or sub-domain
LVESMKRGWMPSFPQFNRNPLILS

SEQ ID NO: 12916 - protein, 25 aa, artificial
  peptide fold or domain or sub-domain
LVEVSLLEAKKQGVKRITASHVKSA

SEQ ID NO: 12917 - protein, 28 aa, artificial
  peptide fold or domain or sub-domain
LVEVTGAELQRQGIEPVLAGKLARKVAA

SEQ ID NO: 12918 - protein, 28 aa, artificial
  peptide fold or domain or sub-domain
LVEWCIKNHVFTEDQYMAKFEESYYSFA

SEQ ID NO: 12919 - protein, 25 aa, artificial
  peptide fold or domain or sub-domain
LVEWLRANPKAIQPAQKHAEVLAEV

SEQ ID NO: 12920 - protein, 28 aa, artificial
  peptide fold or domain or sub-domain
LVFAEDYIIDEEQSRAAGLEELSRHILR

SEQ ID NO: 12921 - protein, 24 aa, artificial
  peptide fold or domain or sub-domain
LVGGIVPDDDQEELRGQGVDEIFG

SEQ ID NO: 12922 - protein, 23 aa, artificial
  peptide fold or domain or sub-domain
LVGGPEHGWIWTDGKVLSFSRLR

SEQ ID NO: 12923 - protein, 27 aa, artificial
  peptide fold or domain or sub-domain
LVGGYTNDTNGYFHHNGGSDFSTLENG

SEQ ID NO: 12924 - protein, 27 aa, artificial
  peptide fold or domain or sub-domain
LVGKFSDDKDKIFNHESWTDFSTYENS

SEQ ID NO: 12925 - protein, 24 aa, artificial
  peptide fold or domain or sub-domain
LVGLIQAMKSYNDNQIDQKYLNVT

SEQ ID NO: 12926 - protein, 23 aa, artificial
  peptide fold or domain or sub-domain
LVGQNSILQSMRGPEFATAFGVS

SEQ ID NO: 12927 - protein, 24 aa, artificial
  peptide fold or domain or sub-domain
LVGRLQQKLLSEGKTGPEWHEPSR

SEQ ID NO: 12928 - protein, 23 aa, artificial
  peptide fold or domain or sub-domain
LVGRNSLIQSMPRQVVAATCGIR

SEQ ID NO: 12929 - protein, 27 aa, artificial
  peptide fold or domain or sub-domain
LVGRYGADSAGHFHHGPAIGDFNDRYQ

SEQ ID NO: 12930 - protein, 24 aa, artificial
  peptide fold or domain or sub-domain
LVGSCRSCESCCDNRESHCENTID

SEQ ID NO: 12931 - protein, 23 aa, artificial
  peptide fold or domain or sub-domain
LVGSNSLLRTLNLTSLSIAFGVD

SEQ ID NO: 12932 - protein, 29 aa, artificial
  peptide fold or domain or sub-domain
LVGVISGTPSKVVVWRKKYNIPQKNCYNY

SEQ ID NO: 12933 - protein, 28 aa, artificial
  peptide fold or domain or sub-domain
LVGWLVDKGITSEKQWIQEDQASYISFN

SEQ ID NO: 12934 - protein, 25 aa, artificial
  peptide fold or domain or sub-domain
LVGYKGEDNDKDVLEFLQNVKAKDL

SEQ ID NO: 12935 - protein, 24 aa, artificial
  peptide fold or domain or sub-domain
LVHAEQVIEMDDKPGQSLRSKPES

SEQ ID NO: 12936 - protein, 28 aa, artificial
  peptide fold or domain or sub-domain
LVHALIDRGVVSREQWQMVDPAQYQFYH

SEQ ID NO: 12937 - protein, 30 aa, artificial
  peptide fold or domain or sub-domain
LVHAPVAPKLQEKWMDGSKELPRRAGWKLL

SEQ ID NO: 12938 - protein, 30 aa, artificial
  peptide fold or domain or sub-domain
LVHCNEYPQLKSDFYIPVQINNITYQAGIS

SEQ ID NO: 12939 - protein, 30 aa, artificial
  peptide fold or domain or sub-domain
LVHCNSNSFIPGDVLLNINHEGEKMEASLN

SEQ ID NO: 12940 - protein, 30 aa, artificial
  peptide fold or domain or sub-domain
LVHCSLNELEDAALTFPVLFQDVIYQVYVR

SEQ ID NO: 12941 - protein, 30 aa, artificial
  peptide fold or domain or sub-domain
LVHCSVDEVKNPHMQFPVTFNGVEYTVNVK

SEQ ID NO: 12942 - protein, 30 aa, artificial
  peptide fold or domain or sub-domain
LVHCTNEMLKGVKPDLLVKIATYSTPWFVY

SEQ ID NO: 12943 - protein, 28 aa, artificial
  peptide fold or domain or sub-domain
LVHFLADKGIVDPDKWMALFPDSYITWS

SEQ ID NO: 12944 - protein, 22 aa, artificial
  peptide fold or domain or sub-domain
LVHGRTPGQIAGDLELSASAVH

SEQ ID NO: 12945 - protein, 30 aa, artificial
  peptide fold or domain or sub-domain
LVHSQFKAENDHDFSLDIIVQSQLFKVYVT

SEQ ID NO: 12946 - protein, 30 aa, artificial
  peptide fold or domain or sub-domain
LVHSSFEPMKINDLIVEVTMKDQKYKIYVN

SEQ ID NO: 12947 - protein, 30 aa, artificial
  peptide fold or domain or sub-domain
LVHSSFKPVNNADFIIPVEIDGVVHQVYVL

SEQ ID NO: 12948 - protein, 30 aa, artificial
  peptide fold or domain or sub-domain
LVHSSFQPMGNSDYTLSIKVQNIPFTIHVK

SEQ ID NO: 12949 - protein, 30 aa, artificial
  peptide fold or domain or sub-domain
LVHSTLEPCEDSDFTFPVHFNLREHTIYVR

SEQ ID NO: 12950 - protein, 30 aa, artificial
  peptide fold or domain or sub-domain
LVHSTLKPVTHHQITVKVLIEDMDCTFYVI

SEQ ID NO: 12951 - protein, 28 aa, artificial
  peptide fold or domain or sub-domain
LVIAWRGGNAERQVDQLASLGIKVMWVD

SEQ ID NO: 12952 - protein, 27 aa, artificial
  peptide fold or domain or sub-domain
LVIGPRRSKVTAANGSTVQPHHHLEGF

SEQ ID NO: 12953 - protein, 23 aa, artificial
  peptide fold or domain or sub-domain
LVIKEISKRIGSPITTTHARLKR

SEQ ID NO: 12954 - protein, 26 aa, artificial
  peptide fold or domain or sub-domain
LVKAINEDHGRILEKVGASEVIYPEK

SEQ ID NO: 12955 - protein, 23 aa, artificial
  peptide fold or domain or sub-domain
LVKAVNKTLDEANISKKGLEVID

SEQ ID NO: 12956 - protein, 26 aa, artificial
  peptide fold or domain or sub-domain
LVKDTNLKLPNGEIVRNGTIFRNTAH

SEQ ID NO: 12957 - protein, 27 aa, artificial
  peptide fold or domain or sub-domain
LVKELFNVEKTTEEEDINNLIEFKRLC

SEQ ID NO: 12958 - protein, 29 aa, artificial
  peptide fold or domain or sub-domain
LVKGAGGNREYHLHHILVDNEQQAKDLIA

SEQ ID NO: 12959 - protein, 24 aa, artificial
  peptide fold or domain or sub-domain
LVKILESKIYNDGITGPEGCLYSH

SEQ ID NO: 12960 - protein, 26 aa, artificial
  peptide fold or domain or sub-domain
LVKKIEESAFDGLEWVNREEKTFKIP

SEQ ID NO: 12961 - protein, 25 aa, artificial
  peptide fold or domain or sub-domain
LVKKSGEMARGQGTKRITAEILKKT

SEQ ID NO: 12962 - protein, 21 aa, artificial
  peptide fold or domain or sub-domain
LVKPYNGDPFVGHLSTPISDS

SEQ ID NO: 12963 - protein, 25 aa, artificial
  peptide fold or domain or sub-domain
LVKQAVNRGFKMGLRDGIMYERDLF

SEQ ID NO: 12964 - protein, 29 aa, artificial
  peptide fold or domain or sub-domain
LVKRISQQAAAGNNMEDIFGELLLQLHQQ

SEQ ID NO: 12965 - protein, 29 aa, artificial
  peptide fold or domain or sub-domain
LVLCLGMLGDKEREKVVDILVPLADEVII

SEQ ID NO: 12966 - protein, 29 aa, artificial
  peptide fold or domain or sub-domain
LVLDKHFNDVSSSNKVFSTIKAQGYAITE

SEQ ID NO: 12967 - protein, 22 aa, artificial
  peptide fold or domain or sub-domain
LVLEVGKTIREARTEVQRAIQT

SEQ ID NO: 12968 - protein, 24 aa, artificial
  peptide fold or domain or sub-domain
LVLGADMVAHPKPHPEMGLLAMSR

SEQ ID NO: 12969 - protein, 26 aa, artificial
  peptide fold or domain or sub-domain
LVLGFSRKCILFMTAKTKKFLVEYPL

SEQ ID NO: 12970 - protein, 20 aa, artificial
  peptide fold or domain or sub-domain
LVLGYSSPLRVTDNKLTFNF

SEQ ID NO: 12971 - protein, 26 aa, artificial
  peptide fold or domain or sub-domain
LVLRPGESRNMALWPAHPPSFRNSID

SEQ ID NO: 12972 - protein, 25 aa, artificial
  peptide fold or domain or sub-domain
LVMDAVDTGMSCGLDEGLRLEAEAF

SEQ ID NO: 12973 - protein, 25 aa, artificial
  peptide fold or domain or sub-domain
LVMKTCKITQAKKGKVISVNHLKEC

SEQ ID NO: 12974 - protein, 27 aa, artificial
  peptide fold or domain or sub-domain
LVMNFGVQGKSYVIKNGRPLYTDEIMN

SEQ ID NO: 12975 - protein, 30 aa, artificial
  peptide fold or domain or sub-domain
LVNAEELRKELEAADRHLTSSTDSECIAHA

SEQ ID NO: 12976 - protein, 30 aa, artificial
  peptide fold or domain or sub-domain
LVNAHIIREELEQEGAIFQTTIDSEVIANL

SEQ ID NO: 12977 - protein, 30 aa, artificial
  peptide fold or domain or sub-domain
LVNANYLKDMLEEDGYMFQTNSDTEVILYI

SEQ ID NO: 12978 - protein, 30 aa, artificial
  peptide fold or domain or sub-domain
LVNAPHLRQKLLERGVGLSSTSDTEVMIMM

SEQ ID NO: 12979 - protein, 30 aa, artificial
  peptide fold or domain or sub-domain
LVNFLTLRKELEDKGIKFNYNSDSELFLAL

SEQ ID NO: 12980 - protein, 30 aa, artificial
  peptide fold or domain or sub-domain
LVNGQELKHILKAEGYRFESAIDSEVIIKL

SEQ ID NO: 12981 - protein, 23 aa, artificial
  peptide fold or domain or sub-domain
LVNGRVRPLVSGARLQELCPDCS

SEQ ID NO: 12982 - protein, 30 aa, artificial
  peptide fold or domain or sub-domain
LVNIGEEFASKYTGNELQEKYTQWFREHRS

SEQ ID NO: 12983 - protein, 25 aa, artificial
  peptide fold or domain or sub-domain
LVNRLLDDMLAQPEPDFIRDFATPL

SEQ ID NO: 12984 - protein, 23 aa, artificial
  peptide fold or domain or sub-domain
LVPCGKCIYCKSGDYGLCTDYHI

SEQ ID NO: 12985 - protein, 27 aa, artificial
  peptide fold or domain or sub-domain
LVPVFEGYVGKMHYPAKDSPKEAVAQA

SEQ ID NO: 12986 - protein, 22 aa, artificial
  peptide fold or domain or sub-domain
LVQLIAYTDWNETQQKQPDGSW

SEQ ID NO: 12987 - protein, 29 aa, artificial
  peptide fold or domain or sub-domain
LVQSLQQTNKKWIQIKDIDDSFLGKNILI

SEQ ID NO: 12988 - protein, 25 aa, artificial
  peptide fold or domain or sub-domain
LVRAHLVGRGPAKPEQLHREALKYV

SEQ ID NO: 12989 - protein, 24 aa, artificial
  peptide fold or domain or sub-domain
LVRDLWDLWHNGQINEAREVHEQL

SEQ ID NO: 12990 - protein, 26 aa, artificial
  peptide fold or domain or sub-domain
LVRDLWDLWHNGQINEAREVHEQLLE

SEQ ID NO: 12991 - protein, 23 aa, artificial
  peptide fold or domain or sub-domain
LVRDVNAAADAGEVKRGDVASLL

SEQ ID NO: 12992 - protein, 22 aa, artificial
  peptide fold or domain or sub-domain
LVREMLEKGAIAAADVENFTKA

SEQ ID NO: 12993 - protein, 23 aa, artificial
  peptide fold or domain or sub-domain
LVRNANIYMNSSNPNVQALESVA

SEQ ID NO: 12994 - protein, 23 aa, artificial
  peptide fold or domain or sub-domain
LVRRLDSSWEWTEGSPLRYLNWA

SEQ ID NO: 12995 - protein, 20 aa, artificial
  peptide fold or domain or sub-domain
LVRRLNELYRERPDWHTGDA

SEQ ID NO: 12996 - protein, 30 aa, artificial
  peptide fold or domain or sub-domain
LVSDPYVQLSAEDRNAGVELVALDNLLARS

SEQ ID NO: 12997 - protein, 25 aa, artificial
  peptide fold or domain or sub-domain
LVSEDAQHDPLFAPSHPIFRELDIR

SEQ ID NO: 12998 - protein, 28 aa, artificial
  peptide fold or domain or sub-domain
LVSGFEMSQNSERLSWTAEEVDSKLHQV

SEQ ID NO: 12999 - protein, 25 aa, artificial
  peptide fold or domain or sub-domain
LVSKVQCSDDEDTLQCLRDVPFETL

SEQ ID NO: 13000 - protein, 21 aa, artificial
  peptide fold or domain or sub-domain
LVSLKDQTLTKAIYQQDSIKR

SEQ ID NO: 13001 - protein, 21 aa, artificial
  peptide fold or domain or sub-domain
LVSLKHFGWDRYVIEPKTIET

SEQ ID NO: 13002 - protein, 24 aa, artificial
  peptide fold or domain or sub-domain
LVSPESIREILQDSKEQLVAFLEN

SEQ ID NO: 13003 - protein, 26 aa, artificial
  peptide fold or domain or sub-domain
LVSQLDLGQLEGVAWVNKSRTRFRIP

SEQ ID NO: 13004 - protein, 23 aa, artificial
  peptide fold or domain or sub-domain
LVSRTNKYIDETAPWQLAKSDDA

SEQ ID NO: 13005 - protein, 25 aa, artificial
  peptide fold or domain or sub-domain
LVSTDDVEIAEVAKKYGADVPFLRD

SEQ ID NO: 13006 - protein, 25 aa, artificial
  peptide fold or domain or sub-domain
LVSWTRPFLTSAEGLAAIIDQSLGP

SEQ ID NO: 13007 - protein, 24 aa, artificial
  peptide fold or domain or sub-domain
LVTARRRELEATGQTDPAYHANSR

SEQ ID NO: 13008 - protein, 26 aa, artificial
  peptide fold or domain or sub-domain
LVTASLRRLLIDRDPEGAVAHAQDVI

SEQ ID NO: 13009 - protein, 24 aa, artificial
  peptide fold or domain or sub-domain
LVTGKAKPSSKPKPPSYSKVFGET

SEQ ID NO: 13010 - protein, 21 aa, artificial
  peptide fold or domain or sub-domain
LVTIKNNKGLRHLSRLKTRGQ

SEQ ID NO: 13011 - protein, 25 aa, artificial
  peptide fold or domain or sub-domain
LVTKAAQQAKERSSKRVTAMHLKEA

SEQ ID NO: 13012 - protein, 25 aa, artificial
  peptide fold or domain or sub-domain
LVTKLVDGLDGKERIDIVDDFAYPF

SEQ ID NO: 13013 - protein, 27 aa, artificial
  peptide fold or domain or sub-domain
LVTLTGGTAAGDALARAAGAKRFLGEL

SEQ ID NO: 13014 - protein, 27 aa, artificial
  peptide fold or domain or sub-domain
LVTLYERDEDNNLLTEKQKLRVKKIHE

SEQ ID NO: 13015 - protein, 28 aa, artificial
  peptide fold or domain or sub-domain
LVTMSMAYSLPNNKYYKNEDLKNKIIYS

SEQ ID NO: 13016 - protein, 21 aa, artificial
  peptide fold or domain or sub-domain
LVTRLLTAVAADPSLDGRVAH

SEQ ID NO: 13017 - protein, 26 aa, artificial
  peptide fold or domain or sub-domain
LVTSRSADKASRARAHGADAAIDAPA

SEQ ID NO: 13018 - protein, 27 aa, artificial
  peptide fold or domain or sub-domain
LVTTICNADTSSEEELVKLVTHFEEMT

SEQ ID NO: 13019 - protein, 21 aa, artificial
  peptide fold or domain or sub-domain
LVTTLRSTLSAPPYNLPTIAF

SEQ ID NO: 13020 - protein, 25 aa, artificial
  peptide fold or domain or sub-domain
LVTWTRPVLRDKDRLEELVDSRLEG

SEQ ID NO: 13021 - protein, 25 aa, artificial
  peptide fold or domain or sub-domain
LVTYSARGEFSTLNPATGVVSKKAC

SEQ ID NO: 13022 - protein, 25 aa, artificial
  peptide fold or domain or sub-domain
LVVEATVDGKTYLRGYGEQPFVYVA

SEQ ID NO: 13023 - protein, 24 aa, artificial
  peptide fold or domain or sub-domain
LVVGADDAPAIKPDPAHVTCILDR

SEQ ID NO: 13024 - protein, 26 aa, artificial
  peptide fold or domain or sub-domain
LVVGHRPGSRGLAQAADLGCVTRSGG

SEQ ID NO: 13025 - protein, 29 aa, artificial
  peptide fold or domain or sub-domain
LVVILGFSQDKDIDNILREIVPCANDIFV

SEQ ID NO: 13026 - protein, 21 aa, artificial
  peptide fold or domain or sub-domain
LVVKLPIGMGPCKDEEYREYY

SEQ ID NO: 13027 - protein, 29 aa, artificial
  peptide fold or domain or sub-domain
LVVNENELATLSGRQVDSESPTSAILSAI

SEQ ID NO: 13028 - protein, 29 aa, artificial
  peptide fold or domain or sub-domain
LVVNETEASFMAGSEVSSIDDAHSCAAKL

SEQ ID NO: 13029 - protein, 23 aa, artificial
  peptide fold or domain or sub-domain
LVVQDATTYIGNVTDDPYVSQYS

SEQ ID NO: 13030 - protein, 26 aa, artificial
  peptide fold or domain or sub-domain
LVVTAYGSIENAVEAMHQGAFNYLTK

SEQ ID NO: 13031 - protein, 30 aa, artificial
  peptide fold or domain or sub-domain
LVVTGPQMDFADFEALKRTAAKETTVIRHS

SEQ ID NO: 13032 - protein, 30 aa, artificial
  peptide fold or domain or sub-domain
LVWSPSLPAGEALPPGARRVDTLQELLREA

SEQ ID NO: 13033 - protein, 30 aa, artificial
  peptide fold or domain or sub-domain
LVYAVEFSHRSGRDLINLAKKRTNIIPVIE

SEQ ID NO: 13034 - protein, 30 aa, artificial
  peptide fold or domain or sub-domain
LVYDPYVSKDSVRLLEATPVDDLEQLLKES

SEQ ID NO: 13035 - protein, 28 aa, artificial
  peptide fold or domain or sub-domain
LWACLGDVSRQVEWHGRWLDAESWKCVF

SEQ ID NO: 13036 - protein, 30 aa, artificial
  peptide fold or domain or sub-domain
LWARFNPEDLATEAAYREHPRMVWDWYQER

SEQ ID NO: 13037 - protein, 30 aa, artificial
  peptide fold or domain or sub-domain
LWEEHRVEDVATPEGFDRDPELVQAFYNAR

SEQ ID NO: 13038 - protein, 26 aa, artificial
  peptide fold or domain or sub-domain
LWELDYDQDGFQWIDADNNEQSIYIF

SEQ ID NO: 13039 - protein, 30 aa, artificial
  peptide fold or domain or sub-domain
LWENMDPTEVLSTKVLFNSPEEFYRVGFKI

SEQ ID NO: 13040 - protein, 28 aa, artificial
  peptide fold or domain or sub-domain
LWFLYREISEKVFIDGRRFSQDVWHEFL

SEQ ID NO: 13041 - protein, 30 aa, artificial
  peptide fold or domain or sub-domain
LWFQKPYKTGSTLADNLIKHEVGAWNENSL

SEQ ID NO: 13042 - protein, 25 aa, artificial
  peptide fold or domain or sub-domain
LWIEDINADPRWDRRLGEANSLQLR

SEQ ID NO: 13043 - protein, 30 aa, artificial
  peptide fold or domain or sub-domain
LWKDVDPVSLISMTALRRRPVDFYRFYRMR

SEQ ID NO: 13044 - protein, 30 aa, artificial
  peptide fold or domain or sub-domain
LWKQHDPSKIASIDTLNNNVETFIDFYRER

SEQ ID NO: 13045 - protein, 26 aa, artificial
  peptide fold or domain or sub-domain
LWLAVDQKGLHLLEHRSRNTLCTYDY

SEQ ID NO: 13046 - protein, 26 aa, artificial
  peptide fold or domain or sub-domain
LWLDEISKDLLPLVGGKAAGLGEMIK

SEQ ID NO: 13047 - protein, 26 aa, artificial
  peptide fold or domain or sub-domain
LWLGVSADAVSVYKRGEGRPLEVFQY

SEQ ID NO: 13048 - protein, 30 aa, artificial
  peptide fold or domain or sub-domain
LWNQYDPQEVASIQALKKNPESFYALNFQW

SEQ ID NO: 13049 - protein, 30 aa, artificial
  peptide fold or domain or sub-domain
LWNRYRPEELANPQAFAKDPEKVWKWYAWR

SEQ ID NO: 13050 - protein, 24 aa, artificial
  peptide fold or domain or sub-domain
LWREGGEGWSQVDAAVASELLSQL

SEQ ID NO: 13051 - protein, 22 aa, artificial
  peptide fold or domain or sub-domain
LWRMDWDENRIVITVDGEVLND

SEQ ID NO: 13052 - protein, 29 aa, artificial
  peptide fold or domain or sub-domain
LWSFMGLLWPESGEILPITDALEQGIVST

SEQ ID NO: 13053 - protein, 30 aa, artificial
  peptide fold or domain or sub-domain
LWSRFDPFEYAHIDAFKRDPAKVWKMLLEI

SEQ ID NO: 13054 - protein, 28 aa, artificial
  peptide fold or domain or sub-domain
LWTMTEAYVQEGTGATGDPALLADILRG

SEQ ID NO: 13055 - protein, 25 aa, artificial
  peptide fold or domain or sub-domain
LWTYKGTLSYYRNPVLVNNIYGRWF

SEQ ID NO: 13056 - protein, 24 aa, artificial
  peptide fold or domain or sub-domain
LWWTCGECEFCTTGREQLCHERII

SEQ ID NO: 13057 - protein, 22 aa, artificial
  peptide fold or domain or sub-domain
LWYLFYGNSTVLQGPVTSSEYQ

SEQ ID NO: 13058 - protein, 25 aa, artificial
  peptide fold or domain or sub-domain
LWYMQGKTLQKLGKHQKAKKSYKKA

SEQ ID NO: 13059 - protein, 28 aa, artificial
  peptide fold or domain or sub-domain
LYAAHPFVDDVQLRKESKIRIYDIIFDY

SEQ ID NO: 13060 - protein, 30 aa, artificial
  peptide fold or domain or sub-domain
LYADANVEMYLSRGYYNRSPKEFWKHYKEI

SEQ ID NO: 13061 - protein, 21 aa, artificial
  peptide fold or domain or sub-domain
LYAESIYDKAPTKMALEAEME

SEQ ID NO: 13062 - protein, 22 aa, artificial
  peptide fold or domain or sub-domain
LYAESLRTLHEADVQTLTAETE

SEQ ID NO: 13063 - protein, 22 aa, artificial
  peptide fold or domain or sub-domain
LYAIEKGLGNTFDNETKEAWMA

SEQ ID NO: 13064 - protein, 24 aa, artificial
  peptide fold or domain or sub-domain
LYAIGQIAEQLQVSITPVREALLD

SEQ ID NO: 13065 - protein, 25 aa, artificial
  peptide fold or domain or sub-domain
LYAKADILKRQLRYFCRQCDFSRIS

SEQ ID NO: 13066 - protein, 25 aa, artificial
  peptide fold or domain or sub-domain
LYAKSDRKSKKLIYVCRSCEYISLK

SEQ ID NO: 13067 - protein, 24 aa, artificial
  peptide fold or domain or sub-domain
LYANGQFSGSMVTTMAGMLGAPIV

SEQ ID NO: 13068 - protein, 26 aa, artificial
  peptide fold or domain or sub-domain
LYASPRSAGSTLEFRGQPLTVQATPD

SEQ ID NO: 13069 - protein, 25 aa, artificial
  peptide fold or domain or sub-domain
LYATVAQARYVFYYDQYHTNIPNNT

SEQ ID NO: 13070 - protein, 30 aa, artificial
  peptide fold or domain or sub-domain
LYCWRVEKMKAVPLNQAEVGAFFNGDSYLV

SEQ ID NO: 13071 - protein, 20 aa, artificial
  peptide fold or domain or sub-domain
LYDEIAARHPELHGQFWSGD

SEQ ID NO: 13072 - protein, 29 aa, artificial
  peptide fold or domain or sub-domain
LYDEKQQHIVYCSNDLLGDLFGVPSFSVK

SEQ ID NO: 13073 - protein, 28 aa, artificial
  peptide fold or domain or sub-domain
LYDFVFAYTHPKNSYYQNEDLYHKIVKG

SEQ ID NO: 13074 - protein, 26 aa, artificial
  peptide fold or domain or sub-domain
LYDISRLLELEGEEAYRIRAYRKASQ

SEQ ID NO: 13075 - protein, 26 aa, artificial
  peptide fold or domain or sub-domain
LYDLPDPQTFWDEYVSLEKAAIFRGA

SEQ ID NO: 13076 - protein, 26 aa, artificial
  peptide fold or domain or sub-domain
LYEATLVSGDFLTYSVGKQTTVAINF

SEQ ID NO: 13077 - protein, 26 aa, artificial
  peptide fold or domain or sub-domain
LYECSQYGRDFNSTTNVKNNQRVHQE

SEQ ID NO: 13078 - protein, 20 aa, artificial
  peptide fold or domain or sub-domain
LYEIINYYAARGDMLPKTLD

SEQ ID NO: 13079 - protein, 24 aa, artificial
  peptide fold or domain or sub-domain
LYELGSIELFIKGKKRVNDLRSIF

SEQ ID NO: 13080 - protein, 26 aa, artificial
  peptide fold or domain or sub-domain
LYEMGELLEIRGENRFKVIAYSRAAR

SEQ ID NO: 13081 - protein, 24 aa, artificial
  peptide fold or domain or sub-domain
LYFDAKVSINSGRRVPRTSAVWWP

SEQ ID NO: 13082 - protein, 26 aa, artificial
  peptide fold or domain or sub-domain
LYFIQKNLGFGEVRSYNNYSSFTVTR

SEQ ID NO: 13083 - protein, 27 aa, artificial
  peptide fold or domain or sub-domain
LYGDDHLNPKPGTIRGDYSVDIGRNVC

SEQ ID NO: 13084 - protein, 28 aa, artificial
  peptide fold or domain or sub-domain
LYGGHFLCSAEPPTLPPPLPQGRALVKE

SEQ ID NO: 13085 - protein, 22 aa, artificial
  peptide fold or domain or sub-domain
LYGGVLTHSTIANSGLSYLIHR

SEQ ID NO: 13086 - protein, 28 aa, artificial
  peptide fold or domain or sub-domain
LYGGVLTHSTIANSGLSYLIHRNGHIMS

SEQ ID NO: 13087 - protein, 23 aa, artificial
  peptide fold or domain or sub-domain
LYGHGAKGTIGNDVDTVAAFNLM

SEQ ID NO: 13088 - protein, 27 aa, artificial
  peptide fold or domain or sub-domain
LYGQASGAAKGTWEAGVQDYRDLYDNY

SEQ ID NO: 13089 - protein, 29 aa, artificial
  peptide fold or domain or sub-domain
LYHNEEVTTISDNRLAMLANNNLQILNIN

SEQ ID NO: 13090 - protein, 30 aa, artificial
  peptide fold or domain or sub-domain
LYHNRHQLPEDEERALGVSYVPLADLLSQA

SEQ ID NO: 13091 - protein, 23 aa, artificial
  peptide fold or domain or sub-domain
LYIGSNDGLERRIVPEEGFDFQG

SEQ ID NO: 13092 - protein, 20 aa, artificial
  peptide fold or domain or sub-domain
LYITAQAPVGFTNKAVTLKY

SEQ ID NO: 13093 - protein, 26 aa, artificial
  peptide fold or domain or sub-domain
LYKIKNLLGCGTVKKYNNVAVFRIKK

SEQ ID NO: 13094 - protein, 23 aa, artificial
  peptide fold or domain or sub-domain
LYKQLNFTENETDNFEVFQKIID

SEQ ID NO: 13095 - protein, 30 aa, artificial
  peptide fold or domain or sub-domain
LYKQPNTEKMFDIDVFYRDPSVYYGMAKEF

SEQ ID NO: 13096 - protein, 25 aa, artificial
  peptide fold or domain or sub-domain
LYKSVNEQYEILNSAIKHRRGVEAS

SEQ ID NO: 13097 - protein, 26 aa, artificial
  peptide fold or domain or sub-domain
LYLALCIFQTGRIRYKSGSNATLVFT

SEQ ID NO: 13098 - protein, 22 aa, artificial
  peptide fold or domain or sub-domain
LYMLEKCLGPAFTPATRAAWSQ

SEQ ID NO: 13099 - protein, 30 aa, artificial
  peptide fold or domain or sub-domain
LYNKRTRLSEAEEKAQGITFADKDDLIRRA

SEQ ID NO: 13100 - protein, 25 aa, artificial
  peptide fold or domain or sub-domain
LYPENDPLDRQMRWRCNYCRTTEVH

SEQ ID NO: 13101 - protein, 25 aa, artificial
  peptide fold or domain or sub-domain
LYPKSDNNAKVLLYQCRNCNYTENA

SEQ ID NO: 13102 - protein, 25 aa, artificial
  peptide fold or domain or sub-domain
LYPREDKENNRLLFECRTCSYVEEA

SEQ ID NO: 13103 - protein, 28 aa, artificial
  peptide fold or domain or sub-domain
LYQLFKRDLARHDVDTKIAISLLNSICK

SEQ ID NO: 13104 - protein, 20 aa, artificial
  peptide fold or domain or sub-domain
LYQNYRNAVIESGNPKADEI

SEQ ID NO: 13105 - protein, 28 aa, artificial
  peptide fold or domain or sub-domain
LYQSATQAVFQKRQAGELDESVLELTSQ

SEQ ID NO: 13106 - protein, 27 aa, artificial
  peptide fold or domain or sub-domain
LYRIMTSQRHRSVGNLQGLLYTVVGSV

SEQ ID NO: 13107 - protein, 26 aa, artificial
  peptide fold or domain or sub-domain
LYRSGMRPGDFVVDLGSLKVAVVPFF

SEQ ID NO: 13108 - protein, 22 aa, artificial
  peptide fold or domain or sub-domain
LYRYMVKKKGAEDAGDRFGRLL

SEQ ID NO: 13109 - protein, 24 aa, artificial
  peptide fold or domain or sub-domain
LYSACGHCDYCLSGQETLCEHQKN

SEQ ID NO: 13110 - protein, 20 aa, artificial
  peptide fold or domain or sub-domain
LYSLKPTIKASEVEAILKKS

SEQ ID NO: 13111 - protein, 30 aa, artificial
  peptide fold or domain or sub-domain
LYSQHHRLPISRETQLGATFVSQDELLQRA

SEQ ID NO: 13112 - protein, 22 aa, artificial
  peptide fold or domain or sub-domain
LYSVIWDSNQIIWMINNIPYFK

SEQ ID NO: 13113 - protein, 25 aa, artificial
  peptide fold or domain or sub-domain
LYSVNREALKDLSLDDKVDRMCELN

SEQ ID NO: 13114 - protein, 23 aa, artificial
  peptide fold or domain or sub-domain
LYSYVSHLRGGAKEPIDEEVQRL

SEQ ID NO: 13115 - protein, 25 aa, artificial
  peptide fold or domain or sub-domain
LYTFYLKYLFNYLPYNLLIKLYYIY

SEQ ID NO: 13116 - protein, 22 aa, artificial
  peptide fold or domain or sub-domain
LYTMIWSPNDIRFYVNNSLQYT

SEQ ID NO: 13117 - protein, 28 aa, artificial
  peptide fold or domain or sub-domain
LYTQDDVEQADGAGPETGKPQNLANAQL

SEQ ID NO: 13118 - protein, 26 aa, artificial
  peptide fold or domain or sub-domain
LYVGEDNWKVIHGNPFLIVRGKLVPA

SEQ ID NO: 13119 - protein, 23 aa, artificial
  peptide fold or domain or sub-domain
LYVGTRTGREAAIVPQAGIAFAV

SEQ ID NO: 13120 - protein, 20 aa, artificial
  peptide fold or domain or sub-domain
LYVKTGNGLEADSSNVRVKI

SEQ ID NO: 13121 - protein, 26 aa, artificial
  peptide fold or domain or sub-domain
LYYIKKILGVGSVNMHKTIGVYRIRD

SEQ ID NO: 13122 - protein, 29 aa, artificial
  peptide fold or domain or sub-domain
LYYSEKALRNVNDKVVKIAETEGLTAHAN

SEQ ID NO: 13123 - protein, 21 aa, artificial
  peptide fold or domain or sub-domain
MAAAGPQVRNRPSVEARRQSL

SEQ ID NO: 13124 - protein, 23 aa, artificial
  peptide fold or domain or sub-domain
MAAAYYQELWSTITRGEVWRGEF

SEQ ID NO: 13125 - protein, 25 aa, artificial
  peptide fold or domain or sub-domain
MAAEAFIDLAQSGALTNATAALAGY

SEQ ID NO: 13126 - protein, 20 aa, artificial
  peptide fold or domain or sub-domain
MAAIAEDAAGRNVTRAVVMD

SEQ ID NO: 13127 - protein, 25 aa, artificial
  peptide fold or domain or sub-domain
MACGGSWFVKPELIRARKAKDIINL

SEQ ID NO: 13128 - protein, 28 aa, artificial
  peptide fold or domain or sub-domain
MADFVPRLAADPRIGEFFKETKLSELQK

SEQ ID NO: 13129 - protein, 22 aa, artificial
  peptide fold or domain or sub-domain
MADGMTSTEIGRQLSISNHTVD

SEQ ID NO: 13130 - protein, 22 aa, artificial
  peptide fold or domain or sub-domain
MADGWLDRGRLVCPWHGSWFAA

SEQ ID NO: 13131 - protein, 30 aa, artificial
  peptide fold or domain or sub-domain
MADMDKGKSCGACHNGKDAFSSASDCGKCH

SEQ ID NO: 13132 - protein, 25 aa, artificial
  peptide fold or domain or sub-domain
MADSDFLALMTGKMNPQSAFFQGKL

SEQ ID NO: 13133 - protein, 25 aa, artificial
  peptide fold or domain or sub-domain
MAEADLRALLCRELRPLGAYMSGRL

SEQ ID NO: 13134 - protein, 26 aa, artificial
  peptide fold or domain or sub-domain
MAEELRKEQDTSAHLERMKKNLEATV

SEQ ID NO: 13135 - protein, 30 aa, artificial
  peptide fold or domain or sub-domain
MAEEWAQSHSGNLPSTREEKKEFKDLVKSK

SEQ ID NO: 13136 - protein, 28 aa, artificial
  peptide fold or domain or sub-domain
MAEGRYNSPGLAKQAMQAGASCVTVGSA

SEQ ID NO: 13137 - protein, 28 aa, artificial
  peptide fold or domain or sub-domain
MAETTKVAPIHVIRTYLEAAQERNAKKV

SEQ ID NO: 13138 - protein, 28 aa, artificial
  peptide fold or domain or sub-domain
MAEVMSFEDFKTYGSESEVKRAGKYHQR

SEQ ID NO: 13139 - protein, 25 aa, artificial
  peptide fold or domain or sub-domain
MAFAEAWALLERGAIDNAMALIGMH

SEQ ID NO: 13140 - protein, 29 aa, artificial
  peptide fold or domain or sub-domain
MAFDDLDFRFTPTTNCEFSALAREGRFRD

SEQ ID NO: 13141 - protein, 23 aa, artificial
  peptide fold or domain or sub-domain
MAGLIQRINSDFQGAGLTGQDVV

SEQ ID NO: 13142 - protein, 30 aa, artificial
  peptide fold or domain or sub-domain
MAHRGFSPDGLENSMAAFRAAVELGYRYLE

SEQ ID NO: 13143 - protein, 21 aa, artificial
  peptide fold or domain or sub-domain
MAHSYIQAHDSEYQALKNFTQ

SEQ ID NO: 13144 - protein, 21 aa, artificial
  peptide fold or domain or sub-domain
MAHSYVEAFPDERAAFRAFAG

SEQ ID NO: 13145 - protein, 25 aa, artificial
  peptide fold or domain or sub-domain
MAHTRKDVENWARNEDQSGFLGHEQ

SEQ ID NO: 13146 - protein, 24 aa, artificial
  peptide fold or domain or sub-domain
MAINGPLEQMSFEKVIPFNDASFF

SEQ ID NO: 13147 - protein, 25 aa, artificial
  peptide fold or domain or sub-domain
MAKESVNAAFEMTLTEGSKLEKKLF

SEQ ID NO: 13148 - protein, 22 aa, artificial
  peptide fold or domain or sub-domain
MAKHSVPTVASTQQRRTQLFAL

SEQ ID NO: 13149 - protein, 25 aa, artificial
  peptide fold or domain or sub-domain
MAKQVPLHPSSPDMVKLGKDLWKFG

SEQ ID NO: 13150 - protein, 24 aa, artificial
  peptide fold or domain or sub-domain
MALAPPLADADYSSLNPFNKESYF

SEQ ID NO: 13151 - protein, 30 aa, artificial
  peptide fold or domain or sub-domain
MALFKPGELTSNGRLSAQFGITRKDSFLNI

SEQ ID NO: 13152 - protein, 26 aa, artificial
  peptide fold or domain or sub-domain
MALINKPNYSLLQSSLKIDDFIDPRM

SEQ ID NO: 13153 - protein, 21 aa, artificial
  peptide fold or domain or sub-domain
MALKPEDFRWAREFGYALKLL

SEQ ID NO: 13154 - protein, 26 aa, artificial
  peptide fold or domain or sub-domain
MALLTSGGEISQTDARAVGITASMTK

SEQ ID NO: 13155 - protein, 29 aa, artificial
  peptide fold or domain or sub-domain
MAMGNADRFALAAANYVLPALSDDGAAYG

SEQ ID NO: 13156 - protein, 21 aa, artificial
  peptide fold or domain or sub-domain
MANRINQLYTAQHPNSPPIAT

SEQ ID NO: 13157 - protein, 23 aa, artificial
  peptide fold or domain or sub-domain
MANTRLYGIRHDIELSPSAVASF

SEQ ID NO: 13158 - protein, 23 aa, artificial
  peptide fold or domain or sub-domain
MAPELPVLDEQFAERLGIKEGGL

SEQ ID NO: 13159 - protein, 26 aa, artificial
  peptide fold or domain or sub-domain
MAPVFGKIIPRAGLSGEELYRTFNMG

SEQ ID NO: 13160 - protein, 27 aa, artificial
  peptide fold or domain or sub-domain
MAQKLELAGKAGDMTGAVTLIEQIEME

SEQ ID NO: 13161 - protein, 27 aa, artificial
  peptide fold or domain or sub-domain
MAQKSLEKLTALLKLDYDYLQDSRFGE

SEQ ID NO: 13162 - protein, 25 aa, artificial
  peptide fold or domain or sub-domain
MAQSLGCAHAPDAAACLRALPADTL

SEQ ID NO: 13163 - protein, 23 aa, artificial
  peptide fold or domain or sub-domain
MAREVNRLKAEDMAAANAMASHL

SEQ ID NO: 13164 - protein, 20 aa, artificial
  peptide fold or domain or sub-domain
MARYAPKAMELGPRDIVARS

SEQ ID NO: 13165 - protein, 29 aa, artificial
  peptide fold or domain or sub-domain
MASDDLMMLALDAGASDFNEEDDSFEVLT

SEQ ID NO: 13166 - protein, 28 aa, artificial
  peptide fold or domain or sub-domain
MATSLQDFLIKTVSIDGADQGIFNQFFN

SEQ ID NO: 13167 - protein, 28 aa, artificial
  peptide fold or domain or sub-domain
MATTIQRELEGVGIKSKEAREAALKAVE

SEQ ID NO: 13168 - protein, 24 aa, artificial
  peptide fold or domain or sub-domain
MAVHRRDGIGVDEDMADAFYWFGE

SEQ ID NO: 13169 - protein, 23 aa, artificial
  peptide fold or domain or sub-domain
MAVLNGDRDGKHVTITTAGLSQL

SEQ ID NO: 13170 - protein, 23 aa, artificial
  peptide fold or domain or sub-domain
MAVLNGHHTKNGTEIKTEDLKQL

SEQ ID NO: 13171 - protein, 23 aa, artificial
  peptide fold or domain or sub-domain
MAVQASDHSKQPIVIDDALLSSV

SEQ ID NO: 13172 - protein, 23 aa, artificial
  peptide fold or domain or sub-domain
MAVSELADKVNMSDTPCLRRVKK

SEQ ID NO: 13173 - protein, 24 aa, artificial
  peptide fold or domain or sub-domain
MAVTHPDRMVGRSDKEQQIGAQQS

SEQ ID NO: 13174 - protein, 30 aa, artificial
  peptide fold or domain or sub-domain
MAYDPYIPREKAEKLGVKLVDNLHDMLREI

SEQ ID NO: 13175 - protein, 24 aa, artificial
  peptide fold or domain or sub-domain
MAYLGCRSCINYQGLNPFSSQSYY

SEQ ID NO: 13176 - protein, 23 aa, artificial
  peptide fold or domain or sub-domain
MCAASIAQGTGYEELDELMKNPR

SEQ ID NO: 13177 - protein, 22 aa, artificial
  peptide fold or domain or sub-domain
MCDICLDSVKLENLSVLSNVEP

SEQ ID NO: 13178 - protein, 24 aa, artificial
  peptide fold or domain or sub-domain
MCGGVIPPQDYEFLFEVGVSNVFG

SEQ ID NO: 13179 - protein, 24 aa, artificial
  peptide fold or domain or sub-domain
MCGRAVRDWLVLLTMEKYIGKFLE

SEQ ID NO: 13180 - protein, 20 aa, artificial
  peptide fold or domain or sub-domain
MCHLLKNDEELLSEWRRNGE

SEQ ID NO: 13181 - protein, 20 aa, artificial
  peptide fold or domain or sub-domain
MCIEDVSRVLGCQPGAAKHS

SEQ ID NO: 13182 - protein, 30 aa, artificial
  peptide fold or domain or sub-domain
MCPHQEILLSEGSYEGGVITCRAHLWTFND

SEQ ID NO: 13183 - protein, 28 aa, artificial
  peptide fold or domain or sub-domain
MCTEVSRCVLIFELLKSATGVAQILEKV

SEQ ID NO: 13184 - protein, 24 aa, artificial
  peptide fold or domain or sub-domain
MCTNIVYEWLKALQLPQYAESFVD

SEQ ID NO: 13185 - protein, 25 aa, artificial
  peptide fold or domain or sub-domain
MCVGGSWLTPKSLVENEDWDGIREL

SEQ ID NO: 13186 - protein, 25 aa, artificial
  peptide fold or domain or sub-domain
MCVGTGWMLDSSWIKNGDWARIEAC

SEQ ID NO: 13187 - protein, 28 aa, artificial
  peptide fold or domain or sub-domain
MCVTVPNGHSEVRRRADLVTQAMGGRGA

SEQ ID NO: 13188 - protein, 26 aa, artificial
  peptide fold or domain or sub-domain
MDALGSTIGHIEASPPQHSRRLSQLL

SEQ ID NO: 13189 - protein, 30 aa, artificial
  peptide fold or domain or sub-domain
MDALYQGQYCGACHAGNMAFAANTECARCH

SEQ ID NO: 13190 - protein, 20 aa, artificial
  peptide fold or domain or sub-domain
MDAVIKALQTGAASSWALSN

SEQ ID NO: 13191 - protein, 28 aa, artificial
  peptide fold or domain or sub-domain
MDDFMTRLLADPRTGPHFKPANQQQVKE

SEQ ID NO: 13192 - protein, 25 aa, artificial
  peptide fold or domain or sub-domain
MDDLKSIIGKVATGASLSRDEAASA

SEQ ID NO: 13193 - protein, 26 aa, artificial
  peptide fold or domain or sub-domain
MDDSALFQMHPGCTTKLQARDGRKSV

SEQ ID NO: 13194 - protein, 21 aa, artificial
  peptide fold or domain or sub-domain
MDEFAKKLRVEGRSEDILLDY

SEQ ID NO: 13195 - protein, 27 aa, artificial
  peptide fold or domain or sub-domain
MDEVLAKHYIEEGVIYGGMVPKVNACL

SEQ ID NO: 13196 - protein, 23 aa, artificial
  peptide fold or domain or sub-domain
MDFDILDNIDQDYAFEIVNEAHN

SEQ ID NO: 13197 - protein, 20 aa, artificial
  peptide fold or domain or sub-domain
MDFEIMRACGFSARKIDSLK

SEQ ID NO: 13198 - protein, 21 aa, artificial
  peptide fold or domain or sub-domain
MDGTFGNPASRSHRFGWQAEE

SEQ ID NO: 13199 - protein, 27 aa, artificial
  peptide fold or domain or sub-domain
MDHKKIKNIGMNAYLHVSKGSSKNPYL

SEQ ID NO: 13200 - protein, 26 aa, artificial
  peptide fold or domain or sub-domain
MDKCLQLFGGAGYMNEYPIARAWRAA

SEQ ID NO: 13201 - protein, 24 aa, artificial
  peptide fold or domain or sub-domain
MDKNLYGYTDEEIFKASAEYKILE

SEQ ID NO: 13202 - protein, 27 aa, artificial
  peptide fold or domain or sub-domain
MDKQAIEAAGFTALLAVNQGSAKEPRF

SEQ ID NO: 13203 - protein, 23 aa, artificial
  peptide fold or domain or sub-domain
MDKSIFQGFLNLYFQNNPNAFDF

SEQ ID NO: 13204 - protein, 29 aa, artificial
  peptide fold or domain or sub-domain
MDLEELELELIEGGASKFEKEDDYLTIYT

SEQ ID NO: 13205 - protein, 21 aa, artificial
  peptide fold or domain or sub-domain
MDLFSSQAAYHYATVEKGLLE

SEQ ID NO: 13206 - protein, 22 aa, artificial
  peptide fold or domain or sub-domain
MDLIKGDHKKPDYGKVTLLRTS

SEQ ID NO: 13207 - protein, 26 aa, artificial
  peptide fold or domain or sub-domain
MDNLVLVIEHARRCTRDEAVTAARGE

SEQ ID NO: 13208 - protein, 29 aa, artificial
  peptide fold or domain or sub-domain
MDPADVSYMKKQEEQHNYNDPHYQELLMK

SEQ ID NO: 13209 - protein, 27 aa, artificial
  peptide fold or domain or sub-domain
MDPKLGVIEPGQKCPVCGNTLAGCPGH

SEQ ID NO: 13210 - protein, 27 aa, artificial
  peptide fold or domain or sub-domain
MDPLMGISSKTGECGTCGEKLDKCNGH

SEQ ID NO: 13211 - protein, 28 aa, artificial
  peptide fold or domain or sub-domain
MDPNEVRHAWLTSGKTTERPQAREGRTG

SEQ ID NO: 13212 - protein, 27 aa, artificial
  peptide fold or domain or sub-domain
MDQIHSDIVCEISSIDDEISPCDAIIT

SEQ ID NO: 13213 - protein, 20 aa, artificial
  peptide fold or domain or sub-domain
MDRYDPIWGDKGGLFTIARA

SEQ ID NO: 13214 - protein, 29 aa, artificial
  peptide fold or domain or sub-domain
MDSDGQTLVFEAGGRLKRYDVATGQVSEI

SEQ ID NO: 13215 - protein, 25 aa, artificial
  peptide fold or domain or sub-domain
MDSEDFKKMVDGELNGTEAFMSGRL

SEQ ID NO: 13216 - protein, 26 aa, artificial
  peptide fold or domain or sub-domain
MDTAVEILARHLAGKTESSVRVAKLM

SEQ ID NO: 13217 - protein, 24 aa, artificial
  peptide fold or domain or sub-domain
MDVEDIRTIIRPINYYNNKAKNIL

SEQ ID NO: 13218 - protein, 25 aa, artificial
  peptide fold or domain or sub-domain
MDVEDIRTIIRPINYYNNKAKNILA

SEQ ID NO: 13219 - protein, 28 aa, artificial
  peptide fold or domain or sub-domain
MDVEERLKLVTRNAVEVVTEEELRQLLE

SEQ ID NO: 13220 - protein, 27 aa, artificial
  peptide fold or domain or sub-domain
MDVQELCLALEAAGFTLNNQLVESLCQ

SEQ ID NO: 13221 - protein, 26 aa, artificial
  peptide fold or domain or sub-domain
MDWFANETVWYADDELQAVVSKSVPD

SEQ ID NO: 13222 - protein, 25 aa, artificial
  peptide fold or domain or sub-domain
MDWGEWAIDNRNPQFGGMGNHPTGD

SEQ ID NO: 13223 - protein, 24 aa, artificial
  peptide fold or domain or sub-domain
MDYKLYGYESLAKFMDGAEFKLLS

SEQ ID NO: 13224 - protein, 25 aa, artificial
  peptide fold or domain or sub-domain
MEAETFIDVINGNQDGMSAFMSGKL

SEQ ID NO: 13225 - protein, 22 aa, artificial
  peptide fold or domain or sub-domain
MEAIKAELGVGFTKQVHDAWAK

SEQ ID NO: 13226 - protein, 27 aa, artificial
  peptide fold or domain or sub-domain
MEAIQDDLPSLSEQVANGRFDPLLDWL

SEQ ID NO: 13227 - protein, 30 aa, artificial
  peptide fold or domain or sub-domain
MEALKDCTTVLAIEPKNIEAKRSLARINDR

SEQ ID NO: 13228 - protein, 25 aa, artificial
  peptide fold or domain or sub-domain
MEAVEASSGSVLLRIDDADHRLAVH

SEQ ID NO: 13229 - protein, 25 aa, artificial
  peptide fold or domain or sub-domain
MEDDIMFAIGTGALPAKEAMAQDKM

SEQ ID NO: 13230 - protein, 20 aa, artificial
  peptide fold or domain or sub-domain
MEDEKETHEATETKLFFDMQ

SEQ ID NO: 13231 - protein, 30 aa, artificial
  peptide fold or domain or sub-domain
MEDHVKTTYLSRYKGEWSEEDVEKIAGQVA

SEQ ID NO: 13232 - protein, 26 aa, artificial
  peptide fold or domain or sub-domain
MEDYIRLMEETTKRQGFFNHNGEYFR

SEQ ID NO: 13233 - protein, 28 aa, artificial
  peptide fold or domain or sub-domain
MEEIYHRIPDSDPSSSKTRQIISTIRTQ

SEQ ID NO: 13234 - protein, 27 aa, artificial
  peptide fold or domain or sub-domain
MEETLELARRRHTDHPQLPLALRLIEN

SEQ ID NO: 13235 - protein, 26 aa, artificial
  peptide fold or domain or sub-domain
MEEVCLKLLFRTQDLSKVKEFCLKEW

SEQ ID NO: 13236 - protein, 27 aa, artificial
  peptide fold or domain or sub-domain
MEGATGVTWPADVLPGTPQWERCRSMF

SEQ ID NO: 13237 - protein, 27 aa, artificial
  peptide fold or domain or sub-domain
MEGCAGVTSWEQTHYGHKGYDLALKEM

SEQ ID NO: 13238 - protein, 27 aa, artificial
  peptide fold or domain or sub-domain
MEGISGLPDDTFVDSGKRNYERGRLIM

SEQ ID NO: 13239 - protein, 28 aa, artificial
  peptide fold or domain or sub-domain
MEGSPQPVQEAIKNNLSERNRETLEDEL

SEQ ID NO: 13240 - protein, 30 aa, artificial
  peptide fold or domain or sub-domain
MEHHPLKTLLQINEYAPMRHLSDLEQPRQQ

SEQ ID NO: 13241 - protein, 26 aa, artificial
  peptide fold or domain or sub-domain
MEHIDMLRLAREEDDNELETETMRAL

SEQ ID NO: 13242 - protein, 30 aa, artificial
  peptide fold or domain or sub-domain
MEHVAFGSEDIENTLAKMDDGQLDGLAFGA

SEQ ID NO: 13243 - protein, 29 aa, artificial
  peptide fold or domain or sub-domain
MEIDAYLRKRIEELPESRTRLFQSVVDML

SEQ ID NO: 13244 - protein, 25 aa, artificial
  peptide fold or domain or sub-domain
MEKKSIREIATQKGIDEDKLLLDLL

SEQ ID NO: 13245 - protein, 23 aa, artificial
  peptide fold or domain or sub-domain
MEKTDLYIEDWIGIQQLDNEGRL

SEQ ID NO: 13246 - protein, 20 aa, artificial
  peptide fold or domain or sub-domain
MEKYFMENKLVRMYEKLSDF

SEQ ID NO: 13247 - protein, 25 aa, artificial
  peptide fold or domain or sub-domain
MELVRELLRKIAEFENLTAEEMYNL

SEQ ID NO: 13248 - protein, 20 aa, artificial
  peptide fold or domain or sub-domain
MEMERMRQTHSKEMESRDEE

SEQ ID NO: 13249 - protein, 28 aa, artificial
  peptide fold or domain or sub-domain
MENIGLNFKNEIVIPQIRQHFAIQEATE

SEQ ID NO: 13250 - protein, 21 aa, artificial
  peptide fold or domain or sub-domain
MENVYATPEHLTLLRPWIGMM

SEQ ID NO: 13251 - protein, 29 aa, artificial
  peptide fold or domain or sub-domain
MEQFVQDAKANKHQEAGWGTSAYVVSKVG

SEQ ID NO: 13252 - protein, 30 aa, artificial
  peptide fold or domain or sub-domain
MEQHLTVDALSPEGEIMALSHKSHPTYGIQ

SEQ ID NO: 13253 - protein, 30 aa, artificial
  peptide fold or domain or sub-domain
MEQLEQGVLLFNNSPEEGISYLIEHKLVED

SEQ ID NO: 13254 - protein, 23 aa, artificial
  peptide fold or domain or sub-domain
MERAGINAEQFDVDANLVKAVFR

SEQ ID NO: 13255 - protein, 20 aa, artificial
  peptide fold or domain or sub-domain
MERFREWYELYFPELSKKFE

SEQ ID NO: 13256 - protein, 29 aa, artificial
  peptide fold or domain or sub-domain
MERFVREAQEGVHSERGWPSTAYGISKTG

SEQ ID NO: 13257 - protein, 20 aa, artificial
  peptide fold or domain or sub-domain
MESYDKERLELSTRDKVAIA

SEQ ID NO: 13258 - protein, 23 aa, artificial
  peptide fold or domain or sub-domain
METIKDAFVQADPDNKDYYETNY

SEQ ID NO: 13259 - protein, 25 aa, artificial
  peptide fold or domain or sub-domain
METRDFIALVEGRADRRALFFMGRL

SEQ ID NO: 13260 - protein, 20 aa, artificial
  peptide fold or domain or sub-domain
METVGVDGQILDHFDGRTLN

SEQ ID NO: 13261 - protein, 27 aa, artificial
  peptide fold or domain or sub-domain
MEVQRRPWLVKYGDSGEQIAGFVKEFS

SEQ ID NO: 13262 - protein, 24 aa, artificial
  peptide fold or domain or sub-domain
MEVRRHVERGTPDEPQDFIDFYLA

SEQ ID NO: 13263 - protein, 25 aa, artificial
  peptide fold or domain or sub-domain
MEVVKRTADQIWYRGYGTDQYVYYA

SEQ ID NO: 13264 - protein, 30 aa, artificial
  peptide fold or domain or sub-domain
MEWKDIKGYEGHYQVSNTGEVYSIKSGKTL

SEQ ID NO: 13265 - protein, 28 aa, artificial
  peptide fold or domain or sub-domain
MFAWEIRDRLLAERVCDNDTVPSVSSIN

SEQ ID NO: 13266 - protein, 23 aa, artificial
  peptide fold or domain or sub-domain
MFCGTEKKFEEEYVVQQGFRFQK

SEQ ID NO: 13267 - protein, 25 aa, artificial
  peptide fold or domain or sub-domain
MFDLKATIGRLAQGQTLGRQDAWML

SEQ ID NO: 13268 - protein, 22 aa, artificial
  peptide fold or domain or sub-domain
MFFDAYQLNSTDQSIAEFMKTS

SEQ ID NO: 13269 - protein, 22 aa, artificial
  peptide fold or domain or sub-domain
MFGDGSSEMGNRLGQLVVSGRK

SEQ ID NO: 13270 - protein, 21 aa, artificial
  peptide fold or domain or sub-domain
MFKKYTKKGINSAVSFINAPR

SEQ ID NO: 13271 - protein, 23 aa, artificial
  peptide fold or domain or sub-domain
MFRKNLYELRENRNIKPQVLSEM

SEQ ID NO: 13272 - protein, 24 aa, artificial
  peptide fold or domain or sub-domain
MFSALKHQGKPLYEYARAGITVER

SEQ ID NO: 13273 - protein, 24 aa, artificial
  peptide fold or domain or sub-domain
MFSAVKIKGKKMYRLARKNQVVDI

SEQ ID NO: 13274 - protein, 21 aa, artificial
  peptide fold or domain or sub-domain
MFVADGHQQSFAEIGAEAKKA

SEQ ID NO: 13275 - protein, 20 aa, artificial
  peptide fold or domain or sub-domain
MFVSHVASYNDNILLGTKAT

SEQ ID NO: 13276 - protein, 23 aa, artificial
  peptide fold or domain or sub-domain
MGAAYYWGHGVAQDYRQALSWYR

SEQ ID NO: 13277 - protein, 22 aa, artificial
  peptide fold or domain or sub-domain
MGAKSLGEQMGIKENDAACYID

SEQ ID NO: 13278 - protein, 22 aa, artificial
  peptide fold or domain or sub-domain
MGAQRFARETGISAVEGREFID

SEQ ID NO: 13279 - protein, 27 aa, artificial
  peptide fold or domain or sub-domain
MGATHPKDALPGTIRGDFATTIDENVI

SEQ ID NO: 13280 - protein, 30 aa, artificial
  peptide fold or domain or sub-domain
MGDFEGKDHKELEKLYPKEWNAWCEDWKEC

SEQ ID NO: 13281 - protein, 26 aa, artificial
  peptide fold or domain or sub-domain
MGDLKSSDSLKVCDWQNDLEGLSNFP

SEQ ID NO: 13282 - protein, 30 aa, artificial
  peptide fold or domain or sub-domain
MGDMEGIQQEEFKKLYPEQVKNFFFNQLEY

SEQ ID NO: 13283 - protein, 26 aa, artificial
  peptide fold or domain or sub-domain
MGEIFHGDPAYVGDYTRYLDAALDFP

SEQ ID NO: 13284 - protein, 26 aa, artificial
  peptide fold or domain or sub-domain
MGEVWGHGAYRSPYFDDGFDALINFD

SEQ ID NO: 13285 - protein, 25 aa, artificial
  peptide fold or domain or sub-domain
MGEWEGRLFSEIQERFPAEYRLRGE

SEQ ID NO: 13286 - protein, 23 aa, artificial
  peptide fold or domain or sub-domain
MGGDAVPALVFDVFGTQDIFDIP

SEQ ID NO: 13287 - protein, 21 aa, artificial
  peptide fold or domain or sub-domain
MGGYADDGIIVNGEKLQVDVL

SEQ ID NO: 13288 - protein, 25 aa, artificial
  peptide fold or domain or sub-domain
MGIGGVLGLLWFQKRLPKYSCQFIE

SEQ ID NO: 13289 - protein, 28 aa, artificial
  peptide fold or domain or sub-domain
MGISTSHLQIGVIAQNQGDYTTAEKRYQ

SEQ ID NO: 13290 - protein, 25 aa, artificial
  peptide fold or domain or sub-domain
MGITAALERLKKDGVVGLPEGMGPK

SEQ ID NO: 13291 - protein, 29 aa, artificial
  peptide fold or domain or sub-domain
MGKNKVTEDEIGEIDKGRFVEQQNVMCYI

SEQ ID NO: 13292 - protein, 26 aa, artificial
  peptide fold or domain or sub-domain
MGKSADEMMELKNREDGSCAEAFEAA

SEQ ID NO: 13293 - protein, 25 aa, artificial
  peptide fold or domain or sub-domain
MGKWEGMNQTDIINKYPETWENFWN

SEQ ID NO: 13294 - protein, 28 aa, artificial
  peptide fold or domain or sub-domain
MGLAALMVKAQLAASNSEAGRLIQGGGV

SEQ ID NO: 13295 - protein, 30 aa, artificial
  peptide fold or domain or sub-domain
MGLERFVAMNRGINEGGDLPEELLRNLYDS

SEQ ID NO: 13296 - protein, 27 aa, artificial
  peptide fold or domain or sub-domain
MGMALLATGHSVNSRSDAELKEAYEFL

SEQ ID NO: 13297 - protein, 27 aa, artificial
  peptide fold or domain or sub-domain
MGMALNSLGYSLNDTNKAHLQEAKRKL

SEQ ID NO: 13298 - protein, 26 aa, artificial
  peptide fold or domain or sub-domain
MGMPANVLMELKESDDKAASEAILHA

SEQ ID NO: 13299 - protein, 22 aa, artificial
  peptide fold or domain or sub-domain
MGMRSLAESLNCSEQEARMISD

SEQ ID NO: 13300 - protein, 29 aa, artificial
  peptide fold or domain or sub-domain
MGNARVEWGNVVVFEAYNNTEQVSYYLRA

SEQ ID NO: 13301 - protein, 24 aa, artificial
  peptide fold or domain or sub-domain
MGNTNLNFNQNYPFNQSSHYHDWC

SEQ ID NO: 13302 - protein, 25 aa, artificial
  peptide fold or domain or sub-domain
MGPADFEWFENNYPGWSAAYQGYWE

SEQ ID NO: 13303 - protein, 22 aa, artificial
  peptide fold or domain or sub-domain
MGPQKLAQELKVTLNEAKEFIE

SEQ ID NO: 13304 - protein, 29 aa, artificial
  peptide fold or domain or sub-domain
MGQWQISGLANGWVIMGPGYNGEIKPGTA

SEQ ID NO: 13305 - protein, 29 aa, artificial
  peptide fold or domain or sub-domain
MGRDPEYFENPLEFRPERFAVETSAEKAN

SEQ ID NO: 13306 - protein, 29 aa, artificial
  peptide fold or domain or sub-domain
MGRNPLYWEKPETFWPERFDQVSRDFMGN

SEQ ID NO: 13307 - protein, 22 aa, artificial
  peptide fold or domain or sub-domain
MGSKALAEQLNTDEAQATRFMQ

SEQ ID NO: 13308 - protein, 22 aa, artificial
  peptide fold or domain or sub-domain
MGSLKFSRSTGIDKNVANEFIK

SEQ ID NO: 13309 - protein, 24 aa, artificial
  peptide fold or domain or sub-domain
MGSLYSKGIGVPRDPTMAFEWFKK

SEQ ID NO: 13310 - protein, 22 aa, artificial
  peptide fold or domain or sub-domain
MGSRKLSETLRISPKEAKGYID

SEQ ID NO: 13311 - protein, 27 aa, artificial
  peptide fold or domain or sub-domain
MGSTDPKKSEMGTLRAQFGMQTERNLI

SEQ ID NO: 13312 - protein, 26 aa, artificial
  peptide fold or domain or sub-domain
MGTSADQLMEIRQNDDKAAGDIFQDA

SEQ ID NO: 13313 - protein, 28 aa, artificial
  peptide fold or domain or sub-domain
MGVGKMAVTYGLCGSVGETQRLVQSFAL

SEQ ID NO: 13314 - protein, 30 aa, artificial
  peptide fold or domain or sub-domain
MGVLEKRHIDSLTEEEENWRRQLVNGTVDG

SEQ ID NO: 13315 - protein, 24 aa, artificial
  peptide fold or domain or sub-domain
MGYDGAGSSVDYSVFKPFSSQDYF

SEQ ID NO: 13316 - protein, 27 aa, artificial
  peptide fold or domain or sub-domain
MGYITQEITGKLPGYLSPSTGVKYDDD

SEQ ID NO: 13317 - protein, 29 aa, artificial
  peptide fold or domain or sub-domain
MGYPTRIFVMDLLESVKSSQDIKKYCNEY

SEQ ID NO: 13318 - protein, 22 aa, artificial
  peptide fold or domain or sub-domain
MHAIKQGLDSDYNNDVEKSWLA

SEQ ID NO: 13319 - protein, 25 aa, artificial
  peptide fold or domain or sub-domain
MHDEASRASRYLDKMTEAKILQVMD

SEQ ID NO: 13320 - protein, 20 aa, artificial
  peptide fold or domain or sub-domain
MHDVYNRDEIRRIVDSCGFI

SEQ ID NO: 13321 - protein, 24 aa, artificial
  peptide fold or domain or sub-domain
MHFKARNYPNTLTENEKEDWFEIV

SEQ ID NO: 13322 - protein, 22 aa, artificial
  peptide fold or domain or sub-domain
MHFNPFNGSTTAKTPAALELGD

SEQ ID NO: 13323 - protein, 28 aa, artificial
  peptide fold or domain or sub-domain
MHGVVDAETGMSRIAPILNLTNIPIKDV

SEQ ID NO: 13324 - protein, 26 aa, artificial
  peptide fold or domain or sub-domain
MHKTADELNDLQENDENAFMNCMAEA

SEQ ID NO: 13325 - protein, 25 aa, artificial
  peptide fold or domain or sub-domain
MHLDETLTDVMRFRLDDNACRFLLT

SEQ ID NO: 13326 - protein, 28 aa, artificial
  peptide fold or domain or sub-domain
MHPAECILPPSLYGNSELTGKLREHTIV

SEQ ID NO: 13327 - protein, 25 aa, artificial
  peptide fold or domain or sub-domain
MHPIYAYGSEEQRQKYLPQLAKGEL

SEQ ID NO: 13328 - protein, 29 aa, artificial
  peptide fold or domain or sub-domain
MHPRFQTAFAQLADNLQSALEPILADKYF

SEQ ID NO: 13329 - protein, 29 aa, artificial
  peptide fold or domain or sub-domain
MHRDPKLFDDPEKFDPERFSPERTMEQSS

SEQ ID NO: 13330 - protein, 27 aa, artificial
  peptide fold or domain or sub-domain
MHRNEPSKTIIAAGGGGTWGYHFPEPR

SEQ ID NO: 13331 - protein, 25 aa, artificial
  peptide fold or domain or sub-domain
MHRYLDELVASGPPADLVRHVTSPF

SEQ ID NO: 13332 - protein, 27 aa, artificial
  peptide fold or domain or sub-domain
MHSGIGPAKVLEAAGIGLRLDRPGVGA

SEQ ID NO: 13333 - protein, 24 aa, artificial
  peptide fold or domain or sub-domain
MIALVIERLERRGNTDPFFHAIAR

SEQ ID NO: 13334 - protein, 25 aa, artificial
  peptide fold or domain or sub-domain
MIDGDFEQVCLGKLNPNNAFMTGKM

SEQ ID NO: 13335 - protein, 26 aa, artificial
  peptide fold or domain or sub-domain
MIDKFMLDKACKDKSGKTFQKDFRIE

SEQ ID NO: 13336 - protein, 27 aa, artificial
  peptide fold or domain or sub-domain
MIFIEKTGRIGVNNEIPMDSYPPLTQK

SEQ ID NO: 13337 - protein, 25 aa, artificial
  peptide fold or domain or sub-domain
MIFTTDASFANTSNDKIMYIDYANL

SEQ ID NO: 13338 - protein, 27 aa, artificial
  peptide fold or domain or sub-domain
MIHAVIEKEIYKKEKIAFEKEVIEDSS

SEQ ID NO: 13339 - protein, 22 aa, artificial
  peptide fold or domain or sub-domain
MIKGLDRTENYSKLKKYYRSCV

SEQ ID NO: 13340 - protein, 25 aa, artificial
  peptide fold or domain or sub-domain
MIKKLKEDSDTDKILKLVKKIKKWE

SEQ ID NO: 13341 - protein, 25 aa, artificial
  peptide fold or domain or sub-domain
MIKQSIYHGMQMDLDRAIRYEAELF

SEQ ID NO: 13342 - protein, 29 aa, artificial
  peptide fold or domain or sub-domain
MILIVLDAPVSMRKIPQSSSPKRLFFLRS

SEQ ID NO: 13343 - protein, 30 aa, artificial
  peptide fold or domain or sub-domain
MILLGKCYENLMVDVQASNEKLKARAVRIV

SEQ ID NO: 13344 - protein, 26 aa, artificial
  peptide fold or domain or sub-domain
MIMTHQIDNYPGSHIGASGKEIYDTM

SEQ ID NO: 13345 - protein, 25 aa, artificial
  peptide fold or domain or sub-domain
MINKEHVSNTDARCCVHDAACPANQ

SEQ ID NO: 13346 - protein, 24 aa, artificial
  peptide fold or domain or sub-domain
MIRWVARRLLERGHKAPKFHGVSH

SEQ ID NO: 13347 - protein, 25 aa, artificial
  peptide fold or domain or sub-domain
MISLKSIVDKLYNLEDLSYQESYQL

SEQ ID NO: 13348 - protein, 23 aa, artificial
  peptide fold or domain or sub-domain
MISNGGRDGRVFSPDNTFVQNLA

SEQ ID NO: 13349 - protein, 25 aa, artificial
  peptide fold or domain or sub-domain
MISSEDDEILHFAQLHGIDTRYRRP

SEQ ID NO: 13350 - protein, 20 aa, artificial
  peptide fold or domain or sub-domain
MITDEDIQADLRGKWENSAR

SEQ ID NO: 13351 - protein, 27 aa, artificial
  peptide fold or domain or sub-domain
MITFTGSPEVGIAIRNKAGLKRVTLEL

SEQ ID NO: 13352 - protein, 29 aa, artificial
  peptide fold or domain or sub-domain
MITRLKAEEAAGQDLSKNNGALALRLYSQ

SEQ ID NO: 13353 - protein, 23 aa, artificial
  peptide fold or domain or sub-domain
MIVDLIFEGGFEKMRHDCSNTCE

SEQ ID NO: 13354 - protein, 29 aa, artificial
  peptide fold or domain or sub-domain
MIYEPSLPDGQLFFGSEVVHDFPKFKEKS

SEQ ID NO: 13355 - protein, 29 aa, artificial
  peptide fold or domain or sub-domain
MKADDQTILSLHTRVITHNPRISVTHDDS

SEQ ID NO: 13356 - protein, 23 aa, artificial
  peptide fold or domain or sub-domain
MKADEYKQMWETITAGKEWHGEY

SEQ ID NO: 13357 - protein, 25 aa, artificial
  peptide fold or domain or sub-domain
MKAELELYRLQRRVNMPIEAVATLL

SEQ ID NO: 13358 - protein, 26 aa, artificial
  peptide fold or domain or sub-domain
MKDKITRHIKIMYPNYSDEDISTFLN

SEQ ID NO: 13359 - protein, 30 aa, artificial
  peptide fold or domain or sub-domain
MKDMEQGRSCGVCHEDKTVFGVTGNCDRCH

SEQ ID NO: 13360 - protein, 29 aa, artificial
  peptide fold or domain or sub-domain
MKEFQQVVADGSWKENGWKGVAYATSKSG

SEQ ID NO: 13361 - protein, 24 aa, artificial
  peptide fold or domain or sub-domain
MKFALCLAEGQTDGDINPDLDPHD

SEQ ID NO: 13362 - protein, 21 aa, artificial
  peptide fold or domain or sub-domain
MKFEGVLREAVFVKGRFWDMK

SEQ ID NO: 13363 - protein, 25 aa, artificial
  peptide fold or domain or sub-domain
MKGMKEYIKKLEEGSDLSSEEAEAA

SEQ ID NO: 13364 - protein, 27 aa, artificial
  peptide fold or domain or sub-domain
MKIDPSVLHEESVKGSDLLEIFVNGFI

SEQ ID NO: 13365 - protein, 30 aa, artificial
  peptide fold or domain or sub-domain
MKKEDFRRVHRDSDGGNKLPDEFLDRLYDD

SEQ ID NO: 13366 - protein, 29 aa, artificial
  peptide fold or domain or sub-domain
MKKETFFKFMKAEQKQEEIDLKSQQFLDM

SEQ ID NO: 13367 - protein, 27 aa, artificial
  peptide fold or domain or sub-domain
MKKEVQDEEKNKKFGLSVGHHLGKSIP

SEQ ID NO: 13368 - protein, 30 aa, artificial
  peptide fold or domain or sub-domain
MKKFKISKDLSPQDARKIMVVRQLMEEQGY

SEQ ID NO: 13369 - protein, 21 aa, artificial
  peptide fold or domain or sub-domain
MKKLKSWKGVRHSLGLKVRGQ

SEQ ID NO: 13370 - protein, 26 aa, artificial
  peptide fold or domain or sub-domain
MKKNVASKYNINTVSDLSKVSNNMIL

SEQ ID NO: 13371 - protein, 27 aa, artificial
  peptide fold or domain or sub-domain
MKKVKEMHSNIKDDILKGDFSNLNNYL

SEQ ID NO: 13372 - protein, 30 aa, artificial
  peptide fold or domain or sub-domain
MKLEDFIKNLRGVDNGQDIPRDLLVGIYQR

SEQ ID NO: 13373 - protein, 28 aa, artificial
  peptide fold or domain or sub-domain
MKNMEEAARSSPDYQNWSYEQAYKDYSE

SEQ ID NO: 13374 - protein, 20 aa, artificial
  peptide fold or domain or sub-domain
MKNNCMSSFFKKYHHTPPTN

SEQ ID NO: 13375 - protein, 23 aa, artificial
  peptide fold or domain or sub-domain
MKNRSELAKKLGINEEFVVDVFK

SEQ ID NO: 13376 - protein, 27 aa, artificial
  peptide fold or domain or sub-domain
MKQVHSGVVHKVDGPIAEQLTGDGLIT

SEQ ID NO: 13377 - protein, 21 aa, artificial
  peptide fold or domain or sub-domain
MKRLVDKGLAHNIKSAKRMVE

SEQ ID NO: 13378 - protein, 30 aa, artificial
  peptide fold or domain or sub-domain
MKRQDYVERTINVTKSKTVTFKVLSEIYDR

SEQ ID NO: 13379 - protein, 25 aa, artificial
  peptide fold or domain or sub-domain
MKRVEKLLAGKLSDAKRAELKLRLN

SEQ ID NO: 13380 - protein, 28 aa, artificial
  peptide fold or domain or sub-domain
MKSGIEQIKVDAITPEEAAVLNALQYLE

SEQ ID NO: 13381 - protein, 21 aa, artificial
  peptide fold or domain or sub-domain
MKSLGTISKDELKIALLQIYS

SEQ ID NO: 13382 - protein, 25 aa, artificial
  peptide fold or domain or sub-domain
MKTERPKPNTFIIRCLQWTTVIERT

SEQ ID NO: 13383 - protein, 20 aa, artificial
  peptide fold or domain or sub-domain
MKTSIVEAIANDREQAKVLL

SEQ ID NO: 13384 - protein, 21 aa, artificial
  peptide fold or domain or sub-domain
MKVEFVDPENPVKGYKYLYVT

SEQ ID NO: 13385 - protein, 28 aa, artificial
  peptide fold or domain or sub-domain
MKVEKEEFKKKFYKNMSLENTNLIKNYC

SEQ ID NO: 13386 - protein, 30 aa, artificial
  peptide fold or domain or sub-domain
MKVFSSTEINEGQGFTVLLNKKDKRLSLNL

SEQ ID NO: 13387 - protein, 25 aa, artificial
  peptide fold or domain or sub-domain
MLALSKIEALTEWNTEALHHVIAQV

SEQ ID NO: 13388 - protein, 24 aa, artificial
  peptide fold or domain or sub-domain
MLAMDTILASARFFSGNLTKVPTM

SEQ ID NO: 13389 - protein, 30 aa, artificial
  peptide fold or domain or sub-domain
MLDISWYDLQPKLNLKDFSPASQDKMAIEY

SEQ ID NO: 13390 - protein, 20 aa, artificial
  peptide fold or domain or sub-domain
MLDNAALMRRIKGERSAIRN

SEQ ID NO: 13391 - protein, 23 aa, artificial
  peptide fold or domain or sub-domain
MLDQMLYLPTLLANRGKDPDTGE

SEQ ID NO: 13392 - protein, 23 aa, artificial
  peptide fold or domain or sub-domain
MLEIGDNFSMNSNSCLGAADGGE

SEQ ID NO: 13393 - protein, 26 aa, artificial
  peptide fold or domain or sub-domain
MLEKILYLLLVKLDLDGAIEFVKQKV

SEQ ID NO: 13394 - protein, 25 aa, artificial
  peptide fold or domain or sub-domain
MLEVTEAADVIGNGVSSSTWQSWES

SEQ ID NO: 13395 - protein, 22 aa, artificial
  peptide fold or domain or sub-domain
MLGDALQLCGIENEIASFMKRK

SEQ ID NO: 13396 - protein, 28 aa, artificial
  peptide fold or domain or sub-domain
MLGLTGRPVPVTKARGQVIAADSFSILV

SEQ ID NO: 13397 - protein, 27 aa, artificial
  peptide fold or domain or sub-domain
MLGQAHHFRLYAPEKIEYAVNRYTNEA

SEQ ID NO: 13398 - protein, 23 aa, artificial
  peptide fold or domain or sub-domain
MLGSMVAQARGGGLSHADVLDNA

SEQ ID NO: 13399 - protein, 27 aa, artificial
  peptide fold or domain or sub-domain
MLGTKDGVNKNLAWASKICGVSEQDLA

SEQ ID NO: 13400 - protein, 30 aa, artificial
  peptide fold or domain or sub-domain
MLIKKILARPEQKTRLKMIAKQFGVSEMQI

SEQ ID NO: 13401 - protein, 22 aa, artificial
  peptide fold or domain or sub-domain
MLKSDLINILVAKRGVTQKQAE

SEQ ID NO: 13402 - protein, 29 aa, artificial
  peptide fold or domain or sub-domain
MLKSDLINILVAKRGVTQKQAEATIETIF

SEQ ID NO: 13403 - protein, 25 aa, artificial
  peptide fold or domain or sub-domain
MLKYRGLEIDLEGHAVLVDGSAVAL

SEQ ID NO: 13404 - protein, 20 aa, artificial
  peptide fold or domain or sub-domain
MLLAAHQPFEWVEQWEAADF

SEQ ID NO: 13405 - protein, 20 aa, artificial
  peptide fold or domain or sub-domain
MLLAGAMSAEHALRWAGANF

SEQ ID NO: 13406 - protein, 25 aa, artificial
  peptide fold or domain or sub-domain
MLLANIDQAKLSRRLVALEESVPVP

SEQ ID NO: 13407 - protein, 27 aa, artificial
  peptide fold or domain or sub-domain
MLLGPTSAPVKATDGKQLPVEASMEGM

SEQ ID NO: 13408 - protein, 30 aa, artificial
  peptide fold or domain or sub-domain
MLLLFKDGQVQITQIGAVGKGRLTQMIDKV

SEQ ID NO: 13409 - protein, 26 aa, artificial
  peptide fold or domain or sub-domain
MLLLTSDQTVTREEVEGAGVHASLSK

SEQ ID NO: 13410 - protein, 26 aa, artificial
  peptide fold or domain or sub-domain
MLLTEKFASLGHLDAKAKNEFRDIMR

SEQ ID NO: 13411 - protein, 29 aa, artificial
  peptide fold or domain or sub-domain
MLLTWSDDLVSGLSSHVDEAAIQKLMDTF

SEQ ID NO: 13412 - protein, 22 aa, artificial
  peptide fold or domain or sub-domain
MLNCSERHDNVQPDGSTFRNYM

SEQ ID NO: 13413 - protein, 27 aa, artificial
  peptide fold or domain or sub-domain
MLNHHCGTYSFGSPELLLGHRYDGPKN

SEQ ID NO: 13414 - protein, 22 aa, artificial
  peptide fold or domain or sub-domain
MLNMFFAENIDVLERYRNFKKR

SEQ ID NO: 13415 - protein, 25 aa, artificial
  peptide fold or domain or sub-domain
MLNVVEIISKKKNNIELSEQEIKFV

SEQ ID NO: 13416 - protein, 26 aa, artificial
  peptide fold or domain or sub-domain
MLPIFDVVKKYGQLNEMEMYEIFNMG

SEQ ID NO: 13417 - protein, 22 aa, artificial
  peptide fold or domain or sub-domain
MLPPLVLERLRQAKELGDVMDE

SEQ ID NO: 13418 - protein, 21 aa, artificial
  peptide fold or domain or sub-domain
MLRNCGNPGRGGHRMALEASR

SEQ ID NO: 13419 - protein, 25 aa, artificial
  peptide fold or domain or sub-domain
MLSERQETLKLSKRLALLDSNIPIP

SEQ ID NO: 13420 - protein, 20 aa, artificial
  peptide fold or domain or sub-domain
MLSGFDPQVLAQALKIDVRL

SEQ ID NO: 13421 - protein, 27 aa, artificial
  peptide fold or domain or sub-domain
MLSGIGDKSHLAEHMIECVADIPAVGQ

SEQ ID NO: 13422 - protein, 27 aa, artificial
  peptide fold or domain or sub-domain
MLSGVGPQAHLEEVGVEPLVDSPGVGS

SEQ ID NO: 13423 - protein, 26 aa, artificial
  peptide fold or domain or sub-domain
MLSPTDLRDISRLYMGERAALAGRFP

SEQ ID NO: 13424 - protein, 27 aa, artificial
  peptide fold or domain or sub-domain
MLTAYRDNFDDWSKLSTPLLRKKLIAM

SEQ ID NO: 13425 - protein, 23 aa, artificial
  peptide fold or domain or sub-domain
MLTQGGRSGQIQNEDGSFKLKLA

SEQ ID NO: 13426 - protein, 21 aa, artificial
  peptide fold or domain or sub-domain
MLVAITGFAAPLGWLPAKAAS

SEQ ID NO: 13427 - protein, 23 aa, artificial
  peptide fold or domain or sub-domain
MLVDLVYEKGISGMLKAVSDTAK

SEQ ID NO: 13428 - protein, 28 aa, artificial
  peptide fold or domain or sub-domain
MLVDLVYEKGISGMLKAVSDTAKYGGMT

SEQ ID NO: 13429 - protein, 25 aa, artificial
  peptide fold or domain or sub-domain
MLVNDYAQAKEKYDNLPEGINFTAV

SEQ ID NO: 13430 - protein, 24 aa, artificial
  peptide fold or domain or sub-domain
MLVSGDYVKKSKPYPDIFLYTAEK

SEQ ID NO: 13431 - protein, 26 aa, artificial
  peptide fold or domain or sub-domain
MLWTENEMTFYIDGVAYYSYVFKDPS

SEQ ID NO: 13432 - protein, 26 aa, artificial
  peptide fold or domain or sub-domain
MLWTRQGFRFYVDDMEVFDAPNDFAH

SEQ ID NO: 13433 - protein, 24 aa, artificial
  peptide fold or domain or sub-domain
MLYELQRVGTKNESPKIILRGDKA

SEQ ID NO: 13434 - protein, 24 aa, artificial
  peptide fold or domain or sub-domain
MMADLVAAARAGNIAVARDLQVRM

SEQ ID NO: 13435 - protein, 26 aa, artificial
  peptide fold or domain or sub-domain
MMETVLNKLLIEKNLNSAIEYTKSKI

SEQ ID NO: 13436 - protein, 30 aa, artificial
  peptide fold or domain or sub-domain
MMLQKGGEEKSHEKITAKLDEKKQQSSLHI

SEQ ID NO: 13437 - protein, 28 aa, artificial
  peptide fold or domain or sub-domain
MMRKAAELADEARELEKSNDAVLRTPHA

SEQ ID NO: 13438 - protein, 22 aa, artificial
  peptide fold or domain or sub-domain
MMVRLSNSRLKPKEVSAMRDCV

SEQ ID NO: 13439 - protein, 25 aa, artificial
  peptide fold or domain or sub-domain
MMVYYTRIMPQASFDQLHMVSETVH

SEQ ID NO: 13440 - protein, 25 aa, artificial
  peptide fold or domain or sub-domain
MNDINSVLETLFTQKDLDQHQVESL

SEQ ID NO: 13441 - protein, 21 aa, artificial
  peptide fold or domain or sub-domain
MNDNQGQPFNAEYLGFQVATR

SEQ ID NO: 13442 - protein, 29 aa, artificial
  peptide fold or domain or sub-domain
MNEFLECCKTETNAANGWTTWSYGVSKLG

SEQ ID NO: 13443 - protein, 20 aa, artificial
  peptide fold or domain or sub-domain
MNELADRRTRADAQLAVLAS

SEQ ID NO: 13444 - protein, 29 aa, artificial
  peptide fold or domain or sub-domain
MNEYIKATKEGDFKTKGWAELAYGISKIG

SEQ ID NO: 13445 - protein, 25 aa, artificial
  peptide fold or domain or sub-domain
MNFTTDEKYATACDTQNMYVDYKNI

SEQ ID NO: 13446 - protein, 29 aa, artificial
  peptide fold or domain or sub-domain
MNGWVPIYKNNLSIMSVGYLLPNFDDPVI

SEQ ID NO: 13447 - protein, 20 aa, artificial
  peptide fold or domain or sub-domain
MNIEETADLLGVKPETVKTR

SEQ ID NO: 13448 - protein, 29 aa, artificial
  peptide fold or domain or sub-domain
MNKAQLVTAMAQKSELTKKDAQAALTSLQ

SEQ ID NO: 13449 - protein, 28 aa, artificial
  peptide fold or domain or sub-domain
MNKEKYEGYLRRKGLFSRAEIEFAVSRV

SEQ ID NO: 13450 - protein, 29 aa, artificial
  peptide fold or domain or sub-domain
MNKFVEDTKNGVHRKEGWSDSTYGVTKIG

SEQ ID NO: 13451 - protein, 22 aa, artificial
  peptide fold or domain or sub-domain
MNKKELIDRVAKKAGAKKKDVK

SEQ ID NO: 13452 - protein, 29 aa, artificial
  peptide fold or domain or sub-domain
MNKKELIDRVAKKAGAKKKDVKLILDTIL

SEQ ID NO: 13453 - protein, 26 aa, artificial
  peptide fold or domain or sub-domain
MNKKLKALGNKKAVRPDDLRKALEQM

SEQ ID NO: 13454 - protein, 22 aa, artificial
  peptide fold or domain or sub-domain
MNKKQLIAQLSGSLNLSKADAE

SEQ ID NO: 13455 - protein, 29 aa, artificial
  peptide fold or domain or sub-domain
MNKLEFLRKLAEKNGVSQKEADKFLNNFI

SEQ ID NO: 13456 - protein, 29 aa, artificial
  peptide fold or domain or sub-domain
MNKQEFIKFLTSEQSPYQKQCEDAFRLFA

SEQ ID NO: 13457 - protein, 22 aa, artificial
  peptide fold or domain or sub-domain
MNKSELIEALSQDVNIPHREAA

SEQ ID NO: 13458 - protein, 22 aa, artificial
  peptide fold or domain or sub-domain
MNKSELIKQVAIQSELKKPQAS

SEQ ID NO: 13459 - protein, 22 aa, artificial
  peptide fold or domain or sub-domain
MNKSELVKSLAEKAEITQKDAA

SEQ ID NO: 13460 - protein, 29 aa, artificial
  peptide fold or domain or sub-domain
MNKSELVKSLAEKAEITQKDAAKVLDALV

SEQ ID NO: 13461 - protein, 22 aa, artificial
  peptide fold or domain or sub-domain
MNKSQLIDKIAAGADISKAAAG

SEQ ID NO: 13462 - protein, 22 aa, artificial
  peptide fold or domain or sub-domain
MNKSQLVDRIAQQIEGGRSNAT

SEQ ID NO: 13463 - protein, 29 aa, artificial
  peptide fold or domain or sub-domain
MNKSQLVDRIAQQIEGGRSNATKAVDAVF

SEQ ID NO: 13464 - protein, 29 aa, artificial
  peptide fold or domain or sub-domain
MNKTDLIDHVAAQTDMSKAAAGRAIDALI

SEQ ID NO: 13465 - protein, 29 aa, artificial
  peptide fold or domain or sub-domain
MNKTELINAVAETSGLSKKDATKAVDAVF

SEQ ID NO: 13466 - protein, 22 aa, artificial
  peptide fold or domain or sub-domain
MNKTELVESVSDSSHLSKKDVQ

SEQ ID NO: 13467 - protein, 29 aa, artificial
  peptide fold or domain or sub-domain
MNKTELVESVSDSSHLSKKDVQAVLDGFL

SEQ ID NO: 13468 - protein, 29 aa, artificial
  peptide fold or domain or sub-domain
MNKTQLIDFIAEKADLTKVQAKAALEATL

SEQ ID NO: 13469 - protein, 21 aa, artificial
  peptide fold or domain or sub-domain
MNLAEQPFYNHRMQVDAGLCR

SEQ ID NO: 13470 - protein, 21 aa, artificial
  peptide fold or domain or sub-domain
MNLEEIGQTLDIGAARVCQIK

SEQ ID NO: 13471 - protein, 22 aa, artificial
  peptide fold or domain or sub-domain
MNLGELKKIVADKTGMSQADAG

SEQ ID NO: 13472 - protein, 29 aa, artificial
  peptide fold or domain or sub-domain
MNLGELKKIVADKTGMSQADAGRAVAATL

SEQ ID NO: 13473 - protein, 22 aa, artificial
  peptide fold or domain or sub-domain
MNMREKQHKSPDYLKINPNGKI

SEQ ID NO: 13474 - protein, 23 aa, artificial
  peptide fold or domain or sub-domain
MNNISQRLGLSNNISEEVFTQIE

SEQ ID NO: 13475 - protein, 23 aa, artificial
  peptide fold or domain or sub-domain
MNNVFYRGRGFLEGRYDDLRPGL

SEQ ID NO: 13476 - protein, 26 aa, artificial
  peptide fold or domain or sub-domain
MNQANYKKYRTKTLSEVTALSKSDPG

SEQ ID NO: 13477 - protein, 29 aa, artificial
  peptide fold or domain or sub-domain
MNQSKEKITREWTDVSQLTESLVGKSVLI

SEQ ID NO: 13478 - protein, 28 aa, artificial
  peptide fold or domain or sub-domain
MNRLKEKYLNEVVPALMSKFNYKSIMQV

SEQ ID NO: 13479 - protein, 29 aa, artificial
  peptide fold or domain or sub-domain
MNRQELVKAIADESGHSQSTVGEVLNSLI

SEQ ID NO: 13480 - protein, 28 aa, artificial
  peptide fold or domain or sub-domain
MNSAFFEELKARGLVYQVTDEEALQKQL

SEQ ID NO: 13481 - protein, 26 aa, artificial
  peptide fold or domain or sub-domain
MNSIELRNALKHVGFSINNSVFSTLV

SEQ ID NO: 13482 - protein, 27 aa, artificial
  peptide fold or domain or sub-domain
MNSIELRNALKHVGFSINNSVFSTLVM

SEQ ID NO: 13483 - protein, 25 aa, artificial
  peptide fold or domain or sub-domain
MNSKNFFDMFSGKLKAAPAYMTGKL

SEQ ID NO: 13484 - protein, 22 aa, artificial
  peptide fold or domain or sub-domain
MNSLKETLGSSFNDNTKNAWLT

SEQ ID NO: 13485 - protein, 24 aa, artificial
  peptide fold or domain or sub-domain
MNSSCGNCEYCMKAEETICPHIQL

SEQ ID NO: 13486 - protein, 23 aa, artificial
  peptide fold or domain or sub-domain
MNSSIEEALAAETGDARYAADTR

SEQ ID NO: 13487 - protein, 27 aa, artificial
  peptide fold or domain or sub-domain
MNSTQLRDAFYNLGCVLPTSVHQLIVS

SEQ ID NO: 13488 - protein, 28 aa, artificial
  peptide fold or domain or sub-domain
MNTDERYKLLRSVGEECIQESELRNLIE

SEQ ID NO: 13489 - protein, 30 aa, artificial
  peptide fold or domain or sub-domain
MNTMCGVGICGECSCGNILTCKKGTFVSLD

SEQ ID NO: 13490 - protein, 30 aa, artificial
  peptide fold or domain or sub-domain
MNTVDFHDSDLARTIEQLAPEQIDALPFGV

SEQ ID NO: 13491 - protein, 22 aa, artificial
  peptide fold or domain or sub-domain
MNVFKGQHMSDEFKKLNPVQTI

SEQ ID NO: 13492 - protein, 25 aa, artificial
  peptide fold or domain or sub-domain
MNVVVSQQQFQNCRRQLPPEITVYE

SEQ ID NO: 13493 - protein, 29 aa, artificial
  peptide fold or domain or sub-domain
MNYRLARECCYFFKAKERKISASEFAHRL

SEQ ID NO: 13494 - protein, 22 aa, artificial
  peptide fold or domain or sub-domain
MPAVNFLYAAPYYWYQKYQIRK

SEQ ID NO: 13495 - protein, 23 aa, artificial
  peptide fold or domain or sub-domain
MPDDALEQRIADEYRRDRPEFEK

SEQ ID NO: 13496 - protein, 30 aa, artificial
  peptide fold or domain or sub-domain
MPDMDGLLQYWKTAFDRVKAKDSGIFVPKA

SEQ ID NO: 13497 - protein, 20 aa, artificial
  peptide fold or domain or sub-domain
MPDYEPEKKELASRDVVSRR

SEQ ID NO: 13498 - protein, 22 aa, artificial
  peptide fold or domain or sub-domain
MPEHNYLYSVPREYYEKFAARK

SEQ ID NO: 13499 - protein, 22 aa, artificial
  peptide fold or domain or sub-domain
MPEHVKTYPIDQGIAKANGLRK

SEQ ID NO: 13500 - protein, 22 aa, artificial
  peptide fold or domain or sub-domain
MPESAARYAIDPKIADRYRIRR

SEQ ID NO: 13501 - protein, 29 aa, artificial
  peptide fold or domain or sub-domain
MPGHVDAALHFRAYNKTYFFRGPYVWRYD

SEQ ID NO: 13502 - protein, 21 aa, artificial
  peptide fold or domain or sub-domain
MPHAFIMCYPEQEDAWLAFAQ

SEQ ID NO: 13503 - protein, 21 aa, artificial
  peptide fold or domain or sub-domain
MPHALMLSVGDNVKAWKAFDE

SEQ ID NO: 13504 - protein, 27 aa, artificial
  peptide fold or domain or sub-domain
MPINKETVSIIVNAGPAGMVVAEKDIY

SEQ ID NO: 13505 - protein, 26 aa, artificial
  peptide fold or domain or sub-domain
MPITALLLDKETGGYKGVRLASGQEI

SEQ ID NO: 13506 - protein, 29 aa, artificial
  peptide fold or domain or sub-domain
MPKASFLRLNEERKARELFANPRNAAAGS

SEQ ID NO: 13507 - protein, 30 aa, artificial
  peptide fold or domain or sub-domain
MPKSCEILALNDKNIIMAIKHKKYEIYGVQ

SEQ ID NO: 13508 - protein, 24 aa, artificial
  peptide fold or domain or sub-domain
MPKWKRNGWKTFNNKPVINKIELL

SEQ ID NO: 13509 - protein, 21 aa, artificial
  peptide fold or domain or sub-domain
MPLKDANDMLMRNRADEVYQL

SEQ ID NO: 13510 - protein, 23 aa, artificial
  peptide fold or domain or sub-domain
MPMEVLAKTFLMGEDEVGAIKSK

SEQ ID NO: 13511 - protein, 24 aa, artificial
  peptide fold or domain or sub-domain
MPMNKVSESFAQAEGLDYWYEEHA

SEQ ID NO: 13512 - protein, 30 aa, artificial
  peptide fold or domain or sub-domain
MPPQFSSKKVKGKKALDLAYKNIAIKLKKQ

SEQ ID NO: 13513 - protein, 28 aa, artificial
  peptide fold or domain or sub-domain
MPPVKKTMLEARLQKRLRKLGISSFKDY

SEQ ID NO: 13514 - protein, 22 aa, artificial
  peptide fold or domain or sub-domain
MPPYAYMYALPYDLYEKHGVRK

SEQ ID NO: 13515 - protein, 29 aa, artificial
  peptide fold or domain or sub-domain
MPQDVLKALDDIEFGFMKGQLEAEFEKFN

SEQ ID NO: 13516 - protein, 29 aa, artificial
  peptide fold or domain or sub-domain
MPQDVLNALDEIEYPEFSKTLKKHLEAYE

SEQ ID NO: 13517 - protein, 26 aa, artificial
  peptide fold or domain or sub-domain
MPQQIHIRDDRLDSDFSFSGQVFPCR

SEQ ID NO: 13518 - protein, 26 aa, artificial
  peptide fold or domain or sub-domain
MPQTIHVGEDALESELRFGGIPHYCI

SEQ ID NO: 13519 - protein, 23 aa, artificial
  peptide fold or domain or sub-domain
MPQVVPIRLGGKLVDKKIIVLAQ

SEQ ID NO: 13520 - protein, 21 aa, artificial
  peptide fold or domain or sub-domain
MPRKVLASRLSMQPETLSRLF

SEQ ID NO: 13521 - protein, 27 aa, artificial
  peptide fold or domain or sub-domain
MPTHKSEIRKLIEQKQIEGWDDIRLPT

SEQ ID NO: 13522 - protein, 20 aa, artificial
  peptide fold or domain or sub-domain
MPTTVTTAPSVAQVVMNDLN

SEQ ID NO: 13523 - protein, 21 aa, artificial
  peptide fold or domain or sub-domain
MPVDIHPEEGVPAVELILCIS

SEQ ID NO: 13524 - protein, 20 aa, artificial
  peptide fold or domain or sub-domain
MPVPLPTWYIVDSTQVAANK

SEQ ID NO: 13525 - protein, 28 aa, artificial
  peptide fold or domain or sub-domain
MPVVELLMALAAFPSKNEARRMIQQGAV

SEQ ID NO: 13526 - protein, 25 aa, artificial
  peptide fold or domain or sub-domain
MQALDAPDGALYLKMDERDFRYVIV

SEQ ID NO: 13527 - protein, 22 aa, artificial
  peptide fold or domain or sub-domain
MQAYGLARDTGMSRQDAQRFIE

SEQ ID NO: 13528 - protein, 24 aa, artificial
  peptide fold or domain or sub-domain
MQHDFNCYPFVPRHTIVNIGVDVM

SEQ ID NO: 13529 - protein, 21 aa, artificial
  peptide fold or domain or sub-domain
MQKLGFDQPEYDADQVLAEIA

SEQ ID NO: 13530 - protein, 25 aa, artificial
  peptide fold or domain or sub-domain
MQLAHKDADSLRLRTDQKPYRWIIE

SEQ ID NO: 13531 - protein, 22 aa, artificial
  peptide fold or domain or sub-domain
MQLLIEMKKQNQLTIEEIAAQC

SEQ ID NO: 13532 - protein, 23 aa, artificial
  peptide fold or domain or sub-domain
MQLRTAFANPDRYITPDLIARGT

SEQ ID NO: 13533 - protein, 24 aa, artificial
  peptide fold or domain or sub-domain
MQNDKNLKRYQDRAAANGFAVERG

SEQ ID NO: 13534 - protein, 25 aa, artificial
  peptide fold or domain or sub-domain
MQNFLSHTGPDLIPEVPRQLVTNCA

SEQ ID NO: 13535 - protein, 24 aa, artificial
  peptide fold or domain or sub-domain
MQNHHELEPYEDLINQSQLAVKRG

SEQ ID NO: 13536 - protein, 22 aa, artificial
  peptide fold or domain or sub-domain
MQNIHQLEEIYGSAGTASMLDL

SEQ ID NO: 13537 - protein, 20 aa, artificial
  peptide fold or domain or sub-domain
MQNLYPESYKVRVIPSFAQM

SEQ ID NO: 13538 - protein, 21 aa, artificial
  peptide fold or domain or sub-domain
MQQAGVPDMADLPPPAARQVY

SEQ ID NO: 13539 - protein, 20 aa, artificial
  peptide fold or domain or sub-domain
MQQEEIIEGYYGASKGLKKS

SEQ ID NO: 13540 - protein, 21 aa, artificial
  peptide fold or domain or sub-domain
MQQEGITRRAERLADRIVDHV

SEQ ID NO: 13541 - protein, 21 aa, artificial
  peptide fold or domain or sub-domain
MQQEGYLREHHWIKGQWRDSW

SEQ ID NO: 13542 - protein, 21 aa, artificial
  peptide fold or domain or sub-domain
MQQLATAVGLKGWQSVQQWEK

SEQ ID NO: 13543 - protein, 21 aa, artificial
  peptide fold or domain or sub-domain
MQQLDRPGLHTMPPEQARAIY

SEQ ID NO: 13544 - protein, 25 aa, artificial
  peptide fold or domain or sub-domain
MQQVDRGGKMRAFRMDDRKQRLIVD

SEQ ID NO: 13545 - protein, 24 aa, artificial
  peptide fold or domain or sub-domain
MQRLYAEGVATGELLDVDPTVATA

SEQ ID NO: 13546 - protein, 24 aa, artificial
  peptide fold or domain or sub-domain
MQRRKEGIPYADAEKQMFLEAAKQ

SEQ ID NO: 13547 - protein, 21 aa, artificial
  peptide fold or domain or sub-domain
MQTAEIAERWPLMNAEGVLGG

SEQ ID NO: 13548 - protein, 25 aa, artificial
  peptide fold or domain or sub-domain
MQYIAATFIAGYTKRKWENNEYWLE

SEQ ID NO: 13549 - protein, 23 aa, artificial
  peptide fold or domain or sub-domain
MRACYHCEFCLRGEHSFCAQFAV

SEQ ID NO: 13550 - protein, 30 aa, artificial
  peptide fold or domain or sub-domain
MRACYHCEFCLRGEHSFCAQFAVRGTRFDG

SEQ ID NO: 13551 - protein, 25 aa, artificial
  peptide fold or domain or sub-domain
MRAEARLYELRHNRMISARALANMI

SEQ ID NO: 13552 - protein, 21 aa, artificial
  peptide fold or domain or sub-domain
MRALGFEPRKDEVRRLIASTM

SEQ ID NO: 13553 - protein, 29 aa, artificial
  peptide fold or domain or sub-domain
MRAVVGMLSDKDIAGTLAHLIPLIDEWYC

SEQ ID NO: 13554 - protein, 27 aa, artificial
  peptide fold or domain or sub-domain
MRDAMVDVVQSGTGRGIRTPLYQIAGK

SEQ ID NO: 13555 - protein, 22 aa, artificial
  peptide fold or domain or sub-domain
MREGADKVGTREIPIVVAEGKN

SEQ ID NO: 13556 - protein, 27 aa, artificial
  peptide fold or domain or sub-domain
MREILKSVVAEGTGKAGYIEGFDVAGK

SEQ ID NO: 13557 - protein, 21 aa, artificial
  peptide fold or domain or sub-domain
MREIVARDIVQNVKAAKRLVE

SEQ ID NO: 13558 - protein, 21 aa, artificial
  peptide fold or domain or sub-domain
MRFEGCHKGRLILRDGYHDSN

SEQ ID NO: 13559 - protein, 25 aa, artificial
  peptide fold or domain or sub-domain
MRHMPLHPMSPALRRIHTDKWVFES

SEQ ID NO: 13560 - protein, 21 aa, artificial
  peptide fold or domain or sub-domain
MRIIGSIIAHGRIWGGVIDYI

SEQ ID NO: 13561 - protein, 29 aa, artificial
  peptide fold or domain or sub-domain
MRIILCDTNEVVTNLWQESIPKYLCIHHG

SEQ ID NO: 13562 - protein, 23 aa, artificial
  peptide fold or domain or sub-domain
MRIYDFIVQKLLEANIKKDVKVM

SEQ ID NO: 13563 - protein, 26 aa, artificial
  peptide fold or domain or sub-domain
MRKEKVENEYLTSERLGNGEYLVKGV

SEQ ID NO: 13564 - protein, 26 aa, artificial
  peptide fold or domain or sub-domain
MRKFQSFDVTGTGMISVNCRQFLHMT

SEQ ID NO: 13565 - protein, 22 aa, artificial
  peptide fold or domain or sub-domain
MRKPELAAAIAEKADLTKEQAN

SEQ ID NO: 13566 - protein, 21 aa, artificial
  peptide fold or domain or sub-domain
MRLEGRFIKSLWFKNNWVDEM

SEQ ID NO: 13567 - protein, 26 aa, artificial
  peptide fold or domain or sub-domain
MRLFYELLQETAQRDKFLIRGYEYFE

SEQ ID NO: 13568 - protein, 29 aa, artificial
  peptide fold or domain or sub-domain
MRLWESRSDIGLVGNHIDVLTGKWVAQDA

SEQ ID NO: 13569 - protein, 21 aa, artificial
  peptide fold or domain or sub-domain
MRMSDLMKLTGCGKSSISNHV

SEQ ID NO: 13570 - protein, 23 aa, artificial
  peptide fold or domain or sub-domain
MRMYEYILHQLIKGNIEKSPEAL

SEQ ID NO: 13571 - protein, 28 aa, artificial
  peptide fold or domain or sub-domain
MRNIGLAVMEKMSAPELQIYQARQVYEE

SEQ ID NO: 13572 - protein, 26 aa, artificial
  peptide fold or domain or sub-domain
MRNKIFRQIKIVYPDATQSAIESIAE

SEQ ID NO: 13573 - protein, 26 aa, artificial
  peptide fold or domain or sub-domain
MRNKIKRQAGCLDSNLNENQIDELCD

SEQ ID NO: 13574 - protein, 27 aa, artificial
  peptide fold or domain or sub-domain
MRQMMEGVVLYGTGAKARLDGYSSGGK

SEQ ID NO: 13575 - protein, 22 aa, artificial
  peptide fold or domain or sub-domain
MRQSLEKEHGPERGRALFDELL

SEQ ID NO: 13576 - protein, 23 aa, artificial
  peptide fold or domain or sub-domain
MRRLVEIMVYDVERFATPELCAQ

SEQ ID NO: 13577 - protein, 28 aa, artificial
  peptide fold or domain or sub-domain
MRRRVNADLRRKGLGRDKVMACILRILG

SEQ ID NO: 13578 - protein, 28 aa, artificial
  peptide fold or domain or sub-domain
MRRVTGQHITQRPIDENVVLACMTRMLD

SEQ ID NO: 13579 - protein, 27 aa, artificial
  peptide fold or domain or sub-domain
MRSGIGARAELDQHGIPCQVDLPGVGK

SEQ ID NO: 13580 - protein, 27 aa, artificial
  peptide fold or domain or sub-domain
MRSGIGRENVLREAGVTCRVKAPELGL

SEQ ID NO: 13581 - protein, 20 aa, artificial
  peptide fold or domain or sub-domain
MRWQRQAGAPGDSRWKPYSV

SEQ ID NO: 13582 - protein, 30 aa, artificial
  peptide fold or domain or sub-domain
MSADDFIRNNRGIDDGKDLPADYMRSLYER

SEQ ID NO: 13583 - protein, 25 aa, artificial
  peptide fold or domain or sub-domain
MSADDIPALLNGGQVDNAASLIALQ

SEQ ID NO: 13584 - protein, 28 aa, artificial
  peptide fold or domain or sub-domain
MSAEDVYKALMEAGEDVGLATVYRVLTQ

SEQ ID NO: 13585 - protein, 22 aa, artificial
  peptide fold or domain or sub-domain
MSAESTWFQEYLNLNDTYKDFF

SEQ ID NO: 13586 - protein, 22 aa, artificial
  peptide fold or domain or sub-domain
MSAFGLARQLNIPRKEAQKYMD

SEQ ID NO: 13587 - protein, 22 aa, artificial
  peptide fold or domain or sub-domain
MSAHRLSGELSIPYEEAVAFIE

SEQ ID NO: 13588 - protein, 29 aa, artificial
  peptide fold or domain or sub-domain
MSATDKAVIDRLGQVSTGSLATALTEVHA

SEQ ID NO: 13589 - protein, 27 aa, artificial
  peptide fold or domain or sub-domain
MSAYEMRMAIESAGFKLNKKLYELIIT

SEQ ID NO: 13590 - protein, 30 aa, artificial
  peptide fold or domain or sub-domain
MSCADFSKNLRGVNAGKDFAPEFLQQIYDS

SEQ ID NO: 13591 - protein, 30 aa, artificial
  peptide fold or domain or sub-domain
MSCAEFVDNLADLNDGENFPKDVLKSLYQA

SEQ ID NO: 13592 - protein, 23 aa, artificial
  peptide fold or domain or sub-domain
MSDAKYCYGAQGRSPDIPPNAAL

SEQ ID NO: 13593 - protein, 25 aa, artificial
  peptide fold or domain or sub-domain
MSDILEAIERKKRGGELPEPLIRSV

SEQ ID NO: 13594 - protein, 28 aa, artificial
  peptide fold or domain or sub-domain
MSEFQREGLIETRNRRIALLNREALAER

SEQ ID NO: 13595 - protein, 29 aa, artificial
  peptide fold or domain or sub-domain
MSEHGTTQAQIDDVDKGNLVNEPSITCYM

SEQ ID NO: 13596 - protein, 30 aa, artificial
  peptide fold or domain or sub-domain
MSEQDFVLMVTAAEAASEVDAEKIAAIYKR

SEQ ID NO: 13597 - protein, 29 aa, artificial
  peptide fold or domain or sub-domain
MSFDELLRFVSEVQGERHAGLDYVQDIFH

SEQ ID NO: 13598 - protein, 25 aa, artificial
  peptide fold or domain or sub-domain
MSFDEMMALIRSGEICNGPLLLTAL

SEQ ID NO: 13599 - protein, 30 aa, artificial
  peptide fold or domain or sub-domain
MSFEDYSGNLKGCCNHKDFPFWYLDRIYCS

SEQ ID NO: 13600 - protein, 28 aa, artificial
  peptide fold or domain or sub-domain
MSFNNDDLVVDLRAHTVRKKGVVVNLTP

SEQ ID NO: 13601 - protein, 24 aa, artificial
  peptide fold or domain or sub-domain
MSGWTGADLSQYDLDEPITNIESN

SEQ ID NO: 13602 - protein, 21 aa, artificial
  peptide fold or domain or sub-domain
MSKLCDVVGLTSTSSIFALIK

SEQ ID NO: 13603 - protein, 21 aa, artificial
  peptide fold or domain or sub-domain
MSKQDMAKMIGASREMVSKVM

SEQ ID NO: 13604 - protein, 30 aa, artificial
  peptide fold or domain or sub-domain
MSKQQWLKMNSKNNGGADYDEQFLLGIYDR

SEQ ID NO: 13605 - protein, 30 aa, artificial
  peptide fold or domain or sub-domain
MSKSDFIKNHNDLILSSPKLVDSLEAFYDN

SEQ ID NO: 13606 - protein, 30 aa, artificial
  peptide fold or domain or sub-domain
MSKSDFTRMNATNDPEDCAPTELLEEIYDS

SEQ ID NO: 13607 - protein, 22 aa, artificial
  peptide fold or domain or sub-domain
MSKSSDWFKRFSDNEAPYNQFF

SEQ ID NO: 13608 - protein, 21 aa, artificial
  peptide fold or domain or sub-domain
MSKVSVPELNKTPIEDLRKIF

SEQ ID NO: 13609 - protein, 28 aa, artificial
  peptide fold or domain or sub-domain
MSKWKKQGIINTERGYIEIIDKKALEKL

SEQ ID NO: 13610 - protein, 30 aa, artificial
  peptide fold or domain or sub-domain
MSLDQYKRNLRGQCDGQDYEAEFLESIYND

SEQ ID NO: 13611 - protein, 25 aa, artificial
  peptide fold or domain or sub-domain
MSLELLTRIRERSTADFIADYARPL

SEQ ID NO: 13612 - protein, 25 aa, artificial
  peptide fold or domain or sub-domain
MSLPLNTQLKAILDDTFTPEDLAEV

SEQ ID NO: 13613 - protein, 30 aa, artificial
  peptide fold or domain or sub-domain
MSLQEFLENNEGIDNGRDLPRDFLEGLFNE

SEQ ID NO: 13614 - protein, 23 aa, artificial
  peptide fold or domain or sub-domain
MSMKDIISDILNATIDTADDLAD

SEQ ID NO: 13615 - protein, 20 aa, artificial
  peptide fold or domain or sub-domain
MSNAEIAEVMDTTIAAVESL

SEQ ID NO: 13616 - protein, 25 aa, artificial
  peptide fold or domain or sub-domain
MSNIQEALKTLLVQKNLTDDMAQKV

SEQ ID NO: 13617 - protein, 24 aa, artificial
  peptide fold or domain or sub-domain
MSNNETETTPSRIVGFYADWERTD

SEQ ID NO: 13618 - protein, 27 aa, artificial
  peptide fold or domain or sub-domain
MSPPPQPVGAADSTYFRFAIKVPAYKT

SEQ ID NO: 13619 - protein, 20 aa, artificial
  peptide fold or domain or sub-domain
MSPRLLEYIERSFGSQEKMV

SEQ ID NO: 13620 - protein, 27 aa, artificial
  peptide fold or domain or sub-domain
MSPSEIASKLPASTQHSDLPNRLDRML

SEQ ID NO: 13621 - protein, 23 aa, artificial
  peptide fold or domain or sub-domain
MSQRELKNELGAGIATITRGSNS

SEQ ID NO: 13622 - protein, 28 aa, artificial
  peptide fold or domain or sub-domain
MSRLHKQEVIALDKKHVVINQMDKLRAI

SEQ ID NO: 13623 - protein, 29 aa, artificial
  peptide fold or domain or sub-domain
MSRPKISEEMANYPSQGIFPDDKEFKCYV

SEQ ID NO: 13624 - protein, 22 aa, artificial
  peptide fold or domain or sub-domain
MSRQDGDHRRPEHLARNPFGKV

SEQ ID NO: 13625 - protein, 28 aa, artificial
  peptide fold or domain or sub-domain
MSRWRKEGLIRSGRGWVAVVDRERLAAI

SEQ ID NO: 13626 - protein, 27 aa, artificial
  peptide fold or domain or sub-domain
MSSLEMRDAVKEAGFQLNNDVLEVLIA

SEQ ID NO: 13627 - protein, 20 aa, artificial
  peptide fold or domain or sub-domain
MSSSMIKEIIFYGGNLDYFL

SEQ ID NO: 13628 - protein, 27 aa, artificial
  peptide fold or domain or sub-domain
MSSYELRTALKAAGFQLGSHLLQLIVL

SEQ ID NO: 13629 - protein, 22 aa, artificial
  peptide fold or domain or sub-domain
MSSYGLEQATELSLAEADKFIK

SEQ ID NO: 13630 - protein, 27 aa, artificial
  peptide fold or domain or sub-domain
MSTGSLRPSELNKLHKMCKIGWTETLL

SEQ ID NO: 13631 - protein, 29 aa, artificial
  peptide fold or domain or sub-domain
MSTTDQAAIHQAEMTGDFTTPAYLAANER

SEQ ID NO: 13632 - protein, 26 aa, artificial
  peptide fold or domain or sub-domain
MSTYELRTALKAAGFQLSSHLLQLIV

SEQ ID NO: 13633 - protein, 24 aa, artificial
  peptide fold or domain or sub-domain
MSVVDYYGVYYVDHSGVRVYYHQF

SEQ ID NO: 13634 - protein, 24 aa, artificial
  peptide fold or domain or sub-domain
MSWESKQFQDVLAKGEESEYYPMF

SEQ ID NO: 13635 - protein, 26 aa, artificial
  peptide fold or domain or sub-domain
MSWLKNGRKIHSNGRIKMYNSKLVIN

SEQ ID NO: 13636 - protein, 21 aa, artificial
  peptide fold or domain or sub-domain
MSYKAIGEKCGVSHERARQIY

SEQ ID NO: 13637 - protein, 20 aa, artificial
  peptide fold or domain or sub-domain
MSYKEIASTLEISVSAVDSL

SEQ ID NO: 13638 - protein, 20 aa, artificial
  peptide fold or domain or sub-domain
MSYQEISQCLSIPIGTVKTH

SEQ ID NO: 13639 - protein, 20 aa, artificial
  peptide fold or domain or sub-domain
MSYTDIAAVTELPLNTIKSH

SEQ ID NO: 13640 - protein, 27 aa, artificial
  peptide fold or domain or sub-domain
MTAAKAEQLIEQGIITDGMIVKVNAAL

SEQ ID NO: 13641 - protein, 25 aa, artificial
  peptide fold or domain or sub-domain
MTADRSPQGGVAFRMDEHAARLEIV

SEQ ID NO: 13642 - protein, 29 aa, artificial
  peptide fold or domain or sub-domain
MTAEEFTRFCISNDAAATVTPMRCASLFH

SEQ ID NO: 13643 - protein, 29 aa, artificial
  peptide fold or domain or sub-domain
MTAEQLCRFLVEVQDETEVLVSDAEKIIE

SEQ ID NO: 13644 - protein, 30 aa, artificial
  peptide fold or domain or sub-domain
MTAKELEADILGTMMVGGDFTDDELVDQML

SEQ ID NO: 13645 - protein, 25 aa, artificial
  peptide fold or domain or sub-domain
MTAMGWQYVSEARRRILQKADIASA

SEQ ID NO: 13646 - protein, 26 aa, artificial
  peptide fold or domain or sub-domain
MTAMRHEIETNHAPIKGDVTVLDTLL

SEQ ID NO: 13647 - protein, 25 aa, artificial
  peptide fold or domain or sub-domain
MTARALLVDTAALGEAQRAGDVLAA

SEQ ID NO: 13648 - protein, 30 aa, artificial
  peptide fold or domain or sub-domain
MTCQDFIKNNRGVDDGANLSDSFLTEVYEE

SEQ ID NO: 13649 - protein, 30 aa, artificial
  peptide fold or domain or sub-domain
MTCQEFIANLQGVDEGGDFSKDLLKALYNS

SEQ ID NO: 13650 - protein, 25 aa, artificial
  peptide fold or domain or sub-domain
MTDEDFAYLEEKYPGWEQHFGPFWT

SEQ ID NO: 13651 - protein, 21 aa, artificial
  peptide fold or domain or sub-domain
MTDHDVVSWLVENGPEFAGAT

SEQ ID NO: 13652 - protein, 26 aa, artificial
  peptide fold or domain or sub-domain
MTEAYANMEQTMRWYGDGKRNGSHFP

SEQ ID NO: 13653 - protein, 25 aa, artificial
  peptide fold or domain or sub-domain
MTEEQREWLSYGCVGVTWVNSGQYP

SEQ ID NO: 13654 - protein, 21 aa, artificial
  peptide fold or domain or sub-domain
MTEIMQLLNLDLADDSLMETP

SEQ ID NO: 13655 - protein, 24 aa, artificial
  peptide fold or domain or sub-domain
MTEKEIVDYVASQVTTAKKLRGGV

SEQ ID NO: 13656 - protein, 29 aa, artificial
  peptide fold or domain or sub-domain
MTEYGNALNVFASDLDVDAVVEALQDAAK

SEQ ID NO: 13657 - protein, 25 aa, artificial
  peptide fold or domain or sub-domain
MTFDQFETAIAKGEMIDAKSIASYF

SEQ ID NO: 13658 - protein, 28 aa, artificial
  peptide fold or domain or sub-domain
MTFEDGTYITRQQMELMYEPDFVSALMQ

SEQ ID NO: 13659 - protein, 30 aa, artificial
  peptide fold or domain or sub-domain
MTFEQLKNNLKGTNESKNFNDNFLKKIYDE

SEQ ID NO: 13660 - protein, 21 aa, artificial
  peptide fold or domain or sub-domain
MTFSELLEYSRIPKSSLTMHL

SEQ ID NO: 13661 - protein, 25 aa, artificial
  peptide fold or domain or sub-domain
MTFTAAVPEAVPTKRKWEEESEPER

SEQ ID NO: 13662 - protein, 30 aa, artificial
  peptide fold or domain or sub-domain
MTGLGLVFDNLMCNVQPENAKLRQRCTSII

SEQ ID NO: 13663 - protein, 29 aa, artificial
  peptide fold or domain or sub-domain
MTGLQPIYVTENLCTMSIGYLVATETAVV

SEQ ID NO: 13664 - protein, 25 aa, artificial
  peptide fold or domain or sub-domain
MTGRTLASIAAEWGVDQKAVCRRLQ

SEQ ID NO: 13665 - protein, 28 aa, artificial
  peptide fold or domain or sub-domain
MTIDEQVSYLTKGCVDVVRPGELRAKLE

SEQ ID NO: 13666 - protein, 29 aa, artificial
  peptide fold or domain or sub-domain
MTIEESEDEWGVPHCLTLRGQRQSIIVAA

SEQ ID NO: 13667 - protein, 22 aa, artificial
  peptide fold or domain or sub-domain
MTKADIIEGVYEKVGFSKKESA

SEQ ID NO: 13668 - protein, 29 aa, artificial
  peptide fold or domain or sub-domain
MTKADIIEGVYEKVGFSKKESAEIVELVF

SEQ ID NO: 13669 - protein, 22 aa, artificial
  peptide fold or domain or sub-domain
MTKADLIDEVSRLAELTRKDSE

SEQ ID NO: 13670 - protein, 29 aa, artificial
  peptide fold or domain or sub-domain
MTKADLIDEVSRLAELTRKDSEVIVETIF

SEQ ID NO: 13671 - protein, 22 aa, artificial
  peptide fold or domain or sub-domain
MTKADLIDQIADGTGLTKIETR

SEQ ID NO: 13672 - protein, 29 aa, artificial
  peptide fold or domain or sub-domain
MTKADLIDQIADGTGLTKIETRAVVEGFM

SEQ ID NO: 13673 - protein, 30 aa, artificial
  peptide fold or domain or sub-domain
MTKAKFVKSLSKINSGKDLPSEFLEDMFDR

SEQ ID NO: 13674 - protein, 28 aa, artificial
  peptide fold or domain or sub-domain
MTKDLLALLKERGLFVQANFEKELKQLL

SEQ ID NO: 13675 - protein, 30 aa, artificial
  peptide fold or domain or sub-domain
MTKDTFFNNTKGIDTANILTRELLDSIYDN

SEQ ID NO: 13676 - protein, 23 aa, artificial
  peptide fold or domain or sub-domain
MTKIINTQLRDKKLNLQLASDFY

SEQ ID NO: 13677 - protein, 22 aa, artificial
  peptide fold or domain or sub-domain
MTKKDLINEIIANENISKVECE

SEQ ID NO: 13678 - protein, 29 aa, artificial
  peptide fold or domain or sub-domain
MTKKDLINEIIANENISKVECEAVVNSLF

SEQ ID NO: 13679 - protein, 22 aa, artificial
  peptide fold or domain or sub-domain
MTKKEFMQKISEHSFISQRDVE

SEQ ID NO: 13680 - protein, 22 aa, artificial
  peptide fold or domain or sub-domain
MTKKEIVRVISEELGLTQQETK

SEQ ID NO: 13681 - protein, 29 aa, artificial
  peptide fold or domain or sub-domain
MTKKEIVRVISEELGLTQQETKEVVQRTF

SEQ ID NO: 13682 - protein, 30 aa, artificial
  peptide fold or domain or sub-domain
MTKQGYINMNRGINEGGNIPVELLEAIFED

SEQ ID NO: 13683 - protein, 30 aa, artificial
  peptide fold or domain or sub-domain
MTKRSFVQNNTGFKGKKDLPIEYLESLYDR

SEQ ID NO: 13684 - protein, 29 aa, artificial
  peptide fold or domain or sub-domain
MTKSELILTIAAQKGLTKQAAAMVVDMVF

SEQ ID NO: 13685 - protein, 25 aa, artificial
  peptide fold or domain or sub-domain
MTKYLTPKSPVFIAQVGQDLVSQTE

SEQ ID NO: 13686 - protein, 30 aa, artificial
  peptide fold or domain or sub-domain
MTLAQFTNLAKGINDGENLPQEMLQGFYLR

SEQ ID NO: 13687 - protein, 21 aa, artificial
  peptide fold or domain or sub-domain
MTLKQIAEILNISKQRAGQIE

SEQ ID NO: 13688 - protein, 29 aa, artificial
  peptide fold or domain or sub-domain
MTLKVDGAPCERPDAEVQSAATHLHAGEA

SEQ ID NO: 13689 - protein, 22 aa, artificial
  peptide fold or domain or sub-domain
MTLLRGDKLMEEFLKVNPQQTI

SEQ ID NO: 13690 - protein, 20 aa, artificial
  peptide fold or domain or sub-domain
MTLLRGEVIAKNGKFVGQKG

SEQ ID NO: 13691 - protein, 28 aa, artificial
  peptide fold or domain or sub-domain
MTLLRGVAEDLSFEEWLFSKVLPIEDRL

SEQ ID NO: 13692 - protein, 21 aa, artificial
  peptide fold or domain or sub-domain
MTLNDPNDYIKQGRERDFIDA

SEQ ID NO: 13693 - protein, 22 aa, artificial
  peptide fold or domain or sub-domain
MTLSELSSRLPSQPVNEDALYR

SEQ ID NO: 13694 - protein, 22 aa, artificial
  peptide fold or domain or sub-domain
MTLSQICSALNIQPNKTQAMER

SEQ ID NO: 13695 - protein, 22 aa, artificial
  peptide fold or domain or sub-domain
MTLSQLLQSIPINKEKTQCFQR

SEQ ID NO: 13696 - protein, 20 aa, artificial
  peptide fold or domain or sub-domain
MTLSRGRIAFDKGQVTAKPG

SEQ ID NO: 13697 - protein, 20 aa, artificial
  peptide fold or domain or sub-domain
MTLVRGSVVFDGDIEVSPGY

SEQ ID NO: 13698 - protein, 27 aa, artificial
  peptide fold or domain or sub-domain
MTMNDLCRALGVTKPAVYYYFTDKYEI

SEQ ID NO: 13699 - protein, 29 aa, artificial
  peptide fold or domain or sub-domain
MTMRRVAKQLNVAPGALYWHFKNKQELID

SEQ ID NO: 13700 - protein, 20 aa, artificial
  peptide fold or domain or sub-domain
MTNESILESYSGVTPERKKS

SEQ ID NO: 13701 - protein, 25 aa, artificial
  peptide fold or domain or sub-domain
MTNPEILRVLKEKFKFEENIDDVLK

SEQ ID NO: 13702 - protein, 28 aa, artificial
  peptide fold or domain or sub-domain
MTPDIILQRTGIDVRAVEQGDDAWHKLR

SEQ ID NO: 13703 - protein, 22 aa, artificial
  peptide fold or domain or sub-domain
MTPDRMFAPDIMGMNLVPYMRA

SEQ ID NO: 13704 - protein, 29 aa, artificial
  peptide fold or domain or sub-domain
MTPEADLRPRHIVSSFKGLRFDLQFRKQR

SEQ ID NO: 13705 - protein, 29 aa, artificial
  peptide fold or domain or sub-domain
MTPEDQKVIHYCHEIGATDAQVYKDVSYR

SEQ ID NO: 13706 - protein, 28 aa, artificial
  peptide fold or domain or sub-domain
MTPEEQVKILKRNVVDLISEEELLDRIK

SEQ ID NO: 13707 - protein, 22 aa, artificial
  peptide fold or domain or sub-domain
MTQAALRGGRFIAAATPHARTA

SEQ ID NO: 13708 - protein, 28 aa, artificial
  peptide fold or domain or sub-domain
MTQAALRGGRFIAAATPHARTAAAADAM

SEQ ID NO: 13709 - protein, 21 aa, artificial
  peptide fold or domain or sub-domain
MTQSQIAQEVGISQMHVSRLL

SEQ ID NO: 13710 - protein, 21 aa, artificial
  peptide fold or domain or sub-domain
MTRGDIGNYLGLTVETISRLL

SEQ ID NO: 13711 - protein, 21 aa, artificial
  peptide fold or domain or sub-domain
MTRMGYPCAYESAKEIMEEIS

SEQ ID NO: 13712 - protein, 21 aa, artificial
  peptide fold or domain or sub-domain
MTRYKEVNKGSLSDADYKSMQ

SEQ ID NO: 13713 - protein, 20 aa, artificial
  peptide fold or domain or sub-domain
MTSLGRTAEAEGEKAIWADL

SEQ ID NO: 13714 - protein, 23 aa, artificial
  peptide fold or domain or sub-domain
MTSLGRTAEAEGEKAIWADLRQK

SEQ ID NO: 13715 - protein, 28 aa, artificial
  peptide fold or domain or sub-domain
MTSLGRTAEAEGEKAIWADLRQKLFIDP

SEQ ID NO: 13716 - protein, 20 aa, artificial
  peptide fold or domain or sub-domain
MTSTWWKKLPFYRFYMLREG

SEQ ID NO: 13717 - protein, 22 aa, artificial
  peptide fold or domain or sub-domain
MTTIAAHYGEKFTPEINCAAEK

SEQ ID NO: 13718 - protein, 25 aa, artificial
  peptide fold or domain or sub-domain
MTTKEVTEFWYQQHPWQGDSLVSVE

SEQ ID NO: 13719 - protein, 22 aa, artificial
  peptide fold or domain or sub-domain
MTTVTASQGLRASGVKSKKGRS

SEQ ID NO: 13720 - protein, 30 aa, artificial
  peptide fold or domain or sub-domain
MTVEDFLRNLRGLNGNSDFDQEMLTKIYHA

SEQ ID NO: 13721 - protein, 21 aa, artificial
  peptide fold or domain or sub-domain
MTVGELKRALGFSWGDLDSKL

SEQ ID NO: 13722 - protein, 20 aa, artificial
  peptide fold or domain or sub-domain
MVANFPAPPTEEASTAIWRE

SEQ ID NO: 13723 - protein, 28 aa, artificial
  peptide fold or domain or sub-domain
MVATLIEYGIVNENTWCLEEFESYLEVQ

SEQ ID NO: 13724 - protein, 23 aa, artificial
  peptide fold or domain or sub-domain
MVCDETIADDSEGVLAFLEEKGH

SEQ ID NO: 13725 - protein, 24 aa, artificial
  peptide fold or domain or sub-domain
MVDEQGGLTMSSCTLSVLEELATE

SEQ ID NO: 13726 - protein, 22 aa, artificial
  peptide fold or domain or sub-domain
MVDGEVVDCGLECYMHGSFFDL

SEQ ID NO: 13727 - protein, 20 aa, artificial
  peptide fold or domain or sub-domain
MVDPVGFAEAWKAQFPDSEP

SEQ ID NO: 13728 - protein, 25 aa, artificial
  peptide fold or domain or sub-domain
MVDQLIARVRDTGKMEIVGELACPL

SEQ ID NO: 13729 - protein, 24 aa, artificial
  peptide fold or domain or sub-domain
MVDSCGECENCRRGEEQYCHQGNV

SEQ ID NO: 13730 - protein, 27 aa, artificial
  peptide fold or domain or sub-domain
MVFVGAGYFLGLHAPGRRGMKNFLPAI

SEQ ID NO: 13731 - protein, 25 aa, artificial
  peptide fold or domain or sub-domain
MVGDGSLKSEMNIHWCENEWVLLNA

SEQ ID NO: 13732 - protein, 25 aa, artificial
  peptide fold or domain or sub-domain
MVGENAEDSPDYLVYCADESEVFRR

SEQ ID NO: 13733 - protein, 24 aa, artificial
  peptide fold or domain or sub-domain
MVGGQLFNNNKSLLKELKIDGYAE

SEQ ID NO: 13734 - protein, 24 aa, artificial
  peptide fold or domain or sub-domain
MVGGYPFNVDIKLWKKVGADLHAA

SEQ ID NO: 13735 - protein, 25 aa, artificial
  peptide fold or domain or sub-domain
MVGKSIAEIAAIQKKPPLEEVLDLL

SEQ ID NO: 13736 - protein, 27 aa, artificial
  peptide fold or domain or sub-domain
MVGYRQSISLIERGNPSRSLDQVCRWA

SEQ ID NO: 13737 - protein, 24 aa, artificial
  peptide fold or domain or sub-domain
MVKKKVVFCPVKEALEVDWSSEKA

SEQ ID NO: 13738 - protein, 30 aa, artificial
  peptide fold or domain or sub-domain
MVKSGKVYQNLMINVVPTNGKTFERAKKII

SEQ ID NO: 13739 - protein, 24 aa, artificial
  peptide fold or domain or sub-domain
MVKWMIEALEEQGLTDAYYHGVSR

SEQ ID NO: 13740 - protein, 27 aa, artificial
  peptide fold or domain or sub-domain
MVLGGADKGPKVSSNAALTLRNFCSWQ

SEQ ID NO: 13741 - protein, 27 aa, artificial
  peptide fold or domain or sub-domain
MVLGPEAREYRAKSGFAWKAEAAAGEA

SEQ ID NO: 13742 - protein, 26 aa, artificial
  peptide fold or domain or sub-domain
MVLIQRRAYVDLVQGSVIDIAISPQQ

SEQ ID NO: 13743 - protein, 21 aa, artificial
  peptide fold or domain or sub-domain
MVLTKDLDLEKLFPYRGWLLE

SEQ ID NO: 13744 - protein, 24 aa, artificial
  peptide fold or domain or sub-domain
MVNALTTIAIEEQRLTVKDYSEAR

SEQ ID NO: 13745 - protein, 21 aa, artificial
  peptide fold or domain or sub-domain
MVNREGAYYMRTVQWENKARV

SEQ ID NO: 13746 - protein, 28 aa, artificial
  peptide fold or domain or sub-domain
MVNWLCENRVFTEDKWKLVDFNQYTLLS

SEQ ID NO: 13747 - protein, 27 aa, artificial
  peptide fold or domain or sub-domain
MVRKGWLEGGPGAAGDRRGADDFVEIT

SEQ ID NO: 13748 - protein, 29 aa, artificial
  peptide fold or domain or sub-domain
MVRMVAALQATASSQKLAPANWRPGEPLL

SEQ ID NO: 13749 - protein, 27 aa, artificial
  peptide fold or domain or sub-domain
MVRREFLEKGVNADRSTRGNGDFVRVS

SEQ ID NO: 13750 - protein, 20 aa, artificial
  peptide fold or domain or sub-domain
MVSANRNRESYAGFGCPVIA

SEQ ID NO: 13751 - protein, 27 aa, artificial
  peptide fold or domain or sub-domain
MVSFTGGTNTGKHLAKKASMIPLVLEL

SEQ ID NO: 13752 - protein, 27 aa, artificial
  peptide fold or domain or sub-domain
MVSGIGPKAQLDKYAITPVVVNENVGQ

SEQ ID NO: 13753 - protein, 24 aa, artificial
  peptide fold or domain or sub-domain
MVVELCSLIEKNKLEEARQIHYNL

SEQ ID NO: 13754 - protein, 26 aa, artificial
  peptide fold or domain or sub-domain
MVVELCSLIEKNKLEEARQIHYNLAP

SEQ ID NO: 13755 - protein, 22 aa, artificial
  peptide fold or domain or sub-domain
MVVKFFEKNPGIQKMLTRFQRE

SEQ ID NO: 13756 - protein, 25 aa, artificial
  peptide fold or domain or sub-domain
MVWVTSVSWGEITKNKWDQDAAFNQ

SEQ ID NO: 13757 - protein, 30 aa, artificial
  peptide fold or domain or sub-domain
MVYAVEQIPWAGRQLTIMANRRSNIVPIVE

SEQ ID NO: 13758 - protein, 27 aa, artificial
  peptide fold or domain or sub-domain
MVYVMMGYLTAYWPPFIKSPFKAFKVA

SEQ ID NO: 13759 - protein, 27 aa, artificial
  peptide fold or domain or sub-domain
MWIGRVYSDGSGNDYAESFKGRAEITR

SEQ ID NO: 13760 - protein, 30 aa, artificial
  peptide fold or domain or sub-domain
MWKRYEPKVYASYENFVNKPEMFWKMCNEL

SEQ ID NO: 13761 - protein, 27 aa, artificial
  peptide fold or domain or sub-domain
MWVVLLEDGIEFYKKKSDNSPKGMIPL

SEQ ID NO: 13762 - protein, 24 aa, artificial
  peptide fold or domain or sub-domain
MYELCLLLAESRFDPSSHPSVVVK

SEQ ID NO: 13763 - protein, 28 aa, artificial
  peptide fold or domain or sub-domain
MYGQYLDVMGTGPDDDIDAALRIARYKT

SEQ ID NO: 13764 - protein, 21 aa, artificial
  peptide fold or domain or sub-domain
MYKEKVMERGEDIEKVMQSIY

SEQ ID NO: 13765 - protein, 23 aa, artificial
  peptide fold or domain or sub-domain
MYNNIHSQMSEDEIFSIFKERQV

SEQ ID NO: 13766 - protein, 22 aa, artificial
  peptide fold or domain or sub-domain
MYPADGRKLPDIYSQPENLRSR

SEQ ID NO: 13767 - protein, 25 aa, artificial
  peptide fold or domain or sub-domain
MYRYNDLTINFNSMEVCVNEKPINL

SEQ ID NO: 13768 - protein, 23 aa, artificial
  peptide fold or domain or sub-domain
MYVGAQRGLENKIVPETGMPFRT

SEQ ID NO: 13769 - protein, 29 aa, artificial
  peptide fold or domain or sub-domain
MYVSDEQPNKDWFQASIGGKKGLVPANYV

SEQ ID NO: 13770 - protein, 29 aa, artificial
  peptide fold or domain or sub-domain
NAANSDFTATNIHVTSHGTEFTLQTPTGS

SEQ ID NO: 13771 - protein, 21 aa, artificial
  peptide fold or domain or sub-domain
NADATIYKIVGNLLVKSDKTS

SEQ ID NO: 13772 - protein, 29 aa, artificial
  peptide fold or domain or sub-domain
NADDIMLAMNKLGFEHYNKPLRNYHNKWK

SEQ ID NO: 13773 - protein, 30 aa, artificial
  peptide fold or domain or sub-domain
NADFDQHKFFNLDGSNFPHDNETTIRKFKA

SEQ ID NO: 13774 - protein, 22 aa, artificial
  peptide fold or domain or sub-domain
NADMTKVNNKTNDSSFSENAAG

SEQ ID NO: 13775 - protein, 21 aa, artificial
  peptide fold or domain or sub-domain
NADVAEGLRKAGFEAVEKSQV

SEQ ID NO: 13776 - protein, 27 aa, artificial
  peptide fold or domain or sub-domain
NAEDVLKRLLTENPQTEENVEFIFRLT

SEQ ID NO: 13777 - protein, 29 aa, artificial
  peptide fold or domain or sub-domain
NAEHVLEALDRLGFKDYKQEAEAVLNDCK

SEQ ID NO: 13778 - protein, 24 aa, artificial
  peptide fold or domain or sub-domain
NAEKFADPEQRADVESMIPMGYIG

SEQ ID NO: 13779 - protein, 24 aa, artificial
  peptide fold or domain or sub-domain
NAELLSDPMMKQYATTISAFNRLG

SEQ ID NO: 13780 - protein, 29 aa, artificial
  peptide fold or domain or sub-domain
NAEVYVCGPLGMLETVRQHWHAAGRPRAR

SEQ ID NO: 13781 - protein, 24 aa, artificial
  peptide fold or domain or sub-domain
NAFPNPKSDNSSYNSMPGVDPVNG

SEQ ID NO: 13782 - protein, 22 aa, artificial
  peptide fold or domain or sub-domain
NAGAVISNLETNQKLGFGGPNM

SEQ ID NO: 13783 - protein, 30 aa, artificial
  peptide fold or domain or sub-domain
NAGEKIILPDPSYPCYKNFAYLLDAQPVFV

SEQ ID NO: 13784 - protein, 29 aa, artificial
  peptide fold or domain or sub-domain
NAGFDSLRILLPSISDGEKMSKATILQLT

SEQ ID NO: 13785 - protein, 21 aa, artificial
  peptide fold or domain or sub-domain
NAGLDAMYKYSQGSCYWTAKF

SEQ ID NO: 13786 - protein, 21 aa, artificial
  peptide fold or domain or sub-domain
NAGLSWTMWSYKATHGLVPDS

SEQ ID NO: 13787 - protein, 23 aa, artificial
  peptide fold or domain or sub-domain
NAGSAVDKSLVEDPKLLASVEHP

SEQ ID NO: 13788 - protein, 25 aa, artificial
  peptide fold or domain or sub-domain
NAHELRKKLFEEKRRHINTTSDSEI

SEQ ID NO: 13789 - protein, 26 aa, artificial
  peptide fold or domain or sub-domain
NAHQALSIFINQMIYDLKHLGEDVTV

SEQ ID NO: 13790 - protein, 30 aa, artificial
  peptide fold or domain or sub-domain
NAIDFARRFADQHACRVRAHEKFVTAVVIF

SEQ ID NO: 13791 - protein, 30 aa, artificial
  peptide fold or domain or sub-domain
NAIELAKELARRHGVNVHPFPEFGTAHLKI

SEQ ID NO: 13792 - protein, 30 aa, artificial
  peptide fold or domain or sub-domain
NAIKFGQGLLEGFNYKATLHPRFNNLSADI

SEQ ID NO: 13793 - protein, 30 aa, artificial
  peptide fold or domain or sub-domain
NAIVQTRDVGQAVRVSEALEVGTVWVNDWF

SEQ ID NO: 13794 - protein, 20 aa, artificial
  peptide fold or domain or sub-domain
NAKAGRRTQNARKGESYDQT

SEQ ID NO: 13795 - protein, 26 aa, artificial
  peptide fold or domain or sub-domain
NAKAIALLATNGGEIGDYEGVNQSKK

SEQ ID NO: 13796 - protein, 22 aa, artificial
  peptide fold or domain or sub-domain
NAKDMANASENGISKIMQDRLL

SEQ ID NO: 13797 - protein, 27 aa, artificial
  peptide fold or domain or sub-domain
NAKIVVGNTEIGIETRFRSIVYPTIIC

SEQ ID NO: 13798 - protein, 26 aa, artificial
  peptide fold or domain or sub-domain
NAKKLAEIGFSAIPHNMSMEAHVKRF

SEQ ID NO: 13799 - protein, 23 aa, artificial
  peptide fold or domain or sub-domain
NAKKMAKIMASIANGGVCPFTSK

SEQ ID NO: 13800 - protein, 27 aa, artificial
  peptide fold or domain or sub-domain
NAKLIVGNTEVGVEMKFKNLLYAVLIN

SEQ ID NO: 13801 - protein, 24 aa, artificial
  peptide fold or domain or sub-domain
NAKLLDDPEIRNFAANSSVFGRIG

SEQ ID NO: 13802 - protein, 30 aa, artificial
  peptide fold or domain or sub-domain
NAKQELLIPFLKMLRSIGGGFLVSESGIEF

SEQ ID NO: 13803 - protein, 23 aa, artificial
  peptide fold or domain or sub-domain
NALDDPKVLEIGRKYGKTGGQVI

SEQ ID NO: 13804 - protein, 30 aa, artificial
  peptide fold or domain or sub-domain
NALEFAEYAKRFLPGKLVKHDKFMTASLFL

SEQ ID NO: 13805 - protein, 29 aa, artificial
  peptide fold or domain or sub-domain
NALMDRNFGPILRGSRPATSLAGLSRSVD

SEQ ID NO: 13806 - protein, 24 aa, artificial
  peptide fold or domain or sub-domain
NALRAQVAINDGNPDEAERLAKLA

SEQ ID NO: 13807 - protein, 26 aa, artificial
  peptide fold or domain or sub-domain
NALTGLGPAFLFGPAPVWTVDRLEAE

SEQ ID NO: 13808 - protein, 22 aa, artificial
  peptide fold or domain or sub-domain
NALYRYMVKKKGAEDAGDRFGR

SEQ ID NO: 13809 - protein, 30 aa, artificial
  peptide fold or domain or sub-domain
NAMFCYQCQETVGNKGCTQVGVCGKKPETA

SEQ ID NO: 13810 - protein, 29 aa, artificial
  peptide fold or domain or sub-domain
NAMFSSLRSCLPASDQSKKLSVSATVSQA

SEQ ID NO: 13811 - protein, 23 aa, artificial
  peptide fold or domain or sub-domain
NANCLNCEYCKTGHEPLCDHIQN

SEQ ID NO: 13812 - protein, 30 aa, artificial
  peptide fold or domain or sub-domain
NANCLNCEYCKTGHEPLCDHIQNYGIDRHG

SEQ ID NO: 13813 - protein, 28 aa, artificial
  peptide fold or domain or sub-domain
NANIQEAIHVSEEFRNWDLEMAEKEYCR

SEQ ID NO: 13814 - protein, 26 aa, artificial
  peptide fold or domain or sub-domain
NANVRRFVDDEVGKGDFSRAEWQDFF

SEQ ID NO: 13815 - protein, 28 aa, artificial
  peptide fold or domain or sub-domain
NAPRPMLVTAATDDLSQANLAAGGGLRT

SEQ ID NO: 13816 - protein, 26 aa, artificial
  peptide fold or domain or sub-domain
NAPWSHFTKFDSDIWKAAYTARDLGF

SEQ ID NO: 13817 - protein, 23 aa, artificial
  peptide fold or domain or sub-domain
NAQFLDMVANETGLTDLTLETVW

SEQ ID NO: 13818 - protein, 29 aa, artificial
  peptide fold or domain or sub-domain
NAQKLAQIGMPFDNREQLLDEIQIEFEFL

SEQ ID NO: 13819 - protein, 30 aa, artificial
  peptide fold or domain or sub-domain
NAQPDTLDAVLAKLREAGADIETGEDWISL

SEQ ID NO: 13820 - protein, 27 aa, artificial
  peptide fold or domain or sub-domain
NARDIGMQLQQVSFFSKADGPYFSDLL

SEQ ID NO: 13821 - protein, 22 aa, artificial
  peptide fold or domain or sub-domain
NARDLDEARAAGLEAALIDRLT

SEQ ID NO: 13822 - protein, 24 aa, artificial
  peptide fold or domain or sub-domain
NARFDAFITGDSKALNASEKRGWA

SEQ ID NO: 13823 - protein, 30 aa, artificial
  peptide fold or domain or sub-domain
NARINHLRAVVEKLKLIGGEVVEENGNLRV

SEQ ID NO: 13824 - protein, 20 aa, artificial
  peptide fold or domain or sub-domain
NARISAARTQDCAALFSASE

SEQ ID NO: 13825 - protein, 27 aa, artificial
  peptide fold or domain or sub-domain
NARKRLLKYLRNEDKDRFFKICIALNI

SEQ ID NO: 13826 - protein, 20 aa, artificial
  peptide fold or domain or sub-domain
NARTGRETEMCGGKLSFDDV

SEQ ID NO: 13827 - protein, 29 aa, artificial
  peptide fold or domain or sub-domain
NASDVLSAMEEMEFQRFVTPLKEALEAYR

SEQ ID NO: 13828 - protein, 20 aa, artificial
  peptide fold or domain or sub-domain
NASNGRGPECIQDPEPPDPR

SEQ ID NO: 13829 - protein, 25 aa, artificial
  peptide fold or domain or sub-domain
NASRKLVERALEALDAQDTDPEAAH

SEQ ID NO: 13830 - protein, 29 aa, artificial
  peptide fold or domain or sub-domain
NATDVFAALDDMEFSEFTEPLRANLEVFR

SEQ ID NO: 13831 - protein, 29 aa, artificial
  peptide fold or domain or sub-domain
NATECEAEADGTPVIKHWWDLTEDDIQAD

SEQ ID NO: 13832 - protein, 30 aa, artificial
  peptide fold or domain or sub-domain
NATFEALLDQAIGLKDKAERAKLYQKAQVL

SEQ ID NO: 13833 - protein, 20 aa, artificial
  peptide fold or domain or sub-domain
NATKEQVDRSNEDLRNLIKQ

SEQ ID NO: 13834 - protein, 27 aa, artificial
  peptide fold or domain or sub-domain
NATLVAGATDVALWVNKDFRVLIEIIS

SEQ ID NO: 13835 - protein, 28 aa, artificial
  peptide fold or domain or sub-domain
NATPFSPAPGSPLVPNGDPMLSGFGPAA

SEQ ID NO: 13836 - protein, 21 aa, artificial
  peptide fold or domain or sub-domain
NAVAVTEQLLSVSPDLAKNLT

SEQ ID NO: 13837 - protein, 30 aa, artificial
  peptide fold or domain or sub-domain
NAVFGYYLEVTRPYYERVPKEYRPVQTLKD

SEQ ID NO: 13838 - protein, 27 aa, artificial
  peptide fold or domain or sub-domain
NAVFLSESISELIRLNDTIVEIHAQKC

SEQ ID NO: 13839 - protein, 30 aa, artificial
  peptide fold or domain or sub-domain
NAVHGYYIQISRGQSHLAPINYMRRQTLKN

SEQ ID NO: 13840 - protein, 21 aa, artificial
  peptide fold or domain or sub-domain
NAVHYLDTVLSSGSSLAKEIT

SEQ ID NO: 13841 - protein, 21 aa, artificial
  peptide fold or domain or sub-domain
NAVKVVRDLMNVSSSSAKSIL

SEQ ID NO: 13842 - protein, 21 aa, artificial
  peptide fold or domain or sub-domain
NAVQMVMRMQDTTEESAKQIV

SEQ ID NO: 13843 - protein, 21 aa, artificial
  peptide fold or domain or sub-domain
NAVWILMRVEQLNAQAALDRL

SEQ ID NO: 13844 - protein, 21 aa, artificial
  peptide fold or domain or sub-domain
NAVWLFMQWNNVDVATAKKLV

SEQ ID NO: 13845 - protein, 29 aa, artificial
  peptide fold or domain or sub-domain
NAVYLHGACAELWTDEHSAHTLLAHELSD

SEQ ID NO: 13846 - protein, 22 aa, artificial
  peptide fold or domain or sub-domain
NAWCPADAVYLDSEEERQEYVL

SEQ ID NO: 13847 - protein, 29 aa, artificial
  peptide fold or domain or sub-domain
NAWRLIRGEVKLNMYTIEAVSEAVLRQKV

SEQ ID NO: 13848 - protein, 25 aa, artificial
  peptide fold or domain or sub-domain
NAYAPEHLVIVTKDHYKTLESINNA

SEQ ID NO: 13849 - protein, 21 aa, artificial
  peptide fold or domain or sub-domain
NCELKDGSKILEIYKRKSIVE

SEQ ID NO: 13850 - protein, 25 aa, artificial
  peptide fold or domain or sub-domain
NCFESSTRLLRMKGSKASFPNICAS

SEQ ID NO: 13851 - protein, 28 aa, artificial
  peptide fold or domain or sub-domain
NCFGLMQINKHYHAVKGNAYSSEHIDQG

SEQ ID NO: 13852 - protein, 20 aa, artificial
  peptide fold or domain or sub-domain
NCFIKKMVDENKIYKQRYLD

SEQ ID NO: 13853 - protein, 21 aa, artificial
  peptide fold or domain or sub-domain
NCFLQSYFLNLGVYPEVVQMM

SEQ ID NO: 13854 - protein, 22 aa, artificial
  peptide fold or domain or sub-domain
NCFSVLTNPETKDKKSLRTNII

SEQ ID NO: 13855 - protein, 20 aa, artificial
  peptide fold or domain or sub-domain
NCGHCQPCAEGRPALCEPGA

SEQ ID NO: 13856 - protein, 26 aa, artificial
  peptide fold or domain or sub-domain
NCGIYDVSGIPNAPGIGGWGFRIALW

SEQ ID NO: 13857 - protein, 20 aa, artificial
  peptide fold or domain or sub-domain
NCGLHEFRCDNGVCISKRFV

SEQ ID NO: 13858 - protein, 20 aa, artificial
  peptide fold or domain or sub-domain
NCGYPDITMDQCSKKGCCYD

SEQ ID NO: 13859 - protein, 20 aa, artificial
  peptide fold or domain or sub-domain
NCGYPGISPEDCAARNCCFS

SEQ ID NO: 13860 - protein, 23 aa, artificial
  peptide fold or domain or sub-domain
NCHDLAVMAATLANRGVNPITGE

SEQ ID NO: 13861 - protein, 30 aa, artificial
  peptide fold or domain or sub-domain
NCKLIISSRNEEALKIVKNNCTHKENVIVL

SEQ ID NO: 13862 - protein, 23 aa, artificial
  peptide fold or domain or sub-domain
NCKSPANVDAAKLYTDDYPMYKK

SEQ ID NO: 13863 - protein, 27 aa, artificial
  peptide fold or domain or sub-domain
NCLEKRSEVDKIVYEDPDKNNGFLLLQ

SEQ ID NO: 13864 - protein, 22 aa, artificial
  peptide fold or domain or sub-domain
NCLKDHVTFNNGGLNRPNYLSK

SEQ ID NO: 13865 - protein, 26 aa, artificial
  peptide fold or domain or sub-domain
NCNNRLRRLIALRAPQSIVAAEHDLL

SEQ ID NO: 13866 - protein, 20 aa, artificial
  peptide fold or domain or sub-domain
NCNVKHQLEIGNIAQFRYDH

SEQ ID NO: 13867 - protein, 20 aa, artificial
  peptide fold or domain or sub-domain
NCNVKLNLNSNLVPEFRYKN

SEQ ID NO: 13868 - protein, 29 aa, artificial
  peptide fold or domain or sub-domain
NCPNAVTCTNSQHCVKANTCTGSTDCNTA

SEQ ID NO: 13869 - protein, 29 aa, artificial
  peptide fold or domain or sub-domain
NCQNGENCQNGENCQNGENCQNGENCQNG

SEQ ID NO: 13870 - protein, 27 aa, artificial
  peptide fold or domain or sub-domain
NCRDLGNCMRTMGYMPTEMELIELSQQ

SEQ ID NO: 13871 - protein, 20 aa, artificial
  peptide fold or domain or sub-domain
NCTDDQFECLNGFCIPRTWV

SEQ ID NO: 13872 - protein, 21 aa, artificial
  peptide fold or domain or sub-domain
NCTLLNGTLAQKCYQCKNIRE

SEQ ID NO: 13873 - protein, 24 aa, artificial
  peptide fold or domain or sub-domain
NDAANGPLFKEYRQFFDQQFLDFE

SEQ ID NO: 13874 - protein, 30 aa, artificial
  peptide fold or domain or sub-domain
NDAATFYTNRVLKDYKHSDLRHVDWVKSYL

SEQ ID NO: 13875 - protein, 29 aa, artificial
  peptide fold or domain or sub-domain
NDAFDRLRDVVPSLGNDRKLSKFETLQMA

SEQ ID NO: 13876 - protein, 24 aa, artificial
  peptide fold or domain or sub-domain
NDAIDYAQKIGGNQNTKITNASDR

SEQ ID NO: 13877 - protein, 29 aa, artificial
  peptide fold or domain or sub-domain
NDALEHLRGILPALPDEPKMTKIETLRKA

SEQ ID NO: 13878 - protein, 29 aa, artificial
  peptide fold or domain or sub-domain
NDALGFDLASLCFEGNQEELNKTSLSQPA

SEQ ID NO: 13879 - protein, 26 aa, artificial
  peptide fold or domain or sub-domain
NDASELFDLANSENDTETLEALFNDA

SEQ ID NO: 13880 - protein, 21 aa, artificial
  peptide fold or domain or sub-domain
NDDDWSQDSNKSDDSRWAHRP

SEQ ID NO: 13881 - protein, 20 aa, artificial
  peptide fold or domain or sub-domain
NDEDWLPHEGYPYLNTRSGE

SEQ ID NO: 13882 - protein, 24 aa, artificial
  peptide fold or domain or sub-domain
NDELEKFSKRFHIKTNNFEFHQEI

SEQ ID NO: 13883 - protein, 30 aa, artificial
  peptide fold or domain or sub-domain
NDELHDILIEAQSDPDQKKRNKLYQDAQEL

SEQ ID NO: 13884 - protein, 26 aa, artificial
  peptide fold or domain or sub-domain
NDELQTLIRSLGLNPTFFGLMVAMNK

SEQ ID NO: 13885 - protein, 26 aa, artificial
  peptide fold or domain or sub-domain
NDELTLLEILSGDADENFANNRWKKF

SEQ ID NO: 13886 - protein, 23 aa, artificial
  peptide fold or domain or sub-domain
NDESGANVDAAIMWREQRDEFNA

SEQ ID NO: 13887 - protein, 22 aa, artificial
  peptide fold or domain or sub-domain
NDEYVKLEKDAAEKTGFKVFNS

SEQ ID NO: 13888 - protein, 23 aa, artificial
  peptide fold or domain or sub-domain
NDFFKDFYGVSLLSHAVSDEFIK

SEQ ID NO: 13889 - protein, 28 aa, artificial
  peptide fold or domain or sub-domain
NDFSQTTISRFEALNLSFKNMSKLKPLL

SEQ ID NO: 13890 - protein, 29 aa, artificial
  peptide fold or domain or sub-domain
NDFYVCDFKGHCVAVFQDDGTFLYRIGNE

SEQ ID NO: 13891 - protein, 27 aa, artificial
  peptide fold or domain or sub-domain
NDGCWGMIKGSQKAAFGGRFIGVDFKD

SEQ ID NO: 13892 - protein, 24 aa, artificial
  peptide fold or domain or sub-domain
NDGFRRAGQPGAPAIDSQGGSTGH

SEQ ID NO: 13893 - protein, 27 aa, artificial
  peptide fold or domain or sub-domain
NDGIREEAIQALVALGYSATDALKAVK

SEQ ID NO: 13894 - protein, 30 aa, artificial
  peptide fold or domain or sub-domain
NDGLSDKDGNLKKELTFDGAHLNPAGYSIV

SEQ ID NO: 13895 - protein, 28 aa, artificial
  peptide fold or domain or sub-domain
NDHKHLYSQDSAYAWSRADGDLIVLTLN

SEQ ID NO: 13896 - protein, 30 aa, artificial
  peptide fold or domain or sub-domain
NDIHTLQFVRRARDLGFSVEQIKDLLALWR

SEQ ID NO: 13897 - protein, 29 aa, artificial
  peptide fold or domain or sub-domain
NDILGKELQNIATGQNPKEALQRVQDAAD

SEQ ID NO: 13898 - protein, 30 aa, artificial
  peptide fold or domain or sub-domain
NDILMNLDIGDFPGVGKASKKVMHNHDIYT

SEQ ID NO: 13899 - protein, 20 aa, artificial
  peptide fold or domain or sub-domain
NDKAGRETELGQGIFSADQL

SEQ ID NO: 13900 - protein, 25 aa, artificial
  peptide fold or domain or sub-domain
NDKKATMHHLAQSKMRKYGAELLPY

SEQ ID NO: 13901 - protein, 24 aa, artificial
  peptide fold or domain or sub-domain
NDKLLHDPSKLKPLLEHIPLKRMG

SEQ ID NO: 13902 - protein, 28 aa, artificial
  peptide fold or domain or sub-domain
NDLDDGKYVMELIHDLNNLYKNDFNFYN

SEQ ID NO: 13903 - protein, 26 aa, artificial
  peptide fold or domain or sub-domain
NDLKEDGSFVREPFKGWVAKKDDDKF

SEQ ID NO: 13904 - protein, 30 aa, artificial
  peptide fold or domain or sub-domain
NDLLEVMIKAGSDDEYRNTITVNDIVEECK

SEQ ID NO: 13905 - protein, 25 aa, artificial
  peptide fold or domain or sub-domain
NDNCAFTANNDQADTDTDGVGDVCE

SEQ ID NO: 13906 - protein, 27 aa, artificial
  peptide fold or domain or sub-domain
NDNSYRVLYFRQKVQKMGRVYGTLHTN

SEQ ID NO: 13907 - protein, 25 aa, artificial
  peptide fold or domain or sub-domain
NDNTKDWFVKAAVSQEYADKWRAEV

SEQ ID NO: 13908 - protein, 29 aa, artificial
  peptide fold or domain or sub-domain
NDPAMYHNRGDSTWAGESATYGDFNGLDD

SEQ ID NO: 13909 - protein, 21 aa, artificial
  peptide fold or domain or sub-domain
NDPGYRDDPLRQHEGRWLHRP

SEQ ID NO: 13910 - protein, 27 aa, artificial
  peptide fold or domain or sub-domain
NDPLLGTTDYHILCETCHMDIKTCPGH

SEQ ID NO: 13911 - protein, 27 aa, artificial
  peptide fold or domain or sub-domain
NDPRLGSIDRNLKCQTCQEGMNECPGH

SEQ ID NO: 13912 - protein, 28 aa, artificial
  peptide fold or domain or sub-domain
NDPRSIVQNFIREYRNAHGIDPDVVASS

SEQ ID NO: 13913 - protein, 23 aa, artificial
  peptide fold or domain or sub-domain
NDQFADHALNAEVWDADGKRMID

SEQ ID NO: 13914 - protein, 28 aa, artificial
  peptide fold or domain or sub-domain
NDQFETAEGSDILRLTPPEVFQAAYGVS

SEQ ID NO: 13915 - protein, 25 aa, artificial
  peptide fold or domain or sub-domain
NDRIREAIRGNLDNESKGFMQGNYS

SEQ ID NO: 13916 - protein, 30 aa, artificial
  peptide fold or domain or sub-domain
NDRVDELLDLGRRSADPVEREAYYMEAQVI

SEQ ID NO: 13917 - protein, 24 aa, artificial
  peptide fold or domain or sub-domain
NDSLYGGSENDTLLGDGRDVAAES

SEQ ID NO: 13918 - protein, 29 aa, artificial
  peptide fold or domain or sub-domain
NDSTADFYTKDLDYQPTGVKGTFVTPQGE

SEQ ID NO: 13919 - protein, 24 aa, artificial
  peptide fold or domain or sub-domain
NDSTMNDPELLAKLNAAIPIGRMA

SEQ ID NO: 13920 - protein, 21 aa, artificial
  peptide fold or domain or sub-domain
NDTDFAAVPAHAADNRWVHRP

SEQ ID NO: 13921 - protein, 27 aa, artificial
  peptide fold or domain or sub-domain
NDTDMMELAENVLQNNQSLKSLDISYN

SEQ ID NO: 13922 - protein, 24 aa, artificial
  peptide fold or domain or sub-domain
NDTLDGIENLTGSAFNDTLTGSDE

SEQ ID NO: 13923 - protein, 21 aa, artificial
  peptide fold or domain or sub-domain
NDTVNDFGQVGGDPYNRPMMK

SEQ ID NO: 13924 - protein, 21 aa, artificial
  peptide fold or domain or sub-domain
NDVKNSVVVSHLREDMLTKEI

SEQ ID NO: 13925 - protein, 21 aa, artificial
  peptide fold or domain or sub-domain
NDYDYEKDLAKIGDTRWLHRL

SEQ ID NO: 13926 - protein, 21 aa, artificial
  peptide fold or domain or sub-domain
NDYEDEQLKEEPPTKVLIDKV

SEQ ID NO: 13927 - protein, 24 aa, artificial
  peptide fold or domain or sub-domain
NDYLAGGEGDDTLYGGDGDDILDG

SEQ ID NO: 13928 - protein, 21 aa, artificial
  peptide fold or domain or sub-domain
NDYLHSDGSKLLDDYGNQVRM

SEQ ID NO: 13929 - protein, 21 aa, artificial
  peptide fold or domain or sub-domain
NDYQEFLRQEENETIVAGRSK

SEQ ID NO: 13930 - protein, 21 aa, artificial
  peptide fold or domain or sub-domain
NDYSYLDDHSKKEDSRWVNRP

SEQ ID NO: 13931 - protein, 29 aa, artificial
  peptide fold or domain or sub-domain
NEAFEGLRTHIPTLPYEKRLSKVDTLKLA

SEQ ID NO: 13932 - protein, 22 aa, artificial
  peptide fold or domain or sub-domain
NEAIEKLQDDVAAAHDFVITTH

SEQ ID NO: 13933 - protein, 26 aa, artificial
  peptide fold or domain or sub-domain
NEAKGDLKAAYAIDPNNQAVIEEMHE

SEQ ID NO: 13934 - protein, 27 aa, artificial
  peptide fold or domain or sub-domain
NEALRRDVAHVDQLIADGTLAPIKEWL

SEQ ID NO: 13935 - protein, 24 aa, artificial
  peptide fold or domain or sub-domain
NEAVVWGIRQNGDDLQTLSFILDK

SEQ ID NO: 13936 - protein, 21 aa, artificial
  peptide fold or domain or sub-domain
NECEFRNCFHNKEKKCKVKDE

SEQ ID NO: 13937 - protein, 28 aa, artificial
  peptide fold or domain or sub-domain
NEDPGVQTTASSFFGLPADVAAVSLNIS

SEQ ID NO: 13938 - protein, 26 aa, artificial
  peptide fold or domain or sub-domain
NEDYGSIEALTGIDPRVTTPSLRILS

SEQ ID NO: 13939 - protein, 23 aa, artificial
  peptide fold or domain or sub-domain
NEEAESFKENYGMNIPVKVLAEK

SEQ ID NO: 13940 - protein, 25 aa, artificial
  peptide fold or domain or sub-domain
NEEELIKFMCGEKQFSEERIRSGVK

SEQ ID NO: 13941 - protein, 25 aa, artificial
  peptide fold or domain or sub-domain
NEEFIRGFERAENTFKHQIVFDPRE

SEQ ID NO: 13942 - protein, 27 aa, artificial
  peptide fold or domain or sub-domain
NEELLGVLAAHVDMPEGFGAEMNGALL

SEQ ID NO: 13943 - protein, 23 aa, artificial
  peptide fold or domain or sub-domain
NEENKDFFQKLKKDTGVTEDITV

SEQ ID NO: 13944 - protein, 30 aa, artificial
  peptide fold or domain or sub-domain
NEEYDSLIAQAKVEQDEAKRYQLLHDAEKI

SEQ ID NO: 13945 - protein, 30 aa, artificial
  peptide fold or domain or sub-domain
NEEYHQLMVDGKRTTDQAKRIEIYKKAQEL

SEQ ID NO: 13946 - protein, 25 aa, artificial
  peptide fold or domain or sub-domain
NEFCPHILLLAMEDPWTMVEKVQRA

SEQ ID NO: 13947 - protein, 23 aa, artificial
  peptide fold or domain or sub-domain
NEFRHEKKDEQVRAIYPEGMHTV

SEQ ID NO: 13948 - protein, 25 aa, artificial
  peptide fold or domain or sub-domain
NEFYEILKNSDPKTDEDYKNLMSKV

SEQ ID NO: 13949 - protein, 30 aa, artificial
  peptide fold or domain or sub-domain
NEGDTLLLPDKYWGNYNFIFGVRRKASIET

SEQ ID NO: 13950 - protein, 23 aa, artificial
  peptide fold or domain or sub-domain
NEGRDEKRKPEVLTVYPDGIGGV

SEQ ID NO: 13951 - protein, 27 aa, artificial
  peptide fold or domain or sub-domain
NEIKIRKIKGKYIIENKIIKLIINSVG

SEQ ID NO: 13952 - protein, 27 aa, artificial
  peptide fold or domain or sub-domain
NEKEAENDFLRIKFNEEGNIVSLFDKR

SEQ ID NO: 13953 - protein, 20 aa, artificial
  peptide fold or domain or sub-domain
NEKLEDIRAVKESEITEKFE

SEQ ID NO: 13954 - protein, 27 aa, artificial
  peptide fold or domain or sub-domain
NEKLVKLESGLKVYGGDDRIGALTHKI

SEQ ID NO: 13955 - protein, 22 aa, artificial
  peptide fold or domain or sub-domain
NELDLKDGKEKKLSSALMDRLL

SEQ ID NO: 13956 - protein, 22 aa, artificial
  peptide fold or domain or sub-domain
NEMYRDADIPPAIEEDIQEAER

SEQ ID NO: 13957 - protein, 25 aa, artificial
  peptide fold or domain or sub-domain
NENLENMYKSYIGDPNSTRAESLFH

SEQ ID NO: 13958 - protein, 28 aa, artificial
  peptide fold or domain or sub-domain
NENLVERFSQEVQITEARCFYGFQIAME

SEQ ID NO: 13959 - protein, 23 aa, artificial
  peptide fold or domain or sub-domain
NENQHERATGPANAMYPDGIHTT

SEQ ID NO: 13960 - protein, 22 aa, artificial
  peptide fold or domain or sub-domain
NEPDRLDKINFEQYRLQVPCWY

SEQ ID NO: 13961 - protein, 22 aa, artificial
  peptide fold or domain or sub-domain
NEPWTYMGNFSSPEGDYDIYTS

SEQ ID NO: 13962 - protein, 30 aa, artificial
  peptide fold or domain or sub-domain
NEQELTKGFRQFSTEFKQLEKKDKEVIEEE

SEQ ID NO: 13963 - protein, 22 aa, artificial
  peptide fold or domain or sub-domain
NEQKILPEDMVKLSENEMIAQC

SEQ ID NO: 13964 - protein, 30 aa, artificial
  peptide fold or domain or sub-domain
NERELNDVESHRPTDRIPMDMKEKAVAESL

SEQ ID NO: 13965 - protein, 29 aa, artificial
  peptide fold or domain or sub-domain
NERFQSLMDIIPQNQNDQKRDKASFLLEV

SEQ ID NO: 13966 - protein, 29 aa, artificial
  peptide fold or domain or sub-domain
NERKKAKKMMNECKDEMLKKVYDGRQLAL

SEQ ID NO: 13967 - protein, 28 aa, artificial
  peptide fold or domain or sub-domain
NERPEDFGLGAAFGAMTDAVLGNTYDLD

SEQ ID NO: 13968 - protein, 24 aa, artificial
  peptide fold or domain or sub-domain
NESDGLDLSDTGDTNGKIKELTKV

SEQ ID NO: 13969 - protein, 30 aa, artificial
  peptide fold or domain or sub-domain
NESLASYEKAIALKSVNAEVYAHRGVVLQK

SEQ ID NO: 13970 - protein, 27 aa, artificial
  peptide fold or domain or sub-domain
NESRLKQFTNHPLWSQLQAVQKNQVYP

SEQ ID NO: 13971 - protein, 25 aa, artificial
  peptide fold or domain or sub-domain
NEVAEWLENHEEFSVEEFNNILFEV

SEQ ID NO: 13972 - protein, 27 aa, artificial
  peptide fold or domain or sub-domain
NEVDVDQCIKKLLDNDPSLKEINLNNM

SEQ ID NO: 13973 - protein, 23 aa, artificial
  peptide fold or domain or sub-domain
NEVETPKLDDEFVKSLNLKNVNT

SEQ ID NO: 13974 - protein, 29 aa, artificial
  peptide fold or domain or sub-domain
NEVFASPQHSSRSAEVFAQEIGGKVVFLD

SEQ ID NO: 13975 - protein, 24 aa, artificial
  peptide fold or domain or sub-domain
NEVGLDPICKRRIVGYYSEYDSTD

SEQ ID NO: 13976 - protein, 28 aa, artificial
  peptide fold or domain or sub-domain
NEVIANRASEILGKPLGSKYAHPNDHVN

SEQ ID NO: 13977 - protein, 23 aa, artificial
  peptide fold or domain or sub-domain
NEVLAAIYMVRSDVSLTVRQAAL

SEQ ID NO: 13978 - protein, 24 aa, artificial
  peptide fold or domain or sub-domain
NEVVRVMAEFALDLMRTMRRFNTE

SEQ ID NO: 13979 - protein, 21 aa, artificial
  peptide fold or domain or sub-domain
NEYDEEELRENPPAKVQVDHI

SEQ ID NO: 13980 - protein, 24 aa, artificial
  peptide fold or domain or sub-domain
NFAASPYCKSLQQQGKTCDFAHFA

SEQ ID NO: 13981 - protein, 25 aa, artificial
  peptide fold or domain or sub-domain
NFALDESGEEILLIAGGIGITPIIG

SEQ ID NO: 13982 - protein, 28 aa, artificial
  peptide fold or domain or sub-domain
NFAQLLFVYESENANREIMGMVTREVHA

SEQ ID NO: 13983 - protein, 22 aa, artificial
  peptide fold or domain or sub-domain
NFAYYLAKHGKRYSDGSANNLT

SEQ ID NO: 13984 - protein, 25 aa, artificial
  peptide fold or domain or sub-domain
NFDTELAFDVEDPMDLDASSEFLDI

SEQ ID NO: 13985 - protein, 24 aa, artificial
  peptide fold or domain or sub-domain
NFEGNYVQTSFKTATQMDPYASDY

SEQ ID NO: 13986 - protein, 24 aa, artificial
  peptide fold or domain or sub-domain
NFEKELFVHVSTLENEKGKAAEKN

SEQ ID NO: 13987 - protein, 27 aa, artificial
  peptide fold or domain or sub-domain
NFELVTASGEVINANEKENPDLWTALK

SEQ ID NO: 13988 - protein, 23 aa, artificial
  peptide fold or domain or sub-domain
NFFAGLFRARDKLFYLRHHWIDF

SEQ ID NO: 13989 - protein, 22 aa, artificial
  peptide fold or domain or sub-domain
NFFVEPSGKKTMLGDKPEEKKR

SEQ ID NO: 13990 - protein, 27 aa, artificial
  peptide fold or domain or sub-domain
NFGDMAEMVKGRKDWNQDVFAQRAQYI

SEQ ID NO: 13991 - protein, 27 aa, artificial
  peptide fold or domain or sub-domain
NFGDMGAMMKGKKPFDAETFAMRAKNV

SEQ ID NO: 13992 - protein, 30 aa, artificial
  peptide fold or domain or sub-domain
NFGESNGRYSALTARGISKETCQKAGYWIA

SEQ ID NO: 13993 - protein, 20 aa, artificial
  peptide fold or domain or sub-domain
NFHAYVETNYYDSDKDGTLN

SEQ ID NO: 13994 - protein, 29 aa, artificial
  peptide fold or domain or sub-domain
NFHHLKVDYPGGEKWTLAKPDFVALKTLF

SEQ ID NO: 13995 - protein, 25 aa, artificial
  peptide fold or domain or sub-domain
NFHMRELYTKYFGAPLSHEAHEVLH

SEQ ID NO: 13996 - protein, 22 aa, artificial
  peptide fold or domain or sub-domain
NFIEDENGHLINLSKESQEKRI

SEQ ID NO: 13997 - protein, 30 aa, artificial
  peptide fold or domain or sub-domain
NFIELVTNGTFELKSMDRESLELKLEEIGF

SEQ ID NO: 13998 - protein, 21 aa, artificial
  peptide fold or domain or sub-domain
NFIHIYARSHSISPLEALMET

SEQ ID NO: 13999 - protein, 25 aa, artificial
  peptide fold or domain or sub-domain
NFILLGNYVKLKFGWDKDKYNKIIV

SEQ ID NO: 14000 - protein, 29 aa, artificial
  peptide fold or domain or sub-domain
NFLTELNSTKTVDGKSTFLHILAKSLSQH

SEQ ID NO: 14001 - protein, 24 aa, artificial
  peptide fold or domain or sub-domain
NFPQSNLCLKREKQDESCSLTQAL

SEQ ID NO: 14002 - protein, 30 aa, artificial
  peptide fold or domain or sub-domain
NFQKVEKIGEGTYGVVYKARNKLGEVVALK

SEQ ID NO: 14003 - protein, 27 aa, artificial
  peptide fold or domain or sub-domain
NFSAMAAMVKGEVEYNADFFQRRANDF

SEQ ID NO: 14004 - protein, 26 aa, artificial
  peptide fold or domain or sub-domain
NFSEDVLGWRESFDLLLSSKNGVAAF

SEQ ID NO: 14005 - protein, 29 aa, artificial
  peptide fold or domain or sub-domain
NFSIPRVDAKNKKLISVDGKEVDYELLVT

SEQ ID NO: 14006 - protein, 22 aa, artificial
  peptide fold or domain or sub-domain
NFVINDHGTRTDLSCCTDLSTI

SEQ ID NO: 14007 - protein, 22 aa, artificial
  peptide fold or domain or sub-domain
NFVQFQNGIKMKIRENNSSVIC

SEQ ID NO: 14008 - protein, 25 aa, artificial
  peptide fold or domain or sub-domain
NFYAPEHLEVAVNEYNDICDRLTNY

SEQ ID NO: 14009 - protein, 25 aa, artificial
  peptide fold or domain or sub-domain
NGAASLVQRAMNWASIDEMHYQACY

SEQ ID NO: 14010 - protein, 25 aa, artificial
  peptide fold or domain or sub-domain
NGARVLVRRALAGSIEHDGIGEEET

SEQ ID NO: 14011 - protein, 29 aa, artificial
  peptide fold or domain or sub-domain
NGDDVCHAMRSLGLDHYADAMHRYLQRYR

SEQ ID NO: 14012 - protein, 26 aa, artificial
  peptide fold or domain or sub-domain
NGDISNWDDRYEAQWKNFTDPAGFSL

SEQ ID NO: 14013 - protein, 24 aa, artificial
  peptide fold or domain or sub-domain
NGDKGEKEAIIKLSADQLGLQKFE

SEQ ID NO: 14014 - protein, 26 aa, artificial
  peptide fold or domain or sub-domain
NGDMPQNQRERTIEQLKNGNINIVVA

SEQ ID NO: 14015 - protein, 27 aa, artificial
  peptide fold or domain or sub-domain
NGDRCHDQCVGGCERVNDATACHACKN

SEQ ID NO: 14016 - protein, 21 aa, artificial
  peptide fold or domain or sub-domain
NGDVAEAIETATKKEIDRRDI

SEQ ID NO: 14017 - protein, 29 aa, artificial
  peptide fold or domain or sub-domain
NGEDIINALSTFGFGDYTDTLINYLNIWR

SEQ ID NO: 14018 - protein, 29 aa, artificial
  peptide fold or domain or sub-domain
NGEDILFAMTTLGFDNYVEPLKVYLQKYR

SEQ ID NO: 14019 - protein, 29 aa, artificial
  peptide fold or domain or sub-domain
NGEEAEDLDRLYMVSEEEELYKIVSERIE

SEQ ID NO: 14020 - protein, 27 aa, artificial
  peptide fold or domain or sub-domain
NGEPAFTVNTIDRHGVAIGEYPKYKIR

SEQ ID NO: 14021 - protein, 25 aa, artificial
  peptide fold or domain or sub-domain
NGFCPTLRAGTARDKGSFQAVRPIH

SEQ ID NO: 14022 - protein, 28 aa, artificial
  peptide fold or domain or sub-domain
NGFGLMQVDKRSHKPQGTWNGEVHITQG

SEQ ID NO: 14023 - protein, 21 aa, artificial
  peptide fold or domain or sub-domain
NGFTNRTTPHFKHFAKNPKSK

SEQ ID NO: 14024 - protein, 24 aa, artificial
  peptide fold or domain or sub-domain
NGGILDRSCGRRRVGYITSWGKHP

SEQ ID NO: 14025 - protein, 27 aa, artificial
  peptide fold or domain or sub-domain
NGGTLFEIAYLQRKIDAFFEYAHQIGL

SEQ ID NO: 14026 - protein, 30 aa, artificial
  peptide fold or domain or sub-domain
NGIAFAKKVAEHFKGKFFPHEKFLTATVTL

SEQ ID NO: 14027 - protein, 30 aa, artificial
  peptide fold or domain or sub-domain
NGIDFAYELNEYIKGELIEYPAFKTATIKK

SEQ ID NO: 14028 - protein, 22 aa, artificial
  peptide fold or domain or sub-domain
NGILSLFRDGGFDTELSARLFR

SEQ ID NO: 14029 - protein, 29 aa, artificial
  peptide fold or domain or sub-domain
NGIPALVKILQMKSSEMQSLGAAVLCNMS

SEQ ID NO: 14030 - protein, 28 aa, artificial
  peptide fold or domain or sub-domain
NGIYQDISLSDWLAKTPSYLLADNFNNN

SEQ ID NO: 14031 - protein, 28 aa, artificial
  peptide fold or domain or sub-domain
NGIYSTNLEYPLQNDTLTMGYRTGSSNS

SEQ ID NO: 14032 - protein, 20 aa, artificial
  peptide fold or domain or sub-domain
NGKDVSAPGAVDDAGGTPPD

SEQ ID NO: 14033 - protein, 27 aa, artificial
  peptide fold or domain or sub-domain
NGKIIAGGQSMMPILNMRLSTPELLID

SEQ ID NO: 14034 - protein, 25 aa, artificial
  peptide fold or domain or sub-domain
NGKKATTNRAALNLLEKHFPDVEVV

SEQ ID NO: 14035 - protein, 27 aa, artificial
  peptide fold or domain or sub-domain
NGKTYASDDVKRAIEKGTNDYYNDPNG

SEQ ID NO: 14036 - protein, 25 aa, artificial
  peptide fold or domain or sub-domain
NGLDTAIRLLKLKGSSTTYANICPK

SEQ ID NO: 14037 - protein, 21 aa, artificial
  peptide fold or domain or sub-domain
NGMDERCLPHFKRGSRTPESK

SEQ ID NO: 14038 - protein, 24 aa, artificial
  peptide fold or domain or sub-domain
NGMDEVGRLFNNNELIVAEVLQSA

SEQ ID NO: 14039 - protein, 26 aa, artificial
  peptide fold or domain or sub-domain
NGNHGQVSTFLDEKAHFKGKHDTEFL

SEQ ID NO: 14040 - protein, 21 aa, artificial
  peptide fold or domain or sub-domain
NGPLVTSGRWIRDASGTNLTY

SEQ ID NO: 14041 - protein, 20 aa, artificial
  peptide fold or domain or sub-domain
NGQHRHRSLPKRPDGKHMTP

SEQ ID NO: 14042 - protein, 25 aa, artificial
  peptide fold or domain or sub-domain
NGRRFTLHWENLPNFTEKYPDLAPE

SEQ ID NO: 14043 - protein, 25 aa, artificial
  peptide fold or domain or sub-domain
NGRRIKESGETMFTLTAQDKHGILK

SEQ ID NO: 14044 - protein, 23 aa, artificial
  peptide fold or domain or sub-domain
NGSCMTCEFCESGHESNCPDADL

SEQ ID NO: 14045 - protein, 30 aa, artificial
  peptide fold or domain or sub-domain
NGSCMTCEFCESGHESNCPDADLSGYTHDG

SEQ ID NO: 14046 - protein, 29 aa, artificial
  peptide fold or domain or sub-domain
NGTEGPNFYVPFSNKTGVVRSPFEAPQYY

SEQ ID NO: 14047 - protein, 24 aa, artificial
  peptide fold or domain or sub-domain
NGTLVLVLNSAGDRTYVKSYENGA

SEQ ID NO: 14048 - protein, 27 aa, artificial
  peptide fold or domain or sub-domain
NGVALSGYAYGASPPRAQSMGAMFAAI

SEQ ID NO: 14049 - protein, 25 aa, artificial
  peptide fold or domain or sub-domain
NGVERLIKRALVDNMEGEPEEDLYQ

SEQ ID NO: 14050 - protein, 27 aa, artificial
  peptide fold or domain or sub-domain
NGVNRDLRQPYDPTAPIEDQPGIVRTR

SEQ ID NO: 14051 - protein, 25 aa, artificial
  peptide fold or domain or sub-domain
NGVPALVARCLDATGGPADDFDSAL

SEQ ID NO: 14052 - protein, 29 aa, artificial
  peptide fold or domain or sub-domain
NGVTGQQLQDEMWAHGKLRPRASGGIGVR

SEQ ID NO: 14053 - protein, 29 aa, artificial
  peptide fold or domain or sub-domain
NGWDNQYVEAGGQGSPNWHKSNALKTMRK

SEQ ID NO: 14054 - protein, 26 aa, artificial
  peptide fold or domain or sub-domain
NHAICDYVRQNEGSDELLVQLESVLL

SEQ ID NO: 14055 - protein, 20 aa, artificial
  peptide fold or domain or sub-domain
NHAIIQLLVHGLKDLSIPKP

SEQ ID NO: 14056 - protein, 20 aa, artificial
  peptide fold or domain or sub-domain
NHAIIQNSIFGLGKNRVPPL

SEQ ID NO: 14057 - protein, 26 aa, artificial
  peptide fold or domain or sub-domain
NHAIIQYLQPLCQQDNHVLLDQLSKL

SEQ ID NO: 14058 - protein, 20 aa, artificial
  peptide fold or domain or sub-domain
NHAIMQTFISELGVADIPLP

SEQ ID NO: 14059 - protein, 20 aa, artificial
  peptide fold or domain or sub-domain
NHAIVQTLVNSVNPALVPKA

SEQ ID NO: 14060 - protein, 20 aa, artificial
  peptide fold or domain or sub-domain
NHAMLMTMMNSVDPSNTPMP

SEQ ID NO: 14061 - protein, 20 aa, artificial
  peptide fold or domain or sub-domain
NHAVLRALMHAAAPGAADLP

SEQ ID NO: 14062 - protein, 20 aa, artificial
  peptide fold or domain or sub-domain
NHAVMTSILNLHKPGKAPMP

SEQ ID NO: 14063 - protein, 20 aa, artificial
  peptide fold or domain or sub-domain
NHAYMQSLLKHYHPDRVAPP

SEQ ID NO: 14064 - protein, 20 aa, artificial
  peptide fold or domain or sub-domain
NHCDEEEVTKDQRTDAKPDT

SEQ ID NO: 14065 - protein, 25 aa, artificial
  peptide fold or domain or sub-domain
NHELSMVFQFEHIGLQHKPEAPKWD

SEQ ID NO: 14066 - protein, 23 aa, artificial
  peptide fold or domain or sub-domain
NHEYKRHGICCSNLYDQRAYFLL

SEQ ID NO: 14067 - protein, 29 aa, artificial
  peptide fold or domain or sub-domain
NHGFDVLRNRLQPKNHTKKWSKADTLREA

SEQ ID NO: 14068 - protein, 25 aa, artificial
  peptide fold or domain or sub-domain
NHGVPIALQAELEGKDPEEIVEKYH

SEQ ID NO: 14069 - protein, 29 aa, artificial
  peptide fold or domain or sub-domain
NHHLPELWTDPEKFDPARFTEPRNEHKQH

SEQ ID NO: 14070 - protein, 29 aa, artificial
  peptide fold or domain or sub-domain
NHIGADARVLDCAVDANGTAVFALIGDDP

SEQ ID NO: 14071 - protein, 24 aa, artificial
  peptide fold or domain or sub-domain
NHINSELTKEKGRKVSKEHGVKNP

SEQ ID NO: 14072 - protein, 30 aa, artificial
  peptide fold or domain or sub-domain
NHIQELNLVSRAKNAGFSLQECKEFVQLAH

SEQ ID NO: 14073 - protein, 30 aa, artificial
  peptide fold or domain or sub-domain
NHISELLLIKRSRMIGFSLDECRDLLTLSM

SEQ ID NO: 14074 - protein, 25 aa, artificial
  peptide fold or domain or sub-domain
NHLELRKLIKEENLNKLKSCSDCAV

SEQ ID NO: 14075 - protein, 29 aa, artificial
  peptide fold or domain or sub-domain
NHLFVVDYNNTRIQELSNTGVFIAKWGKI

SEQ ID NO: 14076 - protein, 20 aa, artificial
  peptide fold or domain or sub-domain
NHLNKVKAKLEQTLDELEDS

SEQ ID NO: 14077 - protein, 25 aa, artificial
  peptide fold or domain or sub-domain
NHLTLREELIEIVPSYWNGHSDTET

SEQ ID NO: 14078 - protein, 20 aa, artificial
  peptide fold or domain or sub-domain
NHMFDLVNEERGIKNEGWEA

SEQ ID NO: 14079 - protein, 23 aa, artificial
  peptide fold or domain or sub-domain
NHQALRAEYGDRYQFQTGSDCEV

SEQ ID NO: 14080 - protein, 22 aa, artificial
  peptide fold or domain or sub-domain
NHQDLLNATQNNLTVAMVDRLK

SEQ ID NO: 14081 - protein, 27 aa, artificial
  peptide fold or domain or sub-domain
NHRKKLLAYLRKNKFTSYASLIEKLNI

SEQ ID NO: 14082 - protein, 24 aa, artificial
  peptide fold or domain or sub-domain
NHSLGYIFFQLGKLAESQKYYEQA

SEQ ID NO: 14083 - protein, 20 aa, artificial
  peptide fold or domain or sub-domain
NHVSENEVDDKMRRHTKQLC

SEQ ID NO: 14084 - protein, 29 aa, artificial
  peptide fold or domain or sub-domain
NIAVGLSVNDAYWLDSIWANDKRVHRYIG

SEQ ID NO: 14085 - protein, 30 aa, artificial
  peptide fold or domain or sub-domain
NICNEAAVHCVRRNGEQIEEFDVLNAVERV

SEQ ID NO: 14086 - protein, 30 aa, artificial
  peptide fold or domain or sub-domain
NIDDLLNGKVAVINTFAQKSGVMQDMSGEE

SEQ ID NO: 14087 - protein, 30 aa, artificial
  peptide fold or domain or sub-domain
NIDEIIEKKGWWTFWGENLMGVKDYPVRLP

SEQ ID NO: 14088 - protein, 30 aa, artificial
  peptide fold or domain or sub-domain
NIDKPLSTYLPEFSINSRFPDASPITPRTI

SEQ ID NO: 14089 - protein, 22 aa, artificial
  peptide fold or domain or sub-domain
NIDVHKSTRGRRGNQQTQGNGS

SEQ ID NO: 14090 - protein, 29 aa, artificial
  peptide fold or domain or sub-domain
NIEEYLKAMGRDDEEFANRLLYRKSVVVI

SEQ ID NO: 14091 - protein, 30 aa, artificial
  peptide fold or domain or sub-domain
NIEGMIDSNGNSINKTIQKVKVISKSILEI

SEQ ID NO: 14092 - protein, 20 aa, artificial
  peptide fold or domain or sub-domain
NIEKIQSLPFRNAKNAAIQL

SEQ ID NO: 14093 - protein, 23 aa, artificial
  peptide fold or domain or sub-domain
NIEKMLGEALGNPQEVGPLLNTM

SEQ ID NO: 14094 - protein, 29 aa, artificial
  peptide fold or domain or sub-domain
NIEKMLGEALGNPQEVGPLLNTMIKGRYN

SEQ ID NO: 14095 - protein, 27 aa, artificial
  peptide fold or domain or sub-domain
NIERVLEISQRDGIPAYLAADRLAEER

SEQ ID NO: 14096 - protein, 26 aa, artificial
  peptide fold or domain or sub-domain
NIESIKDVAEMLGIGNLADEPAAAIA

SEQ ID NO: 14097 - protein, 23 aa, artificial
  peptide fold or domain or sub-domain
NIFCGQCYYCHRGEVHLCKELQA

SEQ ID NO: 14098 - protein, 30 aa, artificial
  peptide fold or domain or sub-domain
NIFCGQCYYCHRGEVHLCKELQAIGVTRNG

SEQ ID NO: 14099 - protein, 27 aa, artificial
  peptide fold or domain or sub-domain
NIFISLGYRLGLHPPGVKDMKRMYEAN

SEQ ID NO: 14100 - protein, 23 aa, artificial
  peptide fold or domain or sub-domain
NIFQNGVLRSIAEKYGKTVAQVI

SEQ ID NO: 14101 - protein, 30 aa, artificial
  peptide fold or domain or sub-domain
NIIEEHLDSYLAKVEEMGVVIDADEDSLYV

SEQ ID NO: 14102 - protein, 30 aa, artificial
  peptide fold or domain or sub-domain
NIIPEHLEALWFVLEKTGAIIKKGENEVEV

SEQ ID NO: 14103 - protein, 20 aa, artificial
  peptide fold or domain or sub-domain
NIITETTPENQAKRNREKRK

SEQ ID NO: 14104 - protein, 29 aa, artificial
  peptide fold or domain or sub-domain
NIITETTPENQAKRNREKRKTLVNGIQTL

SEQ ID NO: 14105 - protein, 26 aa, artificial
  peptide fold or domain or sub-domain
NIKNKMLKDLESAFGKEMEDLENKTL

SEQ ID NO: 14106 - protein, 20 aa, artificial
  peptide fold or domain or sub-domain
NIKTPMNDEDILDQARKRGL

SEQ ID NO: 14107 - protein, 29 aa, artificial
  peptide fold or domain or sub-domain
NIKWIRENQELFDEKLSQRFIEPMSSKIA

SEQ ID NO: 14108 - protein, 30 aa, artificial
  peptide fold or domain or sub-domain
NIKYYLRALSRTFEENYTYNDKFKTGRIRL

SEQ ID NO: 14109 - protein, 21 aa, artificial
  peptide fold or domain or sub-domain
NILDELRKGAMVVTSEIMDVI

SEQ ID NO: 14110 - protein, 21 aa, artificial
  peptide fold or domain or sub-domain
NILDKARNSEIKITSDLLDKI

SEQ ID NO: 14111 - protein, 27 aa, artificial
  peptide fold or domain or sub-domain
NILDKKAEADRIVFENPDPSDGFVLIP

SEQ ID NO: 14112 - protein, 21 aa, artificial
  peptide fold or domain or sub-domain
NILDKVRNGQLNINEDIIDLL

SEQ ID NO: 14113 - protein, 27 aa, artificial
  peptide fold or domain or sub-domain
NILEGKAEQERILYQNQDLHTGFIILP

SEQ ID NO: 14114 - protein, 27 aa, artificial
  peptide fold or domain or sub-domain
NILFEGKESETFIYHDKDLQEGFVLLP

SEQ ID NO: 14115 - protein, 21 aa, artificial
  peptide fold or domain or sub-domain
NILGMVRNKSIIPTPEIINVL

SEQ ID NO: 14116 - protein, 30 aa, artificial
  peptide fold or domain or sub-domain
NILNIAAIKCSVEGKKSVDMNSIEQAFDRV

SEQ ID NO: 14117 - protein, 21 aa, artificial
  peptide fold or domain or sub-domain
NILSDLKEGLLEVTPQVVDIL

SEQ ID NO: 14118 - protein, 21 aa, artificial
  peptide fold or domain or sub-domain
NILVLKEILGHSTIEMTMRYA

SEQ ID NO: 14119 - protein, 20 aa, artificial
  peptide fold or domain or sub-domain
NINDINVRNMCHSEVVQVLK

SEQ ID NO: 14120 - protein, 21 aa, artificial
  peptide fold or domain or sub-domain
NINGTLTGNMRHLDPDTKRDI

SEQ ID NO: 14121 - protein, 26 aa, artificial
  peptide fold or domain or sub-domain
NINGTLTGNMRHLDPDTKRDIEAIDT

SEQ ID NO: 14122 - protein, 28 aa, artificial
  peptide fold or domain or sub-domain
NINLIDYVRAAVPELEARYFYDQQILIE

SEQ ID NO: 14123 - protein, 23 aa, artificial
  peptide fold or domain or sub-domain
NINNLSEKKRKEDMYTPQHYHSY

SEQ ID NO: 14124 - protein, 23 aa, artificial
  peptide fold or domain or sub-domain
NIPKGFSIIASTKNCKYAAIFNK

SEQ ID NO: 14125 - protein, 30 aa, artificial
  peptide fold or domain or sub-domain
NIPMTFHNGFAPGSVTDKMDLWRPFISGKD

SEQ ID NO: 14126 - protein, 23 aa, artificial
  peptide fold or domain or sub-domain
NIQDPAQAEAYTIYCQNRVEYEK

SEQ ID NO: 14127 - protein, 20 aa, artificial
  peptide fold or domain or sub-domain
NIRAQLIRDRMSREGENMPQ

SEQ ID NO: 14128 - protein, 20 aa, artificial
  peptide fold or domain or sub-domain
NIRFQATKLGISQTTLNNAF

SEQ ID NO: 14129 - protein, 24 aa, artificial
  peptide fold or domain or sub-domain
NIRHGNMAFRNANLMIEFALAMSQ

SEQ ID NO: 14130 - protein, 27 aa, artificial
  peptide fold or domain or sub-domain
NIRKWIEYLASNNLHARSINRKISTIK

SEQ ID NO: 14131 - protein, 21 aa, artificial
  peptide fold or domain or sub-domain
NIRVTTISPGVVATELGSDIT

SEQ ID NO: 14132 - protein, 20 aa, artificial
  peptide fold or domain or sub-domain
NISAIFKYSGEPEFRRLERE

SEQ ID NO: 14133 - protein, 20 aa, artificial
  peptide fold or domain or sub-domain
NISATIIRERLQNGESCEDL

SEQ ID NO: 14134 - protein, 30 aa, artificial
  peptide fold or domain or sub-domain
NISDDEEHIVYLSPAEDEYYRIATGNQLAS

SEQ ID NO: 14135 - protein, 20 aa, artificial
  peptide fold or domain or sub-domain
NISFKEFAKHCQRLKEDEQS

SEQ ID NO: 14136 - protein, 21 aa, artificial
  peptide fold or domain or sub-domain
NISFQELGWERWIVYPPSFIF

SEQ ID NO: 14137 - protein, 22 aa, artificial
  peptide fold or domain or sub-domain
NISGTELRRRLRVGGEIPEWFS

SEQ ID NO: 14138 - protein, 20 aa, artificial
  peptide fold or domain or sub-domain
NISKACRILGINRSTLYIKI

SEQ ID NO: 14139 - protein, 20 aa, artificial
  peptide fold or domain or sub-domain
NISQAARLLGLTRPAMAYRL

SEQ ID NO: 14140 - protein, 20 aa, artificial
  peptide fold or domain or sub-domain
NISSTAIRKSYYEGKSACGL

SEQ ID NO: 14141 - protein, 20 aa, artificial
  peptide fold or domain or sub-domain
NISSTQCRKDLQNHSRESQL

SEQ ID NO: 14142 - protein, 20 aa, artificial
  peptide fold or domain or sub-domain
NISWVFDVEGEVGFRNREEK

SEQ ID NO: 14143 - protein, 30 aa, artificial
  peptide fold or domain or sub-domain
NITKRALRKQQEDAQKGKITDIAQIMKQLK

SEQ ID NO: 14144 - protein, 23 aa, artificial
  peptide fold or domain or sub-domain
NITKVTVGCVETNAHAEPLKQRM

SEQ ID NO: 14145 - protein, 23 aa, artificial
  peptide fold or domain or sub-domain
NITVVRIGCEERPEHTQPIRDRM

SEQ ID NO: 14146 - protein, 22 aa, artificial
  peptide fold or domain or sub-domain
NIVEFHSDHMKIRNATFPGVQM

SEQ ID NO: 14147 - protein, 27 aa, artificial
  peptide fold or domain or sub-domain
NIVEFHSDHMKIRNATFPGVQMKFVLQ

SEQ ID NO: 14148 - protein, 30 aa, artificial
  peptide fold or domain or sub-domain
NIVFSSDLDKKLNLPEGSVQKKSGLVSRHF

SEQ ID NO: 14149 - protein, 22 aa, artificial
  peptide fold or domain or sub-domain
NIVHLIWNDGTYDMVKFQEEMK

SEQ ID NO: 14150 - protein, 22 aa, artificial
  peptide fold or domain or sub-domain
NIVILLYNNGLYGTIRIHEENR

SEQ ID NO: 14151 - protein, 30 aa, artificial
  peptide fold or domain or sub-domain
NIVNEAALRAVKHGRKFVIQEDLDEAVEVI

SEQ ID NO: 14152 - protein, 28 aa, artificial
  peptide fold or domain or sub-domain
NIVNGQDQNDWIGPPSNGDGSTKPVPIN

SEQ ID NO: 14153 - protein, 30 aa, artificial
  peptide fold or domain or sub-domain
NIVYIAIDAMGDKAGVYRSDDAGESFKQMT

SEQ ID NO: 14154 - protein, 29 aa, artificial
  peptide fold or domain or sub-domain
NIWRAMRSELNLLQYTMENVVFHLLHRRI

SEQ ID NO: 14155 - protein, 29 aa, artificial
  peptide fold or domain or sub-domain
NIWRILRGEVNLLNYSLENVVLNIFKKQT

SEQ ID NO: 14156 - protein, 29 aa, artificial
  peptide fold or domain or sub-domain
NIWRLCRDKLKLTNFDAENVYYELFQIRN

SEQ ID NO: 14157 - protein, 29 aa, artificial
  peptide fold or domain or sub-domain
NIWRLLRKEIAVTQYSFENMVHLLLKIRL

SEQ ID NO: 14158 - protein, 29 aa, artificial
  peptide fold or domain or sub-domain
NIYAFRGHHFLEQDAGNDTWAADTIESDF

SEQ ID NO: 14159 - protein, 28 aa, artificial
  peptide fold or domain or sub-domain
NIYVSGEGEDALGYKNMPSKTQFVKHGD

SEQ ID NO: 14160 - protein, 20 aa, artificial
  peptide fold or domain or sub-domain
NKAETAEKYGDEQVKQWRRG

SEQ ID NO: 14161 - protein, 29 aa, artificial
  peptide fold or domain or sub-domain
NKAKISEVTAEHAATLQAGEKKPEFTYRI

SEQ ID NO: 14162 - protein, 28 aa, artificial
  peptide fold or domain or sub-domain
NKALAFGVYPYVNAAECHLYLAKQMWEE

SEQ ID NO: 14163 - protein, 24 aa, artificial
  peptide fold or domain or sub-domain
NKALLSVLMREGDYAAHEAEEILR

SEQ ID NO: 14164 - protein, 28 aa, artificial
  peptide fold or domain or sub-domain
NKARIAWNEGKSVAPGCIVDNEGHPTVD

SEQ ID NO: 14165 - protein, 28 aa, artificial
  peptide fold or domain or sub-domain
NKARVLAEKGEPAPEGSIIGADGNPTTD

SEQ ID NO: 14166 - protein, 30 aa, artificial
  peptide fold or domain or sub-domain
NKCIDACNEASEVDRREPNTGKNLREIESQ

SEQ ID NO: 14167 - protein, 24 aa, artificial
  peptide fold or domain or sub-domain
NKDAMEDEATTKLIMSKTPVNRWG

SEQ ID NO: 14168 - protein, 20 aa, artificial
  peptide fold or domain or sub-domain
NKDEMKEKLGEDKIHAFRRS

SEQ ID NO: 14169 - protein, 20 aa, artificial
  peptide fold or domain or sub-domain
NKDGALGGNLPFSGYLQGAN

SEQ ID NO: 14170 - protein, 29 aa, artificial
  peptide fold or domain or sub-domain
NKDKFKSGAQIKASHILVRDEKLAQEIVK

SEQ ID NO: 14171 - protein, 20 aa, artificial
  peptide fold or domain or sub-domain
NKDLTRKLFGPDQVASWRRS

SEQ ID NO: 14172 - protein, 24 aa, artificial
  peptide fold or domain or sub-domain
NKDSTARTLMIKSGDVDIARDPLQ

SEQ ID NO: 14173 - protein, 30 aa, artificial
  peptide fold or domain or sub-domain
NKDTPVYVSSPTWENHNGVFTTAGFKDIRS

SEQ ID NO: 14174 - protein, 30 aa, artificial
  peptide fold or domain or sub-domain
NKDYDALMDKSAVTTDLAERAKILAEAEEI

SEQ ID NO: 14175 - protein, 29 aa, artificial
  peptide fold or domain or sub-domain
NKEKFVQPELVKAKHILVQNEKEAKEVIA

SEQ ID NO: 14176 - protein, 24 aa, artificial
  peptide fold or domain or sub-domain
NKEMSFLYKDDTGYNFMSQETFEQ

SEQ ID NO: 14177 - protein, 26 aa, artificial
  peptide fold or domain or sub-domain
NKEQAKRQYMIIQPEATEDEVEAAIS

SEQ ID NO: 14178 - protein, 30 aa, artificial
  peptide fold or domain or sub-domain
NKICCGEGICGSCEIEIEGQKMRTCKVQVD

SEQ ID NO: 14179 - protein, 20 aa, artificial
  peptide fold or domain or sub-domain
NKIEESEVTQDLRNSTKQVC

SEQ ID NO: 14180 - protein, 28 aa, artificial
  peptide fold or domain or sub-domain
NKIENGELSLNKDSCTFYKNGNPIELNA

SEQ ID NO: 14181 - protein, 22 aa, artificial
  peptide fold or domain or sub-domain
NKIKKEKYIGHYSMQEKYRTSG

SEQ ID NO: 14182 - protein, 30 aa, artificial
  peptide fold or domain or sub-domain
NKIKVTKAGLINWNPVTQNFVGGQMSLNSV

SEQ ID NO: 14183 - protein, 26 aa, artificial
  peptide fold or domain or sub-domain
NKINGKDCIKLSDDKGKHTGSLEEVR

SEQ ID NO: 14184 - protein, 29 aa, artificial
  peptide fold or domain or sub-domain
NKISDLHSRSLNNMDEASAQYAEQQLASI

SEQ ID NO: 14185 - protein, 30 aa, artificial
  peptide fold or domain or sub-domain
NKISTSGHTEEEFKERFHATLSKTSVPLTI

SEQ ID NO: 14186 - protein, 29 aa, artificial
  peptide fold or domain or sub-domain
NKITITNPGDSGLFVGETISINEFTEVAQ

SEQ ID NO: 14187 - protein, 30 aa, artificial
  peptide fold or domain or sub-domain
NKIVGYFIEISRAQAEQAPKDYLKKQTLVG

SEQ ID NO: 14188 - protein, 20 aa, artificial
  peptide fold or domain or sub-domain
NKKAAADMLHLKRTTLSAKV

SEQ ID NO: 14189 - protein, 24 aa, artificial
  peptide fold or domain or sub-domain
NKKELREKILDLGDDEKLNFLVKY

SEQ ID NO: 14190 - protein, 20 aa, artificial
  peptide fold or domain or sub-domain
NKKKMMDKKSIETQLMFDML

SEQ ID NO: 14191 - protein, 30 aa, artificial
  peptide fold or domain or sub-domain
NKKYKPSKGAFWKTNYNGFKRLSELGRLIG

SEQ ID NO: 14192 - protein, 20 aa, artificial
  peptide fold or domain or sub-domain
NKLEGSLEQEKKLRMDLERA

SEQ ID NO: 14193 - protein, 20 aa, artificial
  peptide fold or domain or sub-domain
NKLGVTLKPVSEEQKVTDVR

SEQ ID NO: 14194 - protein, 28 aa, artificial
  peptide fold or domain or sub-domain
NKLIASKIFGYEIKDDNIIKDGRYRLGI

SEQ ID NO: 14195 - protein, 20 aa, artificial
  peptide fold or domain or sub-domain
NKLVVHPYTVRSDKLPEYTP

SEQ ID NO: 14196 - protein, 26 aa, artificial
  peptide fold or domain or sub-domain
NKLVYSPHVYGPDVYNQPYFGPAKGF

SEQ ID NO: 14197 - protein, 23 aa, artificial
  peptide fold or domain or sub-domain
NKMKLAQQYVMTSLQQEYKKQML

SEQ ID NO: 14198 - protein, 20 aa, artificial
  peptide fold or domain or sub-domain
NKNEAIKTYGYDTIQKWRRS

SEQ ID NO: 14199 - protein, 25 aa, artificial
  peptide fold or domain or sub-domain
NKNFDFIGPIQFDAVVDLKVRNKKV

SEQ ID NO: 14200 - protein, 20 aa, artificial
  peptide fold or domain or sub-domain
NKNFYEEHDDIKRLQYLDII

SEQ ID NO: 14201 - protein, 24 aa, artificial
  peptide fold or domain or sub-domain
NKPLMENPETNAQFLSSIPLGRWG

SEQ ID NO: 14202 - protein, 20 aa, artificial
  peptide fold or domain or sub-domain
NKQDQYYFKKALLPNQLPAG

SEQ ID NO: 14203 - protein, 23 aa, artificial
  peptide fold or domain or sub-domain
NKQFYKELTNLTGMVISTPNDVN

SEQ ID NO: 14204 - protein, 30 aa, artificial
  peptide fold or domain or sub-domain
NKQYDALVEEAARTMDSAKRFELFEQANKI

SEQ ID NO: 14205 - protein, 22 aa, artificial
  peptide fold or domain or sub-domain
NKRDIEEGKAKGFSDSLLDRLM

SEQ ID NO: 14206 - protein, 29 aa, artificial
  peptide fold or domain or sub-domain
NKRGDTKKRMKRTSDENEHRVLDATQLAI

SEQ ID NO: 14207 - protein, 27 aa, artificial
  peptide fold or domain or sub-domain
NKRIGLDCIALIRDLLPRLTSLKTINL

SEQ ID NO: 14208 - protein, 23 aa, artificial
  peptide fold or domain or sub-domain
NKSDAYWQEKLSEMAYQVCRQQA

SEQ ID NO: 14209 - protein, 20 aa, artificial
  peptide fold or domain or sub-domain
NKSLVAKKLGISRKTLYKRL

SEQ ID NO: 14210 - protein, 26 aa, artificial
  peptide fold or domain or sub-domain
NKSMVLMLTARSLEDDILRGFEVGAQ

SEQ ID NO: 14211 - protein, 24 aa, artificial
  peptide fold or domain or sub-domain
NKSVWENPDTLKDLDDKIAMGFPG

SEQ ID NO: 14212 - protein, 27 aa, artificial
  peptide fold or domain or sub-domain
NKSYPVDEWECTRDDRIAKIQGNHNPF

SEQ ID NO: 14213 - protein, 20 aa, artificial
  peptide fold or domain or sub-domain
NKTATRLQNRDWFQFSGRIT

SEQ ID NO: 14214 - protein, 30 aa, artificial
  peptide fold or domain or sub-domain
NKTDGYYIQVGKSETDAVPEKYQHIKTLKN

SEQ ID NO: 14215 - protein, 30 aa, artificial
  peptide fold or domain or sub-domain
NKTFLDENGVLPKDIMPDLLHPNEKGYALW

SEQ ID NO: 14216 - protein, 26 aa, artificial
  peptide fold or domain or sub-domain
NKTIEAEKVFRGDPEHPAISYLFNVA

SEQ ID NO: 14217 - protein, 29 aa, artificial
  peptide fold or domain or sub-domain
NKTTPVNGFLEPSPESKFAEVPAFQLENI

SEQ ID NO: 14218 - protein, 30 aa, artificial
  peptide fold or domain or sub-domain
NKVIKAHFDEKSNLWNIKTNKDKTFLCKYL

SEQ ID NO: 14219 - protein, 29 aa, artificial
  peptide fold or domain or sub-domain
NKVKVIQSGESHLLQGEIVTQQKFKEVVT

SEQ ID NO: 14220 - protein, 28 aa, artificial
  peptide fold or domain or sub-domain
NKVKVYDLQGKDIPPGWVVDEAGRPVTA

SEQ ID NO: 14221 - protein, 30 aa, artificial
  peptide fold or domain or sub-domain
NKVSGFYFELPKMQAKNAPAHFIRRQTLKS

SEQ ID NO: 14222 - protein, 29 aa, artificial
  peptide fold or domain or sub-domain
NKWFPALRMAAITKSEDAKAKAMEEVEEG

SEQ ID NO: 14223 - protein, 25 aa, artificial
  peptide fold or domain or sub-domain
NKYAPEHLILQIKEAEKAVDLVMNA

SEQ ID NO: 14224 - protein, 26 aa, artificial
  peptide fold or domain or sub-domain
NLAAMTDWAKQNLSGYFPWSFKKMSH

SEQ ID NO: 14225 - protein, 28 aa, artificial
  peptide fold or domain or sub-domain
NLAEEHRQVRAGGWQTTTGMTLSGKTLG

SEQ ID NO: 14226 - protein, 25 aa, artificial
  peptide fold or domain or sub-domain
NLALLESEEINKYSKKEQIAINKET

SEQ ID NO: 14227 - protein, 20 aa, artificial
  peptide fold or domain or sub-domain
NLANANGGSLDNLEPGLQKA

SEQ ID NO: 14228 - protein, 30 aa, artificial
  peptide fold or domain or sub-domain
NLANSAAIRASKLQAKFVSLTDLEWAKDKI

SEQ ID NO: 14229 - protein, 29 aa, artificial
  peptide fold or domain or sub-domain
NLAPAQLDPAHNPLHAFYNTSGGLAELSD

SEQ ID NO: 14230 - protein, 26 aa, artificial
  peptide fold or domain or sub-domain
NLARNAYLQAQAKQPANKEISDEIIS

SEQ ID NO: 14231 - protein, 28 aa, artificial
  peptide fold or domain or sub-domain
NLAWSHQAAHSQNPQAFADAHKHSPLTA

SEQ ID NO: 14232 - protein, 30 aa, artificial
  peptide fold or domain or sub-domain
NLCNNGDPICSDGNRWRAHLGYVPGMTNQA

SEQ ID NO: 14233 - protein, 30 aa, artificial
  peptide fold or domain or sub-domain
NLDAPITDFVPAFRALAPDAAPVTPSVRQL

SEQ ID NO: 14234 - protein, 30 aa, artificial
  peptide fold or domain or sub-domain
NLDDHIADLLPDSIDIERIPNGDEVTVQQL

SEQ ID NO: 14235 - protein, 30 aa, artificial
  peptide fold or domain or sub-domain
NLDDPVLSHLRRWQFPADSPYRGEVTIAQL

SEQ ID NO: 14236 - protein, 30 aa, artificial
  peptide fold or domain or sub-domain
NLDDTSGIHTIYDDENIPIIVDSIPITYIG

SEQ ID NO: 14237 - protein, 27 aa, artificial
  peptide fold or domain or sub-domain
NLDTVSEAALALQQLGYKPAEAARMAR

SEQ ID NO: 14238 - protein, 23 aa, artificial
  peptide fold or domain or sub-domain
NLEDPLNLEVNNLWLSNPAQAKS

SEQ ID NO: 14239 - protein, 27 aa, artificial
  peptide fold or domain or sub-domain
NLEETGIPCWDFRVPHREKEPWDSSAG

SEQ ID NO: 14240 - protein, 29 aa, artificial
  peptide fold or domain or sub-domain
NLEKAQSELLGAADEATRAEIQIRIEANE

SEQ ID NO: 14241 - protein, 26 aa, artificial
  peptide fold or domain or sub-domain
NLEKIESKSLENKFEIKTINSEMQEY

SEQ ID NO: 14242 - protein, 20 aa, artificial
  peptide fold or domain or sub-domain
NLEKMAREMGLSKSAMISVA

SEQ ID NO: 14243 - protein, 21 aa, artificial
  peptide fold or domain or sub-domain
NLFDRIRNGQLVADTRVVTVL

SEQ ID NO: 14244 - protein, 23 aa, artificial
  peptide fold or domain or sub-domain
NLFEAGATVRTLRVWKGSQKEVD

SEQ ID NO: 14245 - protein, 21 aa, artificial
  peptide fold or domain or sub-domain
NLFEMLKQPDPNVQLEATISF

SEQ ID NO: 14246 - protein, 30 aa, artificial
  peptide fold or domain or sub-domain
NLFMIDRCGLLLERHAKIATDGQKPFLKKD

SEQ ID NO: 14247 - protein, 27 aa, artificial
  peptide fold or domain or sub-domain
NLGTLGDMAQGKTEYDAEAAQAAADSL

SEQ ID NO: 14248 - protein, 22 aa, artificial
  peptide fold or domain or sub-domain
NLGWVRRLGLVGDGPSLAWYTS

SEQ ID NO: 14249 - protein, 25 aa, artificial
  peptide fold or domain or sub-domain
NLGYKGDEKDADVLSFLSKVCARQI

SEQ ID NO: 14250 - protein, 24 aa, artificial
  peptide fold or domain or sub-domain
NLICADDLPEGRPGPLGMYQCFVD

SEQ ID NO: 14251 - protein, 28 aa, artificial
  peptide fold or domain or sub-domain
NLIGYHNDIAAGEWQRHKQFCFFTHPIG

SEQ ID NO: 14252 - protein, 30 aa, artificial
  peptide fold or domain or sub-domain
NLINTAAIKAVQNGKETISIKQIDDARDDI

SEQ ID NO: 14253 - protein, 27 aa, artificial
  peptide fold or domain or sub-domain
NLINYGIEGVHYEKISNNKIRLLEESK

SEQ ID NO: 14254 - protein, 21 aa, artificial
  peptide fold or domain or sub-domain
NLIRHIGTYPSSIYKYAILTM

SEQ ID NO: 14255 - protein, 30 aa, artificial
  peptide fold or domain or sub-domain
NLISAERINKKFMSNAINASRYEGNNYGFP

SEQ ID NO: 14256 - protein, 26 aa, artificial
  peptide fold or domain or sub-domain
NLISQSYKGKKVREVLPFFSNTYISE

SEQ ID NO: 14257 - protein, 29 aa, artificial
  peptide fold or domain or sub-domain
NLIYITDFKHHCVQVYTSEGKFIRKMGEP

SEQ ID NO: 14258 - protein, 22 aa, artificial
  peptide fold or domain or sub-domain
NLKDQNEAKASGMLPAMLDRLI

SEQ ID NO: 14259 - protein, 21 aa, artificial
  peptide fold or domain or sub-domain
NLLDALRNNELAVSPPLATLL

SEQ ID NO: 14260 - protein, 21 aa, artificial
  peptide fold or domain or sub-domain
NLLDEARRGEMQLNTDIINLF

SEQ ID NO: 14261 - protein, 21 aa, artificial
  peptide fold or domain or sub-domain
NLLDRIRKQELGLRADMVDAF

SEQ ID NO: 14262 - protein, 23 aa, artificial
  peptide fold or domain or sub-domain
NLLETLKELRENKCEAQGFLVNG

SEQ ID NO: 14263 - protein, 24 aa, artificial
  peptide fold or domain or sub-domain
NLLEVHTAEYEDGSERDILDHLVT

SEQ ID NO: 14264 - protein, 30 aa, artificial
  peptide fold or domain or sub-domain
NLLIKASNYDLYYKAILFYLDEQPEQVNEL

SEQ ID NO: 14265 - protein, 25 aa, artificial
  peptide fold or domain or sub-domain
NLLKGKENGMLCYQLAKLNYEVEVL

SEQ ID NO: 14266 - protein, 25 aa, artificial
  peptide fold or domain or sub-domain
NLLNDLKNKALWNDYQNAQQTIKSS

SEQ ID NO: 14267 - protein, 30 aa, artificial
  peptide fold or domain or sub-domain
NLLNEAALLAGRHGHDAIQYSDIEQARDKV

SEQ ID NO: 14268 - protein, 29 aa, artificial
  peptide fold or domain or sub-domain
NLLQVTDAGNSNLFVGQLVHSHYLNELNK

SEQ ID NO: 14269 - protein, 27 aa, artificial
  peptide fold or domain or sub-domain
NLMIRVDERMNMYDVAPENVEKIRAQM

SEQ ID NO: 14270 - protein, 30 aa, artificial
  peptide fold or domain or sub-domain
NLMNEAAILAARRELKEISKDEISDALERI

SEQ ID NO: 14271 - protein, 25 aa, artificial
  peptide fold or domain or sub-domain
NLMNGREAAMMSRELVELKRDVESP

SEQ ID NO: 14272 - protein, 22 aa, artificial
  peptide fold or domain or sub-domain
NLMQYLESKEYDRCAWTVVQVQ

SEQ ID NO: 14273 - protein, 25 aa, artificial
  peptide fold or domain or sub-domain
NLNADVFGPLAFDNSISKKSAAIKG

SEQ ID NO: 14274 - protein, 24 aa, artificial
  peptide fold or domain or sub-domain
NLNHFPWFKEIPFDDLPENARFKT

SEQ ID NO: 14275 - protein, 27 aa, artificial
  peptide fold or domain or sub-domain
NLNNYNDPEQQKRAIYHWTPDINNYSD

SEQ ID NO: 14276 - protein, 30 aa, artificial
  peptide fold or domain or sub-domain
NLNTPISHWLGKRPWFDRLPNHADITLKQL

SEQ ID NO: 14277 - protein, 23 aa, artificial
  peptide fold or domain or sub-domain
NLPDDFTLAASSATCQVQGFYHK

SEQ ID NO: 14278 - protein, 29 aa, artificial
  peptide fold or domain or sub-domain
NLPTVMDFPLMEEMNKAFDEETTEWNGGL

SEQ ID NO: 14279 - protein, 25 aa, artificial
  peptide fold or domain or sub-domain
NLPVYAWNLWNEGKADIMIDSTITA

SEQ ID NO: 14280 - protein, 26 aa, artificial
  peptide fold or domain or sub-domain
NLPWQGIQAKDQQIKSIKIGETKMAT

SEQ ID NO: 14281 - protein, 25 aa, artificial
  peptide fold or domain or sub-domain
NLQKYADQARLSKRLGEIKVDVPLD

SEQ ID NO: 14282 - protein, 29 aa, artificial
  peptide fold or domain or sub-domain
NLSEVIRSTYFDGLDLVPGNLELMEFEHT

SEQ ID NO: 14283 - protein, 25 aa, artificial
  peptide fold or domain or sub-domain
NLSLVMISEAGSIDEYSSSPLVEQL

SEQ ID NO: 14284 - protein, 30 aa, artificial
  peptide fold or domain or sub-domain
NLSNMKKRLKLRKKLNRYDKFNSKFYEKVQ

SEQ ID NO: 14285 - protein, 24 aa, artificial
  peptide fold or domain or sub-domain
NLSRETRLSNARFFSYKIEAVPKF

SEQ ID NO: 14286 - protein, 27 aa, artificial
  peptide fold or domain or sub-domain
NLSVNDAETVNEIWPHRAHDSVKFVRR

SEQ ID NO: 14287 - protein, 26 aa, artificial
  peptide fold or domain or sub-domain
NLTESATLEMTRLSRELQAQGIDIIN

SEQ ID NO: 14288 - protein, 27 aa, artificial
  peptide fold or domain or sub-domain
NLTETFFKQDPPTEEEVKRFFEFLEKE

SEQ ID NO: 14289 - protein, 29 aa, artificial
  peptide fold or domain or sub-domain
NLTIPQGRPAITISTSQLQRDYRSDYFQR

SEQ ID NO: 14290 - protein, 29 aa, artificial
  peptide fold or domain or sub-domain
NLTQPYFDLSITRNGKQLTTPDGSLAGSC

SEQ ID NO: 14291 - protein, 24 aa, artificial
  peptide fold or domain or sub-domain
NLVLGQIIAAQRGLPAEKGEEMVK

SEQ ID NO: 14292 - protein, 30 aa, artificial
  peptide fold or domain or sub-domain
NLVNEAAILACKENSSFIENQHMDKAFSIV

SEQ ID NO: 14293 - protein, 30 aa, artificial
  peptide fold or domain or sub-domain
NLVNEAALFAARGNKRVVSMVEFEKAKDKI

SEQ ID NO: 14294 - protein, 30 aa, artificial
  peptide fold or domain or sub-domain
NLVNEAALLAGRKSKMTVDKIDFIHAVERS

SEQ ID NO: 14295 - protein, 30 aa, artificial
  peptide fold or domain or sub-domain
NLVNMAAVQAAMADAPAITAADLDWARDRV

SEQ ID NO: 14296 - protein, 30 aa, artificial
  peptide fold or domain or sub-domain
NLVNQAAIAAALRNDPFVEMHHLWDARDRL

SEQ ID NO: 14297 - protein, 30 aa, artificial
  peptide fold or domain or sub-domain
NLVNWAALETTKHNLPEITMEQLENAKENL

SEQ ID NO: 14298 - protein, 21 aa, artificial
  peptide fold or domain or sub-domain
NLVSNLAHCNGVSWEIAFEEL

SEQ ID NO: 14299 - protein, 21 aa, artificial
  peptide fold or domain or sub-domain
NLVSNWCTVDGITMDQALTRL

SEQ ID NO: 14300 - protein, 20 aa, artificial
  peptide fold or domain or sub-domain
NLWVNGQQKVVQGKYLNTRS

SEQ ID NO: 14301 - protein, 25 aa, artificial
  peptide fold or domain or sub-domain
NLYAPEHLCLLTRDPWSLLGQVRRA

SEQ ID NO: 14302 - protein, 25 aa, artificial
  peptide fold or domain or sub-domain
NLYAPEHLIIQCENSNRLLVYVINA

SEQ ID NO: 14303 - protein, 25 aa, artificial
  peptide fold or domain or sub-domain
NLYAPEHVHLNCEGAGAALERVEAA

SEQ ID NO: 14304 - protein, 25 aa, artificial
  peptide fold or domain or sub-domain
NLYGPEHLVLHLKNASSYIPKIDNA

SEQ ID NO: 14305 - protein, 30 aa, artificial
  peptide fold or domain or sub-domain
NLYLEGYSDIYNGKCRYRIFKDSESDAQET

SEQ ID NO: 14306 - protein, 25 aa, artificial
  peptide fold or domain or sub-domain
NLYTPAAGKAQIRSKVCPVDEAWDS

SEQ ID NO: 14307 - protein, 28 aa, artificial
  peptide fold or domain or sub-domain
NLYVYCSNAPGCNAKVILGRYQDHLQQC

SEQ ID NO: 14308 - protein, 23 aa, artificial
  peptide fold or domain or sub-domain
NMCAVIDGNSTTFEHQQPLQDRM

SEQ ID NO: 14309 - protein, 27 aa, artificial
  peptide fold or domain or sub-domain
NMGFMGCTLKGACDAGPKVTLKQAQSL

SEQ ID NO: 14310 - protein, 20 aa, artificial
  peptide fold or domain or sub-domain
NMGKVQAQLQAGDYEKAGTF

SEQ ID NO: 14311 - protein, 27 aa, artificial
  peptide fold or domain or sub-domain
NMGPLGAMAKGKIPLDAKVVEKNAIRI

SEQ ID NO: 14312 - protein, 27 aa, artificial
  peptide fold or domain or sub-domain
NMGTLSGMAKGDVAYDEAAASRAAANI

SEQ ID NO: 14313 - protein, 22 aa, artificial
  peptide fold or domain or sub-domain
NMIEDANGRVSKISSTNSSGDD

SEQ ID NO: 14314 - protein, 30 aa, artificial
  peptide fold or domain or sub-domain
NMINQAALRAAIDGAETVSMKHLETARDKV

SEQ ID NO: 14315 - protein, 24 aa, artificial
  peptide fold or domain or sub-domain
NMIRRIIQTGIERGEIEPHVNAEE

SEQ ID NO: 14316 - protein, 28 aa, artificial
  peptide fold or domain or sub-domain
NMLVEADTDNYDGLNYLSGKSFHEINST

SEQ ID NO: 14317 - protein, 25 aa, artificial
  peptide fold or domain or sub-domain
NMMAPEHLEVLTKKPRNIADRIRTA

SEQ ID NO: 14318 - protein, 22 aa, artificial
  peptide fold or domain or sub-domain
NMMHKKLCSHPNGYDIVFNFHK

SEQ ID NO: 14319 - protein, 21 aa, artificial
  peptide fold or domain or sub-domain
NMNGYLRGSVEKLAPDNAERI

SEQ ID NO: 14320 - protein, 26 aa, artificial
  peptide fold or domain or sub-domain
NMNGYLRGSVEKLAPDNAERIKNLSS

SEQ ID NO: 14321 - protein, 23 aa, artificial
  peptide fold or domain or sub-domain
NMNPHPLHIDEEYGKQTEFGQTL

SEQ ID NO: 14322 - protein, 29 aa, artificial
  peptide fold or domain or sub-domain
NMRKALRAQIPLAATEDEKVLLDMQQIAI

SEQ ID NO: 14323 - protein, 23 aa, artificial
  peptide fold or domain or sub-domain
NMRPSELRYLYYLADIVKNPPAY

SEQ ID NO: 14324 - protein, 23 aa, artificial
  peptide fold or domain or sub-domain
NMSDPAQQDAYDQLRKSKATYEK

SEQ ID NO: 14325 - protein, 29 aa, artificial
  peptide fold or domain or sub-domain
NMSTWAVKELRKMHRRPVTRDYENLGRRI

SEQ ID NO: 14326 - protein, 24 aa, artificial
  peptide fold or domain or sub-domain
NMSWIDDPEQYKAVSSHIPMKRPG

SEQ ID NO: 14327 - protein, 30 aa, artificial
  peptide fold or domain or sub-domain
NMTCKDKNGGCAPEAECKMNDKNEIVCKCT

SEQ ID NO: 14328 - protein, 20 aa, artificial
  peptide fold or domain or sub-domain
NMTEAAGKLGLHRSNLYRKM

SEQ ID NO: 14329 - protein, 27 aa, artificial
  peptide fold or domain or sub-domain
NMTPESFANSVAKLDQQREESKNNWPA

SEQ ID NO: 14330 - protein, 30 aa, artificial
  peptide fold or domain or sub-domain
NMVNISILNAIKHNRQVSNKLDFDFALDRI

SEQ ID NO: 14331 - protein, 27 aa, artificial
  peptide fold or domain or sub-domain
NMYVLEEGEYPNPEALGLLNEDCKISS

SEQ ID NO: 14332 - protein, 20 aa, artificial
  peptide fold or domain or sub-domain
NNALWSKMLVEEDPGFFEKL

SEQ ID NO: 14333 - protein, 27 aa, artificial
  peptide fold or domain or sub-domain
NNASIENHFYKLQLNPDKGTIQSLYDK

SEQ ID NO: 14334 - protein, 29 aa, artificial
  peptide fold or domain or sub-domain
NNAYADLRDCIPNVPPDTKLSKIKTLRLA

SEQ ID NO: 14335 - protein, 27 aa, artificial
  peptide fold or domain or sub-domain
NNAYLGLIRQSQRAFDMDYCVQLAFEN

SEQ ID NO: 14336 - protein, 30 aa, artificial
  peptide fold or domain or sub-domain
NNDGCVIARNAEAKALGVKMGDPWFKQKDL

SEQ ID NO: 14337 - protein, 30 aa, artificial
  peptide fold or domain or sub-domain
NNDGMTVTLSPEAAALGLKKFTPYFQVAEF

SEQ ID NO: 14338 - protein, 30 aa, artificial
  peptide fold or domain or sub-domain
NNDGMVVAANRQAKEAGIPKFVPYFQIRDL

SEQ ID NO: 14339 - protein, 30 aa, artificial
  peptide fold or domain or sub-domain
NNEICIERCLERGKSSGRSDDNRESLEKRI

SEQ ID NO: 14340 - protein, 29 aa, artificial
  peptide fold or domain or sub-domain
NNEIKSVAERAMLRAAAPDCRTMLQDATR

SEQ ID NO: 14341 - protein, 27 aa, artificial
  peptide fold or domain or sub-domain
NNEMLQQVARTPLWQSLSFVRENQLRL

SEQ ID NO: 14342 - protein, 20 aa, artificial
  peptide fold or domain or sub-domain
NNENWRQKMLKQDPQFFSNL

SEQ ID NO: 14343 - protein, 28 aa, artificial
  peptide fold or domain or sub-domain
NNFSIKGSKYELYNHKLLIGDSLCVSNE

SEQ ID NO: 14344 - protein, 26 aa, artificial
  peptide fold or domain or sub-domain
NNFYWPDNETFTTTVNQNANVTVQEK

SEQ ID NO: 14345 - protein, 23 aa, artificial
  peptide fold or domain or sub-domain
NNGAAADWLRTIGAQLTVAGGQI

SEQ ID NO: 14346 - protein, 26 aa, artificial
  peptide fold or domain or sub-domain
NNGAVLGRLMRQYLAAEYPGLVDWFD

SEQ ID NO: 14347 - protein, 26 aa, artificial
  peptide fold or domain or sub-domain
NNGEVLEKVVLQFAKQVSAELCEWVS

SEQ ID NO: 14348 - protein, 25 aa, artificial
  peptide fold or domain or sub-domain
NNGLRDGVKGDVQTPADRGFISGAF

SEQ ID NO: 14349 - protein, 27 aa, artificial
  peptide fold or domain or sub-domain
NNGLYGTIRIHEENRLDGRTNGTDLTN

SEQ ID NO: 14350 - protein, 27 aa, artificial
  peptide fold or domain or sub-domain
NNGNLGMVRQWQTLFYEGRYSNTKLRN

SEQ ID NO: 14351 - protein, 27 aa, artificial
  peptide fold or domain or sub-domain
NNGRLDMPEKAMIKFFGKTVGTNYNVP

SEQ ID NO: 14352 - protein, 27 aa, artificial
  peptide fold or domain or sub-domain
NNGTLSLIRKNQFQLYGERYIDCDFTN

SEQ ID NO: 14353 - protein, 29 aa, artificial
  peptide fold or domain or sub-domain
NNIIVSDGGDCSVKKFSSQGEFLLSFGAE

SEQ ID NO: 14354 - protein, 27 aa, artificial
  peptide fold or domain or sub-domain
NNKSFGWIRAAMLSKYGRVLSGTEISE

SEQ ID NO: 14355 - protein, 21 aa, artificial
  peptide fold or domain or sub-domain
NNLETIKGREVIDGDELIGIV

SEQ ID NO: 14356 - protein, 30 aa, artificial
  peptide fold or domain or sub-domain
NNLIGYYVEVPKSAPLLDSEVFIHRQSLLN

SEQ ID NO: 14357 - protein, 22 aa, artificial
  peptide fold or domain or sub-domain
NNMTLYKNGKVLQVLDKTSDFH

SEQ ID NO: 14358 - protein, 28 aa, artificial
  peptide fold or domain or sub-domain
NNMVKKLKLKKLLKSERYAKLQLTDSGR

SEQ ID NO: 14359 - protein, 28 aa, artificial
  peptide fold or domain or sub-domain
NNMVKKMEERGWLLYEKYKPIKLTSKGE

SEQ ID NO: 14360 - protein, 21 aa, artificial
  peptide fold or domain or sub-domain
NNNAYCQDNEISWFDWRLLDE

SEQ ID NO: 14361 - protein, 20 aa, artificial
  peptide fold or domain or sub-domain
NNNGYCQDSPLSWYDWEHAG

SEQ ID NO: 14362 - protein, 27 aa, artificial
  peptide fold or domain or sub-domain
NNNGYSSIRASQKAFFGEATIGCDTST

SEQ ID NO: 14363 - protein, 20 aa, artificial
  peptide fold or domain or sub-domain
NNPANLGIKNGALTITPVRN

SEQ ID NO: 14364 - protein, 24 aa, artificial
  peptide fold or domain or sub-domain
NNPEEVKSKKARVVGYLSADSFDK

SEQ ID NO: 14365 - protein, 26 aa, artificial
  peptide fold or domain or sub-domain
NNPHCPINDYDDLVEARVCEMAGLHD

SEQ ID NO: 14366 - protein, 24 aa, artificial
  peptide fold or domain or sub-domain
NNPWFNYLKGDLQALNNDQKAGAL

SEQ ID NO: 14367 - protein, 27 aa, artificial
  peptide fold or domain or sub-domain
NNQELEEAVEALLALGYKTNELKKIEK

SEQ ID NO: 14368 - protein, 27 aa, artificial
  peptide fold or domain or sub-domain
NNQEQGMISQLQRESYEGRICYARQDN

SEQ ID NO: 14369 - protein, 27 aa, artificial
  peptide fold or domain or sub-domain
NNQHLGMVMQWEDRFYKANRAHTFLGD

SEQ ID NO: 14370 - protein, 27 aa, artificial
  peptide fold or domain or sub-domain
NNQMYGTIRMHQEIHYPKKVIATDLGN

SEQ ID NO: 14371 - protein, 20 aa, artificial
  peptide fold or domain or sub-domain
NNREWVDRVNAEDPTFFMRL

SEQ ID NO: 14372 - protein, 27 aa, artificial
  peptide fold or domain or sub-domain
NNRFLGMVKQWQDMIYSGRHSSSYMES

SEQ ID NO: 14373 - protein, 20 aa, artificial
  peptide fold or domain or sub-domain
NNRKWLAEKNRTNSEFFDQL

SEQ ID NO: 14374 - protein, 20 aa, artificial
  peptide fold or domain or sub-domain
NNRPHESLPLRSDGEHFTPA

SEQ ID NO: 14375 - protein, 23 aa, artificial
  peptide fold or domain or sub-domain
NNRSPLNAVAAELWDADMEEYRK

SEQ ID NO: 14376 - protein, 27 aa, artificial
  peptide fold or domain or sub-domain
NNRYLGMVSQLQKLFNEHVYATKLTET

SEQ ID NO: 14377 - protein, 20 aa, artificial
  peptide fold or domain or sub-domain
NNSKWSESIKAETPEYFAKL

SEQ ID NO: 14378 - protein, 28 aa, artificial
  peptide fold or domain or sub-domain
NNSLSYISYYNKRMPDYSMDGQTLTGTA

SEQ ID NO: 14379 - protein, 22 aa, artificial
  peptide fold or domain or sub-domain
NNTHPADEFLGTTWQGHLIPRD

SEQ ID NO: 14380 - protein, 28 aa, artificial
  peptide fold or domain or sub-domain
NNTHPADEFLGTTWQGHLIPRDSKPKYK

SEQ ID NO: 14381 - protein, 29 aa, artificial
  peptide fold or domain or sub-domain
NNTIFSEIIEKYNSEYNINLKKEILSLLK

SEQ ID NO: 14382 - protein, 20 aa, artificial
  peptide fold or domain or sub-domain
NNTVASPFYIRQGTTGKAPL

SEQ ID NO: 14383 - protein, 20 aa, artificial
  peptide fold or domain or sub-domain
NNVGNRLTEICAGKSSYAEA

SEQ ID NO: 14384 - protein, 28 aa, artificial
  peptide fold or domain or sub-domain
NNVKLLTEMVMSHSSSEDLMKELYQRCE

SEQ ID NO: 14385 - protein, 29 aa, artificial
  peptide fold or domain or sub-domain
NNVMQTADYLINNALENGNVEVQLSNIQN

SEQ ID NO: 14386 - protein, 24 aa, artificial
  peptide fold or domain or sub-domain
NNVQTLITLMDFSDEMMMQLQKFN

SEQ ID NO: 14387 - protein, 20 aa, artificial
  peptide fold or domain or sub-domain
NNVTVVKDLAGVGQNLQDHL

SEQ ID NO: 14388 - protein, 23 aa, artificial
  peptide fold or domain or sub-domain
NNYFVTNTEYEDSLKYQILLELF

SEQ ID NO: 14389 - protein, 23 aa, artificial
  peptide fold or domain or sub-domain
NNYLIFVLTKLKSEDEPTRSLSG

SEQ ID NO: 14390 - protein, 23 aa, artificial
  peptide fold or domain or sub-domain
NNYLVFILVRAEGKSVEVRQAAG

SEQ ID NO: 14391 - protein, 20 aa, artificial
  peptide fold or domain or sub-domain
NNYSWAQRMKEENSTYFKEL

SEQ ID NO: 14392 - protein, 27 aa, artificial
  peptide fold or domain or sub-domain
NPAARQAREQRRAGRYAEAELMRRIAD

SEQ ID NO: 14393 - protein, 23 aa, artificial
  peptide fold or domain or sub-domain
NPADPLVGSIATQYMTNRAEHDR

SEQ ID NO: 14394 - protein, 25 aa, artificial
  peptide fold or domain or sub-domain
NPALHVLYHDWLQGQDSPQASILLH

SEQ ID NO: 14395 - protein, 30 aa, artificial
  peptide fold or domain or sub-domain
NPAYDKVLAQASTENTVKARNADYNAAEKI

SEQ ID NO: 14396 - protein, 25 aa, artificial
  peptide fold or domain or sub-domain
NPCDEAKCGPYEQCVINRQGIASCE

SEQ ID NO: 14397 - protein, 23 aa, artificial
  peptide fold or domain or sub-domain
NPDDALDSNVAAEYKHEKALYTQ

SEQ ID NO: 14398 - protein, 23 aa, artificial
  peptide fold or domain or sub-domain
NPDDPLANDVAEQWKTNEAQAIE

SEQ ID NO: 14399 - protein, 23 aa, artificial
  peptide fold or domain or sub-domain
NPDDPLMADISSEFKYNKPAFLK

SEQ ID NO: 14400 - protein, 23 aa, artificial
  peptide fold or domain or sub-domain
NPDDPLVPEIAHTYKADREKYNR

SEQ ID NO: 14401 - protein, 24 aa, artificial
  peptide fold or domain or sub-domain
NPDGYGRVVMESGVVQRIIEQKDA

SEQ ID NO: 14402 - protein, 25 aa, artificial
  peptide fold or domain or sub-domain
NPDLALDGELQFDAAFVPETAAIKA

SEQ ID NO: 14403 - protein, 26 aa, artificial
  peptide fold or domain or sub-domain
NPDNVRDVAESVGIASLADNVVEELA

SEQ ID NO: 14404 - protein, 30 aa, artificial
  peptide fold or domain or sub-domain
NPDYDELLQQASKTEDQSKRFTLYQQAESL

SEQ ID NO: 14405 - protein, 30 aa, artificial
  peptide fold or domain or sub-domain
NPDYDKMIKDGNAETDLKKRAEIFKKAEQL

SEQ ID NO: 14406 - protein, 30 aa, artificial
  peptide fold or domain or sub-domain
NPEDIVLNLSKDAPVPPAPEGHKWGEIRHD

SEQ ID NO: 14407 - protein, 30 aa, artificial
  peptide fold or domain or sub-domain
NPEFDKEVELARIALKPEERKEHFKNAQII

SEQ ID NO: 14408 - protein, 30 aa, artificial
  peptide fold or domain or sub-domain
NPEFKKLLNQSQTETDKTKRAELLKKAEGI

SEQ ID NO: 14409 - protein, 24 aa, artificial
  peptide fold or domain or sub-domain
NPEGMIFSNVGADVPVEKALEAVE

SEQ ID NO: 14410 - protein, 22 aa, artificial
  peptide fold or domain or sub-domain
NPEIEALQDKIAEENGYRIVDH

SEQ ID NO: 14411 - protein, 25 aa, artificial
  peptide fold or domain or sub-domain
NPEIIDVYKNFLGEPNSHLAHELLH

SEQ ID NO: 14412 - protein, 30 aa, artificial
  peptide fold or domain or sub-domain
NPELDRILERAASTIDEDERRRLYVRAQEI

SEQ ID NO: 14413 - protein, 23 aa, artificial
  peptide fold or domain or sub-domain
NPESALNEEAGRLLLENYEEYAA

SEQ ID NO: 14414 - protein, 29 aa, artificial
  peptide fold or domain or sub-domain
NPESPWRDWYSFSDDGTALDWLGYASLPK

SEQ ID NO: 14415 - protein, 30 aa, artificial
  peptide fold or domain or sub-domain
NPEVDKLLEAGKTELDPEKRKDIYKQIQEI

SEQ ID NO: 14416 - protein, 30 aa, artificial
  peptide fold or domain or sub-domain
NPEYDALLAQAATVRDLDEREALLEKAENV

SEQ ID NO: 14417 - protein, 23 aa, artificial
  peptide fold or domain or sub-domain
NPFDNFAQTCANCHTQDKAALQK

SEQ ID NO: 14418 - protein, 30 aa, artificial
  peptide fold or domain or sub-domain
NPFFFTHQKAHWSESAMAYNRTVKYPGQYE

SEQ ID NO: 14419 - protein, 30 aa, artificial
  peptide fold or domain or sub-domain
NPFKLQKDLEKAGAAVHGTEEDSKTLHLLL

SEQ ID NO: 14420 - protein, 27 aa, artificial
  peptide fold or domain or sub-domain
NPFNQQSYFHDYCLITNYDDQTNVEDC

SEQ ID NO: 14421 - protein, 30 aa, artificial
  peptide fold or domain or sub-domain
NPGDELIVPEPTFPVYAAAASAFGGKIVPV

SEQ ID NO: 14422 - protein, 30 aa, artificial
  peptide fold or domain or sub-domain
NPGDEVLMTDPAYVAYPSCVFMSYGNPVQI

SEQ ID NO: 14423 - protein, 30 aa, artificial
  peptide fold or domain or sub-domain
NPGDIILVPTPTFSIYTPDVMIAGGTPVEV

SEQ ID NO: 14424 - protein, 30 aa, artificial
  peptide fold or domain or sub-domain
NPGDKILVPTPVWALYFQLIKLTGAIPVQI

SEQ ID NO: 14425 - protein, 23 aa, artificial
  peptide fold or domain or sub-domain
NPHDPLDVVKAGVYRDDVNNYNK

SEQ ID NO: 14426 - protein, 23 aa, artificial
  peptide fold or domain or sub-domain
NPHDPMEVSVADVFKGNRALHDK

SEQ ID NO: 14427 - protein, 22 aa, artificial
  peptide fold or domain or sub-domain
NPIIERQQALIAKEHGFKLTGH

SEQ ID NO: 14428 - protein, 23 aa, artificial
  peptide fold or domain or sub-domain
NPISVERADGIYFWDYDGNRYSD

SEQ ID NO: 14429 - protein, 27 aa, artificial
  peptide fold or domain or sub-domain
NPIYLVDHNSLDRKDLENFNGSIAGII

SEQ ID NO: 14430 - protein, 30 aa, artificial
  peptide fold or domain or sub-domain
NPKAQELIKQGNQATDAGKRKQLFTQAVKM

SEQ ID NO: 14431 - protein, 30 aa, artificial
  peptide fold or domain or sub-domain
NPKQFVKDMFSAIRYHLTGEQEGDELIELY

SEQ ID NO: 14432 - protein, 30 aa, artificial
  peptide fold or domain or sub-domain
NPKVDSLVAEANQKLDDGARAALLTQAHDL

SEQ ID NO: 14433 - protein, 30 aa, artificial
  peptide fold or domain or sub-domain
NPKVVYALVEAGKNVLLRSDDGGTSWKTIN

SEQ ID NO: 14434 - protein, 30 aa, artificial
  peptide fold or domain or sub-domain
NPKYDELIKKANSTNDNAVRMQAMHEAEKL

SEQ ID NO: 14435 - protein, 23 aa, artificial
  peptide fold or domain or sub-domain
NPLDDIASTCLTCHRDSEKAFRD

SEQ ID NO: 14436 - protein, 23 aa, artificial
  peptide fold or domain or sub-domain
NPLDNMDKSCMNCHRESEQKLKD

SEQ ID NO: 14437 - protein, 26 aa, artificial
  peptide fold or domain or sub-domain
NPLKLARIGFCTKPKAISDKEFAFFY

SEQ ID NO: 14438 - protein, 30 aa, artificial
  peptide fold or domain or sub-domain
NPLWTRSASEVKDEDYLEFYKKLYPLADDP

SEQ ID NO: 14439 - protein, 23 aa, artificial
  peptide fold or domain or sub-domain
NPMSPANNEAAALFVNDRHTYNL

SEQ ID NO: 14440 - protein, 25 aa, artificial
  peptide fold or domain or sub-domain
NPMVNDFYRRWFGEENSDVTHKHLH

SEQ ID NO: 14441 - protein, 30 aa, artificial
  peptide fold or domain or sub-domain
NPNADIHYGNPTWVNHLQIIANTGLNSISH

SEQ ID NO: 14442 - protein, 26 aa, artificial
  peptide fold or domain or sub-domain
NPNAQQFIDKMVNKHGFDRQQLQEIL

SEQ ID NO: 14443 - protein, 23 aa, artificial
  peptide fold or domain or sub-domain
NPNDALDSTIAAQYLDDINIFKQ

SEQ ID NO: 14444 - protein, 23 aa, artificial
  peptide fold or domain or sub-domain
NPNKGFSNQLQAFVVKVQQSPLA

SEQ ID NO: 14445 - protein, 23 aa, artificial
  peptide fold or domain or sub-domain
NPNSPANSTAAQLYKENRREYEK

SEQ ID NO: 14446 - protein, 23 aa, artificial
  peptide fold or domain or sub-domain
NPNSPLLEDVNTIFKNDKAAYLQ

SEQ ID NO: 14447 - protein, 26 aa, artificial
  peptide fold or domain or sub-domain
NPPKLVDIGFSPLPRGSTIARLVQQY

SEQ ID NO: 14448 - protein, 30 aa, artificial
  peptide fold or domain or sub-domain
NPQIRAERRYKQLQAKGKTCILDEILRQII

SEQ ID NO: 14449 - protein, 30 aa, artificial
  peptide fold or domain or sub-domain
NPQLDELVRQADVEQDPVKRAELYAQAQRI

SEQ ID NO: 14450 - protein, 25 aa, artificial
  peptide fold or domain or sub-domain
NPQVQALYRELLQAPNSEIAHRLLH

SEQ ID NO: 14451 - protein, 26 aa, artificial
  peptide fold or domain or sub-domain
NPRKLVEVKFSHLSRNMTLQRTMKLY

SEQ ID NO: 14452 - protein, 24 aa, artificial
  peptide fold or domain or sub-domain
NPRRDFYIWRDQPIGEFKNWTYDS

SEQ ID NO: 14453 - protein, 30 aa, artificial
  peptide fold or domain or sub-domain
NPSDEVILPDPSFYSYAEVVKLLGGKPIYA

SEQ ID NO: 14454 - protein, 27 aa, artificial
  peptide fold or domain or sub-domain
NPSIMQPILESLCKQYNRLEYLNLNAC

SEQ ID NO: 14455 - protein, 23 aa, artificial
  peptide fold or domain or sub-domain
NPSSAANGEAALLYTNAKDKYEE

SEQ ID NO: 14456 - protein, 25 aa, artificial
  peptide fold or domain or sub-domain
NPTAKRLFEEWLKEPGSNEAKKYLH

SEQ ID NO: 14457 - protein, 24 aa, artificial
  peptide fold or domain or sub-domain
NPTDDSFSVKSSHPNLLLGTNIGL

SEQ ID NO: 14458 - protein, 27 aa, artificial
  peptide fold or domain or sub-domain
NPTDIDKTLEHVLSNATSLTEVNLNNV

SEQ ID NO: 14459 - protein, 22 aa, artificial
  peptide fold or domain or sub-domain
NPTSVITNWETQQKLGWSARPY

SEQ ID NO: 14460 - protein, 30 aa, artificial
  peptide fold or domain or sub-domain
NPVHKLVPVLLHGDKPISESLVIVEYLDDA

SEQ ID NO: 14461 - protein, 29 aa, artificial
  peptide fold or domain or sub-domain
NPVSLVENHPACRINRSGQRVLPNGQPWK

SEQ ID NO: 14462 - protein, 27 aa, artificial
  peptide fold or domain or sub-domain
NPVTQPYFTARETAVFKAMGLDLTKDS

SEQ ID NO: 14463 - protein, 23 aa, artificial
  peptide fold or domain or sub-domain
NPVYKEAAAKMENYTVEGFKLAV

SEQ ID NO: 14464 - protein, 22 aa, artificial
  peptide fold or domain or sub-domain
NPWCKKDDVYMEIADWRKEYVM

SEQ ID NO: 14465 - protein, 22 aa, artificial
  peptide fold or domain or sub-domain
NPWLNVDSVFMGNHAEREEYVQ

SEQ ID NO: 14466 - protein, 22 aa, artificial
  peptide fold or domain or sub-domain
NPWNENDSTYMAEEERLEEYVL

SEQ ID NO: 14467 - protein, 27 aa, artificial
  peptide fold or domain or sub-domain
NPYAAASIRGSSEVDSGVLIERFNAWI

SEQ ID NO: 14468 - protein, 20 aa, artificial
  peptide fold or domain or sub-domain
NPYATQYDKANRRRCTVEDI

SEQ ID NO: 14469 - protein, 26 aa, artificial
  peptide fold or domain or sub-domain
NPYKCVDCEKSFNNCTRFREHRRIHT

SEQ ID NO: 14470 - protein, 22 aa, artificial
  peptide fold or domain or sub-domain
NPYLKITLEDGTIGKYYLLTDM

SEQ ID NO: 14471 - protein, 25 aa, artificial
  peptide fold or domain or sub-domain
NPYVLKIYEEFLGEPYGEKAHKYLH

SEQ ID NO: 14472 - protein, 23 aa, artificial
  peptide fold or domain or sub-domain
NQAKVLLMQRHGWDEREAHQHLS

SEQ ID NO: 14473 - protein, 30 aa, artificial
  peptide fold or domain or sub-domain
NQDFIKVEKYLPKNVREQHDVTDVGWNNKI

SEQ ID NO: 14474 - protein, 24 aa, artificial
  peptide fold or domain or sub-domain
NQDKFETLKGHPLDEVKDTANFKL

SEQ ID NO: 14475 - protein, 27 aa, artificial
  peptide fold or domain or sub-domain
NQDWVSVLTDVANNSQPFALPLVTHLQ

SEQ ID NO: 14476 - protein, 24 aa, artificial
  peptide fold or domain or sub-domain
NQEALEAYDGVSQGKYTIGLGQTN

SEQ ID NO: 14477 - protein, 28 aa, artificial
  peptide fold or domain or sub-domain
NQEIVKYWYNYHIERYWNTPEAKLEFYR

SEQ ID NO: 14478 - protein, 21 aa, artificial
  peptide fold or domain or sub-domain
NQFCKEPMPDRSFTFWEWFFA

SEQ ID NO: 14479 - protein, 25 aa, artificial
  peptide fold or domain or sub-domain
NQIAPEHASIQTVSPHDYLNHVRYV

SEQ ID NO: 14480 - protein, 30 aa, artificial
  peptide fold or domain or sub-domain
NQIDRYRKVLADRGAAKADRAQALTFLIHM

SEQ ID NO: 14481 - protein, 22 aa, artificial
  peptide fold or domain or sub-domain
NQIGSVIRKLGCTTRTQAVVSA

SEQ ID NO: 14482 - protein, 29 aa, artificial
  peptide fold or domain or sub-domain
NQINNLGMSVFYRYLQKCGKDVQMEEDFY

SEQ ID NO: 14483 - protein, 29 aa, artificial
  peptide fold or domain or sub-domain
NQISILAYALYIRYQQILGNKTLNLPEDS

SEQ ID NO: 14484 - protein, 30 aa, artificial
  peptide fold or domain or sub-domain
NQLEQLRFIKTCRNIGLSLSNIKTLLQLQQ

SEQ ID NO: 14485 - protein, 27 aa, artificial
  peptide fold or domain or sub-domain
NQLGPEQTQKIASMLESSTVRDVLLRY

SEQ ID NO: 14486 - protein, 22 aa, artificial
  peptide fold or domain or sub-domain
NQLHDAIIENENLSDKHKSIIT

SEQ ID NO: 14487 - protein, 22 aa, artificial
  peptide fold or domain or sub-domain
NQLHEYYITNDNFDTNFKNQIS

SEQ ID NO: 14488 - protein, 22 aa, artificial
  peptide fold or domain or sub-domain
NQLMFERLYQQQKFSALLAYAK

SEQ ID NO: 14489 - protein, 28 aa, artificial
  peptide fold or domain or sub-domain
NQNWFTDPEIQNFIKEKGLINETGLEHY

SEQ ID NO: 14490 - protein, 29 aa, artificial
  peptide fold or domain or sub-domain
NQQVFEVMGQVMSQEGEAQAKSVEEARKR

SEQ ID NO: 14491 - protein, 20 aa, artificial
  peptide fold or domain or sub-domain
NQTDIINKYPETWENFWNNP

SEQ ID NO: 14492 - protein, 24 aa, artificial
  peptide fold or domain or sub-domain
NQTFVNLAMEYGEKTEQKALDYVK

SEQ ID NO: 14493 - protein, 20 aa, artificial
  peptide fold or domain or sub-domain
NQTKVSQVLGISTTTLWRKI

SEQ ID NO: 14494 - protein, 20 aa, artificial
  peptide fold or domain or sub-domain
NQTRAALMMGINRGTLRKKL

SEQ ID NO: 14495 - protein, 24 aa, artificial
  peptide fold or domain or sub-domain
NQTRLSIQHFEEKAIKILGFKSKH

SEQ ID NO: 14496 - protein, 29 aa, artificial
  peptide fold or domain or sub-domain
NQVDSLHKRLLTEVNEEQASHLRHSLDNF

SEQ ID NO: 14497 - protein, 20 aa, artificial
  peptide fold or domain or sub-domain
NQVKAARVLGVSRNTLRHRM

SEQ ID NO: 14498 - protein, 27 aa, artificial
  peptide fold or domain or sub-domain
NQVLGASRKGDMWCLRTEKGDVLAEHV

SEQ ID NO: 14499 - protein, 28 aa, artificial
  peptide fold or domain or sub-domain
NQVTTTGLKWNLTNDVLGFGTLVSTSNT

SEQ ID NO: 14500 - protein, 29 aa, artificial
  peptide fold or domain or sub-domain
NQVVALEGIGGKSTNMEDIEAFLVKMGAV

SEQ ID NO: 14501 - protein, 25 aa, artificial
  peptide fold or domain or sub-domain
NQYGPEHLIIQTRNARELVDSITSA

SEQ ID NO: 14502 - protein, 21 aa, artificial
  peptide fold or domain or sub-domain
NQYNDQELIINDPPQILIDKV

SEQ ID NO: 14503 - protein, 26 aa, artificial
  peptide fold or domain or sub-domain
NRAIADYLRSNGYEEAYSVFKKEAEL

SEQ ID NO: 14504 - protein, 26 aa, artificial
  peptide fold or domain or sub-domain
NRAIAEYLQKHGFANTLRQFEEESNI

SEQ ID NO: 14505 - protein, 25 aa, artificial
  peptide fold or domain or sub-domain
NRDALIAFLVEEKKFSADRVNKGCD

SEQ ID NO: 14506 - protein, 24 aa, artificial
  peptide fold or domain or sub-domain
NRDVLKEGMEDGTIRNDIDPFEMA

SEQ ID NO: 14507 - protein, 27 aa, artificial
  peptide fold or domain or sub-domain
NREDPVSDFERQRNEVIEGAQGVRNPF

SEQ ID NO: 14508 - protein, 25 aa, artificial
  peptide fold or domain or sub-domain
NREIVLDVFERTTGNRVLHGINLVG

SEQ ID NO: 14509 - protein, 20 aa, artificial
  peptide fold or domain or sub-domain
NREQMALNHGEEQVRLWRRS

SEQ ID NO: 14510 - protein, 24 aa, artificial
  peptide fold or domain or sub-domain
NRESWEKPEAEAELLKRIPAGRVG

SEQ ID NO: 14511 - protein, 25 aa, artificial
  peptide fold or domain or sub-domain
NRFAPEHLELMVAEPFRWLSRVENA

SEQ ID NO: 14512 - protein, 22 aa, artificial
  peptide fold or domain or sub-domain
NRFLKFREGAFTDPDSYFHNYA

SEQ ID NO: 14513 - protein, 25 aa, artificial
  peptide fold or domain or sub-domain
NRFTERAITLLQNLGVIQSTSKLDL

SEQ ID NO: 14514 - protein, 25 aa, artificial
  peptide fold or domain or sub-domain
NRFYKTLSYFAVDKAEKERLLKIAE

SEQ ID NO: 14515 - protein, 30 aa, artificial
  peptide fold or domain or sub-domain
NRGDEVIIPAPYWINYVQMVCMCSGEPIIT

SEQ ID NO: 14516 - protein, 25 aa, artificial
  peptide fold or domain or sub-domain
NRGEAMQFLVEEMEFDRETTEKKLD

SEQ ID NO: 14517 - protein, 25 aa, artificial
  peptide fold or domain or sub-domain
NRIAPEHLELSLDDAEPWIGRIRHA

SEQ ID NO: 14518 - protein, 22 aa, artificial
  peptide fold or domain or sub-domain
NRIDVEKARERGVKESLVDRLA

SEQ ID NO: 14519 - protein, 27 aa, artificial
  peptide fold or domain or sub-domain
NRILVPETGVDVVNVDQNTGFDQIQPA

SEQ ID NO: 14520 - protein, 30 aa, artificial
  peptide fold or domain or sub-domain
NRINNALADLGKLLVPESASTSKANTVENA

SEQ ID NO: 14521 - protein, 22 aa, artificial
  peptide fold or domain or sub-domain
NRISFFHNEKSVRYHHYKSNFS

SEQ ID NO: 14522 - protein, 30 aa, artificial
  peptide fold or domain or sub-domain
NRKMAMGRKKFNMDPKKGIQFLVENELLQN

SEQ ID NO: 14523 - protein, 30 aa, artificial
  peptide fold or domain or sub-domain
NRKMRYIPIENYLTKQLKKQGIVEQEADDM

SEQ ID NO: 14524 - protein, 23 aa, artificial
  peptide fold or domain or sub-domain
NRLEGRKPRTGKSALRGRPKKIG

SEQ ID NO: 14525 - protein, 25 aa, artificial
  peptide fold or domain or sub-domain
NRMMSSIRLLHLRKKMTTFKNIATQ

SEQ ID NO: 14526 - protein, 20 aa, artificial
  peptide fold or domain or sub-domain
NRMQVRAEYGADLLRFWRRS

SEQ ID NO: 14527 - protein, 29 aa, artificial
  peptide fold or domain or sub-domain
NRMYDELYKMVPGLENSSRSTKREVLMRT

SEQ ID NO: 14528 - protein, 26 aa, artificial
  peptide fold or domain or sub-domain
NRNNRLKKLLAQGAPEIIIRNEKRML

SEQ ID NO: 14529 - protein, 24 aa, artificial
  peptide fold or domain or sub-domain
NRQIAPLYNVTTGVDTFYVYPDTW

SEQ ID NO: 14530 - protein, 24 aa, artificial
  peptide fold or domain or sub-domain
NRRMQYLYASGEAHVFMDNGTYEQ

SEQ ID NO: 14531 - protein, 22 aa, artificial
  peptide fold or domain or sub-domain
NRRWLNHLIKTKKWAAYRKHYA

SEQ ID NO: 14532 - protein, 30 aa, artificial
  peptide fold or domain or sub-domain
NRSDVAEMFITLSHHQLAHSQFSIAEREQI

SEQ ID NO: 14533 - protein, 26 aa, artificial
  peptide fold or domain or sub-domain
NRSICDYVQRCGAEESLVVGLRQLFG

SEQ ID NO: 14534 - protein, 30 aa, artificial
  peptide fold or domain or sub-domain
NRTGIVLAANYEARRFGVKTAMTLNNALKL

SEQ ID NO: 14535 - protein, 20 aa, artificial
  peptide fold or domain or sub-domain
NRTHAARLLGMPVRTLRNKI

SEQ ID NO: 14536 - protein, 29 aa, artificial
  peptide fold or domain or sub-domain
NRTWDLRSELNLVPMSFSPYDTTIYNEVT

SEQ ID NO: 14537 - protein, 30 aa, artificial
  peptide fold or domain or sub-domain
NRVFGYYLEVSNAHKDKIPADFIRKQTLKN

SEQ ID NO: 14538 - protein, 29 aa, artificial
  peptide fold or domain or sub-domain
NRVIVSDSNNHRIQIFDVNGKVLSTVGGE

SEQ ID NO: 14539 - protein, 28 aa, artificial
  peptide fold or domain or sub-domain
NRVLLYRSLGQQLPQGVASDGDGVDTRD

SEQ ID NO: 14540 - protein, 24 aa, artificial
  peptide fold or domain or sub-domain
NSADVQAVLGNLTNYCGQPVDIDN

SEQ ID NO: 14541 - protein, 29 aa, artificial
  peptide fold or domain or sub-domain
NSAFSELRKLLPCHPVDKKLSKNEILRLT

SEQ ID NO: 14542 - protein, 26 aa, artificial
  peptide fold or domain or sub-domain
NSAPVLILSARRSVDERVRGLEQGGD

SEQ ID NO: 14543 - protein, 25 aa, artificial
  peptide fold or domain or sub-domain
NSATFKDELDKLYPIIEEGGSDSAA

SEQ ID NO: 14544 - protein, 28 aa, artificial
  peptide fold or domain or sub-domain
NSAYMKYYSQVFKPTEVLMMLSAFSNIE

SEQ ID NO: 14545 - protein, 28 aa, artificial
  peptide fold or domain or sub-domain
NSCFDQRPSIKQFMNEHGIATYFDLQVY

SEQ ID NO: 14546 - protein, 21 aa, artificial
  peptide fold or domain or sub-domain
NSCLNGAYTASAPNCPNGGYN

SEQ ID NO: 14547 - protein, 24 aa, artificial
  peptide fold or domain or sub-domain
NSCNTESVLELKAYIEQHNLAFSC

SEQ ID NO: 14548 - protein, 23 aa, artificial
  peptide fold or domain or sub-domain
NSEEKFASLLEKLETARPEGGEL

SEQ ID NO: 14549 - protein, 24 aa, artificial
  peptide fold or domain or sub-domain
NSFFYSKYFKKKDEIILTTLEHNS

SEQ ID NO: 14550 - protein, 21 aa, artificial
  peptide fold or domain or sub-domain
NSFVEKYYNLLYKSPSQVHQF

SEQ ID NO: 14551 - protein, 29 aa, artificial
  peptide fold or domain or sub-domain
NSGFAKLRRILPTVPPNRKPSKVDTLQGA

SEQ ID NO: 14552 - protein, 23 aa, artificial
  peptide fold or domain or sub-domain
NSIGETQARKLSKLRVHEFIFHT

SEQ ID NO: 14553 - protein, 29 aa, artificial
  peptide fold or domain or sub-domain
NSIIQRISKFDNILKDKTIINQQDLRQIS

SEQ ID NO: 14554 - protein, 29 aa, artificial
  peptide fold or domain or sub-domain
NSITKLMTLSHDVMTSSQSSSVSSNMNAL

SEQ ID NO: 14555 - protein, 27 aa, artificial
  peptide fold or domain or sub-domain
NSKDMDALMATPLWQAMPFVRAGRFQR

SEQ ID NO: 14556 - protein, 29 aa, artificial
  peptide fold or domain or sub-domain
NSKFLDLARLLPSLASSRRPSKSAIVNGS

SEQ ID NO: 14557 - protein, 23 aa, artificial
  peptide fold or domain or sub-domain
NSLALIERGANEILKFDELERRL

SEQ ID NO: 14558 - protein, 28 aa, artificial
  peptide fold or domain or sub-domain
NSLALIERGANEILKFDELERRLRSGRP

SEQ ID NO: 14559 - protein, 23 aa, artificial
  peptide fold or domain or sub-domain
NSLDLAKIGSVFALNGRHPETGE

SEQ ID NO: 14560 - protein, 28 aa, artificial
  peptide fold or domain or sub-domain
NSLMVKCPAQDCNEEVSLEKYNHHVSSH

SEQ ID NO: 14561 - protein, 30 aa, artificial
  peptide fold or domain or sub-domain
NSLSEIASCSYEARQCGVKNGMFVGAALKL

SEQ ID NO: 14562 - protein, 25 aa, artificial
  peptide fold or domain or sub-domain
NSLTKHIYNDFLDGFQSDKSYDVLH

SEQ ID NO: 14563 - protein, 23 aa, artificial
  peptide fold or domain or sub-domain
NSMFALHEIGENVPYRYSRLSNP

SEQ ID NO: 14564 - protein, 27 aa, artificial
  peptide fold or domain or sub-domain
NSNIGDKGAEKLADALVSLVLLEILKW

SEQ ID NO: 14565 - protein, 27 aa, artificial
  peptide fold or domain or sub-domain
NSNLVPHWANWEHFNELDAKGLAMYGQ

SEQ ID NO: 14566 - protein, 24 aa, artificial
  peptide fold or domain or sub-domain
NSNTSSVVCDKRLVGYYTDYTRAI

SEQ ID NO: 14567 - protein, 30 aa, artificial
  peptide fold or domain or sub-domain
NSPEMSKSLHKAVAAYYDHYELYRQYLKDR

SEQ ID NO: 14568 - protein, 24 aa, artificial
  peptide fold or domain or sub-domain
NSPFDLWLKGNDDALTTAQVEGYQ

SEQ ID NO: 14569 - protein, 24 aa, artificial
  peptide fold or domain or sub-domain
NSPFDRYLSGDQNAISTQAKKGYE

SEQ ID NO: 14570 - protein, 24 aa, artificial
  peptide fold or domain or sub-domain
NSPWKSFVQGDDDAISLNSKKGAL

SEQ ID NO: 14571 - protein, 27 aa, artificial
  peptide fold or domain or sub-domain
NSPYKQQLETNPVWQRLQFVQQKRLYA

SEQ ID NO: 14572 - protein, 23 aa, artificial
  peptide fold or domain or sub-domain
NSQREVASKLGVSITKITRGAAN

SEQ ID NO: 14573 - protein, 24 aa, artificial
  peptide fold or domain or sub-domain
NSRFDRYVMGEESALSPAQKRGLD

SEQ ID NO: 14574 - protein, 24 aa, artificial
  peptide fold or domain or sub-domain
NSRTGGIENTDSWSDLEMNLYKSL

SEQ ID NO: 14575 - protein, 24 aa, artificial
  peptide fold or domain or sub-domain
NSRYDRYNNGDPRAMNVQEVRGME

SEQ ID NO: 14576 - protein, 30 aa, artificial
  peptide fold or domain or sub-domain
NSSEPALIDRILNLVRIGELSYDDVMGEFS

SEQ ID NO: 14577 - protein, 24 aa, artificial
  peptide fold or domain or sub-domain
NSSFDRYVKGESQTIPESVANGFN

SEQ ID NO: 14578 - protein, 24 aa, artificial
  peptide fold or domain or sub-domain
NSSGQIIVCYYTISSDLNTLWELS

SEQ ID NO: 14579 - protein, 27 aa, artificial
  peptide fold or domain or sub-domain
NSSISDLACAIGVSKAAIYHYYPTKQD

SEQ ID NO: 14580 - protein, 27 aa, artificial
  peptide fold or domain or sub-domain
NSSLMFLKLVGDGKVSDADYQKAYQKL

SEQ ID NO: 14581 - protein, 28 aa, artificial
  peptide fold or domain or sub-domain
NSSPINTPLRSANGDVNKLSENIQEQVR

SEQ ID NO: 14582 - protein, 27 aa, artificial
  peptide fold or domain or sub-domain
NSTDVEETLKRIQNNDPDLEEVNLNNI

SEQ ID NO: 14583 - protein, 28 aa, artificial
  peptide fold or domain or sub-domain
NSTEELIKAVGVDNYLGQSINKQKVTWS

SEQ ID NO: 14584 - protein, 21 aa, artificial
  peptide fold or domain or sub-domain
NSVAIVMRIQNLDIPTAKTII

SEQ ID NO: 14585 - protein, 30 aa, artificial
  peptide fold or domain or sub-domain
NSVANIPGVDPVNSITDNFCAQQKTAFGDT

SEQ ID NO: 14586 - protein, 26 aa, artificial
  peptide fold or domain or sub-domain
NSVRNAVTQEFGPVPDTARYYKQHGI

SEQ ID NO: 14587 - protein, 25 aa, artificial
  peptide fold or domain or sub-domain
NSWTTEGKVGGKFNPDRTQGSVTEG

SEQ ID NO: 14588 - protein, 25 aa, artificial
  peptide fold or domain or sub-domain
NSYAPEHLIINRKNPEPWVEKIVAA

SEQ ID NO: 14589 - protein, 30 aa, artificial
  peptide fold or domain or sub-domain
NTAAEAKWMVILAHHLNSRDPNDIAFAESR

SEQ ID NO: 14590 - protein, 25 aa, artificial
  peptide fold or domain or sub-domain
NTALVKMYQNYFGKPGEGRAHEILH

SEQ ID NO: 14591 - protein, 30 aa, artificial
  peptide fold or domain or sub-domain
NTCLKDEKGGLSDENTLDGLHLNFPAYAKL

SEQ ID NO: 14592 - protein, 20 aa, artificial
  peptide fold or domain or sub-domain
NTCTCLSGYTQVAGQVNCQK

SEQ ID NO: 14593 - protein, 24 aa, artificial
  peptide fold or domain or sub-domain
NTCTGSTDCNTAQTCTNSKDCFEA

SEQ ID NO: 14594 - protein, 25 aa, artificial
  peptide fold or domain or sub-domain
NTDRYMVDVLVKDFNLPNTSEEVIR

SEQ ID NO: 14595 - protein, 29 aa, artificial
  peptide fold or domain or sub-domain
NTEGIVGTKTSTNHVMEMKDVLGIEAARY

SEQ ID NO: 14596 - protein, 24 aa, artificial
  peptide fold or domain or sub-domain
NTELLDNTPRGQEFLMRTPMQRFG

SEQ ID NO: 14597 - protein, 20 aa, artificial
  peptide fold or domain or sub-domain
NTFDSIKSASMKTGISSQRI

SEQ ID NO: 14598 - protein, 26 aa, artificial
  peptide fold or domain or sub-domain
NTGSGNIENYQDINQVRNCRLVGLLD

SEQ ID NO: 14599 - protein, 27 aa, artificial
  peptide fold or domain or sub-domain
NTGYGRPFLSEARVLGISTRQQVYIRE

SEQ ID NO: 14600 - protein, 25 aa, artificial
  peptide fold or domain or sub-domain
NTIANINKDAGGTGALLEEKTLVNW

SEQ ID NO: 14601 - protein, 30 aa, artificial
  peptide fold or domain or sub-domain
NTIDEHLDMLMVCHHLKQNIPEDVAFADSR

SEQ ID NO: 14602 - protein, 29 aa, artificial
  peptide fold or domain or sub-domain
NTITKLADTKSTDNKLSLVNYLTRVVIKD

SEQ ID NO: 14603 - protein, 27 aa, artificial
  peptide fold or domain or sub-domain
NTKENLIPKWDFKLTADAPHIVDTSAA

SEQ ID NO: 14604 - protein, 22 aa, artificial
  peptide fold or domain or sub-domain
NTLDLEASREMAVPELILDWLK

SEQ ID NO: 14605 - protein, 29 aa, artificial
  peptide fold or domain or sub-domain
NTLGIETARNTIMSEIDMIMTSHGMSIDI

SEQ ID NO: 14606 - protein, 20 aa, artificial
  peptide fold or domain or sub-domain
NTLKTLRAGNADAADITRQE

SEQ ID NO: 14607 - protein, 22 aa, artificial
  peptide fold or domain or sub-domain
NTLQTYIRCRHPPPGSHLLYAK

SEQ ID NO: 14608 - protein, 29 aa, artificial
  peptide fold or domain or sub-domain
NTLVYCCGPAPLLDAVTGHCDSWPSGTLH

SEQ ID NO: 14609 - protein, 22 aa, artificial
  peptide fold or domain or sub-domain
NTNGGGACETAFMFGNTPINSF

SEQ ID NO: 14610 - protein, 25 aa, artificial
  peptide fold or domain or sub-domain
NTNQLREALAERGCEDFVTTTDSEM

SEQ ID NO: 14611 - protein, 23 aa, artificial
  peptide fold or domain or sub-domain
NTPAPEELNLTGGDLIDLVRGEP

SEQ ID NO: 14612 - protein, 21 aa, artificial
  peptide fold or domain or sub-domain
NTPSDAHGVIRADFPGGFAHH

SEQ ID NO: 14613 - protein, 25 aa, artificial
  peptide fold or domain or sub-domain
NTQVKALYKSYLEKPLGHKSHDLLH

SEQ ID NO: 14614 - protein, 30 aa, artificial
  peptide fold or domain or sub-domain
NTQYDALLKKALTVKDKSEKEAIYQQASDI

SEQ ID NO: 14615 - protein, 24 aa, artificial
  peptide fold or domain or sub-domain
NTRFDRFLSGEQSIFTQQEIIGLN

SEQ ID NO: 14616 - protein, 29 aa, artificial
  peptide fold or domain or sub-domain
NTSDAFNWTVDSENRTNLSCEGCLSPSCL

SEQ ID NO: 14617 - protein, 29 aa, artificial
  peptide fold or domain or sub-domain
NTSFKSLEQTPQAVVVKVLSPAGEETVSA

SEQ ID NO: 14618 - protein, 23 aa, artificial
  peptide fold or domain or sub-domain
NTSSPANVDASVEWRNNRDNYKK

SEQ ID NO: 14619 - protein, 27 aa, artificial
  peptide fold or domain or sub-domain
NTTDVEDSIKMLEANNKELTKLNLNNI

SEQ ID NO: 14620 - protein, 24 aa, artificial
  peptide fold or domain or sub-domain
NTTLIYENTNRLGAMGSDYFSLIN

SEQ ID NO: 14621 - protein, 27 aa, artificial
  peptide fold or domain or sub-domain
NTTLQAVLSHLRNNPITDEHLAKVKRG

SEQ ID NO: 14622 - protein, 29 aa, artificial
  peptide fold or domain or sub-domain
NTTMLANISLNATRNEENITSFFTDEEWL

SEQ ID NO: 14623 - protein, 28 aa, artificial
  peptide fold or domain or sub-domain
NTTVYVGNHGNDTVSVINAATNTVVATI

SEQ ID NO: 14624 - protein, 28 aa, artificial
  peptide fold or domain or sub-domain
NTVHYCLTNNKHFTFPASSLPEQLHSQK

SEQ ID NO: 14625 - protein, 29 aa, artificial
  peptide fold or domain or sub-domain
NTVYVTDTSNNRVNIYNENGDFLESFGSF

SEQ ID NO: 14626 - protein, 21 aa, artificial
  peptide fold or domain or sub-domain
NTYTSPENIENDPQEVIIEDI

SEQ ID NO: 14627 - protein, 26 aa, artificial
  peptide fold or domain or sub-domain
NVAAITSTSATKIDDFANGEIDVLIG

SEQ ID NO: 14628 - protein, 30 aa, artificial
  peptide fold or domain or sub-domain
NVAGQRIQNGFTNRTLPHFKMNCVDGRSRG

SEQ ID NO: 14629 - protein, 27 aa, artificial
  peptide fold or domain or sub-domain
NVAPGAEVTDLGESIEKLYKTKIHTLS

SEQ ID NO: 14630 - protein, 20 aa, artificial
  peptide fold or domain or sub-domain
NVAQAAKALGVAKTTFYSKI

SEQ ID NO: 14631 - protein, 27 aa, artificial
  peptide fold or domain or sub-domain
NVARVYQRWQKEKWTMRDAAIVTALER

SEQ ID NO: 14632 - protein, 30 aa, artificial
  peptide fold or domain or sub-domain
NVCNEAALIAARHLNASVNAKHFEQAIERV

SEQ ID NO: 14633 - protein, 30 aa, artificial
  peptide fold or domain or sub-domain
NVCNESAIRAASNKCHVVTHKDMEYALDRV

SEQ ID NO: 14634 - protein, 24 aa, artificial
  peptide fold or domain or sub-domain
NVDYFTDAMFSLIKDPKNMNAKEE

SEQ ID NO: 14635 - protein, 26 aa, artificial
  peptide fold or domain or sub-domain
NVERIRRQLKITNAGMVSDEELEQML

SEQ ID NO: 14636 - protein, 21 aa, artificial
  peptide fold or domain or sub-domain
NVFDKIRNGDVEYDSTAADVI

SEQ ID NO: 14637 - protein, 21 aa, artificial
  peptide fold or domain or sub-domain
NVFDVLRNGQRSVTPSLMDTM

SEQ ID NO: 14638 - protein, 21 aa, artificial
  peptide fold or domain or sub-domain
NVFSEIRTGKMKVKAELVDVL

SEQ ID NO: 14639 - protein, 26 aa, artificial
  peptide fold or domain or sub-domain
NVHNTGLSGIRLVSNFIKKPVNEVIQ

SEQ ID NO: 14640 - protein, 22 aa, artificial
  peptide fold or domain or sub-domain
NVILNIQRKLNVVNTPQMIAES

SEQ ID NO: 14641 - protein, 30 aa, artificial
  peptide fold or domain or sub-domain
NVINEATLLAVRDNRTTINMNDIDEAIDRV

SEQ ID NO: 14642 - protein, 26 aa, artificial
  peptide fold or domain or sub-domain
NVKKLIEIGFSCLNTRLTMSRAIKLY

SEQ ID NO: 14643 - protein, 27 aa, artificial
  peptide fold or domain or sub-domain
NVLAMVDCNTPGRNNSLPPDTKINIII

SEQ ID NO: 14644 - protein, 21 aa, artificial
  peptide fold or domain or sub-domain
NVLDEVRNNRLAVTEHLVDII

SEQ ID NO: 14645 - protein, 21 aa, artificial
  peptide fold or domain or sub-domain
NVLDLIRNQKLDATSEVLDVV

SEQ ID NO: 14646 - protein, 27 aa, artificial
  peptide fold or domain or sub-domain
NVLHPPTAEELDEHDRIVTVQGNKNPF

SEQ ID NO: 14647 - protein, 21 aa, artificial
  peptide fold or domain or sub-domain
NVLHSIRSNEMSMTAKVVDLL

SEQ ID NO: 14648 - protein, 30 aa, artificial
  peptide fold or domain or sub-domain
NVLNEAAIFTARRRKEAITMAEVNDAIDRV

SEQ ID NO: 14649 - protein, 30 aa, artificial
  peptide fold or domain or sub-domain
NVLPVDADKNVYTMQLMEKNEPYNATAFDL

SEQ ID NO: 14650 - protein, 26 aa, artificial
  peptide fold or domain or sub-domain
NVLSTRNTNSRVGTSSCKLLDACLTM

SEQ ID NO: 14651 - protein, 30 aa, artificial
  peptide fold or domain or sub-domain
NVNPDHLTNFFEKLEETGAKLKVLGNEVEI

SEQ ID NO: 14652 - protein, 22 aa, artificial
  peptide fold or domain or sub-domain
NVQDLERSEAEGLASALMARLK

SEQ ID NO: 14653 - protein, 26 aa, artificial
  peptide fold or domain or sub-domain
NVQLLEKSSFTDKNGVKGTFTHKVFL

SEQ ID NO: 14654 - protein, 21 aa, artificial
  peptide fold or domain or sub-domain
NVRFKDIGWEDWLIAPQHYAA

SEQ ID NO: 14655 - protein, 28 aa, artificial
  peptide fold or domain or sub-domain
NVRNAYSIPGSPIMPLGDPLADGVGPAS

SEQ ID NO: 14656 - protein, 30 aa, artificial
  peptide fold or domain or sub-domain
NVRPDHLRAVTSKLAEMGVDIQEDGNRMVV

SEQ ID NO: 14657 - protein, 21 aa, artificial
  peptide fold or domain or sub-domain
NVRVSLVSPGSTATDFGDHSA

SEQ ID NO: 14658 - protein, 29 aa, artificial
  peptide fold or domain or sub-domain
NVSEIKTNANENSVVCSDGSEYPADIIIV

SEQ ID NO: 14659 - protein, 27 aa, artificial
  peptide fold or domain or sub-domain
NVSEMGDMVKGKTDWSDVIFAKRANQL

SEQ ID NO: 14660 - protein, 29 aa, artificial
  peptide fold or domain or sub-domain
NVSKILKTSGFDVKSLAIKLIEEKGVVTI

SEQ ID NO: 14661 - protein, 27 aa, artificial
  peptide fold or domain or sub-domain
NVSMHEIAERAEFAIGTLYKFFKNKEH

SEQ ID NO: 14662 - protein, 26 aa, artificial
  peptide fold or domain or sub-domain
NVSTSPTNAMAALAKQIKDQGNDVIS

SEQ ID NO: 14663 - protein, 20 aa, artificial
  peptide fold or domain or sub-domain
NVTRAARLLQISRKSLQTKM

SEQ ID NO: 14664 - protein, 25 aa, artificial
  peptide fold or domain or sub-domain
NVVAPEHLEIITPNPFEYLNDIKNA

SEQ ID NO: 14665 - protein, 30 aa, artificial
  peptide fold or domain or sub-domain
NVVAVDIGDEKLELAKELGADLVVNPLKED

SEQ ID NO: 14666 - protein, 30 aa, artificial
  peptide fold or domain or sub-domain
NVVAVDRKGILNENDPETCLNEYHLEIARI

SEQ ID NO: 14667 - protein, 29 aa, artificial
  peptide fold or domain or sub-domain
NVVDPVADEKEVKSFYDINMVKLSEVKEA

SEQ ID NO: 14668 - protein, 24 aa, artificial
  peptide fold or domain or sub-domain
NVVHLYQEQQELPGRQMPAFRNRT

SEQ ID NO: 14669 - protein, 30 aa, artificial
  peptide fold or domain or sub-domain
NVVIEHIRPIIAKFKECNIKVVEGENTIKV

SEQ ID NO: 14670 - protein, 30 aa, artificial
  peptide fold or domain or sub-domain
NVVITDVNEYRLELARKMGITRAVNVAKEN

SEQ ID NO: 14671 - protein, 27 aa, artificial
  peptide fold or domain or sub-domain
NVVMMMGYAVGFQAPGRTLMFDSMPVA

SEQ ID NO: 14672 - protein, 27 aa, artificial
  peptide fold or domain or sub-domain
NVVVTDSDGNAIESQANILWETAEHSF

SEQ ID NO: 14673 - protein, 28 aa, artificial
  peptide fold or domain or sub-domain
NVWVKAQNDYHHRVLEKIGADRIVHPEQ

SEQ ID NO: 14674 - protein, 27 aa, artificial
  peptide fold or domain or sub-domain
NVYAIQGYLDGIWPPGKKDTRAMAAVL

SEQ ID NO: 14675 - protein, 22 aa, artificial
  peptide fold or domain or sub-domain
NVYNRGLNTNSHNQLEIRTLGS

SEQ ID NO: 14676 - protein, 29 aa, artificial
  peptide fold or domain or sub-domain
NVYRNRDASSGTNDMGLWYSKIPTETLPA

SEQ ID NO: 14677 - protein, 21 aa, artificial
  peptide fold or domain or sub-domain
NVYTDPLLEDNPPDIPILDKL

SEQ ID NO: 14678 - protein, 24 aa, artificial
  peptide fold or domain or sub-domain
NWGNDDAKWDANPDIAEECNFQKA

SEQ ID NO: 14679 - protein, 23 aa, artificial
  peptide fold or domain or sub-domain
NWIGTKNSIESRIIPKYGIKIHY

SEQ ID NO: 14680 - protein, 29 aa, artificial
  peptide fold or domain or sub-domain
NWKFGGQGEQMMLNNKMFHREHQYQETVK

SEQ ID NO: 14681 - protein, 27 aa, artificial
  peptide fold or domain or sub-domain
NWKGAKIEAGRARGVAVVESFNTFVAQ

SEQ ID NO: 14682 - protein, 26 aa, artificial
  peptide fold or domain or sub-domain
NWKKLYEVDFTGLPDGHTEEDMIAEN

SEQ ID NO: 14683 - protein, 30 aa, artificial
  peptide fold or domain or sub-domain
NWKRTQPVNFQAFMSEEHTRRRYWARSLIG

SEQ ID NO: 14684 - protein, 26 aa, artificial
  peptide fold or domain or sub-domain
NWQKLYEVGFSPCPSNSKPAFQVRKY

SEQ ID NO: 14685 - protein, 29 aa, artificial
  peptide fold or domain or sub-domain
NWSDTAEEGYSLASNGKYYESEFDKSMPD

SEQ ID NO: 14686 - protein, 29 aa, artificial
  peptide fold or domain or sub-domain
NWSNWCRNRIRELNRRPTARDFRSFGERL

SEQ ID NO: 14687 - protein, 29 aa, artificial
  peptide fold or domain or sub-domain
NWSQWFAREIKKLGRSPTRNDYVNLARRL

SEQ ID NO: 14688 - protein, 27 aa, artificial
  peptide fold or domain or sub-domain
NYASKIGALVKSYLGSDDIDDVVQEVF

SEQ ID NO: 14689 - protein, 25 aa, artificial
  peptide fold or domain or sub-domain
NYDEIVDYLRNRKLRWTFSRNDLEI

SEQ ID NO: 14690 - protein, 25 aa, artificial
  peptide fold or domain or sub-domain
NYDQIKSMLVESQNYQFYGQTDTEV

SEQ ID NO: 14691 - protein, 26 aa, artificial
  peptide fold or domain or sub-domain
NYETTVMNVFASKSKEDVISDVFEMG

SEQ ID NO: 14692 - protein, 26 aa, artificial
  peptide fold or domain or sub-domain
NYFLHMSDVTFHMAENRMEVHHKRVE

SEQ ID NO: 14693 - protein, 26 aa, artificial
  peptide fold or domain or sub-domain
NYFVMKWVNKEYKKIFTKNQFNNSLK

SEQ ID NO: 14694 - protein, 25 aa, artificial
  peptide fold or domain or sub-domain
NYGELRAELETRGVEGWRGHSDTEV

SEQ ID NO: 14695 - protein, 25 aa, artificial
  peptide fold or domain or sub-domain
NYGELVDDLCGKQHRHLNSTLDSEA

SEQ ID NO: 14696 - protein, 24 aa, artificial
  peptide fold or domain or sub-domain
NYGGKFVPTQHHRVAVQDPYAAQA

SEQ ID NO: 14697 - protein, 29 aa, artificial
  peptide fold or domain or sub-domain
NYIFFEQNVSSKLTEIVQNEVGAKSLQLH

SEQ ID NO: 14698 - protein, 22 aa, artificial
  peptide fold or domain or sub-domain
NYIHHPNGTITKLALLRDRSKV

SEQ ID NO: 14699 - protein, 22 aa, artificial
  peptide fold or domain or sub-domain
NYIIKGYNKVIDLRYKSSNSII

SEQ ID NO: 14700 - protein, 21 aa, artificial
  peptide fold or domain or sub-domain
NYINHTAAYEGVDSDAALHKT

SEQ ID NO: 14701 - protein, 27 aa, artificial
  peptide fold or domain or sub-domain
NYIRLSMEGNAETVMGKRRFIHPEEDR

SEQ ID NO: 14702 - protein, 30 aa, artificial
  peptide fold or domain or sub-domain
NYITKSEAQALGWVASKGNLADVAPGKSIG

SEQ ID NO: 14703 - protein, 25 aa, artificial
  peptide fold or domain or sub-domain
NYKNLKDYLKTNGISNFKSNSDTEV

SEQ ID NO: 14704 - protein, 25 aa, artificial
  peptide fold or domain or sub-domain
NYLELREALRTEHGAEFATDGDGEA

SEQ ID NO: 14705 - protein, 26 aa, artificial
  peptide fold or domain or sub-domain
NYLTDLNLKAGEVVKDIKSSQISREL

SEQ ID NO: 14706 - protein, 22 aa, artificial
  peptide fold or domain or sub-domain
NYLYWSYNNHPVNEGSEWVVER

SEQ ID NO: 14707 - protein, 29 aa, artificial
  peptide fold or domain or sub-domain
NYMLWINKKIDALGRTPVVGDYTRLGAEI

SEQ ID NO: 14708 - protein, 25 aa, artificial
  peptide fold or domain or sub-domain
NYNNSIVNWLWELYRNGTITDAADP

SEQ ID NO: 14709 - protein, 24 aa, artificial
  peptide fold or domain or sub-domain
NYNPFNQQSYFHDYCLITNYDDQT

SEQ ID NO: 14710 - protein, 21 aa, artificial
  peptide fold or domain or sub-domain
NYPKGIKAFYMRLNDDEKTVA

SEQ ID NO: 14711 - protein, 26 aa, artificial
  peptide fold or domain or sub-domain
NYPLHQACMENEFFKVQELLHSKPSL

SEQ ID NO: 14712 - protein, 24 aa, artificial
  peptide fold or domain or sub-domain
NYQSCWSLRQRTRGRRQTASLQPG

SEQ ID NO: 14713 - protein, 25 aa, artificial
  peptide fold or domain or sub-domain
NYRSLRARLEHNNGSIFNTTSDTEV

SEQ ID NO: 14714 - protein, 29 aa, artificial
  peptide fold or domain or sub-domain
NYRTEAQRRVSHILIESGDDTAAAEAKIA

SEQ ID NO: 14715 - protein, 29 aa, artificial
  peptide fold or domain or sub-domain
NYSQWARGLVQKLGRKPTSREFANIGRKM

SEQ ID NO: 14716 - protein, 28 aa, artificial
  peptide fold or domain or sub-domain
NYSSDLNRAFNNYGLPIPTATGGATQSG

SEQ ID NO: 14717 - protein, 20 aa, artificial
  peptide fold or domain or sub-domain
NYSYIKSLLPLSDTDRRECP

SEQ ID NO: 14718 - protein, 23 aa, artificial
  peptide fold or domain or sub-domain
NYTERVQMKNITADQKAQALKFI

SEQ ID NO: 14719 - protein, 25 aa, artificial
  peptide fold or domain or sub-domain
NYTLLKQRLLADGDHHLALDTDTEI

SEQ ID NO: 14720 - protein, 22 aa, artificial
  peptide fold or domain or sub-domain
NYTVEWSAERILFAVNDVVYHE

SEQ ID NO: 14721 - protein, 20 aa, artificial
  peptide fold or domain or sub-domain
NYVGKSDQELKSMAKFGDHT

SEQ ID NO: 14722 - protein, 24 aa, artificial
  peptide fold or domain or sub-domain
NYYCPKCGTIENDILCDHDSDKQE

SEQ ID NO: 14723 - protein, 27 aa, artificial
  peptide fold or domain or sub-domain
NYYIVSGDYYYLLKPDADNWLKRENAF

SEQ ID NO: 14724 - protein, 28 aa, artificial
  peptide fold or domain or sub-domain
NYYYYVKCQKTFSDKKRLVNNLDSIKLY

SEQ ID NO: 14725 - protein, 28 aa, artificial
  peptide fold or domain or sub-domain
PAAARDLIDGDTRVDIAAINSPGAVTLA

SEQ ID NO: 14726 - protein, 26 aa, artificial
  peptide fold or domain or sub-domain
PAADEVKKWNLSFSHVMNSEMGRQVF

SEQ ID NO: 14727 - protein, 30 aa, artificial
  peptide fold or domain or sub-domain
PAAGARALAALVGGAAFPLDEERGYWRVTA

SEQ ID NO: 14728 - protein, 20 aa, artificial
  peptide fold or domain or sub-domain
PACSQRVQSMQDYHVGNLKS

SEQ ID NO: 14729 - protein, 30 aa, artificial
  peptide fold or domain or sub-domain
PADEGLKRKQQQKSFDKFENQSLAYHTKIR

SEQ ID NO: 14730 - protein, 27 aa, artificial
  peptide fold or domain or sub-domain
PADRDRLPSEVHYCLESLADLLDRDRY

SEQ ID NO: 14731 - protein, 27 aa, artificial
  peptide fold or domain or sub-domain
PADSRSDILNALLALGYSDKEAQSALK

SEQ ID NO: 14732 - protein, 24 aa, artificial
  peptide fold or domain or sub-domain
PADTIVSLNEAQDHLLSIPKRSLL

SEQ ID NO: 14733 - protein, 29 aa, artificial
  peptide fold or domain or sub-domain
PAEDELPDLSGRSNRTAKARTPQLYAELR

SEQ ID NO: 14734 - protein, 27 aa, artificial
  peptide fold or domain or sub-domain
PAEHRFTYDPLDPFPSLPRDCDRAPLD

SEQ ID NO: 14735 - protein, 29 aa, artificial
  peptide fold or domain or sub-domain
PAELISFTAGENHKQVTLQQEGREITLQT

SEQ ID NO: 14736 - protein, 20 aa, artificial
  peptide fold or domain or sub-domain
PAELPENDVQAKNISQVDIR

SEQ ID NO: 14737 - protein, 21 aa, artificial
  peptide fold or domain or sub-domain
PAERRATLVAKRDAQPGRPVV

SEQ ID NO: 14738 - protein, 26 aa, artificial
  peptide fold or domain or sub-domain
PAERVGDDVVLFSDEERTQTIGTAYG

SEQ ID NO: 14739 - protein, 27 aa, artificial
  peptide fold or domain or sub-domain
PAESWNKLHLQIIFYGREHCTARGCDG

SEQ ID NO: 14740 - protein, 27 aa, artificial
  peptide fold or domain or sub-domain
PAEVADDVASALVNLGYKEAVVRKVLA

SEQ ID NO: 14741 - protein, 30 aa, artificial
  peptide fold or domain or sub-domain
PAEVGLQRAEARGGAARFESKGLAFHERLR

SEQ ID NO: 14742 - protein, 29 aa, artificial
  peptide fold or domain or sub-domain
PAEVVSTNYQPNEVVIAVKIADQLNTIRS

SEQ ID NO: 14743 - protein, 28 aa, artificial
  peptide fold or domain or sub-domain
PAFDPNLFATDVDPATLRELSTSPQNPL

SEQ ID NO: 14744 - protein, 30 aa, artificial
  peptide fold or domain or sub-domain
PAFVFASCRSPDGAKDLQAVAATHTNVKVL

SEQ ID NO: 14745 - protein, 21 aa, artificial
  peptide fold or domain or sub-domain
PAGFATTNGTRFTIDGETQYL

SEQ ID NO: 14746 - protein, 22 aa, artificial
  peptide fold or domain or sub-domain
PAHHRRHEVEFDGVLRQWLSMP

SEQ ID NO: 14747 - protein, 20 aa, artificial
  peptide fold or domain or sub-domain
PAHLRAGASAEERQATTAQP

SEQ ID NO: 14748 - protein, 27 aa, artificial
  peptide fold or domain or sub-domain
PAHSLCGTPEYLAPEIITSKVGHDKTV

SEQ ID NO: 14749 - protein, 26 aa, artificial
  peptide fold or domain or sub-domain
PAIGTIFSNPNGDIPRSRITNEGELD

SEQ ID NO: 14750 - protein, 30 aa, artificial
  peptide fold or domain or sub-domain
PAIKCGKCENCVRGNYNLCEHNGFVGLQSD

SEQ ID NO: 14751 - protein, 24 aa, artificial
  peptide fold or domain or sub-domain
PAINEVGVKYERREYFLPQLIRSA

SEQ ID NO: 14752 - protein, 30 aa, artificial
  peptide fold or domain or sub-domain
PAIPCGGCYPCRKGRTNACMNIDMIGSVRR

SEQ ID NO: 14753 - protein, 27 aa, artificial
  peptide fold or domain or sub-domain
PAITATKFDVDKTSKNPAYVDALAKTN

SEQ ID NO: 14754 - protein, 28 aa, artificial
  peptide fold or domain or sub-domain
PAIVGLPSEPTARAHSAFTPDRALEHQE

SEQ ID NO: 14755 - protein, 29 aa, artificial
  peptide fold or domain or sub-domain
PAKDDFPNFEGHKSLLSKYLTADMYAKLR

SEQ ID NO: 14756 - protein, 26 aa, artificial
  peptide fold or domain or sub-domain
PALGTLQSNPNGQIPKNFFSGHPAYN

SEQ ID NO: 14757 - protein, 25 aa, artificial
  peptide fold or domain or sub-domain
PALLRFVADRSGDRDLRTLLRPDNS

SEQ ID NO: 14758 - protein, 20 aa, artificial
  peptide fold or domain or sub-domain
PALTIRRQGDSYVAAESSAV

SEQ ID NO: 14759 - protein, 30 aa, artificial
  peptide fold or domain or sub-domain
PALWREPKFSITDEQYADFYKHLTFDTEAP

SEQ ID NO: 14760 - protein, 27 aa, artificial
  peptide fold or domain or sub-domain
PALYTLDGLKGVKSPIGLYADRLGVDI

SEQ ID NO: 14761 - protein, 24 aa, artificial
  peptide fold or domain or sub-domain
PAMERIGELYDKGKIFLPQLILAA

SEQ ID NO: 14762 - protein, 26 aa, artificial
  peptide fold or domain or sub-domain
PANAVGDDIRLFTDEAPSQELATFFT

SEQ ID NO: 14763 - protein, 22 aa, artificial
  peptide fold or domain or sub-domain
PANHGLYETERQGRRLTYHALT

SEQ ID NO: 14764 - protein, 22 aa, artificial
  peptide fold or domain or sub-domain
PANHQVRLWQSEQGGRRFYSMP

SEQ ID NO: 14765 - protein, 22 aa, artificial
  peptide fold or domain or sub-domain
PANHRRESRIWQERERFFYTMP

SEQ ID NO: 14766 - protein, 22 aa, artificial
  peptide fold or domain or sub-domain
PANRIRREVEYAGAMRPYYEIF

SEQ ID NO: 14767 - protein, 26 aa, artificial
  peptide fold or domain or sub-domain
PANRVGDDIEIYRDETRTHVINVSHH

SEQ ID NO: 14768 - protein, 22 aa, artificial
  peptide fold or domain or sub-domain
PANYAIEGRRWRGMRREYYVVP

SEQ ID NO: 14769 - protein, 30 aa, artificial
  peptide fold or domain or sub-domain
PAPGIKVTALAEDGTIMAVEHSEFPIYGLQ

SEQ ID NO: 14770 - protein, 20 aa, artificial
  peptide fold or domain or sub-domain
PAPPSPDDPGLRGWIARAAL

SEQ ID NO: 14771 - protein, 26 aa, artificial
  peptide fold or domain or sub-domain
PAQAAGEELVVYDPKDRKTVLTRFAF

SEQ ID NO: 14772 - protein, 27 aa, artificial
  peptide fold or domain or sub-domain
PAQFEEFRKRHYADTEVMLKTMALNRR

SEQ ID NO: 14773 - protein, 25 aa, artificial
  peptide fold or domain or sub-domain
PAQQTHHPLSGLYSNPDGSLSSSRA

SEQ ID NO: 14774 - protein, 29 aa, artificial
  peptide fold or domain or sub-domain
PAQVQSFSPAADHIRVELAQEGSRQTLRA

SEQ ID NO: 14775 - protein, 22 aa, artificial
  peptide fold or domain or sub-domain
PARHARKPAEYNGRKGHYIEIM

SEQ ID NO: 14776 - protein, 27 aa, artificial
  peptide fold or domain or sub-domain
PASSLAYERVFAGMRGLKTNEELAKKY

SEQ ID NO: 14777 - protein, 27 aa, artificial
  peptide fold or domain or sub-domain
PASYEDDLPYTPAWQEKWTGIHRDTLL

SEQ ID NO: 14778 - protein, 29 aa, artificial
  peptide fold or domain or sub-domain
PASYNPMVLIQKTDTGVSLQTYDDLLAKD

SEQ ID NO: 14779 - protein, 22 aa, artificial
  peptide fold or domain or sub-domain
PATAVVTVNDADGARLKASLSG

SEQ ID NO: 14780 - protein, 27 aa, artificial
  peptide fold or domain or sub-domain
PATEQPAPAGLAAELAKRQRAGEVASS

SEQ ID NO: 14781 - protein, 24 aa, artificial
  peptide fold or domain or sub-domain
PATIQTLDKYQGADFYIPDVINAS

SEQ ID NO: 14782 - protein, 27 aa, artificial
  peptide fold or domain or sub-domain
PATPPANTYARVDSSAAAASTPSSPVP

SEQ ID NO: 14783 - protein, 26 aa, artificial
  peptide fold or domain or sub-domain
PATTKQALDSKLMGLFEKKRMANLFE

SEQ ID NO: 14784 - protein, 27 aa, artificial
  peptide fold or domain or sub-domain
PAVETTKTDGERSSKNDSFVAGVVENN

SEQ ID NO: 14785 - protein, 24 aa, artificial
  peptide fold or domain or sub-domain
PAVFVYKGGRERTEEQMEEYRGRT

SEQ ID NO: 14786 - protein, 26 aa, artificial
  peptide fold or domain or sub-domain
PAVGSLVPTAIGTTIPSDLFAGEPGY

SEQ ID NO: 14787 - protein, 27 aa, artificial
  peptide fold or domain or sub-domain
PAVQATEYNGERSAANYAFVNAVARKN

SEQ ID NO: 14788 - protein, 23 aa, artificial
  peptide fold or domain or sub-domain
PAVTLLHDAEADPAEAAAAYEVA

SEQ ID NO: 14789 - protein, 28 aa, artificial
  peptide fold or domain or sub-domain
PAVVRTHGDEERDYLVSLGVDRVVMGEH

SEQ ID NO: 14790 - protein, 28 aa, artificial
  peptide fold or domain or sub-domain
PAYDPNHFIQGFSSEAWGQLINDPQRPL

SEQ ID NO: 14791 - protein, 28 aa, artificial
  peptide fold or domain or sub-domain
PAYDPNIIARGTSKAQREAWNNDPKKPM

SEQ ID NO: 14792 - protein, 28 aa, artificial
  peptide fold or domain or sub-domain
PAYDPNLAALGFSSEERKKIEENEEMPL

SEQ ID NO: 14793 - protein, 28 aa, artificial
  peptide fold or domain or sub-domain
PAYDPVKLSGVLSQKDYNEIFNSPKKPL

SEQ ID NO: 14794 - protein, 26 aa, artificial
  peptide fold or domain or sub-domain
PAYGSVVKSPTGRHIDFDFYDGEKNF

SEQ ID NO: 14795 - protein, 28 aa, artificial
  peptide fold or domain or sub-domain
PAYMNHLDLDLIMNANEDRDGYIKRHSE

SEQ ID NO: 14796 - protein, 28 aa, artificial
  peptide fold or domain or sub-domain
PAYSQSAICRFEKLDITPKSAQKLKPVL

SEQ ID NO: 14797 - protein, 26 aa, artificial
  peptide fold or domain or sub-domain
PCDLLDLWSMETSSLFARFSVATTLK

SEQ ID NO: 14798 - protein, 28 aa, artificial
  peptide fold or domain or sub-domain
PCDTALPNTYVGTDGYLHVVARNASGGA

SEQ ID NO: 14799 - protein, 20 aa, artificial
  peptide fold or domain or sub-domain
PCGHCFACQQGNVHICENNS

SEQ ID NO: 14800 - protein, 26 aa, artificial
  peptide fold or domain or sub-domain
PCGHCFACQQGNVHICENNSPVCGNG

SEQ ID NO: 14801 - protein, 26 aa, artificial
  peptide fold or domain or sub-domain
PCGKCKNCITGKENLCEVFAKNRLNG

SEQ ID NO: 14802 - protein, 30 aa, artificial
  peptide fold or domain or sub-domain
PCHPEQHVMLIKNLKAVGARVDISDDSVTV

SEQ ID NO: 14803 - protein, 20 aa, artificial
  peptide fold or domain or sub-domain
PCKKDEFTCNDKKCIPMELQ

SEQ ID NO: 14804 - protein, 26 aa, artificial
  peptide fold or domain or sub-domain
PCNACSYCKKGETHLCENNTSIGGAG

SEQ ID NO: 14805 - protein, 27 aa, artificial
  peptide fold or domain or sub-domain
PCREVGALKSAIKDAILDGVIPNEYEA

SEQ ID NO: 14806 - protein, 21 aa, artificial
  peptide fold or domain or sub-domain
PCRLKPGSKAHAAYGTEVVHE

SEQ ID NO: 14807 - protein, 26 aa, artificial
  peptide fold or domain or sub-domain
PCRSCELCKRGKYNLCVEPRYCSSMG

SEQ ID NO: 14808 - protein, 28 aa, artificial
  peptide fold or domain or sub-domain
PCSGTVKYVDNSKITIESDSGEQHTLDL

SEQ ID NO: 14809 - protein, 26 aa, artificial
  peptide fold or domain or sub-domain
PCSKSDIFKSKEFGLMEKKQLFQFLH

SEQ ID NO: 14810 - protein, 21 aa, artificial
  peptide fold or domain or sub-domain
PCSLVASTIAANAYKSLEINE

SEQ ID NO: 14811 - protein, 26 aa, artificial
  peptide fold or domain or sub-domain
PCSRSDVFNTKTLTIVEKRLLMKFLT

SEQ ID NO: 14812 - protein, 20 aa, artificial
  peptide fold or domain or sub-domain
PCTPLEFSCGSGECIAREYR

SEQ ID NO: 14813 - protein, 26 aa, artificial
  peptide fold or domain or sub-domain
PCVAVGNSLQLFDPNDRDRPTARFDF

SEQ ID NO: 14814 - protein, 23 aa, artificial
  peptide fold or domain or sub-domain
PCYFALIFSGMNSEGLDVRQRAG

SEQ ID NO: 14815 - protein, 21 aa, artificial
  peptide fold or domain or sub-domain
PCYFNEELRWSKGEDWYLGLF

SEQ ID NO: 14816 - protein, 22 aa, artificial
  peptide fold or domain or sub-domain
PDASTAEILFKKDPIHYVDANA

SEQ ID NO: 14817 - protein, 20 aa, artificial
  peptide fold or domain or sub-domain
PDCMKSMRDMQDFHQLERGW

SEQ ID NO: 14818 - protein, 21 aa, artificial
  peptide fold or domain or sub-domain
PDDAVVYKTVGTLIVKTTKDK

SEQ ID NO: 14819 - protein, 24 aa, artificial
  peptide fold or domain or sub-domain
PDEWFNKNYKANLVPLLTSQTLRK

SEQ ID NO: 14820 - protein, 28 aa, artificial
  peptide fold or domain or sub-domain
PDFDLDILNGKTRKKEWAEIALSPEKPL

SEQ ID NO: 14821 - protein, 28 aa, artificial
  peptide fold or domain or sub-domain
PDFDPNRPFDLLYKDRFPDFDKLPQSEK

SEQ ID NO: 14822 - protein, 20 aa, artificial
  peptide fold or domain or sub-domain
PDFPFSDEIRKPVFGEPMKH

SEQ ID NO: 14823 - protein, 25 aa, artificial
  peptide fold or domain or sub-domain
PDFWVKYLKTKPDEQWSTFEMVSTL

SEQ ID NO: 14824 - protein, 20 aa, artificial
  peptide fold or domain or sub-domain
PDGDLGRAIDEQLGGFEAFK

SEQ ID NO: 14825 - protein, 27 aa, artificial
  peptide fold or domain or sub-domain
PDHDTRPEFQAPEVSWTPVISPSSMMI

SEQ ID NO: 14826 - protein, 25 aa, artificial
  peptide fold or domain or sub-domain
PDHETVRASCNKRNGNKIENMNKVF

SEQ ID NO: 14827 - protein, 21 aa, artificial
  peptide fold or domain or sub-domain
PDIHQREEMARQMGLPESRIQ

SEQ ID NO: 14828 - protein, 29 aa, artificial
  peptide fold or domain or sub-domain
PDIPNSAIIARIREQIAISTGSACSSGTI

SEQ ID NO: 14829 - protein, 25 aa, artificial
  peptide fold or domain or sub-domain
PDKDSNHPGFNDPVYVERRNYISNT

SEQ ID NO: 14830 - protein, 22 aa, artificial
  peptide fold or domain or sub-domain
PDKKLGAQLHAADPKNYPDDNH

SEQ ID NO: 14831 - protein, 22 aa, artificial
  peptide fold or domain or sub-domain
PDKPLAKKLFDEKPDVYKDPNH

SEQ ID NO: 14832 - protein, 26 aa, artificial
  peptide fold or domain or sub-domain
PDLPIIILSARGQDMDKIMGLEIGAD

SEQ ID NO: 14833 - protein, 29 aa, artificial
  peptide fold or domain or sub-domain
PDLVQACGPLPMLRWVKSALAPTVRTQLS

SEQ ID NO: 14834 - protein, 22 aa, artificial
  peptide fold or domain or sub-domain
PDNLRSVELEFRGCPRRVLEYN

SEQ ID NO: 14835 - protein, 27 aa, artificial
  peptide fold or domain or sub-domain
PDPKFAMGHKCSEFTPPVLNLGAHVAP

SEQ ID NO: 14836 - protein, 25 aa, artificial
  peptide fold or domain or sub-domain
PDQEEMEWFEANYPGWYDHYGKIYE

SEQ ID NO: 14837 - protein, 29 aa, artificial
  peptide fold or domain or sub-domain
PDRPKTELRSLLGRFLFTSEDAFKDVRVL

SEQ ID NO: 14838 - protein, 26 aa, artificial
  peptide fold or domain or sub-domain
PDSRQAIFKDTTLQLREKNLLFRFFK

SEQ ID NO: 14839 - protein, 23 aa, artificial
  peptide fold or domain or sub-domain
PDTLSGMSVGNSVPRVMHASAMH

SEQ ID NO: 14840 - protein, 28 aa, artificial
  peptide fold or domain or sub-domain
PDVEELHARANAQDSGISLATVYRTVKL

SEQ ID NO: 14841 - protein, 21 aa, artificial
  peptide fold or domain or sub-domain
PDVFTREELAMRLDLTEARVQ

SEQ ID NO: 14842 - protein, 29 aa, artificial
  peptide fold or domain or sub-domain
PDVMINPMHFDLIFKKVASTCERCFSKAE

SEQ ID NO: 14843 - protein, 22 aa, artificial
  peptide fold or domain or sub-domain
PDVVADVEPSVVTILVGDGLGS

SEQ ID NO: 14844 - protein, 28 aa, artificial
  peptide fold or domain or sub-domain
PDYNPNEPYKGYENFPGKDKTEKMENMW

SEQ ID NO: 14845 - protein, 20 aa, artificial
  peptide fold or domain or sub-domain
PDYPEEPKTDTEKDVKARYD

SEQ ID NO: 14846 - protein, 28 aa, artificial
  peptide fold or domain or sub-domain
PEAEAQYERITRNLQEVTSGEVIRKVLS

SEQ ID NO: 14847 - protein, 20 aa, artificial
  peptide fold or domain or sub-domain
PEAESINAIYDKSAKDYDCY

SEQ ID NO: 14848 - protein, 23 aa, artificial
  peptide fold or domain or sub-domain
PEAVSGLTATFTCPDSPLKRISI

SEQ ID NO: 14849 - protein, 21 aa, artificial
  peptide fold or domain or sub-domain
PEDAAVFMNVGSVMMQKSKEQ

SEQ ID NO: 14850 - protein, 21 aa, artificial
  peptide fold or domain or sub-domain
PEDAELYRLTGFVLVKKSKNE

SEQ ID NO: 14851 - protein, 21 aa, artificial
  peptide fold or domain or sub-domain
PEDGTVYKHAGSVLIKSNKVD

SEQ ID NO: 14852 - protein, 24 aa, artificial
  peptide fold or domain or sub-domain
PEDLDDLRAIYYKRELPENAEEIL

SEQ ID NO: 14853 - protein, 24 aa, artificial
  peptide fold or domain or sub-domain
PEDPLDEQHAVRAVAAAVEMQQAQ

SEQ ID NO: 14854 - protein, 25 aa, artificial
  peptide fold or domain or sub-domain
PEDTLPYFGEDAEGESTGVQMAFNF

SEQ ID NO: 14855 - protein, 20 aa, artificial
  peptide fold or domain or sub-domain
PEEFGADWRPVAASGENRVE

SEQ ID NO: 14856 - protein, 27 aa, artificial
  peptide fold or domain or sub-domain
PEEFVIDGFGQVPNPLDMVGVILEVNA

SEQ ID NO: 14857 - protein, 30 aa, artificial
  peptide fold or domain or sub-domain
PEEVRPFLENVTRGRGIPPERLDEVGAHYY

SEQ ID NO: 14858 - protein, 27 aa, artificial
  peptide fold or domain or sub-domain
PEEVWRDINYLLIRHGRAVCTAKNPKH

SEQ ID NO: 14859 - protein, 28 aa, artificial
  peptide fold or domain or sub-domain
PEFDPALFAGRMPPEIWKQYLEDKRHPL

SEQ ID NO: 14860 - protein, 24 aa, artificial
  peptide fold or domain or sub-domain
PEFPPFEVLDKAKTIRMPFDPNAD

SEQ ID NO: 14861 - protein, 20 aa, artificial
  peptide fold or domain or sub-domain
PEGKLLNEIVSTFGSLEMLK

SEQ ID NO: 14862 - protein, 20 aa, artificial
  peptide fold or domain or sub-domain
PEGVTGPEGVTGPEDVTGPE

SEQ ID NO: 14863 - protein, 21 aa, artificial
  peptide fold or domain or sub-domain
PEIVARHFFKNLGVVVAPHTL

SEQ ID NO: 14864 - protein, 22 aa, artificial
  peptide fold or domain or sub-domain
PEIVGVDADDKALWEQLVLTEV

SEQ ID NO: 14865 - protein, 28 aa, artificial
  peptide fold or domain or sub-domain
PEKKALYDRLKKRGTEQEANIAKRIAKA

SEQ ID NO: 14866 - protein, 24 aa, artificial
  peptide fold or domain or sub-domain
PEKKEEFRAFTDRYLKKVRDDYGR

SEQ ID NO: 14867 - protein, 22 aa, artificial
  peptide fold or domain or sub-domain
PEKNPLETTAKTPGKHEYSNRN

SEQ ID NO: 14868 - protein, 25 aa, artificial
  peptide fold or domain or sub-domain
PELAARLKNLPTFDAASIKEMFHAY

SEQ ID NO: 14869 - protein, 23 aa, artificial
  peptide fold or domain or sub-domain
PELIVSLLSNIHQLPAHVKQATL

SEQ ID NO: 14870 - protein, 28 aa, artificial
  peptide fold or domain or sub-domain
PELVAPMLDEFPGLALAAVNAPGQCVVS

SEQ ID NO: 14871 - protein, 23 aa, artificial
  peptide fold or domain or sub-domain
PEMEGRFAGVIRLEENQRRFVLQ

SEQ ID NO: 14872 - protein, 29 aa, artificial
  peptide fold or domain or sub-domain
PENAGQYSSHPHETVFFQERGEYDSYYGR

SEQ ID NO: 14873 - protein, 20 aa, artificial
  peptide fold or domain or sub-domain
PEQFKTLWNGQKLVTTVTEI

SEQ ID NO: 14874 - protein, 20 aa, artificial
  peptide fold or domain or sub-domain
PEQIKSYVKDGVLVSEIVEH

SEQ ID NO: 14875 - protein, 20 aa, artificial
  peptide fold or domain or sub-domain
PEQLIHKIVNGKLVTSVVDH

SEQ ID NO: 14876 - protein, 20 aa, artificial
  peptide fold or domain or sub-domain
PEQMKHSFADGKFKSAVFEH

SEQ ID NO: 14877 - protein, 20 aa, artificial
  peptide fold or domain or sub-domain
PEQYKTTIAGKTLKTVCVDS

SEQ ID NO: 14878 - protein, 27 aa, artificial
  peptide fold or domain or sub-domain
PESEWQQFTHLLIDHGRAVCGARSADC

SEQ ID NO: 14879 - protein, 27 aa, artificial
  peptide fold or domain or sub-domain
PESLEILSKRFYPESPAMSKVLAINRY

SEQ ID NO: 14880 - protein, 26 aa, artificial
  peptide fold or domain or sub-domain
PESRADIFNNKNLSLASKRIVMRFMK

SEQ ID NO: 14881 - protein, 28 aa, artificial
  peptide fold or domain or sub-domain
PETLRLQASIAKDAGRDRLAMNFERAAE

SEQ ID NO: 14882 - protein, 27 aa, artificial
  peptide fold or domain or sub-domain
PEWALADGHFWLIQFGKRVCRSRIPKC

SEQ ID NO: 14883 - protein, 27 aa, artificial
  peptide fold or domain or sub-domain
PEYRDYLETVDLNQVSSSTGIPLAELY

SEQ ID NO: 14884 - protein, 26 aa, artificial
  peptide fold or domain or sub-domain
PFACGACGKAFGQSSQLIQHQRVHYR

SEQ ID NO: 14885 - protein, 26 aa, artificial
  peptide fold or domain or sub-domain
PFACTECQRRFAQRPQLLKHLQKAHS

SEQ ID NO: 14886 - protein, 21 aa, artificial
  peptide fold or domain or sub-domain
PFARVAAQALCVPEDNIRSLL

SEQ ID NO: 14887 - protein, 28 aa, artificial
  peptide fold or domain or sub-domain
PFEGIVVYVDATRIVVSTSKSKLALSKK

SEQ ID NO: 14888 - protein, 22 aa, artificial
  peptide fold or domain or sub-domain
PFFEWDENDKRWNAAHHPFTSC

SEQ ID NO: 14889 - protein, 24 aa, artificial
  peptide fold or domain or sub-domain
PFIRRPIFTSDSIGIRTLQEAGKL

SEQ ID NO: 14890 - protein, 26 aa, artificial
  peptide fold or domain or sub-domain
PFKCPHCELRFRTSGRRKTHMQFHYK

SEQ ID NO: 14891 - protein, 26 aa, artificial
  peptide fold or domain or sub-domain
PFKCTVCGVAFTQKGNLRRHYKIHSE

SEQ ID NO: 14892 - protein, 29 aa, artificial
  peptide fold or domain or sub-domain
PFKTLWGGLERERLPIVDTRDGQAVEWLS

SEQ ID NO: 14893 - protein, 23 aa, artificial
  peptide fold or domain or sub-domain
PFLQNNRLKEIALSVDKTTAQVS

SEQ ID NO: 14894 - protein, 23 aa, artificial
  peptide fold or domain or sub-domain
PFLYDEHAQNLAKKYGRTTAQIC

SEQ ID NO: 14895 - protein, 26 aa, artificial
  peptide fold or domain or sub-domain
PFQCPVCSYRCRRRDALNGHMRIHSD

SEQ ID NO: 14896 - protein, 21 aa, artificial
  peptide fold or domain or sub-domain
PFREAHHLTGLLTQKLSTEAM

SEQ ID NO: 14897 - protein, 20 aa, artificial
  peptide fold or domain or sub-domain
PFSASDIRKAIADGHYPVDL

SEQ ID NO: 14898 - protein, 26 aa, artificial
  peptide fold or domain or sub-domain
PFSKKEVFSSSDLNLVEKRQVMRLYS

SEQ ID NO: 14899 - protein, 29 aa, artificial
  peptide fold or domain or sub-domain
PFSYDYPDFSLHNNWMSKCMTEEIYNKLC

SEQ ID NO: 14900 - protein, 26 aa, artificial
  peptide fold or domain or sub-domain
PFTCPQCGKSFSTSSHLKNHMKIHTS

SEQ ID NO: 14901 - protein, 21 aa, artificial
  peptide fold or domain or sub-domain
PFTRQYLKATPWEDPEIYRKT

SEQ ID NO: 14902 - protein, 29 aa, artificial
  peptide fold or domain or sub-domain
PFTVTSVDPNNKVIESQEGEKLKFDMLIG

SEQ ID NO: 14903 - protein, 24 aa, artificial
  peptide fold or domain or sub-domain
PFVHRYRDGQDHYGDQELRYQGRT

SEQ ID NO: 14904 - protein, 22 aa, artificial
  peptide fold or domain or sub-domain
PFVTLIFNDSNYGLIKWKQEER

SEQ ID NO: 14905 - protein, 22 aa, artificial
  peptide fold or domain or sub-domain
PFYTYEQVLSTYGIDKPDTRYD

SEQ ID NO: 14906 - protein, 20 aa, artificial
  peptide fold or domain or sub-domain
PGAELAAAIDATFGGMDALK

SEQ ID NO: 14907 - protein, 27 aa, artificial
  peptide fold or domain or sub-domain
PGAKLGETLNNIRKLVVSSEIENTQEA

SEQ ID NO: 14908 - protein, 23 aa, artificial
  peptide fold or domain or sub-domain
PGANDIDPESCHDDMLLATAKYK

SEQ ID NO: 14909 - protein, 27 aa, artificial
  peptide fold or domain or sub-domain
PGARQALRKKPPERTPEDLNTIYSYLH

SEQ ID NO: 14910 - protein, 26 aa, artificial
  peptide fold or domain or sub-domain
PGATGIDGIYSQCLPRVSSGEIQKLM

SEQ ID NO: 14911 - protein, 21 aa, artificial
  peptide fold or domain or sub-domain
PGDIALAVRKAGGPALEKRSI

SEQ ID NO: 14912 - protein, 20 aa, artificial
  peptide fold or domain or sub-domain
PGEPGNKAVVFEARNETVNG

SEQ ID NO: 14913 - protein, 22 aa, artificial
  peptide fold or domain or sub-domain
PGEYIFGAEVKHRLLHDEGTNL

SEQ ID NO: 14914 - protein, 28 aa, artificial
  peptide fold or domain or sub-domain
PGFDPNLLTGRITPAQMASLAKDPLQPM

SEQ ID NO: 14915 - protein, 28 aa, artificial
  peptide fold or domain or sub-domain
PGFDPSEFTTGISQARLDTLTNDPDQPL

SEQ ID NO: 14916 - protein, 28 aa, artificial
  peptide fold or domain or sub-domain
PGFDPSLFIDGIDTQTWTALNTDWQKPL

SEQ ID NO: 14917 - protein, 27 aa, artificial
  peptide fold or domain or sub-domain
PGGTFLEIAVLQGKLKEYLAFVKQAGF

SEQ ID NO: 14918 - protein, 22 aa, artificial
  peptide fold or domain or sub-domain
PGGTLFEIAHLNDKVEEYFQEA

SEQ ID NO: 14919 - protein, 27 aa, artificial
  peptide fold or domain or sub-domain
PGGTLFEIAHLNDKVEEYFQEARSLGF

SEQ ID NO: 14920 - protein, 22 aa, artificial
  peptide fold or domain or sub-domain
PGGTLLEAAIVQQHCRVFMQRA

SEQ ID NO: 14921 - protein, 27 aa, artificial
  peptide fold or domain or sub-domain
PGGTLLEAAIVQQHCRVFMQRARDLGF

SEQ ID NO: 14922 - protein, 22 aa, artificial
  peptide fold or domain or sub-domain
PGGTTLEIAYAKGHLERTLSSL

SEQ ID NO: 14923 - protein, 30 aa, artificial
  peptide fold or domain or sub-domain
PGHHSGHYDDLAPAGYLLHQAYGPTFFASD

SEQ ID NO: 14924 - protein, 30 aa, artificial
  peptide fold or domain or sub-domain
PGHQGGQYYRKHPAGREFYDFFGETVFRAD

SEQ ID NO: 14925 - protein, 30 aa, artificial
  peptide fold or domain or sub-domain
PGHSGGVAFLKSPVGQMYHQFYGENMLRAD

SEQ ID NO: 14926 - protein, 21 aa, artificial
  peptide fold or domain or sub-domain
PGIAALEIHLQETRGWSIEQF

SEQ ID NO: 14927 - protein, 20 aa, artificial
  peptide fold or domain or sub-domain
PGIHTTNQINSYFGSFNAFA

SEQ ID NO: 14928 - protein, 24 aa, artificial
  peptide fold or domain or sub-domain
PGIQTVCELYDIGESYMPEILLAN

SEQ ID NO: 14929 - protein, 22 aa, artificial
  peptide fold or domain or sub-domain
PGIYHTENWEHRGRLYPVCFFN

SEQ ID NO: 14930 - protein, 27 aa, artificial
  peptide fold or domain or sub-domain
PGKNIGVILNFLLENVMQTPELNNKED

SEQ ID NO: 14931 - protein, 27 aa, artificial
  peptide fold or domain or sub-domain
PGKWLGELIAEIEQHVVEGSLENKQEV

SEQ ID NO: 14932 - protein, 24 aa, artificial
  peptide fold or domain or sub-domain
PGLEEVGRRFEKNQVFLPQVMQSA

SEQ ID NO: 14933 - protein, 21 aa, artificial
  peptide fold or domain or sub-domain
PGLNGKTSLFSLPDSINLQDY

SEQ ID NO: 14934 - protein, 30 aa, artificial
  peptide fold or domain or sub-domain
PGLPCGECSSCRVGHYNLCPKVLFLSSPPN

SEQ ID NO: 14935 - protein, 30 aa, artificial
  peptide fold or domain or sub-domain
PGLSCGVCWDCQSGRDNHCKDYDILGLKNK

SEQ ID NO: 14936 - protein, 24 aa, artificial
  peptide fold or domain or sub-domain
PGMKIIGDKFEAAEIFLPQIMMSG

SEQ ID NO: 14937 - protein, 29 aa, artificial
  peptide fold or domain or sub-domain
PGMRWSQNNQGQFDDRLWQDKRYWSQAAA

SEQ ID NO: 14938 - protein, 30 aa, artificial
  peptide fold or domain or sub-domain
PGNDFQLIASTINCKYAALQNLEKKRFSLQ

SEQ ID NO: 14939 - protein, 22 aa, artificial
  peptide fold or domain or sub-domain
PGNHQLHSKEFRGAQRSYYAMP

SEQ ID NO: 14940 - protein, 22 aa, artificial
  peptide fold or domain or sub-domain
PGNYARQHAHWQGQDRHYYDME

SEQ ID NO: 14941 - protein, 27 aa, artificial
  peptide fold or domain or sub-domain
PGPDLGKILNQIESFIVAGNLANERQA

SEQ ID NO: 14942 - protein, 27 aa, artificial
  peptide fold or domain or sub-domain
PGPLFKEILSSVEDGQLEGRLQSREQA

SEQ ID NO: 14943 - protein, 27 aa, artificial
  peptide fold or domain or sub-domain
PGPLLGRVLKKIEYAVVVGDILNDHDA

SEQ ID NO: 14944 - protein, 27 aa, artificial
  peptide fold or domain or sub-domain
PGPMLGDALDELKALWIADRFEPTKEE

SEQ ID NO: 14945 - protein, 27 aa, artificial
  peptide fold or domain or sub-domain
PGPMMGQILAACLQAVVMKQVPNQQDA

SEQ ID NO: 14946 - protein, 27 aa, artificial
  peptide fold or domain or sub-domain
PGPTIGHILNALFDMVLMQPSRNTRPQ

SEQ ID NO: 14947 - protein, 24 aa, artificial
  peptide fold or domain or sub-domain
PGQVHAVGVPGDTPFIMKAWGLGG

SEQ ID NO: 14948 - protein, 28 aa, artificial
  peptide fold or domain or sub-domain
PGRIDTCMYGHEFEDFTQSSIELDSFVF

SEQ ID NO: 14949 - protein, 29 aa, artificial
  peptide fold or domain or sub-domain
PGSFALYGREIRVENGRLVNAEGSLAGAH

SEQ ID NO: 14950 - protein, 27 aa, artificial
  peptide fold or domain or sub-domain
PGVVIPEALNIPGGVWTETGKVFLDGE

SEQ ID NO: 14951 - protein, 21 aa, artificial
  peptide fold or domain or sub-domain
PGWLHTAGGKIVTASGAPYTI

SEQ ID NO: 14952 - protein, 26 aa, artificial
  peptide fold or domain or sub-domain
PHACAFCPAAFSQKGNLQSHIQRVHS

SEQ ID NO: 14953 - protein, 25 aa, artificial
  peptide fold or domain or sub-domain
PHAKESKFPYKQGRLPNDIEMAKQL

SEQ ID NO: 14954 - protein, 29 aa, artificial
  peptide fold or domain or sub-domain
PHDAPAYDQQPNSSSFFSDGGSWESQYGD

SEQ ID NO: 14955 - protein, 21 aa, artificial
  peptide fold or domain or sub-domain
PHFFTSPLATSDTLNLQRDYI

SEQ ID NO: 14956 - protein, 29 aa, artificial
  peptide fold or domain or sub-domain
PHIVLTHNHHWQAEGAEAVCDLEEAIKAA

SEQ ID NO: 14957 - protein, 27 aa, artificial
  peptide fold or domain or sub-domain
PHLEPALEHLPEDIERAAAINRLVEYN

SEQ ID NO: 14958 - protein, 28 aa, artificial
  peptide fold or domain or sub-domain
PHLPLDSFAGGIPAGVWRDLLEDRRAPL

SEQ ID NO: 14959 - protein, 26 aa, artificial
  peptide fold or domain or sub-domain
PHNIVHILAHENRIPLSEALSLTIAQ

SEQ ID NO: 14960 - protein, 30 aa, artificial
  peptide fold or domain or sub-domain
PHNPDRIFVAISAAGAFRSDDGGQTWQAIN

SEQ ID NO: 14961 - protein, 27 aa, artificial
  peptide fold or domain or sub-domain
PHNQKASAVEALISLGYKTAQADKMVQ

SEQ ID NO: 14962 - protein, 28 aa, artificial
  peptide fold or domain or sub-domain
PHPGEAAILLNISIEEVQRDRISAAKQI

SEQ ID NO: 14963 - protein, 27 aa, artificial
  peptide fold or domain or sub-domain
PHPGLKVATNPNFDGKLKEIDDEFIKN

SEQ ID NO: 14964 - protein, 27 aa, artificial
  peptide fold or domain or sub-domain
PHPGYKVAERQSFRGHVKDLRPLFREE

SEQ ID NO: 14965 - protein, 20 aa, artificial
  peptide fold or domain or sub-domain
PHRPERQDEKARIEALGGFV

SEQ ID NO: 14966 - protein, 20 aa, artificial
  peptide fold or domain or sub-domain
PHTTFAAGGVLRRGYILAAG

SEQ ID NO: 14967 - protein, 22 aa, artificial
  peptide fold or domain or sub-domain
PHVHFLKNGHMYMKGHEVRFSR

SEQ ID NO: 14968 - protein, 22 aa, artificial
  peptide fold or domain or sub-domain
PHVKWMKGSEDLTPENEMPIGR

SEQ ID NO: 14969 - protein, 24 aa, artificial
  peptide fold or domain or sub-domain
PHVYLLKDGKEDKEQQRAEYNGRV

SEQ ID NO: 14970 - protein, 21 aa, artificial
  peptide fold or domain or sub-domain
PHWWGPRRTGWTGIAAHGQEV

SEQ ID NO: 14971 - protein, 20 aa, artificial
  peptide fold or domain or sub-domain
PHYPAEPQNEAEESIKLTYA

SEQ ID NO: 14972 - protein, 22 aa, artificial
  peptide fold or domain or sub-domain
PIADFANELFAANAYRDYLEVH

SEQ ID NO: 14973 - protein, 20 aa, artificial
  peptide fold or domain or sub-domain
PIAEVIFRMGWDAFRLEEHK

SEQ ID NO: 14974 - protein, 29 aa, artificial
  peptide fold or domain or sub-domain
PIAFCAKPVAVEAARNTIRCERIDTVRAV

SEQ ID NO: 14975 - protein, 22 aa, artificial
  peptide fold or domain or sub-domain
PIAHEGNYDGFFCPCHGSQYDS

SEQ ID NO: 14976 - protein, 20 aa, artificial
  peptide fold or domain or sub-domain
PIATFFELFGEADFRKIENE

SEQ ID NO: 14977 - protein, 30 aa, artificial
  peptide fold or domain or sub-domain
PIAVFNRSPNKTEKFMAERAVGKDIKAAYT

SEQ ID NO: 14978 - protein, 28 aa, artificial
  peptide fold or domain or sub-domain
PIDKVRKYYGFNDSMFKTIIVTKNEEEL

SEQ ID NO: 14979 - protein, 25 aa, artificial
  peptide fold or domain or sub-domain
PIDRLREYVTSAEVERIGGTTDSAI

SEQ ID NO: 14980 - protein, 25 aa, artificial
  peptide fold or domain or sub-domain
PIELGKVVVEPEKRKVTVEGEAVDL

SEQ ID NO: 14981 - protein, 30 aa, artificial
  peptide fold or domain or sub-domain
PIESLGVKLQGVNLTFLNAVRFGGVVYGVP

SEQ ID NO: 14982 - protein, 22 aa, artificial
  peptide fold or domain or sub-domain
PIFTYEQAIKLLIEHKKLNLQS

SEQ ID NO: 14983 - protein, 28 aa, artificial
  peptide fold or domain or sub-domain
PIGELSRQVKDGCWQSNYEQISRNTYQI

SEQ ID NO: 14984 - protein, 27 aa, artificial
  peptide fold or domain or sub-domain
PIGRVKKIMKLDKDINKINSEALHVIT

SEQ ID NO: 14985 - protein, 27 aa, artificial
  peptide fold or domain or sub-domain
PIGYVVDSIPGIADPIGHQCEELATRM

SEQ ID NO: 14986 - protein, 23 aa, artificial
  peptide fold or domain or sub-domain
PIHSKKDLAITGADLLKWTGENA

SEQ ID NO: 14987 - protein, 27 aa, artificial
  peptide fold or domain or sub-domain
PIICTLQDPRVPALAADMGNTRSAAAL

SEQ ID NO: 14988 - protein, 22 aa, artificial
  peptide fold or domain or sub-domain
PIINVVFSNDSFGFIEAEQEDT

SEQ ID NO: 14989 - protein, 22 aa, artificial
  peptide fold or domain or sub-domain
PIISYAQAMRRFGSDKPDTRFA

SEQ ID NO: 14990 - protein, 22 aa, artificial
  peptide fold or domain or sub-domain
PIKILMLNNRSDGMVQNLQDAA

SEQ ID NO: 14991 - protein, 24 aa, artificial
  peptide fold or domain or sub-domain
PIKRIIAGLNEFHDNYFVAHRELF

SEQ ID NO: 14992 - protein, 23 aa, artificial
  peptide fold or domain or sub-domain
PIKSRQEMDVTGNDLLNWASKKP

SEQ ID NO: 14993 - protein, 23 aa, artificial
  peptide fold or domain or sub-domain
PIKTKGELAVNGKDVIEWVGKPA

SEQ ID NO: 14994 - protein, 23 aa, artificial
  peptide fold or domain or sub-domain
PILMSTLISSLASPSSERRQVAG

SEQ ID NO: 14995 - protein, 30 aa, artificial
  peptide fold or domain or sub-domain
PIPEDKVDTSAFTESSLNALTYKGKLYGLP

SEQ ID NO: 14996 - protein, 22 aa, artificial
  peptide fold or domain or sub-domain
PIPWDGYVRANLLTPDEAALIK

SEQ ID NO: 14997 - protein, 23 aa, artificial
  peptide fold or domain or sub-domain
PIQTRTELAVTGRDVMAHFQKKG

SEQ ID NO: 14998 - protein, 29 aa, artificial
  peptide fold or domain or sub-domain
PIRLRAMDYIHLRNGELRTESLEELVALE

SEQ ID NO: 14999 - protein, 29 aa, artificial
  peptide fold or domain or sub-domain
PIRMSSLSMVYYDHDDIAFQNHEGMIVEE

SEQ ID NO: 15000 - protein, 30 aa, artificial
  peptide fold or domain or sub-domain
PIRPCYACFDCTIQRDLTGCRNGTFVSPAR

SEQ ID NO: 15001 - protein, 23 aa, artificial
  peptide fold or domain or sub-domain
PIRRLQDLTVNGRDMMDLGLRKH

SEQ ID NO: 15002 - protein, 27 aa, artificial
  peptide fold or domain or sub-domain
PISAHSMAPIFFDYKRTPMSLKKVQNA

SEQ ID NO: 15003 - protein, 26 aa, artificial
  peptide fold or domain or sub-domain
PISEKDLQEVLEELRVSSGVSLGEVL

SEQ ID NO: 15004 - protein, 23 aa, artificial
  peptide fold or domain or sub-domain
PITKAADLNISGGELIRSGILTP

SEQ ID NO: 15005 - protein, 30 aa, artificial
  peptide fold or domain or sub-domain
PITKEEIVSEVARQLCVKIDPDNVVLAAPL

SEQ ID NO: 15006 - protein, 27 aa, artificial
  peptide fold or domain or sub-domain
PITRIKKIIHLDEDIVQCSGNATFVVA

SEQ ID NO: 15007 - protein, 22 aa, artificial
  peptide fold or domain or sub-domain
PITVVILNNENLGMIEYEQQVK

SEQ ID NO: 15008 - protein, 20 aa, artificial
  peptide fold or domain or sub-domain
PIVEIYQGKTFRDVKKSSYN

SEQ ID NO: 15009 - protein, 28 aa, artificial
  peptide fold or domain or sub-domain
PIVEIYQGKTFRDVKKSSYNAHSYTVEK

SEQ ID NO: 15010 - protein, 22 aa, artificial
  peptide fold or domain or sub-domain
PIVHIVWKDGGYNLIHSLQMRD

SEQ ID NO: 15011 - protein, 20 aa, artificial
  peptide fold or domain or sub-domain
PIVHPTHDERERIDREGGCV

SEQ ID NO: 15012 - protein, 29 aa, artificial
  peptide fold or domain or sub-domain
PIVIVHHADDTSLLEASIDRDQKIYTTTG

SEQ ID NO: 15013 - protein, 30 aa, artificial
  peptide fold or domain or sub-domain
PIVLYNRTTSRATAFADSIGSNKATVATTI

SEQ ID NO: 15014 - protein, 22 aa, artificial
  peptide fold or domain or sub-domain
PIVTVVVNNDTNGLIELYQNIG

SEQ ID NO: 15015 - protein, 22 aa, artificial
  peptide fold or domain or sub-domain
PIVVTIFDNRALQLVKQWQVYL

SEQ ID NO: 15016 - protein, 20 aa, artificial
  peptide fold or domain or sub-domain
PIWTPLIVATMGEESLKAFG

SEQ ID NO: 15017 - protein, 23 aa, artificial
  peptide fold or domain or sub-domain
PIYDRLRAEQPIRWTGGDWQIFR

SEQ ID NO: 15018 - protein, 28 aa, artificial
  peptide fold or domain or sub-domain
PIYNPNWFVNGISHTNYNQLQTSANIPQ

SEQ ID NO: 15019 - protein, 23 aa, artificial
  peptide fold or domain or sub-domain
PIYRRMRVQNPVVHVASVRRTFL

SEQ ID NO: 15020 - protein, 26 aa, artificial
  peptide fold or domain or sub-domain
PIYTDTCIDPVNSIRSTYMAPFASKL

SEQ ID NO: 15021 - protein, 20 aa, artificial
  peptide fold or domain or sub-domain
PKAELAARHPGMLEGEGLDH

SEQ ID NO: 15022 - protein, 27 aa, artificial
  peptide fold or domain or sub-domain
PKAIQIMQKKPSWRTEDEIQAVCNILQ

SEQ ID NO: 15023 - protein, 30 aa, artificial
  peptide fold or domain or sub-domain
PKANTYYQKAIEIHPNHAEAWCRLGNILQK

SEQ ID NO: 15024 - protein, 28 aa, artificial
  peptide fold or domain or sub-domain
PKATVLQELDERGFVAAITSDKLKQHVA

SEQ ID NO: 15025 - protein, 27 aa, artificial
  peptide fold or domain or sub-domain
PKDFQDPVMGTPAWQEELTGVPANQAI

SEQ ID NO: 15026 - protein, 27 aa, artificial
  peptide fold or domain or sub-domain
PKDLWIGFNPTLVEFGKAVCRPVSPKC

SEQ ID NO: 15027 - protein, 24 aa, artificial
  peptide fold or domain or sub-domain
PKDTIKYVGCNPEIFGETLDRSRL

SEQ ID NO: 15028 - protein, 20 aa, artificial
  peptide fold or domain or sub-domain
PKDTLSGSINKEFGSFNNLT

SEQ ID NO: 15029 - protein, 27 aa, artificial
  peptide fold or domain or sub-domain
PKDYLLDAHHWLILHGRYVCQARKPRC

SEQ ID NO: 15030 - protein, 29 aa, artificial
  peptide fold or domain or sub-domain
PKELDPLILMYYANNEFKFTKMSDMVLLS

SEQ ID NO: 15031 - protein, 27 aa, artificial
  peptide fold or domain or sub-domain
PKELWVKTHHTMIFFGRYHCLARAPKC

SEQ ID NO: 15032 - protein, 29 aa, artificial
  peptide fold or domain or sub-domain
PKERKDITITYYLGRNVKKQTIRNFIPTH

SEQ ID NO: 15033 - protein, 26 aa, artificial
  peptide fold or domain or sub-domain
PKETVEVIAQSIGITNLLPEAALMLA

SEQ ID NO: 15034 - protein, 28 aa, artificial
  peptide fold or domain or sub-domain
PKEWESNPRIAQYMREHKFANGAALQAM

SEQ ID NO: 15035 - protein, 27 aa, artificial
  peptide fold or domain or sub-domain
PKGIESGNKILSPKETDYAPLGCTRLQ

SEQ ID NO: 15036 - protein, 20 aa, artificial
  peptide fold or domain or sub-domain
PKHELLSLIERFWGTMDNFL

SEQ ID NO: 15037 - protein, 25 aa, artificial
  peptide fold or domain or sub-domain
PKHQTIREASNVRNITKMKKYDSTF

SEQ ID NO: 15038 - protein, 22 aa, artificial
  peptide fold or domain or sub-domain
PKITFQQAVEMLNEIVEIPKDL

SEQ ID NO: 15039 - protein, 29 aa, artificial
  peptide fold or domain or sub-domain
PKKMKSLIIAYYEGRKYKVDNLKNMKIVS

SEQ ID NO: 15040 - protein, 25 aa, artificial
  peptide fold or domain or sub-domain
PKLAIGVALYKKGKIPESLATTEAA

SEQ ID NO: 15041 - protein, 27 aa, artificial
  peptide fold or domain or sub-domain
PKLVLPFLARSRSRLRATLDDGREVAV

SEQ ID NO: 15042 - protein, 22 aa, artificial
  peptide fold or domain or sub-domain
PKNIRQYKFLLNGNNHSVYNIP

SEQ ID NO: 15043 - protein, 26 aa, artificial
  peptide fold or domain or sub-domain
PKNWNWFKADNAEATIPATIENAGKY

SEQ ID NO: 15044 - protein, 27 aa, artificial
  peptide fold or domain or sub-domain
PKQFIVDGRDEITDPKKMLGVRLEVEG

SEQ ID NO: 15045 - protein, 27 aa, artificial
  peptide fold or domain or sub-domain
PKQSQSSVCIFADSASTGILKCNALVT

SEQ ID NO: 15046 - protein, 25 aa, artificial
  peptide fold or domain or sub-domain
PKRYDLIGGKWITLRDGSALTTLLE

SEQ ID NO: 15047 - protein, 25 aa, artificial
  peptide fold or domain or sub-domain
PKRYDWTGKNWVYSHDGVSLHELLA

SEQ ID NO: 15048 - protein, 23 aa, artificial
  peptide fold or domain or sub-domain
PKTGKYLRTGRWQHPIHGESYKA

SEQ ID NO: 15049 - protein, 24 aa, artificial
  peptide fold or domain or sub-domain
PKTNDEVRAILEKDYTPEIGKKVL

SEQ ID NO: 15050 - protein, 22 aa, artificial
  peptide fold or domain or sub-domain
PKVSWKRNGKPLDVSQLSGAFR

SEQ ID NO: 15051 - protein, 20 aa, artificial
  peptide fold or domain or sub-domain
PKYVFHSAGILPHPSYQGRV

SEQ ID NO: 15052 - protein, 30 aa, artificial
  peptide fold or domain or sub-domain
PLADFNISTADFAPGVLSAGTYKDKVYGLA

SEQ ID NO: 15053 - protein, 27 aa, artificial
  peptide fold or domain or sub-domain
PLARIKKIMKADEDVRMISAEAPILFA

SEQ ID NO: 15054 - protein, 27 aa, artificial
  peptide fold or domain or sub-domain
PLARVQKIIHADPERLNVTKNAAFAIA

SEQ ID NO: 15055 - protein, 21 aa, artificial
  peptide fold or domain or sub-domain
PLDEDPGLLEYLQADEIRALL

SEQ ID NO: 15056 - protein, 26 aa, artificial
  peptide fold or domain or sub-domain
PLDFIKSMLSANGFEEMSDEMINLIS

SEQ ID NO: 15057 - protein, 20 aa, artificial
  peptide fold or domain or sub-domain
PLDLSKIHTVDDMVRAMAKT

SEQ ID NO: 15058 - protein, 29 aa, artificial
  peptide fold or domain or sub-domain
PLDLSKIHTVDDMVRAMAKTAFTGRQLGL

SEQ ID NO: 15059 - protein, 28 aa, artificial
  peptide fold or domain or sub-domain
PLDRPWPLVPGTVHPARLVRNLANLRFH

SEQ ID NO: 15060 - protein, 30 aa, artificial
  peptide fold or domain or sub-domain
PLEELEKHLREWGYHPLKIGAKHQTLSVFQ

SEQ ID NO: 15061 - protein, 20 aa, artificial
  peptide fold or domain or sub-domain
PLEELVDWRPEVAQFKSREE

SEQ ID NO: 15062 - protein, 27 aa, artificial
  peptide fold or domain or sub-domain
PLEFWEKVNRAMVGFGQTVCKPQKPLC

SEQ ID NO: 15063 - protein, 27 aa, artificial
  peptide fold or domain or sub-domain
PLEKMHGKQINDWWPYRYKTSQSYIES

SEQ ID NO: 15064 - protein, 25 aa, artificial
  peptide fold or domain or sub-domain
PLEREVESCPDELSEELRRQGFRTV

SEQ ID NO: 15065 - protein, 30 aa, artificial
  peptide fold or domain or sub-domain
PLERSRFPLGSFLPPVVDTATYDGRLYAVP

SEQ ID NO: 15066 - protein, 23 aa, artificial
  peptide fold or domain or sub-domain
PLFERWREQGPMWTSDGSLLLSD

SEQ ID NO: 15067 - protein, 24 aa, artificial
  peptide fold or domain or sub-domain
PLFISIGDWLDSIKMSQYKNNFIA

SEQ ID NO: 15068 - protein, 23 aa, artificial
  peptide fold or domain or sub-domain
PLFKAGAPVGVAEVQGGAERQVS

SEQ ID NO: 15069 - protein, 23 aa, artificial
  peptide fold or domain or sub-domain
PLFTAEPIVEVAKKKGVTPATVL

SEQ ID NO: 15070 - protein, 30 aa, artificial
  peptide fold or domain or sub-domain
PLFVLIHGAKVLARISGANPQKLKAAIDEY

SEQ ID NO: 15071 - protein, 28 aa, artificial
  peptide fold or domain or sub-domain
PLGKPNPFSYIAALYGNNRDKYESYINK

SEQ ID NO: 15072 - protein, 20 aa, artificial
  peptide fold or domain or sub-domain
PLGQLGERIAKSFGDFVHFK

SEQ ID NO: 15073 - protein, 24 aa, artificial
  peptide fold or domain or sub-domain
PLHDLLSQSSDRAKEEEIVLALKA

SEQ ID NO: 15074 - protein, 23 aa, artificial
  peptide fold or domain or sub-domain
PLHRWGLRGYVRNGSFSPGLLDD

SEQ ID NO: 15075 - protein, 23 aa, artificial
  peptide fold or domain or sub-domain
PLIEQLRGDGGPVRTPLSWAAFD

SEQ ID NO: 15076 - protein, 30 aa, artificial
  peptide fold or domain or sub-domain
PLIIYNRTKKRSDDLSDKIASDVGSGKTKV

SEQ ID NO: 15077 - protein, 30 aa, artificial
  peptide fold or domain or sub-domain
PLIMPRSGDYFADRGLFHLSTQLALVGLSW

SEQ ID NO: 15078 - protein, 27 aa, artificial
  peptide fold or domain or sub-domain
PLKAEHAESIYELYPANDMECHEVFLR

SEQ ID NO: 15079 - protein, 27 aa, artificial
  peptide fold or domain or sub-domain
PLKEVLKFKWYDKKTEPEERDFAVSIV

SEQ ID NO: 15080 - protein, 25 aa, artificial
  peptide fold or domain or sub-domain
PLKFRDIEINRSSRTVIVRGQPVDL

SEQ ID NO: 15081 - protein, 24 aa, artificial
  peptide fold or domain or sub-domain
PLLCDVGERWESGTLTVAQEHLVS

SEQ ID NO: 15082 - protein, 21 aa, artificial
  peptide fold or domain or sub-domain
PLLDLELMTAGRELQAGKAFT

SEQ ID NO: 15083 - protein, 25 aa, artificial
  peptide fold or domain or sub-domain
PLLIRSGITGLEVTYAADEKALFHE

SEQ ID NO: 15084 - protein, 30 aa, artificial
  peptide fold or domain or sub-domain
PLLVYNRKEEGVTDFIEYAEKNGVTEDMYE

SEQ ID NO: 15085 - protein, 23 aa, artificial
  peptide fold or domain or sub-domain
PLMQHEVFTTLASKYNKTSAQVL

SEQ ID NO: 15086 - protein, 27 aa, artificial
  peptide fold or domain or sub-domain
PLNFSTDETGGVADPRGLYCDTLTAQL

SEQ ID NO: 15087 - protein, 27 aa, artificial
  peptide fold or domain or sub-domain
PLNRNNPYHPLNIEVYKSIPKENIPDT

SEQ ID NO: 15088 - protein, 26 aa, artificial
  peptide fold or domain or sub-domain
PLNSLKFIQIEKNLNLQESFEYISNY

SEQ ID NO: 15089 - protein, 30 aa, artificial
  peptide fold or domain or sub-domain
PLPASLADADLVPSTVALGRNAAGALYALP

SEQ ID NO: 15090 - protein, 22 aa, artificial
  peptide fold or domain or sub-domain
PLPAVILDRVRQGEALGPVMSQ

SEQ ID NO: 15091 - protein, 28 aa, artificial
  peptide fold or domain or sub-domain
PLPEGLFWLLVTGHIPTEEQVSWLSKEW

SEQ ID NO: 15092 - protein, 22 aa, artificial
  peptide fold or domain or sub-domain
PLPHTTRPIRAGELAKPEYHFV

SEQ ID NO: 15093 - protein, 22 aa, artificial
  peptide fold or domain or sub-domain
PLPRQVYQALEAGEELGHVMDR

SEQ ID NO: 15094 - protein, 22 aa, artificial
  peptide fold or domain or sub-domain
PLPTDIAALLYDGLELSKALKQ

SEQ ID NO: 15095 - protein, 23 aa, artificial
  peptide fold or domain or sub-domain
PLPVVHHARGVFIYDDSGKSYID

SEQ ID NO: 15096 - protein, 26 aa, artificial
  peptide fold or domain or sub-domain
PLPWASIDGHKNHKLIGDAKVEIRTE

SEQ ID NO: 15097 - protein, 27 aa, artificial
  peptide fold or domain or sub-domain
PLPWLRYSDRTAVPSFVAPVHQVGGGL

SEQ ID NO: 15098 - protein, 24 aa, artificial
  peptide fold or domain or sub-domain
PLQETSLYTQDRLGLKEMDNAGQL

SEQ ID NO: 15099 - protein, 30 aa, artificial
  peptide fold or domain or sub-domain
PLQLAVGDFDSLSREEYHFVQETTETLIQA

SEQ ID NO: 15100 - protein, 24 aa, artificial
  peptide fold or domain or sub-domain
PLQQQTQYSEDWLGLRTLDESNRL

SEQ ID NO: 15101 - protein, 30 aa, artificial
  peptide fold or domain or sub-domain
PLQTCPHCGREIKDYGGYKNKMNPKGVTLS

SEQ ID NO: 15102 - protein, 20 aa, artificial
  peptide fold or domain or sub-domain
PLQVLIDKQGDSALLRFEEE

SEQ ID NO: 15103 - protein, 20 aa, artificial
  peptide fold or domain or sub-domain
PLRDIVNHDGLEKFLEIQQS

SEQ ID NO: 15104 - protein, 29 aa, artificial
  peptide fold or domain or sub-domain
PLREPVIQHGPFVMNTNEEISQAILDFRN

SEQ ID NO: 15105 - protein, 24 aa, artificial
  peptide fold or domain or sub-domain
PLRQSSIYLDDRIGLRQLDRRGSL

SEQ ID NO: 15106 - protein, 29 aa, artificial
  peptide fold or domain or sub-domain
PLRYADLQVVELKGAGTEITIKPNMVATR

SEQ ID NO: 15107 - protein, 21 aa, artificial
  peptide fold or domain or sub-domain
PLSEIAAEEGLLDADQLRDVL

SEQ ID NO: 15108 - protein, 24 aa, artificial
  peptide fold or domain or sub-domain
PLSHLFDNNDAWVKRKLADDPQYF

SEQ ID NO: 15109 - protein, 27 aa, artificial
  peptide fold or domain or sub-domain
PLSINEGYYICGLWKCKTMFSMDEIIW

SEQ ID NO: 15110 - protein, 27 aa, artificial
  peptide fold or domain or sub-domain
PLSRIRVIMKSSPEVSSINQEALVLTA

SEQ ID NO: 15111 - protein, 27 aa, artificial
  peptide fold or domain or sub-domain
PLSRVRKILKSDPEVKKISCDVPALFS

SEQ ID NO: 15112 - protein, 30 aa, artificial
  peptide fold or domain or sub-domain
PLTLTDAQKKVYFPSPLNTFTFDGKVMGVP

SEQ ID NO: 15113 - protein, 26 aa, artificial
  peptide fold or domain or sub-domain
PLTRAQVFSADHIGLMQKRRLMKFVK

SEQ ID NO: 15114 - protein, 21 aa, artificial
  peptide fold or domain or sub-domain
PLTVMENSRLAGIYGTTEVEE

SEQ ID NO: 15115 - protein, 24 aa, artificial
  peptide fold or domain or sub-domain
PLVESEFYIQDYIGVKQLDQQRKI

SEQ ID NO: 15116 - protein, 22 aa, artificial
  peptide fold or domain or sub-domain
PLVIVVLNNGGWEAIKDLQISL

SEQ ID NO: 15117 - protein, 24 aa, artificial
  peptide fold or domain or sub-domain
PLWAVNGGKATWFGIEVPFDLNAL

SEQ ID NO: 15118 - protein, 23 aa, artificial
  peptide fold or domain or sub-domain
PLYADFRAAGPLALPEANLVVFS

SEQ ID NO: 15119 - protein, 23 aa, artificial
  peptide fold or domain or sub-domain
PLYARLRGAQPVHRTLGMWVLTR

SEQ ID NO: 15120 - protein, 23 aa, artificial
  peptide fold or domain or sub-domain
PLYEELRETRVAPQDNGSFLVGR

SEQ ID NO: 15121 - protein, 23 aa, artificial
  peptide fold or domain or sub-domain
PLYKRNQTVAKVKVKKGKQKFIE

SEQ ID NO: 15122 - protein, 25 aa, artificial
  peptide fold or domain or sub-domain
PMACSNCHEAQGDESMPGLRDSVHR

SEQ ID NO: 15123 - protein, 28 aa, artificial
  peptide fold or domain or sub-domain
PMAEAMLWYLLTKEIPGVENLKLFSREL

SEQ ID NO: 15124 - protein, 25 aa, artificial
  peptide fold or domain or sub-domain
PMAPLDALLEPGIAATLRGTTDSER

SEQ ID NO: 15125 - protein, 30 aa, artificial
  peptide fold or domain or sub-domain
PMDKYVTSKTDLDKTAVQAMTYKGKLFGIP

SEQ ID NO: 15126 - protein, 22 aa, artificial
  peptide fold or domain or sub-domain
PMFEKTDEGRWTFTHNPFSMPA

SEQ ID NO: 15127 - protein, 23 aa, artificial
  peptide fold or domain or sub-domain
PMHNRKDMMVNGGVLMAHLNAKS

SEQ ID NO: 15128 - protein, 29 aa, artificial
  peptide fold or domain or sub-domain
PMIFYMCGPEGFMDAAESALQQFGVPLKS

SEQ ID NO: 15129 - protein, 24 aa, artificial
  peptide fold or domain or sub-domain
PMLVTWGKLWMQGKLSLAHGYISG

SEQ ID NO: 15130 - protein, 24 aa, artificial
  peptide fold or domain or sub-domain
PMNETDLYKEDRIGLKKLHESGRI

SEQ ID NO: 15131 - protein, 27 aa, artificial
  peptide fold or domain or sub-domain
PMPLASPMHARFDTKYDGVEPTSLPSV

SEQ ID NO: 15132 - protein, 30 aa, artificial
  peptide fold or domain or sub-domain
PMSSCGVCRFCRANNNGHCLGDSEGPGGWR

SEQ ID NO: 15133 - protein, 22 aa, artificial
  peptide fold or domain or sub-domain
PMVIIILNNQKLGFIKLEQEAA

SEQ ID NO: 15134 - protein, 23 aa, artificial
  peptide fold or domain or sub-domain
PMYKALRESNPVFRSPQAVVLSR

SEQ ID NO: 15135 - protein, 24 aa, artificial
  peptide fold or domain or sub-domain
PNALAPGGRAPSVLNGGISLFNEE

SEQ ID NO: 15136 - protein, 26 aa, artificial
  peptide fold or domain or sub-domain
PNCSCATDGSCSCAGSCKCKQCKCTS

SEQ ID NO: 15137 - protein, 28 aa, artificial
  peptide fold or domain or sub-domain
PNCYNYSTHITKWFAEDPSRTYNDLAQY

SEQ ID NO: 15138 - protein, 29 aa, artificial
  peptide fold or domain or sub-domain
PNDAGQYNDTPERTQFFRDNGTYLSEKGR

SEQ ID NO: 15139 - protein, 22 aa, artificial
  peptide fold or domain or sub-domain
PNEAQTLYLNTVNPNVYKDKIF

SEQ ID NO: 15140 - protein, 25 aa, artificial
  peptide fold or domain or sub-domain
PNFDPSKLDSTTVELCDSEKDMILK

SEQ ID NO: 15141 - protein, 21 aa, artificial
  peptide fold or domain or sub-domain
PNFFSNDEEFAKGMDYYQSLF

SEQ ID NO: 15142 - protein, 22 aa, artificial
  peptide fold or domain or sub-domain
PNFLDEALGGGASGDVKGAWDA

SEQ ID NO: 15143 - protein, 25 aa, artificial
  peptide fold or domain or sub-domain
PNFRLAERKIPMLPSADREKLQEIM

SEQ ID NO: 15144 - protein, 20 aa, artificial
  peptide fold or domain or sub-domain
PNGDVAKVIDYYFNTFDNLK

SEQ ID NO: 15145 - protein, 20 aa, artificial
  peptide fold or domain or sub-domain
PNGEFATAINNSFGSFEEFK

SEQ ID NO: 15146 - protein, 28 aa, artificial
  peptide fold or domain or sub-domain
PNIEVLEQRLRNRATDNEEAIKLRMQLA

SEQ ID NO: 15147 - protein, 28 aa, artificial
  peptide fold or domain or sub-domain
PNIIEASAISGVKIEKESDVVIVCKKLR

SEQ ID NO: 15148 - protein, 28 aa, artificial
  peptide fold or domain or sub-domain
PNIKETEALSGMKNIRTREEMVTAGNKI

SEQ ID NO: 15149 - protein, 28 aa, artificial
  peptide fold or domain or sub-domain
PNILEAAMLTGVKSINNVSEMKVAAEKL

SEQ ID NO: 15150 - protein, 28 aa, artificial
  peptide fold or domain or sub-domain
PNIPELAVLCDSAPAITMDEAIAQAQGF

SEQ ID NO: 15151 - protein, 28 aa, artificial
  peptide fold or domain or sub-domain
PNIPKLLGIEDERLTVGPDGIHPATVGN

SEQ ID NO: 15152 - protein, 22 aa, artificial
  peptide fold or domain or sub-domain
PNKEFSSKKHKEDPDSFTDGNH

SEQ ID NO: 15153 - protein, 27 aa, artificial
  peptide fold or domain or sub-domain
PNKFLIDGKTDVDDPRKMIAHSLEVHG

SEQ ID NO: 15154 - protein, 28 aa, artificial
  peptide fold or domain or sub-domain
PNLDEADALLGQPSGYAADSPVEAVKAL

SEQ ID NO: 15155 - protein, 28 aa, artificial
  peptide fold or domain or sub-domain
PNLDEAQRLTGLEGGVGVADLESLAYRL

SEQ ID NO: 15156 - protein, 28 aa, artificial
  peptide fold or domain or sub-domain
PNLEELAFRLVSRGQDSQDSIEARLAAC

SEQ ID NO: 15157 - protein, 28 aa, artificial
  peptide fold or domain or sub-domain
PNLFEAAQLSGLPRIETVEDMKEAAGRI

SEQ ID NO: 15158 - protein, 28 aa, artificial
  peptide fold or domain or sub-domain
PNLFELSVLSGSQICNYDDIITACKKLI

SEQ ID NO: 15159 - protein, 28 aa, artificial
  peptide fold or domain or sub-domain
PNLKESSLILNCSIAKNESQLKEQGKAI

SEQ ID NO: 15160 - protein, 28 aa, artificial
  peptide fold or domain or sub-domain
PNLKETELFWNLDQEPTLEILRERGVEF

SEQ ID NO: 15161 - protein, 28 aa, artificial
  peptide fold or domain or sub-domain
PNLMEAKSLAKLDGLPDKNSAEKLANKI

SEQ ID NO: 15162 - protein, 28 aa, artificial
  peptide fold or domain or sub-domain
PNLPEAAALLDAPHARTEQEMLAQGRAL

SEQ ID NO: 15163 - protein, 28 aa, artificial
  peptide fold or domain or sub-domain
PNLPEAAKILGIESIDSRTEMEQAVKEL

SEQ ID NO: 15164 - protein, 28 aa, artificial
  peptide fold or domain or sub-domain
PNLPEAEVLVGYDLSDEVSIIKAGYDIQ

SEQ ID NO: 15165 - protein, 28 aa, artificial
  peptide fold or domain or sub-domain
PNLPEGAALTGKPVPHSESEMNDMIDDL

SEQ ID NO: 15166 - protein, 28 aa, artificial
  peptide fold or domain or sub-domain
PNLPEINHLLGTHFHGIAQEMDAIKEAF

SEQ ID NO: 15167 - protein, 28 aa, artificial
  peptide fold or domain or sub-domain
PNLSDIFNQDIGHEVTAIDDVPNLSAIE

SEQ ID NO: 15168 - protein, 28 aa, artificial
  peptide fold or domain or sub-domain
PNLVELAAFTGSSPAADEEGACRQAEEL

SEQ ID NO: 15169 - protein, 27 aa, artificial
  peptide fold or domain or sub-domain
PNNDGIIDFVKNRMHNAELALRIASTA

SEQ ID NO: 15170 - protein, 22 aa, artificial
  peptide fold or domain or sub-domain
PNNFQIHYRIWNNQKRGYYSVP

SEQ ID NO: 15171 - protein, 28 aa, artificial
  peptide fold or domain or sub-domain
PNNVTLSQRLINRNTDKAQDLVNRLKMA

SEQ ID NO: 15172 - protein, 26 aa, artificial
  peptide fold or domain or sub-domain
PNNWGWIDKKDIPGTIGQAIENTCSY

SEQ ID NO: 15173 - protein, 26 aa, artificial
  peptide fold or domain or sub-domain
PNNWGWISMTDQPSTYEAGEQKCRDY

SEQ ID NO: 15174 - protein, 28 aa, artificial
  peptide fold or domain or sub-domain
PNQFEIGLITGRQLSTWNELETAALQIQ

SEQ ID NO: 15175 - protein, 28 aa, artificial
  peptide fold or domain or sub-domain
PNREELALLSQTPLASCHKQAIQQAKKL

SEQ ID NO: 15176 - protein, 25 aa, artificial
  peptide fold or domain or sub-domain
PNRFDLLNGEWVSLRNGTKLTDILT

SEQ ID NO: 15177 - protein, 30 aa, artificial
  peptide fold or domain or sub-domain
PNRVYGLIDSETKAGLYRSDDLGVNWSFVS

SEQ ID NO: 15178 - protein, 29 aa, artificial
  peptide fold or domain or sub-domain
PNSMDWEIVKELSLLDIDYEALYRQFYTL

SEQ ID NO: 15179 - protein, 24 aa, artificial
  peptide fold or domain or sub-domain
PNSRLIDALLSPGKEITRNGKSYK

SEQ ID NO: 15180 - protein, 28 aa, artificial
  peptide fold or domain or sub-domain
PNTEELSQLVGREVRTTVEAELAARELV

SEQ ID NO: 15181 - protein, 28 aa, artificial
  peptide fold or domain or sub-domain
PNVKEASALLDGFRIETVAEMRSAAKSL

SEQ ID NO: 15182 - protein, 28 aa, artificial
  peptide fold or domain or sub-domain
PNVLELGRLTHSDVSTKAQFAAAALALS

SEQ ID NO: 15183 - protein, 28 aa, artificial
  peptide fold or domain or sub-domain
PNVPEACRLLAAQPPASPDGLVSLAQAL

SEQ ID NO: 15184 - protein, 28 aa, artificial
  peptide fold or domain or sub-domain
PNVPELSHLLERSLGTSLEMAEAAEELA

SEQ ID NO: 15185 - protein, 22 aa, artificial
  peptide fold or domain or sub-domain
PNVTWSRKNNILPNGEEKLHSH

SEQ ID NO: 15186 - protein, 20 aa, artificial
  peptide fold or domain or sub-domain
PNYNDGNLNSATMDLTALYG

SEQ ID NO: 15187 - protein, 28 aa, artificial
  peptide fold or domain or sub-domain
PPAHEFLCQTTSMDFLAKYQFDFNTCIH

SEQ ID NO: 15188 - protein, 20 aa, artificial
  peptide fold or domain or sub-domain
PPAKVADALSAAFGSVDACV

SEQ ID NO: 15189 - protein, 28 aa, artificial
  peptide fold or domain or sub-domain
PPDSLDRDDSIRSDTTADVRTFNREDAM

SEQ ID NO: 15190 - protein, 27 aa, artificial
  peptide fold or domain or sub-domain
PPDVLPKLAQSPLWNRLAFARPGQSVD

SEQ ID NO: 15191 - protein, 30 aa, artificial
  peptide fold or domain or sub-domain
PPEEAALRLQGARVPDKFEAQPLEFFRRVA

SEQ ID NO: 15192 - protein, 26 aa, artificial
  peptide fold or domain or sub-domain
PPEKLDPNNPLHQFYHTEPDIMQLSN

SEQ ID NO: 15193 - protein, 20 aa, artificial
  peptide fold or domain or sub-domain
PPEKLREMIEHSFGSVEGFN

SEQ ID NO: 15194 - protein, 27 aa, artificial
  peptide fold or domain or sub-domain
PPEQWLAAHQAMIYFGRAICHPKNPEC

SEQ ID NO: 15195 - protein, 22 aa, artificial
  peptide fold or domain or sub-domain
PPEVGANGGVLHCMCHGSAYDP

SEQ ID NO: 15196 - protein, 30 aa, artificial
  peptide fold or domain or sub-domain
PPEVSSDILRKWGEEFWDPGVRFGTVCAKK

SEQ ID NO: 15197 - protein, 29 aa, artificial
  peptide fold or domain or sub-domain
PPFEPQAKTVKNIETRLEIRPIDLRRDAL

SEQ ID NO: 15198 - protein, 20 aa, artificial
  peptide fold or domain or sub-domain
PPGSVYNLPPDSTIELSIPG

SEQ ID NO: 15199 - protein, 27 aa, artificial
  peptide fold or domain or sub-domain
PPHAARLRAASPLWQRLPSVRAGRAHG

SEQ ID NO: 15200 - protein, 29 aa, artificial
  peptide fold or domain or sub-domain
PPIDVTGKTPASFEDYINYRYLALRLPRV

SEQ ID NO: 15201 - protein, 30 aa, artificial
  peptide fold or domain or sub-domain
PPIISLKRLLVREVAREDKAMFLINASTSM

SEQ ID NO: 15202 - protein, 23 aa, artificial
  peptide fold or domain or sub-domain
PPIVIKKGEGVWLYDEQNQRYLD

SEQ ID NO: 15203 - protein, 30 aa, artificial
  peptide fold or domain or sub-domain
PPKDFFVIASSQHCPIAAIECPKKKLFGLQ

SEQ ID NO: 15204 - protein, 27 aa, artificial
  peptide fold or domain or sub-domain
PPKPAPKPAPKQTPTPVPETEPAKTVA

SEQ ID NO: 15205 - protein, 24 aa, artificial
  peptide fold or domain or sub-domain
PPKPLLDGYREFRRDAYKTQRAHY

SEQ ID NO: 15206 - protein, 21 aa, artificial
  peptide fold or domain or sub-domain
PPKTAVLLHAVNNRLLPEGKL

SEQ ID NO: 15207 - protein, 23 aa, artificial
  peptide fold or domain or sub-domain
PPLTSKELALTGKDIMAALGIGP

SEQ ID NO: 15208 - protein, 22 aa, artificial
  peptide fold or domain or sub-domain
PPMLNITFRNDSTILVNMFAQF

SEQ ID NO: 15209 - protein, 22 aa, artificial
  peptide fold or domain or sub-domain
PPNLQDIDACRDYPKEQWGLFC

SEQ ID NO: 15210 - protein, 27 aa, artificial
  peptide fold or domain or sub-domain
PPNSWIDLHHRLIFFGRRICKAQKPSC

SEQ ID NO: 15211 - protein, 27 aa, artificial
  peptide fold or domain or sub-domain
PPPGTYCDSTTKQQKCIACIQPNCSQC

SEQ ID NO: 15212 - protein, 27 aa, artificial
  peptide fold or domain or sub-domain
PPPLGTEECGRMEELPEAALAPRFLQQ

SEQ ID NO: 15213 - protein, 29 aa, artificial
  peptide fold or domain or sub-domain
PPSAEYPDLRKHNNCMASHLTPAVYARLC

SEQ ID NO: 15214 - protein, 28 aa, artificial
  peptide fold or domain or sub-domain
PPSKQHGLKDIETRYRLRHLDLLTNELS

SEQ ID NO: 15215 - protein, 25 aa, artificial
  peptide fold or domain or sub-domain
PPSSLKNIFAALMESYPNMTPPTHG

SEQ ID NO: 15216 - protein, 22 aa, artificial
  peptide fold or domain or sub-domain
PPSTYTGYTPPPVNQQEGLSTY

SEQ ID NO: 15217 - protein, 27 aa, artificial
  peptide fold or domain or sub-domain
PPTLMQTLGASPLWRQLPFVKAGQVTV

SEQ ID NO: 15218 - protein, 29 aa, artificial
  peptide fold or domain or sub-domain
PPVREMIDSGVPTALATDYCPNAYCMSLP

SEQ ID NO: 15219 - protein, 20 aa, artificial
  peptide fold or domain or sub-domain
PPVVFKSRTQVVHESFQGRS

SEQ ID NO: 15220 - protein, 20 aa, artificial
  peptide fold or domain or sub-domain
PPVVLKTKTNTAHDNYMGRT

SEQ ID NO: 15221 - protein, 27 aa, artificial
  peptide fold or domain or sub-domain
PPVVRFNHADGIAPYNGVVAVTANSRT

SEQ ID NO: 15222 - protein, 21 aa, artificial
  peptide fold or domain or sub-domain
PPYVEKHSRDPWGGCSNQRDR

SEQ ID NO: 15223 - protein, 23 aa, artificial
  peptide fold or domain or sub-domain
PQAAGKEEERKGEEVVSGRVEAL

SEQ ID NO: 15224 - protein, 21 aa, artificial
  peptide fold or domain or sub-domain
PQDAKIFKNVGNFLVPQSRDV

SEQ ID NO: 15225 - protein, 27 aa, artificial
  peptide fold or domain or sub-domain
PQDQASVKVPDWLNDPRFYHNQGDSTF

SEQ ID NO: 15226 - protein, 26 aa, artificial
  peptide fold or domain or sub-domain
PQDTVKDVAESLGLENINDDVLKALA

SEQ ID NO: 15227 - protein, 27 aa, artificial
  peptide fold or domain or sub-domain
PQEFIVDDQDGVLDPIGMAGTIMRGSA

SEQ ID NO: 15228 - protein, 27 aa, artificial
  peptide fold or domain or sub-domain
PQEFKIDGQSEIKEPIGMYGGRLESSF

SEQ ID NO: 15229 - protein, 27 aa, artificial
  peptide fold or domain or sub-domain
PQEFMIDEQNGVHDPAGMMARSLEVRV

SEQ ID NO: 15230 - protein, 27 aa, artificial
  peptide fold or domain or sub-domain
PQELWTKFSLLLLNHGKTICKARNPEC

SEQ ID NO: 15231 - protein, 27 aa, artificial
  peptide fold or domain or sub-domain
PQEQWTFFGPATVLHGRYTCTAKKPKC

SEQ ID NO: 15232 - protein, 23 aa, artificial
  peptide fold or domain or sub-domain
PQETKLYTEDWIGLRTLDEAGKV

SEQ ID NO: 15233 - protein, 27 aa, artificial
  peptide fold or domain or sub-domain
PQEYAIDYQEGIKNPVGLSGVRMQAKV

SEQ ID NO: 15234 - protein, 20 aa, artificial
  peptide fold or domain or sub-domain
PQFLKKGMSVSDLVDVFSHS

SEQ ID NO: 15235 - protein, 30 aa, artificial
  peptide fold or domain or sub-domain
PQHLFTTCRNREQAKELEDLAKNHSNIHIL

SEQ ID NO: 15236 - protein, 29 aa, artificial
  peptide fold or domain or sub-domain
PQILFGSLKRKDYQGMLGYLTENLPQVEL

SEQ ID NO: 15237 - protein, 20 aa, artificial
  peptide fold or domain or sub-domain
PQKGVLEQIDKDFGSFTNFR

SEQ ID NO: 15238 - protein, 30 aa, artificial
  peptide fold or domain or sub-domain
PQKIIATVRNPAAAEELQKLAKAHPDVHIV

SEQ ID NO: 15239 - protein, 27 aa, artificial
  peptide fold or domain or sub-domain
PQKKWTQSCLVMGTHGRLTCIARKPLC

SEQ ID NO: 15240 - protein, 27 aa, artificial
  peptide fold or domain or sub-domain
PQKYWKHINLLLVKLGQNICRPISPKC

SEQ ID NO: 15241 - protein, 23 aa, artificial
  peptide fold or domain or sub-domain
PQLFENFGKIFPANETSVSAGQG

SEQ ID NO: 15242 - protein, 25 aa, artificial
  peptide fold or domain or sub-domain
PQLLRLLSTLAEEPREQQELEALSQ

SEQ ID NO: 15243 - protein, 27 aa, artificial
  peptide fold or domain or sub-domain
PQMFQFPDELDQARRSIRIYDLIKDWQ

SEQ ID NO: 15244 - protein, 27 aa, artificial
  peptide fold or domain or sub-domain
PQMIQSANTMQNHSVKPVITAEPMAKV

SEQ ID NO: 15245 - protein, 26 aa, artificial
  peptide fold or domain or sub-domain
PQNIAVLVKQREHCTWSRAIERVEQM

SEQ ID NO: 15246 - protein, 26 aa, artificial
  peptide fold or domain or sub-domain
PQNVFVRLMELGNLNYKQMYEIFNMG

SEQ ID NO: 15247 - protein, 27 aa, artificial
  peptide fold or domain or sub-domain
PQPDWENWSIRLIYHGRAVCQARQPQC

SEQ ID NO: 15248 - protein, 22 aa, artificial
  peptide fold or domain or sub-domain
PQPGQREECVRKGRDPLTECAN

SEQ ID NO: 15249 - protein, 27 aa, artificial
  peptide fold or domain or sub-domain
PQPLEKEGGWIINGVKRKVSHKFGYGL

SEQ ID NO: 15250 - protein, 20 aa, artificial
  peptide fold or domain or sub-domain
PQQYIHSFKDGQFITSPVSH

SEQ ID NO: 15251 - protein, 25 aa, artificial
  peptide fold or domain or sub-domain
PQRFNYVNGKWVNSKQEEIEKQLLN

SEQ ID NO: 15252 - protein, 22 aa, artificial
  peptide fold or domain or sub-domain
PQRIDELIEAGALPAKSREVFV

SEQ ID NO: 15253 - protein, 29 aa, artificial
  peptide fold or domain or sub-domain
PQRLGVNFMSKLAVDADIRGRLGLGRATV

SEQ ID NO: 15254 - protein, 28 aa, artificial
  peptide fold or domain or sub-domain
PQSFTAFEPLKRLAARSPLPPNPVEPPS

SEQ ID NO: 15255 - protein, 29 aa, artificial
  peptide fold or domain or sub-domain
PQTFKPLTILFYNRGRPEIRQLNNMIIET

SEQ ID NO: 15256 - protein, 26 aa, artificial
  peptide fold or domain or sub-domain
PQTIHLPSGEILDVFDAAERYQQAGL

SEQ ID NO: 15257 - protein, 22 aa, artificial
  peptide fold or domain or sub-domain
PQVYYQKQITQSGRDFIMHCFE

SEQ ID NO: 15258 - protein, 30 aa, artificial
  peptide fold or domain or sub-domain
PQYQELKSEEIPKPSKDGVTVAVISGEALG

SEQ ID NO: 15259 - protein, 29 aa, artificial
  peptide fold or domain or sub-domain
PQYRSRVVREPRQLLKEEFGFEVPPSKEI

SEQ ID NO: 15260 - protein, 27 aa, artificial
  peptide fold or domain or sub-domain
PREFKRNCHRWLVKHGRYTCKSKNPDC

SEQ ID NO: 15261 - protein, 20 aa, artificial
  peptide fold or domain or sub-domain
PREGNGWSYHHARRRWDLAD

SEQ ID NO: 15262 - protein, 27 aa, artificial
  peptide fold or domain or sub-domain
PREHWILYNIQIITHGRGLCTARSPQC

SEQ ID NO: 15263 - protein, 27 aa, artificial
  peptide fold or domain or sub-domain
PREYWIELNDLMVQFGQDICRPLGPRH

SEQ ID NO: 15264 - protein, 22 aa, artificial
  peptide fold or domain or sub-domain
PRFILYKDSKVVQSLSAQGEYK

SEQ ID NO: 15265 - protein, 20 aa, artificial
  peptide fold or domain or sub-domain
PRFNKEGKPYYGSPEELYGT

SEQ ID NO: 15266 - protein, 27 aa, artificial
  peptide fold or domain or sub-domain
PRFYTVDGFAGVVDPVGMTGSRLEAET

SEQ ID NO: 15267 - protein, 27 aa, artificial
  peptide fold or domain or sub-domain
PRGYVLDGTEGVKNPLGLAARKVTLRA

SEQ ID NO: 15268 - protein, 22 aa, artificial
  peptide fold or domain or sub-domain
PRHRHRKEFLRKGRYYSVHFIP

SEQ ID NO: 15269 - protein, 22 aa, artificial
  peptide fold or domain or sub-domain
PRISYDEAVELLRSDETAEMID

SEQ ID NO: 15270 - protein, 27 aa, artificial
  peptide fold or domain or sub-domain
PRKYILDDHTEVKNPLGLVGSKLSVEM

SEQ ID NO: 15271 - protein, 20 aa, artificial
  peptide fold or domain or sub-domain
PRKYTQPMLAKEYNISEITV

SEQ ID NO: 15272 - protein, 27 aa, artificial
  peptide fold or domain or sub-domain
PRPASTQDMKRMEDLTEEELDSEFLQQ

SEQ ID NO: 15273 - protein, 27 aa, artificial
  peptide fold or domain or sub-domain
PRQEPMFRWMRFSDLSTWEGDRNLAPS

SEQ ID NO: 15274 - protein, 26 aa, artificial
  peptide fold or domain or sub-domain
PRRDGTPGAVLCPIPFLRPRDIITSQ

SEQ ID NO: 15275 - protein, 27 aa, artificial
  peptide fold or domain or sub-domain
PRREVCELNPDCDELADHIGFQEAYRR

SEQ ID NO: 15276 - protein, 27 aa, artificial
  peptide fold or domain or sub-domain
PRSFTLDAQTGLRSPQGMSGNHLIAHV

SEQ ID NO: 15277 - protein, 27 aa, artificial
  peptide fold or domain or sub-domain
PRSYQLDGSVPLRDPTGLCGRTLAAEV

SEQ ID NO: 15278 - protein, 29 aa, artificial
  peptide fold or domain or sub-domain
PRTDGTTIVYHTHGALWRMTGLDAEPERL

SEQ ID NO: 15279 - protein, 24 aa, artificial
  peptide fold or domain or sub-domain
PRTRDEVRAVFGRDKFSHTPEELD

SEQ ID NO: 15280 - protein, 24 aa, artificial
  peptide fold or domain or sub-domain
PRTRTELRSVFANERYAMSGDELD

SEQ ID NO: 15281 - protein, 28 aa, artificial
  peptide fold or domain or sub-domain
PSAEEIHLEVIQSFPGVSLDTVYRNLNM

SEQ ID NO: 15282 - protein, 28 aa, artificial
  peptide fold or domain or sub-domain
PSARREVFPGAPYYRTDTALQAGVGPGS

SEQ ID NO: 15283 - protein, 21 aa, artificial
  peptide fold or domain or sub-domain
PSAVGLDEEGGLLVGYAARNQ

SEQ ID NO: 15284 - protein, 29 aa, artificial
  peptide fold or domain or sub-domain
PSAVGLDEEGGLLVGYAARNQLALHPERT

SEQ ID NO: 15285 - protein, 20 aa, artificial
  peptide fold or domain or sub-domain
PSDDLKKAIESQWKSLEEFK

SEQ ID NO: 15286 - protein, 24 aa, artificial
  peptide fold or domain or sub-domain
PSDEELRAWTRETLGRHKAPQYFF

SEQ ID NO: 15287 - protein, 29 aa, artificial
  peptide fold or domain or sub-domain
PSDNLVVPYRLRTELDNKQFSQLNIIDLL

SEQ ID NO: 15288 - protein, 30 aa, artificial
  peptide fold or domain or sub-domain
PSEHAEEITRGYGTAAVGASSVGGEVYGYP

SEQ ID NO: 15289 - protein, 27 aa, artificial
  peptide fold or domain or sub-domain
PSERWALGHQLLVWHGRRTCFARSPAC

SEQ ID NO: 15290 - protein, 26 aa, artificial
  peptide fold or domain or sub-domain
PSESIQEVAQSLPLDPLGPGAATLLA

SEQ ID NO: 15291 - protein, 26 aa, artificial
  peptide fold or domain or sub-domain
PSESMKVVAESMGIAQIQEETCQLLT

SEQ ID NO: 15292 - protein, 28 aa, artificial
  peptide fold or domain or sub-domain
PSFDPNEALYGTSENFWGDLEENELNPV

SEQ ID NO: 15293 - protein, 21 aa, artificial
  peptide fold or domain or sub-domain
PSFFCSHFQVIQNPVAYFRLF

SEQ ID NO: 15294 - protein, 21 aa, artificial
  peptide fold or domain or sub-domain
PSFFWRDDLYARGIAFYLRNF

SEQ ID NO: 15295 - protein, 28 aa, artificial
  peptide fold or domain or sub-domain
PSFNPNLFVTGISHVDYSALRDNLDQPL

SEQ ID NO: 15296 - protein, 28 aa, artificial
  peptide fold or domain or sub-domain
PSFPLNEDSSVNAILTNGHLGLRTKKRQ

SEQ ID NO: 15297 - protein, 26 aa, artificial
  peptide fold or domain or sub-domain
PSFQEIENWKKSPGLLAASKYGCALF

SEQ ID NO: 15298 - protein, 30 aa, artificial
  peptide fold or domain or sub-domain
PSGTKEIVPGPLLDRCFARHRKDYAALSAT

SEQ ID NO: 15299 - protein, 25 aa, artificial
  peptide fold or domain or sub-domain
PSHIVVKEGSNIRKISKIRQFDSLF

SEQ ID NO: 15300 - protein, 25 aa, artificial
  peptide fold or domain or sub-domain
PSHSIIKQASNIRNGDKIDQYNRMF

SEQ ID NO: 15301 - protein, 26 aa, artificial
  peptide fold or domain or sub-domain
PSIDDVQSWGKSLEILLSHTYGRALF

SEQ ID NO: 15302 - protein, 28 aa, artificial
  peptide fold or domain or sub-domain
PSIEALRERLIKRRQDDTAIIEQRLALA

SEQ ID NO: 15303 - protein, 29 aa, artificial
  peptide fold or domain or sub-domain
PSIEISKDVDADLSTRLDERHLDVRKPST

SEQ ID NO: 15304 - protein, 27 aa, artificial
  peptide fold or domain or sub-domain
PSIPGPTMTTACINPSKGRFVHPTQHH

SEQ ID NO: 15305 - protein, 27 aa, artificial
  peptide fold or domain or sub-domain
PSIPLEEGELELPDIWGAGEEQNECGS

SEQ ID NO: 15306 - protein, 28 aa, artificial
  peptide fold or domain or sub-domain
PSIPQMFGQIGVNVTSGMTGLQPIYVTE

SEQ ID NO: 15307 - protein, 28 aa, artificial
  peptide fold or domain or sub-domain
PSIPRIFGLRDKANMNEVGVIPGETSHR

SEQ ID NO: 15308 - protein, 28 aa, artificial
  peptide fold or domain or sub-domain
PSIPRILGLENSKIHTCAEGWLPVYADG

SEQ ID NO: 15309 - protein, 28 aa, artificial
  peptide fold or domain or sub-domain
PSISILRERLIGRKTETSDVVEKRIKNA

SEQ ID NO: 15310 - protein, 22 aa, artificial
  peptide fold or domain or sub-domain
PSISWKRDDGSMISINKTYSVM

SEQ ID NO: 15311 - protein, 28 aa, artificial
  peptide fold or domain or sub-domain
PSITDIYKRIKNRGTENAQTIKNRVNKA

SEQ ID NO: 15312 - protein, 20 aa, artificial
  peptide fold or domain or sub-domain
PSKALESGLKQNFYSKEDFK

SEQ ID NO: 15313 - protein, 20 aa, artificial
  peptide fold or domain or sub-domain
PSKATDITKESGIPHTRVYD

SEQ ID NO: 15314 - protein, 28 aa, artificial
  peptide fold or domain or sub-domain
PSKEELERRLNTRGQDSDAVIAKRMGEA

SEQ ID NO: 15315 - protein, 28 aa, artificial
  peptide fold or domain or sub-domain
PSKEILFERLSNRDMKDKLIVEERMKEF

SEQ ID NO: 15316 - protein, 28 aa, artificial
  peptide fold or domain or sub-domain
PSLDDVFQTEVTNQLAPVLDDAKLFAAE

SEQ ID NO: 15317 - protein, 28 aa, artificial
  peptide fold or domain or sub-domain
PSLDKLRQKKLRNGEPFKEEELKDIIAT

SEQ ID NO: 15318 - protein, 24 aa, artificial
  peptide fold or domain or sub-domain
PSLDSPQAWLLAIGLECYQDNFSK

SEQ ID NO: 15319 - protein, 26 aa, artificial
  peptide fold or domain or sub-domain
PSLEEALSWSRSFELMLRSLEGREVF

SEQ ID NO: 15320 - protein, 26 aa, artificial
  peptide fold or domain or sub-domain
PSLEEVLQWRQSLDKLLQNSYGFASF

SEQ ID NO: 15321 - protein, 30 aa, artificial
  peptide fold or domain or sub-domain
PSLEKYIEMNEQLLEKGAITIEQLTEVYES

SEQ ID NO: 15322 - protein, 28 aa, artificial
  peptide fold or domain or sub-domain
PSLPHMLGCIKETVHESNSGWTPVYVTD

SEQ ID NO: 15323 - protein, 28 aa, artificial
  peptide fold or domain or sub-domain
PSLPRLTGVRGEDAHQSAGGIEPVLVDE

SEQ ID NO: 15324 - protein, 28 aa, artificial
  peptide fold or domain or sub-domain
PSLPTLIGKEKQQLYAPEDKPKEILPIE

SEQ ID NO: 15325 - protein, 25 aa, artificial
  peptide fold or domain or sub-domain
PSLSTLETREAARGDRPAGSAARDF

SEQ ID NO: 15326 - protein, 28 aa, artificial
  peptide fold or domain or sub-domain
PSMEALRQRIAARGTESPEAVARRLAEA

SEQ ID NO: 15327 - protein, 28 aa, artificial
  peptide fold or domain or sub-domain
PSMPAMLGVNSVRPELENEQFVPINAHG

SEQ ID NO: 15328 - protein, 28 aa, artificial
  peptide fold or domain or sub-domain
PSMSSMRHSRRNAKIITDYFVDMKFKDE

SEQ ID NO: 15329 - protein, 23 aa, artificial
  peptide fold or domain or sub-domain
PSNFSQTCYNSAIQGSVLTSTCE

SEQ ID NO: 15330 - protein, 20 aa, artificial
  peptide fold or domain or sub-domain
PSPALVKQITQDFGSLDAFK

SEQ ID NO: 15331 - protein, 27 aa, artificial
  peptide fold or domain or sub-domain
PSPASPEKMKQLESLQEKDLVPDFLEV

SEQ ID NO: 15332 - protein, 28 aa, artificial
  peptide fold or domain or sub-domain
PSPEEKLHLITRNLQEVLGEEKLKEILK

SEQ ID NO: 15333 - protein, 24 aa, artificial
  peptide fold or domain or sub-domain
PSPFEQFLSGDAQALRPEQRRGFA

SEQ ID NO: 15334 - protein, 27 aa, artificial
  peptide fold or domain or sub-domain
PSPQVGEATRFLLEAVLDDPALNESER

SEQ ID NO: 15335 - protein, 28 aa, artificial
  peptide fold or domain or sub-domain
PSQEELERRLNARDSEKDFQKKERLEHS

SEQ ID NO: 15336 - protein, 28 aa, artificial
  peptide fold or domain or sub-domain
PSQERLRALLAKEGKNPKPEELREIIEK

SEQ ID NO: 15337 - protein, 26 aa, artificial
  peptide fold or domain or sub-domain
PSQQRVKRWGFSLEEALKDPMGRDQF

SEQ ID NO: 15338 - protein, 26 aa, artificial
  peptide fold or domain or sub-domain
PSRTETGGYRFSPFDYEQGMGGHIEV

SEQ ID NO: 15339 - protein, 20 aa, artificial
  peptide fold or domain or sub-domain
PSSASKVRAAISAAAHWEAD

SEQ ID NO: 15340 - protein, 24 aa, artificial
  peptide fold or domain or sub-domain
PSSEAVVQWLSDFQLQVYAPNFLG

SEQ ID NO: 15341 - protein, 26 aa, artificial
  peptide fold or domain or sub-domain
PSSREDVFADDVISVKSKRTLMRFLR

SEQ ID NO: 15342 - protein, 29 aa, artificial
  peptide fold or domain or sub-domain
PSTDGRRIVYHAGADLYLFDPATNTSRRI

SEQ ID NO: 15343 - protein, 28 aa, artificial
  peptide fold or domain or sub-domain
PSTDVLLSRLLTRNTENQEQIQKRMEQL

SEQ ID NO: 15344 - protein, 26 aa, artificial
  peptide fold or domain or sub-domain
PSTETEALASNLMGMFEKRRFRKFLV

SEQ ID NO: 15345 - protein, 26 aa, artificial
  peptide fold or domain or sub-domain
PSTFYELYALSMRNLGTPVFSKPYIT

SEQ ID NO: 15346 - protein, 26 aa, artificial
  peptide fold or domain or sub-domain
PSTKGSIFKDSTFSLKEKRLIMKFME

SEQ ID NO: 15347 - protein, 23 aa, artificial
  peptide fold or domain or sub-domain
PSTKIAKLKGMAVCSATVRNAMA

SEQ ID NO: 15348 - protein, 28 aa, artificial
  peptide fold or domain or sub-domain
PSVEDLKKRLEGRGTETEESINKRLSAA

SEQ ID NO: 15349 - protein, 24 aa, artificial
  peptide fold or domain or sub-domain
PSVENKIRTILKESYPEVDEKEFF

SEQ ID NO: 15350 - protein, 28 aa, artificial
  peptide fold or domain or sub-domain
PSVETIYQELATQLPNLSLATVYNTLKL

SEQ ID NO: 15351 - protein, 29 aa, artificial
  peptide fold or domain or sub-domain
PSVHGNTIVFENGGYIYKMDAAARKAEKV

SEQ ID NO: 15352 - protein, 28 aa, artificial
  peptide fold or domain or sub-domain
PSVPKICGLEGCDVYRGEKGWIPVSSQA

SEQ ID NO: 15353 - protein, 28 aa, artificial
  peptide fold or domain or sub-domain
PSYDPNAFVNGISQTDYDKYANNTSLPF

SEQ ID NO: 15354 - protein, 28 aa, artificial
  peptide fold or domain or sub-domain
PSYDPNEFVVGITSTRYEELQEDERNPL

SEQ ID NO: 15355 - protein, 28 aa, artificial
  peptide fold or domain or sub-domain
PSYDPNGFIFGWSDKEWKKLNKDKNNPF

SEQ ID NO: 15356 - protein, 28 aa, artificial
  peptide fold or domain or sub-domain
PSYDVYPFMYGMSNEEYNKLTEDKKEPL

SEQ ID NO: 15357 - protein, 22 aa, artificial
  peptide fold or domain or sub-domain
PSYFVPYRNLPPSSKLSQIFAY

SEQ ID NO: 15358 - protein, 28 aa, artificial
  peptide fold or domain or sub-domain
PSYFVPYRNLPPSSKLSQIFAYLDHPLP

SEQ ID NO: 15359 - protein, 28 aa, artificial
  peptide fold or domain or sub-domain
PTADDIYKALEGKFPNMSVATVYNNLRV

SEQ ID NO: 15360 - protein, 26 aa, artificial
  peptide fold or domain or sub-domain
PTAEEVLSWSQNFDKMMKAPAGRNLF

SEQ ID NO: 15361 - protein, 28 aa, artificial
  peptide fold or domain or sub-domain
PTAESIYHVARRYCPTVGMATVYRSLDL

SEQ ID NO: 15362 - protein, 29 aa, artificial
  peptide fold or domain or sub-domain
PTALVSGDAAKANQVAQQYGIKPQNVYNY

SEQ ID NO: 15363 - protein, 29 aa, artificial
  peptide fold or domain or sub-domain
PTANSKELNEKYKNLSREDTDKQNTEFVF

SEQ ID NO: 15364 - protein, 29 aa, artificial
  peptide fold or domain or sub-domain
PTAYAGKLLISLSEERISAHHVPNMVATE

SEQ ID NO: 15365 - protein, 23 aa, artificial
  peptide fold or domain or sub-domain
PTCGGRLEALGIENTEENRRRYR

SEQ ID NO: 15366 - protein, 26 aa, artificial
  peptide fold or domain or sub-domain
PTDDGGIHDINNTVEMRYCNLLGLSD

SEQ ID NO: 15367 - protein, 30 aa, artificial
  peptide fold or domain or sub-domain
PTDKLEPLFLGYAQRLYQMAEKTAADQAVQ

SEQ ID NO: 15368 - protein, 20 aa, artificial
  peptide fold or domain or sub-domain
PTDTEMMAAVQPDMRAAIVA

SEQ ID NO: 15369 - protein, 30 aa, artificial
  peptide fold or domain or sub-domain
PTEGSWNNPPVREHTFDDIRDAGFKSVRIP

SEQ ID NO: 15370 - protein, 28 aa, artificial
  peptide fold or domain or sub-domain
PTFASELTNQILKESEKPLASHPFALPQ

SEQ ID NO: 15371 - protein, 30 aa, artificial
  peptide fold or domain or sub-domain
PTFCFFRGESKIYQFSGGNKGRLREYIAKY

SEQ ID NO: 15372 - protein, 28 aa, artificial
  peptide fold or domain or sub-domain
PTFDPNIFSKQRLTQKDWESVQGEDHPL

SEQ ID NO: 15373 - protein, 28 aa, artificial
  peptide fold or domain or sub-domain
PTFDPNKFTVRIKTKDWREIADNPDHPL

SEQ ID NO: 15374 - protein, 28 aa, artificial
  peptide fold or domain or sub-domain
PTFDQEKFVRGLRKEEWQALSKNPNHPL

SEQ ID NO: 15375 - protein, 30 aa, artificial
  peptide fold or domain or sub-domain
PTFFFLKNGQQIGKLVGANKPELQKKVTSI

SEQ ID NO: 15376 - protein, 30 aa, artificial
  peptide fold or domain or sub-domain
PTFHLYRNSKQIDSMTGAKIKALTDLIGKH

SEQ ID NO: 15377 - protein, 30 aa, artificial
  peptide fold or domain or sub-domain
PTFIAFVNGQKKATIQGADESGLRSMVAKY

SEQ ID NO: 15378 - protein, 30 aa, artificial
  peptide fold or domain or sub-domain
PTFIFLRGAEQVDRITGAAPQKLRDKVQEL

SEQ ID NO: 15379 - protein, 30 aa, artificial
  peptide fold or domain or sub-domain
PTFIFMKEGEIKETVVGAAKEEIIANLEKH

SEQ ID NO: 15380 - protein, 30 aa, artificial
  peptide fold or domain or sub-domain
PTFIFTKNGDAIEALEGCVEDELRQKVLEH

SEQ ID NO: 15381 - protein, 30 aa, artificial
  peptide fold or domain or sub-domain
PTFIFYRNRTKIDRVQGADVNGLEAKIQEH

SEQ ID NO: 15382 - protein, 30 aa, artificial
  peptide fold or domain or sub-domain
PTFIIYYNGSVVSTIVGANFPKLKHAVTDY

SEQ ID NO: 15383 - protein, 22 aa, artificial
  peptide fold or domain or sub-domain
PTFIWYRNSERLTEGTIGDKLI

SEQ ID NO: 15384 - protein, 30 aa, artificial
  peptide fold or domain or sub-domain
PTFKIFQNGACIETIKGANPPALTAAIKNA

SEQ ID NO: 15385 - protein, 30 aa, artificial
  peptide fold or domain or sub-domain
PTFLFIKNKTKLDEISGANEESIKEMLDKH

SEQ ID NO: 15386 - protein, 30 aa, artificial
  peptide fold or domain or sub-domain
PTFLFLKNKSVVDTLQGADPNRLTALVKQH

SEQ ID NO: 15387 - protein, 30 aa, artificial
  peptide fold or domain or sub-domain
PTFLLLKQGKEVERVVGAKKDELEKKILKH

SEQ ID NO: 15388 - protein, 30 aa, artificial
  peptide fold or domain or sub-domain
PTFMVFQSGVRVEQMKGADAKALETMVKKY

SEQ ID NO: 15389 - protein, 30 aa, artificial
  peptide fold or domain or sub-domain
PTFQFFKKGQKVGEFSGANKEKLEATINEL

SEQ ID NO: 15390 - protein, 30 aa, artificial
  peptide fold or domain or sub-domain
PTFQVYKDGQKIDELVGANPTALESLVQKS

SEQ ID NO: 15391 - protein, 30 aa, artificial
  peptide fold or domain or sub-domain
PTFRDYMKDFTAEEIPPSFSEEYLESMYQS

SEQ ID NO: 15392 - protein, 30 aa, artificial
  peptide fold or domain or sub-domain
PTFVAYKDGKVIETVTGAVPAKINALLDKV

SEQ ID NO: 15393 - protein, 30 aa, artificial
  peptide fold or domain or sub-domain
PTFVFIKTGTVVDCFVGCNSEKLAKTMEKY

SEQ ID NO: 15394 - protein, 30 aa, artificial
  peptide fold or domain or sub-domain
PTFVFTKDDDILHKIRGANPKGLAKAIEEF

SEQ ID NO: 15395 - protein, 30 aa, artificial
  peptide fold or domain or sub-domain
PTFVLFKNGKGLGKVVGADPRGVEEAIKHF

SEQ ID NO: 15396 - protein, 20 aa, artificial
  peptide fold or domain or sub-domain
PTGDLAASLNETFGDYDGFI

SEQ ID NO: 15397 - protein, 20 aa, artificial
  peptide fold or domain or sub-domain
PTGLVKEQIDRCFSSFSKYK

SEQ ID NO: 15398 - protein, 20 aa, artificial
  peptide fold or domain or sub-domain
PTGPIRKKIEEKFGSFSAFK

SEQ ID NO: 15399 - protein, 20 aa, artificial
  peptide fold or domain or sub-domain
PTGSELITAGIRPERGQTIE

SEQ ID NO: 15400 - protein, 27 aa, artificial
  peptide fold or domain or sub-domain
PTGYSLDGERGIRDPLSMYGDLLGVDM

SEQ ID NO: 15401 - protein, 28 aa, artificial
  peptide fold or domain or sub-domain
PTHALALTAALTSQQDRPAPTHLFPGPA

SEQ ID NO: 15402 - protein, 29 aa, artificial
  peptide fold or domain or sub-domain
PTHHAADLQTEYADADKDALETKALHVAL

SEQ ID NO: 15403 - protein, 28 aa, artificial
  peptide fold or domain or sub-domain
PTIAEIQQSLREIYPAVSTATIYNTIRY

SEQ ID NO: 15404 - protein, 30 aa, artificial
  peptide fold or domain or sub-domain
PTILFFKNGQAVDKVVGADVQSIRTKIAQH

SEQ ID NO: 15405 - protein, 29 aa, artificial
  peptide fold or domain or sub-domain
PTIVAGILSDKDAYSFFSVLRQLSGKIIF

SEQ ID NO: 15406 - protein, 26 aa, artificial
  peptide fold or domain or sub-domain
PTKMRVERWAFNFSELIRDPKGRQSF

SEQ ID NO: 15407 - protein, 29 aa, artificial
  peptide fold or domain or sub-domain
PTKMSPLSMLYYENGEMLLRHHEDMIVDE

SEQ ID NO: 15408 - protein, 26 aa, artificial
  peptide fold or domain or sub-domain
PTLDEIRLWHQSFDTLMSSGKGRRKF

SEQ ID NO: 15409 - protein, 30 aa, artificial
  peptide fold or domain or sub-domain
PTLHFFKGGSKKGEVVGADVTKLKNLMEQL

SEQ ID NO: 15410 - protein, 30 aa, artificial
  peptide fold or domain or sub-domain
PTLILFKNGEEVNRVIGANPAAIKQALASL

SEQ ID NO: 15411 - protein, 23 aa, artificial
  peptide fold or domain or sub-domain
PTLMPGLYQAAGSADKAHRETAI

SEQ ID NO: 15412 - protein, 28 aa, artificial
  peptide fold or domain or sub-domain
PTLNELESRIKGRATESDDKIKARLDKA

SEQ ID NO: 15413 - protein, 26 aa, artificial
  peptide fold or domain or sub-domain
PTLRQFCADMDLQFSMSAGDCLLLIR

SEQ ID NO: 15414 - protein, 20 aa, artificial
  peptide fold or domain or sub-domain
PTLTTETTSITEAQLIDGYT

SEQ ID NO: 15415 - protein, 28 aa, artificial
  peptide fold or domain or sub-domain
PTMRELQQRLNRRAEDTAEVIETRLQNA

SEQ ID NO: 15416 - protein, 28 aa, artificial
  peptide fold or domain or sub-domain
PTMTSSQGSEVHQSALGWEPISVLPNMA

SEQ ID NO: 15417 - protein, 28 aa, artificial
  peptide fold or domain or sub-domain
PTMVELEKRLRSRGTDREDIIQHRLLSA

SEQ ID NO: 15418 - protein, 30 aa, artificial
  peptide fold or domain or sub-domain
PTMVLFRKGQELDRIVGADVKTLSSLLAKY

SEQ ID NO: 15419 - protein, 25 aa, artificial
  peptide fold or domain or sub-domain
PTNCADCHSDGKNGASPDRKTAVHT

SEQ ID NO: 15420 - protein, 26 aa, artificial
  peptide fold or domain or sub-domain
PTNEAQSMTTGLIGIWQKPKVMRFFW

SEQ ID NO: 15421 - protein, 30 aa, artificial
  peptide fold or domain or sub-domain
PTNKCLENIKRRGNTDEIATVDERYLKTIE

SEQ ID NO: 15422 - protein, 21 aa, artificial
  peptide fold or domain or sub-domain
PTQLENKNTNDRLLKHDLLFH

SEQ ID NO: 15423 - protein, 28 aa, artificial
  peptide fold or domain or sub-domain
PTQQELRERLVLRGTDDKETIDLRVMHA

SEQ ID NO: 15424 - protein, 21 aa, artificial
  peptide fold or domain or sub-domain
PTTDASQYWLKEMTAEMALAN

SEQ ID NO: 15425 - protein, 20 aa, artificial
  peptide fold or domain or sub-domain
PTTDPRHPGHGDVAYIARRK

SEQ ID NO: 15426 - protein, 25 aa, artificial
  peptide fold or domain or sub-domain
PTTDPRHPGHGDVAYIARRKFLNDQ

SEQ ID NO: 15427 - protein, 22 aa, artificial
  peptide fold or domain or sub-domain
PTTEALALCSVRTRDQELKCQN

SEQ ID NO: 15428 - protein, 26 aa, artificial
  peptide fold or domain or sub-domain
PTTGLILLTARSDIESKVDALRGGAD

SEQ ID NO: 15429 - protein, 30 aa, artificial
  peptide fold or domain or sub-domain
PTTLMFKNGKKLSQVIGADIAKIINELNNH

SEQ ID NO: 15430 - protein, 28 aa, artificial
  peptide fold or domain or sub-domain
PTVDEVYDGVRKKLTRISKATVYKNLKF

SEQ ID NO: 15431 - protein, 28 aa, artificial
  peptide fold or domain or sub-domain
PTVEEIYERVRVNFPTTSLATVYKTVSV

SEQ ID NO: 15432 - protein, 28 aa, artificial
  peptide fold or domain or sub-domain
PTVESFWYFLLTGEVPTQAQVDEVVAEW

SEQ ID NO: 15433 - protein, 29 aa, artificial
  peptide fold or domain or sub-domain
PTVIAVHYLDQTEQWEKFGLEKRQEALEL

SEQ ID NO: 15434 - protein, 28 aa, artificial
  peptide fold or domain or sub-domain
PTYDPSIFTRPLSATIYNGLLNDPYRPL

SEQ ID NO: 15435 - protein, 25 aa, artificial
  peptide fold or domain or sub-domain
PVACPSIEAQLSEHVIWRLVSGSLN

SEQ ID NO: 15436 - protein, 21 aa, artificial
  peptide fold or domain or sub-domain
PVADAIDARWGKNKRPIPNLL

SEQ ID NO: 15437 - protein, 27 aa, artificial
  peptide fold or domain or sub-domain
PVARVRRIIKLDKDVKQASAEAIKCVT

SEQ ID NO: 15438 - protein, 29 aa, artificial
  peptide fold or domain or sub-domain
PVAYDPLEVLDWNDEGSFLSIKPDMIARE

SEQ ID NO: 15439 - protein, 20 aa, artificial
  peptide fold or domain or sub-domain
PVCKEIVKSIQDQHQKQNKW

SEQ ID NO: 15440 - protein, 27 aa, artificial
  peptide fold or domain or sub-domain
PVDIDDAQVINDQWEWSEPDSLSVVRR

SEQ ID NO: 15441 - protein, 30 aa, artificial
  peptide fold or domain or sub-domain
PVDIGLSRVEKRAQSDRLDDEPVVFHQMVR

SEQ ID NO: 15442 - protein, 27 aa, artificial
  peptide fold or domain or sub-domain
PVEAREGLRNSAIWRALPAVRQGRVVT

SEQ ID NO: 15443 - protein, 30 aa, artificial
  peptide fold or domain or sub-domain
PVEDGRRRITSSRGEETNDFEKAEMLEKVS

SEQ ID NO: 15444 - protein, 20 aa, artificial
  peptide fold or domain or sub-domain
PVEELYTGKTYLDFEANSIN

SEQ ID NO: 15445 - protein, 28 aa, artificial
  peptide fold or domain or sub-domain
PVEELYTGKTYLDFEANSINEKEYEVQP

SEQ ID NO: 15446 - protein, 27 aa, artificial
  peptide fold or domain or sub-domain
PVEESSEHYPANNPVFDVVPREFLPNG

SEQ ID NO: 15447 - protein, 30 aa, artificial
  peptide fold or domain or sub-domain
PVEPSDDTLNALDDAFWGAVQYNGQYFGYP

SEQ ID NO: 15448 - protein, 20 aa, artificial
  peptide fold or domain or sub-domain
PVETPLVERMHETSSRKLWT

SEQ ID NO: 15449 - protein, 30 aa, artificial
  peptide fold or domain or sub-domain
PVEVVLDRVHQRGGMNRLDSQTVEFYEKAR

SEQ ID NO: 15450 - protein, 29 aa, artificial
  peptide fold or domain or sub-domain
PVEYDDLCVIELESETTNISYKTNVVATK

SEQ ID NO: 15451 - protein, 28 aa, artificial
  peptide fold or domain or sub-domain
PVFDPNAFSVRVSRQEWNRLLSDESKPL

SEQ ID NO: 15452 - protein, 29 aa, artificial
  peptide fold or domain or sub-domain
PVFDYQLYFQEPGVAEAELEQNLDRTFKN

SEQ ID NO: 15453 - protein, 30 aa, artificial
  peptide fold or domain or sub-domain
PVFPEHLAAVLAKLREMGSVVNLVGPGTLE

SEQ ID NO: 15454 - protein, 30 aa, artificial
  peptide fold or domain or sub-domain
PVFSLDTRGGRVAFKGWLAEEEIDPVSLLK

SEQ ID NO: 15455 - protein, 27 aa, artificial
  peptide fold or domain or sub-domain
PVGPALRNMLEDPHSEGMDQDYFSQLT

SEQ ID NO: 15456 - protein, 20 aa, artificial
  peptide fold or domain or sub-domain
PVGSELLHPETMTGDGSLDY

SEQ ID NO: 15457 - protein, 27 aa, artificial
  peptide fold or domain or sub-domain
PVGVEERLETSALWQHLPSVRRDDVLT

SEQ ID NO: 15458 - protein, 28 aa, artificial
  peptide fold or domain or sub-domain
PVHGLEETARIATSLGLPGPTETFAKTS

SEQ ID NO: 15459 - protein, 21 aa, artificial
  peptide fold or domain or sub-domain
PVHTASGTRLAELIGESADVP

SEQ ID NO: 15460 - protein, 22 aa, artificial
  peptide fold or domain or sub-domain
PVIACVFRNMAWCAEKKNQIDF

SEQ ID NO: 15461 - protein, 21 aa, artificial
  peptide fold or domain or sub-domain
PVILKKNTIAFKLYGQDRIIE

SEQ ID NO: 15462 - protein, 30 aa, artificial
  peptide fold or domain or sub-domain
PVIPEHIGAVIKKLKQCGCSIEKAGKGLKI

SEQ ID NO: 15463 - protein, 22 aa, artificial
  peptide fold or domain or sub-domain
PVISLIVNNTSLGMIRQLQKVM

SEQ ID NO: 15464 - protein, 30 aa, artificial
  peptide fold or domain or sub-domain
PVIVGRERLQSTRVADRFEMESNLFFERVR

SEQ ID NO: 15465 - protein, 28 aa, artificial
  peptide fold or domain or sub-domain
PVIVRTIDESELDVLRQAGADEVVAEVM

SEQ ID NO: 15466 - protein, 22 aa, artificial
  peptide fold or domain or sub-domain
PVIWIVMNNSSYGTIAGLEKAH

SEQ ID NO: 15467 - protein, 29 aa, artificial
  peptide fold or domain or sub-domain
PVKFSSMSLIYYGDDGIIKRDLPKMVVDE

SEQ ID NO: 15468 - protein, 22 aa, artificial
  peptide fold or domain or sub-domain
PVKIIVMDNKALGMVRQWQQLF

SEQ ID NO: 15469 - protein, 22 aa, artificial
  peptide fold or domain or sub-domain
PVKIVVIKNNVLGQIKWEQMVL

SEQ ID NO: 15470 - protein, 30 aa, artificial
  peptide fold or domain or sub-domain
PVKIWPLPVRELFGVGSRLEKRLRDLNIHT

SEQ ID NO: 15471 - protein, 22 aa, artificial
  peptide fold or domain or sub-domain
PVLAFADAVKMLNESGWRDDEG

SEQ ID NO: 15472 - protein, 27 aa, artificial
  peptide fold or domain or sub-domain
PVLAIKESLSLQQEASRIYAQEKFPAD

SEQ ID NO: 15473 - protein, 23 aa, artificial
  peptide fold or domain or sub-domain
PVLDEPEIVEIGKKFDKSSAQVV

SEQ ID NO: 15474 - protein, 30 aa, artificial
  peptide fold or domain or sub-domain
PVLEGMARANKRSAADRFEQQATEFFTRVH

SEQ ID NO: 15475 - protein, 28 aa, artificial
  peptide fold or domain or sub-domain
PVLESGKLRLDPSSCEAVYARNLLPLTP

SEQ ID NO: 15476 - protein, 21 aa, artificial
  peptide fold or domain or sub-domain
PVLEVACEESNLNPVELARLL

SEQ ID NO: 15477 - protein, 28 aa, artificial
  peptide fold or domain or sub-domain
PVLLHPADDMLWRDIHPDKEFRAVEDGL

SEQ ID NO: 15478 - protein, 24 aa, artificial
  peptide fold or domain or sub-domain
PVLREIGDRWGRDEISLAQGFVAG

SEQ ID NO: 15479 - protein, 28 aa, artificial
  peptide fold or domain or sub-domain
PVLTFASLVIDPETRAVIREQRLINLTA

SEQ ID NO: 15480 - protein, 22 aa, artificial
  peptide fold or domain or sub-domain
PVLVVNLNNRYLGMVKQWQDMI

SEQ ID NO: 15481 - protein, 27 aa, artificial
  peptide fold or domain or sub-domain
PVLYHLDGLNNITELKGLYGSKLKANV

SEQ ID NO: 15482 - protein, 27 aa, artificial
  peptide fold or domain or sub-domain
PVNFALDNRSGLEDPRGQMGQALSVDM

SEQ ID NO: 15483 - protein, 20 aa, artificial
  peptide fold or domain or sub-domain
PVNSEMFTAGKSEETIRRMA

SEQ ID NO: 15484 - protein, 20 aa, artificial
  peptide fold or domain or sub-domain
PVNSNMLREQLSKADFDEYL

SEQ ID NO: 15485 - protein, 29 aa, artificial
  peptide fold or domain or sub-domain
PVPAWASAQGWGDEQMAAQLLEHCGVAIT

SEQ ID NO: 15486 - protein, 20 aa, artificial
  peptide fold or domain or sub-domain
PVPLFPGFDTLGTLEYITKS

SEQ ID NO: 15487 - protein, 30 aa, artificial
  peptide fold or domain or sub-domain
PVPMTEDEKKTYYPNIVDTVTFEDTQWGVP

SEQ ID NO: 15488 - protein, 23 aa, artificial
  peptide fold or domain or sub-domain
PVPRLRDLPITGEDVMRITGLKP

SEQ ID NO: 15489 - protein, 30 aa, artificial
  peptide fold or domain or sub-domain
PVPSGVLNTGLYAPNTIDAIKVNGTMYSVP

SEQ ID NO: 15490 - protein, 22 aa, artificial
  peptide fold or domain or sub-domain
PVPVTTRPRRDREVAGVDRVFL

SEQ ID NO: 15491 - protein, 24 aa, artificial
  peptide fold or domain or sub-domain
PVQHEIGRLWQTNQISVAHEHYAT

SEQ ID NO: 15492 - protein, 30 aa, artificial
  peptide fold or domain or sub-domain
PVQLPQEVADGFEQVALDAVTFEGQLYGVP

SEQ ID NO: 15493 - protein, 21 aa, artificial
  peptide fold or domain or sub-domain
PVRELILEKKLMDEKTLEAVL

SEQ ID NO: 15494 - protein, 23 aa, artificial
  peptide fold or domain or sub-domain
PVRRMTFSRMYGDRRLITKETLA

SEQ ID NO: 15495 - protein, 21 aa, artificial
  peptide fold or domain or sub-domain
PVRVDQASRISTVVGPGPVVT

SEQ ID NO: 15496 - protein, 29 aa, artificial
  peptide fold or domain or sub-domain
PVRYSDQLIISVSSQGLEVRKFPNMVAEE

SEQ ID NO: 15497 - protein, 20 aa, artificial
  peptide fold or domain or sub-domain
PVSASEIRQRVRQGKPIAHL

SEQ ID NO: 15498 - protein, 20 aa, artificial
  peptide fold or domain or sub-domain
PVSATKIRRLAAAGQPIGQF

SEQ ID NO: 15499 - protein, 30 aa, artificial
  peptide fold or domain or sub-domain
PVSPSASFAEGVLDTTLDAVTFDGKTWGYP

SEQ ID NO: 15500 - protein, 27 aa, artificial
  peptide fold or domain or sub-domain
PVSYAIDGTEGVLDPRGMFGQSLGVSI

SEQ ID NO: 15501 - protein, 25 aa, artificial
  peptide fold or domain or sub-domain
PVTCPDVSSISVEHGRWRLIFETQY

SEQ ID NO: 15502 - protein, 22 aa, artificial
  peptide fold or domain or sub-domain
PVTEPNPNWPPLPPPVIPIIYP

SEQ ID NO: 15503 - protein, 20 aa, artificial
  peptide fold or domain or sub-domain
PVTNYIESWYRYPLNDLLQF

SEQ ID NO: 15504 - protein, 30 aa, artificial
  peptide fold or domain or sub-domain
PVTPSQKMRDSVAPFTWRALTVGDDIYGFP

SEQ ID NO: 15505 - protein, 29 aa, artificial
  peptide fold or domain or sub-domain
PVTRSNITIMYMLGKNVKVSEIKDFLPSS

SEQ ID NO: 15506 - protein, 29 aa, artificial
  peptide fold or domain or sub-domain
PVTYEALEVVKLNEHGTYLSLEEDVVARE

SEQ ID NO: 15507 - protein, 20 aa, artificial
  peptide fold or domain or sub-domain
PVVARSRPSSAVHESFAGRA

SEQ ID NO: 15508 - protein, 22 aa, artificial
  peptide fold or domain or sub-domain
PVVFLVQNNQGYMSIRGGQRKF

SEQ ID NO: 15509 - protein, 28 aa, artificial
  peptide fold or domain or sub-domain
PVYMSKDEFDFLTDPDKNGSSKFTQYGL

SEQ ID NO: 15510 - protein, 26 aa, artificial
  peptide fold or domain or sub-domain
PWDQPSDSCQEYSDWKEKKTYLNPWK

SEQ ID NO: 15511 - protein, 23 aa, artificial
  peptide fold or domain or sub-domain
PWGCGRCGPCRQGAENHCERVFE

SEQ ID NO: 15512 - protein, 30 aa, artificial
  peptide fold or domain or sub-domain
PWGCGRCGPCRQGAENHCERVFELRSHGGG

SEQ ID NO: 15513 - protein, 27 aa, artificial
  peptide fold or domain or sub-domain
PWGKALGVASSGGVFTVEYLFYVLYSV

SEQ ID NO: 15514 - protein, 30 aa, artificial
  peptide fold or domain or sub-domain
PWIGCGKCATCLGGDENMCLTPRSLGVYCD

SEQ ID NO: 15515 - protein, 23 aa, artificial
  peptide fold or domain or sub-domain
PWNRESLLSHSDSSHDVKHGLFE

SEQ ID NO: 15516 - protein, 24 aa, artificial
  peptide fold or domain or sub-domain
PWSDGSPEWDYVEPEIKEELYRKK

SEQ ID NO: 15517 - protein, 24 aa, artificial
  peptide fold or domain or sub-domain
PWSDNSVCWSLVPKETKQKLWVKR

SEQ ID NO: 15518 - protein, 24 aa, artificial
  peptide fold or domain or sub-domain
PWSDSSPEWRSVSLEEQKRLGHTA

SEQ ID NO: 15519 - protein, 30 aa, artificial
  peptide fold or domain or sub-domain
PWSGPILLPSTCDDSLTDTFKAAGIKDVQQ

SEQ ID NO: 15520 - protein, 24 aa, artificial
  peptide fold or domain or sub-domain
PWSIDSPEWSEVSPNSLERLHSEL

SEQ ID NO: 15521 - protein, 25 aa, artificial
  peptide fold or domain or sub-domain
PWSQALIATRPVMGLCVENHGPDYK

SEQ ID NO: 15522 - protein, 29 aa, artificial
  peptide fold or domain or sub-domain
PWTLTSMEPTGTGYRCVLSGPAGQQTVDA

SEQ ID NO: 15523 - protein, 24 aa, artificial
  peptide fold or domain or sub-domain
PYADWFWIKKFPVYPSGDKNEWDF

SEQ ID NO: 15524 - protein, 24 aa, artificial
  peptide fold or domain or sub-domain
PYASILAKAERFFGVVNYNWYDSY

SEQ ID NO: 15525 - protein, 28 aa, artificial
  peptide fold or domain or sub-domain
PYDLPALWEDNGQFGLLRVTPFGNSLTL

SEQ ID NO: 15526 - protein, 26 aa, artificial
  peptide fold or domain or sub-domain
PYECDECSKMYYWKSDLTSHQKTHRQ

SEQ ID NO: 15527 - protein, 30 aa, artificial
  peptide fold or domain or sub-domain
PYEKYTGIENIGKKNGIIGEITFNKIRRFD

SEQ ID NO: 15528 - protein, 28 aa, artificial
  peptide fold or domain or sub-domain
PYFDQNIFTQHNAHELYAQLSHDTRFPL

SEQ ID NO: 15529 - protein, 26 aa, artificial
  peptide fold or domain or sub-domain
PYFPNAEYLLQRAEFDALDALNPQLR

SEQ ID NO: 15530 - protein, 26 aa, artificial
  peptide fold or domain or sub-domain
PYGCSVCPRAFNQRVVLREHIRSHHS

SEQ ID NO: 15531 - protein, 20 aa, artificial
  peptide fold or domain or sub-domain
PYGRAAMEFLKNTGLYKKVL

SEQ ID NO: 15532 - protein, 26 aa, artificial
  peptide fold or domain or sub-domain
PYHCPACGRSFNQRSILNRHQKTQHR

SEQ ID NO: 15533 - protein, 24 aa, artificial
  peptide fold or domain or sub-domain
PYIDAERTRAEGRKIPTEDAVARP

SEQ ID NO: 15534 - protein, 24 aa, artificial
  peptide fold or domain or sub-domain
PYIDSTLTTAQGRRLGKSNCVPYP

SEQ ID NO: 15535 - protein, 29 aa, artificial
  peptide fold or domain or sub-domain
PYIMLEQNTNSKIADVIKQETNTKTLTLH

SEQ ID NO: 15536 - protein, 30 aa, artificial
  peptide fold or domain or sub-domain
PYINCQKCYSCERGLTNCCESHQTLGVMCD

SEQ ID NO: 15537 - protein, 26 aa, artificial
  peptide fold or domain or sub-domain
PYKCAYCVMGFTQKSNMKLHMKRAHS

SEQ ID NO: 15538 - protein, 26 aa, artificial
  peptide fold or domain or sub-domain
PYKCNNCAKKFRHINSLRRHQRQVHD

SEQ ID NO: 15539 - protein, 26 aa, artificial
  peptide fold or domain or sub-domain
PYNCKICSKRFARSDECKRHTRIHNK

SEQ ID NO: 15540 - protein, 26 aa, artificial
  peptide fold or domain or sub-domain
PYNCSHCGKSFSRPDHLNSHVRQVHS

SEQ ID NO: 15541 - protein, 27 aa, artificial
  peptide fold or domain or sub-domain
PYNFKVDDQDYIEDPLGMNASRLEVDT

SEQ ID NO: 15542 - protein, 26 aa, artificial
  peptide fold or domain or sub-domain
PYPCAQCSKTFMQLSYLAIHQRIFQQ

SEQ ID NO: 15543 - protein, 27 aa, artificial
  peptide fold or domain or sub-domain
PYPGRIVDASDSFDGNLDDIDEIFKIQ

SEQ ID NO: 15544 - protein, 25 aa, artificial
  peptide fold or domain or sub-domain
PYPGSVSNGKILLVGNMGLYDYRPY

SEQ ID NO: 15545 - protein, 30 aa, artificial
  peptide fold or domain or sub-domain
PYPPGYRRRGSRETKGKGYPLDDVWNANPF

SEQ ID NO: 15546 - protein, 26 aa, artificial
  peptide fold or domain or sub-domain
PYQCEECGKVFRTCSSLSNHKRTHSE

SEQ ID NO: 15547 - protein, 26 aa, artificial
  peptide fold or domain or sub-domain
PYQCEYCLQYFSRTDRVLKHKRMCHE

SEQ ID NO: 15548 - protein, 26 aa, artificial
  peptide fold or domain or sub-domain
PYQCNVCGKAFSYRSALLSHQDIHNK

SEQ ID NO: 15549 - protein, 26 aa, artificial
  peptide fold or domain or sub-domain
PYQGTVVPYNGGKISNTFFEGEDDYD

SEQ ID NO: 15550 - protein, 24 aa, artificial
  peptide fold or domain or sub-domain
PYRDYYIWSTEKPEKNSNLWYKKP

SEQ ID NO: 15551 - protein, 26 aa, artificial
  peptide fold or domain or sub-domain
PYSCDVCLKKFTHDFTLRAHKRTHTQ

SEQ ID NO: 15552 - protein, 30 aa, artificial
  peptide fold or domain or sub-domain
PYTNCGECSSCRKGRLNACRYNKTLGVQQQ

SEQ ID NO: 15553 - protein, 21 aa, artificial
  peptide fold or domain or sub-domain
PYVNGLKSSDYNTQLTCTKHF

SEQ ID NO: 15554 - protein, 26 aa, artificial
  peptide fold or domain or sub-domain
PYWVGGVVSEKKKLIARTAEEFLNRY

SEQ ID NO: 15555 - protein, 24 aa, artificial
  peptide fold or domain or sub-domain
PYYCSKCQKIVSEKNCAHYKEHRI

SEQ ID NO: 15556 - protein, 30 aa, artificial
  peptide fold or domain or sub-domain
PYYLYGAQQDNSTVGIATMDEQEGVIGRWD

SEQ ID NO: 15557 - protein, 26 aa, artificial
  peptide fold or domain or sub-domain
PYYVSGDVADEKELRSTSFHMLRDEF

SEQ ID NO: 15558 - protein, 26 aa, artificial
  peptide fold or domain or sub-domain
PYYVSGEIAEREQLLVQTPEALKARF

SEQ ID NO: 15559 - protein, 23 aa, artificial
  peptide fold or domain or sub-domain
QAAAQLASQWNWSDQAIRAAYRA

SEQ ID NO: 15560 - protein, 22 aa, artificial
  peptide fold or domain or sub-domain
QAADIRLAGLIEDEKALAKTRA

SEQ ID NO: 15561 - protein, 26 aa, artificial
  peptide fold or domain or sub-domain
QAAFPYTVRIHESVLYLQGDGRLYKG

SEQ ID NO: 15562 - protein, 25 aa, artificial
  peptide fold or domain or sub-domain
QAAGGSWMLPKSKVQAGDWQAVTQL

SEQ ID NO: 15563 - protein, 29 aa, artificial
  peptide fold or domain or sub-domain
QAAMNYPFRDLIINLLNGHRSSQDVAHQL

SEQ ID NO: 15564 - protein, 25 aa, artificial
  peptide fold or domain or sub-domain
QAARDRLASLEPWTHDRLEAELRAL

SEQ ID NO: 15565 - protein, 29 aa, artificial
  peptide fold or domain or sub-domain
QAARFEGQGQVRAVICADGRRVPADVVLV

SEQ ID NO: 15566 - protein, 29 aa, artificial
  peptide fold or domain or sub-domain
QAATGFIIDPKENRRYSVEEALRAGIIGP

SEQ ID NO: 15567 - protein, 29 aa, artificial
  peptide fold or domain or sub-domain
QAATGGIIDPHRNEKLTVDSAIARDLIDF

SEQ ID NO: 15568 - protein, 29 aa, artificial
  peptide fold or domain or sub-domain
QAATGGLVDPTQGQLLPVSEALQQGLVGL

SEQ ID NO: 15569 - protein, 21 aa, artificial
  peptide fold or domain or sub-domain
QACQYRDCDHERTSGCAVLAA

SEQ ID NO: 15570 - protein, 29 aa, artificial
  peptide fold or domain or sub-domain
QACTGGIIHPTTGQKLSLQDAVSQGVIDQ

SEQ ID NO: 15571 - protein, 24 aa, artificial
  peptide fold or domain or sub-domain
QADTKSEKQKNARPETSTHALNLK

SEQ ID NO: 15572 - protein, 30 aa, artificial
  peptide fold or domain or sub-domain
QAEAEAFLAKHYASKLGPKSLARMKKIFAH

SEQ ID NO: 15573 - protein, 24 aa, artificial
  peptide fold or domain or sub-domain
QAEFKNVAMPSFEDFWSEGIVEFP

SEQ ID NO: 15574 - protein, 22 aa, artificial
  peptide fold or domain or sub-domain
QAEHAAKAEPALASLLNAVILS

SEQ ID NO: 15575 - protein, 26 aa, artificial
  peptide fold or domain or sub-domain
QAEKDVKEAADRMGIKYFIGIGEASF

SEQ ID NO: 15576 - protein, 26 aa, artificial
  peptide fold or domain or sub-domain
QAELLHRSRQAEKEGQEPDPRVEQAL

SEQ ID NO: 15577 - protein, 27 aa, artificial
  peptide fold or domain or sub-domain
QAEVTEALIALPGYAEYADSIRALHRS

SEQ ID NO: 15578 - protein, 22 aa, artificial
  peptide fold or domain or sub-domain
QAFDWGSPVQNMMHYHQSMPPY

SEQ ID NO: 15579 - protein, 21 aa, artificial
  peptide fold or domain or sub-domain
QAFESNSVDGTAGGITQVKTC

SEQ ID NO: 15580 - protein, 24 aa, artificial
  peptide fold or domain or sub-domain
QAFLDEIRTVLKRVLPEHMVPTHL

SEQ ID NO: 15581 - protein, 26 aa, artificial
  peptide fold or domain or sub-domain
QAFLEQIQEATDLGDWALLSDYAEER

SEQ ID NO: 15582 - protein, 29 aa, artificial
  peptide fold or domain or sub-domain
QAFTGNFVDLISGQRLTLAEAKKEGLLTN

SEQ ID NO: 15583 - protein, 30 aa, artificial
  peptide fold or domain or sub-domain
QAGVYTSDINKAFKAIRRLDVGGVIINDIP

SEQ ID NO: 15584 - protein, 25 aa, artificial
  peptide fold or domain or sub-domain
QAGYAGENNTRDVWEFLKNAKGSEI

SEQ ID NO: 15585 - protein, 25 aa, artificial
  peptide fold or domain or sub-domain
QAHLAAQFGVDKVSFDDRVKYIEQH

SEQ ID NO: 15586 - protein, 30 aa, artificial
  peptide fold or domain or sub-domain
QAHRGARAFYPDNTLQAFCKAADLGCRVIE

SEQ ID NO: 15587 - protein, 22 aa, artificial
  peptide fold or domain or sub-domain
QAHVRMLAVAGFDEQHAYDLLR

SEQ ID NO: 15588 - protein, 27 aa, artificial
  peptide fold or domain or sub-domain
QAHWIAEVLADTEPRGEAARACLETLT

SEQ ID NO: 15589 - protein, 30 aa, artificial
  peptide fold or domain or sub-domain
QAIKKCVEVLKDQNSSRDEKQFYLKMLVHF

SEQ ID NO: 15590 - protein, 20 aa, artificial
  peptide fold or domain or sub-domain
QAILVNEESGTVQLEAGSSP

SEQ ID NO: 15591 - protein, 22 aa, artificial
  peptide fold or domain or sub-domain
QAINADELDKHKDEEYTENSII

SEQ ID NO: 15592 - protein, 25 aa, artificial
  peptide fold or domain or sub-domain
QAIQTDEFKDLISPNYIDPDNNWIG

SEQ ID NO: 15593 - protein, 30 aa, artificial
  peptide fold or domain or sub-domain
QAIWMMDPKDVREWQHEEFYRYVAQAHDKP

SEQ ID NO: 15594 - protein, 29 aa, artificial
  peptide fold or domain or sub-domain
QAIYHLQESHRVARVKDIADQMNVQPASV

SEQ ID NO: 15595 - protein, 22 aa, artificial
  peptide fold or domain or sub-domain
QAKFAVENYKFENKISSHIKKF

SEQ ID NO: 15596 - protein, 28 aa, artificial
  peptide fold or domain or sub-domain
QAKLINKLIECFETNNIEEFSQQCFEYN

SEQ ID NO: 15597 - protein, 27 aa, artificial
  peptide fold or domain or sub-domain
QAKLLAGGTDVLIQLHHHNDRYRHIVD

SEQ ID NO: 15598 - protein, 21 aa, artificial
  peptide fold or domain or sub-domain
QAKPEAKAAVEKIKAGGFVPE

SEQ ID NO: 15599 - protein, 25 aa, artificial
  peptide fold or domain or sub-domain
QAKQSIHRGLQMSLADGLAFEIEAY

SEQ ID NO: 15600 - protein, 27 aa, artificial
  peptide fold or domain or sub-domain
QALIIASLQMSRVGENQARQSAQLVIA

SEQ ID NO: 15601 - protein, 30 aa, artificial
  peptide fold or domain or sub-domain
QALWTKQAQDISSDEYKDFYNSNFSTFDDP

SEQ ID NO: 15602 - protein, 24 aa, artificial
  peptide fold or domain or sub-domain
QAPIDAYLQGDHTAMNAQQVEGMN

SEQ ID NO: 15603 - protein, 23 aa, artificial
  peptide fold or domain or sub-domain
QAPVLPELDAEFATSMGIADGDV

SEQ ID NO: 15604 - protein, 30 aa, artificial
  peptide fold or domain or sub-domain
QAQGFDIRPSSDFPGTDHGITDGVAVFSQN

SEQ ID NO: 15605 - protein, 22 aa, artificial
  peptide fold or domain or sub-domain
QAQIAALTERTYGTNINPLDTV

SEQ ID NO: 15606 - protein, 29 aa, artificial
  peptide fold or domain or sub-domain
QARFANVQVTDFTQAENQITFTLDLNWQN

SEQ ID NO: 15607 - protein, 24 aa, artificial
  peptide fold or domain or sub-domain
QARFPQFAGKDLDTIKTSGQFATH

SEQ ID NO: 15608 - protein, 29 aa, artificial
  peptide fold or domain or sub-domain
QARGVLDLQKTPTSLEGPGWRAYATSKLA

SEQ ID NO: 15609 - protein, 29 aa, artificial
  peptide fold or domain or sub-domain
QARKLVKKYDLKYQEEIFVQTLSRELAED

SEQ ID NO: 15610 - protein, 24 aa, artificial
  peptide fold or domain or sub-domain
QARLNQTAHSHGDHDLQLIAEEVE

SEQ ID NO: 15611 - protein, 22 aa, artificial
  peptide fold or domain or sub-domain
QARQLTERNPVLGDYATSHLLV

SEQ ID NO: 15612 - protein, 27 aa, artificial
  peptide fold or domain or sub-domain
QARVIAGGTDLFLESTQGLKDLPVLID

SEQ ID NO: 15613 - protein, 20 aa, artificial
  peptide fold or domain or sub-domain
QARVTLQWYPNSGHVITVSG

SEQ ID NO: 15614 - protein, 30 aa, artificial
  peptide fold or domain or sub-domain
QARWIGNMMFHVRTDSNHDVLMDTKEEVGG

SEQ ID NO: 15615 - protein, 21 aa, artificial
  peptide fold or domain or sub-domain
QASALEELDDEYLKERAADVR

SEQ ID NO: 15616 - protein, 30 aa, artificial
  peptide fold or domain or sub-domain
QASDVSINCGKDSKVPSPPPGSRWKEVRHD

SEQ ID NO: 15617 - protein, 23 aa, artificial
  peptide fold or domain or sub-domain
QASFPKFSTKKSNLEQDPEVKHQ

SEQ ID NO: 15618 - protein, 30 aa, artificial
  peptide fold or domain or sub-domain
QASIFTNDFPRAFGIAEQLEVGTVHINNKT

SEQ ID NO: 15619 - protein, 28 aa, artificial
  peptide fold or domain or sub-domain
QASLINTSLDKTKGELSQLTPELKDQVA

SEQ ID NO: 15620 - protein, 24 aa, artificial
  peptide fold or domain or sub-domain
QATLAKILSDQRGIPLSSAEQLVK

SEQ ID NO: 15621 - protein, 24 aa, artificial
  peptide fold or domain or sub-domain
QATLQKIFREIGGKSETEAVAYFK

SEQ ID NO: 15622 - protein, 20 aa, artificial
  peptide fold or domain or sub-domain
QATQNAPFYLLNGGTQQVQM

SEQ ID NO: 15623 - protein, 26 aa, artificial
  peptide fold or domain or sub-domain
QATSARNAGRYLYQVHPNLRGRTNLQ

SEQ ID NO: 15624 - protein, 28 aa, artificial
  peptide fold or domain or sub-domain
QATVCARAQAPPPSWDQMWKCLIRLKPT

SEQ ID NO: 15625 - protein, 28 aa, artificial
  peptide fold or domain or sub-domain
QATWRYWRGRALQANGSRGAANAIFLAL

SEQ ID NO: 15626 - protein, 29 aa, artificial
  peptide fold or domain or sub-domain
QAVAASRKTEALAKACGIHIIDFPTMEKL

SEQ ID NO: 15627 - protein, 22 aa, artificial
  peptide fold or domain or sub-domain
QAVKEVVDIDLDMAYELTINDL

SEQ ID NO: 15628 - protein, 29 aa, artificial
  peptide fold or domain or sub-domain
QAVMNYPLRRLIIHVLNGTLTPAEWWREL

SEQ ID NO: 15629 - protein, 25 aa, artificial
  peptide fold or domain or sub-domain
QAVQTQTLKSNIPSHLRDPKGLWTG

SEQ ID NO: 15630 - protein, 25 aa, artificial
  peptide fold or domain or sub-domain
QAVSSDEINSAVPSHFRSTDNLWFG

SEQ ID NO: 15631 - protein, 27 aa, artificial
  peptide fold or domain or sub-domain
QAVYAEKFVASGYSQEQADSLATVFHA

SEQ ID NO: 15632 - protein, 26 aa, artificial
  peptide fold or domain or sub-domain
QAWNSKSPHDHGKTPEKFPNADLREN

SEQ ID NO: 15633 - protein, 28 aa, artificial
  peptide fold or domain or sub-domain
QAYAEVDTVLPGDALPVYADLARMPVLD

SEQ ID NO: 15634 - protein, 20 aa, artificial
  peptide fold or domain or sub-domain
QCAIIDALNKGKISTQRYEN

SEQ ID NO: 15635 - protein, 20 aa, artificial
  peptide fold or domain or sub-domain
QCALDQFLCWNGRCIGQRKL

SEQ ID NO: 15636 - protein, 20 aa, artificial
  peptide fold or domain or sub-domain
QCDAKMIQCKNGLCKPMFWR

SEQ ID NO: 15637 - protein, 30 aa, artificial
  peptide fold or domain or sub-domain
QCGDVVESCPSNCKACKLVESDPPRYRCLD

SEQ ID NO: 15638 - protein, 26 aa, artificial
  peptide fold or domain or sub-domain
QCGECKFCKNPKTNLCQKIRLTQGKG

SEQ ID NO: 15639 - protein, 29 aa, artificial
  peptide fold or domain or sub-domain
QCGGVAHPAAGDSAALVNAMLHDAGVVLV

SEQ ID NO: 15640 - protein, 26 aa, artificial
  peptide fold or domain or sub-domain
QCGNCFYCNHGQPVLCESGQPSMLQG

SEQ ID NO: 15641 - protein, 20 aa, artificial
  peptide fold or domain or sub-domain
QCKNGTFQCASGHCIASYFR

SEQ ID NO: 15642 - protein, 27 aa, artificial
  peptide fold or domain or sub-domain
QCKQLENLARSGMLSGVDGQYIQLEKE

SEQ ID NO: 15643 - protein, 22 aa, artificial
  peptide fold or domain or sub-domain
QCKSCISGCSQCPDDKTCVKCS

SEQ ID NO: 15644 - protein, 22 aa, artificial
  peptide fold or domain or sub-domain
QCLLTYCLREYAENNGPSRFAS

SEQ ID NO: 15645 - protein, 22 aa, artificial
  peptide fold or domain or sub-domain
QCLQCPYQCQACTSANFCTKCK

SEQ ID NO: 15646 - protein, 26 aa, artificial
  peptide fold or domain or sub-domain
QCLQGVLKEARRGGEDLASAHWLKLY

SEQ ID NO: 15647 - protein, 25 aa, artificial
  peptide fold or domain or sub-domain
QCPVCRNSLTLSGNRLACVEGHSFD

SEQ ID NO: 15648 - protein, 22 aa, artificial
  peptide fold or domain or sub-domain
QCQLCQDPCVNCSNKTSCLTCK

SEQ ID NO: 15649 - protein, 21 aa, artificial
  peptide fold or domain or sub-domain
QCQLVDDSLVRQLYNAPTIVE

SEQ ID NO: 15650 - protein, 20 aa, artificial
  peptide fold or domain or sub-domain
QCQPGEFACKNNRCIQERWK

SEQ ID NO: 15651 - protein, 26 aa, artificial
  peptide fold or domain or sub-domain
QCRECDACLHPKGNFCYKQDVLPCSG

SEQ ID NO: 15652 - protein, 21 aa, artificial
  peptide fold or domain or sub-domain
QCRLETFRVSGPGGQHRNKRD

SEQ ID NO: 15653 - protein, 22 aa, artificial
  peptide fold or domain or sub-domain
QCRQGYYYDPESEMCFPCSNCE

SEQ ID NO: 15654 - protein, 20 aa, artificial
  peptide fold or domain or sub-domain
QCRSDEYNCSSGMCIRSSWV

SEQ ID NO: 15655 - protein, 20 aa, artificial
  peptide fold or domain or sub-domain
QCSERQFRCNDGHCIHVSFV

SEQ ID NO: 15656 - protein, 24 aa, artificial
  peptide fold or domain or sub-domain
QCTGGADCTSCTGACTGCGNCPNA

SEQ ID NO: 15657 - protein, 22 aa, artificial
  peptide fold or domain or sub-domain
QCTHDQLVEFKAAKILPSDVKA

SEQ ID NO: 15658 - protein, 22 aa, artificial
  peptide fold or domain or sub-domain
QCTPVQLEILRRAGAMPISSRR

SEQ ID NO: 15659 - protein, 20 aa, artificial
  peptide fold or domain or sub-domain
QCYLDPDSQQATTYLSLKTK

SEQ ID NO: 15660 - protein, 23 aa, artificial
  peptide fold or domain or sub-domain
QDADACAILRAMRERRHFTSSDE

SEQ ID NO: 15661 - protein, 30 aa, artificial
  peptide fold or domain or sub-domain
QDAKSDLLKVLELEPKNSESKTSLENLKKK

SEQ ID NO: 15662 - protein, 30 aa, artificial
  peptide fold or domain or sub-domain
QDALLYASGISDKAKKFLTEDDKKESINNL

SEQ ID NO: 15663 - protein, 25 aa, artificial
  peptide fold or domain or sub-domain
QDAYPLVAIGDLTDTDNDGAPDSCD

SEQ ID NO: 15664 - protein, 22 aa, artificial
  peptide fold or domain or sub-domain
QDCPRDNPLKEILRCNCQASKD

SEQ ID NO: 15665 - protein, 21 aa, artificial
  peptide fold or domain or sub-domain
QDEFDGDQIDQSKWNIANNFT

SEQ ID NO: 15666 - protein, 21 aa, artificial
  peptide fold or domain or sub-domain
QDEFEGDSLDLSIWNEISQSY

SEQ ID NO: 15667 - protein, 24 aa, artificial
  peptide fold or domain or sub-domain
QDFFPKLEGKSGSALKGDPNMQAQ

SEQ ID NO: 15668 - protein, 28 aa, artificial
  peptide fold or domain or sub-domain
QDFLIFNKDTLSWLAVDNVAHTIKQAWE

SEQ ID NO: 15669 - protein, 30 aa, artificial
  peptide fold or domain or sub-domain
QDGFADYYFGLTKSEYLTELKDKMKRICKQ

SEQ ID NO: 15670 - protein, 28 aa, artificial
  peptide fold or domain or sub-domain
QDHLEFCPDTLDWRAAEPRAWPTKLEWE

SEQ ID NO: 15671 - protein, 24 aa, artificial
  peptide fold or domain or sub-domain
QDHLGDVDLSAYPIDGPVPDIPYT

SEQ ID NO: 15672 - protein, 20 aa, artificial
  peptide fold or domain or sub-domain
QDIDDMIELFKADRPKTLAD

SEQ ID NO: 15673 - protein, 27 aa, artificial
  peptide fold or domain or sub-domain
QDIIIVDHNERAQSVDNLEDLHLLEII

SEQ ID NO: 15674 - protein, 24 aa, artificial
  peptide fold or domain or sub-domain
QDKFETLKGHPLDEVKDTANFKLI

SEQ ID NO: 15675 - protein, 24 aa, artificial
  peptide fold or domain or sub-domain
QDKFPNYKGKSVDSLSSVATFAPH

SEQ ID NO: 15676 - protein, 27 aa, artificial
  peptide fold or domain or sub-domain
QDLAWVGAFLEGDRTAFDRLVLRHKDR

SEQ ID NO: 15677 - protein, 22 aa, artificial
  peptide fold or domain or sub-domain
QDPFEIAVKQLERAAQHMKISE

SEQ ID NO: 15678 - protein, 29 aa, artificial
  peptide fold or domain or sub-domain
QDQLMESTFLVVKTDGEAQQKAIDHVYEK

SEQ ID NO: 15679 - protein, 23 aa, artificial
  peptide fold or domain or sub-domain
QDQWRKHGSCCFPPHESEIYFLK

SEQ ID NO: 15680 - protein, 24 aa, artificial
  peptide fold or domain or sub-domain
QDRGLETHSLHTIDKNPSKSKHLE

SEQ ID NO: 15681 - protein, 26 aa, artificial
  peptide fold or domain or sub-domain
QDSQAIVELLELEDDQALLTEAETTL

SEQ ID NO: 15682 - protein, 28 aa, artificial
  peptide fold or domain or sub-domain
QDTDKRVQDFVKRYKQKYKIEPNALSAL

SEQ ID NO: 15683 - protein, 20 aa, artificial
  peptide fold or domain or sub-domain
QDTHQSRFYLSKKKWVMVPM

SEQ ID NO: 15684 - protein, 28 aa, artificial
  peptide fold or domain or sub-domain
QDTLKKVAERRGESWDQKLAQLKKNKQW

SEQ ID NO: 15685 - protein, 27 aa, artificial
  peptide fold or domain or sub-domain
QDTSSYAKILTCPKTKLKISYKDAINR

SEQ ID NO: 15686 - protein, 30 aa, artificial
  peptide fold or domain or sub-domain
QDYLVASNNVHWTIVGEFVRVGSRYDNTLN

SEQ ID NO: 15687 - protein, 30 aa, artificial
  peptide fold or domain or sub-domain
QEAINSFEQGIKVKPDYADAWNNRGVCLAK

SEQ ID NO: 15688 - protein, 30 aa, artificial
  peptide fold or domain or sub-domain
QEAISACEKAKKLSPKDGMINSMLKGLKEK

SEQ ID NO: 15689 - protein, 30 aa, artificial
  peptide fold or domain or sub-domain
QEAKQDFEEVLKLEPGNKQALNELQKVQIK

SEQ ID NO: 15690 - protein, 27 aa, artificial
  peptide fold or domain or sub-domain
QEALAALFLRHGLAEERGRRLAAFVIA

SEQ ID NO: 15691 - protein, 27 aa, artificial
  peptide fold or domain or sub-domain
QEAQKWMYSGLDSNLLLQYIAWVTYPV

SEQ ID NO: 15692 - protein, 30 aa, artificial
  peptide fold or domain or sub-domain
QEAVEAYQKGVEVDPSNEVLKKGLAASKEQ

SEQ ID NO: 15693 - protein, 21 aa, artificial
  peptide fold or domain or sub-domain
QEDFNGDSLDMSVWNYEEGDG

SEQ ID NO: 15694 - protein, 22 aa, artificial
  peptide fold or domain or sub-domain
QEDKIEAIYTTLHGGKSVVLWT

SEQ ID NO: 15695 - protein, 27 aa, artificial
  peptide fold or domain or sub-domain
QEDWVDWALDQMAPTEEIQEAHVTVIQ

SEQ ID NO: 15696 - protein, 27 aa, artificial
  peptide fold or domain or sub-domain
QEEIFTKQLESSGKPESIIKGIVAGKI

SEQ ID NO: 15697 - protein, 25 aa, artificial
  peptide fold or domain or sub-domain
QEFADLLEANDDFTAENIEAQLKAF

SEQ ID NO: 15698 - protein, 29 aa, artificial
  peptide fold or domain or sub-domain
QEHLDKYSSEEQRRVAHILIEGDDQAKAQ

SEQ ID NO: 15699 - protein, 27 aa, artificial
  peptide fold or domain or sub-domain
QEHLSRAASFLDPGTHESLSYGQLLAR

SEQ ID NO: 15700 - protein, 29 aa, artificial
  peptide fold or domain or sub-domain
QEIFISDNRAHCVKVFNYEGQYLRQIGGE

SEQ ID NO: 15701 - protein, 28 aa, artificial
  peptide fold or domain or sub-domain
QEISLYDSDIGFYVARTELGQPFTELQN

SEQ ID NO: 15702 - protein, 29 aa, artificial
  peptide fold or domain or sub-domain
QEITAEIQKWWTNSRWENVERPYQAQDVA

SEQ ID NO: 15703 - protein, 29 aa, artificial
  peptide fold or domain or sub-domain
QEKFQWNDRSLIVKNNFCSLEDGTLVGTT

SEQ ID NO: 15704 - protein, 27 aa, artificial
  peptide fold or domain or sub-domain
QEKLFCGLKQSFARQDYDTAAQQVRQG

SEQ ID NO: 15705 - protein, 24 aa, artificial
  peptide fold or domain or sub-domain
QEKVYDDLFSSENEAEMDHISLSR

SEQ ID NO: 15706 - protein, 20 aa, artificial
  peptide fold or domain or sub-domain
QELDKAKRKLEAESNDLQEQ

SEQ ID NO: 15707 - protein, 27 aa, artificial
  peptide fold or domain or sub-domain
QELLHDTVKVRVRKDDGTLGTVTEDLY

SEQ ID NO: 15708 - protein, 29 aa, artificial
  peptide fold or domain or sub-domain
QELSKEGFSALASTIETLAAAERLTAHKN

SEQ ID NO: 15709 - protein, 27 aa, artificial
  peptide fold or domain or sub-domain
QEMAQPPQSDQSESDPSDEHASVPSST

SEQ ID NO: 15710 - protein, 24 aa, artificial
  peptide fold or domain or sub-domain
QENQRWALYGDGSIRPKQNQSQCL

SEQ ID NO: 15711 - protein, 28 aa, artificial
  peptide fold or domain or sub-domain
QENSGHDIKIIGGSKSSPGVTEVPDNLQ

SEQ ID NO: 15712 - protein, 29 aa, artificial
  peptide fold or domain or sub-domain
QESAGGILDPNLSVFLPRNKAIERSIIDE

SEQ ID NO: 15713 - protein, 23 aa, artificial
  peptide fold or domain or sub-domain
QESVADKMGMGQSGVGALFNGIN

SEQ ID NO: 15714 - protein, 27 aa, artificial
  peptide fold or domain or sub-domain
QETWFIHKYKKALHKGDDLRLRHHQRR

SEQ ID NO: 15715 - protein, 26 aa, artificial
  peptide fold or domain or sub-domain
QEWTSQDPQQHDRIPANYPNAGLDDN

SEQ ID NO: 15716 - protein, 29 aa, artificial
  peptide fold or domain or sub-domain
QEYFKITNKFKVANFNFFNNIFFNSKMVK

SEQ ID NO: 15717 - protein, 22 aa, artificial
  peptide fold or domain or sub-domain
QFADKLRSLKFHGLGVDQAEVL

SEQ ID NO: 15718 - protein, 23 aa, artificial
  peptide fold or domain or sub-domain
QFAMKIRGKSSEYIKSCLSPKMH

SEQ ID NO: 15719 - protein, 30 aa, artificial
  peptide fold or domain or sub-domain
QFDFAYRDKDDNYRSEKGITPRAFFEKYVG

SEQ ID NO: 15720 - protein, 23 aa, artificial
  peptide fold or domain or sub-domain
QFDPQPFHTDPEAARQTFFNGLA

SEQ ID NO: 15721 - protein, 28 aa, artificial
  peptide fold or domain or sub-domain
QFEFLKKLIECVEEADEETFNKMVADYD

SEQ ID NO: 15722 - protein, 29 aa, artificial
  peptide fold or domain or sub-domain
QFEHLSLWDAEKKKDLDVVGLKKVLTKWQ

SEQ ID NO: 15723 - protein, 29 aa, artificial
  peptide fold or domain or sub-domain
QFEHMDLDSGEGGKWDVKPCSLLTLKENL

SEQ ID NO: 15724 - protein, 22 aa, artificial
  peptide fold or domain or sub-domain
QFFHPSDCLFHSVARPYAVAHF

SEQ ID NO: 15725 - protein, 24 aa, artificial
  peptide fold or domain or sub-domain
QFGGAILQFDATGDPEFLEIGRQR

SEQ ID NO: 15726 - protein, 26 aa, artificial
  peptide fold or domain or sub-domain
QFGKPTLIDANDDDVTLSLPCHPRPV

SEQ ID NO: 15727 - protein, 25 aa, artificial
  peptide fold or domain or sub-domain
QFIFQYYEEEERQRGNFPDRFSGHQ

SEQ ID NO: 15728 - protein, 25 aa, artificial
  peptide fold or domain or sub-domain
QFILRRSGKSAGCTTSQAEGFNTFK

SEQ ID NO: 15729 - protein, 25 aa, artificial
  peptide fold or domain or sub-domain
QFILYRDDTSSHDADFVQGRFSVKH

SEQ ID NO: 15730 - protein, 30 aa, artificial
  peptide fold or domain or sub-domain
QFKGIERSEKGTEGLFFVETESGVFIVKRS

SEQ ID NO: 15731 - protein, 29 aa, artificial
  peptide fold or domain or sub-domain
QFLDWEFAILHDDRIDKKVEALTAVLAYL

SEQ ID NO: 15732 - protein, 30 aa, artificial
  peptide fold or domain or sub-domain
QFLEVIASGKLKIQGRSKQDLIKELESGEI

SEQ ID NO: 15733 - protein, 27 aa, artificial
  peptide fold or domain or sub-domain
QFLGWIYPFGNNTGYAPSFQDRVTISA

SEQ ID NO: 15734 - protein, 25 aa, artificial
  peptide fold or domain or sub-domain
QFLISFYQKMQREKGSIPDRFSAQQ

SEQ ID NO: 15735 - protein, 29 aa, artificial
  peptide fold or domain or sub-domain
QFLKWEKEMLHSNDWQVRGNAVRCVKDYL

SEQ ID NO: 15736 - protein, 29 aa, artificial
  peptide fold or domain or sub-domain
QFNGTDIILGPDQLVTADQRLVLLQATSQ

SEQ ID NO: 15737 - protein, 29 aa, artificial
  peptide fold or domain or sub-domain
QFPVDSWDTQLVDRISEYGKHFNLTTTTE

SEQ ID NO: 15738 - protein, 22 aa, artificial
  peptide fold or domain or sub-domain
QFQALVRSTTDPNAKGSYHVCA

SEQ ID NO: 15739 - protein, 25 aa, artificial
  peptide fold or domain or sub-domain
QFQFLIENANAHLPSQSKYRGPVND

SEQ ID NO: 15740 - protein, 20 aa, artificial
  peptide fold or domain or sub-domain
QFVAAAKTLGMHRTTVKKKA

SEQ ID NO: 15741 - protein, 28 aa, artificial
  peptide fold or domain or sub-domain
QFVHYEEGLQYDYSYLQHGPQLQISSYG

SEQ ID NO: 15742 - protein, 28 aa, artificial
  peptide fold or domain or sub-domain
QFVSKFGVRGDNMSPAEEAERNEDERRL

SEQ ID NO: 15743 - protein, 27 aa, artificial
  peptide fold or domain or sub-domain
QFYDQALQQAVVDDDANNAKAVVKTFH

SEQ ID NO: 15744 - protein, 22 aa, artificial
  peptide fold or domain or sub-domain
QGAFSLAKQLGITTKVAKEFID

SEQ ID NO: 15745 - protein, 28 aa, artificial
  peptide fold or domain or sub-domain
QGAGIVHSVTADYIIVKEYSGRKLKYIL

SEQ ID NO: 15746 - protein, 26 aa, artificial
  peptide fold or domain or sub-domain
QGAIKLLQKVATLEPENRAVQSDLAR

SEQ ID NO: 15747 - protein, 29 aa, artificial
  peptide fold or domain or sub-domain
QGAPADVHARDLQATAHGQVFTLALPDGE

SEQ ID NO: 15748 - protein, 22 aa, artificial
  peptide fold or domain or sub-domain
QGATALGQRLGLKRTEAKGYIS

SEQ ID NO: 15749 - protein, 28 aa, artificial
  peptide fold or domain or sub-domain
QGCPLSVDSDGDGVPDDIDECPDTAYGV

SEQ ID NO: 15750 - protein, 26 aa, artificial
  peptide fold or domain or sub-domain
QGEEWTGQADLFCEWQEYMDGLHNFP

SEQ ID NO: 15751 - protein, 27 aa, artificial
  peptide fold or domain or sub-domain
QGELWDGFFARHFSGTTRALAQRIFAN

SEQ ID NO: 15752 - protein, 26 aa, artificial
  peptide fold or domain or sub-domain
QGEMPQDRRNNAISRFREGDVNILLA

SEQ ID NO: 15753 - protein, 29 aa, artificial
  peptide fold or domain or sub-domain
QGIETIQKLWRGESIRVRGGGKNEINVSC

SEQ ID NO: 15754 - protein, 24 aa, artificial
  peptide fold or domain or sub-domain
QGINRAGELYQQQKVFIPELLLIS

SEQ ID NO: 15755 - protein, 21 aa, artificial
  peptide fold or domain or sub-domain
QGIVEHIISEGSLVIGGVSFV

SEQ ID NO: 15756 - protein, 30 aa, artificial
  peptide fold or domain or sub-domain
QGKIPIAGTVVTRLDEIEGNDCTFEITGNT

SEQ ID NO: 15757 - protein, 30 aa, artificial
  peptide fold or domain or sub-domain
QGKLPTTGMTITKLEDSENHRNAFEISGSM

SEQ ID NO: 15758 - protein, 24 aa, artificial
  peptide fold or domain or sub-domain
QGLLARSGSSSNEKTFMKNFHAKR

SEQ ID NO: 15759 - protein, 24 aa, artificial
  peptide fold or domain or sub-domain
QGLTRALRRMAPDIPLLANIGAAQ

SEQ ID NO: 15760 - protein, 28 aa, artificial
  peptide fold or domain or sub-domain
QGMLEKVAGAKGLNYEEFIKKLKKNGQW

SEQ ID NO: 15761 - protein, 27 aa, artificial
  peptide fold or domain or sub-domain
QGNFPTSVTDPQPMGKVGMCFHPEQHR

SEQ ID NO: 15762 - protein, 26 aa, artificial
  peptide fold or domain or sub-domain
QGNLSQNRRHAVMEGFRRGNFKILVA

SEQ ID NO: 15763 - protein, 26 aa, artificial
  peptide fold or domain or sub-domain
QGPVKRWGVQKRKGKHARQGWRRRIG

SEQ ID NO: 15764 - protein, 24 aa, artificial
  peptide fold or domain or sub-domain
QGRFDIRFMGRNQTLGARIASETG

SEQ ID NO: 15765 - protein, 30 aa, artificial
  peptide fold or domain or sub-domain
QGRFVLRKYRIVDREDSPEFRHAFELWGRE

SEQ ID NO: 15766 - protein, 27 aa, artificial
  peptide fold or domain or sub-domain
QGRTVGIIKSRMENAIIDGDIPYDRQA

SEQ ID NO: 15767 - protein, 23 aa, artificial
  peptide fold or domain or sub-domain
QGRVVHSGEIEDADKAAICLSLM

SEQ ID NO: 15768 - protein, 27 aa, artificial
  peptide fold or domain or sub-domain
QGTAKRTTIGLNIQNPDQKAYTQLRQS

SEQ ID NO: 15769 - protein, 29 aa, artificial
  peptide fold or domain or sub-domain
QGTGSEINDYDPSKPSLWELQENRDKLVA

SEQ ID NO: 15770 - protein, 28 aa, artificial
  peptide fold or domain or sub-domain
QGTVTFGGVTATVKSWTSNRIEVYVPNM

SEQ ID NO: 15771 - protein, 24 aa, artificial
  peptide fold or domain or sub-domain
QGVEVVGKRYCNGEYYLSDLIMSE

SEQ ID NO: 15772 - protein, 22 aa, artificial
  peptide fold or domain or sub-domain
QGVREVSEARGEDYFEIGLGDL

SEQ ID NO: 15773 - protein, 23 aa, artificial
  peptide fold or domain or sub-domain
QHGERLFGGTSSQAEREAAVVEV

SEQ ID NO: 15774 - protein, 29 aa, artificial
  peptide fold or domain or sub-domain
QHHTGGLVDPKTGRRVNIFDALGCKMLNS

SEQ ID NO: 15775 - protein, 27 aa, artificial
  peptide fold or domain or sub-domain
QHIYFNKLIQSGIKEETAEFLSMTILT

SEQ ID NO: 15776 - protein, 20 aa, artificial
  peptide fold or domain or sub-domain
QHKAKLPDEKKRITSLGVPV

SEQ ID NO: 15777 - protein, 29 aa, artificial
  peptide fold or domain or sub-domain
QHKVTAVDAKAGLIKFDVQDDVKANVLNV

SEQ ID NO: 15778 - protein, 24 aa, artificial
  peptide fold or domain or sub-domain
QHLEAEGFDVVRMDLSRPCDPDQF

SEQ ID NO: 15779 - protein, 29 aa, artificial
  peptide fold or domain or sub-domain
QHLTGGLIDPKRTGRIPIQQALLSGMISE

SEQ ID NO: 15780 - protein, 24 aa, artificial
  peptide fold or domain or sub-domain
QHPVYEALVDVEAEMNMNHITLAR

SEQ ID NO: 15781 - protein, 28 aa, artificial
  peptide fold or domain or sub-domain
QHRFTHEDFGRTPPPPEQEPFHTLNDHG

SEQ ID NO: 15782 - protein, 27 aa, artificial
  peptide fold or domain or sub-domain
QHRNEFQRLFALMVQRWHDGEHADNGL

SEQ ID NO: 15783 - protein, 30 aa, artificial
  peptide fold or domain or sub-domain
QHTDAIVTEDYSRARQFLREVDSSSVMINA

SEQ ID NO: 15784 - protein, 30 aa, artificial
  peptide fold or domain or sub-domain
QHVQRDGQAVLENVSEDGEELSGCLGRHQN

SEQ ID NO: 15785 - protein, 20 aa, artificial
  peptide fold or domain or sub-domain
QHVSQLARMADMKPQQLNGF

SEQ ID NO: 15786 - protein, 28 aa, artificial
  peptide fold or domain or sub-domain
QHVSVGDLEIDFQRLSVCKNRQKLDLSS

SEQ ID NO: 15787 - protein, 29 aa, artificial
  peptide fold or domain or sub-domain
QHVVLSTRKLDLPAGVLQLKSEEEVSAWL

SEQ ID NO: 15788 - protein, 29 aa, artificial
  peptide fold or domain or sub-domain
QIAEAQKIVSGGGSQQDIAEAQVELEVLE

SEQ ID NO: 15789 - protein, 29 aa, artificial
  peptide fold or domain or sub-domain
QIASGGVVDPVNSVFLPKDVALARGLIDR

SEQ ID NO: 15790 - protein, 29 aa, artificial
  peptide fold or domain or sub-domain
QIATGGIIDPKESHRLPVDIAYKRGYFNE

SEQ ID NO: 15791 - protein, 21 aa, artificial
  peptide fold or domain or sub-domain
QIAVVAEELGIMSQLDMNKLL

SEQ ID NO: 15792 - protein, 26 aa, artificial
  peptide fold or domain or sub-domain
QIDSPLNGKVTNEGTTSTLTMNPVSF

SEQ ID NO: 15793 - protein, 23 aa, artificial
  peptide fold or domain or sub-domain
QIDTRSGTPTLMISIQNAAEPVA

SEQ ID NO: 15794 - protein, 26 aa, artificial
  peptide fold or domain or sub-domain
QIDVENAERYDISYVNADGKLERPIV

SEQ ID NO: 15795 - protein, 23 aa, artificial
  peptide fold or domain or sub-domain
QIDVFKNGTRGNAPVMSAVAHTL

SEQ ID NO: 15796 - protein, 25 aa, artificial
  peptide fold or domain or sub-domain
QIEELKHFLIKDYNFNELRVTNYIN

SEQ ID NO: 15797 - protein, 26 aa, artificial
  peptide fold or domain or sub-domain
QIEKNLSDLIDLVPSLCEDLLSSVDQ

SEQ ID NO: 15798 - protein, 24 aa, artificial
  peptide fold or domain or sub-domain
QIESFEVARQENPDGLIFANVNPT

SEQ ID NO: 15799 - protein, 22 aa, artificial
  peptide fold or domain or sub-domain
QIETVGGLEKVGDQLAGGGPCS

SEQ ID NO: 15800 - protein, 30 aa, artificial
  peptide fold or domain or sub-domain
QIFDKDLLAFSVEQHLGLMCDSANNLHSSD

SEQ ID NO: 15801 - protein, 29 aa, artificial
  peptide fold or domain or sub-domain
QIFNEKAIQSLAPVAEKLAKEEGLYAHAK

SEQ ID NO: 15802 - protein, 22 aa, artificial
  peptide fold or domain or sub-domain
QIGNINSHGMSSQQVATILRHQ

SEQ ID NO: 15803 - protein, 30 aa, artificial
  peptide fold or domain or sub-domain
QIIAVDIVEEKLAMTKTFGATHTVNAREDD

SEQ ID NO: 15804 - protein, 30 aa, artificial
  peptide fold or domain or sub-domain
QIIDARPAARFNAEVDELRRGHIPGALNVP

SEQ ID NO: 15805 - protein, 25 aa, artificial
  peptide fold or domain or sub-domain
QIKEVANLGIDMPLQAALALERKAF

SEQ ID NO: 15806 - protein, 22 aa, artificial
  peptide fold or domain or sub-domain
QIKPGACDQSFGIHCAEFARFP

SEQ ID NO: 15807 - protein, 30 aa, artificial
  peptide fold or domain or sub-domain
QIKSIKLSDSGSRGVLFIDSENGAIVLKLS

SEQ ID NO: 15808 - protein, 25 aa, artificial
  peptide fold or domain or sub-domain
QILAQGSSGKIQLKGQFDNPRFTVM

SEQ ID NO: 15809 - protein, 30 aa, artificial
  peptide fold or domain or sub-domain
QILAYDRSPAPFERLAGHPAWGKRLRAAAG

SEQ ID NO: 15810 - protein, 25 aa, artificial
  peptide fold or domain or sub-domain
QILFTHSGGRLARVPVAQNELERLS

SEQ ID NO: 15811 - protein, 23 aa, artificial
  peptide fold or domain or sub-domain
QILHRGKKVGTERIWYGDKENID

SEQ ID NO: 15812 - protein, 23 aa, artificial
  peptide fold or domain or sub-domain
QILNQEHGWHWSNGQPYRYMNWD

SEQ ID NO: 15813 - protein, 25 aa, artificial
  peptide fold or domain or sub-domain
QINGMAWEKDGMRKRLVAKADASPL

SEQ ID NO: 15814 - protein, 22 aa, artificial
  peptide fold or domain or sub-domain
QINNIRQRFNDTLGKNRIALCE

SEQ ID NO: 15815 - protein, 22 aa, artificial
  peptide fold or domain or sub-domain
QINVEEIQRTIFGPRRLQGLGS

SEQ ID NO: 15816 - protein, 22 aa, artificial
  peptide fold or domain or sub-domain
QIPPPFLSQVLSGVEMGAVAEQ

SEQ ID NO: 15817 - protein, 29 aa, artificial
  peptide fold or domain or sub-domain
QIQDAKEDVADATTDESRQRAARQLADLE

SEQ ID NO: 15818 - protein, 20 aa, artificial
  peptide fold or domain or sub-domain
QIRCKLLKSRQTPEGEFLPL

SEQ ID NO: 15819 - protein, 25 aa, artificial
  peptide fold or domain or sub-domain
QIRERGEDGTLYLRMDKAHHRVAVH

SEQ ID NO: 15820 - protein, 29 aa, artificial
  peptide fold or domain or sub-domain
QISAKGIYDPIEKCYLTEEQAYRRGHYDE

SEQ ID NO: 15821 - protein, 22 aa, artificial
  peptide fold or domain or sub-domain
QISGTALRDLIRAGKAPSEYIL

SEQ ID NO: 15822 - protein, 30 aa, artificial
  peptide fold or domain or sub-domain
QISRLLEKGHPRQQLAIIFGIGVSTLYRYF

SEQ ID NO: 15823 - protein, 29 aa, artificial
  peptide fold or domain or sub-domain
QISSDNGPAFISKVLQLLISTLKITWKFS

SEQ ID NO: 15824 - protein, 26 aa, artificial
  peptide fold or domain or sub-domain
QISSQKQRGRSASNEFLNIWGGQYNH

SEQ ID NO: 15825 - protein, 27 aa, artificial
  peptide fold or domain or sub-domain
QITDDGVPVWDYSLPADEIQYKDSSAG

SEQ ID NO: 15826 - protein, 27 aa, artificial
  peptide fold or domain or sub-domain
QITSPVDEGWKRNGAGFHFNHKFGFGR

SEQ ID NO: 15827 - protein, 30 aa, artificial
  peptide fold or domain or sub-domain
QITTTVIAAEIEKQTGKTIDKRKLELAEPI

SEQ ID NO: 15828 - protein, 25 aa, artificial
  peptide fold or domain or sub-domain
QIVEDAQNDPRWKHFYDDREEIGSA

SEQ ID NO: 15829 - protein, 27 aa, artificial
  peptide fold or domain or sub-domain
QIVSLVADPRATELAARRQTTRSAAGV

SEQ ID NO: 15830 - protein, 29 aa, artificial
  peptide fold or domain or sub-domain
QIVVIEPDEDNKNIEWAREMGAVVLIGDA

SEQ ID NO: 15831 - protein, 20 aa, artificial
  peptide fold or domain or sub-domain
QIYGKLLRTTNTPDGETIIM

SEQ ID NO: 15832 - protein, 29 aa, artificial
  peptide fold or domain or sub-domain
QIYLPLHPQDKWWPEIADKYTGKVISVAG

SEQ ID NO: 15833 - protein, 29 aa, artificial
  peptide fold or domain or sub-domain
QIYMLIEEKGYARVSDIAEALAVHPSSVT

SEQ ID NO: 15834 - protein, 29 aa, artificial
  peptide fold or domain or sub-domain
QIYSARYSGVDVYEFIHSTGSIMKRKKDD

SEQ ID NO: 15835 - protein, 30 aa, artificial
  peptide fold or domain or sub-domain
QKACEAYTRAVDLEPGNSSYRANLEIAEQK

SEQ ID NO: 15836 - protein, 23 aa, artificial
  peptide fold or domain or sub-domain
QKAKAILMDGQGLSEADAYESIR

SEQ ID NO: 15837 - protein, 24 aa, artificial
  peptide fold or domain or sub-domain
QKALHPDNFVSSNALDQRVAMQKS

SEQ ID NO: 15838 - protein, 22 aa, artificial
  peptide fold or domain or sub-domain
QKATPPKLEDKSPDSPEMKDFR

SEQ ID NO: 15839 - protein, 24 aa, artificial
  peptide fold or domain or sub-domain
QKAVRVGILSGITTNPSLIAQAKK

SEQ ID NO: 15840 - protein, 29 aa, artificial
  peptide fold or domain or sub-domain
QKAYHGMHVAGTALAGIPANREGYGELMA

SEQ ID NO: 15841 - protein, 24 aa, artificial
  peptide fold or domain or sub-domain
QKDFTFLYQQGDALIFMDSQSYEQ

SEQ ID NO: 15842 - protein, 24 aa, artificial
  peptide fold or domain or sub-domain
QKFFAKFGNVAVDSLAGNVDYEKQ

SEQ ID NO: 15843 - protein, 25 aa, artificial
  peptide fold or domain or sub-domain
QKFLVLNADNDRIIGKQGGSGFFIY

SEQ ID NO: 15844 - protein, 25 aa, artificial
  peptide fold or domain or sub-domain
QKFMLLRADDRSIYGRHDAEGVVCV

SEQ ID NO: 15845 - protein, 22 aa, artificial
  peptide fold or domain or sub-domain
QKFQMLMSKHQAHVRPQFESLE

SEQ ID NO: 15846 - protein, 25 aa, artificial
  peptide fold or domain or sub-domain
QKIDSKVLEKNIPAQFRDSNDQWFG

SEQ ID NO: 15847 - protein, 30 aa, artificial
  peptide fold or domain or sub-domain
QKIKISKNQIVEYSPITRRHINQTMTVKQL

SEQ ID NO: 15848 - protein, 29 aa, artificial
  peptide fold or domain or sub-domain
QKISKSGLESLKETIIALAEEEGLQAHAD

SEQ ID NO: 15849 - protein, 24 aa, artificial
  peptide fold or domain or sub-domain
QKKLHPDLVHNKSKKERDYAAEQS

SEQ ID NO: 15850 - protein, 29 aa, artificial
  peptide fold or domain or sub-domain
QKLDKESLKNIADIVITLAEAEGLFGHAE

SEQ ID NO: 15851 - protein, 29 aa, artificial
  peptide fold or domain or sub-domain
QKLDQQGLIDVSSSIISLSEVERMDAHTN

SEQ ID NO: 15852 - protein, 27 aa, artificial
  peptide fold or domain or sub-domain
QKLRVLLTIPPKQRTDDHIREISVLVQ

SEQ ID NO: 15853 - protein, 24 aa, artificial
  peptide fold or domain or sub-domain
QKMFSKFANVPQSELLGNGNFLAQ

SEQ ID NO: 15854 - protein, 23 aa, artificial
  peptide fold or domain or sub-domain
QKMIEDQCYADGITMKPKALSSW

SEQ ID NO: 15855 - protein, 23 aa, artificial
  peptide fold or domain or sub-domain
QKNCQKPSKCKNGEGQYHCKPCR

SEQ ID NO: 15856 - protein, 23 aa, artificial
  peptide fold or domain or sub-domain
QKPEAEWRAELTELEFYILRKAG

SEQ ID NO: 15857 - protein, 24 aa, artificial
  peptide fold or domain or sub-domain
QKPVCDPKAADGPFSTAGAHFNPE

SEQ ID NO: 15858 - protein, 25 aa, artificial
  peptide fold or domain or sub-domain
QKQYESFCQDLFESRKGKDSLESVQ

SEQ ID NO: 15859 - protein, 24 aa, artificial
  peptide fold or domain or sub-domain
QKRFHPDNFATASERDRLMSVQKA

SEQ ID NO: 15860 - protein, 29 aa, artificial
  peptide fold or domain or sub-domain
QKRKAVKEKMKNEKDAVKLSQLEIRQKAI

SEQ ID NO: 15861 - protein, 24 aa, artificial
  peptide fold or domain or sub-domain
QKRLHPDRFASKSPKEKALSQSQA

SEQ ID NO: 15862 - protein, 30 aa, artificial
  peptide fold or domain or sub-domain
QKSASLSPFIEHWDQAMQYLSLPAGKFNYI

SEQ ID NO: 15863 - protein, 22 aa, artificial
  peptide fold or domain or sub-domain
QKSKPSKLANKPDNSAEVMDYH

SEQ ID NO: 15864 - protein, 29 aa, artificial
  peptide fold or domain or sub-domain
QKSLPYNKTFLEPHMDEETLHLHFEFHHG

SEQ ID NO: 15865 - protein, 30 aa, artificial
  peptide fold or domain or sub-domain
QKTLNEGIEECRKRSDNGSRELLERILEDT

SEQ ID NO: 15866 - protein, 24 aa, artificial
  peptide fold or domain or sub-domain
QKTPSTDYNLYQSGKLDAALLGPQ

SEQ ID NO: 15867 - protein, 21 aa, artificial
  peptide fold or domain or sub-domain
QKTQHANIHRAVHHLSDLATQ

SEQ ID NO: 15868 - protein, 30 aa, artificial
  peptide fold or domain or sub-domain
QKTVAEYYKIKVADLLSKRRSRSVARPRQM

SEQ ID NO: 15869 - protein, 28 aa, artificial
  peptide fold or domain or sub-domain
QKVCYSTSSSEHVTFPEWSPPCRMDIKM

SEQ ID NO: 15870 - protein, 27 aa, artificial
  peptide fold or domain or sub-domain
QKVGLVDFNQKTQLHKDVDNSDIVAII

SEQ ID NO: 15871 - protein, 23 aa, artificial
  peptide fold or domain or sub-domain
QKVIDDQCLDDKNEMKPRSFYNW

SEQ ID NO: 15872 - protein, 27 aa, artificial
  peptide fold or domain or sub-domain
QKVIEQNGDSFTIHTNSSLRNYFVKFK

SEQ ID NO: 15873 - protein, 30 aa, artificial
  peptide fold or domain or sub-domain
QKVKYESRDLEYHSPITTKYKGSGMTLGDM

SEQ ID NO: 15874 - protein, 23 aa, artificial
  peptide fold or domain or sub-domain
QKVLASRHLIYQHQHNKQMSCPA

SEQ ID NO: 15875 - protein, 28 aa, artificial
  peptide fold or domain or sub-domain
QKVPNITLEKLEALDLINQVEFSTLINM

SEQ ID NO: 15876 - protein, 22 aa, artificial
  peptide fold or domain or sub-domain
QKVQYFQNGMGKKFSHQNFEYH

SEQ ID NO: 15877 - protein, 23 aa, artificial
  peptide fold or domain or sub-domain
QKVVIERGEGCYVYDVNGKRYLD

SEQ ID NO: 15878 - protein, 26 aa, artificial
  peptide fold or domain or sub-domain
QKWNEQQPHRHDTHIPDPLTGVGNHN

SEQ ID NO: 15879 - protein, 26 aa, artificial
  peptide fold or domain or sub-domain
QKWSDQAPHLHRRTPQVFPELSDAEN

SEQ ID NO: 15880 - protein, 26 aa, artificial
  peptide fold or domain or sub-domain
QKWSDTSPHVPKYSPSTHPSEGLEEN

SEQ ID NO: 15881 - protein, 25 aa, artificial
  peptide fold or domain or sub-domain
QKYLENYYDLKKDSGPVVKKIREMQ

SEQ ID NO: 15882 - protein, 26 aa, artificial
  peptide fold or domain or sub-domain
QLADVLFTPSLDGDENLHREGIPDNK

SEQ ID NO: 15883 - protein, 25 aa, artificial
  peptide fold or domain or sub-domain
QLASGYYDSTIKLWDSATGELLQTL

SEQ ID NO: 15884 - protein, 29 aa, artificial
  peptide fold or domain or sub-domain
QLATGGLVCPARRLRLPVEAALRLGCLDK

SEQ ID NO: 15885 - protein, 22 aa, artificial
  peptide fold or domain or sub-domain
QLAWPRSLGLIRSDAAAERHLR

SEQ ID NO: 15886 - protein, 30 aa, artificial
  peptide fold or domain or sub-domain
QLDDPVSKYLSFFKVKYPSDKSSVITIRQL

SEQ ID NO: 15887 - protein, 29 aa, artificial
  peptide fold or domain or sub-domain
QLDEVDFANTLSVDIFEVLQILGVEAARK

SEQ ID NO: 15888 - protein, 30 aa, artificial
  peptide fold or domain or sub-domain
QLDGWFAFSSVDEIKAHTGWDLKVSPTAHM

SEQ ID NO: 15889 - protein, 29 aa, artificial
  peptide fold or domain or sub-domain
QLEEAKSYFNTAKGTKNEVEANLAVKRAE

SEQ ID NO: 15890 - protein, 23 aa, artificial
  peptide fold or domain or sub-domain
QLEGPGQVGLSSDGPSYQISVYE

SEQ ID NO: 15891 - protein, 27 aa, artificial
  peptide fold or domain or sub-domain
QLEISNNDDKWTIRTITMIRMAEVTFT

SEQ ID NO: 15892 - protein, 27 aa, artificial
  peptide fold or domain or sub-domain
QLEIVTGKGEVVTCSEKRNSELFFSVL

SEQ ID NO: 15893 - protein, 25 aa, artificial
  peptide fold or domain or sub-domain
QLEKTIKDQGDKIDPKEKEQTEKEI

SEQ ID NO: 15894 - protein, 26 aa, artificial
  peptide fold or domain or sub-domain
QLELMSTPITINNINFYTLPFATISE

SEQ ID NO: 15895 - protein, 26 aa, artificial
  peptide fold or domain or sub-domain
QLELQRMIVKHFKSGNEQFLAFCAVG

SEQ ID NO: 15896 - protein, 29 aa, artificial
  peptide fold or domain or sub-domain
QLERELYPLYEETSNPRKKKDAVKKISAY

SEQ ID NO: 15897 - protein, 23 aa, artificial
  peptide fold or domain or sub-domain
QLFFFDFSQNTRVPRLPEFADWA

SEQ ID NO: 15898 - protein, 26 aa, artificial
  peptide fold or domain or sub-domain
QLFGISSEAVLTLDPMTNNTISLYSL

SEQ ID NO: 15899 - protein, 26 aa, artificial
  peptide fold or domain or sub-domain
QLFLENKVTAEDDVRNFAPEDIEKKG

SEQ ID NO: 15900 - protein, 23 aa, artificial
  peptide fold or domain or sub-domain
QLFSFDFPKSQWLPQLPDAPSWP

SEQ ID NO: 15901 - protein, 23 aa, artificial
  peptide fold or domain or sub-domain
QLFSVELKKRQAVWRLPEFGNLA

SEQ ID NO: 15902 - protein, 30 aa, artificial
  peptide fold or domain or sub-domain
QLFYTRRNEWKECPDYVSAGENSCYFNSSF

SEQ ID NO: 15903 - protein, 23 aa, artificial
  peptide fold or domain or sub-domain
QLHAPGKQFIYVLGDFNNFMPDS

SEQ ID NO: 15904 - protein, 29 aa, artificial
  peptide fold or domain or sub-domain
QLHTDNGPNFTSQEVAAICWWGKIEHTTG

SEQ ID NO: 15905 - protein, 29 aa, artificial
  peptide fold or domain or sub-domain
QLIDKKQQGVLCCTTEESVFKEKNELNII

SEQ ID NO: 15906 - protein, 23 aa, artificial
  peptide fold or domain or sub-domain
QLKAGVHTLDHSLQDIEICLDHI

SEQ ID NO: 15907 - protein, 23 aa, artificial
  peptide fold or domain or sub-domain
QLKDFKSGVRGNDKVMADIARRL

SEQ ID NO: 15908 - protein, 24 aa, artificial
  peptide fold or domain or sub-domain
QLKFHPDRFVTMPTINISYSQEYS

SEQ ID NO: 15909 - protein, 25 aa, artificial
  peptide fold or domain or sub-domain
QLKGIVEGPLDIDCASSRERALRKG

SEQ ID NO: 15910 - protein, 26 aa, artificial
  peptide fold or domain or sub-domain
QLKGTERKKLCEEISAIYPTLTDEET

SEQ ID NO: 15911 - protein, 26 aa, artificial
  peptide fold or domain or sub-domain
QLKPSATLAINEESNKLKKSGKKVYK

SEQ ID NO: 15912 - protein, 29 aa, artificial
  peptide fold or domain or sub-domain
QLKTDNGPGYKSKVFSTWYSLWGIKHVTG

SEQ ID NO: 15913 - protein, 30 aa, artificial
  peptide fold or domain or sub-domain
QLLFKQLPLYQEGDFKIVQTPAIIDYISEK

SEQ ID NO: 15914 - protein, 25 aa, artificial
  peptide fold or domain or sub-domain
QLLLQKLAQVATEEPERQRLEALCQ

SEQ ID NO: 15915 - protein, 25 aa, artificial
  peptide fold or domain or sub-domain
QLLLVGEGNALSTATVAEKVEVTPL

SEQ ID NO: 15916 - protein, 25 aa, artificial
  peptide fold or domain or sub-domain
QLLMSVFSNVDRKEEQGLTVLLNKK

SEQ ID NO: 15917 - protein, 29 aa, artificial
  peptide fold or domain or sub-domain
QLLSGGLIDCNSGQKMTVEEAVAEGVIDR

SEQ ID NO: 15918 - protein, 23 aa, artificial
  peptide fold or domain or sub-domain
QLLTDLCRSKQRINYLKTHWLDF

SEQ ID NO: 15919 - protein, 26 aa, artificial
  peptide fold or domain or sub-domain
QLLTDTHALSSDQTQSVPLHHELRIN

SEQ ID NO: 15920 - protein, 21 aa, artificial
  peptide fold or domain or sub-domain
QLMYELEFGLPWENRERWDAL

SEQ ID NO: 15921 - protein, 27 aa, artificial
  peptide fold or domain or sub-domain
QLNKQEQEQVFIERTLVGRFYYRFKQG

SEQ ID NO: 15922 - protein, 25 aa, artificial
  peptide fold or domain or sub-domain
QLPGKKVSEYIAMLRRSKPGVTLIS

SEQ ID NO: 15923 - protein, 22 aa, artificial
  peptide fold or domain or sub-domain
QLPPDVTEEALSGEEVGEVFSE

SEQ ID NO: 15924 - protein, 26 aa, artificial
  peptide fold or domain or sub-domain
QLPWQNMQNVTDEERTNKVGEMKMTI

SEQ ID NO: 15925 - protein, 23 aa, artificial
  peptide fold or domain or sub-domain
QLQAFRLGQRADGGAHAAALAAL

SEQ ID NO: 15926 - protein, 23 aa, artificial
  peptide fold or domain or sub-domain
QLQFPNKKMLNIVDILNGKDLDK

SEQ ID NO: 15927 - protein, 23 aa, artificial
  peptide fold or domain or sub-domain
QLQRSGKKPLFWRDFLNGSPLLL

SEQ ID NO: 15928 - protein, 29 aa, artificial
  peptide fold or domain or sub-domain
QLQTGGIIDTVTGQRLTIDEAVSNDLVAA

SEQ ID NO: 15929 - protein, 23 aa, artificial
  peptide fold or domain or sub-domain
QLRAFKSWDGKPPERENPIMGAM

SEQ ID NO: 15930 - protein, 23 aa, artificial
  peptide fold or domain or sub-domain
QLRLWRDGVRHGSELMAAAAREL

SEQ ID NO: 15931 - protein, 21 aa, artificial
  peptide fold or domain or sub-domain
QLRRAFAGDSDGYYQDYTGNT

SEQ ID NO: 15932 - protein, 27 aa, artificial
  peptide fold or domain or sub-domain
QLSGIGDSEHLRSLGIEPRIHLPGVGE

SEQ ID NO: 15933 - protein, 27 aa, artificial
  peptide fold or domain or sub-domain
QLSGIGPEAVLSSAGVDTIVNLQGVGA

SEQ ID NO: 15934 - protein, 27 aa, artificial
  peptide fold or domain or sub-domain
QLSGVGPGDLLRKHGIDVVLDAQGVGH

SEQ ID NO: 15935 - protein, 23 aa, artificial
  peptide fold or domain or sub-domain
QLSIGGKKVMNAQEFNNGFLSKL

SEQ ID NO: 15936 - protein, 26 aa, artificial
  peptide fold or domain or sub-domain
QLSTIAANNGGNRAHGRPGYKASVDY

SEQ ID NO: 15937 - protein, 30 aa, artificial
  peptide fold or domain or sub-domain
QLTLAIGDFDSVSKTELDKISVSTDKLIKL

SEQ ID NO: 15938 - protein, 23 aa, artificial
  peptide fold or domain or sub-domain
QLVAFQNGSRSNSVQMHDLAGRM

SEQ ID NO: 15939 - protein, 23 aa, artificial
  peptide fold or domain or sub-domain
QLVAFRQGTRTNNSVMSTIAAQM

SEQ ID NO: 15940 - protein, 22 aa, artificial
  peptide fold or domain or sub-domain
QLVIGKSGESNALWISRKMNVP

SEQ ID NO: 15941 - protein, 30 aa, artificial
  peptide fold or domain or sub-domain
QLVIGSLAITNPDLTIQIIEKIKPENIVLA

SEQ ID NO: 15942 - protein, 23 aa, artificial
  peptide fold or domain or sub-domain
QLVKKGATIKPFATADVKYGRTK

SEQ ID NO: 15943 - protein, 26 aa, artificial
  peptide fold or domain or sub-domain
QLVLQDRPEIIELAKVGPGIEGMVHD

SEQ ID NO: 15944 - protein, 23 aa, artificial
  peptide fold or domain or sub-domain
QLVNSFIVLIRTSQDELLRSYPP

SEQ ID NO: 15945 - protein, 30 aa, artificial
  peptide fold or domain or sub-domain
QLVQEAALVAVRKTHNSILQSDMDDAVDRL

SEQ ID NO: 15946 - protein, 24 aa, artificial
  peptide fold or domain or sub-domain
QLVYLYKDREEVSGKSTYNYVNRT

SEQ ID NO: 15947 - protein, 26 aa, artificial
  peptide fold or domain or sub-domain
QLWRSRYPHKPEINSTTHPGADLQEN

SEQ ID NO: 15948 - protein, 25 aa, artificial
  peptide fold or domain or sub-domain
QLYALQTARKLGASLDDAILRQGLH

SEQ ID NO: 15949 - protein, 22 aa, artificial
  peptide fold or domain or sub-domain
QLYDDDMALLAGYGSRHYQVPL

SEQ ID NO: 15950 - protein, 29 aa, artificial
  peptide fold or domain or sub-domain
QLYERNIKTIAELRQNQHLLNKNQKIGLQ

SEQ ID NO: 15951 - protein, 30 aa, artificial
  peptide fold or domain or sub-domain
QLYESDECSKTLDDHLSDVCSIGDSIASSP

SEQ ID NO: 15952 - protein, 29 aa, artificial
  peptide fold or domain or sub-domain
QLYIFKGSHFWEVAADGNVSEPRPLQERW

SEQ ID NO: 15953 - protein, 25 aa, artificial
  peptide fold or domain or sub-domain
QLYVYAHATELGLIDARQEVEQATD

SEQ ID NO: 15954 - protein, 26 aa, artificial
  peptide fold or domain or sub-domain
QMAALHLAPTHGNFANLIREGVPEKN

SEQ ID NO: 15955 - protein, 22 aa, artificial
  peptide fold or domain or sub-domain
QMFEESDNMLNSLTRPYQIANF

SEQ ID NO: 15956 - protein, 23 aa, artificial
  peptide fold or domain or sub-domain
QMFQYNFADKSVVPRIPNLKKWA

SEQ ID NO: 15957 - protein, 27 aa, artificial
  peptide fold or domain or sub-domain
QMGPMGAMAQGDIEYDADEFATRANNL

SEQ ID NO: 15958 - protein, 27 aa, artificial
  peptide fold or domain or sub-domain
QMHEMMNDVSPDDLDRVRTEGGSLVEL

SEQ ID NO: 15959 - protein, 24 aa, artificial
  peptide fold or domain or sub-domain
QMIDLHLQKNREESEDDFVDLLLR

SEQ ID NO: 15960 - protein, 28 aa, artificial
  peptide fold or domain or sub-domain
QMIEQIQFVKLFGMVKIDNLLQEMLLGG

SEQ ID NO: 15961 - protein, 21 aa, artificial
  peptide fold or domain or sub-domain
QMKIQAPLLRTAEEAETIKFT

SEQ ID NO: 15962 - protein, 27 aa, artificial
  peptide fold or domain or sub-domain
QMKVIGSMAKGEADFDADAVNAALIEI

SEQ ID NO: 15963 - protein, 30 aa, artificial
  peptide fold or domain or sub-domain
QMLKDWPHYKTLLRLTDFAEIAQDLTCLQH

SEQ ID NO: 15964 - protein, 22 aa, artificial
  peptide fold or domain or sub-domain
QMLLKLLTFEYGKSRADIAYSN

SEQ ID NO: 15965 - protein, 26 aa, artificial
  peptide fold or domain or sub-domain
QMLYSIHYFNLLDCKKTLSTTERTNY

SEQ ID NO: 15966 - protein, 24 aa, artificial
  peptide fold or domain or sub-domain
QMQEQAAQLSTTFQAQNRSLLSEL

SEQ ID NO: 15967 - protein, 24 aa, artificial
  peptide fold or domain or sub-domain
QMVELCAEYFSGNLEKSREVHRKL

SEQ ID NO: 15968 - protein, 26 aa, artificial
  peptide fold or domain or sub-domain
QMVELCAEYFSGNLEKSREVHRKLRP

SEQ ID NO: 15969 - protein, 23 aa, artificial
  peptide fold or domain or sub-domain
QMVIDEELLGDGHSYSPRAIHSW

SEQ ID NO: 15970 - protein, 22 aa, artificial
  peptide fold or domain or sub-domain
QMYDDDVQQPLSLSTSSRFTKV

SEQ ID NO: 15971 - protein, 22 aa, artificial
  peptide fold or domain or sub-domain
QMYDDSPGFKPSYYTNLNRIAR

SEQ ID NO: 15972 - protein, 24 aa, artificial
  peptide fold or domain or sub-domain
QNADGSFKNSIASGSFYGITFLHE

SEQ ID NO: 15973 - protein, 24 aa, artificial
  peptide fold or domain or sub-domain
QNAFADYKGKDPESLKSLPKFKTH

SEQ ID NO: 15974 - protein, 26 aa, artificial
  peptide fold or domain or sub-domain
QNALFNLIRDNSNNMTSVTSRFGNLL

SEQ ID NO: 15975 - protein, 21 aa, artificial
  peptide fold or domain or sub-domain
QNCKFYNCTHLHEPGCGVISE

SEQ ID NO: 15976 - protein, 20 aa, artificial
  peptide fold or domain or sub-domain
QNCSHEVKQVQDHHMIQYKW

SEQ ID NO: 15977 - protein, 24 aa, artificial
  peptide fold or domain or sub-domain
QNDNDNDNEDAAALLQQTPYAQPA

SEQ ID NO: 15978 - protein, 23 aa, artificial
  peptide fold or domain or sub-domain
QNEFPCKGESLAALKTNVLLGQH

SEQ ID NO: 15979 - protein, 25 aa, artificial
  peptide fold or domain or sub-domain
QNGAFFSSDCVYAVHFDDELCMLKA

SEQ ID NO: 15980 - protein, 27 aa, artificial
  peptide fold or domain or sub-domain
QNGDYQDYWRTFRAAFAAWTQDQLTGM

SEQ ID NO: 15981 - protein, 24 aa, artificial
  peptide fold or domain or sub-domain
QNGNCTPGTAAQPFPGTGEHWNPT

SEQ ID NO: 15982 - protein, 27 aa, artificial
  peptide fold or domain or sub-domain
QNGQMRLFDLVKEYHFTLAYLVWVGYV

SEQ ID NO: 15983 - protein, 29 aa, artificial
  peptide fold or domain or sub-domain
QNIIAARERINEVLVSVGLSNINNNVSFL

SEQ ID NO: 15984 - protein, 22 aa, artificial
  peptide fold or domain or sub-domain
QNISADELKKLKTKGYSRDNVI

SEQ ID NO: 15985 - protein, 29 aa, artificial
  peptide fold or domain or sub-domain
QNITPEGLENIGRAVMCVAKKEGLDGHRN

SEQ ID NO: 15986 - protein, 24 aa, artificial
  peptide fold or domain or sub-domain
QNKFGFKGVALGSLKGNAAYKTQA

SEQ ID NO: 15987 - protein, 22 aa, artificial
  peptide fold or domain or sub-domain
QNKYKGNHFQDERNFIDPLYFK

SEQ ID NO: 15988 - protein, 25 aa, artificial
  peptide fold or domain or sub-domain
QNLISQSTGISQSYISQFLLHGYVM

SEQ ID NO: 15989 - protein, 27 aa, artificial
  peptide fold or domain or sub-domain
QNLLSTFLQRSEMKEDQVKPVSILLLA

SEQ ID NO: 15990 - protein, 28 aa, artificial
  peptide fold or domain or sub-domain
QNNIRLTKLNNPDYVSMNPEDATKDFLG

SEQ ID NO: 15991 - protein, 25 aa, artificial
  peptide fold or domain or sub-domain
QNNMRPYPYKPCPTVAASFQSNFIH

SEQ ID NO: 15992 - protein, 26 aa, artificial
  peptide fold or domain or sub-domain
QNNMVMILRREHGWSKSRSVSHMQNE

SEQ ID NO: 15993 - protein, 29 aa, artificial
  peptide fold or domain or sub-domain
QNPNSPYSGVISIVMDSYKRLLANQEVTF

SEQ ID NO: 15994 - protein, 27 aa, artificial
  peptide fold or domain or sub-domain
QNQIVTAATLKQDESQLLSEQDCLLRE

SEQ ID NO: 15995 - protein, 27 aa, artificial
  peptide fold or domain or sub-domain
QNQRMGALVHTADNYPLLLTVAFLCSA

SEQ ID NO: 15996 - protein, 22 aa, artificial
  peptide fold or domain or sub-domain
QNRGVRGGSGEKNGIFENMLAG

SEQ ID NO: 15997 - protein, 22 aa, artificial
  peptide fold or domain or sub-domain
QNRKKGNFGGTLSKDSIPESFL

SEQ ID NO: 15998 - protein, 24 aa, artificial
  peptide fold or domain or sub-domain
QNRNIRYYDAFGIREIPGQGFHYE

SEQ ID NO: 15999 - protein, 22 aa, artificial
  peptide fold or domain or sub-domain
QNRYMRNTNSNNSKNYIKESFI

SEQ ID NO: 16000 - protein, 27 aa, artificial
  peptide fold or domain or sub-domain
QNSTDRFQGSSWDNDPLIDACGNPNPP

SEQ ID NO: 16001 - protein, 24 aa, artificial
  peptide fold or domain or sub-domain
QNTFYDIVAEFGPMEHTQAVDYVK

SEQ ID NO: 16002 - protein, 23 aa, artificial
  peptide fold or domain or sub-domain
QNTLLNSNGTINKTAFEKAKAKF

SEQ ID NO: 16003 - protein, 29 aa, artificial
  peptide fold or domain or sub-domain
QNTTIKNIKKNYKKNDKEYFKNNKIIISI

SEQ ID NO: 16004 - protein, 21 aa, artificial
  peptide fold or domain or sub-domain
QPAEIWKESGRWTVYTQDGTM

SEQ ID NO: 16005 - protein, 21 aa, artificial
  peptide fold or domain or sub-domain
QPAELWEKTGRWKAFLSEKLL

SEQ ID NO: 16006 - protein, 28 aa, artificial
  peptide fold or domain or sub-domain
QPCWRYWRARALAETHHLDAARTIYTRL

SEQ ID NO: 16007 - protein, 23 aa, artificial
  peptide fold or domain or sub-domain
QPDDPQDAEVAKMYKENYSLYLK

SEQ ID NO: 16008 - protein, 21 aa, artificial
  peptide fold or domain or sub-domain
QPEDMYQLIHSWEEERLQQFQ

SEQ ID NO: 16009 - protein, 28 aa, artificial
  peptide fold or domain or sub-domain
QPEELSNPQGNNQIFMNQRGSHGVVLAN

SEQ ID NO: 16010 - protein, 23 aa, artificial
  peptide fold or domain or sub-domain
QPEHPLRADLAEEYSKDRKKFCK

SEQ ID NO: 16011 - protein, 30 aa, artificial
  peptide fold or domain or sub-domain
QPETVGQLGTVLRNLKLARKLMEQYGTPNN

SEQ ID NO: 16012 - protein, 28 aa, artificial
  peptide fold or domain or sub-domain
QPEWIYWLGRSLHAGGRTTEGNALFEKI

SEQ ID NO: 16013 - protein, 28 aa, artificial
  peptide fold or domain or sub-domain
QPFAYVSNEWANEITVIDVASKSVVAKI

SEQ ID NO: 16014 - protein, 26 aa, artificial
  peptide fold or domain or sub-domain
QPFKSVLLAHPVLSEQVTAADLDEWL

SEQ ID NO: 16015 - protein, 23 aa, artificial
  peptide fold or domain or sub-domain
QPFPQGQPVTTVKVWKGQRDQLG

SEQ ID NO: 16016 - protein, 26 aa, artificial
  peptide fold or domain or sub-domain
QPFQEVIMDDTNIVSCLGQEMLEKLF

SEQ ID NO: 16017 - protein, 20 aa, artificial
  peptide fold or domain or sub-domain
QPGKLRQRLEEGREIALLSK

SEQ ID NO: 16018 - protein, 29 aa, artificial
  peptide fold or domain or sub-domain
QPIGEFKNWTYDSSTQQYYFHLFSPQQPD

SEQ ID NO: 16019 - protein, 28 aa, artificial
  peptide fold or domain or sub-domain
QPIKFGSLEIYENQRTVIYNGKNVDLSK

SEQ ID NO: 16020 - protein, 25 aa, artificial
  peptide fold or domain or sub-domain
QPISNSLIDSIVPANLRDTDKQWVG

SEQ ID NO: 16021 - protein, 22 aa, artificial
  peptide fold or domain or sub-domain
QPITESEYDALVEKGYKIRDRI

SEQ ID NO: 16022 - protein, 30 aa, artificial
  peptide fold or domain or sub-domain
QPIWTRKPSNVSKEEYEKFYMALSRDYRPP

SEQ ID NO: 16023 - protein, 27 aa, artificial
  peptide fold or domain or sub-domain
QPKGGHSQHNGLKNVTEHLNGCRGYPR

SEQ ID NO: 16024 - protein, 29 aa, artificial
  peptide fold or domain or sub-domain
QPKHKISDEVADAVNRGVFADTKDFKCYV

SEQ ID NO: 16025 - protein, 29 aa, artificial
  peptide fold or domain or sub-domain
QPKLPFAEADLAPVISARTVGLHYGKHHK

SEQ ID NO: 16026 - protein, 28 aa, artificial
  peptide fold or domain or sub-domain
QPMFVNREGEQVARFADMPNERRVGYAW

SEQ ID NO: 16027 - protein, 29 aa, artificial
  peptide fold or domain or sub-domain
QPMHGVFLRCISLNENKSLEEWATEFVPH

SEQ ID NO: 16028 - protein, 25 aa, artificial
  peptide fold or domain or sub-domain
QPNDLESIFGGSAWQYDDKSDQYYL

SEQ ID NO: 16029 - protein, 23 aa, artificial
  peptide fold or domain or sub-domain
QPNSNLRIGYALRKRGDDGFHTY

SEQ ID NO: 16030 - protein, 25 aa, artificial
  peptide fold or domain or sub-domain
QPPFYGKDEQNILFIREHNLQQYLN

SEQ ID NO: 16031 - protein, 20 aa, artificial
  peptide fold or domain or sub-domain
QPPLGIRWTPSADAFTISPL

SEQ ID NO: 16032 - protein, 30 aa, artificial
  peptide fold or domain or sub-domain
QPQVASARRGAVRMPDKFESESDAFFARTR

SEQ ID NO: 16033 - protein, 30 aa, artificial
  peptide fold or domain or sub-domain
QPQVFDLDAHPWSDKLVWELHMYHMSEDQD

SEQ ID NO: 16034 - protein, 22 aa, artificial
  peptide fold or domain or sub-domain
QPSENLISYFNNCTVNPKESIL

SEQ ID NO: 16035 - protein, 28 aa, artificial
  peptide fold or domain or sub-domain
QPSRGQARKTIASNAITINGEKQSDPEY

SEQ ID NO: 16036 - protein, 28 aa, artificial
  peptide fold or domain or sub-domain
QPTAIIAKTFKGRGITGVEDKESWHGKP

SEQ ID NO: 16037 - protein, 28 aa, artificial
  peptide fold or domain or sub-domain
QPTLIEVKTIIGYGSPNKSASAASHGAP

SEQ ID NO: 16038 - protein, 25 aa, artificial
  peptide fold or domain or sub-domain
QPVQSEILETNVPEYLRSPDGMWFG

SEQ ID NO: 16039 - protein, 25 aa, artificial
  peptide fold or domain or sub-domain
QPVRSASLDGAIPANLRGAGGNWYA

SEQ ID NO: 16040 - protein, 23 aa, artificial
  peptide fold or domain or sub-domain
QPVVIESASGAIIKDISGREFID

SEQ ID NO: 16041 - protein, 26 aa, artificial
  peptide fold or domain or sub-domain
QPWALQHPHSHHLSSTDFPELGGGHA

SEQ ID NO: 16042 - protein, 26 aa, artificial
  peptide fold or domain or sub-domain
QPWSSMIPHEHSFLPSSYRGKDLQEN

SEQ ID NO: 16043 - protein, 24 aa, artificial
  peptide fold or domain or sub-domain
QQALLSIIKEFGSKDDNSAQQFID

SEQ ID NO: 16044 - protein, 23 aa, artificial
  peptide fold or domain or sub-domain
QQARVILSRQSTREQVGAAFTAL

SEQ ID NO: 16045 - protein, 24 aa, artificial
  peptide fold or domain or sub-domain
QQEFHPDRFASKGDVDKRLALQTT

SEQ ID NO: 16046 - protein, 26 aa, artificial
  peptide fold or domain or sub-domain
QQEPILLLTRKVNPADRIAGFEAGAD

SEQ ID NO: 16047 - protein, 22 aa, artificial
  peptide fold or domain or sub-domain
QQERPIRNSVDELNNNVEAVSQ

SEQ ID NO: 16048 - protein, 28 aa, artificial
  peptide fold or domain or sub-domain
QQERPIRNSVDELNNNVEAVSQTSSSSF

SEQ ID NO: 16049 - protein, 22 aa, artificial
  peptide fold or domain or sub-domain
QQFAYERTDQNLAHYGREQPPA

SEQ ID NO: 16050 - protein, 22 aa, artificial
  peptide fold or domain or sub-domain
QQFDYKNFLTNMQRYKQVKAPE

SEQ ID NO: 16051 - protein, 21 aa, artificial
  peptide fold or domain or sub-domain
QQFLQQYYQTLMTNKMGLIQF

SEQ ID NO: 16052 - protein, 24 aa, artificial
  peptide fold or domain or sub-domain
QQFRAKGVLAGVDGQGTPIFLESH

SEQ ID NO: 16053 - protein, 28 aa, artificial
  peptide fold or domain or sub-domain
QQFVHFDSDTGVFQADSPFGVPTAEYWN

SEQ ID NO: 16054 - protein, 23 aa, artificial
  peptide fold or domain or sub-domain
QQGPSRKPRGGAYESYKFIPALE

SEQ ID NO: 16055 - protein, 22 aa, artificial
  peptide fold or domain or sub-domain
QQICEYVVESDSIGDIEKSKIS

SEQ ID NO: 16056 - protein, 30 aa, artificial
  peptide fold or domain or sub-domain
QQIFGAGLDVIENEPNIQADHPILKQERCV

SEQ ID NO: 16057 - protein, 29 aa, artificial
  peptide fold or domain or sub-domain
QQILTLATLGGMNTSVVDVAEALVRAGAL

SEQ ID NO: 16058 - protein, 20 aa, artificial
  peptide fold or domain or sub-domain
QQKNIIKALTTKSSSDVFDL

SEQ ID NO: 16059 - protein, 30 aa, artificial
  peptide fold or domain or sub-domain
QQKYLVVTCNYEARKLGVKKLMNVRDAKEK

SEQ ID NO: 16060 - protein, 25 aa, artificial
  peptide fold or domain or sub-domain
QQLSEQLQALPDWTKDNVKSTLTQI

SEQ ID NO: 16061 - protein, 24 aa, artificial
  peptide fold or domain or sub-domain
QQMFRFFQGVQLAFLVQSPKFAAH

SEQ ID NO: 16062 - protein, 23 aa, artificial
  peptide fold or domain or sub-domain
QQNAIRTNGSSTAREASAANQEL

SEQ ID NO: 16063 - protein, 23 aa, artificial
  peptide fold or domain or sub-domain
QQNFPFRDMPFEELGASKKFHAH

SEQ ID NO: 16064 - protein, 25 aa, artificial
  peptide fold or domain or sub-domain
QQNIPAPATQTPITQTGTPTIEESQ

SEQ ID NO: 16065 - protein, 24 aa, artificial
  peptide fold or domain or sub-domain
QQNLGDVLAKIGKWEEAATVYQKA

SEQ ID NO: 16066 - protein, 27 aa, artificial
  peptide fold or domain or sub-domain
QQPKYATLNAAKDFYSSGKTVTAPVYT

SEQ ID NO: 16067 - protein, 24 aa, artificial
  peptide fold or domain or sub-domain
QQPVVIDEFTTTDPHHVVHVALAD

SEQ ID NO: 16068 - protein, 24 aa, artificial
  peptide fold or domain or sub-domain
QQQFHPDKFATQADTARRYAMEYA

SEQ ID NO: 16069 - protein, 27 aa, artificial
  peptide fold or domain or sub-domain
QQQMIEHLEQLHDDHPRMALAKRMIQN

SEQ ID NO: 16070 - protein, 24 aa, artificial
  peptide fold or domain or sub-domain
QQRLRDGIEVEDATWDKLRALARE

SEQ ID NO: 16071 - protein, 21 aa, artificial
  peptide fold or domain or sub-domain
QQRPLNAPSVKIDLGKNAFLK

SEQ ID NO: 16072 - protein, 27 aa, artificial
  peptide fold or domain or sub-domain
QQRQAILRYLKRDNPEKYYWTIQKLGL

SEQ ID NO: 16073 - protein, 20 aa, artificial
  peptide fold or domain or sub-domain
QQSLAVSNMGARSKGQCPEP

SEQ ID NO: 16074 - protein, 29 aa, artificial
  peptide fold or domain or sub-domain
QQSYHGNSIAAMSISSNLARKVPFTGFMY

SEQ ID NO: 16075 - protein, 24 aa, artificial
  peptide fold or domain or sub-domain
QQVDEHDRTFEGDDIRDIVDSFLA

SEQ ID NO: 16076 - protein, 26 aa, artificial
  peptide fold or domain or sub-domain
QQWRAQSPHSHSRTPENYPTKNLVGN

SEQ ID NO: 16077 - protein, 22 aa, artificial
  peptide fold or domain or sub-domain
QQYDYRSPRLNTLRYGRTTPPS

SEQ ID NO: 16078 - protein, 28 aa, artificial
  peptide fold or domain or sub-domain
QQYRARIVDPIKGVLPDDVVSSINEQLS

SEQ ID NO: 16079 - protein, 23 aa, artificial
  peptide fold or domain or sub-domain
QRAKNTLMTRFSLREDEAYRMLQ

SEQ ID NO: 16080 - protein, 23 aa, artificial
  peptide fold or domain or sub-domain
QRASALLQMNAPVAEAVKNADAL

SEQ ID NO: 16081 - protein, 24 aa, artificial
  peptide fold or domain or sub-domain
QRAVHPDKFANDTEQQKLLSVQRT

SEQ ID NO: 16082 - protein, 21 aa, artificial
  peptide fold or domain or sub-domain
QRAVTAVIKHKSFDPDTYNND

SEQ ID NO: 16083 - protein, 21 aa, artificial
  peptide fold or domain or sub-domain
QRCKVSLVDAKGTRFSKEGKI

SEQ ID NO: 16084 - protein, 25 aa, artificial
  peptide fold or domain or sub-domain
QRDLELLAQKNVCPSHQIHLAALAA

SEQ ID NO: 16085 - protein, 24 aa, artificial
  peptide fold or domain or sub-domain
QREDHILNTRIPLGNPIPAIPEIQ

SEQ ID NO: 16086 - protein, 24 aa, artificial
  peptide fold or domain or sub-domain
QRELHPDKYSTRGDGVVDLARELS

SEQ ID NO: 16087 - protein, 21 aa, artificial
  peptide fold or domain or sub-domain
QREPPAPPELPMERMKASWKM

SEQ ID NO: 16088 - protein, 27 aa, artificial
  peptide fold or domain or sub-domain
QREVFQAHVASLQKPAHVKESIVQGKL

SEQ ID NO: 16089 - protein, 25 aa, artificial
  peptide fold or domain or sub-domain
QREVVDTTGLNQSHLSQHLNKGTPM

SEQ ID NO: 16090 - protein, 30 aa, artificial
  peptide fold or domain or sub-domain
QREWKERFGIDVNNLHIWEDLKKGYMSRYR

SEQ ID NO: 16091 - protein, 26 aa, artificial
  peptide fold or domain or sub-domain
QRFDEGLDPVLEVLGGKGASLVTMTD

SEQ ID NO: 16092 - protein, 23 aa, artificial
  peptide fold or domain or sub-domain
QRFFDSLALSLLCIMGNPKVKAH

SEQ ID NO: 16093 - protein, 24 aa, artificial
  peptide fold or domain or sub-domain
QRFIARNFLDTLSTDLQSQWYVDC

SEQ ID NO: 16094 - protein, 29 aa, artificial
  peptide fold or domain or sub-domain
QRGYVGLIWPHSGEIFPTSSSLQQELITN

SEQ ID NO: 16095 - protein, 28 aa, artificial
  peptide fold or domain or sub-domain
QRHLDGIRNDLSEQVSAAMVNEINQQLE

SEQ ID NO: 16096 - protein, 24 aa, artificial
  peptide fold or domain or sub-domain
QRIDWFIQRVQENQKMQEEESEKQ

SEQ ID NO: 16097 - protein, 29 aa, artificial
  peptide fold or domain or sub-domain
QRIDYLRQAIVQSSSEMDTQDLEKRLARF

SEQ ID NO: 16098 - protein, 28 aa, artificial
  peptide fold or domain or sub-domain
QRIEQIAESIDLPVEQLEPYGRYTAKVP

SEQ ID NO: 16099 - protein, 29 aa, artificial
  peptide fold or domain or sub-domain
QRIEQVRRLWAGERLSFPGPGGDPVSVVT

SEQ ID NO: 16100 - protein, 21 aa, artificial
  peptide fold or domain or sub-domain
QRIQPYKNQNIMFTVEELSQV

SEQ ID NO: 16101 - protein, 24 aa, artificial
  peptide fold or domain or sub-domain
QRKFPQMAGLSPAELRTSRQMHAH

SEQ ID NO: 16102 - protein, 23 aa, artificial
  peptide fold or domain or sub-domain
QRKLAEAAGITPASVNQYLRGIN

SEQ ID NO: 16103 - protein, 29 aa, artificial
  peptide fold or domain or sub-domain
QRLREGDVERLAPIVEELAEREGLPNHAE

SEQ ID NO: 16104 - protein, 25 aa, artificial
  peptide fold or domain or sub-domain
QRLRHSVFAEEMGAHVSGPAGLDVD

SEQ ID NO: 16105 - protein, 24 aa, artificial
  peptide fold or domain or sub-domain
QRLVHPDFFSQRSQTEKDFSEKHS

SEQ ID NO: 16106 - protein, 21 aa, artificial
  peptide fold or domain or sub-domain
QRNLGGNPGRGSSREALKAGS

SEQ ID NO: 16107 - protein, 27 aa, artificial
  peptide fold or domain or sub-domain
QRNVEQQLATLLNQQQWQKADLLTERL

SEQ ID NO: 16108 - protein, 22 aa, artificial
  peptide fold or domain or sub-domain
QRNYLSDLAGADRWRDFLAVQP

SEQ ID NO: 16109 - protein, 28 aa, artificial
  peptide fold or domain or sub-domain
QRPDSRTQDFVEAFRREYGQPPTSYAAA

SEQ ID NO: 16110 - protein, 24 aa, artificial
  peptide fold or domain or sub-domain
QRQYHPDKFASGSQAEQLAAVQQS

SEQ ID NO: 16111 - protein, 23 aa, artificial
  peptide fold or domain or sub-domain
QRRAETGPEDAGWWTAAGAPTDG

SEQ ID NO: 16112 - protein, 21 aa, artificial
  peptide fold or domain or sub-domain
QRRALIALEDKSNFIEADSRC

SEQ ID NO: 16113 - protein, 27 aa, artificial
  peptide fold or domain or sub-domain
QRRKKYLKYLRRTDWDSYCLVLSKLGL

SEQ ID NO: 16114 - protein, 28 aa, artificial
  peptide fold or domain or sub-domain
QRRYGDTFDELLGDAQSVGLDVDRDDVG

SEQ ID NO: 16115 - protein, 23 aa, artificial
  peptide fold or domain or sub-domain
QRSEREWREMLTDQEYAVGFQEG

SEQ ID NO: 16116 - protein, 27 aa, artificial
  peptide fold or domain or sub-domain
QRSGVGAKTDLNSIGVDQRIELAGVGK

SEQ ID NO: 16117 - protein, 27 aa, artificial
  peptide fold or domain or sub-domain
QRSGVGNAELLAEFDIPLVHELPGVGE

SEQ ID NO: 16118 - protein, 29 aa, artificial
  peptide fold or domain or sub-domain
QRSLCDYLSFYKLKELNSLVKDTIMRTDF

SEQ ID NO: 16119 - protein, 23 aa, artificial
  peptide fold or domain or sub-domain
QRTPEEWRAVLSPEQFRILREKG

SEQ ID NO: 16120 - protein, 30 aa, artificial
  peptide fold or domain or sub-domain
QRVEIKKSDLVNYNPIAEKHVNGTMTLAEL

SEQ ID NO: 16121 - protein, 29 aa, artificial
  peptide fold or domain or sub-domain
QRVLGEELIRILLEGPEEELKKTTYTQPA

SEQ ID NO: 16122 - protein, 27 aa, artificial
  peptide fold or domain or sub-domain
QRVPPLPNWEPPFFQLGTNKSANGIIE

SEQ ID NO: 16123 - protein, 30 aa, artificial
  peptide fold or domain or sub-domain
QRVTFPESAVVAYSPVTKGRGEAGMTLAEI

SEQ ID NO: 16124 - protein, 30 aa, artificial
  peptide fold or domain or sub-domain
QRVYPLRECTVDKVFGHTKSQGGLISLTFA

SEQ ID NO: 16125 - protein, 26 aa, artificial
  peptide fold or domain or sub-domain
QRWASEATYRNMTAEQALRRGLGHHT

SEQ ID NO: 16126 - protein, 26 aa, artificial
  peptide fold or domain or sub-domain
QRWDAQEPHMHGYTLKHFPGKDLKMN

SEQ ID NO: 16127 - protein, 26 aa, artificial
  peptide fold or domain or sub-domain
QRWDHQTPHRHKFLPERYPDKGFDDN

SEQ ID NO: 16128 - protein, 26 aa, artificial
  peptide fold or domain or sub-domain
QRWDTQYPHKHFQPPLVFHQLLEGEN

SEQ ID NO: 16129 - protein, 26 aa, artificial
  peptide fold or domain or sub-domain
QRWEGTFPHVPNITPRAYPKADLESN

SEQ ID NO: 16130 - protein, 24 aa, artificial
  peptide fold or domain or sub-domain
QRWMCQTCEQCKKGDNQLCSQFIG

SEQ ID NO: 16131 - protein, 26 aa, artificial
  peptide fold or domain or sub-domain
QRWNVQTPHGHSYTPAQYPGILGNHN

SEQ ID NO: 16132 - protein, 26 aa, artificial
  peptide fold or domain or sub-domain
QRWSAETPHKPQFTFTSEPHAQLEEN

SEQ ID NO: 16133 - protein, 24 aa, artificial
  peptide fold or domain or sub-domain
QRYFTAFMDTPLNELPANKRFQAH

SEQ ID NO: 16134 - protein, 25 aa, artificial
  peptide fold or domain or sub-domain
QRYIYLSGTDRVVRAKLGRSGVHCM

SEQ ID NO: 16135 - protein, 21 aa, artificial
  peptide fold or domain or sub-domain
QRYVSRVKVHELYNPRSFDND

SEQ ID NO: 16136 - protein, 25 aa, artificial
  peptide fold or domain or sub-domain
QSCELSPSKLEKNEDVNTNLTHLLN

SEQ ID NO: 16137 - protein, 20 aa, artificial
  peptide fold or domain or sub-domain
QSCHGADATGQRRPDFDSGG

SEQ ID NO: 16138 - protein, 29 aa, artificial
  peptide fold or domain or sub-domain
QSCSANNTRLSDVSVGSSCDGGGGYMCWD

SEQ ID NO: 16139 - protein, 27 aa, artificial
  peptide fold or domain or sub-domain
QSDAADRVAELFLDPGQRERIPRVYQK

SEQ ID NO: 16140 - protein, 27 aa, artificial
  peptide fold or domain or sub-domain
QSDIESEQENLYKILGKKCELYELYQI

SEQ ID NO: 16141 - protein, 27 aa, artificial
  peptide fold or domain or sub-domain
QSEAAAIISERLQLIPAKKRLLRFISK

SEQ ID NO: 16142 - protein, 29 aa, artificial
  peptide fold or domain or sub-domain
QSEFGGSAWELDAATGQYYYHAFLKEQPD

SEQ ID NO: 16143 - protein, 27 aa, artificial
  peptide fold or domain or sub-domain
QSEITDSFVEFPGLKEHEEIIRRLHAA

SEQ ID NO: 16144 - protein, 26 aa, artificial
  peptide fold or domain or sub-domain
QSENYHLSMLTVEDVNILLNNTITAQ

SEQ ID NO: 16145 - protein, 27 aa, artificial
  peptide fold or domain or sub-domain
QSEVQAAARTLFPRMSERRHMLDVFTN

SEQ ID NO: 16146 - protein, 26 aa, artificial
  peptide fold or domain or sub-domain
QSFDPKTLYSLPLNIVLVNSIALAYF

SEQ ID NO: 16147 - protein, 27 aa, artificial
  peptide fold or domain or sub-domain
QSFITYASPAGMPNWGTSGELSAEQVD

SEQ ID NO: 16148 - protein, 25 aa, artificial
  peptide fold or domain or sub-domain
QSFTSNGVTQKVPSHLISDDKNWFL

SEQ ID NO: 16149 - protein, 20 aa, artificial
  peptide fold or domain or sub-domain
QSGDDLGRALDLGRVTVNTL

SEQ ID NO: 16150 - protein, 29 aa, artificial
  peptide fold or domain or sub-domain
QSGLVDFQLKENQQRVCLETPDGQRNVEV

SEQ ID NO: 16151 - protein, 21 aa, artificial
  peptide fold or domain or sub-domain
QSGSTELKPSARITVNFRGQD

SEQ ID NO: 16152 - protein, 29 aa, artificial
  peptide fold or domain or sub-domain
QSIASIHQRMLSSPDNRSSSELEAIVSQT

SEQ ID NO: 16153 - protein, 28 aa, artificial
  peptide fold or domain or sub-domain
QSIGANFAFQHFPLAEVARRMRGFGFTE

SEQ ID NO: 16154 - protein, 28 aa, artificial
  peptide fold or domain or sub-domain
QSIQVGTVLLNRKTFEVTIGEQTVTLPL

SEQ ID NO: 16155 - protein, 30 aa, artificial
  peptide fold or domain or sub-domain
QSITSETLDHRLGFPTGHLKTLSGVSSRFV

SEQ ID NO: 16156 - protein, 24 aa, artificial
  peptide fold or domain or sub-domain
QSKFKAFKGLAVSALKGNPNAEKH

SEQ ID NO: 16157 - protein, 24 aa, artificial
  peptide fold or domain or sub-domain
QSKLHPDKFMMATPEERKLSEEHS

SEQ ID NO: 16158 - protein, 29 aa, artificial
  peptide fold or domain or sub-domain
QSLDALSDTRTLDKSWTLLHFIVETIENQ

SEQ ID NO: 16159 - protein, 29 aa, artificial
  peptide fold or domain or sub-domain
QSLDLLLDTKSTDRKMTLLHYIALIVKEK

SEQ ID NO: 16160 - protein, 23 aa, artificial
  peptide fold or domain or sub-domain
QSLEHGAAFMNAYATHQELNYDL

SEQ ID NO: 16161 - protein, 23 aa, artificial
  peptide fold or domain or sub-domain
QSLFQTLGLLGSNTLPTMEKIGR

SEQ ID NO: 16162 - protein, 30 aa, artificial
  peptide fold or domain or sub-domain
QSLGELFANRREWLMGKDWVEANPNANTFP

SEQ ID NO: 16163 - protein, 26 aa, artificial
  peptide fold or domain or sub-domain
QSLKGTSEWATSLENLLEDPEGVKRF

SEQ ID NO: 16164 - protein, 26 aa, artificial
  peptide fold or domain or sub-domain
QSLKKIEDCIRAGQHGRALMEACNEF

SEQ ID NO: 16165 - protein, 27 aa, artificial
  peptide fold or domain or sub-domain
QSLLAQHFESLGHTKASANAMALSIIA

SEQ ID NO: 16166 - protein, 23 aa, artificial
  peptide fold or domain or sub-domain
QSLSLSTSNSNLEVINSQYVYQF

SEQ ID NO: 16167 - protein, 29 aa, artificial
  peptide fold or domain or sub-domain
QSLTEEGLRNLGPYVATMAEIEGLDAHKR

SEQ ID NO: 16168 - protein, 27 aa, artificial
  peptide fold or domain or sub-domain
QSLYKEKLLLSGFSEERSKELALLVSS

SEQ ID NO: 16169 - protein, 24 aa, artificial
  peptide fold or domain or sub-domain
QSMIHPDKFAQKSEHEKAIALEWS

SEQ ID NO: 16170 - protein, 24 aa, artificial
  peptide fold or domain or sub-domain
QSMLNMLSEDEALQGMEKLLQGLT

SEQ ID NO: 16171 - protein, 26 aa, artificial
  peptide fold or domain or sub-domain
QSNINLKNALMKGAPVQTIVECWDYM

SEQ ID NO: 16172 - protein, 22 aa, artificial
  peptide fold or domain or sub-domain
QSPFGLAKTLGISNDEARDYIE

SEQ ID NO: 16173 - protein, 29 aa, artificial
  peptide fold or domain or sub-domain
QSPGQSVEQQYLQPIAAGASTTFKQDLQH

SEQ ID NO: 16174 - protein, 27 aa, artificial
  peptide fold or domain or sub-domain
QSQVSKIAKQAGVADGTIYLYFKNKED

SEQ ID NO: 16175 - protein, 24 aa, artificial
  peptide fold or domain or sub-domain
QSRAHPDRHAHASDAERRVAMQWA

SEQ ID NO: 16176 - protein, 27 aa, artificial
  peptide fold or domain or sub-domain
QSREIGIILRELYNIVLDNPEMNTKEK

SEQ ID NO: 16177 - protein, 22 aa, artificial
  peptide fold or domain or sub-domain
QSRFVNELARREDWRGLLAFSP

SEQ ID NO: 16178 - protein, 24 aa, artificial
  peptide fold or domain or sub-domain
QSRLARIAAQAEDADLAAVSEGLE

SEQ ID NO: 16179 - protein, 27 aa, artificial
  peptide fold or domain or sub-domain
QSRVAAELIGAGVPTAQARRLATFAVA

SEQ ID NO: 16180 - protein, 29 aa, artificial
  peptide fold or domain or sub-domain
QSSGADVVFTPPSYGDDGMLSTLILPNGE

SEQ ID NO: 16181 - protein, 24 aa, artificial
  peptide fold or domain or sub-domain
QSSSCHDCEWCARGDEQLCSAVGC

SEQ ID NO: 16182 - protein, 30 aa, artificial
  peptide fold or domain or sub-domain
QSTCKEAIAYCESVRDYVSREIFEKILDDT

SEQ ID NO: 16183 - protein, 24 aa, artificial
  peptide fold or domain or sub-domain
QSTIAKIVAKHREIQEDKAVELVK

SEQ ID NO: 16184 - protein, 30 aa, artificial
  peptide fold or domain or sub-domain
QSTYPDFYFKITNSEHKTELKEKFQRMCDK

SEQ ID NO: 16185 - protein, 20 aa, artificial
  peptide fold or domain or sub-domain
QSVAMVAESIGESEATVRQR

SEQ ID NO: 16186 - protein, 20 aa, artificial
  peptide fold or domain or sub-domain
QSVECAGLGGQNKTWTSGRL

SEQ ID NO: 16187 - protein, 24 aa, artificial
  peptide fold or domain or sub-domain
QSVEKHRATLDPSNPRDFIDVYLL

SEQ ID NO: 16188 - protein, 24 aa, artificial
  peptide fold or domain or sub-domain
QSVHVLRLSEDLVKDHAQDYLGRT

SEQ ID NO: 16189 - protein, 22 aa, artificial
  peptide fold or domain or sub-domain
QSVINTEGDLISLKSCKNRADI

SEQ ID NO: 16190 - protein, 20 aa, artificial
  peptide fold or domain or sub-domain
QSVKEIVKVTDLTEDNIKIK

SEQ ID NO: 16191 - protein, 27 aa, artificial
  peptide fold or domain or sub-domain
QSVVIVDTNNPSELPEAINDADIQGII

SEQ ID NO: 16192 - protein, 26 aa, artificial
  peptide fold or domain or sub-domain
QSWFFAKARHLYRRKQRCLDVHGAIS

SEQ ID NO: 16193 - protein, 26 aa, artificial
  peptide fold or domain or sub-domain
QSWSSMTPHWHQRTTEYYPNGGLTRN

SEQ ID NO: 16194 - protein, 28 aa, artificial
  peptide fold or domain or sub-domain
QSYANQMTIDLAKEKGLPVPEHGFTDSL

SEQ ID NO: 16195 - protein, 28 aa, artificial
  peptide fold or domain or sub-domain
QSYDMVYNELLKSGLNETQAKELAAHKV

SEQ ID NO: 16196 - protein, 24 aa, artificial
  peptide fold or domain or sub-domain
QSYFKKFDGKKPDELKGDAQLATH

SEQ ID NO: 16197 - protein, 24 aa, artificial
  peptide fold or domain or sub-domain
QSYFPKLKNKSLGELKDTADIKAQ

SEQ ID NO: 16198 - protein, 24 aa, artificial
  peptide fold or domain or sub-domain
QSYSCLDCRQCKNDNETYCRKQLD

SEQ ID NO: 16199 - protein, 23 aa, artificial
  peptide fold or domain or sub-domain
QSYVEGEVARLEACSPVDFARQN

SEQ ID NO: 16200 - protein, 23 aa, artificial
  peptide fold or domain or sub-domain
QSYVETVVKELALGHRDEFIGQT

SEQ ID NO: 16201 - protein, 20 aa, artificial
  peptide fold or domain or sub-domain
QTADEIKEYREKKLNSPWRD

SEQ ID NO: 16202 - protein, 29 aa, artificial
  peptide fold or domain or sub-domain
QTCAIDGNTVVNASVQSGCIGGSSYMCSN

SEQ ID NO: 16203 - protein, 24 aa, artificial
  peptide fold or domain or sub-domain
QTCESWSLQELANKLNSVHIPFRC

SEQ ID NO: 16204 - protein, 23 aa, artificial
  peptide fold or domain or sub-domain
QTDVLQESKGAFRLLMEQLLKGE

SEQ ID NO: 16205 - protein, 29 aa, artificial
  peptide fold or domain or sub-domain
QTEEIVGDDRVEGLRFKDGTSIEADLVVM

SEQ ID NO: 16206 - protein, 29 aa, artificial
  peptide fold or domain or sub-domain
QTEFQFFDGKVVRDGMTLRDLHGSLAGSV

SEQ ID NO: 16207 - protein, 21 aa, artificial
  peptide fold or domain or sub-domain
QTEIARAFGFKGVRAVQHHLD

SEQ ID NO: 16208 - protein, 25 aa, artificial
  peptide fold or domain or sub-domain
QTEKQLKELGEKIPGPVKEKVEAKL

SEQ ID NO: 16209 - protein, 29 aa, artificial
  peptide fold or domain or sub-domain
QTELFVKNYDGKIAELSNGERIPTASLIW

SEQ ID NO: 16210 - protein, 20 aa, artificial
  peptide fold or domain or sub-domain
QTENLSRIGNGDLLKFFHDI

SEQ ID NO: 16211 - protein, 20 aa, artificial
  peptide fold or domain or sub-domain
QTGQSIRRLALTYQVTENRI

SEQ ID NO: 16212 - protein, 27 aa, artificial
  peptide fold or domain or sub-domain
QTGYVPVTKAAYELTQKQGFYDKNPGT

SEQ ID NO: 16213 - protein, 22 aa, artificial
  peptide fold or domain or sub-domain
QTHFEVQMLNGSLQELELRSRF

SEQ ID NO: 16214 - protein, 29 aa, artificial
  peptide fold or domain or sub-domain
QTIATLHSRSLQGGDAGAQQQLEQQIAET

SEQ ID NO: 16215 - protein, 22 aa, artificial
  peptide fold or domain or sub-domain
QTIAYGNVPKQQMHPFFSSEIF

SEQ ID NO: 16216 - protein, 29 aa, artificial
  peptide fold or domain or sub-domain
QTIDATVRLLTEESVSEDTPFFRYRDAQS

SEQ ID NO: 16217 - protein, 21 aa, artificial
  peptide fold or domain or sub-domain
QTIFSERLESSAGSVSQVREV

SEQ ID NO: 16218 - protein, 28 aa, artificial
  peptide fold or domain or sub-domain
QTIFYNDWVKEGKWCESEIFTDFTQMLS

SEQ ID NO: 16219 - protein, 26 aa, artificial
  peptide fold or domain or sub-domain
QTIISLCKKLDTSYGLNAGESLYEIR

SEQ ID NO: 16220 - protein, 23 aa, artificial
  peptide fold or domain or sub-domain
QTIKKRFDNIKIENTVQNRASYR

SEQ ID NO: 16221 - protein, 21 aa, artificial
  peptide fold or domain or sub-domain
QTIVSQEVDGISGGSTQVREV

SEQ ID NO: 16222 - protein, 30 aa, artificial
  peptide fold or domain or sub-domain
QTKLWPLSIKSMHGVGAKTYEKLHSLGIET

SEQ ID NO: 16223 - protein, 21 aa, artificial
  peptide fold or domain or sub-domain
QTLCSVDIDSPVGGIVQIKAV

SEQ ID NO: 16224 - protein, 25 aa, artificial
  peptide fold or domain or sub-domain
QTLPRTEWMKKVESDYWDEETQIGR

SEQ ID NO: 16225 - protein, 21 aa, artificial
  peptide fold or domain or sub-domain
QTLQQVANEVGLTRERIRQLQ

SEQ ID NO: 16226 - protein, 30 aa, artificial
  peptide fold or domain or sub-domain
QTLRDLVTAKPQEYLGESIITKFGSSKELP

SEQ ID NO: 16227 - protein, 22 aa, artificial
  peptide fold or domain or sub-domain
QTLSDTVQSTPSNTATTFAFQR

SEQ ID NO: 16228 - protein, 27 aa, artificial
  peptide fold or domain or sub-domain
QTLVAYTSFDREQVSNWLQTMPLKKLL

SEQ ID NO: 16229 - protein, 23 aa, artificial
  peptide fold or domain or sub-domain
QTLVPTLLKALSDCTRYTDDALE

SEQ ID NO: 16230 - protein, 29 aa, artificial
  peptide fold or domain or sub-domain
QTLVVISPDDAHFDARRFAGLRFAVRRCG

SEQ ID NO: 16231 - protein, 26 aa, artificial
  peptide fold or domain or sub-domain
QTNITLQNQINRGANMTTINELRTNL

SEQ ID NO: 16232 - protein, 20 aa, artificial
  peptide fold or domain or sub-domain
QTQDPWANEEGSKFLLAFIP

SEQ ID NO: 16233 - protein, 29 aa, artificial
  peptide fold or domain or sub-domain
QTQTGVATVDIEAVRNGQWPETRQLKCYM

SEQ ID NO: 16234 - protein, 25 aa, artificial
  peptide fold or domain or sub-domain
QTRIEGILKGKLSNEKKRTMEEKRN

SEQ ID NO: 16235 - protein, 27 aa, artificial
  peptide fold or domain or sub-domain
QTRLVAGATDLGVLHNKGKAFMDDVMS

SEQ ID NO: 16236 - protein, 25 aa, artificial
  peptide fold or domain or sub-domain
QTRPHPVSRGYMNGVYYPSWLVYKD

SEQ ID NO: 16237 - protein, 26 aa, artificial
  peptide fold or domain or sub-domain
QTSDLIVQEFNHDITDIPGITLAVWN

SEQ ID NO: 16238 - protein, 29 aa, artificial
  peptide fold or domain or sub-domain
QTSLESFVQHEDRVVCQLQTPDGAEELET

SEQ ID NO: 16239 - protein, 25 aa, artificial
  peptide fold or domain or sub-domain
QTTAAIHKQNNQRFGCLMKESIQKY

SEQ ID NO: 16240 - protein, 30 aa, artificial
  peptide fold or domain or sub-domain
QTTPDATARTVRRKQRPPHTGHIDAGHYVS

SEQ ID NO: 16241 - protein, 25 aa, artificial
  peptide fold or domain or sub-domain
QTVDSDALNQAVPRDLRDSEGRWFG

SEQ ID NO: 16242 - protein, 20 aa, artificial
  peptide fold or domain or sub-domain
QTVEEVAKYREERLDPPGRK

SEQ ID NO: 16243 - protein, 30 aa, artificial
  peptide fold or domain or sub-domain
QTVGAVATASYEAREYGVESAQAISAALER

SEQ ID NO: 16244 - protein, 24 aa, artificial
  peptide fold or domain or sub-domain
QTVRSQAYFSMGDFVGAEQAAREA

SEQ ID NO: 16245 - protein, 20 aa, artificial
  peptide fold or domain or sub-domain
QTWADVVRSIWSFHTYTRGW

SEQ ID NO: 16246 - protein, 25 aa, artificial
  peptide fold or domain or sub-domain
QTWRAVGKAAEIVKEEWEKINLVKS

SEQ ID NO: 16247 - protein, 29 aa, artificial
  peptide fold or domain or sub-domain
QTYLLVPEDFQDEARGLVCGHPSVTVVAG

SEQ ID NO: 16248 - protein, 25 aa, artificial
  peptide fold or domain or sub-domain
QVAAIVFSQSGRLHEYSSSQMEKII

SEQ ID NO: 16249 - protein, 26 aa, artificial
  peptide fold or domain or sub-domain
QVAEAFTPIELDGVQFFLLPYFEPFA

SEQ ID NO: 16250 - protein, 28 aa, artificial
  peptide fold or domain or sub-domain
QVCELCQQSIEPERLLALPYTALCASCA

SEQ ID NO: 16251 - protein, 26 aa, artificial
  peptide fold or domain or sub-domain
QVCRCSECGKIFRNPRYFSVHKKIHT

SEQ ID NO: 16252 - protein, 21 aa, artificial
  peptide fold or domain or sub-domain
QVDNNYNGISNLYVRLPRGKG

SEQ ID NO: 16253 - protein, 23 aa, artificial
  peptide fold or domain or sub-domain
QVELEHYEKIEGSTLSLDAKANR

SEQ ID NO: 16254 - protein, 27 aa, artificial
  peptide fold or domain or sub-domain
QVEVKMEGDSVLLEVDGEEVLRLRQVS

SEQ ID NO: 16255 - protein, 30 aa, artificial
  peptide fold or domain or sub-domain
QVFDSNLLKLSPAGHAQQACRNTGAYGGAD

SEQ ID NO: 16256 - protein, 20 aa, artificial
  peptide fold or domain or sub-domain
QVFSRGDLISVKGEYVGTRG

SEQ ID NO: 16257 - protein, 24 aa, artificial
  peptide fold or domain or sub-domain
QVGDFIAAAHGLLRDPLSGEKRKA

SEQ ID NO: 16258 - protein, 24 aa, artificial
  peptide fold or domain or sub-domain
QVGKCEPNSVAPTGGAPGNFLSAG

SEQ ID NO: 16259 - protein, 30 aa, artificial
  peptide fold or domain or sub-domain
QVGVFTNDVKLAWKCIKEIEAGGVLINEGP

SEQ ID NO: 16260 - protein, 29 aa, artificial
  peptide fold or domain or sub-domain
QVHDPAVKKEDREDTATHCDSALKALQSA

SEQ ID NO: 16261 - protein, 23 aa, artificial
  peptide fold or domain or sub-domain
QVIAFAIDSEGERAIRYDKVSEL

SEQ ID NO: 16262 - protein, 30 aa, artificial
  peptide fold or domain or sub-domain
QVIHKVTNSDIIHKVIDFYIEEHPLNLYNL

SEQ ID NO: 16263 - protein, 27 aa, artificial
  peptide fold or domain or sub-domain
QVIHVDPNAVAAGDGTVENPYNALQLA

SEQ ID NO: 16264 - protein, 22 aa, artificial
  peptide fold or domain or sub-domain
QVIPDENLAKYQYLPDSGDTNH

SEQ ID NO: 16265 - protein, 29 aa, artificial
  peptide fold or domain or sub-domain
QVIVALGTEDQYFAESELAHHKDIIRVNG

SEQ ID NO: 16266 - protein, 20 aa, artificial
  peptide fold or domain or sub-domain
QVIVNGTLVIENEKFGGILA

SEQ ID NO: 16267 - protein, 29 aa, artificial
  peptide fold or domain or sub-domain
QVIWRLTEREREVSVSDIAKAIGHSLSTV

SEQ ID NO: 16268 - protein, 30 aa, artificial
  peptide fold or domain or sub-domain
QVKNLSQLVKRIDADLYNHFQNEHVEFIQF

SEQ ID NO: 16269 - protein, 25 aa, artificial
  peptide fold or domain or sub-domain
QVLLLVVSETGLVYTFSTPKFEPIV

SEQ ID NO: 16270 - protein, 22 aa, artificial
  peptide fold or domain or sub-domain
QVLPGPASKSYGVEVAAMAGLP

SEQ ID NO: 16271 - protein, 28 aa, artificial
  peptide fold or domain or sub-domain
QVLVVNDGADFITDDGVDVRLFSTVRDC

SEQ ID NO: 16272 - protein, 27 aa, artificial
  peptide fold or domain or sub-domain
QVMVVYNQDIKEPVPFETRVEKTADLL

SEQ ID NO: 16273 - protein, 22 aa, artificial
  peptide fold or domain or sub-domain
QVNGIHVELCTHKEVVHLLRTA

SEQ ID NO: 16274 - protein, 20 aa, artificial
  peptide fold or domain or sub-domain
QVNGVDLEGLRHSEVVALIQ

SEQ ID NO: 16275 - protein, 25 aa, artificial
  peptide fold or domain or sub-domain
QVNGYRYQKRKELPSLIADNNAPSI

SEQ ID NO: 16276 - protein, 23 aa, artificial
  peptide fold or domain or sub-domain
QVPAEFGYGPRGLFEIVPPNTDL

SEQ ID NO: 16277 - protein, 30 aa, artificial
  peptide fold or domain or sub-domain
QVPAYSAAKHKGQPLYKLAREGKETPVKTR

SEQ ID NO: 16278 - protein, 23 aa, artificial
  peptide fold or domain or sub-domain
QVPPGFEIMGHTGGSSAAVIADR

SEQ ID NO: 16279 - protein, 21 aa, artificial
  peptide fold or domain or sub-domain
QVPPTHTLTPEQARHFYRERR

SEQ ID NO: 16280 - protein, 22 aa, artificial
  peptide fold or domain or sub-domain
QVQDVSVQEMTRFEAWNLVKSL

SEQ ID NO: 16281 - protein, 22 aa, artificial
  peptide fold or domain or sub-domain
QVQIQLSRNNFKIFSWHLHPFL

SEQ ID NO: 16282 - protein, 23 aa, artificial
  peptide fold or domain or sub-domain
QVQPAGKPKMDIASFLNGVGRTL

SEQ ID NO: 16283 - protein, 30 aa, artificial
  peptide fold or domain or sub-domain
QVRAFDLSAAAVERAVAAGCLAAASVAEAV

SEQ ID NO: 16284 - protein, 23 aa, artificial
  peptide fold or domain or sub-domain
QVRTETGPPVRALDYFAAFGEYL

SEQ ID NO: 16285 - protein, 30 aa, artificial
  peptide fold or domain or sub-domain
QVRTNADLEKMVDTSDEWIVTRTGIRERHI

SEQ ID NO: 16286 - protein, 28 aa, artificial
  peptide fold or domain or sub-domain
QVSANNADAYLMQTELGKGGMFGFPRVQ

SEQ ID NO: 16287 - protein, 29 aa, artificial
  peptide fold or domain or sub-domain
QVSELEGDGRVRCVRLDDGTVLPCTAVVI

SEQ ID NO: 16288 - protein, 26 aa, artificial
  peptide fold or domain or sub-domain
QVSELHLAPTEISRENLRRENFRSAD

SEQ ID NO: 16289 - protein, 27 aa, artificial
  peptide fold or domain or sub-domain
QVSGIGDPALLKSINVPVVVDLPAVGQ

SEQ ID NO: 16290 - protein, 27 aa, artificial
  peptide fold or domain or sub-domain
QVSGVGPKEVLKKSGVELIKHSPEVGQ

SEQ ID NO: 16291 - protein, 20 aa, artificial
  peptide fold or domain or sub-domain
QVSSTEVRRTFEKSGDLYQK

SEQ ID NO: 16292 - protein, 30 aa, artificial
  peptide fold or domain or sub-domain
QVTASDIAEVVLATSGLDIDRRNVLLDEEI

SEQ ID NO: 16293 - protein, 23 aa, artificial
  peptide fold or domain or sub-domain
QVTDPYSLSLAMNSEFSQVVDLN

SEQ ID NO: 16294 - protein, 30 aa, artificial
  peptide fold or domain or sub-domain
QVTGGSIAVKDAATFEGWISRYGTDKIILG

SEQ ID NO: 16295 - protein, 30 aa, artificial
  peptide fold or domain or sub-domain
QVTHLHPGVTRADVERNTGFELKWHADVAV

SEQ ID NO: 16296 - protein, 27 aa, artificial
  peptide fold or domain or sub-domain
QVTMEDGLVKVISPIEDTPAFRAGVKT

SEQ ID NO: 16297 - protein, 20 aa, artificial
  peptide fold or domain or sub-domain
QVTNTEQIVNLVLKQEIDLG

SEQ ID NO: 16298 - protein, 29 aa, artificial
  peptide fold or domain or sub-domain
QVVDGGIIHHISGMRLSVDNAFRHGLIGE

SEQ ID NO: 16299 - protein, 30 aa, artificial
  peptide fold or domain or sub-domain
QVVENSELAVTLGVDPAWMLQATGIAERRF

SEQ ID NO: 16300 - protein, 30 aa, artificial
  peptide fold or domain or sub-domain
QVVGYNLIPDRTAALVEAGGTAADSIAKAV

SEQ ID NO: 16301 - protein, 24 aa, artificial
  peptide fold or domain or sub-domain
QVVNVYADGKEVEDRQSAPYRGRT

SEQ ID NO: 16302 - protein, 27 aa, artificial
  peptide fold or domain or sub-domain
QVVSTTTGQHKGVLGRVMTTTKTIEGV

SEQ ID NO: 16303 - protein, 29 aa, artificial
  peptide fold or domain or sub-domain
QVVTGGIIDLKRGKKVSVTLASTLGLVDV

SEQ ID NO: 16304 - protein, 29 aa, artificial
  peptide fold or domain or sub-domain
QVVTGGLYDPEVKCRRTIQDALEMGWLDE

SEQ ID NO: 16305 - protein, 30 aa, artificial
  peptide fold or domain or sub-domain
QVVVTDLSATRLSKAKEIGADLVLQISKES

SEQ ID NO: 16306 - protein, 25 aa, artificial
  peptide fold or domain or sub-domain
QVWMYCRLYRKLERFHRPELLDAAK

SEQ ID NO: 16307 - protein, 24 aa, artificial
  peptide fold or domain or sub-domain
QVYATYSYNDGENYYFMNTQTYDM

SEQ ID NO: 16308 - protein, 27 aa, artificial
  peptide fold or domain or sub-domain
QVYRMNRKELSGILDENEKHERLVELN

SEQ ID NO: 16309 - protein, 30 aa, artificial
  peptide fold or domain or sub-domain
QWDQPLNTYIPELAFDSDPTLASRLTLIDL

SEQ ID NO: 16310 - protein, 21 aa, artificial
  peptide fold or domain or sub-domain
QWGCAGAPAAASSSEALQKCQ

SEQ ID NO: 16311 - protein, 27 aa, artificial
  peptide fold or domain or sub-domain
QWIGAIYPGDADTRYSPSYQGRCHIST

SEQ ID NO: 16312 - protein, 27 aa, artificial
  peptide fold or domain or sub-domain
QWIGRIDPEDGGTEYLSSLQERLKVTT

SEQ ID NO: 16313 - protein, 22 aa, artificial
  peptide fold or domain or sub-domain
QWQDVENLKKASNVSMPQSLIN

SEQ ID NO: 16314 - protein, 27 aa, artificial
  peptide fold or domain or sub-domain
QWVGRINPNNGNTDYTSSFKGRFTITK

SEQ ID NO: 16315 - protein, 30 aa, artificial
  peptide fold or domain or sub-domain
QWVHSPPMQHHDFMNNDAARKRYWARSLGG

SEQ ID NO: 16316 - protein, 24 aa, artificial
  peptide fold or domain or sub-domain
QYAAGLSPPEQWDALPFAAKAQII

SEQ ID NO: 16317 - protein, 26 aa, artificial
  peptide fold or domain or sub-domain
QYEGIEEFVKNNPKYSFMMELNNLKL

SEQ ID NO: 16318 - protein, 22 aa, artificial
  peptide fold or domain or sub-domain
QYEVLRERGHSPSEAFNETVEE

SEQ ID NO: 16319 - protein, 30 aa, artificial
  peptide fold or domain or sub-domain
QYGLIEANKSLRIYGAHMITSRNEASYALN

SEQ ID NO: 16320 - protein, 24 aa, artificial
  peptide fold or domain or sub-domain
QYIKEILYQGIQNCELRSNLDIDA

SEQ ID NO: 16321 - protein, 20 aa, artificial
  peptide fold or domain or sub-domain
QYISKNDLYNTDNKEYSLVK

SEQ ID NO: 16322 - protein, 28 aa, artificial
  peptide fold or domain or sub-domain
QYKFVVNLIKAVDNNNVQMFSDECFDFN

SEQ ID NO: 16323 - protein, 23 aa, artificial
  peptide fold or domain or sub-domain
QYKGFSIPDHPELLEDTEWQLGT

SEQ ID NO: 16324 - protein, 23 aa, artificial
  peptide fold or domain or sub-domain
QYKGIRVDEHPEYLHDKVWATAT

SEQ ID NO: 16325 - protein, 24 aa, artificial
  peptide fold or domain or sub-domain
QYLDAELTPHDGRRLTRTQAVDDP

SEQ ID NO: 16326 - protein, 24 aa, artificial
  peptide fold or domain or sub-domain
QYLDVNVSAFGYLKNQIPRLDNFL

SEQ ID NO: 16327 - protein, 21 aa, artificial
  peptide fold or domain or sub-domain
QYLMDENGEKYDSWDKYFEMK

SEQ ID NO: 16328 - protein, 29 aa, artificial
  peptide fold or domain or sub-domain
QYLMLRGKVLSVVTAGGEERRELGSADEL

SEQ ID NO: 16329 - protein, 22 aa, artificial
  peptide fold or domain or sub-domain
QYLQNGGKVADIYAKPASLRDS

SEQ ID NO: 16330 - protein, 28 aa, artificial
  peptide fold or domain or sub-domain
QYLSYNSLRGEAEPCGAWYWEKETTDLR

SEQ ID NO: 16331 - protein, 29 aa, artificial
  peptide fold or domain or sub-domain
QYLTGGLIEPDTPGRVPLDEALQRGTVDA

SEQ ID NO: 16332 - protein, 29 aa, artificial
  peptide fold or domain or sub-domain
QYLTGGLVDPEVHGRISTEEAIRKGFIDG

SEQ ID NO: 16333 - protein, 21 aa, artificial
  peptide fold or domain or sub-domain
QYRDILEGNRTLHEHARLPIP

SEQ ID NO: 16334 - protein, 21 aa, artificial
  peptide fold or domain or sub-domain
QYRLLVEEGPAHLRRFQVGVY

SEQ ID NO: 16335 - protein, 24 aa, artificial
  peptide fold or domain or sub-domain
QYSAIQIGGQRAYAVARAGGQLDL

SEQ ID NO: 16336 - protein, 23 aa, artificial
  peptide fold or domain or sub-domain
QYSIADELGITQGAVGHYLNGRN

SEQ ID NO: 16337 - protein, 21 aa, artificial
  peptide fold or domain or sub-domain
QYTVVATHGAAHSQQFEVECA

SEQ ID NO: 16338 - protein, 21 aa, artificial
  peptide fold or domain or sub-domain
QYVLIHADGPPHQRSYSVEAH

SEQ ID NO: 16339 - protein, 28 aa, artificial
  peptide fold or domain or sub-domain
QYVNKLTSKVRQTGKTLLEVCLEDSLIL

SEQ ID NO: 16340 - protein, 26 aa, artificial
  peptide fold or domain or sub-domain
QYVSELNTQTDGMVQNIKGSQLSREL

SEQ ID NO: 16341 - protein, 27 aa, artificial
  peptide fold or domain or sub-domain
QYYAVLCAYGHKYVDFHDAEEIVQDSL

SEQ ID NO: 16342 - protein, 29 aa, artificial
  peptide fold or domain or sub-domain
RAADPHVDAARLPPRVTLVEVDAGELAAA

SEQ ID NO: 16343 - protein, 28 aa, artificial
  peptide fold or domain or sub-domain
RAADYPDEAAGSMGRQLLAFVKGTEMAL

SEQ ID NO: 16344 - protein, 27 aa, artificial
  peptide fold or domain or sub-domain
RAAELEAACGQGESAAVGVLVEHLPTL

SEQ ID NO: 16345 - protein, 24 aa, artificial
  peptide fold or domain or sub-domain
RAASGGIVSVPRDTWTQIERLADR

SEQ ID NO: 16346 - protein, 23 aa, artificial
  peptide fold or domain or sub-domain
RAASGQLAELFGTVALDSDRFIR

SEQ ID NO: 16347 - protein, 28 aa, artificial
  peptide fold or domain or sub-domain
RAASGQLAELFGTVALDSDRFIRVLGFS

SEQ ID NO: 16348 - protein, 22 aa, artificial
  peptide fold or domain or sub-domain
RAAVARDHLERFDLEYNPDSEV

SEQ ID NO: 16349 - protein, 27 aa, artificial
  peptide fold or domain or sub-domain
RADKQGVNITGAAVRQPDLEVPDLKTL

SEQ ID NO: 16350 - protein, 22 aa, artificial
  peptide fold or domain or sub-domain
RADTEIIDNDTGERSYFGDSAG

SEQ ID NO: 16351 - protein, 22 aa, artificial
  peptide fold or domain or sub-domain
RADWIRFLGKRSAWNEVESEFP

SEQ ID NO: 16352 - protein, 22 aa, artificial
  peptide fold or domain or sub-domain
RADWLTYLARKHDWNHFMDYYQ

SEQ ID NO: 16353 - protein, 30 aa, artificial
  peptide fold or domain or sub-domain
RADWRDPGVTTSVDAWSGRVRAGLHRATGG

SEQ ID NO: 16354 - protein, 22 aa, artificial
  peptide fold or domain or sub-domain
RADYLNALIATKNWPYLIAYQT

SEQ ID NO: 16355 - protein, 26 aa, artificial
  peptide fold or domain or sub-domain
RAEADLAVALEENNIPFEYQLGEGAF

SEQ ID NO: 16356 - protein, 27 aa, artificial
  peptide fold or domain or sub-domain
RAEAGRQVSELFPNLRGHYDLAFSEPS

SEQ ID NO: 16357 - protein, 27 aa, artificial
  peptide fold or domain or sub-domain
RAEARADALEALTELGLSKADAERSIR

SEQ ID NO: 16358 - protein, 25 aa, artificial
  peptide fold or domain or sub-domain
RAEHHGNIEFRRLSKENGGTNLSEL

SEQ ID NO: 16359 - protein, 21 aa, artificial
  peptide fold or domain or sub-domain
RAEHYAADIVTDPYDVLKTQE

SEQ ID NO: 16360 - protein, 21 aa, artificial
  peptide fold or domain or sub-domain
RAEIAQRLGFRSPNAAEEHLK

SEQ ID NO: 16361 - protein, 26 aa, artificial
  peptide fold or domain or sub-domain
RAELHKGVMVVDEFEGTPVREAREEI

SEQ ID NO: 16362 - protein, 25 aa, artificial
  peptide fold or domain or sub-domain
RAENKPKGYKPIPDADVQNKLFPNS

SEQ ID NO: 16363 - protein, 25 aa, artificial
  peptide fold or domain or sub-domain
RAEPWGRWAETLAAETWETETMDLN

SEQ ID NO: 16364 - protein, 26 aa, artificial
  peptide fold or domain or sub-domain
RAEQEAQLRRERGSVMGEEQVRRFVD

SEQ ID NO: 16365 - protein, 28 aa, artificial
  peptide fold or domain or sub-domain
RAETVSYKDFVENDGWVNSKTNGKMRLE

SEQ ID NO: 16366 - protein, 28 aa, artificial
  peptide fold or domain or sub-domain
RAEVIAYEDFIQFNGENGAKEAGKWRLE

SEQ ID NO: 16367 - protein, 28 aa, artificial
  peptide fold or domain or sub-domain
RAEVISFEDLVKAGSQAAAREMGLLRLE

SEQ ID NO: 16368 - protein, 28 aa, artificial
  peptide fold or domain or sub-domain
RAFGFRRLYKNDRGRSNVERLQSEPIGN

SEQ ID NO: 16369 - protein, 26 aa, artificial
  peptide fold or domain or sub-domain
RAFQCPHCPLTFKWSSHFQYHLRQHT

SEQ ID NO: 16370 - protein, 25 aa, artificial
  peptide fold or domain or sub-domain
RAFQILFEGDQRGVDVLTVLADWIR

SEQ ID NO: 16371 - protein, 27 aa, artificial
  peptide fold or domain or sub-domain
RAFSVCGTIEYMAPEIVEGGESGHDKV

SEQ ID NO: 16372 - protein, 22 aa, artificial
  peptide fold or domain or sub-domain
RAFTSGMIIRKLRQRDGIDIDT

SEQ ID NO: 16373 - protein, 22 aa, artificial
  peptide fold or domain or sub-domain
RAFTSTIVRKRIYKNEGIKVDS

SEQ ID NO: 16374 - protein, 25 aa, artificial
  peptide fold or domain or sub-domain
RAGATGAASGARELAALRRASGPDL

SEQ ID NO: 16375 - protein, 24 aa, artificial
  peptide fold or domain or sub-domain
RAGWERKGYRNSKGEPVANLGLWK

SEQ ID NO: 16376 - protein, 29 aa, artificial
  peptide fold or domain or sub-domain
RAHALEKGFTINEYTIRPLGVTGVAGEPL

SEQ ID NO: 16377 - protein, 25 aa, artificial
  peptide fold or domain or sub-domain
RAHVLYTHARKLLPALAPASSEERY

SEQ ID NO: 16378 - protein, 22 aa, artificial
  peptide fold or domain or sub-domain
RAIADYEKTSGSEMALSTGDVV

SEQ ID NO: 16379 - protein, 28 aa, artificial
  peptide fold or domain or sub-domain
RAIARASSEEAVQKLKRAGADEVVSPYI

SEQ ID NO: 16380 - protein, 28 aa, artificial
  peptide fold or domain or sub-domain
RAIFDSDINKIGQEVEGIEIKPVSELEK

SEQ ID NO: 16381 - protein, 29 aa, artificial
  peptide fold or domain or sub-domain
RAIFVQKQSSRSNAELIARAIGAEVIVLD

SEQ ID NO: 16382 - protein, 27 aa, artificial
  peptide fold or domain or sub-domain
RAINFGIEGESYTMVNGVPTFTEDVLK

SEQ ID NO: 16383 - protein, 29 aa, artificial
  peptide fold or domain or sub-domain
RAIPELTKLLNDEDQVVVNKAAVMVHQLS

SEQ ID NO: 16384 - protein, 29 aa, artificial
  peptide fold or domain or sub-domain
RAIPELTMLMKDQDNEVVHKAVILMQNIA

SEQ ID NO: 16385 - protein, 22 aa, artificial
  peptide fold or domain or sub-domain
RAITAEELKKKKEGTYSDTSNI

SEQ ID NO: 16386 - protein, 30 aa, artificial
  peptide fold or domain or sub-domain
RAIYRTDAFWELGAPDESVDAIARRCPNTD

SEQ ID NO: 16387 - protein, 29 aa, artificial
  peptide fold or domain or sub-domain
RAKAEAAEFRYKYGYDMPCDVLAKRMANL

SEQ ID NO: 16388 - protein, 20 aa, artificial
  peptide fold or domain or sub-domain
RAKMRLMRRERSSEGYSLMK

SEQ ID NO: 16389 - protein, 23 aa, artificial
  peptide fold or domain or sub-domain
RAKNSNIKTFPRSCTVMEYKEAT

SEQ ID NO: 16390 - protein, 20 aa, artificial
  peptide fold or domain or sub-domain
RAKTRTQSSELANLYDKLVT

SEQ ID NO: 16391 - protein, 29 aa, artificial
  peptide fold or domain or sub-domain
RAKVIERDRRRAERAADALERTIVLHGDG

SEQ ID NO: 16392 - protein, 28 aa, artificial
  peptide fold or domain or sub-domain
RAKVISFSDFIFYKNFLTAKKYGKIKIE

SEQ ID NO: 16393 - protein, 27 aa, artificial
  peptide fold or domain or sub-domain
RAKVISGGTDLLVKMKHGVLAPEVLVS

SEQ ID NO: 16394 - protein, 24 aa, artificial
  peptide fold or domain or sub-domain
RALFYKDGKLFTDNNFLNPVSDDN

SEQ ID NO: 16395 - protein, 30 aa, artificial
  peptide fold or domain or sub-domain
RALPSAEIDARLGKPSGWLESASGVITRPV

SEQ ID NO: 16396 - protein, 25 aa, artificial
  peptide fold or domain or sub-domain
RALQILFQVDVGGADPGEAFRLMDE

SEQ ID NO: 16397 - protein, 26 aa, artificial
  peptide fold or domain or sub-domain
RALSRALGARYRTGDATPLDTYSATC

SEQ ID NO: 16398 - protein, 22 aa, artificial
  peptide fold or domain or sub-domain
RALWDHMYEEKRISKEELDKVY

SEQ ID NO: 16399 - protein, 23 aa, artificial
  peptide fold or domain or sub-domain
RALYNYMFQRLVEGNVKKDVEKI

SEQ ID NO: 16400 - protein, 25 aa, artificial
  peptide fold or domain or sub-domain
RAMEDALIAIKGGRIPPPSSLPSFE

SEQ ID NO: 16401 - protein, 26 aa, artificial
  peptide fold or domain or sub-domain
RAMHHAVYAQSVRNLGTPVFPRRLFD

SEQ ID NO: 16402 - protein, 30 aa, artificial
  peptide fold or domain or sub-domain
RAMLEPMTVRTLPGVGPATGDHLRRAGITT

SEQ ID NO: 16403 - protein, 25 aa, artificial
  peptide fold or domain or sub-domain
RAMQALYQMDITGELEPKVAVENTL

SEQ ID NO: 16404 - protein, 28 aa, artificial
  peptide fold or domain or sub-domain
RAMTDVGAELGLSPEDVLPWGTHRAKVS

SEQ ID NO: 16405 - protein, 24 aa, artificial
  peptide fold or domain or sub-domain
RANFTQIATKYDLKELHNAVGRLN

SEQ ID NO: 16406 - protein, 26 aa, artificial
  peptide fold or domain or sub-domain
RANGNVRTCEAEGSPAHVVAEFEQLL

SEQ ID NO: 16407 - protein, 29 aa, artificial
  peptide fold or domain or sub-domain
RANILNRVEQELLSGQMELSTAVEELTNI

SEQ ID NO: 16408 - protein, 24 aa, artificial
  peptide fold or domain or sub-domain
RAPGGDMRTAQAVAMGQYDRGSQF

SEQ ID NO: 16409 - protein, 24 aa, artificial
  peptide fold or domain or sub-domain
RAPGTDGMTAQALSRSSAEPQAFA

SEQ ID NO: 16410 - protein, 24 aa, artificial
  peptide fold or domain or sub-domain
RAPGTDQPTAEAIRKDFFEQAQRF

SEQ ID NO: 16411 - protein, 30 aa, artificial
  peptide fold or domain or sub-domain
RAPIYSALKQGGEPLYAKARRGEVVNAPVR

SEQ ID NO: 16412 - protein, 24 aa, artificial
  peptide fold or domain or sub-domain
RAQASDTLNINPAIWRNLERLAQS

SEQ ID NO: 16413 - protein, 28 aa, artificial
  peptide fold or domain or sub-domain
RAQEESFTGPAEPLEWESEAGETTLPYT

SEQ ID NO: 16414 - protein, 28 aa, artificial
  peptide fold or domain or sub-domain
RAQEEVRDLVTGKEMVEEIDLSKLLYIK

SEQ ID NO: 16415 - protein, 21 aa, artificial
  peptide fold or domain or sub-domain
RAQVEQDLAAPALSRANVLAA

SEQ ID NO: 16416 - protein, 28 aa, artificial
  peptide fold or domain or sub-domain
RAQVISYDEFIKYGNLNIIRKLGRIRSE

SEQ ID NO: 16417 - protein, 29 aa, artificial
  peptide fold or domain or sub-domain
RARFYLCGPEPMMQAITAGLIERGVPPFD

SEQ ID NO: 16418 - protein, 29 aa, artificial
  peptide fold or domain or sub-domain
RARKLAQQYYLVYQEPIPTAQLVQRVASV

SEQ ID NO: 16419 - protein, 29 aa, artificial
  peptide fold or domain or sub-domain
RARLEAQIYRLTYGEEISIEMLAKKICDI

SEQ ID NO: 16420 - protein, 20 aa, artificial
  peptide fold or domain or sub-domain
RARRAATRAFNAASPVLKKG

SEQ ID NO: 16421 - protein, 29 aa, artificial
  peptide fold or domain or sub-domain
RARSEAKNYKSTYGQPIPIKVLSQRIASY

SEQ ID NO: 16422 - protein, 28 aa, artificial
  peptide fold or domain or sub-domain
RARTVEMAAASADYKGWNRQDALEDYKQ

SEQ ID NO: 16423 - protein, 29 aa, artificial
  peptide fold or domain or sub-domain
RARVECQSHKLTVEDPVTVEYITRFIATL

SEQ ID NO: 16424 - protein, 26 aa, artificial
  peptide fold or domain or sub-domain
RASLYQALDKARAGEMAESEQCMIRA

SEQ ID NO: 16425 - protein, 21 aa, artificial
  peptide fold or domain or sub-domain
RASSMWDRANIFGEPTAETPM

SEQ ID NO: 16426 - protein, 27 aa, artificial
  peptide fold or domain or sub-domain
RASVRQLHRQAHMRGRDRDLGEMLRAT

SEQ ID NO: 16427 - protein, 30 aa, artificial
  peptide fold or domain or sub-domain
RASYKESREICDKLGDYVSKQLFDELLADE

SEQ ID NO: 16428 - protein, 29 aa, artificial
  peptide fold or domain or sub-domain
RATAASATGYPPEKIHVLTGEVEKNNGYT

SEQ ID NO: 16429 - protein, 21 aa, artificial
  peptide fold or domain or sub-domain
RATCSNGATVGDASSCAWFDV

SEQ ID NO: 16430 - protein, 27 aa, artificial
  peptide fold or domain or sub-domain
RATLNEVAERLNITKPALYNYFRSKEE

SEQ ID NO: 16431 - protein, 28 aa, artificial
  peptide fold or domain or sub-domain
RATSKDWKGVIRCNGETLRHLEQKGLLF

SEQ ID NO: 16432 - protein, 27 aa, artificial
  peptide fold or domain or sub-domain
RATTAEIAQRLGISEATVFSYFRGKRE

SEQ ID NO: 16433 - protein, 28 aa, artificial
  peptide fold or domain or sub-domain
RATWLHQALREGTRVQSVEQIREVASGA

SEQ ID NO: 16434 - protein, 20 aa, artificial
  peptide fold or domain or sub-domain
RAVDELTAEDFSEDLLESLI

SEQ ID NO: 16435 - protein, 25 aa, artificial
  peptide fold or domain or sub-domain
RAVGGSWLTPAEAIAGKDWPAVSDI

SEQ ID NO: 16436 - protein, 23 aa, artificial
  peptide fold or domain or sub-domain
RAVHDPTVIQVAKELGKTPAQVL

SEQ ID NO: 16437 - protein, 22 aa, artificial
  peptide fold or domain or sub-domain
RAVLRIRMGDYFDEEIVAAWAA

SEQ ID NO: 16438 - protein, 22 aa, artificial
  peptide fold or domain or sub-domain
RAVQNVVRRSGLPAHRLTGAIS

SEQ ID NO: 16439 - protein, 30 aa, artificial
  peptide fold or domain or sub-domain
RAVSEEDLCSGFYLRKEDIGKPRDASVVGR

SEQ ID NO: 16440 - protein, 26 aa, artificial
  peptide fold or domain or sub-domain
RAVSRHHAGEPIHKVHPHLRGLVEGR

SEQ ID NO: 16441 - protein, 30 aa, artificial
  peptide fold or domain or sub-domain
RAVTTAELATALGRDPQTVASRTGIRTRHW

SEQ ID NO: 16442 - protein, 30 aa, artificial
  peptide fold or domain or sub-domain
RAVVGTVAVKDPGLLARMLEAVGPDRLAVA

SEQ ID NO: 16443 - protein, 23 aa, artificial
  peptide fold or domain or sub-domain
RAWGPNWPYASNWGKGSQAGFVS

SEQ ID NO: 16444 - protein, 26 aa, artificial
  peptide fold or domain or sub-domain
RAYAFEALDEAENKNYDKAEEFLKKA

SEQ ID NO: 16445 - protein, 29 aa, artificial
  peptide fold or domain or sub-domain
RAYDPVALDEARRVFALDLHDGADALARL

SEQ ID NO: 16446 - protein, 24 aa, artificial
  peptide fold or domain or sub-domain
RAYNRSQDKADRLKEFGAEISTSI

SEQ ID NO: 16447 - protein, 26 aa, artificial
  peptide fold or domain or sub-domain
RAYWDPQDASAGPAGIGAAVNAGMFD

SEQ ID NO: 16448 - protein, 22 aa, artificial
  peptide fold or domain or sub-domain
RCAYGYYQDETTGRCEACRVCE

SEQ ID NO: 16449 - protein, 29 aa, artificial
  peptide fold or domain or sub-domain
RCCRTCTNIWRISGHRVGLELSRLPFSEV

SEQ ID NO: 16450 - protein, 25 aa, artificial
  peptide fold or domain or sub-domain
RCEMLVTRVEELMPGVCDTRLPEQG

SEQ ID NO: 16451 - protein, 26 aa, artificial
  peptide fold or domain or sub-domain
RCIVQDRYVVNASSPGPAVVEMQQHD

SEQ ID NO: 16452 - protein, 21 aa, artificial
  peptide fold or domain or sub-domain
RCLLAEGSRARALYGRGEVWE

SEQ ID NO: 16453 - protein, 30 aa, artificial
  peptide fold or domain or sub-domain
RCNDVVDKCSADCQECEESPAGDGFVCRDW

SEQ ID NO: 16454 - protein, 23 aa, artificial
  peptide fold or domain or sub-domain
RCPFRKGACEITRKTRRQCQACR

SEQ ID NO: 16455 - protein, 25 aa, artificial
  peptide fold or domain or sub-domain
RCPICAGRLELTPGALRCRQRHTFN

SEQ ID NO: 16456 - protein, 25 aa, artificial
  peptide fold or domain or sub-domain
RCPLCQQALLLNEKSYRCENNHSFD

SEQ ID NO: 16457 - protein, 25 aa, artificial
  peptide fold or domain or sub-domain
RCPLDGLPMEWDSHSLRCPNKHSFD

SEQ ID NO: 16458 - protein, 25 aa, artificial
  peptide fold or domain or sub-domain
RCPRCSGELESIHGSLCCSCGFSYL

SEQ ID NO: 16459 - protein, 22 aa, artificial
  peptide fold or domain or sub-domain
RCQPGMFCAAWALECTHCELLS

SEQ ID NO: 16460 - protein, 27 aa, artificial
  peptide fold or domain or sub-domain
RCRAVAQILFSGIGDISEDDRDKLLEA

SEQ ID NO: 16461 - protein, 22 aa, artificial
  peptide fold or domain or sub-domain
RCRDGFYKSVIDSTKYQCLRCK

SEQ ID NO: 16462 - protein, 28 aa, artificial
  peptide fold or domain or sub-domain
RCREEIHGLLGDGASITWNHLDQMPYTT

SEQ ID NO: 16463 - protein, 27 aa, artificial
  peptide fold or domain or sub-domain
RCREVELAVATMSASECHGAARELAAL

SEQ ID NO: 16464 - protein, 20 aa, artificial
  peptide fold or domain or sub-domain
RCSQGRISEIAGEETLRSDI

SEQ ID NO: 16465 - protein, 23 aa, artificial
  peptide fold or domain or sub-domain
RCSQGRISEIAGEETLRSDILFR

SEQ ID NO: 16466 - protein, 28 aa, artificial
  peptide fold or domain or sub-domain
RCSQGRISEIAGEETLRSDILFRELKLD

SEQ ID NO: 16467 - protein, 23 aa, artificial
  peptide fold or domain or sub-domain
RCSSDYAYGAGGFPAWGIQPNSV

SEQ ID NO: 16468 - protein, 22 aa, artificial
  peptide fold or domain or sub-domain
RCTADQLEILKVMGILPFSAPS

SEQ ID NO: 16469 - protein, 25 aa, artificial
  peptide fold or domain or sub-domain
RCVAGTWIAPRKLIAKSLFDEIAIN

SEQ ID NO: 16470 - protein, 29 aa, artificial
  peptide fold or domain or sub-domain
RCVRVVNPGDSAFHEGEHVARSEAARANA

SEQ ID NO: 16471 - protein, 30 aa, artificial
  peptide fold or domain or sub-domain
RCYSDDDKSKSVQQLTDDLKDTVRLDRDAA

SEQ ID NO: 16472 - protein, 21 aa, artificial
  peptide fold or domain or sub-domain
RDAAIYDFINAGLKGDMLALT

SEQ ID NO: 16473 - protein, 26 aa, artificial
  peptide fold or domain or sub-domain
RDAALAQRTWMDRQRFRPQQWSTRGQ

SEQ ID NO: 16474 - protein, 27 aa, artificial
  peptide fold or domain or sub-domain
RDAEVMRKIFSGAITDPTQHLKPIEAA

SEQ ID NO: 16475 - protein, 26 aa, artificial
  peptide fold or domain or sub-domain
RDALIKLNGGNQVTEQEVKDFMSNFQ

SEQ ID NO: 16476 - protein, 27 aa, artificial
  peptide fold or domain or sub-domain
RDALNTVLRHQGVPPARARRLATLIVA

SEQ ID NO: 16477 - protein, 21 aa, artificial
  peptide fold or domain or sub-domain
RDALTQLVNSNKANFLIKAAN

SEQ ID NO: 16478 - protein, 22 aa, artificial
  peptide fold or domain or sub-domain
RDAVLYKDNEVIGSSPSDADFL

SEQ ID NO: 16479 - protein, 29 aa, artificial
  peptide fold or domain or sub-domain
RDAYFADLQKQYADKTKEELEAAAIPVKV

SEQ ID NO: 16480 - protein, 25 aa, artificial
  peptide fold or domain or sub-domain
RDCIRRFIKGDAGIISEVASRITGS

SEQ ID NO: 16481 - protein, 21 aa, artificial
  peptide fold or domain or sub-domain
RDDFNGTKLNTTIWTARNNMT

SEQ ID NO: 16482 - protein, 29 aa, artificial
  peptide fold or domain or sub-domain
RDDLKKLLETECPQYIRKKGADVWFKELD

SEQ ID NO: 16483 - protein, 25 aa, artificial
  peptide fold or domain or sub-domain
RDDVRRFLCGHDDTVASLATRLAGS

SEQ ID NO: 16484 - protein, 28 aa, artificial
  peptide fold or domain or sub-domain
RDEINHLISLSMAEKIERGKYRLTPSGD

SEQ ID NO: 16485 - protein, 30 aa, artificial
  peptide fold or domain or sub-domain
RDEVDYLIEVKNSQIKDLPDDWIKVNNTKM

SEQ ID NO: 16486 - protein, 24 aa, artificial
  peptide fold or domain or sub-domain
RDFICHTKGITNPEMYVFIKRHIN

SEQ ID NO: 16487 - protein, 28 aa, artificial
  peptide fold or domain or sub-domain
RDFISFDLESGRFMAADSAAEITRRRWE

SEQ ID NO: 16488 - protein, 28 aa, artificial
  peptide fold or domain or sub-domain
RDFIYLDTERGIYIPTMNESQISTQRWN

SEQ ID NO: 16489 - protein, 24 aa, artificial
  peptide fold or domain or sub-domain
RDFQKQLKQYRDQADKALRIVIAG

SEQ ID NO: 16490 - protein, 28 aa, artificial
  peptide fold or domain or sub-domain
RDFTAFDKGTMTFTAAVPEAVPTKRKWE

SEQ ID NO: 16491 - protein, 30 aa, artificial
  peptide fold or domain or sub-domain
RDGEGYFIEVGGKEAHRVPPHYEHRKALKH

SEQ ID NO: 16492 - protein, 25 aa, artificial
  peptide fold or domain or sub-domain
RDGIKGHVAHLKEGGFVNGGEDFEE

SEQ ID NO: 16493 - protein, 25 aa, artificial
  peptide fold or domain or sub-domain
RDGLCGPVGDKRKGAFLAGIPGGEM

SEQ ID NO: 16494 - protein, 29 aa, artificial
  peptide fold or domain or sub-domain
RDGMAGELHAEYDDKSEEELESMGLRVRI

SEQ ID NO: 16495 - protein, 27 aa, artificial
  peptide fold or domain or sub-domain
RDHNIELSKLLYKMGQTLPTWLREDLQ

SEQ ID NO: 16496 - protein, 25 aa, artificial
  peptide fold or domain or sub-domain
RDHPEPERAGRGRRARVRRRLDEYV

SEQ ID NO: 16497 - protein, 29 aa, artificial
  peptide fold or domain or sub-domain
RDHTSDQLHEEFDAKDNQELESLNIEVSV

SEQ ID NO: 16498 - protein, 27 aa, artificial
  peptide fold or domain or sub-domain
RDIEARVVTFPLRDANGEVTQHEHTVY

SEQ ID NO: 16499 - protein, 28 aa, artificial
  peptide fold or domain or sub-domain
RDIEEILHEMGLSKDDYELYGRYMAKLS

SEQ ID NO: 16500 - protein, 22 aa, artificial
  peptide fold or domain or sub-domain
RDIKNDSNYVVKGNARLPVKWM

SEQ ID NO: 16501 - protein, 30 aa, artificial
  peptide fold or domain or sub-domain
RDIRVFVVGERAIAAIYRAENCPLTEEVAR

SEQ ID NO: 16502 - protein, 28 aa, artificial
  peptide fold or domain or sub-domain
RDISPIYPTSTATGLAYTRFNEVWTKLR

SEQ ID NO: 16503 - protein, 22 aa, artificial
  peptide fold or domain or sub-domain
RDIYQSDYYRKERGGMLPIRWM

SEQ ID NO: 16504 - protein, 22 aa, artificial
  peptide fold or domain or sub-domain
RDIYYHEYYKPAGKRLMPVRWM

SEQ ID NO: 16505 - protein, 25 aa, artificial
  peptide fold or domain or sub-domain
RDLARITELPQWSPLYDRYTVKEIR

SEQ ID NO: 16506 - protein, 28 aa, artificial
  peptide fold or domain or sub-domain
RDLDTALASLRAKGLAESEAAVLAPHLV

SEQ ID NO: 16507 - protein, 29 aa, artificial
  peptide fold or domain or sub-domain
RDLDTLRRLWRGESLSFPNGAGTPIDVRI

SEQ ID NO: 16508 - protein, 22 aa, artificial
  peptide fold or domain or sub-domain
RDLEDGQTYEMKSQGRVPVRWM

SEQ ID NO: 16509 - protein, 27 aa, artificial
  peptide fold or domain or sub-domain
RDLEVDGSGTGKNFQMKQAGLYHKSQV

SEQ ID NO: 16510 - protein, 29 aa, artificial
  peptide fold or domain or sub-domain
RDLEVMRKLWRGEAIERQDATGKTFTVKT

SEQ ID NO: 16511 - protein, 22 aa, artificial
  peptide fold or domain or sub-domain
RDLFDRDYYTSSVKTQLPLKWM

SEQ ID NO: 16512 - protein, 22 aa, artificial
  peptide fold or domain or sub-domain
RDLFPSDYHCLGDNENRPVKWM

SEQ ID NO: 16513 - protein, 30 aa, artificial
  peptide fold or domain or sub-domain
RDLFTPDLFKDRSWEDSALPIACGQTISQP

SEQ ID NO: 16514 - protein, 30 aa, artificial
  peptide fold or domain or sub-domain
RDLLTYMVEERLLAQCKDPLTTEDILGHLL

SEQ ID NO: 16515 - protein, 20 aa, artificial
  peptide fold or domain or sub-domain
RDLQTRDEQNEEKKRLLIKQ

SEQ ID NO: 16516 - protein, 27 aa, artificial
  peptide fold or domain or sub-domain
RDMEKRKESFTVKGDNGEKKTVEKIYY

SEQ ID NO: 16517 - protein, 25 aa, artificial
  peptide fold or domain or sub-domain
RDNCINRPNSGQEDADGDGLGDACD

SEQ ID NO: 16518 - protein, 20 aa, artificial
  peptide fold or domain or sub-domain
RDNPESFAASVEEDSALSLE

SEQ ID NO: 16519 - protein, 24 aa, artificial
  peptide fold or domain or sub-domain
RDNVALGSIKAGGMSKPEAYELAD

SEQ ID NO: 16520 - protein, 28 aa, artificial
  peptide fold or domain or sub-domain
RDRATLAGEMIRAGVDEEQRQALLAHRE

SEQ ID NO: 16521 - protein, 30 aa, artificial
  peptide fold or domain or sub-domain
RDRFRKFLLAYGIDDYISYYEAEEPMKNLT

SEQ ID NO: 16522 - protein, 20 aa, artificial
  peptide fold or domain or sub-domain
RDSALQKGNDRADVYGRLAW

SEQ ID NO: 16523 - protein, 26 aa, artificial
  peptide fold or domain or sub-domain
RDTHIRSEMLFGKDTHFNGAHDDELL

SEQ ID NO: 16524 - protein, 28 aa, artificial
  peptide fold or domain or sub-domain
RDTLISQAEAAERTGSEQLGLNLRRAAE

SEQ ID NO: 16525 - protein, 28 aa, artificial
  peptide fold or domain or sub-domain
RDTWRYWDARADLALGRLQEGQQALAEL

SEQ ID NO: 16526 - protein, 24 aa, artificial
  peptide fold or domain or sub-domain
RDVCRASVGTDADLTGILDREKLD

SEQ ID NO: 16527 - protein, 22 aa, artificial
  peptide fold or domain or sub-domain
RDVTAEDLEELDPGEYSANDKI

SEQ ID NO: 16528 - protein, 25 aa, artificial
  peptide fold or domain or sub-domain
RDVVRDYWRGTDGSLPAFAACLCGS

SEQ ID NO: 16529 - protein, 26 aa, artificial
  peptide fold or domain or sub-domain
RDWGAELERTPLFERETHFAGAHATE

SEQ ID NO: 16530 - protein, 30 aa, artificial
  peptide fold or domain or sub-domain
RDWHPENHISFRERGGPWPRHCVQNTPGAE

SEQ ID NO: 16531 - protein, 25 aa, artificial
  peptide fold or domain or sub-domain
RDWVRSFWRGDERVAPDLASGLLGS

SEQ ID NO: 16532 - protein, 27 aa, artificial
  peptide fold or domain or sub-domain
RDYEVCKAVLNGNTQAFAVLVAQYQKR

SEQ ID NO: 16533 - protein, 22 aa, artificial
  peptide fold or domain or sub-domain
RDYLAHLRDLLLVKLEAGAQVL

SEQ ID NO: 16534 - protein, 24 aa, artificial
  peptide fold or domain or sub-domain
RDYQARRGKIRFRREETKKIEYVN

SEQ ID NO: 16535 - protein, 22 aa, artificial
  peptide fold or domain or sub-domain
REAIAAKCTRDNALAVDPATQV

SEQ ID NO: 16536 - protein, 22 aa, artificial
  peptide fold or domain or sub-domain
REAIAATWQAHGWRSIDPQREV

SEQ ID NO: 16537 - protein, 22 aa, artificial
  peptide fold or domain or sub-domain
REAIAEKLKKQNNIEADPNKEI

SEQ ID NO: 16538 - protein, 22 aa, artificial
  peptide fold or domain or sub-domain
REAIAQKTERLYGYQPDADSDI

SEQ ID NO: 16539 - protein, 22 aa, artificial
  peptide fold or domain or sub-domain
REAISRYLYERFHIGYDPESEI

SEQ ID NO: 16540 - protein, 22 aa, artificial
  peptide fold or domain or sub-domain
REALAEKFRRENGLSVTPEETI

SEQ ID NO: 16541 - protein, 24 aa, artificial
  peptide fold or domain or sub-domain
REALERGVPLHSIIMESLTPWGER

SEQ ID NO: 16542 - protein, 22 aa, artificial
  peptide fold or domain or sub-domain
REAVAGYFGRCYGVEAPAEATI

SEQ ID NO: 16543 - protein, 25 aa, artificial
  peptide fold or domain or sub-domain
REAVPPIKCGSSVGIASPPAVWSPY

SEQ ID NO: 16544 - protein, 22 aa, artificial
  peptide fold or domain or sub-domain
REAVSAHQQRFYGLTPDPETEI

SEQ ID NO: 16545 - protein, 27 aa, artificial
  peptide fold or domain or sub-domain
RECFITRDALGEEAEHLPVSQRYWLRE

SEQ ID NO: 16546 - protein, 25 aa, artificial
  peptide fold or domain or sub-domain
REDHTRKVDTYEAFKEAVQEGFALA

SEQ ID NO: 16547 - protein, 22 aa, artificial
  peptide fold or domain or sub-domain
REEEGGMYTVQSGTRQIPIKWT

SEQ ID NO: 16548 - protein, 30 aa, artificial
  peptide fold or domain or sub-domain
REEFVPEDEMHRAYMDMPLPIGEGQTISAP

SEQ ID NO: 16549 - protein, 30 aa, artificial
  peptide fold or domain or sub-domain
REEFVPSARRSVAYSEMEIQTSEGRALWTP

SEQ ID NO: 16550 - protein, 22 aa, artificial
  peptide fold or domain or sub-domain
REEGLMKKHGYDRYAQQKEEHV

SEQ ID NO: 16551 - protein, 20 aa, artificial
  peptide fold or domain or sub-domain
REEIIEILENGAGNSMVLSA

SEQ ID NO: 16552 - protein, 25 aa, artificial
  peptide fold or domain or sub-domain
REEPRAPWIEQEGPEYWDRETQICK

SEQ ID NO: 16553 - protein, 23 aa, artificial
  peptide fold or domain or sub-domain
REESRWGMPHTRLDFPERDPAWN

SEQ ID NO: 16554 - protein, 23 aa, artificial
  peptide fold or domain or sub-domain
REESRYPGFYYRMDKNFVDEENW

SEQ ID NO: 16555 - protein, 27 aa, artificial
  peptide fold or domain or sub-domain
REEVGVILPHEADVLGLQLGAIGGVRE

SEQ ID NO: 16556 - protein, 20 aa, artificial
  peptide fold or domain or sub-domain
REFFDHDWAPFPGEKGRIVE

SEQ ID NO: 16557 - protein, 28 aa, artificial
  peptide fold or domain or sub-domain
REFIALDTDRWVYVHSVREAQLTEQKWN

SEQ ID NO: 16558 - protein, 21 aa, artificial
  peptide fold or domain or sub-domain
REFVRQYYTLLNQAPDMLHRF

SEQ ID NO: 16559 - protein, 27 aa, artificial
  peptide fold or domain or sub-domain
REGFVEQNEIPEELPLLPKESRYWLRE

SEQ ID NO: 16560 - protein, 29 aa, artificial
  peptide fold or domain or sub-domain
REGLATEIMDLGFNRDLNSFTQTYGGRQT

SEQ ID NO: 16561 - protein, 24 aa, artificial
  peptide fold or domain or sub-domain
REGLWPKLEKPKAKRFDGAGGEKW

SEQ ID NO: 16562 - protein, 24 aa, artificial
  peptide fold or domain or sub-domain
REHAALSGINNSTDLLFDISCLAL

SEQ ID NO: 16563 - protein, 30 aa, artificial
  peptide fold or domain or sub-domain
REHFLPRHLAEFAYIDDDIPLSDDRVMLKP

SEQ ID NO: 16564 - protein, 29 aa, artificial
  peptide fold or domain or sub-domain
REHNRLATELKSLNPRWDGERLYQEARKI

SEQ ID NO: 16565 - protein, 21 aa, artificial
  peptide fold or domain or sub-domain
REHRESEYGSLDADREFLESI

SEQ ID NO: 16566 - protein, 22 aa, artificial
  peptide fold or domain or sub-domain
REIENASDAYTTRGGKIPVRWT

SEQ ID NO: 16567 - protein, 28 aa, artificial
  peptide fold or domain or sub-domain
REIEPVYPPENKTGYSMAYYVINYSKLR

SEQ ID NO: 16568 - protein, 30 aa, artificial
  peptide fold or domain or sub-domain
REIFVPKAFRGVAYVDEDLAIGGGRFLLEP

SEQ ID NO: 16569 - protein, 24 aa, artificial
  peptide fold or domain or sub-domain
REINELTPQYRGIRWDRLSANAEG

SEQ ID NO: 16570 - protein, 20 aa, artificial
  peptide fold or domain or sub-domain
REKLVQELENNDQLELFEEL

SEQ ID NO: 16571 - protein, 21 aa, artificial
  peptide fold or domain or sub-domain
REKVKEHMAQRGLPREKVLAT

SEQ ID NO: 16572 - protein, 23 aa, artificial
  peptide fold or domain or sub-domain
REKWIANAKKYNIPNSLVESILP

SEQ ID NO: 16573 - protein, 25 aa, artificial
  peptide fold or domain or sub-domain
RELAKKYCEETYHLQKKQIGIRDIY

SEQ ID NO: 16574 - protein, 27 aa, artificial
  peptide fold or domain or sub-domain
RELALCKESLDAIAEPSTRERATVIAN

SEQ ID NO: 16575 - protein, 24 aa, artificial
  peptide fold or domain or sub-domain
RELELTVSELGLGYDSDETVLLRY

SEQ ID NO: 16576 - protein, 21 aa, artificial
  peptide fold or domain or sub-domain
RELERREQSERFGKPSYLEAA

SEQ ID NO: 16577 - protein, 30 aa, artificial
  peptide fold or domain or sub-domain
RELFVDEDLQGLAYADMALPLANGHKMLEP

SEQ ID NO: 16578 - protein, 30 aa, artificial
  peptide fold or domain or sub-domain
RELFVPPERAAEAYLDRPVPIPHGQVTTQP

SEQ ID NO: 16579 - protein, 25 aa, artificial
  peptide fold or domain or sub-domain
RELKRQGERIQVDENLRTSIPGVYA

SEQ ID NO: 16580 - protein, 27 aa, artificial
  peptide fold or domain or sub-domain
RELTVLRFVAWSEFTIWGYVALAASPA

SEQ ID NO: 16581 - protein, 22 aa, artificial
  peptide fold or domain or sub-domain
RELWRSLCFEAQVPESLRHAVG

SEQ ID NO: 16582 - protein, 24 aa, artificial
  peptide fold or domain or sub-domain
RENAWRYAPGCDKSSSLEEIETAL

SEQ ID NO: 16583 - protein, 30 aa, artificial
  peptide fold or domain or sub-domain
RENFVPTAYRELAFVDFEVPLPAGQHMLAP

SEQ ID NO: 16584 - protein, 24 aa, artificial
  peptide fold or domain or sub-domain
RENIAAPLRWIQRLGKEEAAERAD

SEQ ID NO: 16585 - protein, 26 aa, artificial
  peptide fold or domain or sub-domain
REPCWKIQAKYNIPDLVKRMSTSGKT

SEQ ID NO: 16586 - protein, 26 aa, artificial
  peptide fold or domain or sub-domain
REPCYKLGVRFENQNILKQFIDHGFP

SEQ ID NO: 16587 - protein, 30 aa, artificial
  peptide fold or domain or sub-domain
REPYDEETKAAYMKDKRLNPESVEKGRNPT

SEQ ID NO: 16588 - protein, 24 aa, artificial
  peptide fold or domain or sub-domain
REQAVANYRESHPELSESEVRGRL

SEQ ID NO: 16589 - protein, 30 aa, artificial
  peptide fold or domain or sub-domain
REQFFPADRQYMAYSDMPITMAPGRRCLTP

SEQ ID NO: 16590 - protein, 24 aa, artificial
  peptide fold or domain or sub-domain
REQLQQGVSYSSATLKVLQHCAEF

SEQ ID NO: 16591 - protein, 28 aa, artificial
  peptide fold or domain or sub-domain
REQLTPWLAAERGIELAANNSAHFCVVA

SEQ ID NO: 16592 - protein, 22 aa, artificial
  peptide fold or domain or sub-domain
REQVVQQFEQRDQVRLDPVHEI

SEQ ID NO: 16593 - protein, 22 aa, artificial
  peptide fold or domain or sub-domain
RERIADYEAATHNLQYDPDEEI

SEQ ID NO: 16594 - protein, 23 aa, artificial
  peptide fold or domain or sub-domain
RERLAQALLDEGFKRLYSYTPTP

SEQ ID NO: 16595 - protein, 24 aa, artificial
  peptide fold or domain or sub-domain
RERNAKMITIPVSFWSWIVEHYAR

SEQ ID NO: 16596 - protein, 22 aa, artificial
  peptide fold or domain or sub-domain
RESISLLMENIHNANYDPNSEI

SEQ ID NO: 16597 - protein, 25 aa, artificial
  peptide fold or domain or sub-domain
RESVIRFFATGEIHAERFDAELTRA

SEQ ID NO: 16598 - protein, 30 aa, artificial
  peptide fold or domain or sub-domain
RESVKNVTEISLLAKDFETFERMQWFVKDS

SEQ ID NO: 16599 - protein, 20 aa, artificial
  peptide fold or domain or sub-domain
RESVTELAHIQRMHMQERGF

SEQ ID NO: 16600 - protein, 20 aa, artificial
  peptide fold or domain or sub-domain
RETVKSPFQLSEGKNVTVEM

SEQ ID NO: 16601 - protein, 27 aa, artificial
  peptide fold or domain or sub-domain
RETWLIYKNTKLVKKIDHAKVRKHQRK

SEQ ID NO: 16602 - protein, 30 aa, artificial
  peptide fold or domain or sub-domain
REVFVPAPFKHFAYTLNALSMQAQQYISSP

SEQ ID NO: 16603 - protein, 30 aa, artificial
  peptide fold or domain or sub-domain
REVSNKEVCTWIDSTEEWIETRTGIRSRRI

SEQ ID NO: 16604 - protein, 30 aa, artificial
  peptide fold or domain or sub-domain
REVYAPDAARDVAYADGPIPLGDGRQVLDP

SEQ ID NO: 16605 - protein, 24 aa, artificial
  peptide fold or domain or sub-domain
REVYRLDNWVEQLVHQDPVYRGRA

SEQ ID NO: 16606 - protein, 23 aa, artificial
  peptide fold or domain or sub-domain
REWAPAAQEAQLIGEFNNWNGAK

SEQ ID NO: 16607 - protein, 27 aa, artificial
  peptide fold or domain or sub-domain
REWVVSTSGNDAGDGSAAQPLRTLNKA

SEQ ID NO: 16608 - protein, 28 aa, artificial
  peptide fold or domain or sub-domain
REYRDSMINPYKGKLPEAVLKNMEEQLS

SEQ ID NO: 16609 - protein, 27 aa, artificial
  peptide fold or domain or sub-domain
RFADFYHPQVFGNAAPDGRKRLAFEKA

SEQ ID NO: 16610 - protein, 27 aa, artificial
  peptide fold or domain or sub-domain
RFADYYYPQIFAKQPANAENEKKMKDA

SEQ ID NO: 16611 - protein, 27 aa, artificial
  peptide fold or domain or sub-domain
RFAMEQSIGELEPMLRTGQFEAIFTWL

SEQ ID NO: 16612 - protein, 27 aa, artificial
  peptide fold or domain or sub-domain
RFAQYFYPQVFGGAKPDAAALKKLEEA

SEQ ID NO: 16613 - protein, 29 aa, artificial
  peptide fold or domain or sub-domain
RFDLVGKAGLKGNDEIRKLLLDQASFAVV

SEQ ID NO: 16614 - protein, 21 aa, artificial
  peptide fold or domain or sub-domain
RFDRSYFKGAPWTYTEHYIEK

SEQ ID NO: 16615 - protein, 25 aa, artificial
  peptide fold or domain or sub-domain
RFDYTNERALRRTLQEDLVKDVLSN

SEQ ID NO: 16616 - protein, 27 aa, artificial
  peptide fold or domain or sub-domain
RFFASPRSEGKKLTFRGQEIEVENAET

SEQ ID NO: 16617 - protein, 30 aa, artificial
  peptide fold or domain or sub-domain
RFFDDSENVLLEFFNDDWTPLAGDKGRIVE

SEQ ID NO: 16618 - protein, 27 aa, artificial
  peptide fold or domain or sub-domain
RFFVFEQTTLSYYKDQLLFSKMGEIPL

SEQ ID NO: 16619 - protein, 29 aa, artificial
  peptide fold or domain or sub-domain
RFGFMLPIFIKFGLYSPRVDPQYLGRTRI

SEQ ID NO: 16620 - protein, 20 aa, artificial
  peptide fold or domain or sub-domain
RFGVGSTEVLECPKTMVGRI

SEQ ID NO: 16621 - protein, 28 aa, artificial
  peptide fold or domain or sub-domain
RFGVGSTEVLECPKTMVGRIIGKGGETI

SEQ ID NO: 16622 - protein, 28 aa, artificial
  peptide fold or domain or sub-domain
RFHEMRDYQLQGKWPGHLGGPQPDREPG

SEQ ID NO: 16623 - protein, 30 aa, artificial
  peptide fold or domain or sub-domain
RFIHAPSGQIREFFDLDWNPAPGVAGRICE

SEQ ID NO: 16624 - protein, 30 aa, artificial
  peptide fold or domain or sub-domain
RFIKEVSMGELVISRRRKGEVIFDLESRGY

SEQ ID NO: 16625 - protein, 30 aa, artificial
  peptide fold or domain or sub-domain
RFILAVVEGDIIVNNRKRAELFVELKQKGF

SEQ ID NO: 16626 - protein, 30 aa, artificial
  peptide fold or domain or sub-domain
RFILAVVNKELVISNVKKVDLINKLKEMKF

SEQ ID NO: 16627 - protein, 30 aa, artificial
  peptide fold or domain or sub-domain
RFILEKIQGKITIENRSKKDLIQMLVQRGY

SEQ ID NO: 16628 - protein, 29 aa, artificial
  peptide fold or domain or sub-domain
RFIPTSLQIKMKAEELKMSIGDESLIPSV

SEQ ID NO: 16629 - protein, 30 aa, artificial
  peptide fold or domain or sub-domain
RFIREVIAGIIKVNGVPRATILAALERGNY

SEQ ID NO: 16630 - protein, 27 aa, artificial
  peptide fold or domain or sub-domain
RFISLWTPRDAARRAELPQLRVRGEQA

SEQ ID NO: 16631 - protein, 30 aa, artificial
  peptide fold or domain or sub-domain
RFITMVNNDEIIINKKHESVISAELEKLNF

SEQ ID NO: 16632 - protein, 26 aa, artificial
  peptide fold or domain or sub-domain
RFIVQDLPAVIHGVEDTDKVTMMEHD

SEQ ID NO: 16633 - protein, 25 aa, artificial
  peptide fold or domain or sub-domain
RFLDMNRDVIVQPEVLKRLQTSRDE

SEQ ID NO: 16634 - protein, 24 aa, artificial
  peptide fold or domain or sub-domain
RFLFYLEGVLYYDADRTRRVEDSN

SEQ ID NO: 16635 - protein, 22 aa, artificial
  peptide fold or domain or sub-domain
RFLKGVPGNSFAFAMMRRMGFS

SEQ ID NO: 16636 - protein, 29 aa, artificial
  peptide fold or domain or sub-domain
RFMLQDTSEGCDTRRKRCIQFCPWHGTLR

SEQ ID NO: 16637 - protein, 27 aa, artificial
  peptide fold or domain or sub-domain
RFNGTVEVKDGQLIVNGKAIRVTAEKN

SEQ ID NO: 16638 - protein, 30 aa, artificial
  peptide fold or domain or sub-domain
RFPLGQLVVLDVDGELLTQSRAIYRYIARQ

SEQ ID NO: 16639 - protein, 26 aa, artificial
  peptide fold or domain or sub-domain
RFQCPECNKKFMRSDHLSKHIRTHNK

SEQ ID NO: 16640 - protein, 29 aa, artificial
  peptide fold or domain or sub-domain
RFQHWTQTLIKSFEPQVVMQNAREITDWI

SEQ ID NO: 16641 - protein, 27 aa, artificial
  peptide fold or domain or sub-domain
RFRDMILSKGHTMDYGPMFRAFYGRDP

SEQ ID NO: 16642 - protein, 27 aa, artificial
  peptide fold or domain or sub-domain
RFRDTVLGMGGGTHPRDVFREFRGRDA

SEQ ID NO: 16643 - protein, 27 aa, artificial
  peptide fold or domain or sub-domain
RFREAILSRGNSEDLERLYRQWRGKAP

SEQ ID NO: 16644 - protein, 28 aa, artificial
  peptide fold or domain or sub-domain
RFREILLSSGTTRGNPAVYSIAGNIKPE

SEQ ID NO: 16645 - protein, 27 aa, artificial
  peptide fold or domain or sub-domain
RFRNKVLAPGGSKNPLDIISDYLGREP

SEQ ID NO: 16646 - protein, 27 aa, artificial
  peptide fold or domain or sub-domain
RFRREILERGDTADAMELYVAFRGHEP

SEQ ID NO: 16647 - protein, 27 aa, artificial
  peptide fold or domain or sub-domain
RFRRIILSRGASIDFEDAFWMFRGQQR

SEQ ID NO: 16648 - protein, 27 aa, artificial
  peptide fold or domain or sub-domain
RFRTILLMTGNETDRAEAYRAFRGRDP

SEQ ID NO: 16649 - protein, 27 aa, artificial
  peptide fold or domain or sub-domain
RFSMFYEQYYTDDGRLVRAGNVLFASM

SEQ ID NO: 16650 - protein, 22 aa, artificial
  peptide fold or domain or sub-domain
RFSPFEQKLYERGEYHEYFLIH

SEQ ID NO: 16651 - protein, 27 aa, artificial
  peptide fold or domain or sub-domain
RFTAKNLASKIGISDAAIFKHFSSMEE

SEQ ID NO: 16652 - protein, 21 aa, artificial
  peptide fold or domain or sub-domain
RFVALLGSPNADCRDQSAWAI

SEQ ID NO: 16653 - protein, 30 aa, artificial
  peptide fold or domain or sub-domain
RFVFAQAPDGDFIIYRTVDGGREQLLKFND

SEQ ID NO: 16654 - protein, 29 aa, artificial
  peptide fold or domain or sub-domain
RFVIRYHPTNNDDDTQEVNVGGGTTSFVL

SEQ ID NO: 16655 - protein, 27 aa, artificial
  peptide fold or domain or sub-domain
RFVQFNGRSLMYFGSDKDPFPKGVIPL

SEQ ID NO: 16656 - protein, 30 aa, artificial
  peptide fold or domain or sub-domain
RFVQMIIDGDLVISKKKKPVLVAELKKHGF

SEQ ID NO: 16657 - protein, 30 aa, artificial
  peptide fold or domain or sub-domain
RFVREVVEGTLVVTKRKKKELLEDLQRRMY

SEQ ID NO: 16658 - protein, 27 aa, artificial
  peptide fold or domain or sub-domain
RFYEYYYWQLIDGSPLSEVRFKLLQEA

SEQ ID NO: 16659 - protein, 24 aa, artificial
  peptide fold or domain or sub-domain
RGAAPVPALVEEWAIEAEKRGYLY

SEQ ID NO: 16660 - protein, 20 aa, artificial
  peptide fold or domain or sub-domain
RGAAYAGAYESLDRKALKLT

SEQ ID NO: 16661 - protein, 30 aa, artificial
  peptide fold or domain or sub-domain
RGALYREAEALIVHPPLSHLPRERALSEAV

SEQ ID NO: 16662 - protein, 24 aa, artificial
  peptide fold or domain or sub-domain
RGAYQYEFDRMANGMPATDGGKYL

SEQ ID NO: 16663 - protein, 24 aa, artificial
  peptide fold or domain or sub-domain
RGAYSYEYERLMPGMDAWEAGQRM

SEQ ID NO: 16664 - protein, 21 aa, artificial
  peptide fold or domain or sub-domain
RGCKFSSCLHVNEPDCNIIKA

SEQ ID NO: 16665 - protein, 28 aa, artificial
  peptide fold or domain or sub-domain
RGDACKDDFDHDSVPDIDDICPENVDIS

SEQ ID NO: 16666 - protein, 22 aa, artificial
  peptide fold or domain or sub-domain
RGDKERHNFATGEIEFRKDYAG

SEQ ID NO: 16667 - protein, 22 aa, artificial
  peptide fold or domain or sub-domain
RGDKTATPFGSSTGLVYNNAGG

SEQ ID NO: 16668 - protein, 30 aa, artificial
  peptide fold or domain or sub-domain
RGDLLSMLISTYDEDDGSYMTDRQLRDEII

SEQ ID NO: 16669 - protein, 26 aa, artificial
  peptide fold or domain or sub-domain
RGEYVAQWVREGYHEQAEYEFLKDIL

SEQ ID NO: 16670 - protein, 28 aa, artificial
  peptide fold or domain or sub-domain
RGFFDVDPEKVGRPVRGGVIEHVDLLPQ

SEQ ID NO: 16671 - protein, 28 aa, artificial
  peptide fold or domain or sub-domain
RGFFSDRDGSKFYDITQMSLERRTGYSW

SEQ ID NO: 16672 - protein, 29 aa, artificial
  peptide fold or domain or sub-domain
RGGLLEGVSKELADGGVVVDVRKPDVIRV

SEQ ID NO: 16673 - protein, 20 aa, artificial
  peptide fold or domain or sub-domain
RGHAITELFHHNKAALAQYN

SEQ ID NO: 16674 - protein, 22 aa, artificial
  peptide fold or domain or sub-domain
RGIIINLDEGELCLNSAQCKSN

SEQ ID NO: 16675 - protein, 29 aa, artificial
  peptide fold or domain or sub-domain
RGIPPLISLLEDPRAPIRLAACGALKNLS

SEQ ID NO: 16676 - protein, 30 aa, artificial
  peptide fold or domain or sub-domain
RGITCGECYWCKVSKEPYLCPNRKVYGINR

SEQ ID NO: 16677 - protein, 24 aa, artificial
  peptide fold or domain or sub-domain
RGKEMGIDMPNFEEFWKKGYVEFE

SEQ ID NO: 16678 - protein, 25 aa, artificial
  peptide fold or domain or sub-domain
RGKKATTHWASLERLQREFPEIYVQ

SEQ ID NO: 16679 - protein, 22 aa, artificial
  peptide fold or domain or sub-domain
RGLDDRDHYIMTAHRRIPFAWC

SEQ ID NO: 16680 - protein, 27 aa, artificial
  peptide fold or domain or sub-domain
RGLKLLRLRELESWVEEERRKGRLLGL

SEQ ID NO: 16681 - protein, 29 aa, artificial
  peptide fold or domain or sub-domain
RGLPVLVELLQSETDKVVRAVAIALRNLS

SEQ ID NO: 16682 - protein, 24 aa, artificial
  peptide fold or domain or sub-domain
RGLSGKGKGSEKTRPSLRSNGGKA

SEQ ID NO: 16683 - protein, 23 aa, artificial
  peptide fold or domain or sub-domain
RGNAVAEWMKQKLEEKPEYAGLK

SEQ ID NO: 16684 - protein, 26 aa, artificial
  peptide fold or domain or sub-domain
RGNAVAEWMKQKLEEKPEYAGLKDYY

SEQ ID NO: 16685 - protein, 20 aa, artificial
  peptide fold or domain or sub-domain
RGNEGTVSEIFGEDYLSKDE

SEQ ID NO: 16686 - protein, 23 aa, artificial
  peptide fold or domain or sub-domain
RGNEGTVSEIFGEDYLSKDEQSR

SEQ ID NO: 16687 - protein, 28 aa, artificial
  peptide fold or domain or sub-domain
RGNEGTVSEIFGEDYLSKDEQSRRDGYS

SEQ ID NO: 16688 - protein, 26 aa, artificial
  peptide fold or domain or sub-domain
RGPCNTLAHRWGRPDLVKVVKENHRS

SEQ ID NO: 16689 - protein, 27 aa, artificial
  peptide fold or domain or sub-domain
RGPKLFDYLRSRIPLCFLEKSLGGECE

SEQ ID NO: 16690 - protein, 22 aa, artificial
  peptide fold or domain or sub-domain
RGPSELSPTDMPQAALTALAAS

SEQ ID NO: 16691 - protein, 23 aa, artificial
  peptide fold or domain or sub-domain
RGQAELEVLRQAMAERRDCRVVL

SEQ ID NO: 16692 - protein, 22 aa, artificial
  peptide fold or domain or sub-domain
RGQAQMAFGRDGRFADLLAISD

SEQ ID NO: 16693 - protein, 28 aa, artificial
  peptide fold or domain or sub-domain
RGRALYWQGRAAEAQGDPIAAQAFYAEG

SEQ ID NO: 16694 - protein, 29 aa, artificial
  peptide fold or domain or sub-domain
RGREEAASFKKLYKTPIPIPAFADRLGQY

SEQ ID NO: 16695 - protein, 24 aa, artificial
  peptide fold or domain or sub-domain
RGRIDELAQTIQNKELIEHLNRLG

SEQ ID NO: 16696 - protein, 25 aa, artificial
  peptide fold or domain or sub-domain
RGRKLTAVKPIIIDVKNAGAEFYDQ

SEQ ID NO: 16697 - protein, 25 aa, artificial
  peptide fold or domain or sub-domain
RGRKNVIKKFLELYGENLPIKQMYE

SEQ ID NO: 16698 - protein, 24 aa, artificial
  peptide fold or domain or sub-domain
RGRLEQIAKELEHNELTETVERMT

SEQ ID NO: 16699 - protein, 24 aa, artificial
  peptide fold or domain or sub-domain
RGRLFEICGKQGIHELNETLGMVD

SEQ ID NO: 16700 - protein, 23 aa, artificial
  peptide fold or domain or sub-domain
RGRNANSGTVPKNTDVQTYRHST

SEQ ID NO: 16701 - protein, 23 aa, artificial
  peptide fold or domain or sub-domain
RGRNARPGHLPRTAAPAEYHSST

SEQ ID NO: 16702 - protein, 30 aa, artificial
  peptide fold or domain or sub-domain
RGSAEFYTNRILKEFKGVNQDQVDWVSNYV

SEQ ID NO: 16703 - protein, 28 aa, artificial
  peptide fold or domain or sub-domain
RGSSKDWKRSIKYGGKSLQSLIDEGTLT

SEQ ID NO: 16704 - protein, 26 aa, artificial
  peptide fold or domain or sub-domain
RGTQLNVANGNIKKVEDLSSDDFLRC

SEQ ID NO: 16705 - protein, 22 aa, artificial
  peptide fold or domain or sub-domain
RGVHHIDYYKKTSNGRLPVKWM

SEQ ID NO: 16706 - protein, 27 aa, artificial
  peptide fold or domain or sub-domain
RGVTLTEGLYNLFDLQKRGMKSNNISS

SEQ ID NO: 16707 - protein, 29 aa, artificial
  peptide fold or domain or sub-domain
RHANSEVWLAQRGGPLPSDTEYSFNDDAT

SEQ ID NO: 16708 - protein, 27 aa, artificial
  peptide fold or domain or sub-domain
RHAPRVHRIAAGTVGPGAADDVVQEVF

SEQ ID NO: 16709 - protein, 26 aa, artificial
  peptide fold or domain or sub-domain
RHDCNDPGNYANDCDDGDRFMGGDAD

SEQ ID NO: 16710 - protein, 20 aa, artificial
  peptide fold or domain or sub-domain
RHDPTEPEELGRVRAGGGFI

SEQ ID NO: 16711 - protein, 30 aa, artificial
  peptide fold or domain or sub-domain
RHEFVLLELRPYAYADTPLPSCFDKTISQP

SEQ ID NO: 16712 - protein, 29 aa, artificial
  peptide fold or domain or sub-domain
RHEQAWGISQALIEAKVIVDFRAPDIVRF

SEQ ID NO: 16713 - protein, 25 aa, artificial
  peptide fold or domain or sub-domain
RHFHPAAADDRIIRVVQEGNGAMLV

SEQ ID NO: 16714 - protein, 27 aa, artificial
  peptide fold or domain or sub-domain
RHGPALMRYARNLLSGSDVEDCVQDAF

SEQ ID NO: 16715 - protein, 27 aa, artificial
  peptide fold or domain or sub-domain
RHIDRVVGVARRVVGPTEAEDIAQDVF

SEQ ID NO: 16716 - protein, 30 aa, artificial
  peptide fold or domain or sub-domain
RHIFLDNAFLEHAYQDKAFPIGDGQTISQP

SEQ ID NO: 16717 - protein, 22 aa, artificial
  peptide fold or domain or sub-domain
RHIGEKKSTVNTKGGKISLRWT

SEQ ID NO: 16718 - protein, 29 aa, artificial
  peptide fold or domain or sub-domain
RHKDFLLRLDPYENTGQYRADSAFQLVKG

SEQ ID NO: 16719 - protein, 30 aa, artificial
  peptide fold or domain or sub-domain
RHLDFLDILLLAKMENGSILSDKDLRAEVD

SEQ ID NO: 16720 - protein, 30 aa, artificial
  peptide fold or domain or sub-domain
RHLFVPRARRASAYSDGQVQVGDARMLMRP

SEQ ID NO: 16721 - protein, 26 aa, artificial
  peptide fold or domain or sub-domain
RHLKDILLENEEVMKYITKEELEELM

SEQ ID NO: 16722 - protein, 29 aa, artificial
  peptide fold or domain or sub-domain
RHPHAQQVMAQLIECGIVGDFRTPDILRF

SEQ ID NO: 16723 - protein, 30 aa, artificial
  peptide fold or domain or sub-domain
RHPLGRVPVLEDGDVRVFESAAICLWLAER

SEQ ID NO: 16724 - protein, 30 aa, artificial
  peptide fold or domain or sub-domain
RHQCGPTHSDATQNNYAAVTNAKWKVEPYL

SEQ ID NO: 16725 - protein, 23 aa, artificial
  peptide fold or domain or sub-domain
RHQPGATAIRNAIKKGQSCRVVL

SEQ ID NO: 16726 - protein, 27 aa, artificial
  peptide fold or domain or sub-domain
RHQQRVRSLLFQLCGAVALDDLVQEVF

SEQ ID NO: 16727 - protein, 29 aa, artificial
  peptide fold or domain or sub-domain
RHSYHGMTYGALSVTGIVDEKVKSIVQPM

SEQ ID NO: 16728 - protein, 29 aa, artificial
  peptide fold or domain or sub-domain
RHSYHGRSAMAMTLTGQGTWRLGPAQSGV

SEQ ID NO: 16729 - protein, 29 aa, artificial
  peptide fold or domain or sub-domain
RHTLDRRSKIGLMAANIHAMTGAFTSRNA

SEQ ID NO: 16730 - protein, 27 aa, artificial
  peptide fold or domain or sub-domain
RHVICTAEDMLNPNYEDLLIRKSNHSF

SEQ ID NO: 16731 - protein, 27 aa, artificial
  peptide fold or domain or sub-domain
RHVSSRELKGKKLEGYTKRNIVYENLS

SEQ ID NO: 16732 - protein, 29 aa, artificial
  peptide fold or domain or sub-domain
RHYENVLYAASNGGVQTFDSKTSFNNDVS

SEQ ID NO: 16733 - protein, 29 aa, artificial
  peptide fold or domain or sub-domain
RHYNYQLRVDPTDGTDQFRQDSSFNPVTA

SEQ ID NO: 16734 - protein, 27 aa, artificial
  peptide fold or domain or sub-domain
RHYPALCAYARLFVEPDDGQEIVSDVM

SEQ ID NO: 16735 - protein, 22 aa, artificial
  peptide fold or domain or sub-domain
RIAALRSSHKEEKMQECLRISS

SEQ ID NO: 16736 - protein, 26 aa, artificial
  peptide fold or domain or sub-domain
RIADLLLTPSPDADINLQKEGAAPSR

SEQ ID NO: 16737 - protein, 22 aa, artificial
  peptide fold or domain or sub-domain
RIADLQDLERDKRRKDCLSACG

SEQ ID NO: 16738 - protein, 27 aa, artificial
  peptide fold or domain or sub-domain
RIAGLGGSIRYNDGPNQWTERQQRRRA

SEQ ID NO: 16739 - protein, 23 aa, artificial
  peptide fold or domain or sub-domain
RIAKTWFIEEDKSKYFYLCEEAG

SEQ ID NO: 16740 - protein, 27 aa, artificial
  peptide fold or domain or sub-domain
RIANNWELPATENKEILQPYLDATPPD

SEQ ID NO: 16741 - protein, 20 aa, artificial
  peptide fold or domain or sub-domain
RIAPGKLSEIFGSVALKNDK

SEQ ID NO: 16742 - protein, 28 aa, artificial
  peptide fold or domain or sub-domain
RIAPGKLSEIFGSVALKNDKFFAGIGIE

SEQ ID NO: 16743 - protein, 20 aa, artificial
  peptide fold or domain or sub-domain
RIARGTLSEALGETTVETDR

SEQ ID NO: 16744 - protein, 23 aa, artificial
  peptide fold or domain or sub-domain
RIARGTLSEALGETTVETDRFLR

SEQ ID NO: 16745 - protein, 28 aa, artificial
  peptide fold or domain or sub-domain
RIARGTLSEALGETTVETDRFLRTLGVY

SEQ ID NO: 16746 - protein, 26 aa, artificial
  peptide fold or domain or sub-domain
RIASLHLAPTLRAQQALERENVATGN

SEQ ID NO: 16747 - protein, 22 aa, artificial
  peptide fold or domain or sub-domain
RIAWLRELARREDWATFLASYR

SEQ ID NO: 16748 - protein, 22 aa, artificial
  peptide fold or domain or sub-domain
RIAWVKYLAERDQWSQVAEQLR

SEQ ID NO: 16749 - protein, 26 aa, artificial
  peptide fold or domain or sub-domain
RICCSFVGMNKIFKRRYLEGDVELEF

SEQ ID NO: 16750 - protein, 28 aa, artificial
  peptide fold or domain or sub-domain
RICRDCGEEIQPARLAAMPFAVRCIECQ

SEQ ID NO: 16751 - protein, 30 aa, artificial
  peptide fold or domain or sub-domain
RIDGEPAETRVLGRVLPYYLPDSKDPEGRG

SEQ ID NO: 16752 - protein, 29 aa, artificial
  peptide fold or domain or sub-domain
RIDHARKVLEDASSNEHRTKAEIFLHQLM

SEQ ID NO: 16753 - protein, 29 aa, artificial
  peptide fold or domain or sub-domain
RIDKAWEGKTETGLAVIDVARDAPVEPIS

SEQ ID NO: 16754 - protein, 29 aa, artificial
  peptide fold or domain or sub-domain
RIDLEKYRDIKTDVEFFEKLLEEENVQVL

SEQ ID NO: 16755 - protein, 28 aa, artificial
  peptide fold or domain or sub-domain
RIEADCIGKLAVPDDALYGIHTLRAVHN

SEQ ID NO: 16756 - protein, 29 aa, artificial
  peptide fold or domain or sub-domain
RIEEEKITEKDAGDYLCMARNKLGDDYVV

SEQ ID NO: 16757 - protein, 24 aa, artificial
  peptide fold or domain or sub-domain
RIEHDWVPQVQAVQLGNKAQAEAG

SEQ ID NO: 16758 - protein, 30 aa, artificial
  peptide fold or domain or sub-domain
RIEIRAKRRFRERETPDNENSLDSVIREIA

SEQ ID NO: 16759 - protein, 24 aa, artificial
  peptide fold or domain or sub-domain
RIEKDWYTLMNTIINGSASEADAA

SEQ ID NO: 16760 - protein, 24 aa, artificial
  peptide fold or domain or sub-domain
RIEQDWYPVLAKAEKGTDAERAVA

SEQ ID NO: 16761 - protein, 28 aa, artificial
  peptide fold or domain or sub-domain
RIERDTMGEVRVPADKYWGAQTQRSLEN

SEQ ID NO: 16762 - protein, 27 aa, artificial
  peptide fold or domain or sub-domain
RIEVITAEGEKVVASSDENADLFWALR

SEQ ID NO: 16763 - protein, 28 aa, artificial
  peptide fold or domain or sub-domain
RIFPELRGANAIYKYHPDPSQQAIVDGQ

SEQ ID NO: 16764 - protein, 24 aa, artificial
  peptide fold or domain or sub-domain
RIFSAFDANSWKPEPDLIRYCAMN

SEQ ID NO: 16765 - protein, 22 aa, artificial
  peptide fold or domain or sub-domain
RIFVDLPRGMRTGAGMVFGQGA

SEQ ID NO: 16766 - protein, 26 aa, artificial
  peptide fold or domain or sub-domain
RIGIVTATKKGDYEKFVEGEIDHLIG

SEQ ID NO: 16767 - protein, 24 aa, artificial
  peptide fold or domain or sub-domain
RIGNYKMAMRKKISSILGIDAQRV

SEQ ID NO: 16768 - protein, 30 aa, artificial
  peptide fold or domain or sub-domain
RIHAESFGPSGLRRKTGAAAATGPVRVAAQ

SEQ ID NO: 16769 - protein, 25 aa, artificial
  peptide fold or domain or sub-domain
RIHISNVFGYDKASFGEREQFAIDH

SEQ ID NO: 16770 - protein, 26 aa, artificial
  peptide fold or domain or sub-domain
RIIAGHFTWSPKMQALVKNNTIEAYC

SEQ ID NO: 16771 - protein, 30 aa, artificial
  peptide fold or domain or sub-domain
RIIAVDVSEDKLFLAAHYGADEGLVIGADT

SEQ ID NO: 16772 - protein, 30 aa, artificial
  peptide fold or domain or sub-domain
RIIAVGTRKWKLEKALELGASDVVNSKETD

SEQ ID NO: 16773 - protein, 27 aa, artificial
  peptide fold or domain or sub-domain
RIIAYCSPQWKSGSMGTEENRTKVQDA

SEQ ID NO: 16774 - protein, 22 aa, artificial
  peptide fold or domain or sub-domain
RIIDVGESHYKATGGMVPLRWM

SEQ ID NO: 16775 - protein, 29 aa, artificial
  peptide fold or domain or sub-domain
RIIFAQPQFSQRSARTIAKAIRGQVILID

SEQ ID NO: 16776 - protein, 26 aa, artificial
  peptide fold or domain or sub-domain
RIIGSHWGLQPRWMEMISNNKVEAYC

SEQ ID NO: 16777 - protein, 30 aa, artificial
  peptide fold or domain or sub-domain
RIILGTAALQNPELVKQLSDAFGSSCVNVA

SEQ ID NO: 16778 - protein, 21 aa, artificial
  peptide fold or domain or sub-domain
RIIPGRNLGAAPFGRCLGVGA

SEQ ID NO: 16779 - protein, 29 aa, artificial
  peptide fold or domain or sub-domain
RIIVPSDMASPYWLQIPAASDPRVELVAG

SEQ ID NO: 16780 - protein, 26 aa, artificial
  peptide fold or domain or sub-domain
RIKAEAPWTRQSGLLAYLDEQVASMD

SEQ ID NO: 16781 - protein, 27 aa, artificial
  peptide fold or domain or sub-domain
RIKESGETMFTLTAQDKHGILKNGDIR

SEQ ID NO: 16782 - protein, 25 aa, artificial
  peptide fold or domain or sub-domain
RIKIHELVVELSSFTVKKKGEEIKL

SEQ ID NO: 16783 - protein, 30 aa, artificial
  peptide fold or domain or sub-domain
RIKWVDHMAFLGESGSGHAVLMDTAPESGG

SEQ ID NO: 16784 - protein, 29 aa, artificial
  peptide fold or domain or sub-domain
RILESYRWQEDVVKPLSRELEIDVEEFQD

SEQ ID NO: 16785 - protein, 24 aa, artificial
  peptide fold or domain or sub-domain
RILNEALCLPGLEEIMGPFINVCS

SEQ ID NO: 16786 - protein, 27 aa, artificial
  peptide fold or domain or sub-domain
RILWVAPNGSDSASATEMAPLRTVTRA

SEQ ID NO: 16787 - protein, 27 aa, artificial
  peptide fold or domain or sub-domain
RIMYYGDDERVDRISKQMGITKSASAM

SEQ ID NO: 16788 - protein, 20 aa, artificial
  peptide fold or domain or sub-domain
RINANRHAARYRALGVPVDG

SEQ ID NO: 16789 - protein, 28 aa, artificial
  peptide fold or domain or sub-domain
RINDYDRYCKSGEYSQSDLFTHISDIKM

SEQ ID NO: 16790 - protein, 26 aa, artificial
  peptide fold or domain or sub-domain
RINNRIEELLSYGAPEPILEENWEML

SEQ ID NO: 16791 - protein, 30 aa, artificial
  peptide fold or domain or sub-domain
RINWQDGVQNQASIGEFPPLLMDEPQPLGG

SEQ ID NO: 16792 - protein, 26 aa, artificial
  peptide fold or domain or sub-domain
RIPCATLSARIGDPNFAPRFRQAGQS

SEQ ID NO: 16793 - protein, 30 aa, artificial
  peptide fold or domain or sub-domain
RIPYDADTKKARSRKLFEGSKWLEMGYNPK

SEQ ID NO: 16794 - protein, 25 aa, artificial
  peptide fold or domain or sub-domain
RIQARGPWVKQMGPEYLEMERKNAE

SEQ ID NO: 16795 - protein, 25 aa, artificial
  peptide fold or domain or sub-domain
RIQKGDIILDLNNYCIYKNGEKIDL

SEQ ID NO: 16796 - protein, 25 aa, artificial
  peptide fold or domain or sub-domain
RIQLANLYGFDKVPFSDRLDFVSKN

SEQ ID NO: 16797 - protein, 24 aa, artificial
  peptide fold or domain or sub-domain
RIQQYKSEMQQQVADLLCVRKEQI

SEQ ID NO: 16798 - protein, 29 aa, artificial
  peptide fold or domain or sub-domain
RISELVEAEGAENDRALDSEALERLAGDE

SEQ ID NO: 16799 - protein, 22 aa, artificial
  peptide fold or domain or sub-domain
RISGTRLREMLGRGERPPEYMM

SEQ ID NO: 16800 - protein, 29 aa, artificial
  peptide fold or domain or sub-domain
RISHFNHRHAKDSMAFCLDLLEKTGVAIT

SEQ ID NO: 16801 - protein, 20 aa, artificial
  peptide fold or domain or sub-domain
RITDSAEVVARTIDGGVEFG

SEQ ID NO: 16802 - protein, 23 aa, artificial
  peptide fold or domain or sub-domain
RITRDDGSLAYRTDIWSLMQIGA

SEQ ID NO: 16803 - protein, 22 aa, artificial
  peptide fold or domain or sub-domain
RITSFLNDRQYRHCSWDTVQTE

SEQ ID NO: 16804 - protein, 26 aa, artificial
  peptide fold or domain or sub-domain
RITTLHFAPTKKSAKSLKKEGISKDK

SEQ ID NO: 16805 - protein, 27 aa, artificial
  peptide fold or domain or sub-domain
RIVCKVSDEDAASRAIQDGSTRSAASM

SEQ ID NO: 16806 - protein, 22 aa, artificial
  peptide fold or domain or sub-domain
RIVPGISQDSHGIQIAQAAGFP

SEQ ID NO: 16807 - protein, 27 aa, artificial
  peptide fold or domain or sub-domain
RIVPKTKADYFVYSIEIKRNWRQMVEY

SEQ ID NO: 16808 - protein, 28 aa, artificial
  peptide fold or domain or sub-domain
RIVQRNAMKVWEQGKDFLEELLNDKDVT

SEQ ID NO: 16809 - protein, 29 aa, artificial
  peptide fold or domain or sub-domain
RIVVALASDDDLWPKLGFAGHPRISTCTG

SEQ ID NO: 16810 - protein, 23 aa, artificial
  peptide fold or domain or sub-domain
RIWAPDITLMSLQIQGHDPVPMQ

SEQ ID NO: 16811 - protein, 30 aa, artificial
  peptide fold or domain or sub-domain
RIWMVDSRGVITRDRPKGGLTEHKLHFAQL

SEQ ID NO: 16812 - protein, 30 aa, artificial
  peptide fold or domain or sub-domain
RIYAIDVSNERLEMAQKLGATTVINAIEEN

SEQ ID NO: 16813 - protein, 27 aa, artificial
  peptide fold or domain or sub-domain
RIYALAGRYYWRLDQASPSWGVVRNRF

SEQ ID NO: 16814 - protein, 29 aa, artificial
  peptide fold or domain or sub-domain
RIYAVGEEERIRDLASGCGIDKLCGCARP

SEQ ID NO: 16815 - protein, 27 aa, artificial
  peptide fold or domain or sub-domain
RIYYVAPNGNSSNNGSSFNAPMSFSAA

SEQ ID NO: 16816 - protein, 22 aa, artificial
  peptide fold or domain or sub-domain
RKAACNFVKDNYDLHYSPETET

SEQ ID NO: 16817 - protein, 29 aa, artificial
  peptide fold or domain or sub-domain
RKALARVDEAARTMHFGDGTSEPFDLLAV

SEQ ID NO: 16818 - protein, 23 aa, artificial
  peptide fold or domain or sub-domain
RKALMDETKDDYQTVLVALCGYD

SEQ ID NO: 16819 - protein, 20 aa, artificial
  peptide fold or domain or sub-domain
RKASVHRARPTQGLFYLLSS

SEQ ID NO: 16820 - protein, 29 aa, artificial
  peptide fold or domain or sub-domain
RKATIVNAGSSDFLEGEQVEYSRVKIANR

SEQ ID NO: 16821 - protein, 25 aa, artificial
  peptide fold or domain or sub-domain
RKDSLQEFSNANRLDLVDKVQKELD

SEQ ID NO: 16822 - protein, 23 aa, artificial
  peptide fold or domain or sub-domain
RKDTLNTLQNMFPDMDPSLIEDV

SEQ ID NO: 16823 - protein, 26 aa, artificial
  peptide fold or domain or sub-domain
RKEAEKQMIALGKSGMSDDEIERFVD

SEQ ID NO: 16824 - protein, 26 aa, artificial
  peptide fold or domain or sub-domain
RKEAYKAIDYAEKYQFDQADKHLQMA

SEQ ID NO: 16825 - protein, 25 aa, artificial
  peptide fold or domain or sub-domain
RKELQMVFQFEHMDLDSGEGGKWDV

SEQ ID NO: 16826 - protein, 28 aa, artificial
  peptide fold or domain or sub-domain
RKENDSIGSKDIPEDVYYGVQSLRAAEN

SEQ ID NO: 16827 - protein, 23 aa, artificial
  peptide fold or domain or sub-domain
RKETRWPGYYYRTDYPELNDEEW

SEQ ID NO: 16828 - protein, 25 aa, artificial
  peptide fold or domain or sub-domain
RKFFQEFYRYCSNPEEKIQAKKWAQ

SEQ ID NO: 16829 - protein, 24 aa, artificial
  peptide fold or domain or sub-domain
RKGEVCVEGLYYTWLGQKTFYVNF

SEQ ID NO: 16830 - protein, 30 aa, artificial
  peptide fold or domain or sub-domain
RKIHYRQQDLVDYSPVSEKHLADGMTVGEL

SEQ ID NO: 16831 - protein, 27 aa, artificial
  peptide fold or domain or sub-domain
RKKFALSQTQLRNNQLFPHEIDVLSEK

SEQ ID NO: 16832 - protein, 29 aa, artificial
  peptide fold or domain or sub-domain
RKKRVTDQNSEKKGPILFQSGMTVAPSPN

SEQ ID NO: 16833 - protein, 28 aa, artificial
  peptide fold or domain or sub-domain
RKLEFPGLEIDLLRRRVTARGEQVELTA

SEQ ID NO: 16834 - protein, 30 aa, artificial
  peptide fold or domain or sub-domain
RKLFLENKNVENPYYDEPKPIGYNATISAP

SEQ ID NO: 16835 - protein, 24 aa, artificial
  peptide fold or domain or sub-domain
RKLLEGEGLSPGELYEHLAIDDIR

SEQ ID NO: 16836 - protein, 22 aa, artificial
  peptide fold or domain or sub-domain
RKLMEEDIYEARTGAKFPIKWT

SEQ ID NO: 16837 - protein, 30 aa, artificial
  peptide fold or domain or sub-domain
RKLMSALPVDDVWGIGRRISKKLDAMGIKT

SEQ ID NO: 16838 - protein, 25 aa, artificial
  peptide fold or domain or sub-domain
RKLSFQFPSPTVVTMPNHAGTSMCH

SEQ ID NO: 16839 - protein, 25 aa, artificial
  peptide fold or domain or sub-domain
RKLSLGQLDVYDAVKPALANSFFVP

SEQ ID NO: 16840 - protein, 27 aa, artificial
  peptide fold or domain or sub-domain
RKMTPMPISIDVRRSDGRVEKVTRTLY

SEQ ID NO: 16841 - protein, 27 aa, artificial
  peptide fold or domain or sub-domain
RKMTTKTVSYAAKLADGRTEQRSHTFY

SEQ ID NO: 16842 - protein, 24 aa, artificial
  peptide fold or domain or sub-domain
RKNKILEMKTSEPDADESCLNARL

SEQ ID NO: 16843 - protein, 24 aa, artificial
  peptide fold or domain or sub-domain
RKNSAHGISLPEKTWMELQELAIE

SEQ ID NO: 16844 - protein, 23 aa, artificial
  peptide fold or domain or sub-domain
RKNSTVPFEESNGTIRERVVHSF

SEQ ID NO: 16845 - protein, 26 aa, artificial
  peptide fold or domain or sub-domain
RKPCERLSKNTENEETRDIVYQTGLS

SEQ ID NO: 16846 - protein, 26 aa, artificial
  peptide fold or domain or sub-domain
RKPCVKISKIHNNPNFTHEIFKTGLS

SEQ ID NO: 16847 - protein, 30 aa, artificial
  peptide fold or domain or sub-domain
RKPFSGPASTNLRTWGTGGLRRISDTEPFK

SEQ ID NO: 16848 - protein, 20 aa, artificial
  peptide fold or domain or sub-domain
RKPNVLKEYGKDKYMFIRRD

SEQ ID NO: 16849 - protein, 24 aa, artificial
  peptide fold or domain or sub-domain
RKQGQVVSVTGSDAQIMDLDNYQT

SEQ ID NO: 16850 - protein, 25 aa, artificial
  peptide fold or domain or sub-domain
RKQIQIMAEHTRCPVTKPKLLAFVG

SEQ ID NO: 16851 - protein, 30 aa, artificial
  peptide fold or domain or sub-domain
RKRIAFLDLLLQMHREDASFTLGDIREEVD

SEQ ID NO: 16852 - protein, 21 aa, artificial
  peptide fold or domain or sub-domain
RKSIAIGGEKVSFKPEEVAQM

SEQ ID NO: 16853 - protein, 21 aa, artificial
  peptide fold or domain or sub-domain
RKSLYDEMGDPATDAERHKAI

SEQ ID NO: 16854 - protein, 26 aa, artificial
  peptide fold or domain or sub-domain
RKSVKRMKESRFLQLMISDLELVAQS

SEQ ID NO: 16855 - protein, 21 aa, artificial
  peptide fold or domain or sub-domain
RKTFKFGNDYVPFTEEQLTQI

SEQ ID NO: 16856 - protein, 21 aa, artificial
  peptide fold or domain or sub-domain
RKTSSVAQVTIQAKDGSNRTF

SEQ ID NO: 16857 - protein, 22 aa, artificial
  peptide fold or domain or sub-domain
RKTVSSTETDFNCEHCTKKVDY

SEQ ID NO: 16858 - protein, 27 aa, artificial
  peptide fold or domain or sub-domain
RKVCLINDDDVLLKSKMTGLSRSYLSI

SEQ ID NO: 16859 - protein, 30 aa, artificial
  peptide fold or domain or sub-domain
RKVDSLEIDQMLDVPEGWTLKKAGVKTRYF

SEQ ID NO: 16860 - protein, 30 aa, artificial
  peptide fold or domain or sub-domain
RKVENAEIENNLGLEPGWIERRTGIRSRFW

SEQ ID NO: 16861 - protein, 27 aa, artificial
  peptide fold or domain or sub-domain
RKVIEQLGDRYVVKTLSTVKNYTFSFR

SEQ ID NO: 16862 - protein, 29 aa, artificial
  peptide fold or domain or sub-domain
RKVKIVSVGDTKFIFDQQIDKYRFHEENK

SEQ ID NO: 16863 - protein, 29 aa, artificial
  peptide fold or domain or sub-domain
RKVKVEDQGDTDLLPGSLVDAFDFEDANR

SEQ ID NO: 16864 - protein, 29 aa, artificial
  peptide fold or domain or sub-domain
RKVLVEEPGDTRFLPEQVADRFSVLAENE

SEQ ID NO: 16865 - protein, 29 aa, artificial
  peptide fold or domain or sub-domain
RKVRIIDSGASLFLEDEVIEKRVVDLENK

SEQ ID NO: 16866 - protein, 21 aa, artificial
  peptide fold or domain or sub-domain
RKVSYIMTNWFLNVLVFITND

SEQ ID NO: 16867 - protein, 26 aa, artificial
  peptide fold or domain or sub-domain
RKVVDLCKEYDMAYQQDLGQSLYDIR

SEQ ID NO: 16868 - protein, 20 aa, artificial
  peptide fold or domain or sub-domain
RKYASAVGGSVGSTYLTASL

SEQ ID NO: 16869 - protein, 22 aa, artificial
  peptide fold or domain or sub-domain
RKYDYRNVTKNIIKYGSEVPPT

SEQ ID NO: 16870 - protein, 25 aa, artificial
  peptide fold or domain or sub-domain
RKYIAVKAWMKSNVDRWNSEGAEEQ

SEQ ID NO: 16871 - protein, 27 aa, artificial
  peptide fold or domain or sub-domain
RKYIQRLVATLQEKNPERVEPFKTTVS

SEQ ID NO: 16872 - protein, 22 aa, artificial
  peptide fold or domain or sub-domain
RKYNYGSSDRNIKHYGQAIPPA

SEQ ID NO: 16873 - protein, 26 aa, artificial
  peptide fold or domain or sub-domain
RKYTCQQCGKSCSNAGNFAVHMRIHT

SEQ ID NO: 16874 - protein, 29 aa, artificial
  peptide fold or domain or sub-domain
RLAAKPILEPKLICNRFYVPWRIALELFL

SEQ ID NO: 16875 - protein, 27 aa, artificial
  peptide fold or domain or sub-domain
RLDAEVSVNGNNLVVNGKEIIVKAERD

SEQ ID NO: 16876 - protein, 24 aa, artificial
  peptide fold or domain or sub-domain
RLDAITRRQNSGMFGNDPERVPSR

SEQ ID NO: 16877 - protein, 30 aa, artificial
  peptide fold or domain or sub-domain
RLDDPVAQHLPWFKLKPAGDDDGPVTIEQL

SEQ ID NO: 16878 - protein, 25 aa, artificial
  peptide fold or domain or sub-domain
RLDPARPSPTILRNGGAGGACEACH

SEQ ID NO: 16879 - protein, 23 aa, artificial
  peptide fold or domain or sub-domain
RLDSKYGYGKEGCGETIPGNSVL

SEQ ID NO: 16880 - protein, 30 aa, artificial
  peptide fold or domain or sub-domain
RLDTPINIYLPEKLQLKDQGKKTPVRLRDL

SEQ ID NO: 16881 - protein, 30 aa, artificial
  peptide fold or domain or sub-domain
RLDVKLLPLLKHVVPSFPGIANDIKKSGVQ

SEQ ID NO: 16882 - protein, 25 aa, artificial
  peptide fold or domain or sub-domain
RLDVYDRDFGLGYIEPDLIDAVRTD

SEQ ID NO: 16883 - protein, 26 aa, artificial
  peptide fold or domain or sub-domain
RLEDVAAAAGVSKGTVYLYFANKVEL

SEQ ID NO: 16884 - protein, 26 aa, artificial
  peptide fold or domain or sub-domain
RLEQIAELAGVSKTNLLYYFPSKEAL

SEQ ID NO: 16885 - protein, 25 aa, artificial
  peptide fold or domain or sub-domain
RLEWFTNSEGKRDRRVVEDASVGTL

SEQ ID NO: 16886 - protein, 23 aa, artificial
  peptide fold or domain or sub-domain
RLGAGRLAEVVGEPGLASDRYMR

SEQ ID NO: 16887 - protein, 24 aa, artificial
  peptide fold or domain or sub-domain
RLGAGYTDKAKPEPGKGIIDQSNE

SEQ ID NO: 16888 - protein, 22 aa, artificial
  peptide fold or domain or sub-domain
RLGFDLDADRGIGQELLVENMD

SEQ ID NO: 16889 - protein, 29 aa, artificial
  peptide fold or domain or sub-domain
RLGGIGEQVTQQLQSLTGKESRTVVLGHL

SEQ ID NO: 16890 - protein, 23 aa, artificial
  peptide fold or domain or sub-domain
RLGKWAGRVNPSKMAYPLRGSLM

SEQ ID NO: 16891 - protein, 23 aa, artificial
  peptide fold or domain or sub-domain
RLGRAGEVLVHLPVRGGKRRAVP

SEQ ID NO: 16892 - protein, 20 aa, artificial
  peptide fold or domain or sub-domain
RLHAKHVGPDVGRTFVMCGS

SEQ ID NO: 16893 - protein, 27 aa, artificial
  peptide fold or domain or sub-domain
RLHGQNMETLHEYLSPSILPDTFGGDI

SEQ ID NO: 16894 - protein, 24 aa, artificial
  peptide fold or domain or sub-domain
RLHSALALHQQGCLDDAEVLYRKI

SEQ ID NO: 16895 - protein, 26 aa, artificial
  peptide fold or domain or sub-domain
RLIATHIGLNPKAQQQMLANQIAVDL

SEQ ID NO: 16896 - protein, 30 aa, artificial
  peptide fold or domain or sub-domain
RLIDPQTGAIGEYYDGEWRFAAGESGGVRE

SEQ ID NO: 16897 - protein, 24 aa, artificial
  peptide fold or domain or sub-domain
RLIEKASVNRKPQLPQHFVDAYLD

SEQ ID NO: 16898 - protein, 29 aa, artificial
  peptide fold or domain or sub-domain
RLIEKKQGDVLCSTTETDIYEGKKELSKM

SEQ ID NO: 16899 - protein, 27 aa, artificial
  peptide fold or domain or sub-domain
RLIGLKPGPIKTVTGVQVVPDAVIDEV

SEQ ID NO: 16900 - protein, 23 aa, artificial
  peptide fold or domain or sub-domain
RLIHGELSEVFGPSTLHTDKLMR

SEQ ID NO: 16901 - protein, 28 aa, artificial
  peptide fold or domain or sub-domain
RLIHGELSEVFGPSTLHTDKLMRTLGIV

SEQ ID NO: 16902 - protein, 25 aa, artificial
  peptide fold or domain or sub-domain
RLIHYSVGEGTTAKGEVPDGYNVSR

SEQ ID NO: 16903 - protein, 30 aa, artificial
  peptide fold or domain or sub-domain
RLILGSVALTDPRLVKRLLSEFGGERIVIG

SEQ ID NO: 16904 - protein, 29 aa, artificial
  peptide fold or domain or sub-domain
RLILNYSPRDEEEEMMEVSLDATKRHAVL

SEQ ID NO: 16905 - protein, 26 aa, artificial
  peptide fold or domain or sub-domain
RLILQDLPEVIADVTETTAFESQAYD

SEQ ID NO: 16906 - protein, 26 aa, artificial
  peptide fold or domain or sub-domain
RLILSYLGNNKALEKKYLTGDIAIEL

SEQ ID NO: 16907 - protein, 25 aa, artificial
  peptide fold or domain or sub-domain
RLIRDKDKAFLAKKLAAIDRESPVT

SEQ ID NO: 16908 - protein, 30 aa, artificial
  peptide fold or domain or sub-domain
RLIVGTVAFTDKDDFSKIVDVCHDHGIEVF

SEQ ID NO: 16909 - protein, 25 aa, artificial
  peptide fold or domain or sub-domain
RLIYYSQIVNDFQKGDIAEGYSVSR

SEQ ID NO: 16910 - protein, 27 aa, artificial
  peptide fold or domain or sub-domain
RLKAEVSHTEDTITVDGKTIKVLSERN

SEQ ID NO: 16911 - protein, 22 aa, artificial
  peptide fold or domain or sub-domain
RLKAGECSSSFGINVAKVVGIS

SEQ ID NO: 16912 - protein, 24 aa, artificial
  peptide fold or domain or sub-domain
RLKDIARDLNLSVVTISKVLRDHP

SEQ ID NO: 16913 - protein, 27 aa, artificial
  peptide fold or domain or sub-domain
RLKVLLSNGHVEEIGSSNFFDPTSIFV

SEQ ID NO: 16914 - protein, 29 aa, artificial
  peptide fold or domain or sub-domain
RLLANKKGYSLNQHGLYAGVLRGERGSKL

SEQ ID NO: 16915 - protein, 26 aa, artificial
  peptide fold or domain or sub-domain
RLLAVNKDGFFILKSNTHEILKFTSL

SEQ ID NO: 16916 - protein, 26 aa, artificial
  peptide fold or domain or sub-domain
RLLGITKECVMRVDEKTKEVIQEWSL

SEQ ID NO: 16917 - protein, 24 aa, artificial
  peptide fold or domain or sub-domain
RLLGYVMDVDKLSLDEPVPDDLGE

SEQ ID NO: 16918 - protein, 22 aa, artificial
  peptide fold or domain or sub-domain
RLLWGIPGRSNALAIARRLHLE

SEQ ID NO: 16919 - protein, 23 aa, artificial
  peptide fold or domain or sub-domain
RLNKRQHSALNKWKEELQQSTIK

SEQ ID NO: 16920 - protein, 26 aa, artificial
  peptide fold or domain or sub-domain
RLPCYKLGIRFADPGIIGKFLASGRT

SEQ ID NO: 16921 - protein, 23 aa, artificial
  peptide fold or domain or sub-domain
RLPDHFQVTAMTSTCPIAAMSDE

SEQ ID NO: 16922 - protein, 27 aa, artificial
  peptide fold or domain or sub-domain
RLPKDHVSYWDLIFNDGSDQSRDSSAT

SEQ ID NO: 16923 - protein, 26 aa, artificial
  peptide fold or domain or sub-domain
RLPWEDKLQDPLYVRDSKLRCRDNID

SEQ ID NO: 16924 - protein, 26 aa, artificial
  peptide fold or domain or sub-domain
RLPWMEPGASVSKKQEARTKEIKENL

SEQ ID NO: 16925 - protein, 26 aa, artificial
  peptide fold or domain or sub-domain
RLQAEARQRRSSGQGLQASEVAAMVR

SEQ ID NO: 16926 - protein, 26 aa, artificial
  peptide fold or domain or sub-domain
RLQAEIAMRQDGQAGMSDEEVNDFVS

SEQ ID NO: 16927 - protein, 26 aa, artificial
  peptide fold or domain or sub-domain
RLQAEQELQRQRGQAMSPEAIADFVQ

SEQ ID NO: 16928 - protein, 25 aa, artificial
  peptide fold or domain or sub-domain
RLQLVRSYSAMGDEAAVESICSMYR

SEQ ID NO: 16929 - protein, 25 aa, artificial
  peptide fold or domain or sub-domain
RLQLVSGYLSMGKVEKAEDKLNEAI

SEQ ID NO: 16930 - protein, 26 aa, artificial
  peptide fold or domain or sub-domain
RLQQEHELISKVGKGMTDEQVHAFVD

SEQ ID NO: 16931 - protein, 23 aa, artificial
  peptide fold or domain or sub-domain
RLQREGKKATDAKNYYHNASSEI

SEQ ID NO: 16932 - protein, 25 aa, artificial
  peptide fold or domain or sub-domain
RLQYLGNGRFSIKKLRKDPAQIYEA

SEQ ID NO: 16933 - protein, 27 aa, artificial
  peptide fold or domain or sub-domain
RLRAEDAAMVHDSWPNKGEGSLTYLQA

SEQ ID NO: 16934 - protein, 23 aa, artificial
  peptide fold or domain or sub-domain
RLRALTLDPATPPEEAGAAVRAT

SEQ ID NO: 16935 - protein, 23 aa, artificial
  peptide fold or domain or sub-domain
RLRELAAKSELATYDPEAEARMK

SEQ ID NO: 16936 - protein, 25 aa, artificial
  peptide fold or domain or sub-domain
RLRGAAQMALRLREQREHALLWRQL

SEQ ID NO: 16937 - protein, 26 aa, artificial
  peptide fold or domain or sub-domain
RLRGKDKQGNIDYDLDSKMEFDLQHD

SEQ ID NO: 16938 - protein, 22 aa, artificial
  peptide fold or domain or sub-domain
RLRKGVNRNSHALKVAQLAGLP

SEQ ID NO: 16939 - protein, 27 aa, artificial
  peptide fold or domain or sub-domain
RLRNQVLAVGGSQPSSETIENFLGSKP

SEQ ID NO: 16940 - protein, 25 aa, artificial
  peptide fold or domain or sub-domain
RLRPDKPSYTINTHFNKPNVGCNIH

SEQ ID NO: 16941 - protein, 29 aa, artificial
  peptide fold or domain or sub-domain
RLRQEASEYKLKNGHFMPVDQLSCRLGDL

SEQ ID NO: 16942 - protein, 27 aa, artificial
  peptide fold or domain or sub-domain
RLRSSHNGHNGIRNVLAVLGTNIKFLR

SEQ ID NO: 16943 - protein, 27 aa, artificial
  peptide fold or domain or sub-domain
RLRTFCGSLYFAAPELLNAQPYIGPEV

SEQ ID NO: 16944 - protein, 29 aa, artificial
  peptide fold or domain or sub-domain
RLRTGMSQNGVPATIDLTTGRPKTVLLDP

SEQ ID NO: 16945 - protein, 25 aa, artificial
  peptide fold or domain or sub-domain
RLSALRTFLHEELSWSISKVDDELT

SEQ ID NO: 16946 - protein, 21 aa, artificial
  peptide fold or domain or sub-domain
RLSFSQLKWDNWIVAPHRYNP

SEQ ID NO: 16947 - protein, 20 aa, artificial
  peptide fold or domain or sub-domain
RLSGKLLQTHVTKEGERILL

SEQ ID NO: 16948 - protein, 21 aa, artificial
  peptide fold or domain or sub-domain
RLSLEYLQESWTHVTQLHGVG

SEQ ID NO: 16949 - protein, 29 aa, artificial
  peptide fold or domain or sub-domain
RLSLEYLQESWTHVTQLHGVGKYAADAYA

SEQ ID NO: 16950 - protein, 23 aa, artificial
  peptide fold or domain or sub-domain
RLSLLWPDGKLTLPRVEQAVNDA

SEQ ID NO: 16951 - protein, 24 aa, artificial
  peptide fold or domain or sub-domain
RLSPTTRSQNAPAFEGSPALVPEE

SEQ ID NO: 16952 - protein, 24 aa, artificial
  peptide fold or domain or sub-domain
RLSYEIVRKENPNGLIFANLGSEA

SEQ ID NO: 16953 - protein, 27 aa, artificial
  peptide fold or domain or sub-domain
RLTDYYFPTMFIGAPLDEGKRAKLAEA

SEQ ID NO: 16954 - protein, 22 aa, artificial
  peptide fold or domain or sub-domain
RLTEGACPESYGLQVALMAGIP

SEQ ID NO: 16955 - protein, 25 aa, artificial
  peptide fold or domain or sub-domain
RLTHYTYDVDNTEKVEISNRYSISR

SEQ ID NO: 16956 - protein, 30 aa, artificial
  peptide fold or domain or sub-domain
RLTVFDRVPAQCEAVAAAGAAVAPAAQALV

SEQ ID NO: 16957 - protein, 28 aa, artificial
  peptide fold or domain or sub-domain
RLVQGHALAAATGGASFLERLLADPELP

SEQ ID NO: 16958 - protein, 26 aa, artificial
  peptide fold or domain or sub-domain
RLVTTHIGLNKTVIELMNQGKIDVQF

SEQ ID NO: 16959 - protein, 29 aa, artificial
  peptide fold or domain or sub-domain
RLWAKKKGFNLQDKGLFADRSQAQASRVR

SEQ ID NO: 16960 - protein, 23 aa, artificial
  peptide fold or domain or sub-domain
RLWAPDAAQRGESVRLEIAGMGP

SEQ ID NO: 16961 - protein, 27 aa, artificial
  peptide fold or domain or sub-domain
RLYEDIMSAGNTIDPVEQFRAFRGRDV

SEQ ID NO: 16962 - protein, 26 aa, artificial
  peptide fold or domain or sub-domain
RLYLQDRPEVVRLSKCPDPVHKMPYD

SEQ ID NO: 16963 - protein, 24 aa, artificial
  peptide fold or domain or sub-domain
RMAEMIAAARQGEVSRANELHYQL

SEQ ID NO: 16964 - protein, 26 aa, artificial
  peptide fold or domain or sub-domain
RMAEMIAAARQGEVSRANELHYQLLP

SEQ ID NO: 16965 - protein, 20 aa, artificial
  peptide fold or domain or sub-domain
RMDEIDRRFAEDKPALATYN

SEQ ID NO: 16966 - protein, 25 aa, artificial
  peptide fold or domain or sub-domain
RMEPGMWLMELPGSEYWDPEKQRAM

SEQ ID NO: 16967 - protein, 28 aa, artificial
  peptide fold or domain or sub-domain
RMEQGGAWVREGHWETANFPLNRKASGG

SEQ ID NO: 16968 - protein, 25 aa, artificial
  peptide fold or domain or sub-domain
RMESRVPWLNELNAEFWELATQDVL

SEQ ID NO: 16969 - protein, 25 aa, artificial
  peptide fold or domain or sub-domain
RMETCAPPMEKERPEYWKELKLEVK

SEQ ID NO: 16970 - protein, 27 aa, artificial
  peptide fold or domain or sub-domain
RMFKLSEGKIEYFKDEGMTKKMGDIEL

SEQ ID NO: 16971 - protein, 29 aa, artificial
  peptide fold or domain or sub-domain
RMIKWLGQLDRLEGREPRHYPTIADAAAQ

SEQ ID NO: 16972 - protein, 29 aa, artificial
  peptide fold or domain or sub-domain
RMLTRLVDTKDVDNRHTLLHHLIEEMKRI

SEQ ID NO: 16973 - protein, 23 aa, artificial
  peptide fold or domain or sub-domain
RMMKGQLSEVFGEDFFDSDEFHV

SEQ ID NO: 16974 - protein, 28 aa, artificial
  peptide fold or domain or sub-domain
RMMKGQLSEVFGEDFFDSDEFHVKMDFL

SEQ ID NO: 16975 - protein, 22 aa, artificial
  peptide fold or domain or sub-domain
RMNDGIIESTYGLDVASSMGIP

SEQ ID NO: 16976 - protein, 26 aa, artificial
  peptide fold or domain or sub-domain
RMPCFKLNVKHGVTKFPLWIQETGWS

SEQ ID NO: 16977 - protein, 26 aa, artificial
  peptide fold or domain or sub-domain
RMPCWKLNVRFEQNDMARRLQDTLRT

SEQ ID NO: 16978 - protein, 23 aa, artificial
  peptide fold or domain or sub-domain
RMPEGFELLAHTENTPCAAIAHH

SEQ ID NO: 16979 - protein, 22 aa, artificial
  peptide fold or domain or sub-domain
RMPGHRQAEVAGQPHRHSARRA

SEQ ID NO: 16980 - protein, 24 aa, artificial
  peptide fold or domain or sub-domain
RMPVQFSYMDGENYVFMNLTDYSQ

SEQ ID NO: 16981 - protein, 25 aa, artificial
  peptide fold or domain or sub-domain
RMQMVKGNLSLGKVEEIHSLIDRFV

SEQ ID NO: 16982 - protein, 29 aa, artificial
  peptide fold or domain or sub-domain
RMQQMVNTAFSPSSPEEVRAMREELDAFL

SEQ ID NO: 16983 - protein, 24 aa, artificial
  peptide fold or domain or sub-domain
RMQRDWYALYDQIEDGTGAQTQQA

SEQ ID NO: 16984 - protein, 22 aa, artificial
  peptide fold or domain or sub-domain
RMTPGLVDCSFALSVAKEEGIP

SEQ ID NO: 16985 - protein, 28 aa, artificial
  peptide fold or domain or sub-domain
RMTQGTLAEVFGELALPSDKLYRSLMLR

SEQ ID NO: 16986 - protein, 21 aa, artificial
  peptide fold or domain or sub-domain
RMVSGKTLPSFQAYDASARAG

SEQ ID NO: 16987 - protein, 26 aa, artificial
  peptide fold or domain or sub-domain
RMVSSYVGENAEFERQYLSGELEVEL

SEQ ID NO: 16988 - protein, 26 aa, artificial
  peptide fold or domain or sub-domain
RMYPCENCGKCFSDPSNLHRHIRSQH

SEQ ID NO: 16989 - protein, 30 aa, artificial
  peptide fold or domain or sub-domain
RNACLADLGTNFFLRKEHIGHCISESTYKQ

SEQ ID NO: 16990 - protein, 28 aa, artificial
  peptide fold or domain or sub-domain
RNARVASGDTGPDTAPVPIPAEHRALRT

SEQ ID NO: 16991 - protein, 29 aa, artificial
  peptide fold or domain or sub-domain
RNCLDGLKAIVPLNQDATRHTTLGLLTQA

SEQ ID NO: 16992 - protein, 27 aa, artificial
  peptide fold or domain or sub-domain
RNCTIQSTGRQKRVEAAPGFHRSCFDY

SEQ ID NO: 16993 - protein, 23 aa, artificial
  peptide fold or domain or sub-domain
RNDANVIEQCKICGVPESGLSNV

SEQ ID NO: 16994 - protein, 26 aa, artificial
  peptide fold or domain or sub-domain
RNDCADPGNYPNDCDDGDRFIGGDAD

SEQ ID NO: 16995 - protein, 23 aa, artificial
  peptide fold or domain or sub-domain
RNDIAMAITKFDQFDFLIDIVPR

SEQ ID NO: 16996 - protein, 23 aa, artificial
  peptide fold or domain or sub-domain
RNDKRVQEALQKRGILPNDLNLL

SEQ ID NO: 16997 - protein, 28 aa, artificial
  peptide fold or domain or sub-domain
RNDLEFIEHYAPSMARYSPDGKHLPGTG

SEQ ID NO: 16998 - protein, 23 aa, artificial
  peptide fold or domain or sub-domain
RNDPAVIEQCVLSGIPANEMHKV

SEQ ID NO: 16999 - protein, 22 aa, artificial
  peptide fold or domain or sub-domain
RNDYLLVLGARHDWRAFDEQYK

SEQ ID NO: 17000 - protein, 22 aa, artificial
  peptide fold or domain or sub-domain
RNEDAELLRRLFDPPLPYDKVN

SEQ ID NO: 17001 - protein, 20 aa, artificial
  peptide fold or domain or sub-domain
RNEKWANRVSSVRPSLFPTN

SEQ ID NO: 17002 - protein, 22 aa, artificial
  peptide fold or domain or sub-domain
RNEWLKSLGARRQWTLFAQEYA

SEQ ID NO: 17003 - protein, 26 aa, artificial
  peptide fold or domain or sub-domain
RNGKTAGRRTYHTRSQGDNNVSLVEE

SEQ ID NO: 17004 - protein, 26 aa, artificial
  peptide fold or domain or sub-domain
RNGNDDIQNYGDRYEVQNCELVNLAD

SEQ ID NO: 17005 - protein, 25 aa, artificial
  peptide fold or domain or sub-domain
RNGNGRIYAPTDPPNSNTLDSSVDD

SEQ ID NO: 17006 - protein, 30 aa, artificial
  peptide fold or domain or sub-domain
RNGSIVLAATPPLKAMGVKKLARLYEIPRQ

SEQ ID NO: 17007 - protein, 25 aa, artificial
  peptide fold or domain or sub-domain
RNGTGYDSVQRVTDGYRFHDRAELL

SEQ ID NO: 17008 - protein, 22 aa, artificial
  peptide fold or domain or sub-domain
RNGVYVIKNTEEKTHHLPIRWM

SEQ ID NO: 17009 - protein, 29 aa, artificial
  peptide fold or domain or sub-domain
RNGYHGDTFGAMSVCDPDNSMHSLWKGYL

SEQ ID NO: 17010 - protein, 22 aa, artificial
  peptide fold or domain or sub-domain
RNHDAQLLQKTCNLEVAYKWVN

SEQ ID NO: 17011 - protein, 29 aa, artificial
  peptide fold or domain or sub-domain
RNIIVSRNTKLKVDGCEVVGSINVALNLV

SEQ ID NO: 17012 - protein, 24 aa, artificial
  peptide fold or domain or sub-domain
RNIMEHLVNFDTNCIRDITDALIA

SEQ ID NO: 17013 - protein, 21 aa, artificial
  peptide fold or domain or sub-domain
RNIMLGSCGLKQPSVASQLHL

SEQ ID NO: 17014 - protein, 29 aa, artificial
  peptide fold or domain or sub-domain
RNIVITQQKNLIIEGCDIFYSLDDALSAL

SEQ ID NO: 17015 - protein, 22 aa, artificial
  peptide fold or domain or sub-domain
RNKKRVENFKKTGKFEYDVAKI

SEQ ID NO: 17016 - protein, 23 aa, artificial
  peptide fold or domain or sub-domain
RNKLKRKLKSGKGKMRNRRFKKP

SEQ ID NO: 17017 - protein, 21 aa, artificial
  peptide fold or domain or sub-domain
RNKPTAKKIVDAFKAKNIDPE

SEQ ID NO: 17018 - protein, 25 aa, artificial
  peptide fold or domain or sub-domain
RNKRIAQMIEDGEDLIKINQEWFLL

SEQ ID NO: 17019 - protein, 29 aa, artificial
  peptide fold or domain or sub-domain
RNKVLATMERLEKVNSFQEFVQIFSQFGN

SEQ ID NO: 17020 - protein, 25 aa, artificial
  peptide fold or domain or sub-domain
RNKYDGIHVPVHVRHSNFKLPSDPS

SEQ ID NO: 17021 - protein, 24 aa, artificial
  peptide fold or domain or sub-domain
RNLLKGLVIFPPGYTSVRSIAGIQ

SEQ ID NO: 17022 - protein, 25 aa, artificial
  peptide fold or domain or sub-domain
RNLLVVISRRNQKNEPVFFQIVKPE

SEQ ID NO: 17023 - protein, 24 aa, artificial
  peptide fold or domain or sub-domain
RNLSSAAESGRFRLVEGDLLELDL

SEQ ID NO: 17024 - protein, 20 aa, artificial
  peptide fold or domain or sub-domain
RNLTWSQQTSRKYPSFFTAT

SEQ ID NO: 17025 - protein, 29 aa, artificial
  peptide fold or domain or sub-domain
RNLVLSYVNGETDSIGFHLERAYRETKNI

SEQ ID NO: 17026 - protein, 27 aa, artificial
  peptide fold or domain or sub-domain
RNMAWCAEKKNQIDFYNNRFVGTEIPN

SEQ ID NO: 17027 - protein, 22 aa, artificial
  peptide fold or domain or sub-domain
RNMYSADYYKANENDAIPIRWM

SEQ ID NO: 17028 - protein, 26 aa, artificial
  peptide fold or domain or sub-domain
RNNNALREMERTGAPAHRLNEQIHVL

SEQ ID NO: 17029 - protein, 21 aa, artificial
  peptide fold or domain or sub-domain
RNNPDNAELVKKFRDAGFEPE

SEQ ID NO: 17030 - protein, 26 aa, artificial
  peptide fold or domain or sub-domain
RNPCWKIDERFASEGMAEFIARERLT

SEQ ID NO: 17031 - protein, 28 aa, artificial
  peptide fold or domain or sub-domain
RNPEVIQLTHRFAAQSEALVELTVQVLG

SEQ ID NO: 17032 - protein, 28 aa, artificial
  peptide fold or domain or sub-domain
RNPKVAEISYQLSIHEREDNPQSHVLVM

SEQ ID NO: 17033 - protein, 24 aa, artificial
  peptide fold or domain or sub-domain
RNQLLEISRRNEDTEFKVPLQRLS

SEQ ID NO: 17034 - protein, 23 aa, artificial
  peptide fold or domain or sub-domain
RNQRILADESLPANVRLQALAFM

SEQ ID NO: 17035 - protein, 24 aa, artificial
  peptide fold or domain or sub-domain
RNQVIQAISCRNDSGLEAVASGLD

SEQ ID NO: 17036 - protein, 25 aa, artificial
  peptide fold or domain or sub-domain
RNRKGIIEGLTDIYDSSVPIIDLYD

SEQ ID NO: 17037 - protein, 24 aa, artificial
  peptide fold or domain or sub-domain
RNRLKTLRTRLRDEELDRAVSTLD

SEQ ID NO: 17038 - protein, 24 aa, artificial
  peptide fold or domain or sub-domain
RNRLLSLGLNSDNEEMSKAVANLD

SEQ ID NO: 17039 - protein, 20 aa, artificial
  peptide fold or domain or sub-domain
RNSAFGEPPSHRRLARLLLN

SEQ ID NO: 17040 - protein, 23 aa, artificial
  peptide fold or domain or sub-domain
RNSAGELAELFGKPAVKLDESRR

SEQ ID NO: 17041 - protein, 20 aa, artificial
  peptide fold or domain or sub-domain
RNSAGELASLFGIRALDYDK

SEQ ID NO: 17042 - protein, 22 aa, artificial
  peptide fold or domain or sub-domain
RNSDALALQRNSSLQLDYATVN

SEQ ID NO: 17043 - protein, 22 aa, artificial
  peptide fold or domain or sub-domain
RNSDALHLMKAATVDMPYEDVN

SEQ ID NO: 17044 - protein, 21 aa, artificial
  peptide fold or domain or sub-domain
RNSDGSINLDDPPIVSEIGTD

SEQ ID NO: 17045 - protein, 20 aa, artificial
  peptide fold or domain or sub-domain
RNSEWASKTVEEQPLLFPKL

SEQ ID NO: 17046 - protein, 21 aa, artificial
  peptide fold or domain or sub-domain
RNSFIKMLLKKGKKSIAENLY

SEQ ID NO: 17047 - protein, 29 aa, artificial
  peptide fold or domain or sub-domain
RNSYHGNAAATMGATAQSNWKFNVVQSGV

SEQ ID NO: 17048 - protein, 20 aa, artificial
  peptide fold or domain or sub-domain
RNTAGSHTTGTYATGGSTIH

SEQ ID NO: 17049 - protein, 24 aa, artificial
  peptide fold or domain or sub-domain
RNTAQKNGFTLPDFATFWADGQYR

SEQ ID NO: 17050 - protein, 27 aa, artificial
  peptide fold or domain or sub-domain
RNTISVKKPAVKRKPPPIKDKKISNTD

SEQ ID NO: 17051 - protein, 24 aa, artificial
  peptide fold or domain or sub-domain
RNTLFPLSKLHGNGHEQCGAPGPL

SEQ ID NO: 17052 - protein, 27 aa, artificial
  peptide fold or domain or sub-domain
RNVCLVDFQQQSQLNPAIPMANIVGVI

SEQ ID NO: 17053 - protein, 26 aa, artificial
  peptide fold or domain or sub-domain
RNVFAFYDRERTGQVTFTFDTFIGGS

SEQ ID NO: 17054 - protein, 22 aa, artificial
  peptide fold or domain or sub-domain
RNVSKEQLDTLAEKGYTPDDKI

SEQ ID NO: 17055 - protein, 27 aa, artificial
  peptide fold or domain or sub-domain
RNVTKVDFSQRPFKVWIGDKLHLAKSI

SEQ ID NO: 17056 - protein, 29 aa, artificial
  peptide fold or domain or sub-domain
RNVVVSRNPQWQAEGVEVAPSLDAALALL

SEQ ID NO: 17057 - protein, 29 aa, artificial
  peptide fold or domain or sub-domain
RNVVVTRSQAYTAEGVDIVHSIDEAIRLT

SEQ ID NO: 17058 - protein, 30 aa, artificial
  peptide fold or domain or sub-domain
RNWVNEHLRETGMQLMQIPIVSQVHDWATD

SEQ ID NO: 17059 - protein, 30 aa, artificial
  peptide fold or domain or sub-domain
RNWVNSLVSQKGIGVVNNIKTGLTPTCFKE

SEQ ID NO: 17060 - protein, 24 aa, artificial
  peptide fold or domain or sub-domain
RNYFTHFGNMSDAEMKTTGVGKAH

SEQ ID NO: 17061 - protein, 29 aa, artificial
  peptide fold or domain or sub-domain
RNYRFWADLTEALKTGKAQSEVKQTGRPF

SEQ ID NO: 17062 - protein, 30 aa, artificial
  peptide fold or domain or sub-domain
RPAIVIGDLDSLGATRLALLAADGVEVRRF

SEQ ID NO: 17063 - protein, 29 aa, artificial
  peptide fold or domain or sub-domain
RPALLRSLEQKLKTGTQCVRCAICSVRQL

SEQ ID NO: 17064 - protein, 28 aa, artificial
  peptide fold or domain or sub-domain
RPASHQTFPLQVECTVAQYFKQKYNLQL

SEQ ID NO: 17065 - protein, 28 aa, artificial
  peptide fold or domain or sub-domain
RPAVIIAKTIRGRGIAQIEDTAKQRLPR

SEQ ID NO: 17066 - protein, 25 aa, artificial
  peptide fold or domain or sub-domain
RPCYSVSCGVWQKCETDSSGVGVCR

SEQ ID NO: 17067 - protein, 30 aa, artificial
  peptide fold or domain or sub-domain
RPDEAARRLAARGDRDRMGSKPADYQARLA

SEQ ID NO: 17068 - protein, 25 aa, artificial
  peptide fold or domain or sub-domain
RPDLVVDGEMQADTATNEDILSSTY

SEQ ID NO: 17069 - protein, 30 aa, artificial
  peptide fold or domain or sub-domain
RPDMLLGDFDSIDEEVFNYFKEFHINTIKF

SEQ ID NO: 17070 - protein, 30 aa, artificial
  peptide fold or domain or sub-domain
RPEDIIINIGKEAPIPVPNIPGQWKGIQHD

SEQ ID NO: 17071 - protein, 30 aa, artificial
  peptide fold or domain or sub-domain
RPELTNQQGYLQNRMTYDGLHLVGGGYLRW

SEQ ID NO: 17072 - protein, 30 aa, artificial
  peptide fold or domain or sub-domain
RPERVLEITRGWAEATWEAGIAFGTVGLAR

SEQ ID NO: 17073 - protein, 20 aa, artificial
  peptide fold or domain or sub-domain
RPFDIARYQESGELSYTGPA

SEQ ID NO: 17074 - protein, 27 aa, artificial
  peptide fold or domain or sub-domain
RPFERRQASYRLRQADGSTVDKPLEIR

SEQ ID NO: 17075 - protein, 26 aa, artificial
  peptide fold or domain or sub-domain
RPFKCEICTKEFTQLAHLQKHHLVHT

SEQ ID NO: 17076 - protein, 30 aa, artificial
  peptide fold or domain or sub-domain
RPFLIIGDFDSVDREVLEFYQKEGVKVEKF

SEQ ID NO: 17077 - protein, 28 aa, artificial
  peptide fold or domain or sub-domain
RPFLVHAKCPLLNHHTSGVRMEFYRDDL

SEQ ID NO: 17078 - protein, 27 aa, artificial
  peptide fold or domain or sub-domain
RPFNTDTKVLKVKQPDGSLRADTLTVR

SEQ ID NO: 17079 - protein, 26 aa, artificial
  peptide fold or domain or sub-domain
RPFPCPECGARFARGSHLAAHVRGHT

SEQ ID NO: 17080 - protein, 26 aa, artificial
  peptide fold or domain or sub-domain
RPFRCVDCGKAFAKGAVLLSHRRIHT

SEQ ID NO: 17081 - protein, 22 aa, artificial
  peptide fold or domain or sub-domain
RPGDAKDSFELKPEESREVTFA

SEQ ID NO: 17082 - protein, 25 aa, artificial
  peptide fold or domain or sub-domain
RPGLMIDGPMQYDAASVESVGRQKA

SEQ ID NO: 17083 - protein, 28 aa, artificial
  peptide fold or domain or sub-domain
RPHCIVAHTNKGHGISFMQDKVDWHHKV

SEQ ID NO: 17084 - protein, 28 aa, artificial
  peptide fold or domain or sub-domain
RPIFSGRDSVVKYTVAEIEYERRNGYRW

SEQ ID NO: 17085 - protein, 22 aa, artificial
  peptide fold or domain or sub-domain
RPIIHFGSDYEDRYYRENMHRY

SEQ ID NO: 17086 - protein, 30 aa, artificial
  peptide fold or domain or sub-domain
RPIWLRSPKELKDEDYKQFFSVLSGYNDQP

SEQ ID NO: 17087 - protein, 20 aa, artificial
  peptide fold or domain or sub-domain
RPKIIELLKTNQQYDLYHNI

SEQ ID NO: 17088 - protein, 27 aa, artificial
  peptide fold or domain or sub-domain
RPKSWIEEQEMGSFLSVAKGSEEPPVF

SEQ ID NO: 17089 - protein, 26 aa, artificial
  peptide fold or domain or sub-domain
RPLIELLAEHPEINKHVTREQLASFC

SEQ ID NO: 17090 - protein, 27 aa, artificial
  peptide fold or domain or sub-domain
RPLKTEVITAPYRTADGAMAERKFTVF

SEQ ID NO: 17091 - protein, 24 aa, artificial
  peptide fold or domain or sub-domain
RPLTEVLFQDTEGALDETRYTQPA

SEQ ID NO: 17092 - protein, 21 aa, artificial
  peptide fold or domain or sub-domain
RPMAELAEELEVSESRISQMR

SEQ ID NO: 17093 - protein, 30 aa, artificial
  peptide fold or domain or sub-domain
RPPEIKRLLRPHAGYMWDVGERFGTIGAAV

SEQ ID NO: 17094 - protein, 25 aa, artificial
  peptide fold or domain or sub-domain
RPPFQASDPMKTYTLILKGVDALEI

SEQ ID NO: 17095 - protein, 30 aa, artificial
  peptide fold or domain or sub-domain
RPQAIVDIVTPLAETVWDTGIEYGTVSALV

SEQ ID NO: 17096 - protein, 30 aa, artificial
  peptide fold or domain or sub-domain
RPQFIFASDVWWGRNDFAKDAEFFSLPNVV

SEQ ID NO: 17097 - protein, 21 aa, artificial
  peptide fold or domain or sub-domain
RPQKGGMQRGQAAMADGASRE

SEQ ID NO: 17098 - protein, 26 aa, artificial
  peptide fold or domain or sub-domain
RPRGRRADGTLDRDLDSRIELDMRTD

SEQ ID NO: 17099 - protein, 23 aa, artificial
  peptide fold or domain or sub-domain
RPSDEQIRAKLTSLQYKVTQRDG

SEQ ID NO: 17100 - protein, 28 aa, artificial
  peptide fold or domain or sub-domain
RPSVILCDTKVGRGVPLLEEREKAHFMR

SEQ ID NO: 17101 - protein, 23 aa, artificial
  peptide fold or domain or sub-domain
RPTEEEIKERLSEEQYAICRGNG

SEQ ID NO: 17102 - protein, 27 aa, artificial
  peptide fold or domain or sub-domain
RPTKEIMTKAKLQGIEIKWSDKYQEPY

SEQ ID NO: 17103 - protein, 28 aa, artificial
  peptide fold or domain or sub-domain
RPTLFEEKFGPGATTQQFRFGEECTGHS

SEQ ID NO: 17104 - protein, 26 aa, artificial
  peptide fold or domain or sub-domain
RPTLFRWLQEAGNIPERDLWHTFNLG

SEQ ID NO: 17105 - protein, 22 aa, artificial
  peptide fold or domain or sub-domain
RPTTELASTDIATHALSALKES

SEQ ID NO: 17106 - protein, 28 aa, artificial
  peptide fold or domain or sub-domain
RPVLIEMMTYRVGHHSTSDDSTKYRAAD

SEQ ID NO: 17107 - protein, 30 aa, artificial
  peptide fold or domain or sub-domain
RPVLRLTSAMTREVATDHKAFYVLFTWDQE

SEQ ID NO: 17108 - protein, 24 aa, artificial
  peptide fold or domain or sub-domain
RPVRSVMWGEDPAELDRTGWTQPA

SEQ ID NO: 17109 - protein, 20 aa, artificial
  peptide fold or domain or sub-domain
RPWAAIRKFGIWSTMKSQIR

SEQ ID NO: 17110 - protein, 29 aa, artificial
  peptide fold or domain or sub-domain
RPWKDSATLRTQSDALYKARGFADPAVAK

SEQ ID NO: 17111 - protein, 28 aa, artificial
  peptide fold or domain or sub-domain
RPYAVEAITYRIAPHGAADFFEKYRTKE

SEQ ID NO: 17112 - protein, 26 aa, artificial
  peptide fold or domain or sub-domain
RPYIEGDKIGIKITPERLSSMPEAMK

SEQ ID NO: 17113 - protein, 26 aa, artificial
  peptide fold or domain or sub-domain
RPYKCDQCSREFMRSDHLKQHQKTHR

SEQ ID NO: 17114 - protein, 26 aa, artificial
  peptide fold or domain or sub-domain
RPYLCIHCNAKFVHNYDLKNHMRIHT

SEQ ID NO: 17115 - protein, 26 aa, artificial
  peptide fold or domain or sub-domain
RPYRCPDCPKAFKNTSCLGPHRQLHT

SEQ ID NO: 17116 - protein, 26 aa, artificial
  peptide fold or domain or sub-domain
RPYTCEICDGKFSDSNQLKSHMLVHN

SEQ ID NO: 17117 - protein, 26 aa, artificial
  peptide fold or domain or sub-domain
RPYVCEDCGERFRQKVQIRRHERQLH

SEQ ID NO: 17118 - protein, 26 aa, artificial
  peptide fold or domain or sub-domain
RPYVCQDCGKGFVQSSSLTQHQRVHS

SEQ ID NO: 17119 - protein, 26 aa, artificial
  peptide fold or domain or sub-domain
RPYVCSECWKTFSQRHHLEVHQRSHT

SEQ ID NO: 17120 - protein, 29 aa, artificial
  peptide fold or domain or sub-domain
RQAAAEALNKIVADCPADNVASGLQALDT

SEQ ID NO: 17121 - protein, 22 aa, artificial
  peptide fold or domain or sub-domain
RQAAAHFQETKYGVHYDAEDQV

SEQ ID NO: 17122 - protein, 22 aa, artificial
  peptide fold or domain or sub-domain
RQAIATHYGHWHGLKLDPMSEV

SEQ ID NO: 17123 - protein, 30 aa, artificial
  peptide fold or domain or sub-domain
RQAIDRCSNIWASLPGAGYGQFEHKADSLI

SEQ ID NO: 17124 - protein, 22 aa, artificial
  peptide fold or domain or sub-domain
RQAISEKISSLYGRRYDATTEI

SEQ ID NO: 17125 - protein, 28 aa, artificial
  peptide fold or domain or sub-domain
RQAKDQDQLMDAHTCKLLITRYNKDDIV

SEQ ID NO: 17126 - protein, 23 aa, artificial
  peptide fold or domain or sub-domain
RQATGTVAEILGERELQRDIGTR

SEQ ID NO: 17127 - protein, 28 aa, artificial
  peptide fold or domain or sub-domain
RQATGTVAEILGERELQRDIGTRLFAYR

SEQ ID NO: 17128 - protein, 22 aa, artificial
  peptide fold or domain or sub-domain
RQAYSRHDYVRDGVAGQYLSLQ

SEQ ID NO: 17129 - protein, 27 aa, artificial
  peptide fold or domain or sub-domain
RQCWEAPRPDERRLLAMAHRELAMVRQ

SEQ ID NO: 17130 - protein, 30 aa, artificial
  peptide fold or domain or sub-domain
RQEAYKQYNAMENRFSVNFQKAAKSFSLEI

SEQ ID NO: 17131 - protein, 26 aa, artificial
  peptide fold or domain or sub-domain
RQEEIDKIQSELEAAGKDRHAIQEAL

SEQ ID NO: 17132 - protein, 22 aa, artificial
  peptide fold or domain or sub-domain
RQEISKYLYQTYGLEYNPETEV

SEQ ID NO: 17133 - protein, 26 aa, artificial
  peptide fold or domain or sub-domain
RQEQERTLLATKGTGMTPDQVTQFVN

SEQ ID NO: 17134 - protein, 24 aa, artificial
  peptide fold or domain or sub-domain
RQEVYVDTFAENNPAVIAHIDLAD

SEQ ID NO: 17135 - protein, 22 aa, artificial
  peptide fold or domain or sub-domain
RQFDYGNDEKNYRVYNSVQPPE

SEQ ID NO: 17136 - protein, 26 aa, artificial
  peptide fold or domain or sub-domain
RQFTLSIIQDNFPDPEERRQRREAVE

SEQ ID NO: 17137 - protein, 25 aa, artificial
  peptide fold or domain or sub-domain
RQFVATLAAFAPMRKARQRLCVWVA

SEQ ID NO: 17138 - protein, 27 aa, artificial
  peptide fold or domain or sub-domain
RQGFAHPFPDEALLLKLRSGRRALVRE

SEQ ID NO: 17139 - protein, 27 aa, artificial
  peptide fold or domain or sub-domain
RQGWLRPTRSEAKALGMTERQFALVRE

SEQ ID NO: 17140 - protein, 29 aa, artificial
  peptide fold or domain or sub-domain
RQHIKALFLPATTEILSWKKAIESGILDR

SEQ ID NO: 17141 - protein, 25 aa, artificial
  peptide fold or domain or sub-domain
RQILGVLAKFAPNPEAEAVLKDLNS

SEQ ID NO: 17142 - protein, 22 aa, artificial
  peptide fold or domain or sub-domain
RQINEEQLAANKDKGYKMGDPF

SEQ ID NO: 17143 - protein, 23 aa, artificial
  peptide fold or domain or sub-domain
RQKCRLTKNCKPKDGRWFCKKCR

SEQ ID NO: 17144 - protein, 24 aa, artificial
  peptide fold or domain or sub-domain
RQKFAEKFEVKFEDMKGEKAMVWQ

SEQ ID NO: 17145 - protein, 29 aa, artificial
  peptide fold or domain or sub-domain
RQKIAALYIPESSQVIGLDAAKQLGIIDN

SEQ ID NO: 17146 - protein, 22 aa, artificial
  peptide fold or domain or sub-domain
RQLAIVAYGKAEKWQALLAISD

SEQ ID NO: 17147 - protein, 26 aa, artificial
  peptide fold or domain or sub-domain
RQLIMTALEKIAQHQFSKTRSLLDEA

SEQ ID NO: 17148 - protein, 25 aa, artificial
  peptide fold or domain or sub-domain
RQLLAFIAPFAPTETAKKEALRLGS

SEQ ID NO: 17149 - protein, 25 aa, artificial
  peptide fold or domain or sub-domain
RQLLTLLAGFCEDTADKERLELLVN

SEQ ID NO: 17150 - protein, 29 aa, artificial
  peptide fold or domain or sub-domain
RQLVTLRELNGPKTKLENLERMLVDLGAL

SEQ ID NO: 17151 - protein, 29 aa, artificial
  peptide fold or domain or sub-domain
RQLWRMRSSLDLLGTTLDVVTGEWIEYSS

SEQ ID NO: 17152 - protein, 26 aa, artificial
  peptide fold or domain or sub-domain
RQNEKLRNVIVTNAPETLIEENWMVL

SEQ ID NO: 17153 - protein, 20 aa, artificial
  peptide fold or domain or sub-domain
RQNVGTHSTQNSVSNGSSLN

SEQ ID NO: 17154 - protein, 26 aa, artificial
  peptide fold or domain or sub-domain
RQPCFKLNHRFRLKNFAPNTWRLSRT

SEQ ID NO: 17155 - protein, 26 aa, artificial
  peptide fold or domain or sub-domain
RQPCSKLAFKHQLPDLPKAVCQTGKS

SEQ ID NO: 17156 - protein, 26 aa, artificial
  peptide fold or domain or sub-domain
RQPCVKLAKKFGVKEMVLKVQQTGYT

SEQ ID NO: 17157 - protein, 26 aa, artificial
  peptide fold or domain or sub-domain
RQPCWKLNMHTGNPAQAAHFQKTGRT

SEQ ID NO: 17158 - protein, 26 aa, artificial
  peptide fold or domain or sub-domain
RQPCWKLSANNDRSDLSLQIYRLGLT

SEQ ID NO: 17159 - protein, 26 aa, artificial
  peptide fold or domain or sub-domain
RQPCYKLNHRFQHKKTSAMAQSTGRM

SEQ ID NO: 17160 - protein, 22 aa, artificial
  peptide fold or domain or sub-domain
RQPWLTYLAGQEEYSRFIRDFR

SEQ ID NO: 17161 - protein, 30 aa, artificial
  peptide fold or domain or sub-domain
RQPYVIDRIRIHELKEPTSLGLVYLNEYGA

SEQ ID NO: 17162 - protein, 30 aa, artificial
  peptide fold or domain or sub-domain
RQQFVASPWCNSAYDNKVIPIECGEYIERL

SEQ ID NO: 17163 - protein, 24 aa, artificial
  peptide fold or domain or sub-domain
RQQQRWALYSDGTIRADSDRSLRV

SEQ ID NO: 17164 - protein, 29 aa, artificial
  peptide fold or domain or sub-domain
RQQVLEDTIQPAIDSGKGLMFTQPNQAAG

SEQ ID NO: 17165 - protein, 27 aa, artificial
  peptide fold or domain or sub-domain
RQQVTLSHSKDLLSPYFSEENKVLVRE

SEQ ID NO: 17166 - protein, 24 aa, artificial
  peptide fold or domain or sub-domain
RQRVDNGIFVDDVSWGQLSYLNKN

SEQ ID NO: 17167 - protein, 24 aa, artificial
  peptide fold or domain or sub-domain
RQRVLGGAFPLSANSIDCKTPLNP

SEQ ID NO: 17168 - protein, 27 aa, artificial
  peptide fold or domain or sub-domain
RQSAIKDLRDARVEDKNIGACSKARQY

SEQ ID NO: 17169 - protein, 30 aa, artificial
  peptide fold or domain or sub-domain
RQSFLAAAWSHLAYSPRTAPLDCGEYMEGI

SEQ ID NO: 17170 - protein, 25 aa, artificial
  peptide fold or domain or sub-domain
RQSLMSFVEFAPTDSAKDLLKLLAT

SEQ ID NO: 17171 - protein, 29 aa, artificial
  peptide fold or domain or sub-domain
RQSYHGNTLGSLSLGGHVGRRAPYAPILT

SEQ ID NO: 17172 - protein, 25 aa, artificial
  peptide fold or domain or sub-domain
RQTLNSFAKFAPSPDIQAKLEKVCA

SEQ ID NO: 17173 - protein, 22 aa, artificial
  peptide fold or domain or sub-domain
RQVHREIFDMDEIPEEAIPELV

SEQ ID NO: 17174 - protein, 25 aa, artificial
  peptide fold or domain or sub-domain
RQVREEIAALPDWSVAALDAVIKTV

SEQ ID NO: 17175 - protein, 30 aa, artificial
  peptide fold or domain or sub-domain
RQVSNHDLVGRINTSDEFIVERTGVRTRYH

SEQ ID NO: 17176 - protein, 24 aa, artificial
  peptide fold or domain or sub-domain
RQWAAQQLNHDVARMGLYGLAPIP

SEQ ID NO: 17177 - protein, 27 aa, artificial
  peptide fold or domain or sub-domain
RQYNWNNILPTYSGRESNVQKMAISEL

SEQ ID NO: 17178 - protein, 29 aa, artificial
  peptide fold or domain or sub-domain
RQYTIPQYRRKYAPLLTEPDTSLDETVTI

SEQ ID NO: 17179 - protein, 25 aa, artificial
  peptide fold or domain or sub-domain
RRADDIAHDPASQGFPAGHPPMRTF

SEQ ID NO: 17180 - protein, 27 aa, artificial
  peptide fold or domain or sub-domain
RRAIGWERRNDPAWKQPADRPSIRRGI

SEQ ID NO: 17181 - protein, 20 aa, artificial
  peptide fold or domain or sub-domain
RRALGRFAAWAGKEALSSDM

SEQ ID NO: 17182 - protein, 23 aa, artificial
  peptide fold or domain or sub-domain
RRALGRFAAWAGKEALSSDMLMR

SEQ ID NO: 17183 - protein, 28 aa, artificial
  peptide fold or domain or sub-domain
RRALGRFAAWAGKEALSSDMLMRRLDLA

SEQ ID NO: 17184 - protein, 23 aa, artificial
  peptide fold or domain or sub-domain
RRALNAEVNPSRSATSFHYTGRA

SEQ ID NO: 17185 - protein, 20 aa, artificial
  peptide fold or domain or sub-domain
RRATLAKDNQTRAFYSSIAG

SEQ ID NO: 17186 - protein, 22 aa, artificial
  peptide fold or domain or sub-domain
RRAVAQWYKGRFGVELDPETEI

SEQ ID NO: 17187 - protein, 23 aa, artificial
  peptide fold or domain or sub-domain
RRAVEGETTGKYEKALVGIIEQN

SEQ ID NO: 17188 - protein, 22 aa, artificial
  peptide fold or domain or sub-domain
RRAWLHQRADAGDWQGFIAAYD

SEQ ID NO: 17189 - protein, 22 aa, artificial
  peptide fold or domain or sub-domain
RRCFQQLMDEDVINDENIGVMG

SEQ ID NO: 17190 - protein, 21 aa, artificial
  peptide fold or domain or sub-domain
RRDELKALYQTYKKASHIDAL

SEQ ID NO: 17191 - protein, 23 aa, artificial
  peptide fold or domain or sub-domain
RRDMGRMAEAFGKAFVAADKAAR

SEQ ID NO: 17192 - protein, 27 aa, artificial
  peptide fold or domain or sub-domain
RRDQSMLTFESSQSLGVAGILEKLTNL

SEQ ID NO: 17193 - protein, 22 aa, artificial
  peptide fold or domain or sub-domain
RRDTYDADPKAFLEEWRPKDMD

SEQ ID NO: 17194 - protein, 24 aa, artificial
  peptide fold or domain or sub-domain
RRDVQMMYTDTEHLHVMDKEDYQQ

SEQ ID NO: 17195 - protein, 24 aa, artificial
  peptide fold or domain or sub-domain
RRDVTYLYNDGTSFIVMDDKTFEQ

SEQ ID NO: 17196 - protein, 24 aa, artificial
  peptide fold or domain or sub-domain
RREAMLSYIDGDEYVFMDNEDYTP

SEQ ID NO: 17197 - protein, 26 aa, artificial
  peptide fold or domain or sub-domain
RREDQHVQRALLVISSGDYDGIGERR

SEQ ID NO: 17198 - protein, 20 aa, artificial
  peptide fold or domain or sub-domain
RRETAVQSLGSSWTGPPGGP

SEQ ID NO: 17199 - protein, 23 aa, artificial
  peptide fold or domain or sub-domain
RRETRWKCYEENESYTARDDENF

SEQ ID NO: 17200 - protein, 20 aa, artificial
  peptide fold or domain or sub-domain
RRFTVIRGPFKHKDSREHFE

SEQ ID NO: 17201 - protein, 23 aa, artificial
  peptide fold or domain or sub-domain
RRGAGELSVLFGARALDMDKTSR

SEQ ID NO: 17202 - protein, 29 aa, artificial
  peptide fold or domain or sub-domain
RRGHEVLSQGSDAGVEIYEPFFTQGETKI

SEQ ID NO: 17203 - protein, 27 aa, artificial
  peptide fold or domain or sub-domain
RRGKPGFGAVPKAEAVPDAEFDDMRAF

SEQ ID NO: 17204 - protein, 24 aa, artificial
  peptide fold or domain or sub-domain
RRGRNVVFRQVDADNFNNFIDSSF

SEQ ID NO: 17205 - protein, 25 aa, artificial
  peptide fold or domain or sub-domain
RRIALEAGRIATDALGRTSLARVWA

SEQ ID NO: 17206 - protein, 22 aa, artificial
  peptide fold or domain or sub-domain
RRIITEYAQEFYSEPYNPVTEV

SEQ ID NO: 17207 - protein, 30 aa, artificial
  peptide fold or domain or sub-domain
RRILGNPGVSEADMAGRLRQALFASAHKDF

SEQ ID NO: 17208 - protein, 27 aa, artificial
  peptide fold or domain or sub-domain
RRIRKRSYVIDVKVAPDAVFALSKDLY

SEQ ID NO: 17209 - protein, 21 aa, artificial
  peptide fold or domain or sub-domain
RRKEISRRKYGTSHVMAEEEL

SEQ ID NO: 17210 - protein, 30 aa, artificial
  peptide fold or domain or sub-domain
RRKEISRRKYGTSHVMAEEELEELLEEKPE

SEQ ID NO: 17211 - protein, 22 aa, artificial
  peptide fold or domain or sub-domain
RRKMDFLVASGVPERHAQMAML

SEQ ID NO: 17212 - protein, 30 aa, artificial
  peptide fold or domain or sub-domain
RRLFLSARHHSLAYEDAMLPIECGQIVSAP

SEQ ID NO: 17213 - protein, 25 aa, artificial
  peptide fold or domain or sub-domain
RRLHPDKPAYTILAQMHRDMSEWVH

SEQ ID NO: 17214 - protein, 22 aa, artificial
  peptide fold or domain or sub-domain
RRLIVHAAEDVGLADPMALNVA

SEQ ID NO: 17215 - protein, 20 aa, artificial
  peptide fold or domain or sub-domain
RRLSSMEDRDRVDRDAEEAL

SEQ ID NO: 17216 - protein, 25 aa, artificial
  peptide fold or domain or sub-domain
RRLSWDEPSLTLTCAPAQKQTERCH

SEQ ID NO: 17217 - protein, 24 aa, artificial
  peptide fold or domain or sub-domain
RRLTRGHPSFKERVMAYLTNIDKY

SEQ ID NO: 17218 - protein, 24 aa, artificial
  peptide fold or domain or sub-domain
RRLVAFYSPELLTADEMALFKAYL

SEQ ID NO: 17219 - protein, 26 aa, artificial
  peptide fold or domain or sub-domain
RRLVKAGFGLRRKTLRNALGSAKLAE

SEQ ID NO: 17220 - protein, 25 aa, artificial
  peptide fold or domain or sub-domain
RRMHRNEPSKTIIAAGGGGTWAITS

SEQ ID NO: 17221 - protein, 27 aa, artificial
  peptide fold or domain or sub-domain
RRMILSGLSNRIRVKNRSPLSHLGSTL

SEQ ID NO: 17222 - protein, 26 aa, artificial
  peptide fold or domain or sub-domain
RRPCRTFAHWLDIKGWLKTFTQRGLP

SEQ ID NO: 17223 - protein, 26 aa, artificial
  peptide fold or domain or sub-domain
RRPCYKPAWRFGVRDLALLTQESGMT

SEQ ID NO: 17224 - protein, 25 aa, artificial
  peptide fold or domain or sub-domain
RRPFHIHSSTAATDIVHVFHTATVT

SEQ ID NO: 17225 - protein, 25 aa, artificial
  peptide fold or domain or sub-domain
RRPYYGNRREIREQILAKQVQIQTS

SEQ ID NO: 17226 - protein, 22 aa, artificial
  peptide fold or domain or sub-domain
RRQSWLDLLFSHAVEPNLGHDL

SEQ ID NO: 17227 - protein, 29 aa, artificial
  peptide fold or domain or sub-domain
RRRGRELWLEPYNESYRFRTETSFGITDA

SEQ ID NO: 17228 - protein, 29 aa, artificial
  peptide fold or domain or sub-domain
RRRKAVKDLLKQGGTPEETKALDIRQKAL

SEQ ID NO: 17229 - protein, 21 aa, artificial
  peptide fold or domain or sub-domain
RRRVEEDIEGASPTRERVLAA

SEQ ID NO: 17230 - protein, 21 aa, artificial
  peptide fold or domain or sub-domain
RRSCPQLELVVDMALAPVFAV

SEQ ID NO: 17231 - protein, 20 aa, artificial
  peptide fold or domain or sub-domain
RRSHGRLAEVLGPQAVQADV

SEQ ID NO: 17232 - protein, 23 aa, artificial
  peptide fold or domain or sub-domain
RRSHGRLAEVLGPQAVQADVRQR

SEQ ID NO: 17233 - protein, 29 aa, artificial
  peptide fold or domain or sub-domain
RRSRYILFFQIPWLPEAILSANHGAAFDR

SEQ ID NO: 17234 - protein, 23 aa, artificial
  peptide fold or domain or sub-domain
RRSTRMLSRGVPADERARCAREI

SEQ ID NO: 17235 - protein, 21 aa, artificial
  peptide fold or domain or sub-domain
RRSYSYGGSSVVFGSDELNKV

SEQ ID NO: 17236 - protein, 23 aa, artificial
  peptide fold or domain or sub-domain
RRTADVDTISDNEYIFEIDCQQT

SEQ ID NO: 17237 - protein, 21 aa, artificial
  peptide fold or domain or sub-domain
RRTIDSDLRRHGLPFERVVAA

SEQ ID NO: 17238 - protein, 25 aa, artificial
  peptide fold or domain or sub-domain
RRVAWDRPSPTLVTHPAMPATDLAH

SEQ ID NO: 17239 - protein, 30 aa, artificial
  peptide fold or domain or sub-domain
RRVFFGKKDLVMPFKATKPHLADGMTVEQL

SEQ ID NO: 17240 - protein, 22 aa, artificial
  peptide fold or domain or sub-domain
RRVISDYIKKFYEVSYSPESEI

SEQ ID NO: 17241 - protein, 29 aa, artificial
  peptide fold or domain or sub-domain
RRVRIEEPGDTELLPGELVELHELNRINA

SEQ ID NO: 17242 - protein, 28 aa, artificial
  peptide fold or domain or sub-domain
RRYIQSVKDNLRGMVKSTMLDEVNRQID

SEQ ID NO: 17243 - protein, 20 aa, artificial
  peptide fold or domain or sub-domain
RSAAAELSEDVQTTFNTLTA

SEQ ID NO: 17244 - protein, 20 aa, artificial
  peptide fold or domain or sub-domain
RSAHQYVVLEHSGHVITDDV

SEQ ID NO: 17245 - protein, 24 aa, artificial
  peptide fold or domain or sub-domain
RSALEEGVPVGDATWQKLCKHAEI

SEQ ID NO: 17246 - protein, 30 aa, artificial
  peptide fold or domain or sub-domain
RSASQDLAQVLQIEPHNSAARKQLDAIRAR

SEQ ID NO: 17247 - protein, 26 aa, artificial
  peptide fold or domain or sub-domain
RSAYDLTVHAEYTGTSLAVKEPLPEP

SEQ ID NO: 17248 - protein, 26 aa, artificial
  peptide fold or domain or sub-domain
RSCIIEAMKLGRQRKFTEAYKKIDEA

SEQ ID NO: 17249 - protein, 26 aa, artificial
  peptide fold or domain or sub-domain
RSCIIQSLRAYKEGKKDEADALIAKA

SEQ ID NO: 17250 - protein, 20 aa, artificial
  peptide fold or domain or sub-domain
RSCSSPAVSYDIESHPASPV

SEQ ID NO: 17251 - protein, 26 aa, artificial
  peptide fold or domain or sub-domain
RSCVRDRRARRVDRFFRHNPGMADDY

SEQ ID NO: 17252 - protein, 24 aa, artificial
  peptide fold or domain or sub-domain
RSDLGNLLKALGRLEEAKACYLKA

SEQ ID NO: 17253 - protein, 26 aa, artificial
  peptide fold or domain or sub-domain
RSDYDLKRHQEYSGEALHIVDNGKTV

SEQ ID NO: 17254 - protein, 26 aa, artificial
  peptide fold or domain or sub-domain
RSDYDLSAHAKKSGEKFEVMDGEEKV

SEQ ID NO: 17255 - protein, 30 aa, artificial
  peptide fold or domain or sub-domain
RSEIFDDMIAHYPHDEYLQEKISILTSIDN

SEQ ID NO: 17256 - protein, 26 aa, artificial
  peptide fold or domain or sub-domain
RSEIHEAFAKMREGSFDDAESKLNQS

SEQ ID NO: 17257 - protein, 20 aa, artificial
  peptide fold or domain or sub-domain
RSENDLFLNGAQPSLMTGAS

SEQ ID NO: 17258 - protein, 26 aa, artificial
  peptide fold or domain or sub-domain
RSFAMEALQFAKQGKMAEADEAMVKA

SEQ ID NO: 17259 - protein, 26 aa, artificial
  peptide fold or domain or sub-domain
RSFLEIGLGDVGLVGGKTASLGELYS

SEQ ID NO: 17260 - protein, 22 aa, artificial
  peptide fold or domain or sub-domain
RSFTSHMIVRKLKEKHNMEVLF

SEQ ID NO: 17261 - protein, 22 aa, artificial
  peptide fold or domain or sub-domain
RSFTYMLRDMVIYKTGGDELIE

SEQ ID NO: 17262 - protein, 24 aa, artificial
  peptide fold or domain or sub-domain
RSGLEQSKSSEAIFLDLALEDLTR

SEQ ID NO: 17263 - protein, 22 aa, artificial
  peptide fold or domain or sub-domain
RSGRFGARYGRVSRRRVAEIES

SEQ ID NO: 17264 - protein, 28 aa, artificial
  peptide fold or domain or sub-domain
RSIEDARAKMVQAGFTGQELERQARHRV

SEQ ID NO: 17265 - protein, 29 aa, artificial
  peptide fold or domain or sub-domain
RSISPEEIETKFADKSKEELEEAAIEVSV

SEQ ID NO: 17266 - protein, 29 aa, artificial
  peptide fold or domain or sub-domain
RSIWKYRSDLELVGNHINIINGEWTIKEA

SEQ ID NO: 17267 - protein, 26 aa, artificial
  peptide fold or domain or sub-domain
RSKLLEALKAAENGDFAKADSLVVEA

SEQ ID NO: 17268 - protein, 26 aa, artificial
  peptide fold or domain or sub-domain
RSLAYNALKQAKAGDFAQAKELMAQS

SEQ ID NO: 17269 - protein, 26 aa, artificial
  peptide fold or domain or sub-domain
RSLCFEALKLSRQKEFVLADEKLAQA

SEQ ID NO: 17270 - protein, 28 aa, artificial
  peptide fold or domain or sub-domain
RSLEDVWHLMVFGELPDTATRAAFAARV

SEQ ID NO: 17271 - protein, 28 aa, artificial
  peptide fold or domain or sub-domain
RSLEQVAQLIWTGSMAPGDRAAVPGLFR

SEQ ID NO: 17272 - protein, 20 aa, artificial
  peptide fold or domain or sub-domain
RSLLEARYHGAELVTATEEM

SEQ ID NO: 17273 - protein, 24 aa, artificial
  peptide fold or domain or sub-domain
RSLNIIHFAQEALALENPPLKLLW

SEQ ID NO: 17274 - protein, 27 aa, artificial
  peptide fold or domain or sub-domain
RSLSVSSNEASAKYLLDRSTNNYWQSA

SEQ ID NO: 17275 - protein, 22 aa, artificial
  peptide fold or domain or sub-domain
RSMNFSLNTGYKVLSPEFFELE

SEQ ID NO: 17276 - protein, 23 aa, artificial
  peptide fold or domain or sub-domain
RSMYTYILEKLVDGNIYKEIQYL

SEQ ID NO: 17277 - protein, 24 aa, artificial
  peptide fold or domain or sub-domain
RSNSAEGIDLPDNVVADLNAIAAK

SEQ ID NO: 17278 - protein, 26 aa, artificial
  peptide fold or domain or sub-domain
RSNSFEALKYAREGNFEEAEKCLEKA

SEQ ID NO: 17279 - protein, 26 aa, artificial
  peptide fold or domain or sub-domain
RSPCFKLNKRWGIDNLSVDMQDVSRS

SEQ ID NO: 17280 - protein, 26 aa, artificial
  peptide fold or domain or sub-domain
RSPCFKLNLQFGHRDFALAMQQSQLC

SEQ ID NO: 17281 - protein, 26 aa, artificial
  peptide fold or domain or sub-domain
RSPCYKLNYHFDISDIAQLMQNTGKV

SEQ ID NO: 17282 - protein, 24 aa, artificial
  peptide fold or domain or sub-domain
RSPGGSAEAAEALSGNFIERIHTM

SEQ ID NO: 17283 - protein, 24 aa, artificial
  peptide fold or domain or sub-domain
RSPGGSPLTTLALNNGQPPQLDQF

SEQ ID NO: 17284 - protein, 24 aa, artificial
  peptide fold or domain or sub-domain
RSQLVPVRALGLGHRSDELVRFRF

SEQ ID NO: 17285 - protein, 25 aa, artificial
  peptide fold or domain or sub-domain
RSQVSSLAAATRCPPEKVELERLSA

SEQ ID NO: 17286 - protein, 29 aa, artificial
  peptide fold or domain or sub-domain
RSQYYASKFQLDYGYEMPVSLVAKKTADF

SEQ ID NO: 17287 - protein, 20 aa, artificial
  peptide fold or domain or sub-domain
RSRADLAEAASAPHGPIGPV

SEQ ID NO: 17288 - protein, 21 aa, artificial
  peptide fold or domain or sub-domain
RSRAEFNYQLGGDETLAVETF

SEQ ID NO: 17289 - protein, 29 aa, artificial
  peptide fold or domain or sub-domain
RSRFLALREEVPSLSRSTKTPKVVVLSKA

SEQ ID NO: 17290 - protein, 30 aa, artificial
  peptide fold or domain or sub-domain
RSRGVVCACSYEARTFGIHSAMPMSRALRL

SEQ ID NO: 17291 - protein, 24 aa, artificial
  peptide fold or domain or sub-domain
RSRILETLKKYNIKELDESLSHLS

SEQ ID NO: 17292 - protein, 29 aa, artificial
  peptide fold or domain or sub-domain
RSRKDVKGLMAKESDPARKKQYDLRQLAL

SEQ ID NO: 17293 - protein, 28 aa, artificial
  peptide fold or domain or sub-domain
RSRPDRSGWGKPETKYTKDGPGAPGGQS

SEQ ID NO: 17294 - protein, 24 aa, artificial
  peptide fold or domain or sub-domain
RSRVKELTGKLKSKDLDFALSDYQ

SEQ ID NO: 17295 - protein, 26 aa, artificial
  peptide fold or domain or sub-domain
RSSAMEAIAAAKSGDAEEARKKLQDA

SEQ ID NO: 17296 - protein, 21 aa, artificial
  peptide fold or domain or sub-domain
RSSGKSLPMHQLTVQQAREQF

SEQ ID NO: 17297 - protein, 20 aa, artificial
  peptide fold or domain or sub-domain
RSSIIYGSMFINDIKKNIHI

SEQ ID NO: 17298 - protein, 26 aa, artificial
  peptide fold or domain or sub-domain
RSSSMEALSAARKYDWDKAEELLNAA

SEQ ID NO: 17299 - protein, 29 aa, artificial
  peptide fold or domain or sub-domain
RSSTGVPRDMLHRYAEGQTVDDDDFKCYL

SEQ ID NO: 17300 - protein, 20 aa, artificial
  peptide fold or domain or sub-domain
RSTAFLRSPKVGGLYNQVSL

SEQ ID NO: 17301 - protein, 25 aa, artificial
  peptide fold or domain or sub-domain
RSTMQLLFFISENKLEKEKLYEFTT

SEQ ID NO: 17302 - protein, 20 aa, artificial
  peptide fold or domain or sub-domain
RSTQGTVAEVLGKDFVKFDK

SEQ ID NO: 17303 - protein, 23 aa, artificial
  peptide fold or domain or sub-domain
RSTQGTVAEVLGKDFVKFDKDIR

SEQ ID NO: 17304 - protein, 28 aa, artificial
  peptide fold or domain or sub-domain
RSTQGTVAEVLGKDFVKFDKDIRRNYWP

SEQ ID NO: 17305 - protein, 28 aa, artificial
  peptide fold or domain or sub-domain
RSVEDARRMLLKSGIDERESENLALHKS

SEQ ID NO: 17306 - protein, 28 aa, artificial
  peptide fold or domain or sub-domain
RSVLGEVAEVLGIERLPFDIQTRAMFDH

SEQ ID NO: 17307 - protein, 24 aa, artificial
  peptide fold or domain or sub-domain
RSVRDVVLDGPAELLAETVHAQPA

SEQ ID NO: 17308 - protein, 20 aa, artificial
  peptide fold or domain or sub-domain
RSVSNLELKQTLFDGAADVV

SEQ ID NO: 17309 - protein, 26 aa, artificial
  peptide fold or domain or sub-domain
RSWIEDINLQEKERPVPGFQTLVGGS

SEQ ID NO: 17310 - protein, 25 aa, artificial
  peptide fold or domain or sub-domain
RSWNAQDKVAQTLRDSWEAEGITEI

SEQ ID NO: 17311 - protein, 20 aa, artificial
  peptide fold or domain or sub-domain
RSYEDLRALQLSGRKAEYIV

SEQ ID NO: 17312 - protein, 29 aa, artificial
  peptide fold or domain or sub-domain
RSYFAPSPWTWDETREQYYFHSFASEQPD

SEQ ID NO: 17313 - protein, 26 aa, artificial
  peptide fold or domain or sub-domain
RSYMYEALSKAREGKYDEINGLIKQA

SEQ ID NO: 17314 - protein, 26 aa, artificial
  peptide fold or domain or sub-domain
RSYNYKKSRKVFRQTAHLAHHQRIHT

SEQ ID NO: 17315 - protein, 20 aa, artificial
  peptide fold or domain or sub-domain
RSYVDPSTDERLSYTQLLKR

SEQ ID NO: 17316 - protein, 29 aa, artificial
  peptide fold or domain or sub-domain
RTAVFSMLSDKDIDGVSETVKDQFDEWYI

SEQ ID NO: 17317 - protein, 28 aa, artificial
  peptide fold or domain or sub-domain
RTCVAKNLVKYGGLDEEKAEDFVKGDRF

SEQ ID NO: 17318 - protein, 26 aa, artificial
  peptide fold or domain or sub-domain
RTDHDLSGHMKVSGKDLTVQKDNKKF

SEQ ID NO: 17319 - protein, 23 aa, artificial
  peptide fold or domain or sub-domain
RTDIINSLSRCETFDFLIDMLPR

SEQ ID NO: 17320 - protein, 29 aa, artificial
  peptide fold or domain or sub-domain
RTDLAQDLQDKYGDMDKDELDAKQVVATI

SEQ ID NO: 17321 - protein, 24 aa, artificial
  peptide fold or domain or sub-domain
RTDMIRRMKQRDKRLRSSDILARL

SEQ ID NO: 17322 - protein, 24 aa, artificial
  peptide fold or domain or sub-domain
RTDYLLINIDDEYAFYFDQNDAEQ

SEQ ID NO: 17323 - protein, 21 aa, artificial
  peptide fold or domain or sub-domain
RTEKDAKGYVGFKLPVLDSSH

SEQ ID NO: 17324 - protein, 28 aa, artificial
  peptide fold or domain or sub-domain
RTEKDLLGLREVPNQFYFGIQTLRAIEN

SEQ ID NO: 17325 - protein, 22 aa, artificial
  peptide fold or domain or sub-domain
RTEKDSMRRVDELTKRLARMIQ

SEQ ID NO: 17326 - protein, 28 aa, artificial
  peptide fold or domain or sub-domain
RTEKDSMRRVDELTKRLARMIQLHTEIH

SEQ ID NO: 17327 - protein, 23 aa, artificial
  peptide fold or domain or sub-domain
RTELRSISTGNFKRLLLALFDGN

SEQ ID NO: 17328 - protein, 28 aa, artificial
  peptide fold or domain or sub-domain
RTERDVIGEIQLEDTVFYGINTARAKEN

SEQ ID NO: 17329 - protein, 23 aa, artificial
  peptide fold or domain or sub-domain
RTESRLPCYQERGDYPGKAPEDY

SEQ ID NO: 17330 - protein, 24 aa, artificial
  peptide fold or domain or sub-domain
RTFDAWFGNKQTPVNGLLPPSPEE

SEQ ID NO: 17331 - protein, 25 aa, artificial
  peptide fold or domain or sub-domain
RTFFEMASHFSNNKMHKERLQEFSS

SEQ ID NO: 17332 - protein, 22 aa, artificial
  peptide fold or domain or sub-domain
RTGHQDDARLLDALATPGLKAQ

SEQ ID NO: 17333 - protein, 28 aa, artificial
  peptide fold or domain or sub-domain
RTGHQDDARLLDALATPGLKAQLEARVG

SEQ ID NO: 17334 - protein, 30 aa, artificial
  peptide fold or domain or sub-domain
RTIAVDREPGAQVLAKELGADKVLSGGPDL

SEQ ID NO: 17335 - protein, 29 aa, artificial
  peptide fold or domain or sub-domain
RTIFSERGPSEKVARVLAQEIGASVETIY

SEQ ID NO: 17336 - protein, 29 aa, artificial
  peptide fold or domain or sub-domain
RTIYDLEEEGVTPLRARIAERLDQSGPTV

SEQ ID NO: 17337 - protein, 29 aa, artificial
  peptide fold or domain or sub-domain
RTIYTEELIDPRTAETIARETGAAILPLN

SEQ ID NO: 17338 - protein, 24 aa, artificial
  peptide fold or domain or sub-domain
RTKVVRRLQAASPGLTQGAVLEKL

SEQ ID NO: 17339 - protein, 21 aa, artificial
  peptide fold or domain or sub-domain
RTLAEVAKHMNCSREYCRQVV

SEQ ID NO: 17340 - protein, 26 aa, artificial
  peptide fold or domain or sub-domain
RTLAFNALDAMHRDAFSESKMLLKKS

SEQ ID NO: 17341 - protein, 28 aa, artificial
  peptide fold or domain or sub-domain
RTLDEALAELSKSALSNEEKLLIAKHKV

SEQ ID NO: 17342 - protein, 30 aa, artificial
  peptide fold or domain or sub-domain
RTLFAPPQYQDEVYSKRLIPLECGSFMEGC

SEQ ID NO: 17343 - protein, 27 aa, artificial
  peptide fold or domain or sub-domain
RTLHVAPGGSDLNAGTAASPWGTIQHA

SEQ ID NO: 17344 - protein, 30 aa, artificial
  peptide fold or domain or sub-domain
RTLNNVSNTEVIYKALYFCIQQYPTLVPKL

SEQ ID NO: 17345 - protein, 26 aa, artificial
  peptide fold or domain or sub-domain
RTLSALLRTVSYRLRLPYLDAVKLFK

SEQ ID NO: 17346 - protein, 24 aa, artificial
  peptide fold or domain or sub-domain
RTLVESGKDIESAYWELVVKDIQD

SEQ ID NO: 17347 - protein, 24 aa, artificial
  peptide fold or domain or sub-domain
RTLVYPAKMTDSNTQLSVMAPVGA

SEQ ID NO: 17348 - protein, 26 aa, artificial
  peptide fold or domain or sub-domain
RTNKILRKAIFSCLPSQLINEQINLL

SEQ ID NO: 17349 - protein, 26 aa, artificial
  peptide fold or domain or sub-domain
RTPCRVFAGFWDVPDLVARFSRRGTP

SEQ ID NO: 17350 - protein, 25 aa, artificial
  peptide fold or domain or sub-domain
RTPFEFSSRTKPEEAYVAFRDASIP

SEQ ID NO: 17351 - protein, 24 aa, artificial
  peptide fold or domain or sub-domain
RTPFERFLRGQAKALSDQQLQGLH

SEQ ID NO: 17352 - protein, 30 aa, artificial
  peptide fold or domain or sub-domain
RTPFGHVPMLNVSGNVLGESHAIELLLGGR

SEQ ID NO: 17353 - protein, 27 aa, artificial
  peptide fold or domain or sub-domain
RTPLGSALLRPNPILARLLRAHGAPEP

SEQ ID NO: 17354 - protein, 27 aa, artificial
  peptide fold or domain or sub-domain
RTPTAGIVSWDFDAGTGPHVPIDTSAT

SEQ ID NO: 17355 - protein, 24 aa, artificial
  peptide fold or domain or sub-domain
RTRAIQRFHERHPGYQDAEINARL

SEQ ID NO: 17356 - protein, 24 aa, artificial
  peptide fold or domain or sub-domain
RTRFDAFLQGKTNALSDSAIRGMD

SEQ ID NO: 17357 - protein, 25 aa, artificial
  peptide fold or domain or sub-domain
RTSARNIGPDFRAAFGLEPGQDAVI

SEQ ID NO: 17358 - protein, 29 aa, artificial
  peptide fold or domain or sub-domain
RTSLAKSLKKNFGEKNKKQLVNFKLTTAV

SEQ ID NO: 17359 - protein, 27 aa, artificial
  peptide fold or domain or sub-domain
RTSVQEIVEAAGVTKGALYHYFGSKDD

SEQ ID NO: 17360 - protein, 24 aa, artificial
  peptide fold or domain or sub-domain
RTTALRRYKEKYPDIEDGVLLTKL

SEQ ID NO: 17361 - protein, 28 aa, artificial
  peptide fold or domain or sub-domain
RTTDDVVAELTAKGVSDAEIATLAPQRT

SEQ ID NO: 17362 - protein, 28 aa, artificial
  peptide fold or domain or sub-domain
RTTDEARQEIASEELPPERLEALAAAKT

SEQ ID NO: 17363 - protein, 27 aa, artificial
  peptide fold or domain or sub-domain
RTTIDDIASKLLITKGTVYYYFQDKQD

SEQ ID NO: 17364 - protein, 27 aa, artificial
  peptide fold or domain or sub-domain
RTTVRDIAAAAGVQAGSWFYYFKTKQD

SEQ ID NO: 17365 - protein, 26 aa, artificial
  peptide fold or domain or sub-domain
RTVDSIQFNQETGKVKSIICSEGQTI

SEQ ID NO: 17366 - protein, 23 aa, artificial
  peptide fold or domain or sub-domain
RTVKSLAEILGKTTTPIFERIKK

SEQ ID NO: 17367 - protein, 25 aa, artificial
  peptide fold or domain or sub-domain
RTVMSIQGERLRSALQIDSSQLYKW

SEQ ID NO: 17368 - protein, 20 aa, artificial
  peptide fold or domain or sub-domain
RTVNQRKSDTEHRRKKAESQ

SEQ ID NO: 17369 - protein, 30 aa, artificial
  peptide fold or domain or sub-domain
RTWQTADKMKKQRGPLAEEKNGSDNFRLKR

SEQ ID NO: 17370 - protein, 25 aa, artificial
  peptide fold or domain or sub-domain
RTWTAAVSHAVFYKRKRETDLEDLV

SEQ ID NO: 17371 - protein, 25 aa, artificial
  peptide fold or domain or sub-domain
RTWTAVSSHASLTMKSASFATDTEF

SEQ ID NO: 17372 - protein, 28 aa, artificial
  peptide fold or domain or sub-domain
RTYALGKTRALARRHGLVVPERELRPEE

SEQ ID NO: 17373 - protein, 29 aa, artificial
  peptide fold or domain or sub-domain
RTYLPWHRIGEALRSNRPLTWDPQQQQSM

SEQ ID NO: 17374 - protein, 28 aa, artificial
  peptide fold or domain or sub-domain
RTYWHAKSYTETRKTIGADQVRENASGS

SEQ ID NO: 17375 - protein, 28 aa, artificial
  peptide fold or domain or sub-domain
RVAAMVDAPVRAADPRLCQGGPPLADGE

SEQ ID NO: 17376 - protein, 23 aa, artificial
  peptide fold or domain or sub-domain
RVADMLKAKRLKKMRQTSGINNH

SEQ ID NO: 17377 - protein, 23 aa, artificial
  peptide fold or domain or sub-domain
RVADTIGSATAEKIREAFDIEDD

SEQ ID NO: 17378 - protein, 21 aa, artificial
  peptide fold or domain or sub-domain
RVAGGEPFEKGSVAAARAAYN

SEQ ID NO: 17379 - protein, 29 aa, artificial
  peptide fold or domain or sub-domain
RVAGLLRKTGLSVEQLAEKLLYSYGVLVL

SEQ ID NO: 17380 - protein, 22 aa, artificial
  peptide fold or domain or sub-domain
RVAIAEHAARFYGQQVDPDTMV

SEQ ID NO: 17381 - protein, 26 aa, artificial
  peptide fold or domain or sub-domain
RVAKWHFAPTEKSKDNLLNEHIEADA

SEQ ID NO: 17382 - protein, 25 aa, artificial
  peptide fold or domain or sub-domain
RVALEACTQARNEGRDLAREGGDVI

SEQ ID NO: 17383 - protein, 27 aa, artificial
  peptide fold or domain or sub-domain
RVAPVASNRPVARTIRHVSSTKRRHSS

SEQ ID NO: 17384 - protein, 22 aa, artificial
  peptide fold or domain or sub-domain
RVARGLSADSHAAQCAAMFGIP

SEQ ID NO: 17385 - protein, 27 aa, artificial
  peptide fold or domain or sub-domain
RVARLSVADYNMRDLAVLGLANDSISS

SEQ ID NO: 17386 - protein, 25 aa, artificial
  peptide fold or domain or sub-domain
RVATEACVKARNEGVEIEKHAREVL

SEQ ID NO: 17387 - protein, 25 aa, artificial
  peptide fold or domain or sub-domain
RVAVVFFSPAGRPHCFGHPSVSAVA

SEQ ID NO: 17388 - protein, 25 aa, artificial
  peptide fold or domain or sub-domain
RVDAIRKGPAAYFRDWSTDCGSAAP

SEQ ID NO: 17389 - protein, 26 aa, artificial
  peptide fold or domain or sub-domain
RVDEIAERAGVNKQLVYHYFGDKDAL

SEQ ID NO: 17390 - protein, 25 aa, artificial
  peptide fold or domain or sub-domain
RVDLLNTDHTLDPSLLESGSEILGD

SEQ ID NO: 17391 - protein, 30 aa, artificial
  peptide fold or domain or sub-domain
RVDLLVGDFDSLDGAALADARAAGMAIVQV

SEQ ID NO: 17392 - protein, 22 aa, artificial
  peptide fold or domain or sub-domain
RVDNRLRKDVLQPGDDPVETGS

SEQ ID NO: 17393 - protein, 26 aa, artificial
  peptide fold or domain or sub-domain
RVELVGAERTVHETLGKVNKTHKIMY

SEQ ID NO: 17394 - protein, 30 aa, artificial
  peptide fold or domain or sub-domain
RVEPAEAIAEQAGLPREVVEAKFGLKAKRR

SEQ ID NO: 17395 - protein, 24 aa, artificial
  peptide fold or domain or sub-domain
RVEQDWYGLVEEIENASDGGAQKA

SEQ ID NO: 17396 - protein, 24 aa, artificial
  peptide fold or domain or sub-domain
RVFDTSAHAVSLAVELGAIAEKTL

SEQ ID NO: 17397 - protein, 28 aa, artificial
  peptide fold or domain or sub-domain
RVFGWPAPEGAGQDQGFTPDDQPGHEDL

SEQ ID NO: 17398 - protein, 23 aa, artificial
  peptide fold or domain or sub-domain
RVGENLKIGGWSTNRIVTAIYNE

SEQ ID NO: 17399 - protein, 20 aa, artificial
  peptide fold or domain or sub-domain
RVGLGELSGLVGEAGLEADR

SEQ ID NO: 17400 - protein, 23 aa, artificial
  peptide fold or domain or sub-domain
RVGLGELSGLVGEAGLEADRRAA

SEQ ID NO: 17401 - protein, 28 aa, artificial
  peptide fold or domain or sub-domain
RVGLGELSGLVGEAGLEADRRAAILGLR

SEQ ID NO: 17402 - protein, 20 aa, artificial
  peptide fold or domain or sub-domain
RVGNRAQVVAMLESREIDIA

SEQ ID NO: 17403 - protein, 20 aa, artificial
  peptide fold or domain or sub-domain
RVGSGKLAEVMGPAYIDRDR

SEQ ID NO: 17404 - protein, 23 aa, artificial
  peptide fold or domain or sub-domain
RVGSGKLAEVMGPAYIDRDRLAR

SEQ ID NO: 17405 - protein, 28 aa, artificial
  peptide fold or domain or sub-domain
RVGSGKLAEVMGPAYIDRDRLARAVNYR

SEQ ID NO: 17406 - protein, 23 aa, artificial
  peptide fold or domain or sub-domain
RVHDRLPPRHLDDAQVRAGLGEA

SEQ ID NO: 17407 - protein, 27 aa, artificial
  peptide fold or domain or sub-domain
RVHYGGREDVLKIVPKEVLPKEYGGED

SEQ ID NO: 17408 - protein, 24 aa, artificial
  peptide fold or domain or sub-domain
RVIAGVRSMASMPERLKDLEGNRE

SEQ ID NO: 17409 - protein, 30 aa, artificial
  peptide fold or domain or sub-domain
RVIAVDASPEKLARARELGVPDAVLADTQT

SEQ ID NO: 17410 - protein, 30 aa, artificial
  peptide fold or domain or sub-domain
RVIAVDPRSSALSLASKVGADATLTPGPAT

SEQ ID NO: 17411 - protein, 27 aa, artificial
  peptide fold or domain or sub-domain
RVICPIHHPRVHSFAEERGITRAAAAV

SEQ ID NO: 17412 - protein, 29 aa, artificial
  peptide fold or domain or sub-domain
RVIFVQPEFDRRNAEIIAKQTGTRVISIN

SEQ ID NO: 17413 - protein, 26 aa, artificial
  peptide fold or domain or sub-domain
RVIGGNFGLQVPFMRLVRDELIDAYN

SEQ ID NO: 17414 - protein, 30 aa, artificial
  peptide fold or domain or sub-domain
RVIIGSMAVKHPQFVKEALDKFGSDKIVVG

SEQ ID NO: 17415 - protein, 30 aa, artificial
  peptide fold or domain or sub-domain
RVILGTAAVRNPDFVERAVEQFSARRVVVS

SEQ ID NO: 17416 - protein, 28 aa, artificial
  peptide fold or domain or sub-domain
RVIMIGTPEADAASWGTQVEWVADESAL

SEQ ID NO: 17417 - protein, 26 aa, artificial
  peptide fold or domain or sub-domain
RVIMSILTASSKTAQAMKNNDIEAYF

SEQ ID NO: 17418 - protein, 25 aa, artificial
  peptide fold or domain or sub-domain
RVITWKKIDLPYVDVVSTEKEMIKR

SEQ ID NO: 17419 - protein, 30 aa, artificial
  peptide fold or domain or sub-domain
RVIVGTKAILEPKFIDDLNKEIGKDKIVLA

SEQ ID NO: 17420 - protein, 26 aa, artificial
  peptide fold or domain or sub-domain
RVIVQDIPQTLANAQPAAGVEFMEHN

SEQ ID NO: 17421 - protein, 26 aa, artificial
  peptide fold or domain or sub-domain
RVIVQDRGEVIKCAPDIKGIQWMEHD

SEQ ID NO: 17422 - protein, 30 aa, artificial
  peptide fold or domain or sub-domain
RVIVSTQAVREPEMIRTLAEEFGGERVMAG

SEQ ID NO: 17423 - protein, 29 aa, artificial
  peptide fold or domain or sub-domain
RVIYEIAEAKGYVRIKDISRALGVKPSTA

SEQ ID NO: 17424 - protein, 30 aa, artificial
  peptide fold or domain or sub-domain
RVIYRVFGDQVQEVPISKTVVFTTNASFVV

SEQ ID NO: 17425 - protein, 27 aa, artificial
  peptide fold or domain or sub-domain
RVLCAIREAEVIKTATARGETRAMVAM

SEQ ID NO: 17426 - protein, 30 aa, artificial
  peptide fold or domain or sub-domain
RVLIGHDISDDAFAIYRQSAVDGVIVERAR

SEQ ID NO: 17427 - protein, 24 aa, artificial
  peptide fold or domain or sub-domain
RVLNLGEQVRQVTGPGFPEYRLLV

SEQ ID NO: 17428 - protein, 24 aa, artificial
  peptide fold or domain or sub-domain
RVLPLSKALEGRGVKDFPKYSIIL

SEQ ID NO: 17429 - protein, 26 aa, artificial
  peptide fold or domain or sub-domain
RVLTDLQKLLTDKAPRSGILDASNQF

SEQ ID NO: 17430 - protein, 20 aa, artificial
  peptide fold or domain or sub-domain
RVNGKFVDDKEHAEVVTMIK

SEQ ID NO: 17431 - protein, 26 aa, artificial
  peptide fold or domain or sub-domain
RVNQRLKESKEAGTPPLIVQDLVDLL

SEQ ID NO: 17432 - protein, 26 aa, artificial
  peptide fold or domain or sub-domain
RVPCFKLGIALNNANAVKLFTKNYCT

SEQ ID NO: 17433 - protein, 26 aa, artificial
  peptide fold or domain or sub-domain
RVPCFKLGVKVGDHTFPKRFLISGRV

SEQ ID NO: 17434 - protein, 26 aa, artificial
  peptide fold or domain or sub-domain
RVPCSTISKRVGIPGILPRIVATGYT

SEQ ID NO: 17435 - protein, 27 aa, artificial
  peptide fold or domain or sub-domain
RVPEDGVVYWDFEVPQEPSSYRDSSAS

SEQ ID NO: 17436 - protein, 30 aa, artificial
  peptide fold or domain or sub-domain
RVPHQTSDAIERRRAESGTVTGKAQGKKEL

SEQ ID NO: 17437 - protein, 30 aa, artificial
  peptide fold or domain or sub-domain
RVPQKYANKKHYKGDKKGELSGDPLGKNPG

SEQ ID NO: 17438 - protein, 20 aa, artificial
  peptide fold or domain or sub-domain
RVPVIFEHEGEMGFRDRETQ

SEQ ID NO: 17439 - protein, 28 aa, artificial
  peptide fold or domain or sub-domain
RVQDEIDSVLGPDKCPSLEDRVNLPYTD

SEQ ID NO: 17440 - protein, 28 aa, artificial
  peptide fold or domain or sub-domain
RVQQEIDDVIGQVRRPEMGDQAHMPYTT

SEQ ID NO: 17441 - protein, 28 aa, artificial
  peptide fold or domain or sub-domain
RVQQEVRETVGGKGRVREEDINEMNYLR

SEQ ID NO: 17442 - protein, 22 aa, artificial
  peptide fold or domain or sub-domain
RVQRYLKLMKYNSYAWMVVRAE

SEQ ID NO: 17443 - protein, 28 aa, artificial
  peptide fold or domain or sub-domain
RVRAEIDALFETHGRVTFESLRQMPQLE

SEQ ID NO: 17444 - protein, 21 aa, artificial
  peptide fold or domain or sub-domain
RVRCSAGREAGHPECCKWFDV

SEQ ID NO: 17445 - protein, 21 aa, artificial
  peptide fold or domain or sub-domain
RVRDVVLDEQLLTPEQADYLL

SEQ ID NO: 17446 - protein, 21 aa, artificial
  peptide fold or domain or sub-domain
RVRFTRGSHLHNAYRAPESVE

SEQ ID NO: 17447 - protein, 27 aa, artificial
  peptide fold or domain or sub-domain
RVRPAVEPLFAQSLDQQELAAQAVRAN

SEQ ID NO: 17448 - protein, 30 aa, artificial
  peptide fold or domain or sub-domain
RVRSLHPGVSFDEVQDATGFPLIAAPDLGT

SEQ ID NO: 17449 - protein, 21 aa, artificial
  peptide fold or domain or sub-domain
RVRSYLQIPIEQRLIEHIEIL

SEQ ID NO: 17450 - protein, 26 aa, artificial
  peptide fold or domain or sub-domain
RVSDIGERAGLTHSAFYHYFDSKEDI

SEQ ID NO: 17451 - protein, 24 aa, artificial
  peptide fold or domain or sub-domain
RVSPYRDAMRDSVAGIVGLDRGRV

SEQ ID NO: 17452 - protein, 26 aa, artificial
  peptide fold or domain or sub-domain
RVTCYRLGIRMDEPDMPALLVRHGRP

SEQ ID NO: 17453 - protein, 27 aa, artificial
  peptide fold or domain or sub-domain
RVTDYKNDNAGYYHHNGAIAENGKDWE

SEQ ID NO: 17454 - protein, 25 aa, artificial
  peptide fold or domain or sub-domain
RVTPQGKLVRTNSTSYCRKATLSGE

SEQ ID NO: 17455 - protein, 25 aa, artificial
  peptide fold or domain or sub-domain
RVTSSVVVYHHPEHKKTAFDLQGME

SEQ ID NO: 17456 - protein, 28 aa, artificial
  peptide fold or domain or sub-domain
RVTTEGDGFRADGGFIQHSHIPYTGGYG

SEQ ID NO: 17457 - protein, 30 aa, artificial
  peptide fold or domain or sub-domain
RVVALDLSDRALQVARQLGADQTVNAAERA

SEQ ID NO: 17458 - protein, 28 aa, artificial
  peptide fold or domain or sub-domain
RVVARCTEQRNIEKMRKAGADAIVSPDF

SEQ ID NO: 17459 - protein, 25 aa, artificial
  peptide fold or domain or sub-domain
RVVASVPWNVTNETKYWTDQNKNAR

SEQ ID NO: 17460 - protein, 30 aa, artificial
  peptide fold or domain or sub-domain
RVVAVTTSKNHEDLAYKMGADDVVIMDRNY

SEQ ID NO: 17461 - protein, 27 aa, artificial
  peptide fold or domain or sub-domain
RVVCYLNDVRSKEMADVNGITRSAAGI

SEQ ID NO: 17462 - protein, 29 aa, artificial
  peptide fold or domain or sub-domain
RVVFVSPQFSSAQADAIAGDIGGQTVTVD

SEQ ID NO: 17463 - protein, 27 aa, artificial
  peptide fold or domain or sub-domain
RVVGAMRRKAKSGEFRSNIHRGGEGQA

SEQ ID NO: 17464 - protein, 28 aa, artificial
  peptide fold or domain or sub-domain
RVVGRLVRRCEELGVSLEEVPRAELAAA

SEQ ID NO: 17465 - protein, 24 aa, artificial
  peptide fold or domain or sub-domain
RVVHLYRNGKDQDAEQAPEYRGRT

SEQ ID NO: 17466 - protein, 29 aa, artificial
  peptide fold or domain or sub-domain
RVVIAISPGDSRFAQLPLANHPQITVVDG

SEQ ID NO: 17467 - protein, 30 aa, artificial
  peptide fold or domain or sub-domain
RVVIGSAAVTNPGLIADLLKKYRPSQIVVG

SEQ ID NO: 17468 - protein, 30 aa, artificial
  peptide fold or domain or sub-domain
RVVIGSLALTNPQLCVELLSEFGADKLCLA

SEQ ID NO: 17469 - protein, 30 aa, artificial
  peptide fold or domain or sub-domain
RVVIGSLAVRESARVIEWLQAFGPERITVA

SEQ ID NO: 17470 - protein, 30 aa, artificial
  peptide fold or domain or sub-domain
RVVIGSSAINNITEVEKWLLEFGYKSIVLA

SEQ ID NO: 17471 - protein, 28 aa, artificial
  peptide fold or domain or sub-domain
RVVIPPDFPQYAELKFLGGHTLNELIIA

SEQ ID NO: 17472 - protein, 26 aa, artificial
  peptide fold or domain or sub-domain
RVVKEIYNVLECGSNTAKLIDATNRF

SEQ ID NO: 17473 - protein, 30 aa, artificial
  peptide fold or domain or sub-domain
RVVLGTLAFRDRDALREILESYGSKKIVIS

SEQ ID NO: 17474 - protein, 30 aa, artificial
  peptide fold or domain or sub-domain
RVVPEHMDALVEKLREAGCTITTEGSGLRC

SEQ ID NO: 17475 - protein, 30 aa, artificial
  peptide fold or domain or sub-domain
RVVPNDVILEKIDSSDEWIRSRSGIETRHW

SEQ ID NO: 17476 - protein, 30 aa, artificial
  peptide fold or domain or sub-domain
RVVPNSHFSYLVDDADTWIQSRTGIRERRF

SEQ ID NO: 17477 - protein, 30 aa, artificial
  peptide fold or domain or sub-domain
RVVTSAELDRQLGLETGSVARISGVQQRHV

SEQ ID NO: 17478 - protein, 30 aa, artificial
  peptide fold or domain or sub-domain
RVVVGSTAVKSQDMVKGWFERFGADALVLA

SEQ ID NO: 17479 - protein, 26 aa, artificial
  peptide fold or domain or sub-domain
RVVYSPHDYPNSVYNQPWFQTANFGA

SEQ ID NO: 17480 - protein, 23 aa, artificial
  peptide fold or domain or sub-domain
RVWSPLADSVEVIRCARGEEASC

SEQ ID NO: 17481 - protein, 30 aa, artificial
  peptide fold or domain or sub-domain
RVYCIEFSPRMMRELLGVCESRKNMAPLLE

SEQ ID NO: 17482 - protein, 22 aa, artificial
  peptide fold or domain or sub-domain
RVYSQAVNPFTPWTTDAVRAGS

SEQ ID NO: 17483 - protein, 28 aa, artificial
  peptide fold or domain or sub-domain
RWAANDEDIHTAVERRATELAPAAAKMH

SEQ ID NO: 17484 - protein, 27 aa, artificial
  peptide fold or domain or sub-domain
RWCMLSKDSKLFYHKQANEKHSGFVDL

SEQ ID NO: 17485 - protein, 27 aa, artificial
  peptide fold or domain or sub-domain
RWCVVSRGLFYYYANEKSKQPKGTFLI

SEQ ID NO: 17486 - protein, 27 aa, artificial
  peptide fold or domain or sub-domain
RWFILTANCLLYYKTPQDHEPCGIIPL

SEQ ID NO: 17487 - protein, 27 aa, artificial
  peptide fold or domain or sub-domain
RWFQLQPSCLCYFGSEECKEKRGIIPL

SEQ ID NO: 17488 - protein, 24 aa, artificial
  peptide fold or domain or sub-domain
RWFQLYPGRDKNIMKSMIRRAEKS

SEQ ID NO: 17489 - protein, 27 aa, artificial
  peptide fold or domain or sub-domain
RWFSIQNSQLVYQKKFKDSLTVVVEDL

SEQ ID NO: 17490 - protein, 27 aa, artificial
  peptide fold or domain or sub-domain
RWFSLERDVLFYYKYNNDPKPQGELII

SEQ ID NO: 17491 - protein, 27 aa, artificial
  peptide fold or domain or sub-domain
RWFTLHRNELKYFKDQMSPEPIRILDL

SEQ ID NO: 17492 - protein, 27 aa, artificial
  peptide fold or domain or sub-domain
RWFTMDDRRLMYFKDPLDAFARGEVFI

SEQ ID NO: 17493 - protein, 27 aa, artificial
  peptide fold or domain or sub-domain
RWFVLKGNEMKYFRARLDTDALRVLDL

SEQ ID NO: 17494 - protein, 27 aa, artificial
  peptide fold or domain or sub-domain
RWFVLKGNLLFYFERKGDREPLGMIIL

SEQ ID NO: 17495 - protein, 27 aa, artificial
  peptide fold or domain or sub-domain
RWFVLKPNIISYYVSEDLKDKKGDILL

SEQ ID NO: 17496 - protein, 27 aa, artificial
  peptide fold or domain or sub-domain
RWFVLLGSCLYGFKTKEDPRAACLIFL

SEQ ID NO: 17497 - protein, 27 aa, artificial
  peptide fold or domain or sub-domain
RWFVLRQSRLMYFENDGEEKMKGVLDV

SEQ ID NO: 17498 - protein, 27 aa, artificial
  peptide fold or domain or sub-domain
RWFVLTSSALAYSRSHMETKAQQVIPL

SEQ ID NO: 17499 - protein, 27 aa, artificial
  peptide fold or domain or sub-domain
RWFVLVDRCLFYYKDEKEESILGSIPL

SEQ ID NO: 17500 - protein, 22 aa, artificial
  peptide fold or domain or sub-domain
RWHENKEYYRKKTDVGFPMKWL

SEQ ID NO: 17501 - protein, 30 aa, artificial
  peptide fold or domain or sub-domain
RWHFVPEHEVATYTVRDGERGHYEGGRKQS

SEQ ID NO: 17502 - protein, 26 aa, artificial
  peptide fold or domain or sub-domain
RWIGGIAIASPKMAKLIEEDKCEAYN

SEQ ID NO: 17503 - protein, 29 aa, artificial
  peptide fold or domain or sub-domain
RWISRGFRTLDDLKRPEANLNKNQRMGLE

SEQ ID NO: 17504 - protein, 29 aa, artificial
  peptide fold or domain or sub-domain
RWITMGIYNLQQLQSSGPTLNQAQQAGLE

SEQ ID NO: 17505 - protein, 23 aa, artificial
  peptide fold or domain or sub-domain
RWLGSSYGMEGKLVPEMGYEFCA

SEQ ID NO: 17506 - protein, 23 aa, artificial
  peptide fold or domain or sub-domain
RWLGTADRMEADLVPKHGIEIDF

SEQ ID NO: 17507 - protein, 25 aa, artificial
  peptide fold or domain or sub-domain
RWQVVRKQGLSRFPHLAEQLADAPS

SEQ ID NO: 17508 - protein, 24 aa, artificial
  peptide fold or domain or sub-domain
RWSDGSQEWEETCDPRKSQLHKKR

SEQ ID NO: 17509 - protein, 24 aa, artificial
  peptide fold or domain or sub-domain
RWSDNAPQWDRVRADVRQKLNVQK

SEQ ID NO: 17510 - protein, 24 aa, artificial
  peptide fold or domain or sub-domain
RWSDNCSWWNDINPEDRKKLNTKR

SEQ ID NO: 17511 - protein, 24 aa, artificial
  peptide fold or domain or sub-domain
RWSDNSPLWSQVTFELREKMQVRG

SEQ ID NO: 17512 - protein, 26 aa, artificial
  peptide fold or domain or sub-domain
RWTAEQERVGCAQGGMTAAEIAEFVE

SEQ ID NO: 17513 - protein, 30 aa, artificial
  peptide fold or domain or sub-domain
RWTAYDPDKVATFAGFERDPVGVFQVYQAM

SEQ ID NO: 17514 - protein, 24 aa, artificial
  peptide fold or domain or sub-domain
RWTFEVVREEYPDGLVLANIGLPQ

SEQ ID NO: 17515 - protein, 22 aa, artificial
  peptide fold or domain or sub-domain
RWVSDQSYYHSTPTVALPIKWM

SEQ ID NO: 17516 - protein, 27 aa, artificial
  peptide fold or domain or sub-domain
RWWVLRSSKLAYYKNDKEYQLLRFIDV

SEQ ID NO: 17517 - protein, 29 aa, artificial
  peptide fold or domain or sub-domain
RWYREGLRTLDDLREQPQKLTQQQKAGLQ

SEQ ID NO: 17518 - protein, 27 aa, artificial
  peptide fold or domain or sub-domain
RYAGEVSHDDKHIIVDGHKIATFQERD

SEQ ID NO: 17519 - protein, 25 aa, artificial
  peptide fold or domain or sub-domain
RYAGLYQTLKSLFPKVPEAAIADAE

SEQ ID NO: 17520 - protein, 22 aa, artificial
  peptide fold or domain or sub-domain
RYALAKKQEQFSGMKINPDTEI

SEQ ID NO: 17521 - protein, 27 aa, artificial
  peptide fold or domain or sub-domain
RYARMVHGILLAKVPPKDAEDLVQDVF

SEQ ID NO: 17522 - protein, 20 aa, artificial
  peptide fold or domain or sub-domain
RYASGDLAAILGPELVKHDK

SEQ ID NO: 17523 - protein, 23 aa, artificial
  peptide fold or domain or sub-domain
RYASGDLAAILGPELVKHDKQQR

SEQ ID NO: 17524 - protein, 28 aa, artificial
  peptide fold or domain or sub-domain
RYASGDLAAILGPELVKHDKQQRILGMR

SEQ ID NO: 17525 - protein, 27 aa, artificial
  peptide fold or domain or sub-domain
RYCVLKDACLYFYQDANSKSAFGMACL

SEQ ID NO: 17526 - protein, 22 aa, artificial
  peptide fold or domain or sub-domain
RYDQLKPTTLLKIKPQSRLNNL

SEQ ID NO: 17527 - protein, 20 aa, artificial
  peptide fold or domain or sub-domain
RYDTYIAAEAHYRPPLPDMY

SEQ ID NO: 17528 - protein, 21 aa, artificial
  peptide fold or domain or sub-domain
RYEILLEEGPPHQKIFTAGVI

SEQ ID NO: 17529 - protein, 27 aa, artificial
  peptide fold or domain or sub-domain
RYFEFGSGLPAWKYTDDKSNVNRLSKE

SEQ ID NO: 17530 - protein, 25 aa, artificial
  peptide fold or domain or sub-domain
RYFFEIMSFYATAEHEKERLQYFAS

SEQ ID NO: 17531 - protein, 24 aa, artificial
  peptide fold or domain or sub-domain
RYFMESLAYWYTGGERPDPAKWGD

SEQ ID NO: 17532 - protein, 27 aa, artificial
  peptide fold or domain or sub-domain
RYFQLDENTIGYFKSELEKEPLRVIPL

SEQ ID NO: 17533 - protein, 22 aa, artificial
  peptide fold or domain or sub-domain
RYFSSSRIRELIHFGADISPYV

SEQ ID NO: 17534 - protein, 27 aa, artificial
  peptide fold or domain or sub-domain
RYFVLDHEGLSYYKSNTDTDPIKMISL

SEQ ID NO: 17535 - protein, 27 aa, artificial
  peptide fold or domain or sub-domain
RYFVLRAQQLYYYKDEEDTKPQGCMYL

SEQ ID NO: 17536 - protein, 27 aa, artificial
  peptide fold or domain or sub-domain
RYFVLRDSSLFYFKHQNDNFPCGVILL

SEQ ID NO: 17537 - protein, 25 aa, artificial
  peptide fold or domain or sub-domain
RYFYLFPNRLEWRGEGEAPQSLLTM

SEQ ID NO: 17538 - protein, 24 aa, artificial
  peptide fold or domain or sub-domain
RYHDADVTAFGYEYGQLPGCPAGF

SEQ ID NO: 17539 - protein, 21 aa, artificial
  peptide fold or domain or sub-domain
RYHEIDRSGPEHRPEFTVEVR

SEQ ID NO: 17540 - protein, 24 aa, artificial
  peptide fold or domain or sub-domain
RYHIGEVMSRLGRWDEAVEAYGKA

SEQ ID NO: 17541 - protein, 28 aa, artificial
  peptide fold or domain or sub-domain
RYHQLLSRYIAELTETSLYQAQKFSRKT

SEQ ID NO: 17542 - protein, 27 aa, artificial
  peptide fold or domain or sub-domain
RYHTEGMDSLYKEVPRDMLPNEYGGKA

SEQ ID NO: 17543 - protein, 30 aa, artificial
  peptide fold or domain or sub-domain
RYIMEFIEGKIKIGKMSTSSLNEYLAQNGY

SEQ ID NO: 17544 - protein, 22 aa, artificial
  peptide fold or domain or sub-domain
RYIVRADGVRIDLRKVRSSNDV

SEQ ID NO: 17545 - protein, 27 aa, artificial
  peptide fold or domain or sub-domain
RYKQTFLSCGGSVPTAEVFRRFQGRDP

SEQ ID NO: 17546 - protein, 25 aa, artificial
  peptide fold or domain or sub-domain
RYLFKLMSYFTNDELHNEKLIEISS

SEQ ID NO: 17547 - protein, 21 aa, artificial
  peptide fold or domain or sub-domain
RYLLQGVSGPDHQRIFSVAVF

SEQ ID NO: 17548 - protein, 22 aa, artificial
  peptide fold or domain or sub-domain
RYLSSTMIREIYYHQGQVNAFV

SEQ ID NO: 17549 - protein, 30 aa, artificial
  peptide fold or domain or sub-domain
RYLSVEDKYKKYAHIDEPLPIPAGQTVSAP

SEQ ID NO: 17550 - protein, 28 aa, artificial
  peptide fold or domain or sub-domain
RYMRGELSALFGEDYLRADAQTRTYGFR

SEQ ID NO: 17551 - protein, 22 aa, artificial
  peptide fold or domain or sub-domain
RYNSLVSSGKDTDFERPNLPRA

SEQ ID NO: 17552 - protein, 28 aa, artificial
  peptide fold or domain or sub-domain
RYNTKYNYLKRMEKYYPNAMAYFDKVTI

SEQ ID NO: 17553 - protein, 27 aa, artificial
  peptide fold or domain or sub-domain
RYQHKVASLVSRYVPSGDVPDVVQEAF

SEQ ID NO: 17554 - protein, 27 aa, artificial
  peptide fold or domain or sub-domain
RYQNYVFKIVSGILPNDVVEETAQDVF

SEQ ID NO: 17555 - protein, 21 aa, artificial
  peptide fold or domain or sub-domain
RYQVISETGPAHDKVFDVEVL

SEQ ID NO: 17556 - protein, 23 aa, artificial
  peptide fold or domain or sub-domain
RYQYKKHGTCSVDLYNQEQYFDL

SEQ ID NO: 17557 - protein, 27 aa, artificial
  peptide fold or domain or sub-domain
RYRDIILKPGGSKEIMDNLVELLGRKP

SEQ ID NO: 17558 - protein, 21 aa, artificial
  peptide fold or domain or sub-domain
RYRITNFSGPEHNRLFIAEVY

SEQ ID NO: 17559 - protein, 27 aa, artificial
  peptide fold or domain or sub-domain
RYRREMLAHGGGREPMLMVEGMLQKCP

SEQ ID NO: 17560 - protein, 29 aa, artificial
  peptide fold or domain or sub-domain
RYRVTYSSPEDGIHELFPAPDGEEDTAEL

SEQ ID NO: 17561 - protein, 27 aa, artificial
  peptide fold or domain or sub-domain
RYRYGVLEKGGSQDEMKTLTDFLGREP

SEQ ID NO: 17562 - protein, 22 aa, artificial
  peptide fold or domain or sub-domain
RYRYLNRAGAQKRWSDFLVVSP

SEQ ID NO: 17563 - protein, 24 aa, artificial
  peptide fold or domain or sub-domain
RYSENDVKNWTPELQKYLNFDPRT

SEQ ID NO: 17564 - protein, 27 aa, artificial
  peptide fold or domain or sub-domain
RYSNLYFPMLFRGDEYNQENADKLNEA

SEQ ID NO: 17565 - protein, 29 aa, artificial
  peptide fold or domain or sub-domain
RYTVLTAEQLAGYHYNKGTRVGDIVVQTT

SEQ ID NO: 17566 - protein, 22 aa, artificial
  peptide fold or domain or sub-domain
RYVGHKECFVGHKEEHIPIRWT

SEQ ID NO: 17567 - protein, 22 aa, artificial
  peptide fold or domain or sub-domain
RYVYDDKVYVNRRGGKLPVKWM

SEQ ID NO: 17568 - protein, 29 aa, artificial
  peptide fold or domain or sub-domain
RYWEALGRLDETVRHERYVLDLKDPEVSG

SEQ ID NO: 17569 - protein, 20 aa, artificial
  peptide fold or domain or sub-domain
RYWTLGDLLSGGHLPCPGWF

SEQ ID NO: 17570 - protein, 21 aa, artificial
  peptide fold or domain or sub-domain
SAAAIYCAKDGISFDAAIEEA

SEQ ID NO: 17571 - protein, 27 aa, artificial
  peptide fold or domain or sub-domain
SAAELARSMARMGHPICYAELTDMMRE

SEQ ID NO: 17572 - protein, 27 aa, artificial
  peptide fold or domain or sub-domain
SAAELRHVMTNLGEKLTDDEVDEMIRE

SEQ ID NO: 17573 - protein, 29 aa, artificial
  peptide fold or domain or sub-domain
SAAFDTLRRAIPSYSHNQKLSKLSVLRIA

SEQ ID NO: 17574 - protein, 22 aa, artificial
  peptide fold or domain or sub-domain
SAAGKTTWEISMILSCTTSAID

SEQ ID NO: 17575 - protein, 22 aa, artificial
  peptide fold or domain or sub-domain
SAAGKTYAEIGKIMHVDDRTVK

SEQ ID NO: 17576 - protein, 24 aa, artificial
  peptide fold or domain or sub-domain
SAAMKIVVERYHMRDADEVVAGME

SEQ ID NO: 17577 - protein, 23 aa, artificial
  peptide fold or domain or sub-domain
SAAQAVLARTRDIGAVEAYKIMR

SEQ ID NO: 17578 - protein, 21 aa, artificial
  peptide fold or domain or sub-domain
SAASLVAAGTPAELRDAAQKH

SEQ ID NO: 17579 - protein, 26 aa, artificial
  peptide fold or domain or sub-domain
SAASPLTLWANRYQLSREEAQQLKFS

SEQ ID NO: 17580 - protein, 30 aa, artificial
  peptide fold or domain or sub-domain
SAAVVTRNVTRAFKFVEQIESGMVHINDVT

SEQ ID NO: 17581 - protein, 30 aa, artificial
  peptide fold or domain or sub-domain
SAAVYVEGTLNGVWGIYHSDDGGATWARFN

SEQ ID NO: 17582 - protein, 29 aa, artificial
  peptide fold or domain or sub-domain
SACATSSETTKLAESLGIKISNLDELGQL

SEQ ID NO: 17583 - protein, 20 aa, artificial
  peptide fold or domain or sub-domain
SACKAQARNIQNFHMKSNGW

SEQ ID NO: 17584 - protein, 20 aa, artificial
  peptide fold or domain or sub-domain
SACQTCQSGYYLNSSQSCTP

SEQ ID NO: 17585 - protein, 30 aa, artificial
  peptide fold or domain or sub-domain
SADERANRRLRQMQMQGSKGIISQILAKVK

SEQ ID NO: 17586 - protein, 27 aa, artificial
  peptide fold or domain or sub-domain
SADFRIKDIDTYKEWYGAHCCPDLIQD

SEQ ID NO: 17587 - protein, 27 aa, artificial
  peptide fold or domain or sub-domain
SADFRLESEAQYDEWYDGHTRPKLLEQ

SEQ ID NO: 17588 - protein, 27 aa, artificial
  peptide fold or domain or sub-domain
SADFRLKDPTLYKIWYGYEHPYPDLLK

SEQ ID NO: 17589 - protein, 27 aa, artificial
  peptide fold or domain or sub-domain
SADFRLSNGKLWQETYDSKHRADDLLP

SEQ ID NO: 17590 - protein, 24 aa, artificial
  peptide fold or domain or sub-domain
SADLSVSSWLRALALHQYVPNFLS

SEQ ID NO: 17591 - protein, 28 aa, artificial
  peptide fold or domain or sub-domain
SADPARLGAAGVRQGGASWFGHQQLQPL

SEQ ID NO: 17592 - protein, 20 aa, artificial
  peptide fold or domain or sub-domain
SADTAAREAEEAGIAFWSRL

SEQ ID NO: 17593 - protein, 27 aa, artificial
  peptide fold or domain or sub-domain
SADYRFNDAATYEQWYEPHMNPHLLPK

SEQ ID NO: 17594 - protein, 27 aa, artificial
  peptide fold or domain or sub-domain
SAEAGYYYFTGTGKQGATEAGARAYES

SEQ ID NO: 17595 - protein, 28 aa, artificial
  peptide fold or domain or sub-domain
SAEAQQLAAKNHFRPSDKKILKNLTALF

SEQ ID NO: 17596 - protein, 30 aa, artificial
  peptide fold or domain or sub-domain
SAEARAQRRNAQNLAEGRGDDYAAVLADVQ

SEQ ID NO: 17597 - protein, 29 aa, artificial
  peptide fold or domain or sub-domain
SAEDVLRAIEECDFGEIALETRAALETWQ

SEQ ID NO: 17598 - protein, 27 aa, artificial
  peptide fold or domain or sub-domain
SAEELHEVLRSLGDECSIAECRKMIGG

SEQ ID NO: 17599 - protein, 30 aa, artificial
  peptide fold or domain or sub-domain
SAEERANRRYLQLQDNGINVSLAQVVEELA

SEQ ID NO: 17600 - protein, 30 aa, artificial
  peptide fold or domain or sub-domain
SAEERGRRRYLELVAKGEQVTLEQTIAAVI

SEQ ID NO: 17601 - protein, 22 aa, artificial
  peptide fold or domain or sub-domain
SAEGKTMKDIASIEGMSFATVN

SEQ ID NO: 17602 - protein, 22 aa, artificial
  peptide fold or domain or sub-domain
SAEGLTAREIADQLNRSVATIT

SEQ ID NO: 17603 - protein, 29 aa, artificial
  peptide fold or domain or sub-domain
SAEHVLKGLRDLEHNSIYNHCKQINDNWK

SEQ ID NO: 17604 - protein, 20 aa, artificial
  peptide fold or domain or sub-domain
SAEKKLLLLPNSFHHVCHSI

SEQ ID NO: 17605 - protein, 21 aa, artificial
  peptide fold or domain or sub-domain
SAELLVATKQAGDLQTAEGLL

SEQ ID NO: 17606 - protein, 25 aa, artificial
  peptide fold or domain or sub-domain
SAENLRKVEIETERKRGLENELNNL

SEQ ID NO: 17607 - protein, 26 aa, artificial
  peptide fold or domain or sub-domain
SAESMKVIAESIGVGSLSDDAAKELA

SEQ ID NO: 17608 - protein, 30 aa, artificial
  peptide fold or domain or sub-domain
SAESRAERRVKQLQGMGLDVKISDILANIQ

SEQ ID NO: 17609 - protein, 28 aa, artificial
  peptide fold or domain or sub-domain
SAEVLSYKEFEGFGSNGVEKLKKSFRKE

SEQ ID NO: 17610 - protein, 30 aa, artificial
  peptide fold or domain or sub-domain
SAEYDAVIEKAKTSTSEEERQKLYADAEKL

SEQ ID NO: 17611 - protein, 25 aa, artificial
  peptide fold or domain or sub-domain
SAFAPEHLLLATAAPQEHLARVRHC

SEQ ID NO: 17612 - protein, 25 aa, artificial
  peptide fold or domain or sub-domain
SAFLEKIREKKPETPQEVKKLAKEI

SEQ ID NO: 17613 - protein, 21 aa, artificial
  peptide fold or domain or sub-domain
SAFVNQYYYIFCNMPEHLPRF

SEQ ID NO: 17614 - protein, 22 aa, artificial
  peptide fold or domain or sub-domain
SAGAQRRGQVTADGSIYDIYIS

SEQ ID NO: 17615 - protein, 24 aa, artificial
  peptide fold or domain or sub-domain
SAGASLLAKSCDNDPLQEASSTVS

SEQ ID NO: 17616 - protein, 24 aa, artificial
  peptide fold or domain or sub-domain
SAGHLEDIRKRNATHEDIVSGPNR

SEQ ID NO: 17617 - protein, 28 aa, artificial
  peptide fold or domain or sub-domain
SAGPISVSRGEVSPLNLPAWRDFGLRAV

SEQ ID NO: 17618 - protein, 24 aa, artificial
  peptide fold or domain or sub-domain
SAGTKLIAQSRGDGELLESVAVIN

SEQ ID NO: 17619 - protein, 21 aa, artificial
  peptide fold or domain or sub-domain
SAHMLLLAGVGKNEEESYKIA

SEQ ID NO: 17620 - protein, 25 aa, artificial
  peptide fold or domain or sub-domain
SAHVQELYQEWLEGINSPKAREVLH

SEQ ID NO: 17621 - protein, 26 aa, artificial
  peptide fold or domain or sub-domain
SAIAGHWAMTPALSRMAHDGDIEAYN

SEQ ID NO: 17622 - protein, 25 aa, artificial
  peptide fold or domain or sub-domain
SAIANSINSGEISTKDQLFQHIITT

SEQ ID NO: 17623 - protein, 30 aa, artificial
  peptide fold or domain or sub-domain
SAIANYTQRVSDSSLSSENHAEALRFLVHF

SEQ ID NO: 17624 - protein, 22 aa, artificial
  peptide fold or domain or sub-domain
SAIAVRYSEHGVYEESLRLPRN

SEQ ID NO: 17625 - protein, 30 aa, artificial
  peptide fold or domain or sub-domain
SAIDLHAGIFVDRSRSDEDRLEALKFLAHW

SEQ ID NO: 17626 - protein, 29 aa, artificial
  peptide fold or domain or sub-domain
SAIKHIDDRDALPGAINGLVELIKPAVTR

SEQ ID NO: 17627 - protein, 27 aa, artificial
  peptide fold or domain or sub-domain
SAIKYAKVKPIRDEDGLAIDFEIEGEY

SEQ ID NO: 17628 - protein, 29 aa, artificial
  peptide fold or domain or sub-domain
SAILGDLWGLETTTDPATFESKRQALAAK

SEQ ID NO: 17629 - protein, 29 aa, artificial
  peptide fold or domain or sub-domain
SAILNAIGRLYSAPTEAGFLAESRALTGM

SEQ ID NO: 17630 - protein, 26 aa, artificial
  peptide fold or domain or sub-domain
SAIQFFLEDEESSKDLEMQKELEKEF

SEQ ID NO: 17631 - protein, 22 aa, artificial
  peptide fold or domain or sub-domain
SAITQFKPVDLADMESVDLNLF

SEQ ID NO: 17632 - protein, 30 aa, artificial
  peptide fold or domain or sub-domain
SAIWVRNKNEITPEDYNKFYEYISNSKLAY

SEQ ID NO: 17633 - protein, 27 aa, artificial
  peptide fold or domain or sub-domain
SAKAGGAMLKGEAPFDAAKVAAIFTEM

SEQ ID NO: 17634 - protein, 26 aa, artificial
  peptide fold or domain or sub-domain
SAKAIALLGHHGGAMADYKAPHVQDT

SEQ ID NO: 17635 - protein, 27 aa, artificial
  peptide fold or domain or sub-domain
SAKAQAILALGLRADKETLYRLTEKLS

SEQ ID NO: 17636 - protein, 22 aa, artificial
  peptide fold or domain or sub-domain
SAKAVAQGTMTEEIRQGINENV

SEQ ID NO: 17637 - protein, 24 aa, artificial
  peptide fold or domain or sub-domain
SAKIQLNGQDRFATRKGSYFNKVQ

SEQ ID NO: 17638 - protein, 20 aa, artificial
  peptide fold or domain or sub-domain
SAKVYELDKGELTAATEEVS

SEQ ID NO: 17639 - protein, 22 aa, artificial
  peptide fold or domain or sub-domain
SALEDYLRQQNATQSYHNRFGK

SEQ ID NO: 17640 - protein, 21 aa, artificial
  peptide fold or domain or sub-domain
SALEMDFETNRHGPRKEVQSF

SEQ ID NO: 17641 - protein, 21 aa, artificial
  peptide fold or domain or sub-domain
SALFHALRGAEPANEAIRQAV

SEQ ID NO: 17642 - protein, 30 aa, artificial
  peptide fold or domain or sub-domain
SALKESYKQLKDPKTESQQRREALAFFVHL

SEQ ID NO: 17643 - protein, 25 aa, artificial
  peptide fold or domain or sub-domain
SALKIFEKKDLSLLAYSGRSIFESK

SEQ ID NO: 17644 - protein, 30 aa, artificial
  peptide fold or domain or sub-domain
SALKMFTANLTSSQTSKAEKQLALRFIVHI

SEQ ID NO: 17645 - protein, 26 aa, artificial
  peptide fold or domain or sub-domain
SALLDELGRAKELALSPADQTVLARY

SEQ ID NO: 17646 - protein, 21 aa, artificial
  peptide fold or domain or sub-domain
SALQSRDVDYATQLDYGVKLL

SEQ ID NO: 17647 - protein, 24 aa, artificial
  peptide fold or domain or sub-domain
SALRFYGAAQNRQRPAPYTVNMWD

SEQ ID NO: 17648 - protein, 21 aa, artificial
  peptide fold or domain or sub-domain
SALSKQIQIASTNNGQFESPV

SEQ ID NO: 17649 - protein, 22 aa, artificial
  peptide fold or domain or sub-domain
SALSVIYTPNGEFKRYLFLPRN

SEQ ID NO: 17650 - protein, 22 aa, artificial
  peptide fold or domain or sub-domain
SALSVLYSPEGISQGVEFYPNS

SEQ ID NO: 17651 - protein, 26 aa, artificial
  peptide fold or domain or sub-domain
SALVISNKTKETLDMFSLKQKDGKTV

SEQ ID NO: 17652 - protein, 27 aa, artificial
  peptide fold or domain or sub-domain
SALVRNEEQEALLCKEFKDALEIVVGD

SEQ ID NO: 17653 - protein, 30 aa, artificial
  peptide fold or domain or sub-domain
SALWQRSKSELSAEDYKKAYQQIASAFDDP

SEQ ID NO: 17654 - protein, 30 aa, artificial
  peptide fold or domain or sub-domain
SALWTRTASDVEDDEYVDFYKNITYDMDAP

SEQ ID NO: 17655 - protein, 23 aa, artificial
  peptide fold or domain or sub-domain
SALYDYVMQRLTAANLHNDETAL

SEQ ID NO: 17656 - protein, 20 aa, artificial
  peptide fold or domain or sub-domain
SAMDMEHADAENPFGPGPRK

SEQ ID NO: 17657 - protein, 21 aa, artificial
  peptide fold or domain or sub-domain
SAMGKVRDGEIEVTEELIDVM

SEQ ID NO: 17658 - protein, 25 aa, artificial
  peptide fold or domain or sub-domain
SAMKIFVTTKNTKSQGIEEALKNRN

SEQ ID NO: 17659 - protein, 28 aa, artificial
  peptide fold or domain or sub-domain
SAMRFYTAKGGVMAFFRGHHDEVLVVAN

SEQ ID NO: 17660 - protein, 26 aa, artificial
  peptide fold or domain or sub-domain
SAMRTLLSAPDGRRLGPNHYDGDADF

SEQ ID NO: 17661 - protein, 24 aa, artificial
  peptide fold or domain or sub-domain
SAMVTDVARARDEGDVRDDVDIVA

SEQ ID NO: 17662 - protein, 23 aa, artificial
  peptide fold or domain or sub-domain
SAMYRFAPDGGTSDWDYARSSNP

SEQ ID NO: 17663 - protein, 24 aa, artificial
  peptide fold or domain or sub-domain
SANFFGDFKGKSIADIRASPKLRS

SEQ ID NO: 17664 - protein, 25 aa, artificial
  peptide fold or domain or sub-domain
SAPAETYSIAYFEAFSWKRSCLRMS

SEQ ID NO: 17665 - protein, 29 aa, artificial
  peptide fold or domain or sub-domain
SAPAWLKFNNSLTGGGYLRNDQYGLYANY

SEQ ID NO: 17666 - protein, 21 aa, artificial
  peptide fold or domain or sub-domain
SAPQEQYLETLEQDPGSVKGD

SEQ ID NO: 17667 - protein, 26 aa, artificial
  peptide fold or domain or sub-domain
SAPSAGTAALNHSGKVDTHNFYGTDS

SEQ ID NO: 17668 - protein, 29 aa, artificial
  peptide fold or domain or sub-domain
SAPTWMKTNHKINGFGFLKTEYYQTFANY

SEQ ID NO: 17669 - protein, 21 aa, artificial
  peptide fold or domain or sub-domain
SAQEMQTWSMLSDNMTNDQAA

SEQ ID NO: 17670 - protein, 30 aa, artificial
  peptide fold or domain or sub-domain
SAQINELHKAASKMSDAITQDFLDEFLREQ

SEQ ID NO: 17671 - protein, 27 aa, artificial
  peptide fold or domain or sub-domain
SAQLETIKTKAGETFGEEKEAIFEGHI

SEQ ID NO: 17672 - protein, 24 aa, artificial
  peptide fold or domain or sub-domain
SAQQTKLYREDWIGLKALDAAGKV

SEQ ID NO: 17673 - protein, 26 aa, artificial
  peptide fold or domain or sub-domain
SAQTVSKNYKKSKESFTAWNQSLEIL

SEQ ID NO: 17674 - protein, 30 aa, artificial
  peptide fold or domain or sub-domain
SARAIVQGINSNAGKEGIREGMPLAHARRM

SEQ ID NO: 17675 - protein, 22 aa, artificial
  peptide fold or domain or sub-domain
SARGCQVGEVADRLGVADRTAE

SEQ ID NO: 17676 - protein, 24 aa, artificial
  peptide fold or domain or sub-domain
SARISYNGKDRIPETDDSYFKMIE

SEQ ID NO: 17677 - protein, 25 aa, artificial
  peptide fold or domain or sub-domain
SARLKRTLGGSVAGDRRDNMVRRLN

SEQ ID NO: 17678 - protein, 27 aa, artificial
  peptide fold or domain or sub-domain
SARLVGGASEVQVDIRFKGVEFPVSVF

SEQ ID NO: 17679 - protein, 28 aa, artificial
  peptide fold or domain or sub-domain
SARVLPLIAGHPRVTVAAINGPRNTVIS

SEQ ID NO: 17680 - protein, 27 aa, artificial
  peptide fold or domain or sub-domain
SASAKTPATDAVVTASVSAKKNEAQAA

SEQ ID NO: 17681 - protein, 28 aa, artificial
  peptide fold or domain or sub-domain
SASEINGKLRQNKGVINGFPSNLIKQVE

SEQ ID NO: 17682 - protein, 30 aa, artificial
  peptide fold or domain or sub-domain
SASILATKLTELVKTVPNYDPTAIDLMHMD

SEQ ID NO: 17683 - protein, 30 aa, artificial
  peptide fold or domain or sub-domain
SASIYTKNIGNALEFIKDIEAGLIKVNAET

SEQ ID NO: 17684 - protein, 23 aa, artificial
  peptide fold or domain or sub-domain
SASKGAQYLGDGKNITSTQVEEL

SEQ ID NO: 17685 - protein, 28 aa, artificial
  peptide fold or domain or sub-domain
SASKSEARRLLKQNSVSLNGQKVQDENA

SEQ ID NO: 17686 - protein, 30 aa, artificial
  peptide fold or domain or sub-domain
SASLTNITRDQKVLNPTAVSLQVKLNATID

SEQ ID NO: 17687 - protein, 29 aa, artificial
  peptide fold or domain or sub-domain
SASRQGDLVWSWQGELYRLDAGSDTPRKL

SEQ ID NO: 17688 - protein, 23 aa, artificial
  peptide fold or domain or sub-domain
SATFKHHGLNNSTGYDYARAQNP

SEQ ID NO: 17689 - protein, 28 aa, artificial
  peptide fold or domain or sub-domain
SATLFYRDIANSFGGGVGATYSSSSSAS

SEQ ID NO: 17690 - protein, 28 aa, artificial
  peptide fold or domain or sub-domain
SATLKKLNPEGFVNYRPYGDIELTPAGR

SEQ ID NO: 17691 - protein, 30 aa, artificial
  peptide fold or domain or sub-domain
SATLWTSDLSRTMRMSNELEAGIVWVNTWL

SEQ ID NO: 17692 - protein, 23 aa, artificial
  peptide fold or domain or sub-domain
SATMATTRAGTDAVVSIDDAKEA

SEQ ID NO: 17693 - protein, 27 aa, artificial
  peptide fold or domain or sub-domain
SATMVKKMREYGISDPEEIMWFKNSVH

SEQ ID NO: 17694 - protein, 25 aa, artificial
  peptide fold or domain or sub-domain
SATRSALLEDRIPANLRHPEGLWFG

SEQ ID NO: 17695 - protein, 21 aa, artificial
  peptide fold or domain or sub-domain
SAVCPDGTRVTNAACCAFIPL

SEQ ID NO: 17696 - protein, 26 aa, artificial
  peptide fold or domain or sub-domain
SAVDNNGKYIAKFLPPGFQKLGDAKV

SEQ ID NO: 17697 - protein, 28 aa, artificial
  peptide fold or domain or sub-domain
SAVGEDRLGTFLISHLRKTGIDPGLVQR

SEQ ID NO: 17698 - protein, 28 aa, artificial
  peptide fold or domain or sub-domain
SAVGPDNFAPFLLEHLNKSGVNTDFVQK

SEQ ID NO: 17699 - protein, 21 aa, artificial
  peptide fold or domain or sub-domain
SAVKVLAEESKLGIPATKRVL

SEQ ID NO: 17700 - protein, 21 aa, artificial
  peptide fold or domain or sub-domain
SAVPIFIESFGVNEKSAMRIM

SEQ ID NO: 17701 - protein, 26 aa, artificial
  peptide fold or domain or sub-domain
SAVPVIFLTARDTLDDVVFGLGAGAD

SEQ ID NO: 17702 - protein, 27 aa, artificial
  peptide fold or domain or sub-domain
SAVQDITAAAEVPKGSFYNHFESKEAF

SEQ ID NO: 17703 - protein, 21 aa, artificial
  peptide fold or domain or sub-domain
SAVQVYMAMYSLDQHAAKDFL

SEQ ID NO: 17704 - protein, 25 aa, artificial
  peptide fold or domain or sub-domain
SAVRKQFGPERHGEEMAILEYQLHQ

SEQ ID NO: 17705 - protein, 25 aa, artificial
  peptide fold or domain or sub-domain
SAVRRQFGAHNGGIETQVIDYKTQQ

SEQ ID NO: 17706 - protein, 25 aa, artificial
  peptide fold or domain or sub-domain
SAVRRQSEIKQSEPEPQILDFQTQQ

SEQ ID NO: 17707 - protein, 29 aa, artificial
  peptide fold or domain or sub-domain
SAVSGVSQDVITKARKGEFIEDPKFKEHL

SEQ ID NO: 17708 - protein, 24 aa, artificial
  peptide fold or domain or sub-domain
SAVSTVHEWLRALRMERYQEEFDR

SEQ ID NO: 17709 - protein, 22 aa, artificial
  peptide fold or domain or sub-domain
SAWQIVSVDSTYHSSLSVSHCQ

SEQ ID NO: 17710 - protein, 23 aa, artificial
  peptide fold or domain or sub-domain
SAYFFWSKITLEKKPDSLGTYVE

SEQ ID NO: 17711 - protein, 26 aa, artificial
  peptide fold or domain or sub-domain
SAYGGPYDKGKPAIPPSMLPGGMYQW

SEQ ID NO: 17712 - protein, 24 aa, artificial
  peptide fold or domain or sub-domain
SAYLSEVSAEWKSTYGTKSAFSWP

SEQ ID NO: 17713 - protein, 23 aa, artificial
  peptide fold or domain or sub-domain
SAYNFAVKRNMEQEILHKAISLE

SEQ ID NO: 17714 - protein, 23 aa, artificial
  peptide fold or domain or sub-domain
SCEQLARAGLFLAARGSNPMTGH

SEQ ID NO: 17715 - protein, 20 aa, artificial
  peptide fold or domain or sub-domain
SCGHCKPCMSSHAAYCDHVW

SEQ ID NO: 17716 - protein, 26 aa, artificial
  peptide fold or domain or sub-domain
SCGHCYMCEVGQTAHCETTKNAVYGF

SEQ ID NO: 17717 - protein, 26 aa, artificial
  peptide fold or domain or sub-domain
SCGLCRNCQAGHSTQCQRVSQIRQRP

SEQ ID NO: 17718 - protein, 20 aa, artificial
  peptide fold or domain or sub-domain
SCGRCEMCQSGRPQICQAAV

SEQ ID NO: 17719 - protein, 26 aa, artificial
  peptide fold or domain or sub-domain
SCGTCSYCRTGRPDLCEEAARLMATG

SEQ ID NO: 17720 - protein, 20 aa, artificial
  peptide fold or domain or sub-domain
SCGVCDKCSIGMPTYCRQHV

SEQ ID NO: 17721 - protein, 26 aa, artificial
  peptide fold or domain or sub-domain
SCGYCPPCREGNTSQCDNANPNGPSA

SEQ ID NO: 17722 - protein, 20 aa, artificial
  peptide fold or domain or sub-domain
SCHDWMFKCANDKCVPYWWK

SEQ ID NO: 17723 - protein, 21 aa, artificial
  peptide fold or domain or sub-domain
SCLFAAEFRPRLPKRLRETKL

SEQ ID NO: 17724 - protein, 28 aa, artificial
  peptide fold or domain or sub-domain
SCLGDDSLSRFLVDFLQAEKVETSHVKT

SEQ ID NO: 17725 - protein, 30 aa, artificial
  peptide fold or domain or sub-domain
SCLYGQLPKFQDGDLTLYQSNTILRHLGRT

SEQ ID NO: 17726 - protein, 20 aa, artificial
  peptide fold or domain or sub-domain
SCPAQTFRCSNGKCLSKSQQ

SEQ ID NO: 17727 - protein, 25 aa, artificial
  peptide fold or domain or sub-domain
SCPLCHQPLSREKNSYICPQRHQFD

SEQ ID NO: 17728 - protein, 25 aa, artificial
  peptide fold or domain or sub-domain
SCQAHAHQCHEKAECHDKAEGYCCV

SEQ ID NO: 17729 - protein, 24 aa, artificial
  peptide fold or domain or sub-domain
SCQEFYNGLKKIMGYSGLIKASAN

SEQ ID NO: 17730 - protein, 27 aa, artificial
  peptide fold or domain or sub-domain
SCQNDIRRYARRHCAASDIDDAVQETL

SEQ ID NO: 17731 - protein, 27 aa, artificial
  peptide fold or domain or sub-domain
SCRDYVEQQACRIETPGPPYLAKQQCC

SEQ ID NO: 17732 - protein, 26 aa, artificial
  peptide fold or domain or sub-domain
SCRKKDGRYAIVTDRWQKFSDVILDE

SEQ ID NO: 17733 - protein, 26 aa, artificial
  peptide fold or domain or sub-domain
SCRRKDNRWFAAINKWQVMTAFELNE

SEQ ID NO: 17734 - protein, 27 aa, artificial
  peptide fold or domain or sub-domain
SCRWYVTSRTCGIGPRLPWPELKRRCC

SEQ ID NO: 17735 - protein, 23 aa, artificial
  peptide fold or domain or sub-domain
SCSCGSACGSWDIREEKVCHCQC

SEQ ID NO: 17736 - protein, 20 aa, artificial
  peptide fold or domain or sub-domain
SCSSTQFKCNSGRCIPEHWT

SEQ ID NO: 17737 - protein, 25 aa, artificial
  peptide fold or domain or sub-domain
SCSTCHTVEGKAEGDYITLDRAMHA

SEQ ID NO: 17738 - protein, 23 aa, artificial
  peptide fold or domain or sub-domain
SCTDLSKAFLYLANEGVLPTSEK

SEQ ID NO: 17739 - protein, 23 aa, artificial
  peptide fold or domain or sub-domain
SCVELARCFVYLANQGRSISGSE

SEQ ID NO: 17740 - protein, 28 aa, artificial
  peptide fold or domain or sub-domain
SCVGNDHSASIILDGFKKYHVNCDFVQV

SEQ ID NO: 17741 - protein, 28 aa, artificial
  peptide fold or domain or sub-domain
SCVGSDELGKFLKEELEREGVNIELLLE

SEQ ID NO: 17742 - protein, 21 aa, artificial
  peptide fold or domain or sub-domain
SCVLAPGTLAQREYGAAEVAE

SEQ ID NO: 17743 - protein, 27 aa, artificial
  peptide fold or domain or sub-domain
SCVTRVRDVAGGHVVETSGGNVRARFV

SEQ ID NO: 17744 - protein, 20 aa, artificial
  peptide fold or domain or sub-domain
SCYDSLFDLAKALKVSRSVI

SEQ ID NO: 17745 - protein, 23 aa, artificial
  peptide fold or domain or sub-domain
SCYSRLFNDSMDFAYDLGALGRY

SEQ ID NO: 17746 - protein, 27 aa, artificial
  peptide fold or domain or sub-domain
SDAELLAAHVAGDPEAFGEVVRRHRDR

SEQ ID NO: 17747 - protein, 30 aa, artificial
  peptide fold or domain or sub-domain
SDAGLSGRLEVYGQRMGSLVGLEQANIDQQ

SEQ ID NO: 17748 - protein, 29 aa, artificial
  peptide fold or domain or sub-domain
SDAIGLDLAHFGTKADADEIRDTSVAQPL

SEQ ID NO: 17749 - protein, 29 aa, artificial
  peptide fold or domain or sub-domain
SDAISLDVKKLCFNGDMNELTKTMNAQPA

SEQ ID NO: 17750 - protein, 30 aa, artificial
  peptide fold or domain or sub-domain
SDAMKTSNVVWSDATLGAFVQSPGKVVPGT

SEQ ID NO: 17751 - protein, 30 aa, artificial
  peptide fold or domain or sub-domain
SDANKNSGITWTEEVFREYIRDPKAKIPGT

SEQ ID NO: 17752 - protein, 27 aa, artificial
  peptide fold or domain or sub-domain
SDATLIDRARSGDRRALDELLTRHQRR

SEQ ID NO: 17753 - protein, 30 aa, artificial
  peptide fold or domain or sub-domain
SDAVKAAGFIWDAQQLDKWLADPRGFMPGT

SEQ ID NO: 17754 - protein, 22 aa, artificial
  peptide fold or domain or sub-domain
SDCTWFTDSPSEECAQFMHEIS

SEQ ID NO: 17755 - protein, 21 aa, artificial
  peptide fold or domain or sub-domain
SDDDFFNSGSLTYQQAEIVSN

SEQ ID NO: 17756 - protein, 20 aa, artificial
  peptide fold or domain or sub-domain
SDDEANRTYAAHSSLRLFVL

SEQ ID NO: 17757 - protein, 21 aa, artificial
  peptide fold or domain or sub-domain
SDDFNRDSVDWKKWNKNPENF

SEQ ID NO: 17758 - protein, 21 aa, artificial
  peptide fold or domain or sub-domain
SDDFNYEAPAAGKSTRFYERW

SEQ ID NO: 17759 - protein, 30 aa, artificial
  peptide fold or domain or sub-domain
SDDGLIEHLVYYSQRMSNILNLDQQASSAQ

SEQ ID NO: 17760 - protein, 22 aa, artificial
  peptide fold or domain or sub-domain
SDDGSLGKGEVGMTQNELAAQA

SEQ ID NO: 17761 - protein, 28 aa, artificial
  peptide fold or domain or sub-domain
SDDVQKQISKAYLLPGRTDIKAENRPNV

SEQ ID NO: 17762 - protein, 28 aa, artificial
  peptide fold or domain or sub-domain
SDEAIGLYQQYKALITVPGVDASQAAEK

SEQ ID NO: 17763 - protein, 27 aa, artificial
  peptide fold or domain or sub-domain
SDEDLMSQFQAGTVEAFNILVERYSDR

SEQ ID NO: 17764 - protein, 27 aa, artificial
  peptide fold or domain or sub-domain
SDEELLARSRDGDAEAFALLVERYQRM

SEQ ID NO: 17765 - protein, 21 aa, artificial
  peptide fold or domain or sub-domain
SDEFDGDSLDRTNWTPEQSCW

SEQ ID NO: 17766 - protein, 21 aa, artificial
  peptide fold or domain or sub-domain
SDEFDGSVLNLDKWDNLGLNG

SEQ ID NO: 17767 - protein, 21 aa, artificial
  peptide fold or domain or sub-domain
SDEFEGDKIDRSIWSYNVGGS

SEQ ID NO: 17768 - protein, 21 aa, artificial
  peptide fold or domain or sub-domain
SDEFNAGELDSTKWRDHITTW

SEQ ID NO: 17769 - protein, 21 aa, artificial
  peptide fold or domain or sub-domain
SDEFNGEKIDENKWTIIDGMV

SEQ ID NO: 17770 - protein, 21 aa, artificial
  peptide fold or domain or sub-domain
SDEFNGSIGPDWVFETGNGSG

SEQ ID NO: 17771 - protein, 21 aa, artificial
  peptide fold or domain or sub-domain
SDEFNSSGGFDSTKWSYADRG

SEQ ID NO: 17772 - protein, 21 aa, artificial
  peptide fold or domain or sub-domain
SDEFSGSTLNTTEWNYDIGTG

SEQ ID NO: 17773 - protein, 28 aa, artificial
  peptide fold or domain or sub-domain
SDEGQIAWLKGYCHPIRFNDLAKNGKIP

SEQ ID NO: 17774 - protein, 22 aa, artificial
  peptide fold or domain or sub-domain
SDEINRLRAELVARLGYEIVSQ

SEQ ID NO: 17775 - protein, 27 aa, artificial
  peptide fold or domain or sub-domain
SDEKIINMILAGEKELFARLVEKYQRK

SEQ ID NO: 17776 - protein, 27 aa, artificial
  peptide fold or domain or sub-domain
SDERLMLAFQAGDARAFEALVRKHRTP

SEQ ID NO: 17777 - protein, 27 aa, artificial
  peptide fold or domain or sub-domain
SDESLIELAQKGNGLAFDKLFERYQGK

SEQ ID NO: 17778 - protein, 27 aa, artificial
  peptide fold or domain or sub-domain
SDETLMELVAAGDSTALAQLYDRHARV

SEQ ID NO: 17779 - protein, 22 aa, artificial
  peptide fold or domain or sub-domain
SDFFRASLTKRGLTAEQLEKTI

SEQ ID NO: 17780 - protein, 28 aa, artificial
  peptide fold or domain or sub-domain
SDFLQVGYLLIDGKLPDSAATREFEERI

SEQ ID NO: 17781 - protein, 23 aa, artificial
  peptide fold or domain or sub-domain
SDFNAPFYGINKGQVVSQGVQTQ

SEQ ID NO: 17782 - protein, 28 aa, artificial
  peptide fold or domain or sub-domain
SDFRTVYVDYNTWIFERKFGSHKILVAL

SEQ ID NO: 17783 - protein, 28 aa, artificial
  peptide fold or domain or sub-domain
SDFSDSKLIQGVREGRKKENGQDTDPQD

SEQ ID NO: 17784 - protein, 23 aa, artificial
  peptide fold or domain or sub-domain
SDFTQVYYNKLEQNKTLPVLSVE

SEQ ID NO: 17785 - protein, 24 aa, artificial
  peptide fold or domain or sub-domain
SDGGGTTPLTKINGAYVASWHFPA

SEQ ID NO: 17786 - protein, 30 aa, artificial
  peptide fold or domain or sub-domain
SDGIRQHQGKWDAEKLDAFLSAPNDFAQGT

SEQ ID NO: 17787 - protein, 28 aa, artificial
  peptide fold or domain or sub-domain
SDGKTFRELQKAGEFSKNAMAVAQDFES

SEQ ID NO: 17788 - protein, 30 aa, artificial
  peptide fold or domain or sub-domain
SDGLAKADFAWDETRLDAWLTNPQAVIPGV

SEQ ID NO: 17789 - protein, 27 aa, artificial
  peptide fold or domain or sub-domain
SDGSEESKGFLDPNSMERVSYAELRGR

SEQ ID NO: 17790 - protein, 27 aa, artificial
  peptide fold or domain or sub-domain
SDHQQLAMIEPDYIVSNPVDIQTIVAK

SEQ ID NO: 17791 - protein, 28 aa, artificial
  peptide fold or domain or sub-domain
SDIGILRAFERLHGTRPSVEEAVLLAEE

SEQ ID NO: 17792 - protein, 20 aa, artificial
  peptide fold or domain or sub-domain
SDIIAKRTNKAPDIVGDRTK

SEQ ID NO: 17793 - protein, 20 aa, artificial
  peptide fold or domain or sub-domain
SDIIFHSNKRNVRDGFKGRV

SEQ ID NO: 17794 - protein, 21 aa, artificial
  peptide fold or domain or sub-domain
SDITLADINAASALNYKIKLI

SEQ ID NO: 17795 - protein, 22 aa, artificial
  peptide fold or domain or sub-domain
SDIVAKDLPSELLAIPTLYSSC

SEQ ID NO: 17796 - protein, 25 aa, artificial
  peptide fold or domain or sub-domain
SDIYRDARELEEAISFVKENTRKLL

SEQ ID NO: 17797 - protein, 30 aa, artificial
  peptide fold or domain or sub-domain
SDKKRYQIEIPDSQTKKVGAGFELQSQRKG

SEQ ID NO: 17798 - protein, 30 aa, artificial
  peptide fold or domain or sub-domain
SDKKRYQLDVPESHAHKANKSYALEGQTKG

SEQ ID NO: 17799 - protein, 28 aa, artificial
  peptide fold or domain or sub-domain
SDKLYQKVTADDRIKDFFTNIDMVKMRE

SEQ ID NO: 17800 - protein, 29 aa, artificial
  peptide fold or domain or sub-domain
SDKVYKAGTRLWKLRGDARAQARAEIVQV

SEQ ID NO: 17801 - protein, 25 aa, artificial
  peptide fold or domain or sub-domain
SDLASRGLPAPVVLEFDSEFEMLLA

SEQ ID NO: 17802 - protein, 24 aa, artificial
  peptide fold or domain or sub-domain
SDLGIAYIKWDMNRDIQHPGGADG

SEQ ID NO: 17803 - protein, 26 aa, artificial
  peptide fold or domain or sub-domain
SDLKDLFDLAEAEDDEDTLAAVEADI

SEQ ID NO: 17804 - protein, 24 aa, artificial
  peptide fold or domain or sub-domain
SDLLGEIDLKQFDIDGPLPEDLPE

SEQ ID NO: 17805 - protein, 23 aa, artificial
  peptide fold or domain or sub-domain
SDLQDQNVLALAEKTHKTPAQVL

SEQ ID NO: 17806 - protein, 30 aa, artificial
  peptide fold or domain or sub-domain
SDLQRLKFIRHARQLGFSLESIRELLSIRI

SEQ ID NO: 17807 - protein, 21 aa, artificial
  peptide fold or domain or sub-domain
SDLQYVLQGSLSSVKEQGLFL

SEQ ID NO: 17808 - protein, 29 aa, artificial
  peptide fold or domain or sub-domain
SDLVNRNILYEALKTKSKTPKEALDKAAA

SEQ ID NO: 17809 - protein, 24 aa, artificial
  peptide fold or domain or sub-domain
SDNDLTVYNMYKNNEIDAIFNSIP

SEQ ID NO: 17810 - protein, 30 aa, artificial
  peptide fold or domain or sub-domain
SDPHIKSGLTWDEPTLTKYLADPKTVIPGN

SEQ ID NO: 17811 - protein, 27 aa, artificial
  peptide fold or domain or sub-domain
SDPLDPTSKAGEIVLAARKRHGMKEEV

SEQ ID NO: 17812 - protein, 27 aa, artificial
  peptide fold or domain or sub-domain
SDPSDDTKGFFDPNTEENLTYLQLKER

SEQ ID NO: 17813 - protein, 28 aa, artificial
  peptide fold or domain or sub-domain
SDQGQINLAKGYARPIRNAYIELPQDIK

SEQ ID NO: 17814 - protein, 20 aa, artificial
  peptide fold or domain or sub-domain
SDQKTIKGFAHSKHLMTLGK

SEQ ID NO: 17815 - protein, 27 aa, artificial
  peptide fold or domain or sub-domain
SDRDCPSSPSSSTSWNADCSAGDLNWR

SEQ ID NO: 17816 - protein, 24 aa, artificial
  peptide fold or domain or sub-domain
SDREMDRFLKLPSGTCRNKFDVEY

SEQ ID NO: 17817 - protein, 25 aa, artificial
  peptide fold or domain or sub-domain
SDRLISYCTDKEVTEDYIKKIDDYL

SEQ ID NO: 17818 - protein, 21 aa, artificial
  peptide fold or domain or sub-domain
SDRSELEAELVGADPLTRCSF

SEQ ID NO: 17819 - protein, 28 aa, artificial
  peptide fold or domain or sub-domain
SDRVADISLAQWLALTPADVVATTLKVD

SEQ ID NO: 17820 - protein, 21 aa, artificial
  peptide fold or domain or sub-domain
SDSFNYTSSEGNRPTAFTSKW

SEQ ID NO: 17821 - protein, 28 aa, artificial
  peptide fold or domain or sub-domain
SDSKIQGLQKFYGNSDYRTLQSFIVHSK

SEQ ID NO: 17822 - protein, 22 aa, artificial
  peptide fold or domain or sub-domain
SDSVLKIGAKTSEKEGYHLLDC

SEQ ID NO: 17823 - protein, 20 aa, artificial
  peptide fold or domain or sub-domain
SDSVQPVPRFRQELFRMMAV

SEQ ID NO: 17824 - protein, 27 aa, artificial
  peptide fold or domain or sub-domain
SDTFRITDPNTFTARRGKLHPAPELLA

SEQ ID NO: 17825 - protein, 30 aa, artificial
  peptide fold or domain or sub-domain
SDTMWTDLSSQFFLKESHLGQNRAMCCIQQ

SEQ ID NO: 17826 - protein, 28 aa, artificial
  peptide fold or domain or sub-domain
SDTVKRLAAQGLVEYQPYKPVMLTERGE

SEQ ID NO: 17827 - protein, 21 aa, artificial
  peptide fold or domain or sub-domain
SDVAEIRDYLGLDSGLMSRLL

SEQ ID NO: 17828 - protein, 30 aa, artificial
  peptide fold or domain or sub-domain
SDVDNLIFIRRCRELQIPLEKIKILIQVQT

SEQ ID NO: 17829 - protein, 22 aa, artificial
  peptide fold or domain or sub-domain
SDVDTLRKTDITDYAVEALAKS

SEQ ID NO: 17830 - protein, 22 aa, artificial
  peptide fold or domain or sub-domain
SDYCRSPKTPSAEFSEYIKQRG

SEQ ID NO: 17831 - protein, 20 aa, artificial
  peptide fold or domain or sub-domain
SDYLIDIGPQAGILGGKVQA

SEQ ID NO: 17832 - protein, 23 aa, artificial
  peptide fold or domain or sub-domain
SDYLMHLRDSINMEKLHSLTEQV

SEQ ID NO: 17833 - protein, 24 aa, artificial
  peptide fold or domain or sub-domain
SDYLTKVSTDWKAKIGTGKALTFP

SEQ ID NO: 17834 - protein, 28 aa, artificial
  peptide fold or domain or sub-domain
SDYLTLDLGSMQYIAATFIAGYTKRKWE

SEQ ID NO: 17835 - protein, 23 aa, artificial
  peptide fold or domain or sub-domain
SDYLYFASSNKSADDFHEKVTEA

SEQ ID NO: 17836 - protein, 23 aa, artificial
  peptide fold or domain or sub-domain
SDYTQISSHISNKNRNFPRFEDK

SEQ ID NO: 17837 - protein, 23 aa, artificial
  peptide fold or domain or sub-domain
SDYTQVLYNHLQKHKPYPPIEDL

SEQ ID NO: 17838 - protein, 28 aa, artificial
  peptide fold or domain or sub-domain
SEAELIEQLSRYKPITKEEYLRIVEGKS

SEQ ID NO: 17839 - protein, 27 aa, artificial
  peptide fold or domain or sub-domain
SEAELVDRARGRDESALREIMQANNRR

SEQ ID NO: 17840 - protein, 26 aa, artificial
  peptide fold or domain or sub-domain
SEAIPILRAALKLEPSNKTIHAELSK

SEQ ID NO: 17841 - protein, 30 aa, artificial
  peptide fold or domain or sub-domain
SEAIRELYRACTSAGDIDAIPLLQWFINEQ

SEQ ID NO: 17842 - protein, 29 aa, artificial
  peptide fold or domain or sub-domain
SEAKASGNLIKIQEAHDMVVVYDSLQLAH

SEQ ID NO: 17843 - protein, 29 aa, artificial
  peptide fold or domain or sub-domain
SEALGIDMEELCFSDPEGLLNKTEFTQPA

SEQ ID NO: 17844 - protein, 30 aa, artificial
  peptide fold or domain or sub-domain
SEALKSVPGNWDFASMDEWLKSPRKYAPGT

SEQ ID NO: 17845 - protein, 24 aa, artificial
  peptide fold or domain or sub-domain
SEALMSIFQEEGGLCSPDAAAYLA

SEQ ID NO: 17846 - protein, 30 aa, artificial
  peptide fold or domain or sub-domain
SEALQKSGLTWTEANLRRWMAGNDILVPGT

SEQ ID NO: 17847 - protein, 27 aa, artificial
  peptide fold or domain or sub-domain
SEAMAAAIGSPEEHVRRGDVTPLLDWL

SEQ ID NO: 17848 - protein, 30 aa, artificial
  peptide fold or domain or sub-domain
SEASEDYGKPFMKIFEEADYDFYKIDPGVF

SEQ ID NO: 17849 - protein, 23 aa, artificial
  peptide fold or domain or sub-domain
SEDFNPLHLDPAFAATTAFERPI

SEQ ID NO: 17850 - protein, 27 aa, artificial
  peptide fold or domain or sub-domain
SEDLKNIGNTFFKSQNWEMAIKKYTKV

SEQ ID NO: 17851 - protein, 28 aa, artificial
  peptide fold or domain or sub-domain
SEDPGTNQIAQGFFALNKDVVNATLGFP

SEQ ID NO: 17852 - protein, 28 aa, artificial
  peptide fold or domain or sub-domain
SEEAQKIIGNFGFRPSNQEILEEFSDKF

SEQ ID NO: 17853 - protein, 26 aa, artificial
  peptide fold or domain or sub-domain
SEEDGASEPATFAERSQRLIQQECVA

SEQ ID NO: 17854 - protein, 23 aa, artificial
  peptide fold or domain or sub-domain
SEEDVSREAREMEMERDRYVCDL

SEQ ID NO: 17855 - protein, 30 aa, artificial
  peptide fold or domain or sub-domain
SEEESIIRRHKRGKPDRLEMSSKDFFSRAY

SEQ ID NO: 17856 - protein, 21 aa, artificial
  peptide fold or domain or sub-domain
SEELVKKEHAEYSSKELEKEA

SEQ ID NO: 17857 - protein, 22 aa, artificial
  peptide fold or domain or sub-domain
SEETEMQKKGYADFAAHKAEHD

SEQ ID NO: 17858 - protein, 30 aa, artificial
  peptide fold or domain or sub-domain
SEETMVPRYIGHMPANIKSVSKSHQSKSNK

SEQ ID NO: 17859 - protein, 30 aa, artificial
  peptide fold or domain or sub-domain
SEETMYEGVLEYAREYKKREGKSEEQIEQE

SEQ ID NO: 17860 - protein, 27 aa, artificial
  peptide fold or domain or sub-domain
SEFQLLGDAGKKLFNTMEGIKRLSGQL

SEQ ID NO: 17861 - protein, 26 aa, artificial
  peptide fold or domain or sub-domain
SEGDGGGIYFYNDWRAATPWGATRPD

SEQ ID NO: 17862 - protein, 28 aa, artificial
  peptide fold or domain or sub-domain
SEGEMLQLQSIGEIVSESEYLEVIARKT

SEQ ID NO: 17863 - protein, 26 aa, artificial
  peptide fold or domain or sub-domain
SEGIYDLRTLVDDHPTYSYFTNPAWG

SEQ ID NO: 17864 - protein, 30 aa, artificial
  peptide fold or domain or sub-domain
SEGLKASGWVWDAQTLDTYITDAEKAMPDS

SEQ ID NO: 17865 - protein, 27 aa, artificial
  peptide fold or domain or sub-domain
SEGLSPTLTTMQGGDKIPKILIPEPIQ

SEQ ID NO: 17866 - protein, 24 aa, artificial
  peptide fold or domain or sub-domain
SEGMLDINGLYYNDGETKIYYVNF

SEQ ID NO: 17867 - protein, 30 aa, artificial
  peptide fold or domain or sub-domain
SEGTAYPVGDSKIGKIYHSYTGVTQEGVFN

SEQ ID NO: 17868 - protein, 23 aa, artificial
  peptide fold or domain or sub-domain
SEIESGEKVQDETWELSDGSYIT

SEQ ID NO: 17869 - protein, 24 aa, artificial
  peptide fold or domain or sub-domain
SEINMQQKITQATGKEMDAYVILG

SEQ ID NO: 17870 - protein, 22 aa, artificial
  peptide fold or domain or sub-domain
SEIQGRVVHSGEIEDADKAAIC

SEQ ID NO: 17871 - protein, 22 aa, artificial
  peptide fold or domain or sub-domain
SEITESDLKQESYQGYVQGEDV

SEQ ID NO: 17872 - protein, 22 aa, artificial
  peptide fold or domain or sub-domain
SEITWLNPLPPEEIRQHWNTEY

SEQ ID NO: 17873 - protein, 27 aa, artificial
  peptide fold or domain or sub-domain
SEKELIKRAKKGDVEAFEQLIEGCQKK

SEQ ID NO: 17874 - protein, 20 aa, artificial
  peptide fold or domain or sub-domain
SEKIEDYYIALHPAGLSGYE

SEQ ID NO: 17875 - protein, 28 aa, artificial
  peptide fold or domain or sub-domain
SEKIVRLTEAGLLRHEWREGVSMTPKGR

SEQ ID NO: 17876 - protein, 20 aa, artificial
  peptide fold or domain or sub-domain
SEKRKLLVFEKSGHVLSNDV

SEQ ID NO: 17877 - protein, 20 aa, artificial
  peptide fold or domain or sub-domain
SELDADHPGFKDNVYRKRRK

SEQ ID NO: 17878 - protein, 25 aa, artificial
  peptide fold or domain or sub-domain
SELDADHPGFKDNVYRKRRKYFADL

SEQ ID NO: 17879 - protein, 24 aa, artificial
  peptide fold or domain or sub-domain
SELDSRLSKKYGRVVPRNLAVERP

SEQ ID NO: 17880 - protein, 25 aa, artificial
  peptide fold or domain or sub-domain
SELKSELVDAFVERRNGKATKEQAE

SEQ ID NO: 17881 - protein, 29 aa, artificial
  peptide fold or domain or sub-domain
SELLRLFRKVVKERPAHETSACKAFIEQL

SEQ ID NO: 17882 - protein, 26 aa, artificial
  peptide fold or domain or sub-domain
SELPILFLTVHSDAEMVNQVFSIGAD

SEQ ID NO: 17883 - protein, 24 aa, artificial
  peptide fold or domain or sub-domain
SELPLSEQVEAVTGQPQRVITIFQ

SEQ ID NO: 17884 - protein, 29 aa, artificial
  peptide fold or domain or sub-domain
SELQSLLARLVLQLPAEKTELFRALIQQL

SEQ ID NO: 17885 - protein, 25 aa, artificial
  peptide fold or domain or sub-domain
SELRHEVFVNRLKWPLQCPPGREID

SEQ ID NO: 17886 - protein, 29 aa, artificial
  peptide fold or domain or sub-domain
SELTVEIKKKKILFTTYKKGSPFTSGIPL

SEQ ID NO: 17887 - protein, 22 aa, artificial
  peptide fold or domain or sub-domain
SELTWFRPDPPAECREYFAGVY

SEQ ID NO: 17888 - protein, 23 aa, artificial
  peptide fold or domain or sub-domain
SELYDFMLRKISEANLNNDVKAI

SEQ ID NO: 17889 - protein, 22 aa, artificial
  peptide fold or domain or sub-domain
SEMSWFVDSPPQDALDFWREGY

SEQ ID NO: 17890 - protein, 28 aa, artificial
  peptide fold or domain or sub-domain
SEMVKKLLLEDLVLKDKQAGYLLTKKGQ

SEQ ID NO: 17891 - protein, 27 aa, artificial
  peptide fold or domain or sub-domain
SENSTPLPSEQLYNPVRVCTGCYSKLR

SEQ ID NO: 17892 - protein, 27 aa, artificial [sequence omitted]

SEQ ID NO: 17893 - protein, 27 aa, artificial
  peptide fold or domain or sub-domain
SEPSDSNRAFCVPDSKESVSYAELIQR

SEQ ID NO: 17894 - protein, 23 aa, artificial
  peptide fold or domain or sub-domain
SEPVLLEVNEEFIKSFGVKSGKL

SEQ ID NO: 17895 - protein, 22 aa, artificial
  peptide fold or domain or sub-domain
SEPVLMAGADAAQQFGFKLIES

SEQ ID NO: 17896 - protein, 27 aa, artificial
  peptide fold or domain or sub-domain
SEQELVKKSMEGDTQAFEKLVLQYQNK

SEQ ID NO: 17897 - protein, 20 aa, artificial
  peptide fold or domain or sub-domain
SEQIDFHEYAGAGHVLTVNA

SEQ ID NO: 17898 - protein, 22 aa, artificial
  peptide fold or domain or sub-domain
SEQVNKIISDISKKTGYVIKWH

SEQ ID NO: 17899 - protein, 20 aa, artificial
  peptide fold or domain or sub-domain
SERARSRSAETGIVFNRLRN

SEQ ID NO: 17900 - protein, 22 aa, artificial
  peptide fold or domain or sub-domain
SERKVLVHLGCDVYEPGLCDLN

SEQ ID NO: 17901 - protein, 25 aa, artificial
  peptide fold or domain or sub-domain
SERLRAFVFDKDLTAYYIKKLKDIF

SEQ ID NO: 17902 - protein, 21 aa, artificial
  peptide fold or domain or sub-domain
SERLRRFADWSWNGPEYLRLL

SEQ ID NO: 17903 - protein, 28 aa, artificial
  peptide fold or domain or sub-domain
SERQDPSFFRNKGVEIGRDGCRVPLPWS

SEQ ID NO: 17904 - protein, 29 aa, artificial
  peptide fold or domain or sub-domain
SERVRIKEEMKGSDDPMERKILNVQQEAL

SEQ ID NO: 17905 - protein, 23 aa, artificial
  peptide fold or domain or sub-domain
SESALYEEIQNGIELSPSVLAHM

SEQ ID NO: 17906 - protein, 22 aa, artificial
  peptide fold or domain or sub-domain
SESCFRNAATRAAFDHREGTEF

SEQ ID NO: 17907 - protein, 23 aa, artificial
  peptide fold or domain or sub-domain
SESEISQEADDMAMEKGKYVGEL

SEQ ID NO: 17908 - protein, 24 aa, artificial
  peptide fold or domain or sub-domain
SESGVNHTGLYFMQGNFRHYYVLF

SEQ ID NO: 17909 - protein, 26 aa, artificial
  peptide fold or domain or sub-domain
SESILKNRQGQNEKNKHNYVDILQGI

SEQ ID NO: 17910 - protein, 28 aa, artificial
  peptide fold or domain or sub-domain
SESIRKLADQGLVNHEKYGAVTLTDAGR

SEQ ID NO: 17911 - protein, 30 aa, artificial
  peptide fold or domain or sub-domain
SESQKYYQEALKLDKNYLNAHFGLAAVLLK

SEQ ID NO: 17912 - protein, 28 aa, artificial
  peptide fold or domain or sub-domain
SESTARLANEGLVCLADDRTVQFTEKGL

SEQ ID NO: 17913 - protein, 20 aa, artificial
  peptide fold or domain or sub-domain
SETINCHFKSPKCSGKAVAM

SEQ ID NO: 17914 - protein, 22 aa, artificial
  peptide fold or domain or sub-domain
SETKFYKDHKEIKSLGTASEFL

SEQ ID NO: 17915 - protein, 24 aa, artificial
  peptide fold or domain or sub-domain
SETRRPQKGDAKVVMAYFMGGDVA

SEQ ID NO: 17916 - protein, 27 aa, artificial
  peptide fold or domain or sub-domain
SETRTDWLKSEIGSFLPLWLAAFLISA

SEQ ID NO: 17917 - protein, 20 aa, artificial
  peptide fold or domain or sub-domain
SETTAADFYTDKSSTSTVSM

SEQ ID NO: 17918 - protein, 27 aa, artificial
  peptide fold or domain or sub-domain
SETYEKPLISEAHHLKIPLSQKTWIRC

SEQ ID NO: 17919 - protein, 21 aa, artificial
  peptide fold or domain or sub-domain
SEVLDNSLGSMRIKNTDGSIS

SEQ ID NO: 17920 - protein, 29 aa, artificial
  peptide fold or domain or sub-domain
SEVLGYDLWALVQDGPVEDLNQTFRTQPA

SEQ ID NO: 17921 - protein, 27 aa, artificial
  peptide fold or domain or sub-domain
SEVVDIKRKEDVFVVKTPSKEFYARYV

SEQ ID NO: 17922 - protein, 27 aa, artificial
  peptide fold or domain or sub-domain
SEVVVEQVSQALVGLGFSEKQSDDAVS

SEQ ID NO: 17923 - protein, 22 aa, artificial
  peptide fold or domain or sub-domain
SEWLQCEKPTEKDIVQFIEPIC

SEQ ID NO: 17924 - protein, 30 aa, artificial
  peptide fold or domain or sub-domain
SEWVFSANLGKTSFDEDLWGNGDYTPRDAV

SEQ ID NO: 17925 - protein, 21 aa, artificial
  peptide fold or domain or sub-domain
SFAEFEFEQDINGRRKTSKSF

SEQ ID NO: 17926 - protein, 21 aa, artificial
  peptide fold or domain or sub-domain
SFCKYKSCLHVSEPYCSVTSS

SEQ ID NO: 17927 - protein, 29 aa, artificial
  peptide fold or domain or sub-domain
SFDAASLVQGFYSKKDKAEFLKQLDTEYD

SEQ ID NO: 17928 - protein, 28 aa, artificial
  peptide fold or domain or sub-domain
SFDITWGNGRANIFENGQLLTCTLDKVS

SEQ ID NO: 17929 - protein, 30 aa, artificial
  peptide fold or domain or sub-domain
SFDWEWTDKDGEFHRDGEITPVEFWKKYVG

SEQ ID NO: 17930 - protein, 30 aa, artificial
  peptide fold or domain or sub-domain
SFEDMLEATVVEATKFARDLGVEAGMAGRE

SEQ ID NO: 17931 - protein, 29 aa, artificial
  peptide fold or domain or sub-domain
SFELNRVDGKEKFIESVQGDKVKYDTLVI

SEQ ID NO: 17932 - protein, 27 aa, artificial
  peptide fold or domain or sub-domain
SFELSKNGDEWTFTSSSGDNTYTKTFK

SEQ ID NO: 17933 - protein, 27 aa, artificial
  peptide fold or domain or sub-domain
SFETIYQTAATHKVDMRLAAYMTGIRK

SEQ ID NO: 17934 - protein, 20 aa, artificial
  peptide fold or domain or sub-domain
SFEYLKFSAQEFNVEIYEEL

SEQ ID NO: 17935 - protein, 22 aa, artificial
  peptide fold or domain or sub-domain
SFGLPAEQYALQTGKPPRTFTY

SEQ ID NO: 17936 - protein, 28 aa, artificial
  peptide fold or domain or sub-domain
SFGLYVHNDTMRAFGRPQDMFSDTGIQL

SEQ ID NO: 17937 - protein, 28 aa, artificial
  peptide fold or domain or sub-domain
SFGTDHGYAMSHLSMLGCDYRFWDELFD

SEQ ID NO: 17938 - protein, 23 aa, artificial
  peptide fold or domain or sub-domain
SFHLKQCVRRYSSFDFLTEVVNK

SEQ ID NO: 17939 - protein, 26 aa, artificial
  peptide fold or domain or sub-domain
SFHPAVVGEWSGAITDCATWLNGVGV

SEQ ID NO: 17940 - protein, 29 aa, artificial
  peptide fold or domain or sub-domain
SFIAESSPRPPCRLLLPSGYLLRVGRWSL

SEQ ID NO: 17941 - protein, 22 aa, artificial
  peptide fold or domain or sub-domain
SFISSSLVKEVALYGGDVTEWV

SEQ ID NO: 17942 - protein, 29 aa, artificial
  peptide fold or domain or sub-domain
SFKAASGTTEEVTALRLACSSKLAIYSGD

SEQ ID NO: 17943 - protein, 26 aa, artificial
  peptide fold or domain or sub-domain
SFKCEKCGEMFNWSSHLTEHQRLHSE

SEQ ID NO: 17944 - protein, 30 aa, artificial
  peptide fold or domain or sub-domain
SFKIFHQGQMVQELQGAQSASDFREALEPY

SEQ ID NO: 17945 - protein, 30 aa, artificial
  peptide fold or domain or sub-domain
SFKQIGLDIATCIGDGIRGDLSKNKLYNHY

SEQ ID NO: 17946 - protein, 29 aa, artificial
  peptide fold or domain or sub-domain
SFLAYSSENIHSQAKWLTNDNVESEKCHF

SEQ ID NO: 17947 - protein, 29 aa, artificial
  peptide fold or domain or sub-domain
SFLCKLRDTKSADQKMTLLHFLAELCEND

SEQ ID NO: 17948 - protein, 23 aa, artificial
  peptide fold or domain or sub-domain
SFLDEFTQKFFSNAPGSLLVSEA

SEQ ID NO: 17949 - protein, 27 aa, artificial
  peptide fold or domain or sub-domain
SFLDNILSRGGSEEPMDLFKRFRGREP

SEQ ID NO: 17950 - protein, 26 aa, artificial
  peptide fold or domain or sub-domain
SFLPEVINTWSSIYKEDTVLHLCLRE

SEQ ID NO: 17951 - protein, 29 aa, artificial
  peptide fold or domain or sub-domain
SFLPKLSSTKDYENKQTLLHYIADVVEKK

SEQ ID NO: 17952 - protein, 29 aa, artificial
  peptide fold or domain or sub-domain
SFLVRYDEVTDGVSPQELSVPGDQREVTL

SEQ ID NO: 17953 - protein, 27 aa, artificial
  peptide fold or domain or sub-domain
SFLVSREHAGMHIGFGESGDVVVQDVS

SEQ ID NO: 17954 - protein, 24 aa, artificial
  peptide fold or domain or sub-domain
SFLWTGENPPGKEKVVDDYPVEIV

SEQ ID NO: 17955 - protein, 24 aa, artificial
  peptide fold or domain or sub-domain
SFLYTGDHPTIPMNPVSEYPTVVS

SEQ ID NO: 17956 - protein, 24 aa, artificial
  peptide fold or domain or sub-domain
SFMVLSSLGLLFLLSWSRNNDFPC

SEQ ID NO: 17957 - protein, 21 aa, artificial
  peptide fold or domain or sub-domain
SFREWEADPTNPALREEMRIQ

SEQ ID NO: 17958 - protein, 27 aa, artificial
  peptide fold or domain or sub-domain
SFRLMLASGKVVECSRQENSELFSLVL

SEQ ID NO: 17959 - protein, 21 aa, artificial
  peptide fold or domain or sub-domain
SFRPSINTDDNGNTETPYGEY

SEQ ID NO: 17960 - protein, 27 aa, artificial
  peptide fold or domain or sub-domain
SFSDIEAQFLTENDTSKVDVDYFLELV

SEQ ID NO: 17961 - protein, 27 aa, artificial
  peptide fold or domain or sub-domain
SFSEFEPGNDNLTLQGAALITQSGVLQ

SEQ ID NO: 17962 - protein, 22 aa, artificial
  peptide fold or domain or sub-domain
SFSIPFQNYGEIKLSNPHFRDG

SEQ ID NO: 17963 - protein, 22 aa, artificial
  peptide fold or domain or sub-domain
SFSISIDSSQNVHIRTIEKTNP

SEQ ID NO: 17964 - protein, 30 aa, artificial
  peptide fold or domain or sub-domain
SFSLPYHSTKLLPSVKPLSILLNGLNSDNI

SEQ ID NO: 17965 - protein, 21 aa, artificial
  peptide fold or domain or sub-domain
SFSLTTFSPSGKLVQIEYALA

SEQ ID NO: 17966 - protein, 29 aa, artificial
  peptide fold or domain or sub-domain
SFSPDGRRVVTGSGEGTVRVWDLSAPKSQ

SEQ ID NO: 17967 - protein, 25 aa, artificial
  peptide fold or domain or sub-domain
SFSRKQFQGSDPKFEKQLISYSSHR

SEQ ID NO: 17968 - protein, 22 aa, artificial
  peptide fold or domain or sub-domain
SFSVRLHQDGQVSIELPDSHSP

SEQ ID NO: 17969 - protein, 30 aa, artificial
  peptide fold or domain or sub-domain
SFTWQFKDTDGTISEPKTFTPKAFYDEIIG

SEQ ID NO: 17970 - protein, 29 aa, artificial
  peptide fold or domain or sub-domain
SFVGFSNGTIHKLVTWLPENDLNTEQNEF

SEQ ID NO: 17971 - protein, 29 aa, artificial
  peptide fold or domain or sub-domain
SFVLKIRDTKRKSDPLELIVPGHERTHDI

SEQ ID NO: 17972 - protein, 23 aa, artificial
  peptide fold or domain or sub-domain
SFYAYRLRRSQYNREFLPARNEL

SEQ ID NO: 17973 - protein, 20 aa, artificial
  peptide fold or domain or sub-domain
SFYDRKTVSKDMPFGKGVYD

SEQ ID NO: 17974 - protein, 23 aa, artificial
  peptide fold or domain or sub-domain
SFYLHFLVANTPFMREDCYKIVQ

SEQ ID NO: 17975 - protein, 25 aa, artificial
  peptide fold or domain or sub-domain
SFYNKGLALQSMKEYNEAINAYNKA

SEQ ID NO: 17976 - protein, 20 aa, artificial
  peptide fold or domain or sub-domain
SGADEGTWSPSSSSSSSTSS

SEQ ID NO: 17977 - protein, 29 aa, artificial
  peptide fold or domain or sub-domain
SGAFHGRTYGALSLTASNAKYRNRYAPLL

SEQ ID NO: 17978 - protein, 21 aa, artificial
  peptide fold or domain or sub-domain
SGAHLAAAQNPPATRTPELAN

SEQ ID NO: 17979 - protein, 21 aa, artificial
  peptide fold or domain or sub-domain
SGAKPLPQSSPEEARGLMQHL

SEQ ID NO: 17980 - protein, 26 aa, artificial
  peptide fold or domain or sub-domain
SGALCRLGARGEAPPAAAALDAVVAA

SEQ ID NO: 17981 - protein, 30 aa, artificial
  peptide fold or domain or sub-domain
SGALSNAEGSWTYENLNEWINNPSAYVRGT

SEQ ID NO: 17982 - protein, 29 aa, artificial
  peptide fold or domain or sub-domain
SGALTDFFVQIAQGGDVASLAKDLDAKID

SEQ ID NO: 17983 - protein, 30 aa, artificial
  peptide fold or domain or sub-domain
SGALTDHGGDWTPDRLAAFLANPRKAVPGT

SEQ ID NO: 17984 - protein, 26 aa, artificial
  peptide fold or domain or sub-domain
SGAQQRRKLNTRISELQSELENAPKT

SEQ ID NO: 17985 - protein, 27 aa, artificial
  peptide fold or domain or sub-domain
SGAVVEARSLDQPVGTSVSQPSGLKRE

SEQ ID NO: 17986 - protein, 24 aa, artificial
  peptide fold or domain or sub-domain
SGCASVGEWLRTIKMERYEDSFLQ

SEQ ID NO: 17987 - protein, 22 aa, artificial
  peptide fold or domain or sub-domain
SGCAVVYSKEGIFEAVYYQKMN

SEQ ID NO: 17988 - protein, 26 aa, artificial
  peptide fold or domain or sub-domain
SGCDTRSNPAAFRTESARLLSEERVD

SEQ ID NO: 17989 - protein, 22 aa, artificial
  peptide fold or domain or sub-domain
SGCEGSAYLAKPSMRDIPGAIS

SEQ ID NO: 17990 - protein, 20 aa, artificial
  peptide fold or domain or sub-domain
SGCRDRLLSIQRSHMNDRNF

SEQ ID NO: 17991 - protein, 24 aa, artificial
  peptide fold or domain or sub-domain
SGDAHEWFRQALADPASAEAGYYY

SEQ ID NO: 17992 - protein, 23 aa, artificial
  peptide fold or domain or sub-domain
SGDFNPIHIDPQVGRAAGYSGAI

SEQ ID NO: 17993 - protein, 27 aa, artificial
  peptide fold or domain or sub-domain
SGDFRLKNTAEHKRFYGGDKSAEDVLQ

SEQ ID NO: 17994 - protein, 27 aa, artificial
  peptide fold or domain or sub-domain
SGDFRYKSVEVYEKWYNATHGMPHLLK

SEQ ID NO: 17995 - protein, 23 aa, artificial
  peptide fold or domain or sub-domain
SGDHFYAHMDKIAAAESIFGERV

SEQ ID NO: 17996 - protein, 23 aa, artificial
  peptide fold or domain or sub-domain
SGDHNAPHIDHEFCKTQSYGEPI

SEQ ID NO: 17997 - protein, 23 aa, artificial
  peptide fold or domain or sub-domain
SGDHNPIHIDIDFARKARMPDVF

SEQ ID NO: 17998 - protein, 24 aa, artificial
  peptide fold or domain or sub-domain
SGDKFFAFRDVVEKGEKSKYANWY

SEQ ID NO: 17999 - protein, 23 aa, artificial
  peptide fold or domain or sub-domain
SGDNHPVHYDVEYCRALGMPHML

SEQ ID NO: 18000 - protein, 24 aa, artificial
  peptide fold or domain or sub-domain
SGDRPVEYPAFGLEHEFESRGERF

SEQ ID NO: 18001 - protein, 23 aa, artificial
  peptide fold or domain or sub-domain
SGDVNPAHVDEEYARSDMFHEVV

SEQ ID NO: 18002 - protein, 23 aa, artificial
  peptide fold or domain or sub-domain
SGDYNPIHTDAEFAKSTPFGQRI

SEQ ID NO: 18003 - protein, 27 aa, artificial
  peptide fold or domain or sub-domain
SGDYRFEDLSLYEKYYKIKHKGLPDVK

SEQ ID NO: 18004 - protein, 21 aa, artificial
  peptide fold or domain or sub-domain
SGEIVGARFAPESDWTATQRS

SEQ ID NO: 18005 - protein, 21 aa, artificial
  peptide fold or domain or sub-domain
SGEKVIQGQTDPEYLLLGQRL

SEQ ID NO: 18006 - protein, 27 aa, artificial
  peptide fold or domain or sub-domain
SGEVKKPETINYRTLKPERDGLFCERI

SEQ ID NO: 18007 - protein, 26 aa, artificial
  peptide fold or domain or sub-domain
SGFAADDSAWGDASRRPFVEKRESGD

SEQ ID NO: 18008 - protein, 26 aa, artificial
  peptide fold or domain or sub-domain
SGFDDALFYAWRRDPEFVLNKPEYKQ

SEQ ID NO: 18009 - protein, 29 aa, artificial
  peptide fold or domain or sub-domain
SGFHSFRVHCAARKQEDPFPQMDRKIILT

SEQ ID NO: 18010 - protein, 20 aa, artificial
  peptide fold or domain or sub-domain
SGFTTGSTTPLVEVAVKYLK

SEQ ID NO: 18011 - protein, 24 aa, artificial
  peptide fold or domain or sub-domain
SGGDDADLQRDGDFVPHDARYRRT

SEQ ID NO: 18012 - protein, 20 aa, artificial
  peptide fold or domain or sub-domain
SGGGGADACGLERHLAGGRK

SEQ ID NO: 18013 - protein, 30 aa, artificial
  peptide fold or domain or sub-domain
SGGGGRGATAATPPRIYRTDDYGQSWKLMN

SEQ ID NO: 18014 - protein, 26 aa, artificial
  peptide fold or domain or sub-domain
SGGVYDLLDVSQSSPCYKSYILDAYG

SEQ ID NO: 18015 - protein, 20 aa, artificial
  peptide fold or domain or sub-domain
SGGYAWDHERRLTELPSLVE

SEQ ID NO: 18016 - protein, 25 aa, artificial
  peptide fold or domain or sub-domain
SGHKVTCTEAISDDVINAGGEYVRI

SEQ ID NO: 18017 - protein, 21 aa, artificial
  peptide fold or domain or sub-domain
SGHLLPVLGGPKDGLNAAQEA

SEQ ID NO: 18018 - protein, 25 aa, artificial
  peptide fold or domain or sub-domain
SGIELDGNWIKADGHGRTNVECVFA

SEQ ID NO: 18019 - protein, 20 aa, artificial
  peptide fold or domain or sub-domain
SGIGDPVRLQGIGIEPIHAL

SEQ ID NO: 18020 - protein, 20 aa, artificial
  peptide fold or domain or sub-domain
SGIGKVTDLAEAGISTLVEN

SEQ ID NO: 18021 - protein, 20 aa, artificial
  peptide fold or domain or sub-domain
SGIGLKSVLDQANVTQLLDL

SEQ ID NO: 18022 - protein, 20 aa, artificial
  peptide fold or domain or sub-domain
SGIGNADDLKKLGIPVVCHL

SEQ ID NO: 18023 - protein, 20 aa, artificial
  peptide fold or domain or sub-domain
SGIGPAAHLKEQGLKVRVDS

SEQ ID NO: 18024 - protein, 20 aa, artificial
  peptide fold or domain or sub-domain
SGIGPAEELARHGIVSRHPL

SEQ ID NO: 18025 - protein, 20 aa, artificial
  peptide fold or domain or sub-domain
SGIGPTDILSHHAIPIIIDA

SEQ ID NO: 18026 - protein, 20 aa, artificial
  peptide fold or domain or sub-domain
SGIGQPQQIVSAAKANGVQL

SEQ ID NO: 18027 - protein, 26 aa, artificial
  peptide fold or domain or sub-domain
SGIKSLERSSSAEAEAPLELSFTNDI

SEQ ID NO: 18028 - protein, 24 aa, artificial
  peptide fold or domain or sub-domain
SGIQPLQNLSVLKQVGQENQMQWA

SEQ ID NO: 18029 - protein, 21 aa, artificial
  peptide fold or domain or sub-domain
SGIQVSMISPGVIDTGWADKV

SEQ ID NO: 18030 - protein, 27 aa, artificial
  peptide fold or domain or sub-domain
SGKEIGALLQQLREQWKKSGYQMEKDE

SEQ ID NO: 18031 - protein, 30 aa, artificial
  peptide fold or domain or sub-domain
SGKEIYLIEMPVKLVKQIPNSWQQMSGTAK

SEQ ID NO: 18032 - protein, 30 aa, artificial
  peptide fold or domain or sub-domain
SGKEIYTIEIPISATKNVPSNWVQMAANKT

SEQ ID NO: 18033 - protein, 23 aa, artificial
  peptide fold or domain or sub-domain
SGLFHSIRLGLESLPPDQALAAE

SEQ ID NO: 18034 - protein, 20 aa, artificial
  peptide fold or domain or sub-domain
SGLGAKEQLDRLDIPLVKEI

SEQ ID NO: 18035 - protein, 20 aa, artificial
  peptide fold or domain or sub-domain
SGLGNSAKLQALGIETVVSH

SEQ ID NO: 18036 - protein, 20 aa, artificial
  peptide fold or domain or sub-domain
SGLGPRKHLEKHGIRVLQDL

SEQ ID NO: 18037 - protein, 21 aa, artificial
  peptide fold or domain or sub-domain
SGLIADLSERDWVRYLWYICG

SEQ ID NO: 18038 - protein, 28 aa, artificial
  peptide fold or domain or sub-domain
SGLIDALAAGGLAKSKSEARTFIQSGAV

SEQ ID NO: 18039 - protein, 30 aa, artificial
  peptide fold or domain or sub-domain
SGLIRELAAVQDAERDYDSRALINWFLEEQ

SEQ ID NO: 18040 - protein, 21 aa, artificial
  peptide fold or domain or sub-domain
SGMDHDAAAAAKGKALYNGDA

SEQ ID NO: 18041 - protein, 20 aa, artificial
  peptide fold or domain or sub-domain
SGNLEWFTAQWGEISFDEIN

SEQ ID NO: 18042 - protein, 20 aa, artificial
  peptide fold or domain or sub-domain
SGPAALRVLPESWHLVGIDV

SEQ ID NO: 18043 - protein, 29 aa, artificial
  peptide fold or domain or sub-domain
SGPKLVENLEKDDFRKALPRFQEENLDHN

SEQ ID NO: 18044 - protein, 24 aa, artificial
  peptide fold or domain or sub-domain
  misc_feature (12)..(13): Xaa can be any naturally occurring amino acid
SGPRPDGDGVRXXPDRDSSGQSVF

SEQ ID NO: 18045 - protein, 28 aa, artificial
  peptide fold or domain or sub-domain
SGPSKLAVVKLIKEITGRGLKDSKELVD

SEQ ID NO: 18046 - protein, 27 aa, artificial
  peptide fold or domain or sub-domain
SGPWLKDVLRQIEIAIVTGKVSNEETE

SEQ ID NO: 18047 - protein, 24 aa, artificial
  peptide fold or domain or sub-domain
SGQALNERITGELYPPKFERNERL

SEQ ID NO: 18048 - protein, 25 aa, artificial
  peptide fold or domain or sub-domain
SGRQCQLHPQAPTMIKIDKNMYKFV

SEQ ID NO: 18049 - protein, 25 aa, artificial
  peptide fold or domain or sub-domain
SGRRCAIHWENLPGFSEAFPKAEVY

SEQ ID NO: 18050 - protein, 30 aa, artificial
  peptide fold or domain or sub-domain
SGSSQYYSESVKGRFIISRDNNRAQLNLQM

SEQ ID NO: 18051 - protein, 21 aa, artificial
  peptide fold or domain or sub-domain
SGTASAVVESITVTLPDHGEY

SEQ ID NO: 18052 - protein, 25 aa, artificial
  peptide fold or domain or sub-domain
SGTVLSPDYPEGYGNNMNCVWFIQS

SEQ ID NO: 18053 - protein, 20 aa, artificial
  peptide fold or domain or sub-domain
SGVDYEKVSDEERNFAKHLV

SEQ ID NO: 18054 - protein, 20 aa, artificial
  peptide fold or domain or sub-domain
SGVGACDQLSKFGIDCIHDL

SEQ ID NO: 18055 - protein, 20 aa, artificial
  peptide fold or domain or sub-domain
SGVGDPSLLARQRVPLVHAL

SEQ ID NO: 18056 - protein, 20 aa, artificial
  peptide fold or domain or sub-domain
SGVGPGDVLRAAGVPIVADR

SEQ ID NO: 18057 - protein, 20 aa, artificial
  peptide fold or domain or sub-domain
SGVGPKEDCEKLHIHHVADL

SEQ ID NO: 18058 - protein, 20 aa, artificial
  peptide fold or domain or sub-domain
SGVGREKDLRKLNISTISNL

SEQ ID NO: 18059 - protein, 27 aa, artificial
  peptide fold or domain or sub-domain
SGVIHQMIVTKQPIIYSLLHWKSVDSS

SEQ ID NO: 18060 - protein, 27 aa, artificial
  peptide fold or domain or sub-domain
SGWLAYSTFDHDWVKQQMEETSVNDVL

SEQ ID NO: 18061 - protein, 24 aa, artificial
  peptide fold or domain or sub-domain
SGWQPDDFILRPENTPPRNKPAMF

SEQ ID NO: 18062 - protein, 28 aa, artificial
  peptide fold or domain or sub-domain
SGYDHLCQFVMSGQLSDSEKLLESLENF

SEQ ID NO: 18063 - protein, 26 aa, artificial
  peptide fold or domain or sub-domain
SGYFFEKIKKDHKIEELELFATFNMG

SEQ ID NO: 18064 - protein, 24 aa, artificial
  peptide fold or domain or sub-domain
SGYFFEPFQDVLKNQEKSIYKEWF

SEQ ID NO: 18065 - protein, 25 aa, artificial
  peptide fold or domain or sub-domain
SHDFRSESYGLGWISEEIRNAILSD

SEQ ID NO: 18066 - protein, 30 aa, artificial
  peptide fold or domain or sub-domain
SHDQAVRTYQEHKASMHPVTAMLVGKDLKV

SEQ ID NO: 18067 - protein, 23 aa, artificial
  peptide fold or domain or sub-domain
SHDWNPLHFDPESARKAGFENRL

SEQ ID NO: 18068 - protein, 23 aa, artificial
  peptide fold or domain or sub-domain
SHEWEKHGTCAENVFDQHGYFKK

SEQ ID NO: 18069 - protein, 29 aa, artificial
  peptide fold or domain or sub-domain
SHFEEHLRGMVERLPEHQTRSARAITDML

SEQ ID NO: 18070 - protein, 22 aa, artificial
  peptide fold or domain or sub-domain
SHFNPENKNHGAPGDTDRHVGD

SEQ ID NO: 18071 - protein, 28 aa, artificial
  peptide fold or domain or sub-domain
SHGNTARQAKEHGDIKLAQICGTIAADE

SEQ ID NO: 18072 - protein, 29 aa, artificial
  peptide fold or domain or sub-domain
SHGNTFLTNRLRYITDQYCLCMFPGEFEV

SEQ ID NO: 18073 - protein, 29 aa, artificial
  peptide fold or domain or sub-domain
SHGVEWGGVKDDIRAPIIRDFCDWYKFSI

SEQ ID NO: 18074 - protein, 26 aa, artificial
  peptide fold or domain or sub-domain
SHGVKAVTYEEDLKLFEKGEAQVAIG

SEQ ID NO: 18075 - protein, 24 aa, artificial
  peptide fold or domain or sub-domain
SHHFHLKGEEVDGNLVFDHGHAWI

SEQ ID NO: 18076 - protein, 27 aa, artificial
  peptide fold or domain or sub-domain
SHIVLERDERHLRRKAITLENGEKILA

SEQ ID NO: 18077 - protein, 24 aa, artificial
  peptide fold or domain or sub-domain
SHLKSHQETFQKDNIRDFTDAFLA

SEQ ID NO: 18078 - protein, 29 aa, artificial
  peptide fold or domain or sub-domain
SHMGAVLREKVETLPPHQTQVFLAVLEQL

SEQ ID NO: 18079 - protein, 28 aa, artificial
  peptide fold or domain or sub-domain
SHNRVAKLARGYGNAALSKMCRMISGDE

SEQ ID NO: 18080 - protein, 25 aa, artificial
  peptide fold or domain or sub-domain
SHPLATELSEAFAPLKGSVVRGCLK

SEQ ID NO: 18081 - protein, 22 aa, artificial
  peptide fold or domain or sub-domain
SHQRNIRGKLDAINVAHAIVKA

SEQ ID NO: 18082 - protein, 22 aa, artificial
  peptide fold or domain or sub-domain
SHREPPLELKDTDAAVGDNIGY

SEQ ID NO: 18083 - protein, 28 aa, artificial
  peptide fold or domain or sub-domain
SHRLHSPSLSAEENLKVFGKCNNPNGHG

SEQ ID NO: 18084 - protein, 23 aa, artificial
  peptide fold or domain or sub-domain
SHRNHNVGLLNSHGRDKGADIPM

SEQ ID NO: 18085 - protein, 22 aa, artificial
  peptide fold or domain or sub-domain
SHSAVLYHEDGSFDDYAYFKQS

SEQ ID NO: 18086 - protein, 29 aa, artificial
  peptide fold or domain or sub-domain
SHSTTWGYREMNEDGELVDTWADANQLYL

SEQ ID NO: 18087 - protein, 20 aa, artificial
  peptide fold or domain or sub-domain
SHTVLLLGMQERGSPLQRAP

SEQ ID NO: 18088 - protein, 25 aa, artificial
  peptide fold or domain or sub-domain
SHVLKAISEYCTDDTEKEFLNKLST

SEQ ID NO: 18089 - protein, 23 aa, artificial
  peptide fold or domain or sub-domain
SHWKERRTHGVEPLDFAAALAAE

SEQ ID NO: 18090 - protein, 23 aa, artificial
  peptide fold or domain or sub-domain
SHWRHWRGRINNCPPFHQLLKSK

SEQ ID NO: 18091 - protein, 23 aa, artificial
  peptide fold or domain or sub-domain
SHYFHSIRNLKGAGETRDIFSAI

SEQ ID NO: 18092 - protein, 23 aa, artificial
  peptide fold or domain or sub-domain
SHYRMSLSRGQEHRTMLGAFLLE

SEQ ID NO: 18093 - protein, 23 aa, artificial
  peptide fold or domain or sub-domain
SHYYHEVRLGSEFLSLKEAIATE

SEQ ID NO: 18094 - protein, 27 aa, artificial
  peptide fold or domain or sub-domain
SIADHYDEISQRVVDEPENDEVAPLDI

SEQ ID NO: 18095 - protein, 30 aa, artificial
  peptide fold or domain or sub-domain
SIAERARRRLAEMKSQGYEQQLEAIRDEII

SEQ ID NO: 18096 - protein, 27 aa, artificial
  peptide fold or domain or sub-domain
SIAGYGCVPPTPFLIKDWERLDCGRAA

SEQ ID NO: 18097 - protein, 21 aa, artificial
  peptide fold or domain or sub-domain
SIAHVKKMHPEWDNATVELVA

SEQ ID NO: 18098 - protein, 22 aa, artificial
  peptide fold or domain or sub-domain
SIAHVMEAVERGILKEGPTFGD

SEQ ID NO: 18099 - protein, 30 aa, artificial
  peptide fold or domain or sub-domain
SIAHVMEAVERGILKEGPTFGDFKGAKQLA

SEQ ID NO: 18100 - protein, 29 aa, artificial
  peptide fold or domain or sub-domain
SIAINYSSKLVGKANVYIKTDDLYDVLDH

SEQ ID NO: 18101 - protein, 23 aa, artificial
  peptide fold or domain or sub-domain
SIAVGLLMERYHLTEKDAFERLR

SEQ ID NO: 18102 - protein, 25 aa, artificial
  peptide fold or domain or sub-domain
SIAVVVFSETNLAYAFGDPSVDAVL

SEQ ID NO: 18103 - protein, 23 aa, artificial
  peptide fold or domain or sub-domain
SICPMGGRCRVEGPGRGKCPHCR

SEQ ID NO: 18104 - protein, 25 aa, artificial
  peptide fold or domain or sub-domain
SIDAYDNFDNISLAQRLEKHELIEF

SEQ ID NO: 18105 - protein, 29 aa, artificial
  peptide fold or domain or sub-domain
SIDCFLKRLGLRQHSDIFTQKNVHTVDQL

SEQ ID NO: 18106 - protein, 21 aa, artificial
  peptide fold or domain or sub-domain
SIDHARKINQSLAQQDLIKLA

SEQ ID NO: 18107 - protein, 26 aa, artificial
  peptide fold or domain or sub-domain
SIDKWGLDDAHKDKHHKVYSADFKVS

SEQ ID NO: 18108 - protein, 21 aa, artificial
  peptide fold or domain or sub-domain
SIEFAQQMDITMTHKKAVGIA

SEQ ID NO: 18109 - protein, 25 aa, artificial
  peptide fold or domain or sub-domain
SIEKSLGEYREKIPSEIAKEIEDAV

SEQ ID NO: 18110 - protein, 21 aa, artificial
  peptide fold or domain or sub-domain
SIELETASHKNWSKNAIKQHA

SEQ ID NO: 18111 - protein, 21 aa, artificial
  peptide fold or domain or sub-domain
SIELVQQQNVQLSLTEATEKA

SEQ ID NO: 18112 - protein, 27 aa, artificial
  peptide fold or domain or sub-domain
SIELVRADGTRVEVGAENDAEAWRAAR

SEQ ID NO: 18113 - protein, 29 aa, artificial
  peptide fold or domain or sub-domain
SIENIEHTQHNDYTQLGGVAHSLSSLVAN

SEQ ID NO: 18114 - protein, 27 aa, artificial
  peptide fold or domain or sub-domain
SIEQSIEQEEGLNRSSADLRIRKTQHS

SEQ ID NO: 18115 - protein, 25 aa, artificial
  peptide fold or domain or sub-domain
SIERAIAELTILSSESEISIINSLL

SEQ ID NO: 18116 - protein, 21 aa, artificial
  peptide fold or domain or sub-domain
SIETVLKKNSSLSKEEAAGQA

SEQ ID NO: 18117 - protein, 26 aa, artificial
  peptide fold or domain or sub-domain
SIGQYVVNDEAICFNARFQGMLRDVY

SEQ ID NO: 18118 - protein, 29 aa, artificial
  peptide fold or domain or sub-domain
SIGSLEARANYRDALVAFLEQHALGDYLD

SEQ ID NO: 18119 - protein, 22 aa, artificial
  peptide fold or domain or sub-domain
SIGYAFPELVSAFLADKWQEYA

SEQ ID NO: 18120 - protein, 20 aa, artificial
  peptide fold or domain or sub-domain
SIHSAHAKTLDTQGLRNEFL

SEQ ID NO: 18121 - protein, 27 aa, artificial
  peptide fold or domain or sub-domain
SIHTIDEEIREMLGYDETDFKENGVLL

SEQ ID NO: 18122 - protein, 25 aa, artificial
  peptide fold or domain or sub-domain
SIIANTDKALISRQLVTLKNDVPVA

SEQ ID NO: 18123 - protein, 24 aa, artificial
  peptide fold or domain or sub-domain
SIIAQCIREGQAAGEIDPNQDAEA

SEQ ID NO: 18124 - protein, 27 aa, artificial
  peptide fold or domain or sub-domain
SIIEIARSMLEEKKIKNKQQDFAFSLL

SEQ ID NO: 18125 - protein, 25 aa, artificial
  peptide fold or domain or sub-domain
SIINLGLVKYEMGFIDQAIENWQAA

SEQ ID NO: 18126 - protein, 29 aa, artificial
  peptide fold or domain or sub-domain
SIIVFRGHFFWLLNPKTRRAGPARRITEE

SEQ ID NO: 18127 - protein, 25 aa, artificial
  peptide fold or domain or sub-domain
SIIWTFRDKEILRYNKGRTLSQARL

SEQ ID NO: 18128 - protein, 25 aa, artificial
  peptide fold or domain or sub-domain
SIIYKGSGLFTVRMDKKAEPKNRFF

SEQ ID NO: 18129 - protein, 29 aa, artificial
  peptide fold or domain or sub-domain
SIKEASGNLDQIAEIIEHSPADFSVYSGD

SEQ ID NO: 18130 - protein, 20 aa, artificial
  peptide fold or domain or sub-domain
SIKEFVNKDAKRIKEIRGRL

SEQ ID NO: 18131 - protein, 28 aa, artificial
  peptide fold or domain or sub-domain
SIKEFVNKDAKRIKEIRGRLIGKEGHTR

SEQ ID NO: 18132 - protein, 27 aa, artificial
  peptide fold or domain or sub-domain
SIKELVEKAGRGDLRAFEDLLVHYQDR

SEQ ID NO: 18133 - protein, 21 aa, artificial
  peptide fold or domain or sub-domain
SIKHLVVMKGLMDEKRVDEII

SEQ ID NO: 18134 - protein, 20 aa, artificial
  peptide fold or domain or sub-domain
SIKIVNGAVTELDGKPVSDF

SEQ ID NO: 18135 - protein, 26 aa, artificial
  peptide fold or domain or sub-domain
SIKPSPTLAVVKKTLELKKAGVNIIA

SEQ ID NO: 18136 - protein, 21 aa, artificial
  peptide fold or domain or sub-domain
SIKSLVLATGKITEEQYMKIM

SEQ ID NO: 18137 - protein, 21 aa, artificial
  peptide fold or domain or sub-domain
SIKTEAASIMQKVFGKEDMVN

SEQ ID NO: 18138 - protein, 30 aa, artificial
  peptide fold or domain or sub-domain
SILDDAKVYANHARKKTIDLDDVRLATEVT

SEQ ID NO: 18139 - protein, 22 aa, artificial
  peptide fold or domain or sub-domain
SILIDFSASVAATIEGDDKPSR

SEQ ID NO: 18140 - protein, 24 aa, artificial
  peptide fold or domain or sub-domain
SILKEHEMNGQDQKHTDMLSTLIS

SEQ ID NO: 18141 - protein, 26 aa, artificial
  peptide fold or domain or sub-domain
SILNEVQQAVSDGGSESQILDLSNRF

SEQ ID NO: 18142 - protein, 21 aa, artificial
  peptide fold or domain or sub-domain
SILRDGNNSIFMKIFDHGGGG

SEQ ID NO: 18143 - protein, 28 aa, artificial
  peptide fold or domain or sub-domain
SIMTRRLQMKGLVELIPNMGVRLTEQGL

SEQ ID NO: 18144 - protein, 21 aa, artificial
  peptide fold or domain or sub-domain
SINAAITGRDANPSGHIKTVV

SEQ ID NO: 18145 - protein, 26 aa, artificial
  peptide fold or domain or sub-domain
SINAAITGRDANPSGHIKTVVSQLDS

SEQ ID NO: 18146 - protein, 25 aa, artificial
  peptide fold or domain or sub-domain
SINANSSDTGGLFRDDWNHVREDKL

SEQ ID NO: 18147 - protein, 20 aa, artificial
  peptide fold or domain or sub-domain
SINDLVASAGWQEFRARERQ

SEQ ID NO: 18148 - protein, 20 aa, artificial
  peptide fold or domain or sub-domain
SINEESTISVTNAQARAMLR

SEQ ID NO: 18149 - protein, 22 aa, artificial
  peptide fold or domain or sub-domain
SINEESTISVTNAQARAMLRRH

SEQ ID NO: 18150 - protein, 20 aa, artificial
  peptide fold or domain or sub-domain
SINEIFAEAGEAGFRQIESD

SEQ ID NO: 18151 - protein, 22 aa, artificial
  peptide fold or domain or sub-domain
SINGKSLANSVHGDVLNALHQA

SEQ ID NO: 18152 - protein, 29 aa, artificial
  peptide fold or domain or sub-domain
SINKVDAAVYVQSTGKTLFFAGRSYWSYD

SEQ ID NO: 18153 - protein, 26 aa, artificial
  peptide fold or domain or sub-domain
SINRIVRELGIAKGSIFQYFGSKEGL

SEQ ID NO: 18154 - protein, 30 aa, artificial
  peptide fold or domain or sub-domain
SIPACGRCWWCRRHLKYLCAQTPAIWAAPR

SEQ ID NO: 18155 - protein, 28 aa, artificial
  peptide fold or domain or sub-domain
SIPDFKEFYTESDVNKEGLECLRLLNEI

SEQ ID NO: 18156 - protein, 28 aa, artificial
  peptide fold or domain or sub-domain
SIPDLISELESRNLIAHVTSRSLRSHLS

SEQ ID NO: 18157 - protein, 29 aa, artificial
  peptide fold or domain or sub-domain
SIQSDNGSHFTSGVVQEWAREEGIHWIFH

SEQ ID NO: 18158 - protein, 21 aa, artificial
  peptide fold or domain or sub-domain
SIRAGSTLRNEGGQLITVAQL

SEQ ID NO: 18159 - protein, 20 aa, artificial
  peptide fold or domain or sub-domain
SIRDESTTDINQPFGIEIRN

SEQ ID NO: 18160 - protein, 23 aa, artificial
  peptide fold or domain or sub-domain
SIRDLNRPMFDKLGADTGYDAVG

SEQ ID NO: 18161 - protein, 20 aa, artificial
  peptide fold or domain or sub-domain
SIRDYFDQHGEAAFRDHEAA

SEQ ID NO: 18162 - protein, 21 aa, artificial
  peptide fold or domain or sub-domain
SIRLTRQQYPYWSEKQIEWYA

SEQ ID NO: 18163 - protein, 21 aa, artificial
  peptide fold or domain or sub-domain
SIRTLILEAGLLSEDELNEIL

SEQ ID NO: 18164 - protein, 21 aa, artificial
  peptide fold or domain or sub-domain
SIRYNSLKHASGGEKLSVAQI

SEQ ID NO: 18165 - protein, 30 aa, artificial
  peptide fold or domain or sub-domain
SISGRRMEEGYKDRVLPHFKKGDKSAKARG

SEQ ID NO: 18166 - protein, 22 aa, artificial
  peptide fold or domain or sub-domain
SISGSKMREMLNSGSMPDSRVM

SEQ ID NO: 18167 - protein, 30 aa, artificial
  peptide fold or domain or sub-domain
SISNQDIVDQLKNSHKIDLDKRKFVNFKNL

SEQ ID NO: 18168 - protein, 29 aa, artificial
  peptide fold or domain or sub-domain
SISNWLTTLGLSAYIDNFHQQNLFTMEQL

SEQ ID NO: 18169 - protein, 29 aa, artificial
  peptide fold or domain or sub-domain
SISPDGRLLASAAWDSVISLQEAATGRRV

SEQ ID NO: 18170 - protein, 27 aa, artificial
  peptide fold or domain or sub-domain
SISQIEAEFAVDNDLQQVDRDLFKAVL

SEQ ID NO: 18171 - protein, 22 aa, artificial
  peptide fold or domain or sub-domain
SISRAVAENVSLNVAAHLLPYI

SEQ ID NO: 18172 - protein, 22 aa, artificial
  peptide fold or domain or sub-domain
SISVTTRQRRPSEIDGVHYHFI

SEQ ID NO: 18173 - protein, 24 aa, artificial
  peptide fold or domain or sub-domain
SITDVAKETGLSVTTVSQILNGKG

SEQ ID NO: 18174 - protein, 26 aa, artificial
  peptide fold or domain or sub-domain
SITDWFFVTEPSGQQHLLQEGKPASA

SEQ ID NO: 18175 - protein, 26 aa, artificial
  peptide fold or domain or sub-domain
SITDYFFTTSREAGANLVKEGIADDR

SEQ ID NO: 18176 - protein, 21 aa, artificial
  peptide fold or domain or sub-domain
SITIAADSRLAQALGTTNLMI

SEQ ID NO: 18177 - protein, 30 aa, artificial
  peptide fold or domain or sub-domain
SITKDEVAHALLEQHNVEIDKKHITDKLSI

SEQ ID NO: 18178 - protein, 22 aa, artificial
  peptide fold or domain or sub-domain
SITKVLYPDIAKKYNTTASRVE

SEQ ID NO: 18179 - protein, 30 aa, artificial
  peptide fold or domain or sub-domain
SITSKQIAESLQAQHGLKLDKRKIELADAI

SEQ ID NO: 18180 - protein, 24 aa, artificial
  peptide fold or domain or sub-domain
SIVCTGDTAEGRPSPYMIYRTLPE

SEQ ID NO: 18181 - protein, 25 aa, artificial
  peptide fold or domain or sub-domain
SIVKPELLEKTVYIRCATEKELLVK

SEQ ID NO: 18182 - protein, 30 aa, artificial
  peptide fold or domain or sub-domain
SIWIINSNLVDFLQDQYVELSQIDFLKKSL

SEQ ID NO: 18183 - protein, 29 aa, artificial
  peptide fold or domain or sub-domain
SIYDPLANVKEVQKQYGITLLPSLPTEYF

SEQ ID NO: 18184 - protein, 30 aa, artificial
  peptide fold or domain or sub-domain
SIYLVDRYGLVCDRLRAKRIIPEQKLFVKT

SEQ ID NO: 18185 - protein, 26 aa, artificial
  peptide fold or domain or sub-domain
SIYSDRWSGERAGARLPLPGPAASLA

SEQ ID NO: 18186 - protein, 27 aa, artificial
  peptide fold or domain or sub-domain
SKAIEFTLSEAGLKPEDAKSIGIGIVA

SEQ ID NO: 18187 - protein, 30 aa, artificial
  peptide fold or domain or sub-domain
SKALSSMQGDWSEEELFKFLKSPQSYASGT

SEQ ID NO: 18188 - protein, 30 aa, artificial
  peptide fold or domain or sub-domain
SKAMLNKGGTWEHQDLFEFLTKPQAYIKGT

SEQ ID NO: 18189 - protein, 26 aa, artificial
  peptide fold or domain or sub-domain
SKASQRYIGNPGGVLLPNARGSIDRE

SEQ ID NO: 18190 - protein, 24 aa, artificial
  peptide fold or domain or sub-domain
SKAVKMPDFDEFWAGEGIIEFPAG

SEQ ID NO: 18191 - protein, 28 aa, artificial
  peptide fold or domain or sub-domain
SKDGRAHWPAFAETVPTWPLALWVAVEN

SEQ ID NO: 18192 - protein, 21 aa, artificial
  peptide fold or domain or sub-domain
SKDIAAEIKKQFNVDIDKKKV

SEQ ID NO: 18193 - protein, 20 aa, artificial
  peptide fold or domain or sub-domain
SKDKTLKLFENGYHEMQHDE

SEQ ID NO: 18194 - protein, 26 aa, artificial
  peptide fold or domain or sub-domain
SKDSIKTMAESAGHERLSEETAAILA

SEQ ID NO: 18195 - protein, 26 aa, artificial
  peptide fold or domain or sub-domain
SKEEFDLEQHFEICYMKNPLECFFCQ

SEQ ID NO: 18196 - protein, 22 aa, artificial
  peptide fold or domain or sub-domain
SKEELKTLAEKIGVDVRSAESI

SEQ ID NO: 18197 - protein, 21 aa, artificial
  peptide fold or domain or sub-domain
SKELTARAYGNVTEAQVEELA

SEQ ID NO: 18198 - protein, 22 aa, artificial
  peptide fold or domain or sub-domain
SKELTYIWVQDLGADLISEVST

SEQ ID NO: 18199 - protein, 27 aa, artificial
  peptide fold or domain or sub-domain
SKENNLLVLDFQKNTHTYISAEMDEYC

SEQ ID NO: 18200 - protein, 21 aa, artificial
  peptide fold or domain or sub-domain
SKEQIRNLHPNWPDSKIEKEA

SEQ ID NO: 18201 - protein, 26 aa, artificial
  peptide fold or domain or sub-domain
SKETLKSFAQSKGISNIDDDALRVLS

SEQ ID NO: 18202 - protein, 30 aa, artificial
  peptide fold or domain or sub-domain
SKEVRAKRRFDELKNTNSTITYTKILSEME

SEQ ID NO: 18203 - protein, 25 aa, artificial
  peptide fold or domain or sub-domain
SKFDECIQFFKDRNKPTLFKDLKFN

SEQ ID NO: 18204 - protein, 26 aa, artificial
  peptide fold or domain or sub-domain
SKFFIDNRFRFYVQKNWKGSQGIMPG

SEQ ID NO: 18205 - protein, 29 aa, artificial
  peptide fold or domain or sub-domain
SKGFHGRTLMTMTMTSKVKPYKFGFGPFA

SEQ ID NO: 18206 - protein, 24 aa, artificial
  peptide fold or domain or sub-domain
SKGNEQTSVVSHIEVKEAKPDTGL

SEQ ID NO: 18207 - protein, 28 aa, artificial
  peptide fold or domain or sub-domain
SKGRPLDQLLSFLKSNSIDNLNAFASHI

SEQ ID NO: 18208 - protein, 29 aa, artificial
  peptide fold or domain or sub-domain
SKIEISEPGDSDFIIGSLVNNLDFYNTNN

SEQ ID NO: 18209 - protein, 22 aa, artificial
  peptide fold or domain or sub-domain
SKIKVEAILDTPVNMAVTYDPN

SEQ ID NO: 18210 - protein, 30 aa, artificial
  peptide fold or domain or sub-domain
SKILQSIANHVLFTKEEHMRPFNDFVKSNF

SEQ ID NO: 18211 - protein, 28 aa, artificial
  peptide fold or domain or sub-domain
SKILTGRKESLRRIRGRAIPLDGRYVIP

SEQ ID NO: 18212 - protein, 30 aa, artificial
  peptide fold or domain or sub-domain
SKINDRFQLLRDLLPHNDQKRDKASFLLEV

SEQ ID NO: 18213 - protein, 29 aa, artificial
  peptide fold or domain or sub-domain
SKISIIDPGDSSFYSGSLVDAFVYQKENG

SEQ ID NO: 18214 - protein, 24 aa, artificial
  peptide fold or domain or sub-domain
SKKEFRRLGDVSPANIPNNRKLNG

SEQ ID NO: 18215 - protein, 20 aa, artificial
  peptide fold or domain or sub-domain
SKKIILLGGNKLNKKNFARM

SEQ ID NO: 18216 - protein, 20 aa, artificial
  peptide fold or domain or sub-domain
SKKILQLKHLPVNKKTLTKM

SEQ ID NO: 18217 - protein, 28 aa, artificial
  peptide fold or domain or sub-domain
SKKLTRSNGTTLEYSQITDADNATKAVE

SEQ ID NO: 18218 - protein, 29 aa, artificial
  peptide fold or domain or sub-domain
SKKNDTPKELLDGQFRGEFPQDERLMCYM

SEQ ID NO: 18219 - protein, 22 aa, artificial
  peptide fold or domain or sub-domain
SKKSKFIEVSDDSANGVSKLFQ

SEQ ID NO: 18220 - protein, 26 aa, artificial
  peptide fold or domain or sub-domain
SKLAFEQIFKSIYGLTTDEAVVAEEE

SEQ ID NO: 18221 - protein, 21 aa, artificial
  peptide fold or domain or sub-domain
SKLDALDIRYAEELGYRQAAW

SEQ ID NO: 18222 - protein, 28 aa, artificial
  peptide fold or domain or sub-domain
SKLQISGGKYNLPIYDLGLLDPRAICNE

SEQ ID NO: 18223 - protein, 30 aa, artificial
  peptide fold or domain or sub-domain
SKLVDALVDIAAAEKDKATQDFLWGFVREQ

SEQ ID NO: 18224 - protein, 30 aa, artificial
  peptide fold or domain or sub-domain
SKMNEEFATLKNMIPACTGEMHKLAILQAS

SEQ ID NO: 18225 - protein, 21 aa, artificial
  peptide fold or domain or sub-domain
SKMPKGQDFNNRYVARYNAQI

SEQ ID NO: 18226 - protein, 27 aa, artificial
  peptide fold or domain or sub-domain
SKNLPTPIQSILSISNELLFNDNDDET

SEQ ID NO: 18227 - protein, 28 aa, artificial
  peptide fold or domain or sub-domain
SKNPVHHSEDAPGKSKTGIPGERSANLM

SEQ ID NO: 18228 - protein, 24 aa, artificial
  peptide fold or domain or sub-domain
SKPVISEFFSGRDGTWNSHVDLSL

SEQ ID NO: 18229 - protein, 29 aa, artificial
  peptide fold or domain or sub-domain
SKQEIEDRVRDVMELCGITHLRERPPYAL

SEQ ID NO: 18230 - protein, 20 aa, artificial
  peptide fold or domain or sub-domain
SKQKKLVILENSPHVINDGP

SEQ ID NO: 18231 - protein, 27 aa, artificial
  peptide fold or domain or sub-domain
SKQTIENEKIIVQFENGKINLLNKEQQ

SEQ ID NO: 18232 - protein, 26 aa, artificial
  peptide fold or domain or sub-domain
SKRGVNTLECITLRKSKAPANKSQLK

SEQ ID NO: 18233 - protein, 27 aa, artificial
  peptide fold or domain or sub-domain
SKRKNLLNYLKQNDLNAYRNLISELEL

SEQ ID NO: 18234 - protein, 21 aa, artificial
  peptide fold or domain or sub-domain
SKRLVRQERPGLSEKAVMSLA

SEQ ID NO: 18235 - protein, 29 aa, artificial
  peptide fold or domain or sub-domain
SKRREIKKRMEQEKNKIIKAQYDIQQQAV

SEQ ID NO: 18236 - protein, 27 aa, artificial
  peptide fold or domain or sub-domain
SKRRRLLVYLGRKDREMFEKITSYFNI

SEQ ID NO: 18237 - protein, 21 aa, artificial
  peptide fold or domain or sub-domain
SKRSVYESHIQMLGSYFTKVF

SEQ ID NO: 18238 - protein, 27 aa, artificial
  peptide fold or domain or sub-domain
SKRYLLDDERIVFNPLDMKASKIAIEY

SEQ ID NO: 18239 - protein, 22 aa, artificial
  peptide fold or domain or sub-domain
SKSFRELCELEIGDEEYSFVDR

SEQ ID NO: 18240 - protein, 27 aa, artificial
  peptide fold or domain or sub-domain
SKSKKDLVFNTPIWNALAFKRENRCHE

SEQ ID NO: 18241 - protein, 28 aa, artificial
  peptide fold or domain or sub-domain
SKSKNNAKSVILSSSIRINNKKQKSIDF

SEQ ID NO: 18242 - protein, 30 aa, artificial
  peptide fold or domain or sub-domain
SKSMRNCNETWTEKNMFLFLKDPKAYFRDT

SEQ ID NO: 18243 - protein, 29 aa, artificial
  peptide fold or domain or sub-domain
SKSNNGIDIYSHQFRDDKQIVEIKYNQKH

SEQ ID NO: 18244 - protein, 30 aa, artificial
  peptide fold or domain or sub-domain
SKSSSDYYSTWWGGNLRGVRKYPINLGKYQ

SEQ ID NO: 18245 - protein, 24 aa, artificial
  peptide fold or domain or sub-domain
SKTIQNMLADRLSLSADDALEYMR

SEQ ID NO: 18246 - protein, 20 aa, artificial
  peptide fold or domain or sub-domain
SKTKEIKVMKRSRHMICHGY

SEQ ID NO: 18247 - protein, 27 aa, artificial
  peptide fold or domain or sub-domain
SKTQAVPGPALPEGAAAVGSGPPAAGP

SEQ ID NO: 18248 - protein, 21 aa, artificial
  peptide fold or domain or sub-domain
SKTQEYGGRKAYFDICEVKQI

SEQ ID NO: 18249 - protein, 29 aa, artificial
  peptide fold or domain or sub-domain
SKTRRGFCSRTDGSFNLKTGSNIGNRIQS

SEQ ID NO: 18250 - protein, 29 aa, artificial
  peptide fold or domain or sub-domain
SKTVYSILRHVAEVLEYTKDEQLESLFQR

SEQ ID NO: 18251 - protein, 23 aa, artificial
  peptide fold or domain or sub-domain
SKVILESLVEVDGANAAEYQSNY

SEQ ID NO: 18252 - protein, 20 aa, artificial
  peptide fold or domain or sub-domain
SKVKERQEQAEKMLKEYESK

SEQ ID NO: 18253 - protein, 29 aa, artificial
  peptide fold or domain or sub-domain
SKVKPVEDMKYFTHLFKISGTNNTLTFMA

SEQ ID NO: 18254 - protein, 29 aa, artificial
  peptide fold or domain or sub-domain
SKVLIQERGDTTLFPGELVTINQIEKINS

SEQ ID NO: 18255 - protein, 29 aa, artificial
  peptide fold or domain or sub-domain
SKVPSLVGSFIRSQNKEDYAGLKEEFRKE

SEQ ID NO: 18256 - protein, 29 aa, artificial
  peptide fold or domain or sub-domain
SKVRILESGRSGLLRGELVTLESVENANK

SEQ ID NO: 18257 - protein, 29 aa, artificial
  peptide fold or domain or sub-domain
  misc_feature (5)..(11): Xaa can be any naturally occurring amino acid
SKVVXXXXXXXTLLPGELIELHRIENINK

SEQ ID NO: 18258 - protein, 21 aa, artificial
  peptide fold or domain or sub-domain
SKVYTFGDEIIELTEDENLKI

SEQ ID NO: 18259 - protein, 24 aa, artificial
  peptide fold or domain or sub-domain
SKYWDWFNIYEWPIKTHGKPSYEA

SEQ ID NO: 18260 - protein, 30 aa, artificial
  peptide fold or domain or sub-domain
SLAAGVWSRDIGKLQRFAKRARAGTVWMNT

SEQ ID NO: 18261 - protein, 25 aa, artificial
  peptide fold or domain or sub-domain
SLADMIEELPKKHPNRHVWKNTLQD

SEQ ID NO: 18262 - protein, 21 aa, artificial
  peptide fold or domain or sub-domain
SLAFTRHHHPDWAETKVRTAA

SEQ ID NO: 18263 - protein, 29 aa, artificial
  peptide fold or domain or sub-domain
SLALVKFNHAMPIELFAQELANEQQTLIL

SEQ ID NO: 18264 - protein, 26 aa, artificial
  peptide fold or domain or sub-domain
SLAMTDFQQVLHRNPSNRAARAQITA

SEQ ID NO: 18265 - protein, 23 aa, artificial
  peptide fold or domain or sub-domain
SLANKLQYMDTGAIRQMFNIQQD

SEQ ID NO: 18266 - protein, 26 aa, artificial
  peptide fold or domain or sub-domain
SLARLEPEGKVMRMWETIETYMDRKQ

SEQ ID NO: 18267 - protein, 24 aa, artificial
  peptide fold or domain or sub-domain
SLATLLERNEKWANRVSSVRPSLF

SEQ ID NO: 18268 - protein, 27 aa, artificial
  peptide fold or domain or sub-domain
SLCAARLVQKFGAALNKAEALQKSSVV

SEQ ID NO: 18269 - protein, 27 aa, artificial
  peptide fold or domain or sub-domain
SLDESDDRHPIKDPRYKHIPKRELPST

SEQ ID NO: 18270 - protein, 20 aa, artificial
  peptide fold or domain or sub-domain
SLDHAHAQAEEYLHSYNREL

SEQ ID NO: 18271 - protein, 20 aa, artificial
  peptide fold or domain or sub-domain
SLDKQLLCVESADHHLIYRD

SEQ ID NO: 18272 - protein, 23 aa, artificial
  peptide fold or domain or sub-domain
SLDNIEQQTNPDNETLRKLYVEN

SEQ ID NO: 18273 - protein, 25 aa, artificial
  peptide fold or domain or sub-domain
SLDQIRSFLMYNVSWSQARVDEVMV

SEQ ID NO: 18274 - protein, 30 aa, artificial
  peptide fold or domain or sub-domain
SLDSDLEQILPSLNWDNPWRDETPITLRHL

SEQ ID NO: 18275 - protein, 20 aa, artificial
  peptide fold or domain or sub-domain
SLDTAARRARSDGRRVGAEL

SEQ ID NO: 18276 - protein, 25 aa, artificial
  peptide fold or domain or sub-domain
SLEAFREMMPLVRELVTIRTDLDLP

SEQ ID NO: 18277 - protein, 30 aa, artificial
  peptide fold or domain or sub-domain
SLEARVERKLKEYQKRGLKVTKEEVERELI

SEQ ID NO: 18278 - protein, 26 aa, artificial
  peptide fold or domain or sub-domain
SLEASATAAMTARVAQMRAAGIKVIS

SEQ ID NO: 18279 - protein, 25 aa, artificial
  peptide fold or domain or sub-domain
SLEDHSSQGTLVNNVRLPRGHRLEL

SEQ ID NO: 18280 - protein, 27 aa, artificial
  peptide fold or domain or sub-domain
SLEIRHAHNLNALSDYPTSRSEFTISR

SEQ ID NO: 18281 - protein, 21 aa, artificial
  peptide fold or domain or sub-domain
SLELTKVVKKAFGCKEDVISI

SEQ ID NO: 18282 - protein, 21 aa, artificial
  peptide fold or domain or sub-domain
SLEMVRQRHPQWSEDKIRKVA

SEQ ID NO: 18283 - protein, 22 aa, artificial
  peptide fold or domain or sub-domain
SLENSTEYNDRNTLLQFLFSEC

SEQ ID NO: 18284 - protein, 25 aa, artificial
  peptide fold or domain or sub-domain
SLENVEHILTKLGLKWDEVDARVVR

SEQ ID NO: 18285 - protein, 27 aa, artificial
  peptide fold or domain or sub-domain
SLEPRHAKIITDLWPHRETGSEFVIER

SEQ ID NO: 18286 - protein, 20 aa, artificial
  peptide fold or domain or sub-domain
SLERTKEQSIEFNHSFEREA

SEQ ID NO: 18287 - protein, 20 aa, artificial
  peptide fold or domain or sub-domain
SLESVRENSERFHVAAHEEF

SEQ ID NO: 18288 - protein, 29 aa, artificial
  peptide fold or domain or sub-domain
SLFIFSGEQFWVRKGTEPVSNALRTEAVF

SEQ ID NO: 18289 - protein, 25 aa, artificial
  peptide fold or domain or sub-domain
SLFRYRVGNAGLTAQPKVHVDVKQL

SEQ ID NO: 18290 - protein, 23 aa, artificial
  peptide fold or domain or sub-domain
SLFTHPLMVRLAKKYGKTPAQIA

SEQ ID NO: 18291 - protein, 28 aa, artificial
  peptide fold or domain or sub-domain
SLFVKDIPGETPKIWQQVASSKGEINSN

SEQ ID NO: 18292 - protein, 27 aa, artificial
  peptide fold or domain or sub-domain
SLFWTGERTWEDAITTLPWYIYLLAPT

SEQ ID NO: 18293 - protein, 27 aa, artificial
  peptide fold or domain or sub-domain
SLGAASLTPGTSTFHQPQDPSTAGGSL

SEQ ID NO: 18294 - protein, 20 aa, artificial
  peptide fold or domain or sub-domain
SLGAQLQKKIKELQAHHFHN

SEQ ID NO: 18295 - protein, 27 aa, artificial
  peptide fold or domain or sub-domain
SLGAYQSKDSPYASWYQFDHFPDQYKS

SEQ ID NO: 18296 - protein, 21 aa, artificial
  peptide fold or domain or sub-domain
SLGPSPIANVADEASELAAGI

SEQ ID NO: 18297 - protein, 20 aa, artificial
  peptide fold or domain or sub-domain
SLGSNVVPCSSQAARGEIRD

SEQ ID NO: 18298 - protein, 25 aa, artificial
  peptide fold or domain or sub-domain
SLHGALAADAALLSAAERQVIDDAA

SEQ ID NO: 18299 - protein, 27 aa, artificial
  peptide fold or domain or sub-domain
SLHMVRRLQEMEITNHMESHWFRVAVH

SEQ ID NO: 18300 - protein, 22 aa, artificial
  peptide fold or domain or sub-domain
SLIAAQSKYGVTEGTKVWESFR

SEQ ID NO: 18301 - protein, 21 aa, artificial
  peptide fold or domain or sub-domain
SLIDGLRTRQTVLNSSLIDVL

SEQ ID NO: 18302 - protein, 25 aa, artificial
  peptide fold or domain or sub-domain
SLIEVLDIYPKDLPGYKRLLGYYKR

SEQ ID NO: 18303 - protein, 25 aa, artificial
  peptide fold or domain or sub-domain
SLIEYKDQAFLSRKLGTIVRNLELC

SEQ ID NO: 18304 - protein, 23 aa, artificial
  peptide fold or domain or sub-domain
SLIGQGKSCGIVKIGKGIEEQVE

SEQ ID NO: 18305 - protein, 28 aa, artificial
  peptide fold or domain or sub-domain
SLIQFKGLTIDLKTYTVTAGGQEISLTA

SEQ ID NO: 18306 - protein, 26 aa, artificial
  peptide fold or domain or sub-domain
SLITSHIGSNPNAGRQLNEGRLQIEF

SEQ ID NO: 18307 - protein, 25 aa, artificial
  peptide fold or domain or sub-domain
SLKDKLKETNNEEDRQKFEKFNKNI

SEQ ID NO: 18308 - protein, 27 aa, artificial
  peptide fold or domain or sub-domain
SLKENKASVKPTYEVESLLQILELVEV

SEQ ID NO: 18309 - protein, 24 aa, artificial
  peptide fold or domain or sub-domain
SLKKDRLKEIIKSTKFNKGKYEGF

SEQ ID NO: 18310 - protein, 27 aa, artificial
  peptide fold or domain or sub-domain
SLKPEHVETVNHHYTYKDEDSYEYLMS

SEQ ID NO: 18311 - protein, 25 aa, artificial
  peptide fold or domain or sub-domain
SLKPLVPLQEQEGLEYWEQQVHKVK

SEQ ID NO: 18312 - protein, 23 aa, artificial
  peptide fold or domain or sub-domain
SLKPNVKKEAKQKAKLDPAKDYT

SEQ ID NO: 18313 - protein, 26 aa, artificial
  peptide fold or domain or sub-domain
SLKPSKTMVITDLAATLVQSGVPVIR

SEQ ID NO: 18314 - protein, 24 aa, artificial
  peptide fold or domain or sub-domain
SLKRLAEHLGLSSATVSIVINRKP

SEQ ID NO: 18315 - protein, 27 aa, artificial
  peptide fold or domain or sub-domain
SLKTYEKIIPLDPDSPQIWLDYAMVLR

SEQ ID NO: 18316 - protein, 22 aa, artificial
  peptide fold or domain or sub-domain
SLKWMGDMGLLPDPKVRARYAG

SEQ ID NO: 18317 - protein, 26 aa, artificial
  peptide fold or domain or sub-domain
SLLAKRFSDLGHLTPEVAAEFNDVIK

SEQ ID NO: 18318 - protein, 23 aa, artificial
  peptide fold or domain or sub-domain
SLLANADVKSIANKHNVNTGQIL

SEQ ID NO: 18319 - protein, 29 aa, artificial
  peptide fold or domain or sub-domain
SLLEEATDHAIEAGAEDVKDVGGCLEFTC

SEQ ID NO: 18320 - protein, 27 aa, artificial
  peptide fold or domain or sub-domain
SLLEIFNQAALDCITTVEAANRKCQKT

SEQ ID NO: 18321 - protein, 29 aa, artificial
  peptide fold or domain or sub-domain
SLLEKRSSLYKFLNAKFEGSPLQILKRDP

SEQ ID NO: 18322 - protein, 30 aa, artificial
  peptide fold or domain or sub-domain
SLLENGSQEEREYAKEHNVSLSPLFEGGHR

SEQ ID NO: 18323 - protein, 25 aa, artificial
  peptide fold or domain or sub-domain
SLLEQLGLAGADLAAPGVQQQLELE

SEQ ID NO: 18324 - protein, 25 aa, artificial
  peptide fold or domain or sub-domain
SLLLRAERLYSERTGDLRYQIGDRT

SEQ ID NO: 18325 - protein, 25 aa, artificial
  peptide fold or domain or sub-domain
SLLRHHDQLTLSKRLVSLVDDINIQ

SEQ ID NO: 18326 - protein, 20 aa, artificial
  peptide fold or domain or sub-domain
SLNGQPLDGLSHADAVNLLK

SEQ ID NO: 18327 - protein, 25 aa, artificial
  peptide fold or domain or sub-domain
SLNLVRNGMTINPSLSEHNQISQIN

SEQ ID NO: 18328 - protein, 20 aa, artificial
  peptide fold or domain or sub-domain
SLNTYNTAFTSRGADDKNNY

SEQ ID NO: 18329 - protein, 23 aa, artificial
  peptide fold or domain or sub-domain
SLPACFDVTAWSETREIMGIRHR

SEQ ID NO: 18330 - protein, 28 aa, artificial
  peptide fold or domain or sub-domain
SLPGFSDYYEQKEAADQHFGCLRLLNHI

SEQ ID NO: 18331 - protein, 21 aa, artificial
  peptide fold or domain or sub-domain
SLPKKQYIANLEKNPKKTIGE

SEQ ID NO: 18332 - protein, 23 aa, artificial
  peptide fold or domain or sub-domain
SLPTSLRTIAAAEDRSIMAIRHL

SEQ ID NO: 18333 - protein, 26 aa, artificial
  peptide fold or domain or sub-domain
SLPWMKVEAQTKEERFYLIGQKKMRE

SEQ ID NO: 18334 - protein, 26 aa, artificial
  peptide fold or domain or sub-domain
SLPWQGLKAATNKQKYERIGEKKQST

SEQ ID NO: 18335 - protein, 20 aa, artificial
  peptide fold or domain or sub-domain
SLQALMAERGVEGFRAAEAR

SEQ ID NO: 18336 - protein, 30 aa, artificial
  peptide fold or domain or sub-domain
SLQARAQRRTLELQGKGESVSMDRIKSRIE

SEQ ID NO: 18337 - protein, 27 aa, artificial
  peptide fold or domain or sub-domain
SLQCYDTAIQIDQNFAIAYNNKGRALY

SEQ ID NO: 18338 - protein, 23 aa, artificial
  peptide fold or domain or sub-domain
SLQESGKKMVNAKDYINGKRLGV

SEQ ID NO: 18339 - protein, 30 aa, artificial
  peptide fold or domain or sub-domain
SLQEVENLMPHDLINSKPVSAVVKEFFGSS

SEQ ID NO: 18340 - protein, 24 aa, artificial
  peptide fold or domain or sub-domain
SLQLHPDRVAQASARERLQALEGT

SEQ ID NO: 18341 - protein, 26 aa, artificial
  peptide fold or domain or sub-domain
SLQNEAIKLKKDSLTEDEELTVLSRE

SEQ ID NO: 18342 - protein, 23 aa, artificial
  peptide fold or domain or sub-domain
SLQPAGKKAMSAQDLLNSRREWF

SEQ ID NO: 18343 - protein, 25 aa, artificial
  peptide fold or domain or sub-domain
SLQQNRDAVLFSKRMVTIRTDIDMP

SEQ ID NO: 18344 - protein, 20 aa, artificial
  peptide fold or domain or sub-domain
SLQQYLEENGYLALREQEQQ

SEQ ID NO: 18345 - protein, 30 aa, artificial
  peptide fold or domain or sub-domain
SLQTTEITAFVPSDLLAPGERAVQNWSRLI

SEQ ID NO: 18346 - protein, 20 aa, artificial
  peptide fold or domain or sub-domain
SLREFAKPGSSKITQIKARV

SEQ ID NO: 18347 - protein, 28 aa, artificial
  peptide fold or domain or sub-domain
SLREFAKPGSSKITQIKARVIGTGGKTR

SEQ ID NO: 18348 - protein, 21 aa, artificial
  peptide fold or domain or sub-domain
SLREIAEKKNRFTESELAHIF

SEQ ID NO: 18349 - protein, 27 aa, artificial
  peptide fold or domain or sub-domain
SLRESAKLELEEHANNPFVKEICSFIL

SEQ ID NO: 18350 - protein, 30 aa, artificial
  peptide fold or domain or sub-domain
SLRSLVHEGERYQFCSDGCCDIFKNEPVKY

SEQ ID NO: 18351 - protein, 28 aa, artificial
  peptide fold or domain or sub-domain
SLRWQFWTAQIESKEGEQDKADARLKKL

SEQ ID NO: 18352 - protein, 25 aa, artificial
  peptide fold or domain or sub-domain
SLRYRVEKLLESLTGADQSRAEEML

SEQ ID NO: 18353 - protein, 27 aa, artificial
  peptide fold or domain or sub-domain
SLSAIIEQYGIEKAKDFCKEADPFHRA

SEQ ID NO: 18354 - protein, 27 aa, artificial
  peptide fold or domain or sub-domain
SLSDVIAGLPDAARKAFRMRAHLRDFQ

SEQ ID NO: 18355 - protein, 26 aa, artificial
  peptide fold or domain or sub-domain
SLSESATIAISTLAKELKSQGKDILS

SEQ ID NO: 18356 - protein, 23 aa, artificial
  peptide fold or domain or sub-domain
SLSLQGYGSDEQVEITDELVYKF

SEQ ID NO: 18357 - protein, 26 aa, artificial
  peptide fold or domain or sub-domain
SLSNIAKVAGLSQVGLLHHFPTKLVL

SEQ ID NO: 18358 - protein, 30 aa, artificial
  peptide fold or domain or sub-domain
SLSRHTPMTYQDFTAGVQARRRYWARSHLG

SEQ ID NO: 18359 - protein, 25 aa, artificial
  peptide fold or domain or sub-domain
SLSRRAFSVTANGPEVLLLDYPSHQ

SEQ ID NO: 18360 - protein, 26 aa, artificial
  peptide fold or domain or sub-domain
SLTAPAQAQEGLANAFDGNVSSLWHT

SEQ ID NO: 18361 - protein, 20 aa, artificial
  peptide fold or domain or sub-domain
SLTIKQIQNLLHLSERTIRK

SEQ ID NO: 18362 - protein, 23 aa, artificial
  peptide fold or domain or sub-domain
SLTLELMVHERASAHPTQHPLRA

SEQ ID NO: 18363 - protein, 27 aa, artificial
  peptide fold or domain or sub-domain
SLTLMLANGQLVRCSATSNPDLFRAAL

SEQ ID NO: 18364 - protein, 29 aa, artificial
  peptide fold or domain or sub-domain
SLVEILGDNSVESIKLKSGKEIKTDMVLF

SEQ ID NO: 18365 - protein, 25 aa, artificial
  peptide fold or domain or sub-domain
SLVEVLQFFPTSHDGYGQLHGYLES

SEQ ID NO: 18366 - protein, 21 aa, artificial
  peptide fold or domain or sub-domain
SLVKNYVVSDEISLHEALEKL

SEQ ID NO: 18367 - protein, 26 aa, artificial
  peptide fold or domain or sub-domain
SLVLQDLPDILRELTIAETISVHPHD

SEQ ID NO: 18368 - protein, 30 aa, artificial
  peptide fold or domain or sub-domain
SLVNAEKQYKPSINEIFTDVYDKPTPNLIE

SEQ ID NO: 18369 - protein, 29 aa, artificial
  peptide fold or domain or sub-domain
SLVSFLTGLGCPNCIEYFTSQGLQSIYHL

SEQ ID NO: 18370 - protein, 26 aa, artificial
  peptide fold or domain or sub-domain
SLVSRNASNKPLSDIYPQFIGRIDLK

SEQ ID NO: 18371 - protein, 30 aa, artificial
  peptide fold or domain or sub-domain
SLVTPVEELLPAGFSMRRRDEVAPIRLWHL

SEQ ID NO: 18372 - protein, 30 aa, artificial
  peptide fold or domain or sub-domain
SLYGISQKGGDFLEGSIITGAQLSQVNARI

SEQ ID NO: 18373 - protein, 26 aa, artificial
  peptide fold or domain or sub-domain
SLYKCSECGNSFERRAKLTRLQRINA

SEQ ID NO: 18374 - protein, 23 aa, artificial
  peptide fold or domain or sub-domain
SLYPLIGANGMDWMYAACSTTAR

SEQ ID NO: 18375 - protein, 28 aa, artificial
  peptide fold or domain or sub-domain
SLYPLIGANGMDWMYAACSTTARRGAID

SEQ ID NO: 18376 - protein, 24 aa, artificial
  peptide fold or domain or sub-domain
SLYQLAVIFIDYWQNDKVLSEIQQ

SEQ ID NO: 18377 - protein, 22 aa, artificial
  peptide fold or domain or sub-domain
SMAGLSTAEICSRLKLTMDGVH

SEQ ID NO: 18378 - protein, 26 aa, artificial
  peptide fold or domain or sub-domain
SMDAIAAEAQISKPMLYLYYGSKEDL

SEQ ID NO: 18379 - protein, 22 aa, artificial
  peptide fold or domain or sub-domain
SMEARAKHFAEAGKPYQGRNFL

SEQ ID NO: 18380 - protein, 22 aa, artificial
  peptide fold or domain or sub-domain
SMEARYKKLHAAGKEQEANEFR

SEQ ID NO: 18381 - protein, 22 aa, artificial
  peptide fold or domain or sub-domain
SMEARYRKFMAEGDVVKAEMYL

SEQ ID NO: 18382 - protein, 29 aa, artificial
  peptide fold or domain or sub-domain
SMEGLEPIMNRNGIKVISSEFVLTTSDTP

SEQ ID NO: 18383 - protein, 30 aa, artificial
  peptide fold or domain or sub-domain
SMENLEETNPANLQYKDKVFVNGTWVGVMI

SEQ ID NO: 18384 - protein, 23 aa, artificial
  peptide fold or domain or sub-domain
SMFLRDFLLYLVAGKEADLVVAG

SEQ ID NO: 18385 - protein, 29 aa, artificial
  peptide fold or domain or sub-domain
SMKEATGDLGQMGKLISLVGNKMTVLSGD

SEQ ID NO: 18386 - protein, 21 aa, artificial
  peptide fold or domain or sub-domain
SMKIEKQRHPNLPPKWLEAEA

SEQ ID NO: 18387 - protein, 27 aa, artificial
  peptide fold or domain or sub-domain
SMKLVTPAKGTIELSREKDPELFHLAR

SEQ ID NO: 18388 - protein, 24 aa, artificial
  peptide fold or domain or sub-domain
SMLALTAAMRSNRPDQARVAQFSL

SEQ ID NO: 18389 - protein, 26 aa, artificial
  peptide fold or domain or sub-domain
SMLALTAAMRSNRPDQARVAQFSLRQ

SEQ ID NO: 18390 - protein, 30 aa, artificial
  peptide fold or domain or sub-domain
SMLLPHVMAYNMDAIVDRLAQVADPMGIQL

SEQ ID NO: 18391 - protein, 30 aa, artificial
  peptide fold or domain or sub-domain
SMMHRLAPFTGILRHVRTYQSRPLPEHLTD

SEQ ID NO: 18392 - protein, 24 aa, artificial
  peptide fold or domain or sub-domain
SMMSSEDVTFHKPNPEVYLKSAER

SEQ ID NO: 18393 - protein, 25 aa, artificial
  peptide fold or domain or sub-domain
SMMVEWLHHRGLTLATAQSDDLQAL

SEQ ID NO: 18394 - protein, 26 aa, artificial
  peptide fold or domain or sub-domain
SMPFQLETDSLHSWIHAHCYESPIEI

SEQ ID NO: 18395 - protein, 21 aa, artificial
  peptide fold or domain or sub-domain
SMPQGGLDALNTQDPLSIKAF

SEQ ID NO: 18396 - protein, 26 aa, artificial
  peptide fold or domain or sub-domain
SMQSIADRAGLPKANIHYYFKNKENL

SEQ ID NO: 18397 - protein, 30 aa, artificial
  peptide fold or domain or sub-domain
SMRAGEAAGCSDWLWQNLSDEIAQADQTLI

SEQ ID NO: 18398 - protein, 26 aa, artificial
  peptide fold or domain or sub-domain
SMREVAEAVGVTKPALYHHYADKEAL

SEQ ID NO: 18399 - protein, 26 aa, artificial
  peptide fold or domain or sub-domain
SMWDKNMEDLHRHIFWEPDASKLNEN

SEQ ID NO: 18400 - protein, 23 aa, artificial
  peptide fold or domain or sub-domain
SMWHQNKKEKKNRLTFEEMFDMF

SEQ ID NO: 18401 - protein, 23 aa, artificial
  peptide fold or domain or sub-domain
SNAEDLDADLISDKSVLASVHHP

SEQ ID NO: 18402 - protein, 28 aa, artificial
  peptide fold or domain or sub-domain
SNAHTPMFAIPSGGDVIEDELAAMRAGN

SEQ ID NO: 18403 - protein, 30 aa, artificial
  peptide fold or domain or sub-domain
SNANKNANIVWTKETMFDYLANPKKYMPGS

SEQ ID NO: 18404 - protein, 27 aa, artificial
  peptide fold or domain or sub-domain
SNATFGWIKASQFADKDARYYNVDFNR

SEQ ID NO: 18405 - protein, 29 aa, artificial
  peptide fold or domain or sub-domain
SNAYHGDTFGAMSIAGTSPTTVPFHDLFL

SEQ ID NO: 18406 - protein, 26 aa, artificial
  peptide fold or domain or sub-domain
SNDKLKTFLRNKEINKDNEHYFQNEI

SEQ ID NO: 18407 - protein, 28 aa, artificial
  peptide fold or domain or sub-domain
SNDVNDLNMMGVHIWDQWKQEDGTIGHA

SEQ ID NO: 18408 - protein, 27 aa, artificial
  peptide fold or domain or sub-domain
SNEDQPQRWQADYHIASPLELLKLLAI

SEQ ID NO: 18409 - protein, 29 aa, artificial
  peptide fold or domain or sub-domain
SNEFIKSGKGWYFMNTNGELADNPSFTKE

SEQ ID NO: 18410 - protein, 21 aa, artificial
  peptide fold or domain or sub-domain
SNEITATIMKVFGSREGAVSI

SEQ ID NO: 18411 - protein, 26 aa, artificial
  peptide fold or domain or sub-domain
SNEKIKLFLKDKIISSDKERRLQHEV

SEQ ID NO: 18412 - protein, 27 aa, artificial
  peptide fold or domain or sub-domain
SNFFIAIPREQLYQPQRVCQPCHQRLE

SEQ ID NO: 18413 - protein, 29 aa, artificial
  peptide fold or domain or sub-domain
SNFISVTEQLAEEFFTGDVESFLNEYGLL

SEQ ID NO: 18414 - protein, 26 aa, artificial
  peptide fold or domain or sub-domain
SNGHLLRALVLDFAARIDPALADWIA

SEQ ID NO: 18415 - protein, 26 aa, artificial
  peptide fold or domain or sub-domain
SNGRILRRLLVEMAGLTDKDLAEFIT

SEQ ID NO: 18416 - protein, 29 aa, artificial
  peptide fold or domain or sub-domain
SNGYHGDTFGAMSVGYMPGFFGAFKGQLF

SEQ ID NO: 18417 - protein, 27 aa, artificial
  peptide fold or domain or sub-domain
SNHFIDGPPNEGEKKIRFCRRCYDKIN

SEQ ID NO: 18418 - protein, 27 aa, artificial
  peptide fold or domain or sub-domain
SNIEKIKLSDDEKIIETEDVIYKVKAL

SEQ ID NO: 18419 - protein, 22 aa, artificial
  peptide fold or domain or sub-domain
SNISSAQSVHRRIYGIDLNDEP

SEQ ID NO: 18420 - protein, 26 aa, artificial
  peptide fold or domain or sub-domain
SNKQADKEKKENILTEDDVKRTKDEI

SEQ ID NO: 18421 - protein, 27 aa, artificial
  peptide fold or domain or sub-domain
SNKWGIPSQSEAQALALKPRQKAIIRE

SEQ ID NO: 18422 - protein, 28 aa, artificial
  peptide fold or domain or sub-domain
SNLDEVLGVGLSQSPTAVPGAPDLFALN

SEQ ID NO: 18423 - protein, 27 aa, artificial
  peptide fold or domain or sub-domain
SNLLLRKNPTSLPLGQYPEDVKFGDPR

SEQ ID NO: 18424 - protein, 28 aa, artificial
  peptide fold or domain or sub-domain
SNLQDVFHTELSNKETKIKETPNLSVVN

SEQ ID NO: 18425 - protein, 28 aa, artificial
  peptide fold or domain or sub-domain
SNMIKRLDELEFLTYEAYEGATLTDPGR

SEQ ID NO: 18426 - protein, 28 aa, artificial
  peptide fold or domain or sub-domain
SNMLKKLADKKMIQYEPYYGVSLTAKGR

SEQ ID NO: 18427 - protein, 24 aa, artificial
  peptide fold or domain or sub-domain
SNNETEPDVIKRIIGYYIQKESSE

SEQ ID NO: 18428 - protein, 20 aa, artificial
  peptide fold or domain or sub-domain
SNNIVSISYEENRNAKPLNK

SEQ ID NO: 18429 - protein, 25 aa, artificial
  peptide fold or domain or sub-domain
SNNQRLISDQPALCITANWQSSYIH

SEQ ID NO: 18430 - protein, 26 aa, artificial
  peptide fold or domain or sub-domain
SNNVYLDVERYINEISVNSTSSSAIK

SEQ ID NO: 18431 - protein, 22 aa, artificial
  peptide fold or domain or sub-domain
SNPAQLSPTDINPLFLKSLERS

SEQ ID NO: 18432 - protein, 24 aa, artificial
  peptide fold or domain or sub-domain
SNPATDGEFGALYDNGTLVTNYYE

SEQ ID NO: 18433 - protein, 22 aa, artificial
  peptide fold or domain or sub-domain
SNPFQTALSTLKAASEVAGLEP

SEQ ID NO: 18434 - protein, 21 aa, artificial
  peptide fold or domain or sub-domain
SNPQPQWLVNFENHKAEALSE

SEQ ID NO: 18435 - protein, 24 aa, artificial
  peptide fold or domain or sub-domain
SNPVHSELFNLIAEREIGHISLAD

SEQ ID NO: 18436 - protein, 25 aa, artificial
  peptide fold or domain or sub-domain
SNQNLKKYEEEGAPAHIIRDYEQLV

SEQ ID NO: 18437 - protein, 24 aa, artificial
  peptide fold or domain or sub-domain
SNQYHPDKLHGASEEEKEQAALKL

SEQ ID NO: 18438 - protein, 28 aa, artificial
  peptide fold or domain or sub-domain
SNRFEDVSLNQWMALTPKEIVESNIHVG

SEQ ID NO: 18439 - protein, 29 aa, artificial
  peptide fold or domain or sub-domain
SNRIPEDFPDPHDFVPARYEQPRQEDLLN

SEQ ID NO: 18440 - protein, 23 aa, artificial
  peptide fold or domain or sub-domain
SNSFNTQKRKNVTVVRVPRNKTL

SEQ ID NO: 18441 - protein, 27 aa, artificial
  peptide fold or domain or sub-domain
SNTGRDEALSALETLGYLRKQAQKVVD

SEQ ID NO: 18442 - protein, 30 aa, artificial
  peptide fold or domain or sub-domain
SNTPDFFSELCKAADEEGGLSDKDVMNHMI

SEQ ID NO: 18443 - protein, 27 aa, artificial
  peptide fold or domain or sub-domain
SNTYVSIPALHEMKPQRVCRACATALS

SEQ ID NO: 18444 - protein, 28 aa, artificial
  peptide fold or domain or sub-domain
SNVGQVFSQTIGNTIQAIASVPGLSALE

SEQ ID NO: 18445 - protein, 26 aa, artificial
  peptide fold or domain or sub-domain
SNVPIIFISCKKDSKDIIEGLELGAD

SEQ ID NO: 18446 - protein, 23 aa, artificial
  peptide fold or domain or sub-domain
SNWTHLWAAGLESERDFVRACAL

SEQ ID NO: 18447 - protein, 23 aa, artificial
  peptide fold or domain or sub-domain
SNYLHLLREKREHLPFLEALEEE

SEQ ID NO: 18448 - protein, 23 aa, artificial
  peptide fold or domain or sub-domain
SNYYHEVRSQAESMSIEEVINSR

SEQ ID NO: 18449 - protein, 21 aa, artificial
  peptide fold or domain or sub-domain
SNYYQQALEINPNYAEAWCNL

SEQ ID NO: 18450 - protein, 28 aa, artificial
  peptide fold or domain or sub-domain
SPAAQEIVAQHHLRPRDPNVLKQHASEF

SEQ ID NO: 18451 - protein, 27 aa, artificial
  peptide fold or domain or sub-domain
SPAEIELNFMAEQDLKGVDTAYFRRLF

SEQ ID NO: 18452 - protein, 30 aa, artificial
  peptide fold or domain or sub-domain
SPAFDKLIADTLKVADDTQRSELYAKAEQQ

SEQ ID NO: 18453 - protein, 21 aa, artificial
  peptide fold or domain or sub-domain
SPALVAFQSGDRLLGEEAAGI

SEQ ID NO: 18454 - protein, 29 aa, artificial
  peptide fold or domain or sub-domain
SPALVAFQSGDRLLGEEAAGITARYPNKV

SEQ ID NO: 18455 - protein, 30 aa, artificial
  peptide fold or domain or sub-domain
SPAMRQSRLIWSEANLDRFIKAPMAFMPGT

SEQ ID NO: 18456 - protein, 30 aa, artificial
  peptide fold or domain or sub-domain
SPAMSESEVVWSAETLDAYLTNPREYIRGN

SEQ ID NO: 18457 - protein, 20 aa, artificial
  peptide fold or domain or sub-domain
SPASISEDGETVRYNESAPV

SEQ ID NO: 18458 - protein, 27 aa, artificial
  peptide fold or domain or sub-domain
SPATALPPLRVVPKSPAEEQQLRRLLR

SEQ ID NO: 18459 - protein, 27 aa, artificial
  peptide fold or domain or sub-domain
SPAVDLRIGKAKVKVKTDQSSVIAKDL

SEQ ID NO: 18460 - protein, 25 aa, artificial
  peptide fold or domain or sub-domain
SPCASVRCESWQRCEVTGPNTTVCG

SEQ ID NO: 18461 - protein, 24 aa, artificial
  peptide fold or domain or sub-domain
SPDDLLVDEKGNPLRIDRAYSWEF

SEQ ID NO: 18462 - protein, 28 aa, artificial
  peptide fold or domain or sub-domain
SPDDNFSPETLQFLRNNTGLDGEQWNNI

SEQ ID NO: 18463 - protein, 28 aa, artificial
  peptide fold or domain or sub-domain
SPDGQATGAAAGQNQVPSNAKAALPAGA

SEQ ID NO: 18464 - protein, 25 aa, artificial
  peptide fold or domain or sub-domain
SPDKAPVWNKTPEEEVAKAKMGAEA

SEQ ID NO: 18465 - protein, 30 aa, artificial
  peptide fold or domain or sub-domain
SPDMASIAYARGLPETIPGIGSDMMDTETK

SEQ ID NO: 18466 - protein, 20 aa, artificial
  peptide fold or domain or sub-domain
SPDSSVKKINLKHALDLDRR

SEQ ID NO: 18467 - protein, 20 aa, artificial
  peptide fold or domain or sub-domain
SPDVPAASQQRFVFDPAVDL

SEQ ID NO: 18468 - protein, 27 aa, artificial
  peptide fold or domain or sub-domain
SPEATTYPKISELWVDSPAVRQGRTYE

SEQ ID NO: 18469 - protein, 28 aa, artificial
  peptide fold or domain or sub-domain
SPEGQEIAAKNFYRPRDADVAKKYDDAF

SEQ ID NO: 18470 - protein, 29 aa, artificial
  peptide fold or domain or sub-domain
SPEHVIQALESLGFGSYISEVKEVLQECK

SEQ ID NO: 18471 - protein, 29 aa, artificial
  peptide fold or domain or sub-domain
SPEHVVEALKQLGFEDFVAEVEESNKDFK

SEQ ID NO: 18472 - protein, 30 aa, artificial
  peptide fold or domain or sub-domain
SPEIALQRLKMAGKNDKLDTENFDFHRKVY

SEQ ID NO: 18473 - protein, 20 aa, artificial
  peptide fold or domain or sub-domain
SPEIQRGIKVSELLDMFGST

SEQ ID NO: 18474 - protein, 29 aa, artificial
  peptide fold or domain or sub-domain
SPEIQRGIKVSELLDMFGSTAFNARRLGE

SEQ ID NO: 18475 - protein, 20 aa, artificial
  peptide fold or domain or sub-domain
SPEKEIKKMFKDLGILRSPL

SEQ ID NO: 18476 - protein, 27 aa, artificial
  peptide fold or domain or sub-domain
SPETSRPGLVDPKVIWTPSIAPSGLAF

SEQ ID NO: 18477 - protein, 30 aa, artificial
  peptide fold or domain or sub-domain
SPEVRARRRFDEVLARGDTADFAEILADLK

SEQ ID NO: 18478 - protein, 30 aa, artificial
  peptide fold or domain or sub-domain
SPEVRARRRYEELKSKNMEVSYEELLRQIE

SEQ ID NO: 18479 - protein, 23 aa, artificial
  peptide fold or domain or sub-domain
SPFLNCIHNTDSSVKSPVRKQCV

SEQ ID NO: 18480 - protein, 30 aa, artificial
  peptide fold or domain or sub-domain
SPFQFTHQDAGWLGDESKQWKGTTWTGTPE

SEQ ID NO: 18481 - protein, 23 aa, artificial
  peptide fold or domain or sub-domain
SPFRTFEQSCAQCHRESQEEMAQ

SEQ ID NO: 18482 - protein, 29 aa, artificial
  peptide fold or domain or sub-domain
SPFSQKHYLAERIRNVERWSRLPQIMRQG

SEQ ID NO: 18483 - protein, 23 aa, artificial
  peptide fold or domain or sub-domain
SPFVVTKAKGTRLYNQDGRSILD

SEQ ID NO: 18484 - protein, 28 aa, artificial
  peptide fold or domain or sub-domain
SPGPLDIEKGIIITSPNLPFKNFNIVNP

SEQ ID NO: 18485 - protein, 28 aa, artificial
  peptide fold or domain or sub-domain
SPGPLNTQEGIIYLAPNLGWRNVHIKDI

SEQ ID NO: 18486 - protein, 30 aa, artificial
  peptide fold or domain or sub-domain
SPHTSCIAVSREAKARGVASGSSVREARRI

SEQ ID NO: 18487 - protein, 29 aa, artificial
  peptide fold or domain or sub-domain
SPIDFYKFLRETNWQNPVDAAHTAFHVSY

SEQ ID NO: 18488 - protein, 29 aa, artificial
  peptide fold or domain or sub-domain
SPITSTMRDLPGYFSLNGYNTHGQIAAAQ

SEQ ID NO: 18489 - protein, 23 aa, artificial
  peptide fold or domain or sub-domain
SPKDAHGARELTPAQRNVLFNHG

SEQ ID NO: 18490 - protein, 29 aa, artificial
  peptide fold or domain or sub-domain
SPKDVFQAIEEIDFENFKPQLEEYLAALK

SEQ ID NO: 18491 - protein, 24 aa, artificial
  peptide fold or domain or sub-domain
SPKSTFMNFPYTKDHNIEWALEYF

SEQ ID NO: 18492 - protein, 21 aa, artificial
  peptide fold or domain or sub-domain
SPKTRIMYGANLSYALTGRYI

SEQ ID NO: 18493 - protein, 26 aa, artificial
  peptide fold or domain or sub-domain
SPLDDQGKYTEGKWKGIYVKEADPKI

SEQ ID NO: 18494 - protein, 28 aa, artificial
  peptide fold or domain or sub-domain
SPLFQDVSLTQWLANTPRAIVKATLQLS

SEQ ID NO: 18495 - protein, 27 aa, artificial
  peptide fold or domain or sub-domain
SPLKGTYEGNDTTVGTFESGCVEWYDV

SEQ ID NO: 18496 - protein, 21 aa, artificial
  peptide fold or domain or sub-domain
SPLKNADSQNGKDNPTTARHA

SEQ ID NO: 18497 - protein, 21 aa, artificial
  peptide fold or domain or sub-domain
SPLKNCGGMNLPDSPETCLRD

SEQ ID NO: 18498 - protein, 23 aa, artificial
  peptide fold or domain or sub-domain
SPLKNDLKACQQCHAESPEWLRN

SEQ ID NO: 18499 - protein, 23 aa, artificial
  peptide fold or domain or sub-domain
SPLKTVNESCGQCHGPDGDAIIA

SEQ ID NO: 18500 - protein, 25 aa, artificial
  peptide fold or domain or sub-domain
SPLLVVLSGNHTEQSNFTSRSNQLY

SEQ ID NO: 18501 - protein, 23 aa, artificial
  peptide fold or domain or sub-domain
SPLNNIEQSCTTCHRNGSDWLTR

SEQ ID NO: 18502 - protein, 23 aa, artificial
  peptide fold or domain or sub-domain
SPLRDINSACKSCHKQSEDYLKA

SEQ ID NO: 18503 - protein, 21 aa, artificial
  peptide fold or domain or sub-domain
SPMQWDDSPNAGFTVQEAKPW

SEQ ID NO: 18504 - protein, 23 aa, artificial
  peptide fold or domain or sub-domain
SPMRTVEASCRTCHTQTEAWLLS

SEQ ID NO: 18505 - protein, 29 aa, artificial
  peptide fold or domain or sub-domain
SPMVTKAEINKQTVIEYDPTCEQAEEYRE

SEQ ID NO: 18506 - protein, 23 aa, artificial
  peptide fold or domain or sub-domain
SPNFIETCRNTQLAGSSELAAEC

SEQ ID NO: 18507 - protein, 23 aa, artificial
  peptide fold or domain or sub-domain
SPNFNFLGQLLDFEKNLKSVCDP

SEQ ID NO: 18508 - protein, 22 aa, artificial
  peptide fold or domain or sub-domain
SPNLRYPIADVSGGIGMSPNYR

SEQ ID NO: 18509 - protein, 20 aa, artificial
  peptide fold or domain or sub-domain
SPNPPGDTRAAAAVIQGFLS

SEQ ID NO: 18510 - protein, 28 aa, artificial
  peptide fold or domain or sub-domain
SPPAQQVITRFNYRVYDKAAMEAAKSQF

SEQ ID NO: 18511 - protein, 29 aa, artificial
  peptide fold or domain or sub-domain
SPPAWMKTNNDMKYGGKLKEEYKKTWAEF

SEQ ID NO: 18512 - protein, 29 aa, artificial
  peptide fold or domain or sub-domain
SPPAYMKSNNSLINGGRLLPANYSAYTSH

SEQ ID NO: 18513 - protein, 29 aa, artificial
  peptide fold or domain or sub-domain
SPPRWMREGDNMVDGGPLKADMLDDYAAY

SEQ ID NO: 18514 - protein, 25 aa, artificial
  peptide fold or domain or sub-domain
SPPSVANAVATGEAHTYESEVKLRC

SEQ ID NO: 18515 - protein, 28 aa, artificial
  peptide fold or domain or sub-domain
SPQAQTIITDYYYRVNNPEVMDKLKDKF

SEQ ID NO: 18516 - protein, 27 aa, artificial
  peptide fold or domain or sub-domain
SPQEVKPGEKHYNMAKSYPNEEKDAWD

SEQ ID NO: 18517 - protein, 27 aa, artificial
  peptide fold or domain or sub-domain
SPQLWGPINGSMVEFGKNICKPISPRC

SEQ ID NO: 18518 - protein, 22 aa, artificial
  peptide fold or domain or sub-domain
SPQQEGFLQWAKTLGGAPVVIV

SEQ ID NO: 18519 - protein, 26 aa, artificial
  peptide fold or domain or sub-domain
SPQVAEFVSEMTRDYGFAGEQLMGLF

SEQ ID NO: 18520 - protein, 24 aa, artificial
  peptide fold or domain or sub-domain
SPRETSRLTKLLAKECDVSSYPIA

SEQ ID NO: 18521 - protein, 20 aa, artificial
  peptide fold or domain or sub-domain
SPRKDYLVFPESGHDLLLDR

SEQ ID NO: 18522 - protein, 30 aa, artificial
  peptide fold or domain or sub-domain
SPSILGANFLKLEETIVKLKKQGIKELHID

SEQ ID NO: 18523 - protein, 30 aa, artificial
  peptide fold or domain or sub-domain
SPSILSANFSKLGEQVKAIEQAGCDWIHVD

SEQ ID NO: 18524 - protein, 29 aa, artificial
  peptide fold or domain or sub-domain
SPSKPWEARAKLARFGLAKESHLTTIGKL

SEQ ID NO: 18525 - protein, 30 aa, artificial
  peptide fold or domain or sub-domain
SPSLLNVEESKRAEIATKMIELGIKWIHYD

SEQ ID NO: 18526 - protein, 30 aa, artificial
  peptide fold or domain or sub-domain
SPSLLSANVCNYSDDFKVFNEKNIQVIHID

SEQ ID NO: 18527 - protein, 30 aa, artificial
  peptide fold or domain or sub-domain
SPSLLSSDYGRLADELAALEDAGLSWVHWD

SEQ ID NO: 18528 - protein, 30 aa, artificial
  peptide fold or domain or sub-domain
SPSMKEAGFVWDQDKLTRFMVKPDEVVSGN

SEQ ID NO: 18529 - protein, 23 aa, artificial
  peptide fold or domain or sub-domain
SPSNNTNKVLDKISQSEVKLWNK

SEQ ID NO: 18530 - protein, 28 aa, artificial
  peptide fold or domain or sub-domain
SPSTSQARRDIQAGSVKINQTKVEDINQ

SEQ ID NO: 18531 - protein, 30 aa, artificial
  peptide fold or domain or sub-domain
SPSVMCADLCNLEKSIREIEKEGIDTIHID

SEQ ID NO: 18532 - protein, 22 aa, artificial
  peptide fold or domain or sub-domain
SPTAPQELEGAPKETLSANAGF

SEQ ID NO: 18533 - protein, 28 aa, artificial
  peptide fold or domain or sub-domain
SPTWLYWLARSRAATGNTQEAEKLYKQA

SEQ ID NO: 18534 - protein, 22 aa, artificial
  peptide fold or domain or sub-domain
SPVDRLKSTDIPEPVLDCLSRS

SEQ ID NO: 18535 - protein, 21 aa, artificial
  peptide fold or domain or sub-domain
SPVEGRNDGAVRADMPGFGKA

SEQ ID NO: 18536 - protein, 28 aa, artificial
  peptide fold or domain or sub-domain
SPVFEEISLANWLGGNPVSLLETNFGIP

SEQ ID NO: 18537 - protein, 30 aa, artificial
  peptide fold or domain or sub-domain
SPVIKLSTVLVRQVATDNKALFVISMSDNG

SEQ ID NO: 18538 - protein, 20 aa, artificial
  peptide fold or domain or sub-domain
SPVKQIKWYEQSGHVITLDQ

SEQ ID NO: 18539 - protein, 29 aa, artificial
  peptide fold or domain or sub-domain
SPVNNRVLAAAANKDIYLWSHDGKLIAKL

SEQ ID NO: 18540 - protein, 25 aa, artificial
  peptide fold or domain or sub-domain
SPVSSKYLEKFIPAHLRDKDKKWFA

SEQ ID NO: 18541 - protein, 23 aa, artificial
  peptide fold or domain or sub-domain
SPVVTLDELKRGMVMTREPIRIA

SEQ ID NO: 18542 - protein, 29 aa, artificial
  peptide fold or domain or sub-domain
SPYYSWYQCHGEGQEKEYSCWWGVSTLPE

SEQ ID NO: 18543 - protein, 20 aa, artificial
  peptide fold or domain or sub-domain
SQCHNEHWGRQLRGDTISQG

SEQ ID NO: 18544 - protein, 29 aa, artificial
  peptide fold or domain or sub-domain
SQDLEPLTILYYIGKTPKIEQLSNMIVKS

SEQ ID NO: 18545 - protein, 21 aa, artificial
  peptide fold or domain or sub-domain
SQDLVKEFYPHLPPDKVIELA

SEQ ID NO: 18546 - protein, 20 aa, artificial
  peptide fold or domain or sub-domain
SQDTAERQARELGHSLEEEV

SEQ ID NO: 18547 - protein, 27 aa, artificial
  peptide fold or domain or sub-domain
SQDWVEAIADFVNQGESLAKDVQSLLN

SEQ ID NO: 18548 - protein, 27 aa, artificial
  peptide fold or domain or sub-domain
SQEERQQLTQSPLWQAMEFSRTDSVYE

SEQ ID NO: 18549 - protein, 24 aa, artificial
  peptide fold or domain or sub-domain
SQEEVANNIDFEVDKIKIGLGLEQ

SEQ ID NO: 18550 - protein, 24 aa, artificial
  peptide fold or domain or sub-domain
SQEEVSSLCKIPLEKITKGLGQHQ

SEQ ID NO: 18551 - protein, 21 aa, artificial
  peptide fold or domain or sub-domain
SQEFDDGVIDPNIWNFEIGNG

SEQ ID NO: 18552 - protein, 28 aa, artificial
  peptide fold or domain or sub-domain
SQEILSDICLKTGCYIANFNSPGQLVIS

SEQ ID NO: 18553 - protein, 22 aa, artificial
  peptide fold or domain or sub-domain
SQFAIINDTKRKVKIAIISKKI

SEQ ID NO: 18554 - protein, 22 aa, artificial
  peptide fold or domain or sub-domain
SQFDFGSKEKNKEIYGTDTPPA

SEQ ID NO: 18555 - protein, 21 aa, artificial
  peptide fold or domain or sub-domain
SQFNRENLPGWNYTFWQWFDG

SEQ ID NO: 18556 - protein, 27 aa, artificial
  peptide fold or domain or sub-domain
SQGAYESQSSPWYNYYTFYTWPDSYAS

SEQ ID NO: 18557 - protein, 27 aa, artificial
  peptide fold or domain or sub-domain
SQGEAYIRALLNNKKDEQSRNALLSMF

SEQ ID NO: 18558 - protein, 26 aa, artificial
  peptide fold or domain or sub-domain
SQIEENDELLHEKLDDEMNAMVKDDL

SEQ ID NO: 18559 - protein, 26 aa, artificial
  peptide fold or domain or sub-domain
SQINDNKTILEKEDQQEMKELIKQEL

SEQ ID NO: 18560 - protein, 26 aa, artificial
  peptide fold or domain or sub-domain
SQIRIHKIEKEDNQYLISSNLHENKI

SEQ ID NO: 18561 - protein, 23 aa, artificial
  peptide fold or domain or sub-domain
SQKALLVLVGAGMSREAAYRLVQ

SEQ ID NO: 18562 - protein, 20 aa, artificial
  peptide fold or domain or sub-domain
SQKVGAHENSNRAYGGSTIN

SEQ ID NO: 18563 - protein, 30 aa, artificial
  peptide fold or domain or sub-domain
SQLDRFERELSSKQTSDQDRVLALKYVLHF

SEQ ID NO: 18564 - protein, 27 aa, artificial
  peptide fold or domain or sub-domain
SQLELGEGMKDMGMKITAEEAEHMVRE

SEQ ID NO: 18565 - protein, 23 aa, artificial
  peptide fold or domain or sub-domain
SQLKLHRFHTGRESRVVTALTLL

SEQ ID NO: 18566 - protein, 23 aa, artificial
  peptide fold or domain or sub-domain
SQLKMNLSRARRKPATVEDWLAE

SEQ ID NO: 18567 - protein, 29 aa, artificial
  peptide fold or domain or sub-domain
SQLSRELSNLMGVLPEYQTKTCAAIVKLV

SEQ ID NO: 18568 - protein, 22 aa, artificial
  peptide fold or domain or sub-domain
SQLYEQVMFDERVEDIKKVRLA

SEQ ID NO: 18569 - protein, 24 aa, artificial
  peptide fold or domain or sub-domain
SQNIKDLKEYYQAITEKQHAQIKG

SEQ ID NO: 18570 - protein, 24 aa, artificial
  peptide fold or domain or sub-domain
SQNMPSTAEYGRMVEGGHLATVRG

SEQ ID NO: 18571 - protein, 24 aa, artificial
  peptide fold or domain or sub-domain
SQNSSDINDYQTSLDNGQLAIRRG

SEQ ID NO: 18572 - protein, 24 aa, artificial
  peptide fold or domain or sub-domain
SQNVKSITEYKELLDQDKIPVYRG

SEQ ID NO: 18573 - protein, 30 aa, artificial
  peptide fold or domain or sub-domain
SQPDDSCDWYRLRHEEAMTPDAVVRLAEAA

SEQ ID NO: 18574 - protein, 20 aa, artificial
  peptide fold or domain or sub-domain
SQPIIWTDGRKVTERHHTKY

SEQ ID NO: 18575 - protein, 30 aa, artificial
  peptide fold or domain or sub-domain
SQPMAEAGYTWDEEHLAGFLAAPKKYLPGT

SEQ ID NO: 18576 - protein, 24 aa, artificial
  peptide fold or domain or sub-domain
SQQLQDLSSALDVDIQNFELPSNL

SEQ ID NO: 18577 - protein, 27 aa, artificial
  peptide fold or domain or sub-domain
SQQNAATMIDCNDNHYDNIPFELDNLS

SEQ ID NO: 18578 - protein, 28 aa, artificial
  peptide fold or domain or sub-domain
SQREKWVDDSFYSFQRSKNGDEAIVFIN

SEQ ID NO: 18579 - protein, 30 aa, artificial
  peptide fold or domain or sub-domain
SQRGEISSCNYRARAFGVRAGMWLDEALRA

SEQ ID NO: 18580 - protein, 20 aa, artificial
  peptide fold or domain or sub-domain
SQRLIMLKYRPLNEKYFKKV

SEQ ID NO: 18581 - protein, 29 aa, artificial
  peptide fold or domain or sub-domain
SQRRAVRETMRSCHDPVKRMLLDKEQLAL

SEQ ID NO: 18582 - protein, 27 aa, artificial
  peptide fold or domain or sub-domain
SQRRRLLDYVKGVDHARYQALITRLGL

SEQ ID NO: 18583 - protein, 23 aa, artificial
  peptide fold or domain or sub-domain
SQRVLLKLIEKGLTRKEAYDIVQ

SEQ ID NO: 18584 - protein, 22 aa, artificial
  peptide fold or domain or sub-domain
SQSIPGLEGIYGETDRRALQAG

SEQ ID NO: 18585 - protein, 22 aa, artificial
  peptide fold or domain or sub-domain
SQSKFQAPDGNPIHLKKGGMDY

SEQ ID NO: 18586 - protein, 27 aa, artificial
  peptide fold or domain or sub-domain
SQSLLRPSLSERRALSLPDHRLALVRE

SEQ ID NO: 18587 - protein, 24 aa, artificial
  peptide fold or domain or sub-domain
SQSYFPKLKNKSLGELKDTADIKA

SEQ ID NO: 18588 - protein, 27 aa, artificial
  peptide fold or domain or sub-domain
SQTEMENDYYILKLESSGKIVSLYDKV

SEQ ID NO: 18589 - protein, 28 aa, artificial
  peptide fold or domain or sub-domain
SQTLYVADWNDNRVLAIDTADPSQRREV

SEQ ID NO: 18590 - protein, 28 aa, artificial
  peptide fold or domain or sub-domain
SQTVSRMERDGLLRVAGDRHLELTEKGR

SEQ ID NO: 18591 - protein, 29 aa, artificial
  peptide fold or domain or sub-domain
SQVDPQIWKSSDQFDPHRWLDATTAAAMQ

SEQ ID NO: 18592 - protein, 27 aa, artificial
  peptide fold or domain or sub-domain
SQVNAIEKQENYFFTYLDSKTLLSKAV

SEQ ID NO: 18593 - protein, 24 aa, artificial
  peptide fold or domain or sub-domain
SQVRALSRHLPGLITPKAQDHPGL

SEQ ID NO: 18594 - protein, 28 aa, artificial
  peptide fold or domain or sub-domain
SQVVIDPKASVSKIRGKWFNRQGVKIMA

SEQ ID NO: 18595 - protein, 26 aa, artificial
  peptide fold or domain or sub-domain
SQYFSTTFRSPHTDRVLNAPFDYAYA

SEQ ID NO: 18596 - protein, 23 aa, artificial
  peptide fold or domain or sub-domain
SQYHHWQRLNWEDRSFEVAINQE

SEQ ID NO: 18597 - protein, 23 aa, artificial
  peptide fold or domain or sub-domain
SQYHMERRRGDEHLPYPLALCAE

SEQ ID NO: 18598 - protein, 23 aa, artificial
  peptide fold or domain or sub-domain
SQYLHQLSVGFTGATFRQHIEAC

SEQ ID NO: 18599 - protein, 23 aa, artificial
  peptide fold or domain or sub-domain
SQYQLYSQGQFSGMSFEEVIANK

SEQ ID NO: 18600 - protein, 28 aa, artificial
  peptide fold or domain or sub-domain
SRAATQAQLLEGLAFNLTNNREEEIHRG

SEQ ID NO: 18601 - protein, 27 aa, artificial
  peptide fold or domain or sub-domain
SRAELAALFRSVGHAVTDDEVARMMQE

SEQ ID NO: 18602 - protein, 29 aa, artificial
  peptide fold or domain or sub-domain
SRAFQQAMQDISYYEENPNVQKVLDTRTK

SEQ ID NO: 18603 - protein, 26 aa, artificial
  peptide fold or domain or sub-domain
SRAKAEKQRSDLSRELEEISERLEEA

SEQ ID NO: 18604 - protein, 21 aa, artificial
  peptide fold or domain or sub-domain
SRALGYDMHYAHPSEIMDEIA

SEQ ID NO: 18605 - protein, 21 aa, artificial
  peptide fold or domain or sub-domain
SRALVQAQHPDWPAPQVEAVA

SEQ ID NO: 18606 - protein, 28 aa, artificial
  peptide fold or domain or sub-domain
SRAPEAAIMPLVSRPELEGMLKQWSYFE

SEQ ID NO: 18607 - protein, 30 aa, artificial
  peptide fold or domain or sub-domain
SRAVDAFTKACELDPDNATHKEDLKRAEEK

SEQ ID NO: 18608 - protein, 24 aa, artificial
  peptide fold or domain or sub-domain
SRAYPTPLRSKKTMLVQKNVTSES

SEQ ID NO: 18609 - protein, 28 aa, artificial
  peptide fold or domain or sub-domain
SRDCDEPLTSLTPRCNTAWNRLKLDQVT

SEQ ID NO: 18610 - protein, 28 aa, artificial
  peptide fold or domain or sub-domain
SRDEDPSPGTLQFVGARTCLDAGRWHDI

SEQ ID NO: 18611 - protein, 21 aa, artificial
  peptide fold or domain or sub-domain
SRDIAKLITESVGFEVHKSQI

SEQ ID NO: 18612 - protein, 22 aa, artificial
  peptide fold or domain or sub-domain
SRDIARLGAGELDDEQLLRFNS

SEQ ID NO: 18613 - protein, 28 aa, artificial
  peptide fold or domain or sub-domain
SRDMLSDKTEAFGQKFGECPLKVHHTTS

SEQ ID NO: 18614 - protein, 23 aa, artificial
  peptide fold or domain or sub-domain
SRDYNPVHLDVPYAELRNFRAPI

SEQ ID NO: 18615 - protein, 28 aa, artificial
  peptide fold or domain or sub-domain
SREAQEVFAEFGLRSVDADVAKATAERY

SEQ ID NO: 18616 - protein, 27 aa, artificial
  peptide fold or domain or sub-domain
SREEQINNTLEQYDLNENDREYILDVV

SEQ ID NO: 18617 - protein, 23 aa, artificial
  peptide fold or domain or sub-domain
SREYIKHGTCCSDKFDRVQYFTL

SEQ ID NO: 18618 - protein, 22 aa, artificial
  peptide fold or domain or sub-domain
SRFDYGNAKDNMKHYNQPRPPP

SEQ ID NO: 18619 - protein, 20 aa, artificial
  peptide fold or domain or sub-domain
SRFPANPLVDPGQPILFDPV

SEQ ID NO: 18620 - protein, 27 aa, artificial
  peptide fold or domain or sub-domain
SRFQSEIKRLKISSPVRVCQNCYYNLQ

SEQ ID NO: 18621 - protein, 20 aa, artificial
  peptide fold or domain or sub-domain
SRFRSQHEAERALGVYQANI

SEQ ID NO: 18622 - protein, 28 aa, artificial
  peptide fold or domain or sub-domain
SRFYVKKHNGQTRLKCHYCEKTYSRDSV

SEQ ID NO: 18623 - protein, 22 aa, artificial
  peptide fold or domain or sub-domain
SRGFKVTVLDLAPQLIPTFDKE

SEQ ID NO: 18624 - protein, 28 aa, artificial
  peptide fold or domain or sub-domain
SRGGGGRPHGGTHIDDARPELPGVLFNM

SEQ ID NO: 18625 - protein, 22 aa, artificial
  peptide fold or domain or sub-domain
SRGKKVSVIEMRRVLGLGLVAH

SEQ ID NO: 18626 - protein, 24 aa, artificial
  peptide fold or domain or sub-domain
SRGQRRKMAQENPKMHNSEISKRL

SEQ ID NO: 18627 - protein, 28 aa, artificial
  peptide fold or domain or sub-domain
SRGVTEREMHSVLNYGSFGLTRDDVRLG

SEQ ID NO: 18628 - protein, 30 aa, artificial
  peptide fold or domain or sub-domain
SRHGVVLAKSTPAKKYGIVTGESLYHARKK

SEQ ID NO: 18629 - protein, 22 aa, artificial
  peptide fold or domain or sub-domain
SRHHAGHAERVAYRGLADGFAR

SEQ ID NO: 18630 - protein, 28 aa, artificial
  peptide fold or domain or sub-domain
SRHHAGHAERVAYRGLADGFARLARRLA

SEQ ID NO: 18631 - protein, 27 aa, artificial
  peptide fold or domain or sub-domain
SRHRAAIPMRGITEPERVCDACYLALR

SEQ ID NO: 18632 - protein, 29 aa, artificial
  peptide fold or domain or sub-domain
SRIDYLEKLLSSTDSTFETNLLSERIAKL

SEQ ID NO: 18633 - protein, 28 aa, artificial
  peptide fold or domain or sub-domain
SRIKMEGLAEFYGITGAEATEYFRLHTE

SEQ ID NO: 18634 - protein, 29 aa, artificial
  peptide fold or domain or sub-domain
SRISALKEMKDKTNSNYDKEKLEERIGRL

SEQ ID NO: 18635 - protein, 21 aa, artificial
  peptide fold or domain or sub-domain
SRKDITGKLKDPANFQYPAES

SEQ ID NO: 18636 - protein, 21 aa, artificial
  peptide fold or domain or sub-domain
SRKLISDMGKNVSATDIEYLA

SEQ ID NO: 18637 - protein, 21 aa, artificial
  peptide fold or domain or sub-domain
SRKLLKTFFPNWSQEEVEKWS

SEQ ID NO: 18638 - protein, 26 aa, artificial
  peptide fold or domain or sub-domain
SRKNLGSLKWDLMYSQNPEVGNEVVP

SEQ ID NO: 18639 - protein, 29 aa, artificial
  peptide fold or domain or sub-domain
SRKSGWKNPTDTKNTPLMYAYNTDADMFS

SEQ ID NO: 18640 - protein, 30 aa, artificial
  peptide fold or domain or sub-domain
SRKVMENCVAHLKSVGTYGDAEAEAMQKFA

SEQ ID NO: 18641 - protein, 27 aa, artificial
  peptide fold or domain or sub-domain
SRLAEEGTATTSAEAGAGSESSTEGAV

SEQ ID NO: 18642 - protein, 20 aa, artificial
  peptide fold or domain or sub-domain
SRLALESLGFKSELIAKALQ

SEQ ID NO: 18643 - protein, 25 aa, artificial
  peptide fold or domain or sub-domain
SRLDKLSYLSCQCPICINMTIREFI

SEQ ID NO: 18644 - protein, 26 aa, artificial
  peptide fold or domain or sub-domain
SRLPVLLLSAHADADTLYRALAAGAD

SEQ ID NO: 18645 - protein, 30 aa, artificial
  peptide fold or domain or sub-domain
SRMACGIGACYACVEHDKEDESHALKVCED

SEQ ID NO: 18646 - protein, 24 aa, artificial
  peptide fold or domain or sub-domain
SRMDNVRHIQDRITWIDCDLTDPI

SEQ ID NO: 18647 - protein, 22 aa, artificial
  peptide fold or domain or sub-domain
SRMTKKDKKNYDKKNYLGTLFV

SEQ ID NO: 18648 - protein, 24 aa, artificial
  peptide fold or domain or sub-domain
SRNATRSAAPATILGITGEAIQTL

SEQ ID NO: 18649 - protein, 30 aa, artificial
  peptide fold or domain or sub-domain
SRNDLIDILLQMKNDNRNFIEGDILVSQAL

SEQ ID NO: 18650 - protein, 25 aa, artificial
  peptide fold or domain or sub-domain
SRNYFIKCGLPPWRQTVVERGIVGT

SEQ ID NO: 18651 - protein, 29 aa, artificial
  peptide fold or domain or sub-domain
SRQELVRRLEFLERVGLGYLSLDRAAATL

SEQ ID NO: 18652 - protein, 29 aa, artificial
  peptide fold or domain or sub-domain
SRQFVREHPEKVRDALDAKGVDADLDRIL

SEQ ID NO: 18653 - protein, 26 aa, artificial
  peptide fold or domain or sub-domain
SRQGNLYAGDTQNTNSDSYTRSKYGD

SEQ ID NO: 18654 - protein, 21 aa, artificial
  peptide fold or domain or sub-domain
SRQLHASGIDIIDGSGKKVYL

SEQ ID NO: 18655 - protein, 21 aa, artificial
  peptide fold or domain or sub-domain
SRQLVASRHPDWPPDRIVKQA

SEQ ID NO: 18656 - protein, 29 aa, artificial
  peptide fold or domain or sub-domain
SRQVFVCGPEGFMQKAKNLLLKKGLPESH

SEQ ID NO: 18657 - protein, 30 aa, artificial
  peptide fold or domain or sub-domain
SRRGQRLLKGYNNRALPHFRENDDSPDAHG

SEQ ID NO: 18658 - protein, 27 aa, artificial
  peptide fold or domain or sub-domain
SRRRRLLSYLRKRRLIMYAMVVNRLGL

SEQ ID NO: 18659 - protein, 28 aa, artificial
  peptide fold or domain or sub-domain
SRSIVNILSPVMTDSRVWAGYVRINDNE

SEQ ID NO: 18660 - protein, 25 aa, artificial
  peptide fold or domain or sub-domain
SRSLGDRRASLEMMKTLVVLRRERP

SEQ ID NO: 18661 - protein, 27 aa, artificial
  peptide fold or domain or sub-domain
SRTAQAAAQAKADGDVEAERVLSRLAS

SEQ ID NO: 18662 - protein, 20 aa, artificial
  peptide fold or domain or sub-domain
SRTRLGTFHISRDEKVEVPM

SEQ ID NO: 18663 - protein, 20 aa, artificial
  peptide fold or domain or sub-domain
SRTVTAKGRGVSRLFTGLAV

SEQ ID NO: 18664 - protein, 26 aa, artificial
  peptide fold or domain or sub-domain
SRVFQCLSVKNKDFIHLNINEFINLT

SEQ ID NO: 18665 - protein, 29 aa, artificial
  peptide fold or domain or sub-domain
SRVGELHSRTLNNMDDAAAQRNASQLDEL

SEQ ID NO: 18666 - protein, 30 aa, artificial
  peptide fold or domain or sub-domain
SRVNTARWNETEKYWDVIFEDGSSKRARFL

SEQ ID NO: 18667 - protein, 20 aa, artificial
  peptide fold or domain or sub-domain
SRVRQLHWFDKSDHILPLDL

SEQ ID NO: 18668 - protein, 30 aa, artificial
  peptide fold or domain or sub-domain
SRVSDAIFDEAENEWVVQTEDGAVYRSTYL

SEQ ID NO: 18669 - protein, 24 aa, artificial
  peptide fold or domain or sub-domain
SRYKDWFCIKKFPVLENGLENVDG

SEQ ID NO: 18670 - protein, 24 aa, artificial
  peptide fold or domain or sub-domain
SRYLSKTSDAWRDRMGIGMTLNWP

SEQ ID NO: 18671 - protein, 25 aa, artificial
  peptide fold or domain or sub-domain
SRYNLGISCINLGAHREAVEHFLEA

SEQ ID NO: 18672 - protein, 27 aa, artificial
  peptide fold or domain or sub-domain
SRYRINLSSHDSDTPKRVCRHCFHTLR

SEQ ID NO: 18673 - protein, 27 aa, artificial
  peptide fold or domain or sub-domain
SSAELDEALEALRALGYAEREVSRVVP

SEQ ID NO: 18674 - protein, 24 aa, artificial
  peptide fold or domain or sub-domain
SSAEWVRNNPNDPRTPVIRDRIAS

SEQ ID NO: 18675 - protein, 28 aa, artificial
  peptide fold or domain or sub-domain
SSAIYTRDVNKSFRAMRDLHAGITYVNA

SEQ ID NO: 18676 - protein, 30 aa, artificial
  peptide fold or domain or sub-domain
SSAIYTRDVNKSFRAMRDLHAGITYVNAPT

SEQ ID NO: 18677 - protein, 23 aa, artificial
  peptide fold or domain or sub-domain
SSALLVKNYGIKFSPAKVRYLMT

SEQ ID NO: 18678 - protein, 30 aa, artificial
  peptide fold or domain or sub-domain
SSAMASFGGNWGWEEMNNWLDNPRGYMDGT

SEQ ID NO: 18679 - protein, 30 aa, artificial
  peptide fold or domain or sub-domain
SSAMKKSSIVWNEKTLDQFLTNPLVMVPGS

SEQ ID NO: 18680 - protein, 28 aa, artificial
  peptide fold or domain or sub-domain
SSAQQILELDSQLATNRQDDRAMSGEEA

SEQ ID NO: 18681 - protein, 22 aa, artificial
  peptide fold or domain or sub-domain
SSASLSFVDMPPRARSAYDSCV

SEQ ID NO: 18682 - protein, 27 aa, artificial
  peptide fold or domain or sub-domain
SSATPWNLPCTERMIINNRLNIFTRWR

SEQ ID NO: 18683 - protein, 23 aa, artificial
  peptide fold or domain or sub-domain
SSAVLADLLAGGIERERAYRSVQ

SEQ ID NO: 18684 - protein, 20 aa, artificial
  peptide fold or domain or sub-domain
SSCSSILRGIQNYHINNKEW

SEQ ID NO: 18685 - protein, 22 aa, artificial
  peptide fold or domain or sub-domain
SSDEHDWFVQSANGVAKYRDYY

SEQ ID NO: 18686 - protein, 24 aa, artificial
  peptide fold or domain or sub-domain
SSDEHDWFVQSANGVAKYRDYYIW

SEQ ID NO: 18687 - protein, 21 aa, artificial
  peptide fold or domain or sub-domain
SSDIAEKIGALLGEEFDRRKV

SEQ ID NO: 18688 - protein, 20 aa, artificial
  peptide fold or domain or sub-domain
SSDKTFKLYPNMWHGLLYGE

SEQ ID NO: 18689 - protein, 20 aa, artificial
  peptide fold or domain or sub-domain
SSDKTLEVFPGMKHEIFNEV

SEQ ID NO: 18690 - protein, 26 aa, artificial
  peptide fold or domain or sub-domain
SSDKWTIVGEWSGALTDCAKHVNGFA

SEQ ID NO: 18691 - protein, 30 aa, artificial
  peptide fold or domain or sub-domain
SSDLAAAGGTWDDKSLDAFLTDPKAAYPKA

SEQ ID NO: 18692 - protein, 28 aa, artificial
  peptide fold or domain or sub-domain
SSDLTGYHERLEDLRNGKIRFDIPTRYT

SEQ ID NO: 18693 - protein, 28 aa, artificial
  peptide fold or domain or sub-domain
SSDRRRDNFPFVSTDPETRAQLQSQPTS

SEQ ID NO: 18694 - protein, 28 aa, artificial
  peptide fold or domain or sub-domain
SSDRTNPAWPMVSAAAAVEFTDVQQKVI

SEQ ID NO: 18695 - protein, 23 aa, artificial
  peptide fold or domain or sub-domain
SSDTAEDEALKGVPFRKAYFQLA

SEQ ID NO: 18696 - protein, 29 aa, artificial
  peptide fold or domain or sub-domain
SSDYSSFSKVISENESLTNGEEADRFYKV

SEQ ID NO: 18697 - protein, 28 aa, artificial
  peptide fold or domain or sub-domain
SSEAREIFARHHFVALPTTAGEKHDAGR

SEQ ID NO: 18698 - protein, 20 aa, artificial
  peptide fold or domain or sub-domain
SSEDLENATEEYPVGKGPVD

SEQ ID NO: 18699 - protein, 30 aa, artificial
  peptide fold or domain or sub-domain
SSEERAHRRMLQLQEKGFSVNFERLLAEIK

SEQ ID NO: 18700 - protein, 30 aa, artificial
  peptide fold or domain or sub-domain
SSEFFKDGKYDLDFKNPNSDKSKWLTGPQL

SEQ ID NO: 18701 - protein, 26 aa, artificial
  peptide fold or domain or sub-domain
SSELDQKKRLRLLRDFKSGKYRYMVA

SEQ ID NO: 18702 - protein, 29 aa, artificial
  peptide fold or domain or sub-domain
SSEVVGYSQQQDKVKLEVRHCTETETLEF

SEQ ID NO: 18703 - protein, 28 aa, artificial
  peptide fold or domain or sub-domain
SSFAVRKRANDIALKCKYCEKEFSHNVV

SEQ ID NO: 18704 - protein, 28 aa, artificial
  peptide fold or domain or sub-domain
SSFEETTLLLLFGNLPTADELADFENKL

SEQ ID NO: 18705 - protein, 28 aa, artificial
  peptide fold or domain or sub-domain
SSFEGVTARLWNGASKTSLSEANVRASL

SEQ ID NO: 18706 - protein, 27 aa, artificial
  peptide fold or domain or sub-domain
SSFFVKLQKLHVNKRRRVCRKCFEFLS

SEQ ID NO: 18707 - protein, 21 aa, artificial
  peptide fold or domain or sub-domain
SSFGDLTDELDLTEGNLSSHL

SEQ ID NO: 18708 - protein, 23 aa, artificial
  peptide fold or domain or sub-domain
SSFGEAKAFGLAEDKPGDYVEHN

SEQ ID NO: 18709 - protein, 21 aa, artificial
  peptide fold or domain or sub-domain
SSFIQHYYQLFDNDRTQLGAI

SEQ ID NO: 18710 - protein, 30 aa, artificial
  peptide fold or domain or sub-domain
SSFITTLPLTKIPGVGKVTGKKLEDIGLTT

SEQ ID NO: 18711 - protein, 23 aa, artificial
  peptide fold or domain or sub-domain
SSFNESVGLGYLKTHAIEFVNYN

SEQ ID NO: 18712 - protein, 23 aa, artificial
  peptide fold or domain or sub-domain
SSFSEDKVRRLIKDSGINLVRYN

SEQ ID NO: 18713 - protein, 23 aa, artificial
  peptide fold or domain or sub-domain
SSFSETKAHQILQQKPAQFVRFN

SEQ ID NO: 18714 - protein, 27 aa, artificial
  peptide fold or domain or sub-domain
SSFSHEGKEYKDVHSKTNSKLVLQPID

SEQ ID NO: 18715 - protein, 23 aa, artificial
  peptide fold or domain or sub-domain
SSFTELKAYDLLSKASVQFVDYN

SEQ ID NO: 18716 - protein, 23 aa, artificial
  peptide fold or domain or sub-domain
SSFVETKGETMIAKNAVEFVEYN

SEQ ID NO: 18717 - protein, 27 aa, artificial
  peptide fold or domain or sub-domain
SSFVRNYTVEEKEKLKLLAEGKDLRTV

SEQ ID NO: 18718 - protein, 24 aa, artificial
  peptide fold or domain or sub-domain
SSFYGNFATEFNNAGQLFANMSFA

SEQ ID NO: 18719 - protein, 27 aa, artificial
  peptide fold or domain or sub-domain
SSFYISPNGNDNNPGTISSPFLTISKA

SEQ ID NO: 18720 - protein, 20 aa, artificial
  peptide fold or domain or sub-domain
SSGDELKEPWQDCDEENIYN

SEQ ID NO: 18721 - protein, 20 aa, artificial
  peptide fold or domain or sub-domain
SSGDELRALNQTLDAGSVYD

SEQ ID NO: 18722 - protein, 20 aa, artificial
  peptide fold or domain or sub-domain
SSGDELVDARSAPTTEQIPD

SEQ ID NO: 18723 - protein, 27 aa, artificial
  peptide fold or domain or sub-domain
SSGEIDAQLRGALGYDKADKELLEAIL

SEQ ID NO: 18724 - protein, 23 aa, artificial
  peptide fold or domain or sub-domain
SSHCRDLLVSKDAATLPLLEVGA

SEQ ID NO: 18725 - protein, 26 aa, artificial
  peptide fold or domain or sub-domain
SSHKLQQELMNGKDAFSARNDSQVYF

SEQ ID NO: 18726 - protein, 24 aa, artificial
  peptide fold or domain or sub-domain
SSIGISDLKSSSIEKGESLQDTVR

SEQ ID NO: 18727 - protein, 30 aa, artificial
  peptide fold or domain or sub-domain
SSIKINNMNHFHGRLFCHNIIGHIPIESTG

SEQ ID NO: 18728 - protein, 30 aa, artificial
  peptide fold or domain or sub-domain
SSINDKIIELKDLVVGTEAKLNKSAVLRKA

SEQ ID NO: 18729 - protein, 27 aa, artificial
  peptide fold or domain or sub-domain
SSIQAPKPLIVSSKQQNNPSSKSTIVS

SEQ ID NO: 18730 - protein, 28 aa, artificial
  peptide fold or domain or sub-domain
SSIRAAWQHDLTAEQAELLRQEEPPHIA

SEQ ID NO: 18731 - protein, 27 aa, artificial
  peptide fold or domain or sub-domain
SSISDIMRVTGLQKGGIYNHFQSKDEL

SEQ ID NO: 18732 - protein, 27 aa, artificial
  peptide fold or domain or sub-domain
SSISDLACAIGVSKAAIYHYYPTKQDI

SEQ ID NO: 18733 - protein, 26 aa, artificial
  peptide fold or domain or sub-domain
SSISRDLFTKRRKKVKNALASIGVAD

SEQ ID NO: 18734 - protein, 27 aa, artificial
  peptide fold or domain or sub-domain
SSKDHKQIFDGDKGPNTGGMGVIVPNF

SEQ ID NO: 18735 - protein, 27 aa, artificial
  peptide fold or domain or sub-domain
SSKELGAIMTSLGHEVPEEELEKAITE

SEQ ID NO: 18736 - protein, 23 aa, artificial
  peptide fold or domain or sub-domain
SSKLNENKVIEQISTNKVHIFSN

SEQ ID NO: 18737 - protein, 27 aa, artificial
  peptide fold or domain or sub-domain
SSKNSTIPKFGIEKPVRVCDNCHEKLQ

SEQ ID NO: 18738 - protein, 27 aa, artificial
  peptide fold or domain or sub-domain
SSLAAISKRAGVSNGALHFHFENKKAL

SEQ ID NO: 18739 - protein, 29 aa, artificial
  peptide fold or domain or sub-domain
SSLARLGMVKDDKNETTFADLVERIVRNQ

SEQ ID NO: 18740 - protein, 26 aa, artificial
  peptide fold or domain or sub-domain
SSLCRRYHNLLGWPDGISGQAIREAG

SEQ ID NO: 18741 - protein, 26 aa, artificial
  peptide fold or domain or sub-domain
SSLFLKAVQHAEKSEFAEAEACIEQA

SEQ ID NO: 18742 - protein, 26 aa, artificial
  peptide fold or domain or sub-domain
SSLLDELLKDERVMKYFKEDELREIL

SEQ ID NO: 18743 - protein, 29 aa, artificial
  peptide fold or domain or sub-domain
SSLLKLADTKANKPGMNLLHFVAQEAQKK

SEQ ID NO: 18744 - protein, 25 aa, artificial
  peptide fold or domain or sub-domain
SSLLKSRKKFEEFRKHLDTEQNKTG

SEQ ID NO: 18745 - protein, 28 aa, artificial
  peptide fold or domain or sub-domain
SSLPLLCPSEECSDWVRLDSFREHCLNH

SEQ ID NO: 18746 - protein, 22 aa, artificial
  peptide fold or domain or sub-domain
SSLRDHVTYNAEAQRKAHYLSR

SEQ ID NO: 18747 - protein, 22 aa, artificial
  peptide fold or domain or sub-domain
SSLSVIYSEHGEFEDYWYYEQH

SEQ ID NO: 18748 - protein, 29 aa, artificial
  peptide fold or domain or sub-domain
SSLTSKKLGIIDHWLRPIRDTKVRHKAML

SEQ ID NO: 18749 - protein, 23 aa, artificial
  peptide fold or domain or sub-domain
SSMIMADTSGYYKTALLNLVGTD

SEQ ID NO: 18750 - protein, 23 aa, artificial
  peptide fold or domain or sub-domain
SSMLKTVRSEASSLNYLMDCMPS

SEQ ID NO: 18751 - protein, 29 aa, artificial
  peptide fold or domain or sub-domain
SSMRVPSHADFQAQQGLADKPLIDKEIGE

SEQ ID NO: 18752 - protein, 23 aa, artificial
  peptide fold or domain or sub-domain
SSMVETQALNKLKDNPEDFVDYN

SEQ ID NO: 18753 - protein, 26 aa, artificial
  peptide fold or domain or sub-domain
SSNLVCVLMHERGLTPQAALDEAAAI

SEQ ID NO: 18754 - protein, 24 aa, artificial
  peptide fold or domain or sub-domain
SSNRHEWFKEALAAPRGSAARERY

SEQ ID NO: 18755 - protein, 27 aa, artificial
  peptide fold or domain or sub-domain
SSNSIPLPDLGIYEPVRVCDSCFEDYE

SEQ ID NO: 18756 - protein, 22 aa, artificial
  peptide fold or domain or sub-domain
SSPEKLISIGSGLFAKGNITID

SEQ ID NO: 18757 - protein, 25 aa, artificial
  peptide fold or domain or sub-domain
SSPFSSEESVTQTEISKKITNTEAV

SEQ ID NO: 18758 - protein, 29 aa, artificial
  peptide fold or domain or sub-domain
SSPIAAIFDTENLEKISITEGIERGIVDS

SEQ ID NO: 18759 - protein, 20 aa, artificial
  peptide fold or domain or sub-domain
SSPRELHWLERSGHAITVDA

SEQ ID NO: 18760 - protein, 26 aa, artificial
  peptide fold or domain or sub-domain
SSPYITVTGEWSGTLADCTIFEEGVD

SEQ ID NO: 18761 - protein, 22 aa, artificial
  peptide fold or domain or sub-domain
SSQAQKLGTAYIDGSNYVLAKT

SEQ ID NO: 18762 - protein, 22 aa, artificial
  peptide fold or domain or sub-domain
SSQHHRWFQGFLNDEPEYKDFY

SEQ ID NO: 18763 - protein, 28 aa, artificial
  peptide fold or domain or sub-domain
SSQIEGPFPMEPESEMQRETMQVMLDNA

SEQ ID NO: 18764 - protein, 30 aa, artificial
  peptide fold or domain or sub-domain
SSQLEDAGLTWDLETLDAWIANPRALVPGN

SEQ ID NO: 18765 - protein, 27 aa, artificial
  peptide fold or domain or sub-domain
SSQLVKEGDKYKYISVSSDGTKETVFE

SEQ ID NO: 18766 - protein, 28 aa, artificial
  peptide fold or domain or sub-domain
SSQRGGILMSMGAPEKRHALLFRASMDT

SEQ ID NO: 18767 - protein, 23 aa, artificial
  peptide fold or domain or sub-domain
SSQRVLEVSNIEFSSATIRNDMK

SEQ ID NO: 18768 - protein, 28 aa, artificial
  peptide fold or domain or sub-domain
SSRAYVANEAAGTVSVFDTSKHEVIATI

SEQ ID NO: 18769 - protein, 28 aa, artificial
  peptide fold or domain or sub-domain
SSRRADRMLQAQLPSDTPSGIRQTIAHV

SEQ ID NO: 18770 - protein, 30 aa, artificial
  peptide fold or domain or sub-domain
SSRSELLLEKFAEKIGIGSISFNENRLCSF

SEQ ID NO: 18771 - protein, 27 aa, artificial
  peptide fold or domain or sub-domain
SSRVYEEVELALLALGFAPGEVVRALD

SEQ ID NO: 18772 - protein, 28 aa, artificial
  peptide fold or domain or sub-domain
SSRWTFWQAQLLAKKGQKKQADKIYQSL

SEQ ID NO: 18773 - protein, 24 aa, artificial
  peptide fold or domain or sub-domain
SSSAHPAFQAALASAPGSPERGLY

SEQ ID NO: 18774 - protein, 26 aa, artificial
  peptide fold or domain or sub-domain
SSSANQEGEPPIRDVKILRLVFGNKI

SEQ ID NO: 18775 - protein, 24 aa, artificial
  peptide fold or domain or sub-domain
SSSFNTARIEHLYGNPVTHNGSAS

SEQ ID NO: 18776 - protein, 28 aa, artificial
  peptide fold or domain or sub-domain
SSSNRIARDFLNTGSILINDIKINDENF

SEQ ID NO: 18777 - protein, 23 aa, artificial
  peptide fold or domain or sub-domain
SSSSILEDCGLDICSATIRNEVV

SEQ ID NO: 18778 - protein, 27 aa, artificial
  peptide fold or domain or sub-domain
SSSVANFPTDEDRARFDGMLRDGGSGE

SEQ ID NO: 18779 - protein, 28 aa, artificial
  peptide fold or domain or sub-domain
SSSWEYGGITVAGDGVEHLKEGEIPMPM

SEQ ID NO: 18780 - protein, 27 aa, artificial
  peptide fold or domain or sub-domain
SSTAGHDAVDALLALGFREAQVRAAVA

SEQ ID NO: 18781 - protein, 23 aa, artificial
  peptide fold or domain or sub-domain
SSTFAFRDVCTNAGYDYTRSGNP

SEQ ID NO: 18782 - protein, 23 aa, artificial
  peptide fold or domain or sub-domain
SSTFTWPGFGRKGPHDYTRTSNP

SEQ ID NO: 18783 - protein, 20 aa, artificial
  peptide fold or domain or sub-domain
SSTHRRLFHKSDGSTVSVPM

SEQ ID NO: 18784 - protein, 30 aa, artificial
  peptide fold or domain or sub-domain
SSTLAQLADEAKELNDDSTVNFLRDLEKEQ

SEQ ID NO: 18785 - protein, 24 aa, artificial
  peptide fold or domain or sub-domain
SSTVDVDILRLTDLNAADVFLSRA

SEQ ID NO: 18786 - protein, 23 aa, artificial
  peptide fold or domain or sub-domain
SSTYFGTGPLADGDRGYGRYSNP

SEQ ID NO: 18787 - protein, 23 aa, artificial
  peptide fold or domain or sub-domain
SSTYLWDDPDKKPAYDYGRSRTP

SEQ ID NO: 18788 - protein, 23 aa, artificial
  peptide fold or domain or sub-domain
SSTYNFTGFNEPRAHDYSRRGNP

SEQ ID NO: 18789 - protein, 29 aa, artificial
  peptide fold or domain or sub-domain
SSVDEEYFENALEFIPERWKCEKNTEDSD

SEQ ID NO: 18790 - protein, 29 aa, artificial
  peptide fold or domain or sub-domain
SSVEKTLLEAVAKLPTQKTEVFRGVLEQL

SEQ ID NO: 18791 - protein, 27 aa, artificial
  peptide fold or domain or sub-domain
SSVELHKILTRLGERYAEHDCVEMIKS

SEQ ID NO: 18792 - protein, 21 aa, artificial
  peptide fold or domain or sub-domain
SSVKKTKNPQLIDKGKELFES

SEQ ID NO: 18793 - protein, 27 aa, artificial
  peptide fold or domain or sub-domain
SSVPLNVEEARKYDAKILDSLCEISDW

SEQ ID NO: 18794 - protein, 30 aa, artificial
  peptide fold or domain or sub-domain
SSWIEKNLIDDPECKRYLPFQSDGSDLYDK

SEQ ID NO: 18795 - protein, 25 aa, artificial
  peptide fold or domain or sub-domain
SSWTAADTAAQITQRKWEAARVAEQ

SEQ ID NO: 18796 - protein, 30 aa, artificial
  peptide fold or domain or sub-domain
SSYKWGYNAWWGGNLMAVKDYPVNLPRNKL

SEQ ID NO: 18797 - protein, 21 aa, artificial
  peptide fold or domain or sub-domain
STAAIYQQLSKPLEAQRLPVL

SEQ ID NO: 18798 - protein, 26 aa, artificial
  peptide fold or domain or sub-domain
STAEIAKVAGVSEGTIFKHYGKKDQL

SEQ ID NO: 18799 - protein, 30 aa, artificial
  peptide fold or domain or sub-domain
STALSNITNLQNKISSKKTPLLNELEKTFS

SEQ ID NO: 18800 - protein, 24 aa, artificial
  peptide fold or domain or sub-domain
STALVGILSRGKSITTDEATELIK

SEQ ID NO: 18801 - protein, 23 aa, artificial
  peptide fold or domain or sub-domain
STAYRHEGIGKSTGFDYSRTGNP

SEQ ID NO: 18802 - protein, 28 aa, artificial
  peptide fold or domain or sub-domain
STAYYNRRDVQMALHANVTGAMNYTWAT

SEQ ID NO: 18803 - protein, 21 aa, artificial
  peptide fold or domain or sub-domain
STCVHIGGEKVKVSKGDINEI

SEQ ID NO: 18804 - protein, 30 aa, artificial
  peptide fold or domain or sub-domain
STDEEIENIFQKALGKKEMTEEDYGKFITR

SEQ ID NO: 18805 - protein, 28 aa, artificial
  peptide fold or domain or sub-domain
STDRVTPLERVAANRPSAFQQVVELLSG

SEQ ID NO: 18806 - protein, 28 aa, artificial
  peptide fold or domain or sub-domain
STEADWVYTGWVDYYDNSLLIQMPNHTT

SEQ ID NO: 18807 - protein, 20 aa, artificial
  peptide fold or domain or sub-domain
STEKAEEQAKDYGHTKAREL

SEQ ID NO: 18808 - protein, 20 aa, artificial
  peptide fold or domain or sub-domain
STEKEIVRLRNSYHVATLDY

SEQ ID NO: 18809 - protein, 25 aa, artificial
  peptide fold or domain or sub-domain
STEKSLKDYGDKVSEDDRKAIENAI

SEQ ID NO: 18810 - protein, 28 aa, artificial
  peptide fold or domain or sub-domain
STFEEVVYLLWWGKLPSLSELENFKKEL

SEQ ID NO: 18811 - protein, 20 aa, artificial
  peptide fold or domain or sub-domain
STGDEIISHEQPLLPGKIRN

SEQ ID NO: 18812 - protein, 20 aa, artificial
  peptide fold or domain or sub-domain
STGDELVELGESPAPGTIIN

SEQ ID NO: 18813 - protein, 20 aa, artificial
  peptide fold or domain or sub-domain
STGDELVGIDGVLAGARIVD

SEQ ID NO: 18814 - protein, 20 aa, artificial
  peptide fold or domain or sub-domain
STGDEMISPELAPTAFQLRR

SEQ ID NO: 18815 - protein, 22 aa, artificial
  peptide fold or domain or sub-domain
STGGTHLGTCTSDGGVYDIYTQ

SEQ ID NO: 18816 - protein, 20 aa, artificial
  peptide fold or domain or sub-domain
STGNEIVPPGNELKPGQIYD

SEQ ID NO: 18817 - protein, 20 aa, artificial
  peptide fold or domain or sub-domain
STGNELVDVSQIPLPHQIRK

SEQ ID NO: 18818 - protein, 20 aa, artificial
  peptide fold or domain or sub-domain
STGVELVPAEAIPRTGEVRE

SEQ ID NO: 18819 - protein, 30 aa, artificial
  peptide fold or domain or sub-domain
STGVGTAAGVTPSATAFAKTNDTVAKIDIS

SEQ ID NO: 18820 - protein, 26 aa, artificial
  peptide fold or domain or sub-domain
STHANLDKIRNLKSDDPLYYKKGKLE

SEQ ID NO: 18821 - protein, 21 aa, artificial
  peptide fold or domain or sub-domain
STHLILGNEKIAIPKEYMAKI

SEQ ID NO: 18822 - protein, 27 aa, artificial
  peptide fold or domain or sub-domain
STIIYNGTSRGMPDWGKQGFFTKEQIE

SEQ ID NO: 18823 - protein, 26 aa, artificial
  peptide fold or domain or sub-domain
STIPVLVLTGLGDLTKRVEVTRLGAN

SEQ ID NO: 18824 - protein, 27 aa, artificial
  peptide fold or domain or sub-domain
STIVKERGTVYFKEGKYKQALLQYKKI

SEQ ID NO: 18825 - protein, 28 aa, artificial
  peptide fold or domain or sub-domain
STKIFTDELGFSGKHLGGSNKPDGLLWD

SEQ ID NO: 18826 - protein, 26 aa, artificial
  peptide fold or domain or sub-domain
STKLLSVLLSNTCTIQDILGTDLVKE

SEQ ID NO: 18827 - protein, 29 aa, artificial
  peptide fold or domain or sub-domain
STLGTLGNVTEQASGVYTATLTAGTVAGV

SEQ ID NO: 18828 - protein, 24 aa, artificial
  peptide fold or domain or sub-domain
STLLISGEEAISVAKGENLADTIT

SEQ ID NO: 18829 - protein, 29 aa, artificial
  peptide fold or domain or sub-domain
STLLKLTETKSQQSRVTLLHHVLEEVEKS

SEQ ID NO: 18830 - protein, 20 aa, artificial
  peptide fold or domain or sub-domain
STLPCESEQHYEYSGRCCKK

SEQ ID NO: 18831 - protein, 21 aa, artificial
  peptide fold or domain or sub-domain
STLQELADKYGVSAERVRQLE

SEQ ID NO: 18832 - protein, 21 aa, artificial
  peptide fold or domain or sub-domain
STLVDNAYPRNVEGKNKNEQT

SEQ ID NO: 18833 - protein, 26 aa, artificial
  peptide fold or domain or sub-domain
STLYRLLLKAYREGRGELLERYSAIC

SEQ ID NO: 18834 - protein, 27 aa, artificial
  peptide fold or domain or sub-domain
STMELDWDVRQKSRFEATDSAGRQLGV

SEQ ID NO: 18835 - protein, 28 aa, artificial
  peptide fold or domain or sub-domain
STMVKRLEKGGYVQRTHRLGCTLTRKGA

SEQ ID NO: 18836 - protein, 26 aa, artificial
  peptide fold or domain or sub-domain
STNAVQIMGALGCNDNYSISRCFRDS

SEQ ID NO: 18837 - protein, 27 aa, artificial
  peptide fold or domain or sub-domain
STNRINIPIMGFEFDVRTCDPCYKQLQ

SEQ ID NO: 18838 - protein, 24 aa, artificial
  peptide fold or domain or sub-domain
STNVSETLRKGNFDLNEWMNIPAR

SEQ ID NO: 18839 - protein, 20 aa, artificial
  peptide fold or domain or sub-domain
STPDEITIQIRVPQKVVGLV

SEQ ID NO: 18840 - protein, 28 aa, artificial
  peptide fold or domain or sub-domain
STPDEITIQIRVPQKVVGLVVGPKGATI

SEQ ID NO: 18841 - protein, 22 aa, artificial
  peptide fold or domain or sub-domain
STPEERYNEYRLSSDFIKEYIF

SEQ ID NO: 18842 - protein, 30 aa, artificial
  peptide fold or domain or sub-domain
STPFGQVPTLTVDGVQVTQSDSILRYAGKL

SEQ ID NO: 18843 - protein, 24 aa, artificial
  peptide fold or domain or sub-domain
STQAQAFQALCSAELSDYKVPETW

SEQ ID NO: 18844 - protein, 30 aa, artificial
  peptide fold or domain or sub-domain
STQERAQRRYIELVEKGIQTSLMEVEQGII

SEQ ID NO: 18845 - protein, 21 aa, artificial
  peptide fold or domain or sub-domain
STRGRDLDITGMSYAMLEESP

SEQ ID NO: 18846 - protein, 25 aa, artificial
  peptide fold or domain or sub-domain
STRKQVEEAGDKLPADDKTAIESAL

SEQ ID NO: 18847 - protein, 27 aa, artificial
  peptide fold or domain or sub-domain
STRLEDAEIVNSTWKFATPEDILQQKE

SEQ ID NO: 18848 - protein, 28 aa, artificial
  peptide fold or domain or sub-domain
STRWQYWLARVELKTQRVTAANNRLHAL

SEQ ID NO: 18849 - protein, 26 aa, artificial
  peptide fold or domain or sub-domain
STSAARPDGDVLIDARDIKEELGHGL

SEQ ID NO: 18850 - protein, 26 aa, artificial
  peptide fold or domain or sub-domain
STSANHNGRVPAKTARECHRLFGGRV

SEQ ID NO: 18851 - protein, 26 aa, artificial
  peptide fold or domain or sub-domain
STSANITGAPPPSDPKEIDPEILSRV

SEQ ID NO: 18852 - protein, 26 aa, artificial
  peptide fold or domain or sub-domain
STSANLAGEDPALSGDEILNVFEGKI

SEQ ID NO: 18853 - protein, 26 aa, artificial
  peptide fold or domain or sub-domain
STSANLSGLPPCRTVDEVRAQFGAAF

SEQ ID NO: 18854 - protein, 26 aa, artificial
  peptide fold or domain or sub-domain
STSANLSGQEPAKTWQSLDLVLSKQV

SEQ ID NO: 18855 - protein, 26 aa, artificial
  peptide fold or domain or sub-domain
STSANLSGQNTVLSIAEAKSQFTEQI

SEQ ID NO: 18856 - protein, 26 aa, artificial
  peptide fold or domain or sub-domain
STSANLSSLEAALSSQQVNKMFKSNT

SEQ ID NO: 18857 - protein, 26 aa, artificial
  peptide fold or domain or sub-domain
STSANPSGETPARTLEQIKTYFADTI

SEQ ID NO: 18858 - protein, 26 aa, artificial
  peptide fold or domain or sub-domain
STSANVAGQSPARRREDLDPSLLPHL

SEQ ID NO: 18859 - protein, 26 aa, artificial
  peptide fold or domain or sub-domain
STSCNPGGRPAAKTRLRVEQYFHGQL

SEQ ID NO: 18860 - protein, 25 aa, artificial
  peptide fold or domain or sub-domain
STSNHLWLEFNTNGSDTDQGFQLTY

SEQ ID NO: 18861 - protein, 23 aa, artificial
  peptide fold or domain or sub-domain
STTADGTAIEGSDVFLVGSETRS

SEQ ID NO: 18862 - protein, 30 aa, artificial
  peptide fold or domain or sub-domain
STTAFNRTAATAARWAEEHSGRIAPSPAAA

SEQ ID NO: 18863 - protein, 26 aa, artificial
  peptide fold or domain or sub-domain
STTTVKMPQLAPQAIHTAGEVNYKDY

SEQ ID NO: 18864 - protein, 30 aa, artificial
  peptide fold or domain or sub-domain
STVAGGAGGIFATTDTFGSDPEKVADIDIS

SEQ ID NO: 18865 - protein, 27 aa, artificial
  peptide fold or domain or sub-domain
STVDDIVRYSNLSKGSVYNYFKSKEEI

SEQ ID NO: 18866 - protein, 28 aa, artificial
  peptide fold or domain or sub-domain
STYEEVSYLILYGRLPTKRELEDYINRM

SEQ ID NO: 18867 - protein, 30 aa, artificial
  peptide fold or domain or sub-domain
STYYQDHLEDCGAIQAGLYRFGFNALGKSA

SEQ ID NO: 18868 - protein, 30 aa, artificial
  peptide fold or domain or sub-domain
SVAFAMYLTEKGLLKDGVRFGDAEGLLEML

SEQ ID NO: 18869 - protein, 22 aa, artificial
  peptide fold or domain or sub-domain
SVAFAMYLTEKGVGDFNIKWGD

SEQ ID NO: 18870 - protein, 30 aa, artificial
  peptide fold or domain or sub-domain
SVAGCGVCPGCETHDPVMCFSGPMIFGAGV

SEQ ID NO: 18871 - protein, 30 aa, artificial
  peptide fold or domain or sub-domain
SVALGMSRVESRGRKDRIELETNDFFKRVR

SEQ ID NO: 18872 - protein, 21 aa, artificial
  peptide fold or domain or sub-domain
SVANLNNSSFQCTACDNKTQI

SEQ ID NO: 18873 - protein, 30 aa, artificial
  peptide fold or domain or sub-domain
SVAPEQLASVLDAFRQSGCTVTTNGNSVTL

SEQ ID NO: 18874 - protein, 20 aa, artificial
  peptide fold or domain or sub-domain
SVAQIFEQHKEEGFRALERE

SEQ ID NO: 18875 - protein, 30 aa, artificial
  peptide fold or domain or sub-domain
SVASRAKRRFLDFQEKGIHQDLKDIEHDIE

SEQ ID NO: 18876 - protein, 22 aa, artificial
  peptide fold or domain or sub-domain
SVAWDALARSEELSEIDASTAK

SEQ ID NO: 18877 - protein, 29 aa, artificial
  peptide fold or domain or sub-domain
SVAYHAKPNIMKHANIVINFGRLNKIMDL

SEQ ID NO: 18878 - protein, 20 aa, artificial
  peptide fold or domain or sub-domain
SVCPQGKYIHPQNNSICCTK

SEQ ID NO: 18879 - protein, 20 aa, artificial
  peptide fold or domain or sub-domain
SVDALVALGYTLSESKEAVQ

SEQ ID NO: 18880 - protein, 29 aa, artificial
  peptide fold or domain or sub-domain
SVDDEYPDLSVHNNHMAKVLTLDLYKKLR

SEQ ID NO: 18881 - protein, 26 aa, artificial
  peptide fold or domain or sub-domain
SVDDLAKGAGISRPTFYFYFPSKEAV

SEQ ID NO: 18882 - protein, 27 aa, artificial
  peptide fold or domain or sub-domain
SVDEFGDVIRTLGQNPTKKDIEDAVKR

SEQ ID NO: 18883 - protein, 27 aa, artificial
  peptide fold or domain or sub-domain
SVDELKQAMAKLGELLSQEELDTMIQE

SEQ ID NO: 18884 - protein, 20 aa, artificial
  peptide fold or domain or sub-domain
SVDKELNGLKDSHHLMTHGE

SEQ ID NO: 18885 - protein, 27 aa, artificial
  peptide fold or domain or sub-domain
SVDLVTAGGDQVTASARENPELFWALH

SEQ ID NO: 18886 - protein, 28 aa, artificial
  peptide fold or domain or sub-domain
SVDNTQPGYPWLSEQARTVVLTGGVKPV

SEQ ID NO: 18887 - protein, 22 aa, artificial
  peptide fold or domain or sub-domain
SVDRAVNAGVSLNLSANIMPFV

SEQ ID NO: 18888 - protein, 20 aa, artificial
  peptide fold or domain or sub-domain
SVDTASRDAERGNIPVSDEL

SEQ ID NO: 18889 - protein, 27 aa, artificial
  peptide fold or domain or sub-domain
SVDVKVDGNNKFSQGNYRGAISMYLEG

SEQ ID NO: 18890 - protein, 30 aa, artificial
  peptide fold or domain or sub-domain
SVEDMLGKEISDATVKAREQGLLKGVKLVE

SEQ ID NO: 18891 - protein, 30 aa, artificial
  peptide fold or domain or sub-domain
SVEERAERRYKENMAKGFAGDLNQLKKEIE

SEQ ID NO: 18892 - protein, 25 aa, artificial
  peptide fold or domain or sub-domain
SVEETISSPAANLKRPAKIQIEQEL

SEQ ID NO: 18893 - protein, 23 aa, artificial
  peptide fold or domain or sub-domain
SVEEVNRLAREGMPFRDAYKKVG

SEQ ID NO: 18894 - protein, 30 aa, artificial
  peptide fold or domain or sub-domain
SVEGKRIAFGFVDRTLPHFSKDDYSPESKG

SEQ ID NO: 18895 - protein, 28 aa, artificial
  peptide fold or domain or sub-domain
SVEGMSLIAHHEPRTRFAQVYTAFDFYE

SEQ ID NO: 18896 - protein, 27 aa, artificial
  peptide fold or domain or sub-domain
SVEITSSGNTFTITVHNPAKTFSNTIT

SEQ ID NO: 18897 - protein, 21 aa, artificial
  peptide fold or domain or sub-domain
SVELARSLNQWLPEEELVQLA

SEQ ID NO: 18898 - protein, 22 aa, artificial
  peptide fold or domain or sub-domain
SVEMKSTSDRTYSVKHREGKYP

SEQ ID NO: 18899 - protein, 22 aa, artificial
  peptide fold or domain or sub-domain
SVEVSPPDAAAALLAWHGPEAP

SEQ ID NO: 18900 - protein, 21 aa, artificial
  peptide fold or domain or sub-domain
SVEVVRREHPFWDDQRVEQEA

SEQ ID NO: 18901 - protein, 22 aa, artificial
  peptide fold or domain or sub-domain
SVFDPTNVKTAGCPSGTPRAGD

SEQ ID NO: 18902 - protein, 21 aa, artificial
  peptide fold or domain or sub-domain
SVFDSADTGFVSGKAGQEKLI

SEQ ID NO: 18903 - protein, 24 aa, artificial
  peptide fold or domain or sub-domain
SVFNRTHSKANTVLNNGAIWRDTP

SEQ ID NO: 18904 - protein, 24 aa, artificial
  peptide fold or domain or sub-domain
SVGCCDIGNPNDPFTCASGHWNPD

SEQ ID NO: 18905 - protein, 30 aa, artificial
  peptide fold or domain or sub-domain
SVGDEVIIPTPTFPLYMAIAKAIDATVIEI

SEQ ID NO: 18906 - protein, 21 aa, artificial
  peptide fold or domain or sub-domain
SVGGEVGKQLGVSYFLERREL

SEQ ID NO: 18907 - protein, 25 aa, artificial
  peptide fold or domain or sub-domain
SVGIGSELVNNKLVEEGKFDEITKR

SEQ ID NO: 18908 - protein, 30 aa, artificial
  peptide fold or domain or sub-domain
SVGILAGQWIALHRYLQQLEALNQPLLHLD

SEQ ID NO: 18909 - protein, 30 aa, artificial
  peptide fold or domain or sub-domain
SVGILASDWLKFADTLTTLSRHHLRLLHFD

SEQ ID NO: 18910 - protein, 23 aa, artificial
  peptide fold or domain or sub-domain
SVGRFRKWTTLYLQLLTSPLRAL

SEQ ID NO: 18911 - protein, 24 aa, artificial
  peptide fold or domain or sub-domain
SVHEVHKILESKGMPISYKCTIVE

SEQ ID NO: 18912 - protein, 28 aa, artificial
  peptide fold or domain or sub-domain
SVHGDTNPDLVAGVGLDPHAPASIATFD

SEQ ID NO: 18913 - protein, 20 aa, artificial
  peptide fold or domain or sub-domain
SVHPNVDYNECINFLKNEAE

SEQ ID NO: 18914 - protein, 20 aa, artificial
  peptide fold or domain or sub-domain
SVHSDPNLLEDYAGAKEWVK

SEQ ID NO: 18915 - protein, 27 aa, artificial
  peptide fold or domain or sub-domain
SVIDLIDNDATTWEQEPLMTLAQQGEL

SEQ ID NO: 18916 - protein, 21 aa, artificial
  peptide fold or domain or sub-domain
SVIEFDYQDGIDGKPRPVQMF

SEQ ID NO: 18917 - protein, 27 aa, artificial
  peptide fold or domain or sub-domain
SVIKAEEKRSCDMVFGPANLGEDAIKN

SEQ ID NO: 18918 - protein, 30 aa, artificial
  peptide fold or domain or sub-domain
SVINGLSKALRRTDTPIYVRSFALAHLVHY

SEQ ID NO: 18919 - protein, 30 aa, artificial
  peptide fold or domain or sub-domain
SVIPMLISAITSPTATSDIIITSVANLIHF

SEQ ID NO: 18920 - protein, 30 aa, artificial
  peptide fold or domain or sub-domain
SVIQSKDGGKVTVKTESGATLTVKEDQVFP

SEQ ID NO: 18921 - protein, 22 aa, artificial
  peptide fold or domain or sub-domain
SVIQVDGGIDVEPTKRKAKSAG

SEQ ID NO: 18922 - protein, 29 aa, artificial
  peptide fold or domain or sub-domain
SVITTIISAADAAGRFPSSSDLESVQGNI

SEQ ID NO: 18923 - protein, 23 aa, artificial
  peptide fold or domain or sub-domain
SVKAIERDPTQYGLSAHEVTRRK

SEQ ID NO: 18924 - protein, 25 aa, artificial
  peptide fold or domain or sub-domain
SVKEEDMDEHLRVLWQIDEGGSTGK

SEQ ID NO: 18925 - protein, 21 aa, artificial
  peptide fold or domain or sub-domain
SVKFGIAGAIEHPQVQCDSVN

SEQ ID NO: 18926 - protein, 30 aa, artificial
  peptide fold or domain or sub-domain
SVKPTEISKLILENDKLDIKPSMIQPITEI

SEQ ID NO: 18927 - protein, 20 aa, artificial
  peptide fold or domain or sub-domain
SVKQFVVENGWEKFREEETR

SEQ ID NO: 18928 - protein, 23 aa, artificial
  peptide fold or domain or sub-domain
SVKQINSLLDTNQSDSKQRIEYI

SEQ ID NO: 18929 - protein, 22 aa, artificial
  peptide fold or domain or sub-domain
SVKVIILNNQEQGMISQLQRES

SEQ ID NO: 18930 - protein, 26 aa, artificial
  peptide fold or domain or sub-domain
SVLAPALVRALKKKDTGLLDSYTSLA

SEQ ID NO: 18931 - protein, 20 aa, artificial
  peptide fold or domain or sub-domain
SVLDKTTANVQQPFGAGIET

SEQ ID NO: 18932 - protein, 21 aa, artificial
  peptide fold or domain or sub-domain
SVLDSLRQGKLAVSREIIDIL

SEQ ID NO: 18933 - protein, 30 aa, artificial
  peptide fold or domain or sub-domain
SVLIFKNGAKVEEFVGLRPKNEIVEKLEKH

SEQ ID NO: 18934 - protein, 29 aa, artificial
  peptide fold or domain or sub-domain
SVLKDVLQQRIEDLGPEKSRVYQALVQTL

SEQ ID NO: 18935 - protein, 29 aa, artificial
  peptide fold or domain or sub-domain
SVLNKNFPADGLLPIYINPDTANPSQSTI

SEQ ID NO: 18936 - protein, 29 aa, artificial
  peptide fold or domain or sub-domain
SVLRFEGEGKVKEAVLSDKSKIPADFVLI

SEQ ID NO: 18937 - protein, 30 aa, artificial
  peptide fold or domain or sub-domain
SVLSPIVKVSTVLVRHNAVDKNSLYLVNTS

SEQ ID NO: 18938 - protein, 26 aa, artificial
  peptide fold or domain or sub-domain
SVNDLQIDNEIIQFITRFNGVPKKIR

SEQ ID NO: 18939 - protein, 20 aa, artificial
  peptide fold or domain or sub-domain
SVNDVSVVDVPHASAVDALK

SEQ ID NO: 18940 - protein, 22 aa, artificial
  peptide fold or domain or sub-domain
SVNGEDLSSATHDEAVQVLKKT

SEQ ID NO: 18941 - protein, 20 aa, artificial
  peptide fold or domain or sub-domain
SVNGEDMRNASQETVATVLK

SEQ ID NO: 18942 - protein, 22 aa, artificial
  peptide fold or domain or sub-domain
SVNGVSVEGEHHEKAVELLKAA

SEQ ID NO: 18943 - protein, 28 aa, artificial
  peptide fold or domain or sub-domain
SVNLHHLPKQIEDHLSKFENIQTIHEQP

SEQ ID NO: 18944 - protein, 22 aa, artificial
  peptide fold or domain or sub-domain
SVNNISLEGVSFNTAVKIIQNS

SEQ ID NO: 18945 - protein, 20 aa, artificial
  peptide fold or domain or sub-domain
SVNNVNLTHATHEEAAQALK

SEQ ID NO: 18946 - protein, 21 aa, artificial
  peptide fold or domain or sub-domain
SVPEVLQAEGIMTPEEFEELL

SEQ ID NO: 18947 - protein, 20 aa, artificial
  peptide fold or domain or sub-domain
SVPIATTKIDSSTKYHEISI

SEQ ID NO: 18948 - protein, 26 aa, artificial
  peptide fold or domain or sub-domain
SVQHLQTLTQSGADQHEAWNQTTVIH

SEQ ID NO: 18949 - protein, 20 aa, artificial
  peptide fold or domain or sub-domain
SVRDDHLADTVHPYGPGPKA

SEQ ID NO: 18950 - protein, 20 aa, artificial
  peptide fold or domain or sub-domain
SVRDDSKKTEDAPFGPDVKR

SEQ ID NO: 18951 - protein, 26 aa, artificial
  peptide fold or domain or sub-domain
SVRDLCLENDWISFSARFSGTSYKAL

SEQ ID NO: 18952 - protein, 21 aa, artificial
  peptide fold or domain or sub-domain
SVRDLCLQHDVLTEEELDIIL

SEQ ID NO: 18953 - protein, 21 aa, artificial
  peptide fold or domain or sub-domain
SVREFWLQPNPDIRHLATRVT

SEQ ID NO: 18954 - protein, 30 aa, artificial
  peptide fold or domain or sub-domain
SVRGERIRRGYRERTLSLFKYGDIAPEARG

SEQ ID NO: 18955 - protein, 30 aa, artificial
  peptide fold or domain or sub-domain
SVRLREGLHFTAVADSGRAIELDSPHEGNT

SEQ ID NO: 18956 - protein, 20 aa, artificial
  peptide fold or domain or sub-domain
SVRVENGVIVEMDGRARADF

SEQ ID NO: 18957 - protein, 30 aa, artificial
  peptide fold or domain or sub-domain
SVRVPSARQLVYNDRRANSKGRMPDDTWIL

SEQ ID NO: 18958 - protein, 23 aa, artificial
  peptide fold or domain or sub-domain
SVRVVEDMGERWGLGTNEVHKRR

SEQ ID NO: 18959 - protein, 20 aa, artificial
  peptide fold or domain or sub-domain
SVSALSEHRSDVRRAAEWLA

SEQ ID NO: 18960 - protein, 20 aa, artificial
  peptide fold or domain or sub-domain
SVSATQIRQLLASGKSVRFL

SEQ ID NO: 18961 - protein, 27 aa, artificial
  peptide fold or domain or sub-domain
SVSCFVADPDVARRAREQGITRSILAL

SEQ ID NO: 18962 - protein, 29 aa, artificial
  peptide fold or domain or sub-domain
SVSCIKLIVPIDDETFCQQLLRDTGVLLV

SEQ ID NO: 18963 - protein, 24 aa, artificial
  peptide fold or domain or sub-domain
SVSEDANGTVASCSLSCDVSPVSR

SEQ ID NO: 18964 - protein, 20 aa, artificial
  peptide fold or domain or sub-domain
SVSEKLQDVGNEQFLEEEGK

SEQ ID NO: 18965 - protein, 20 aa, artificial
  peptide fold or domain or sub-domain
SVSFPGFDATQVRRSAEATA

SEQ ID NO: 18966 - protein, 22 aa, artificial
  peptide fold or domain or sub-domain
SVSILPRDDEAYQIAHDSPEWP

SEQ ID NO: 18967 - protein, 27 aa, artificial
  peptide fold or domain or sub-domain
SVSISFNGERMDIQAGSACRNTKISFK

SEQ ID NO: 18968 - protein, 22 aa, artificial
  peptide fold or domain or sub-domain
SVSKFMEKAGVAMNDPKRKERC

SEQ ID NO: 18969 - protein, 29 aa, artificial
  peptide fold or domain or sub-domain
SVSKVIAKVGTSGDSTVTLPGDLKDENNK

SEQ ID NO: 18970 - protein, 22 aa, artificial
  peptide fold or domain or sub-domain
SVSKWCYENKIEATSKQRSERC

SEQ ID NO: 18971 - protein, 30 aa, artificial
  peptide fold or domain or sub-domain
SVSLKQIEDWLAKKFNLKVDKKKFIDNNNL

SEQ ID NO: 18972 - protein, 27 aa, artificial
  peptide fold or domain or sub-domain
SVSSGDGLYPDGSLIQHGYFPYNGSYG

SEQ ID NO: 18973 - protein, 22 aa, artificial
  peptide fold or domain or sub-domain
SVSSTTRTPRAGEVNGKDYNFV

SEQ ID NO: 18974 - protein, 22 aa, artificial
  peptide fold or domain or sub-domain
SVSTAEPYMTDLSSGHKGFPSC

SEQ ID NO: 18975 - protein, 20 aa, artificial
  peptide fold or domain or sub-domain
SVSTDSKHKQDIGKAADFLI

SEQ ID NO: 18976 - protein, 22 aa, artificial
  peptide fold or domain or sub-domain
SVSTWCAANAVSTKSADKLARC

SEQ ID NO: 18977 - protein, 30 aa, artificial
  peptide fold or domain or sub-domain
SVSVRDIVDALAEDGVTGVTKSMVELERPI

SEQ ID NO: 18978 - protein, 30 aa, artificial
  peptide fold or domain or sub-domain
SVSVYNRSPAKTEEFLKDHGESGALQGFTT

SEQ ID NO: 18979 - protein, 30 aa, artificial
  peptide fold or domain or sub-domain
SVTAANIAEAIEKARGIHLDRRKIRLEEPI

SEQ ID NO: 18980 - protein, 30 aa, artificial
  peptide fold or domain or sub-domain
SVTAKDIAEALSRQHGVTIDPKRLALEKPI

SEQ ID NO: 18981 - protein, 26 aa, artificial
  peptide fold or domain or sub-domain
SVTASGDDGNVPSNAIDGDPTTRWSS

SEQ ID NO: 18982 - protein, 22 aa, artificial
  peptide fold or domain or sub-domain
SVTAVKVLDFLFVREPVSGLGS

SEQ ID NO: 18983 - protein, 21 aa, artificial
  peptide fold or domain or sub-domain
SVTCPGGQSTSNSQCCVWFDV

SEQ ID NO: 18984 - protein, 25 aa, artificial
  peptide fold or domain or sub-domain
SVTDCSKHGTLVNKELIGRENSRFV

SEQ ID NO: 18985 - protein, 30 aa, artificial
  peptide fold or domain or sub-domain
SVTISDIIDEAAKKNIILTRKNFPHSHYAI

SEQ ID NO: 18986 - protein, 30 aa, artificial
  peptide fold or domain or sub-domain
SVTNKDVADAIARHIGKPFDRKMVELDAPI

SEQ ID NO: 18987 - protein, 30 aa, artificial
  peptide fold or domain or sub-domain
SVTNKEIADKLSENISYNISHSNIILDKQI

SEQ ID NO: 18988 - protein, 30 aa, artificial
  peptide fold or domain or sub-domain
SVTPADVASAIKASGGPEVDKRRIELGSPI

SEQ ID NO: 18989 - protein, 26 aa, artificial
  peptide fold or domain or sub-domain
SVTPPYTRWTESLHALLSDEDGIQLF

SEQ ID NO: 18990 - protein, 27 aa, artificial
  peptide fold or domain or sub-domain
SVTQTAATPAPATGGGSMVVTSPHASG

SEQ ID NO: 18991 - protein, 30 aa, artificial
  peptide fold or domain or sub-domain
SVTVAEIVHLIQDHAKIELEKKDIQLKHPI

SEQ ID NO: 18992 - protein, 24 aa, artificial
  peptide fold or domain or sub-domain
SVVHALISGQDNESQQCSQFKNRT

SEQ ID NO: 18993 - protein, 28 aa, artificial
  peptide fold or domain or sub-domain
SVVHFQREERLFEQHRYPDAAGHSKRHE

SEQ ID NO: 18994 - protein, 28 aa, artificial
  peptide fold or domain or sub-domain
SVVLSHQKERVEKEILEYFPKTQILEQD

SEQ ID NO: 18995 - protein, 30 aa, artificial
  peptide fold or domain or sub-domain
SVVPEHLIPLIAKLRDIGVTIIEESPDCLR

SEQ ID NO: 18996 - protein, 26 aa, artificial
  peptide fold or domain or sub-domain
SVVSHNFAGQKISDIYPNLKNVFEME

SEQ ID NO: 18997 - protein, 29 aa, artificial
  peptide fold or domain or sub-domain
SVVTKSIVNADAEARYLSPGELDRIKNFV

SEQ ID NO: 18998 - protein, 30 aa, artificial
  peptide fold or domain or sub-domain
SVVVGAHFHTVEGRWHIRTADGRTARAKYF

SEQ ID NO: 18999 - protein, 23 aa, artificial
  peptide fold or domain or sub-domain
SVWAPLAENVELVLQPAQTSTGA

SEQ ID NO: 19000 - protein, 24 aa, artificial
  peptide fold or domain or sub-domain
SVWNRTASKCDDLVAAGATACATP

SEQ ID NO: 19001 - protein, 30 aa, artificial
  peptide fold or domain or sub-domain
SVWTTCSSNTVNDSDECNTGVNLAKCMKES

SEQ ID NO: 19002 - protein, 20 aa, artificial
  peptide fold or domain or sub-domain
SVYDEKTRKAGAPFGTKIEA

SEQ ID NO: 19003 - protein, 21 aa, artificial
  peptide fold or domain or sub-domain
SVYPGMNDSTAVNGSANMTEF

SEQ ID NO: 19004 - protein, 20 aa, artificial
  peptide fold or domain or sub-domain
SVYVNGAAVWEDQSFTGQHA

SEQ ID NO: 19005 - protein, 21 aa, artificial
  peptide fold or domain or sub-domain
SWAWAQQVFPDLDPQEQLYKA

SEQ ID NO: 19006 - protein, 30 aa, artificial
  peptide fold or domain or sub-domain
SWCDTGDIYCDSGSSLTVHGSYFANYTMDS

SEQ ID NO: 19007 - protein, 24 aa, artificial
  peptide fold or domain or sub-domain
SWCKGDDGWNDLDPKDSTQLLSGV

SEQ ID NO: 19008 - protein, 30 aa, artificial
  peptide fold or domain or sub-domain
SWCLAGDNVCAQGTDPTAHTSYFNVFSQEA

SEQ ID NO: 19009 - protein, 30 aa, artificial
  peptide fold or domain or sub-domain
SWDDRLIDHLPWFRLGGDPYITRDFRIRDL

SEQ ID NO: 19010 - protein, 23 aa, artificial
  peptide fold or domain or sub-domain
SWEHDAFIHNKKTGQFFDQAKLH

SEQ ID NO: 19011 - protein, 23 aa, artificial
  peptide fold or domain or sub-domain
SWGDGACRQCHEGNEQLCAHGVW

SEQ ID NO: 19012 - protein, 30 aa, artificial
  peptide fold or domain or sub-domain
SWGDGACRQCHEGNEQLCAHGVWAGFGRHG

SEQ ID NO: 19013 - protein, 23 aa, artificial
  peptide fold or domain or sub-domain
SWLATPAGMENRLLKDQNIPIYQ

SEQ ID NO: 19014 - protein, 25 aa, artificial
  peptide fold or domain or sub-domain
SWMTSAQMPFGMLDNDGRTPRTALI

SEQ ID NO: 19015 - protein, 25 aa, artificial
  peptide fold or domain or sub-domain
SWNPDSGDTGGILKDDWQTVDTVKD

SEQ ID NO: 19016 - protein, 26 aa, artificial
  peptide fold or domain or sub-domain
SWQAIWDAEIAPQMEALIKKPGYSMN

SEQ ID NO: 19017 - protein, 30 aa, artificial
  peptide fold or domain or sub-domain
SWQRQSCDRSRLAELVTGLRQLPAQMEQIL

SEQ ID NO: 19018 - protein, 20 aa, artificial
  peptide fold or domain or sub-domain
SWQWGKKADGSYGVLDPNSA

SEQ ID NO: 19019 - protein, 21 aa, artificial
  peptide fold or domain or sub-domain
SWSAMRNRKYNCTLCSRSDTI

SEQ ID NO: 19020 - protein, 24 aa, artificial
  peptide fold or domain or sub-domain
SWSPLWGSPRTNTRGKKIETVILE

SEQ ID NO: 19021 - protein, 22 aa, artificial
  peptide fold or domain or sub-domain
SWSRKNNDRIEKFQQYKNEYSR

SEQ ID NO: 19022 - protein, 28 aa, artificial
  peptide fold or domain or sub-domain
SWSRKNNDRIEKFQQYKNEYSRTFWDTQ

SEQ ID NO: 19023 - protein, 23 aa, artificial
  peptide fold or domain or sub-domain
SWSTAILTHNDDPAAFATALRDM

SEQ ID NO: 19024 - protein, 23 aa, artificial
  peptide fold or domain or sub-domain
SWYQHQRAHGDPVALNYTFYQVI

SEQ ID NO: 19025 - protein, 27 aa, artificial
  peptide fold or domain or sub-domain
SYADYTYPQFRENKPADPELFKKFESA

SEQ ID NO: 19026 - protein, 22 aa, artificial
  peptide fold or domain or sub-domain
SYAEMLNKTGGKYDADLLSKLI

SEQ ID NO: 19027 - protein, 30 aa, artificial
  peptide fold or domain or sub-domain
SYCDASDPYCCNGSNAATHQGYGSEYGSQA

SEQ ID NO: 19028 - protein, 30 aa, artificial
  peptide fold or domain or sub-domain
SYCDEDDLFCDSGKSLDIHVTYVQRYGAAA

SEQ ID NO: 19029 - protein, 26 aa, artificial
  peptide fold or domain or sub-domain
SYDSGIGKDIDEGNVTLADLEAYSLD

SEQ ID NO: 19030 - protein, 20 aa, artificial
  peptide fold or domain or sub-domain
SYDTCLREAEAQGKPFADHA

SEQ ID NO: 19031 - protein, 29 aa, artificial
  peptide fold or domain or sub-domain
SYEHVYKALKNLGFESYVESCMKEHENYE

SEQ ID NO: 19032 - protein, 27 aa, artificial
  peptide fold or domain or sub-domain
SYEVVLSNGSIVEASATSNKDLFWGLK

SEQ ID NO: 19033 - protein, 28 aa, artificial
  peptide fold or domain or sub-domain
SYFELEGSSNQFKLRCFYCEKLFERGEV

SEQ ID NO: 19034 - protein, 21 aa, artificial
  peptide fold or domain or sub-domain
SYFLQGYYNVLANSPELACQF

SEQ ID NO: 19035 - protein, 24 aa, artificial
  peptide fold or domain or sub-domain
SYGEQRELLQRGFREQAALMEQEL

SEQ ID NO: 19036 - protein, 25 aa, artificial
  peptide fold or domain or sub-domain
SYGSNVNLLKYKFGYSKFSGTDSEV

SEQ ID NO: 19037 - protein, 23 aa, artificial
  peptide fold or domain or sub-domain
SYHEKAEDSELRIPFPEKDEEFK

SEQ ID NO: 19038 - protein, 24 aa, artificial
  peptide fold or domain or sub-domain
SYHRTLRFWDYQQGSWQEEQQTKQ

SEQ ID NO: 19039 - protein, 24 aa, artificial
  peptide fold or domain or sub-domain
SYIDKKKSRREGRKVPEELAIEKP

SEQ ID NO: 19040 - protein, 24 aa, artificial
  peptide fold or domain or sub-domain
SYIDVAQILKNALKKDVDPYYILN

SEQ ID NO: 19041 - protein, 23 aa, artificial
  peptide fold or domain or sub-domain
SYKKAIALKLECDEAYYNMGNAL

SEQ ID NO: 19042 - protein, 30 aa, artificial
  peptide fold or domain or sub-domain
SYKSLAVSVSYELKVKGAKAGMTRGDILKI

SEQ ID NO: 19043 - protein, 29 aa, artificial
  peptide fold or domain or sub-domain
SYLEKVSEVKDTVRRQSLLHHLCSLVLQT

SEQ ID NO: 19044 - protein, 23 aa, artificial
  peptide fold or domain or sub-domain
SYLNNIKEIIDNYKDNKKEGQLL

SEQ ID NO: 19045 - protein, 24 aa, artificial
  peptide fold or domain or sub-domain
SYLNSNNTKSSGRLSSLIHCVEDP

SEQ ID NO: 19046 - protein, 29 aa, artificial
  peptide fold or domain or sub-domain
SYLVRYHPIDDEDDMTEISVTGNTNKGIL

SEQ ID NO: 19047 - protein, 29 aa, artificial
  peptide fold or domain or sub-domain
SYMKFVRNQMKLLGRAETTADYNRVGAAI

SEQ ID NO: 19048 - protein, 29 aa, artificial
  peptide fold or domain or sub-domain
SYNSSKHALEMNKDIKRKFELTLNLKKAR

SEQ ID NO: 19049 - protein, 22 aa, artificial
  peptide fold or domain or sub-domain
SYQYLVILGLNERWAEFIDYFP

SEQ ID NO: 19050 - protein, 22 aa, artificial
  peptide fold or domain or sub-domain
SYRHQVAEELGKLGSIQKASRG

SEQ ID NO: 19051 - protein, 21 aa, artificial
  peptide fold or domain or sub-domain
SYRSYANVHRGVHRLSMEASK

SEQ ID NO: 19052 - protein, 30 aa, artificial
  peptide fold or domain or sub-domain
SYSFNNESIAVGKEKLLNVLSEKPALFEQI

SEQ ID NO: 19053 - protein, 24 aa, artificial
  peptide fold or domain or sub-domain
SYSNVDVHGVYYIRDSRKQYYVNF

SEQ ID NO: 19054 - protein, 26 aa, artificial
  peptide fold or domain or sub-domain
SYTEGIGREIVEGTADFHKLEAHALQ

SEQ ID NO: 19055 - protein, 28 aa, artificial
  peptide fold or domain or sub-domain
SYTIGVNDPTYYRSTGVSYNFRSPEKHG

SEQ ID NO: 19056 - protein, 22 aa, artificial
  peptide fold or domain or sub-domain
SYVASAVTPLRLNSSTKVLDML

SEQ ID NO: 19057 - protein, 28 aa, artificial
  peptide fold or domain or sub-domain
SYVASAVTPLRLNSSTKVLDMLIDSSTL

SEQ ID NO: 19058 - protein, 24 aa, artificial
  peptide fold or domain or sub-domain
SYVDISEMMKKQYNITMEPYYIMD

SEQ ID NO: 19059 - protein, 26 aa, artificial
  peptide fold or domain or sub-domain
SYVSKATQTAEETVKMIRESQLGQEV

SEQ ID NO: 19060 - protein, 24 aa, artificial
  peptide fold or domain or sub-domain
SYVYMYEKGKEDLSNQNETYKGRT

SEQ ID NO: 19061 - protein, 23 aa, artificial
  peptide fold or domain or sub-domain
SYWHHYKMIMGYRGPREHFLEAL

SEQ ID NO: 19062 - protein, 30 aa, artificial
  peptide fold or domain or sub-domain
SYYPFWHGTTENLTSVLKNVASTYKKDVMV

SEQ ID NO: 19063 - protein, 29 aa, artificial
  peptide fold or domain or sub-domain
SYYPKEVLADFKEDVETFAKSEGLTAHAN

SEQ ID NO: 19064 - protein, 28 aa, artificial
  peptide fold or domain or sub-domain
SYYSQGVDSNGQPLPENLYFMSSQTPES

SEQ ID NO: 19065 - protein, 21 aa, artificial
  peptide fold or domain or sub-domain
TAAALLTAGRAKNIQEGMQMA

SEQ ID NO: 19066 - protein, 21 aa, artificial
  peptide fold or domain or sub-domain
TAAALYVGKLVENLKEGVELA

SEQ ID NO: 19067 - protein, 29 aa, artificial
  peptide fold or domain or sub-domain
TAAASSVASTIQAQTHGLPLVALEHLGRL

SEQ ID NO: 19068 - protein, 27 aa, artificial
  peptide fold or domain or sub-domain
TAAELGKVLGRIGEGCSAEECERMIAS

SEQ ID NO: 19069 - protein, 21 aa, artificial
  peptide fold or domain or sub-domain
TAAINPGWVRTEMGGKLAPMR

SEQ ID NO: 19070 - protein, 24 aa, artificial
  peptide fold or domain or sub-domain
TAAISAAVRSWQSTSSSAYPGYES

SEQ ID NO: 19071 - protein, 20 aa, artificial
  peptide fold or domain or sub-domain
TAAKAVLPALGLTCSVDTIR

SEQ ID NO: 19072 - protein, 29 aa, artificial
  peptide fold or domain or sub-domain
TAAMGDAWGMINSPDKEGFVHKAFELRGK

SEQ ID NO: 19073 - protein, 21 aa, artificial
  peptide fold or domain or sub-domain
TAAPGRNGSSYPYGTYSGTMF

SEQ ID NO: 19074 - protein, 24 aa, artificial
  peptide fold or domain or sub-domain
TAAVIDAERDRGAAPRTLPAHELA

SEQ ID NO: 19075 - protein, 23 aa, artificial
  peptide fold or domain or sub-domain
TACDFAEPTEGGERLTLQALHEV

SEQ ID NO: 19076 - protein, 25 aa, artificial
  peptide fold or domain or sub-domain
TACELLDVLPEDYPQRPKVMDYFRA

SEQ ID NO: 19077 - protein, 22 aa, artificial
  peptide fold or domain or sub-domain
TADDHAWAQAARAGDARYLDYY

SEQ ID NO: 19078 - protein, 20 aa, artificial
  peptide fold or domain or sub-domain
TADQTRYQRMTNEELKQAFV

SEQ ID NO: 19079 - protein, 28 aa, artificial
  peptide fold or domain or sub-domain
TADTENIHLTKQGTLSITPRKKSNRLWT

SEQ ID NO: 19080 - protein, 21 aa, artificial
  peptide fold or domain or sub-domain
TADVAAIKAKLAEKSGRNADD

SEQ ID NO: 19081 - protein, 27 aa, artificial
  peptide fold or domain or sub-domain
TAEELGVVMRELGLNPSKAELEDLVNE

SEQ ID NO: 19082 - protein, 30 aa, artificial
  peptide fold or domain or sub-domain
TAEERAQRRVDQNHQLGYNSNYDEVLYEIK

SEQ ID NO: 19083 - protein, 29 aa, artificial
  peptide fold or domain or sub-domain
TAEHVLRALRVLGFEAYENECAIARDEAK

SEQ ID NO: 19084 - protein, 27 aa, artificial
  peptide fold or domain or sub-domain
TAFDFYTQLTPKVGKPLRYLVAELAQE

SEQ ID NO: 19085 - protein, 22 aa, artificial
  peptide fold or domain or sub-domain
TAGGRKSSEIAKLLDLSESAVN

SEQ ID NO: 19086 - protein, 21 aa, artificial
  peptide fold or domain or sub-domain
TAGICPGMVQTDMSKGKGQLT

SEQ ID NO: 19087 - protein, 24 aa, artificial
  peptide fold or domain or sub-domain
TAGLPEQLKKEAMTLDQFISTPSR

SEQ ID NO: 19088 - protein, 24 aa, artificial
  peptide fold or domain or sub-domain
TAGPAFDSPDYRPEYRHADSQYFQ

SEQ ID NO: 19089 - protein, 21 aa, artificial
  peptide fold or domain or sub-domain
TAHFRAEYSKLGDVSERQARL

SEQ ID NO: 19090 - protein, 25 aa, artificial
  peptide fold or domain or sub-domain
TAHHVTDASPLYHKTDFSGFLPHER

SEQ ID NO: 19091 - protein, 24 aa, artificial
  peptide fold or domain or sub-domain
TAHIMKDPELSKTMKSRILLGRWG

SEQ ID NO: 19092 - protein, 20 aa, artificial
  peptide fold or domain or sub-domain
TAHPSPDYAGAAAFLLPYAA

SEQ ID NO: 19093 - protein, 30 aa, artificial
  peptide fold or domain or sub-domain
TAHRGNTKEAPENTISSVKKAIEAKSDYAE

SEQ ID NO: 19094 - protein, 25 aa, artificial
  peptide fold or domain or sub-domain
TAHRLLDALGTHGSTDLIASYAAPL

SEQ ID NO: 19095 - protein, 25 aa, artificial
  peptide fold or domain or sub-domain
TAHRPVDLARPRENEGTSGFLPVER

SEQ ID NO: 19096 - protein, 29 aa, artificial
  peptide fold or domain or sub-domain
TAIASSERSMRQARLVGIPIVDSDTILEL

SEQ ID NO: 19097 - protein, 24 aa, artificial
  peptide fold or domain or sub-domain
TAIHLNVTDLGLGYETKEELIFRY

SEQ ID NO: 19098 - protein, 27 aa, artificial
  peptide fold or domain or sub-domain
TAITSRQYAGKKVHKVHPNLRGLDLRF

SEQ ID NO: 19099 - protein, 26 aa, artificial
  peptide fold or domain or sub-domain
TAKAVAVLINNSGSYAEFASGQLIAQ

SEQ ID NO: 19100 - protein, 26 aa, artificial
  peptide fold or domain or sub-domain
TAKAVKILTANPGPSTAYSGVGKVKN

SEQ ID NO: 19101 - protein, 29 aa, artificial
  peptide fold or domain or sub-domain
TAKDILQTLTELDFESFVPSLTQDLEVYR

SEQ ID NO: 19102 - protein, 26 aa, artificial
  peptide fold or domain or sub-domain
TAKGIGTIVGNGGRINDYEGANRIMR

SEQ ID NO: 19103 - protein, 22 aa, artificial
  peptide fold or domain or sub-domain
TAKGKSAWEIGCILGIKERTAA

SEQ ID NO: 19104 - protein, 26 aa, artificial
  peptide fold or domain or sub-domain
TAKLVAILLNNHVALRDVVDGKVKFK

SEQ ID NO: 19105 - protein, 26 aa, artificial
  peptide fold or domain or sub-domain
TAKSIGLMLRNAGNIRDYVGLDKVTE

SEQ ID NO: 19106 - protein, 23 aa, artificial
  peptide fold or domain or sub-domain
TAKTFLNKLYGGDMKSLVLNFAK

SEQ ID NO: 19107 - protein, 21 aa, artificial
  peptide fold or domain or sub-domain
TALAFGLSQVAWVKWTWFAIS

SEQ ID NO: 19108 - protein, 24 aa, artificial
  peptide fold or domain or sub-domain
TALDSLDAKCNMNQFNLLEILLAA

SEQ ID NO: 19109 - protein, 22 aa, artificial
  peptide fold or domain or sub-domain
TALFQLLMENSEPITAASRLAQ

SEQ ID NO: 19110 - protein, 29 aa, artificial
  peptide fold or domain or sub-domain
TALFRAEEWDEEPTTGKLAEVIGVTASTV

SEQ ID NO: 19111 - protein, 22 aa, artificial
  peptide fold or domain or sub-domain
TALGRRQADIAIALGVSPRTIE

SEQ ID NO: 19112 - protein, 28 aa, artificial
  peptide fold or domain or sub-domain
TALGTDSFSTEMVAAWQKEGVKTDLIQR

SEQ ID NO: 19113 - protein, 27 aa, artificial
  peptide fold or domain or sub-domain
TALIADRMTADGIDAERAAELAMLLLT

SEQ ID NO: 19114 - protein, 21 aa, artificial
  peptide fold or domain or sub-domain
TALINHAYPRTFDGRAAAKMS

SEQ ID NO: 19115 - protein, 30 aa, artificial
  peptide fold or domain or sub-domain
TALINNLAAVANSESDFRTSQFLLWFISEQ

SEQ ID NO: 19116 - protein, 23 aa, artificial
  peptide fold or domain or sub-domain
TALQLSVAAGTIANGGVNPVTKK

SEQ ID NO: 19117 - protein, 30 aa, artificial
  peptide fold or domain or sub-domain
TALQQFRKDLRDPTTPTRRKRLALRFALHI

SEQ ID NO: 19118 - protein, 22 aa, artificial
  peptide fold or domain or sub-domain
TALSNVYSEDGAFLYDVALSRC

SEQ ID NO: 19119 - protein, 27 aa, artificial
  peptide fold or domain or sub-domain
TALTDIAHDGTRFQIRAGNEHITADWL

SEQ ID NO: 19120 - protein, 21 aa, artificial
  peptide fold or domain or sub-domain
TALYRTDYSGRGELSARQMHL

SEQ ID NO: 19121 - protein, 24 aa, artificial
  peptide fold or domain or sub-domain
TAMGEVGQRFQDGKAFVPQLLMAG

SEQ ID NO: 19122 - protein, 24 aa, artificial
  peptide fold or domain or sub-domain
TAMLAKVMKETKLMPAQTTSVATA

SEQ ID NO: 19123 - protein, 22 aa, artificial
  peptide fold or domain or sub-domain
TANGLLAKQICARLSISVSAVQ

SEQ ID NO: 19124 - protein, 28 aa, artificial
  peptide fold or domain or sub-domain
TANIRSVKLSSPDYAGWDAEKAVADYWE

SEQ ID NO: 19125 - protein, 24 aa, artificial
  peptide fold or domain or sub-domain
TAPFDAWLRGEAELAAAAADGAAL

SEQ ID NO: 19126 - protein, 21 aa, artificial
  peptide fold or domain or sub-domain
TAPHPSDIHLLYTEPKKARSQ

SEQ ID NO: 19127 - protein, 21 aa, artificial
  peptide fold or domain or sub-domain
TAPKDNDLICLKRNPELAVSE

SEQ ID NO: 19128 - protein, 21 aa, artificial
  peptide fold or domain or sub-domain
TAPKPEWEDRIESDTGSVLAD

SEQ ID NO: 19129 - protein, 21 aa, artificial
  peptide fold or domain or sub-domain
TAPLESDMPLMDTDPGRVGSR

SEQ ID NO: 19130 - protein, 21 aa, artificial
  peptide fold or domain or sub-domain
TAPSGLSPEQLKANPVGAYAN

SEQ ID NO: 19131 - protein, 21 aa, artificial
  peptide fold or domain or sub-domain
TAPTLESQQFLHKNPLKVQAQ

SEQ ID NO: 19132 - protein, 20 aa, artificial
  peptide fold or domain or sub-domain
TAPTTVSDTRCGSQQRTLFS

SEQ ID NO: 19133 - protein, 24 aa, artificial
  peptide fold or domain or sub-domain
TAPYMQDEQVRAAGLKQIPLRRFG

SEQ ID NO: 19134 - protein, 27 aa, artificial
  peptide fold or domain or sub-domain
TAQAYRAEQLYEGPADDANCIAIKNCD

SEQ ID NO: 19135 - protein, 27 aa, artificial
  peptide fold or domain or sub-domain
TAQEFRYFMVHMGMQFSEEEVDEMIKE

SEQ ID NO: 19136 - protein, 28 aa, artificial
  peptide fold or domain or sub-domain
TAQFYANIQADATVATFFNGIDMPNQTN

SEQ ID NO: 19137 - protein, 22 aa, artificial
  peptide fold or domain or sub-domain
TARALIYTLSSEFDRCMLLPSA

SEQ ID NO: 19138 - protein, 23 aa, artificial
  peptide fold or domain or sub-domain
TARETYRDLWGTLNQGRAWQGVF

SEQ ID NO: 19139 - protein, 27 aa, artificial
  peptide fold or domain or sub-domain
TARLANEGLVCLADDRTVQFTEKGLLR

SEQ ID NO: 19140 - protein, 29 aa, artificial
  peptide fold or domain or sub-domain
TARVQAQRYTFSYQEPMPVEQLVQSLCDT

SEQ ID NO: 19141 - protein, 21 aa, artificial
  peptide fold or domain or sub-domain
TARWLQHMSHRCGGSLIIGEW

SEQ ID NO: 19142 - protein, 24 aa, artificial
  peptide fold or domain or sub-domain
TARYFERMGKLDANNAGSNRELIG

SEQ ID NO: 19143 - protein, 22 aa, artificial
  peptide fold or domain or sub-domain
TASAYLPVTDNDKADNVSKAQA

SEQ ID NO: 19144 - protein, 24 aa, artificial
  peptide fold or domain or sub-domain
TASCTAKSALKNEGDSLVYSKSIF

SEQ ID NO: 19145 - protein, 28 aa, artificial
  peptide fold or domain or sub-domain
TASEALSVWESAKANNDFNAFAPYLQRH

SEQ ID NO: 19146 - protein, 29 aa, artificial
  peptide fold or domain or sub-domain
TASFQVISNAEKQDRFLNLGELDQFVTYL

SEQ ID NO: 19147 - protein, 30 aa, artificial
  peptide fold or domain or sub-domain
TASIHSIYDLAVREGDYPAQVLLNWFVEEQ

SEQ ID NO: 19148 - protein, 24 aa, artificial
  peptide fold or domain or sub-domain
TASLPEEVQKKLTDPAFIPLRRPG

SEQ ID NO: 19149 - protein, 28 aa, artificial
  peptide fold or domain or sub-domain
TASNGEFRRLVQQGGVQLNQQKISDLDR

SEQ ID NO: 19150 - protein, 29 aa, artificial
  peptide fold or domain or sub-domain
TASYDGIVLVWDLSAPKFPAITLAGSSGS

SEQ ID NO: 19151 - protein, 28 aa, artificial
  peptide fold or domain or sub-domain
TATHFNYEELLMERNGYPDLENHKLKHR

SEQ ID NO: 19152 - protein, 28 aa, artificial
  peptide fold or domain or sub-domain
TATISEQEWQYAKPTGDFSKVKANLEKL

SEQ ID NO: 19153 - protein, 27 aa, artificial
  peptide fold or domain or sub-domain
TATVASSKPAKVDPVTTATTQPPAKTT

SEQ ID NO: 19154 - protein, 29 aa, artificial
  peptide fold or domain or sub-domain
TAVASSRISQLLAEAVGIPLSDHSLLQDV

SEQ ID NO: 19155 - protein, 29 aa, artificial
  peptide fold or domain or sub-domain
TAVATSQATEALALRLAVPLVPFQQLSAV

SEQ ID NO: 19156 - protein, 27 aa, artificial
  peptide fold or domain or sub-domain
TAVDKDNKFFFDPSARDQVTYQQLRER

SEQ ID NO: 19157 - protein, 28 aa, artificial
  peptide fold or domain or sub-domain
TAVGGDAIGRAARDMWAAEGVDATATIT

SEQ ID NO: 19158 - protein, 22 aa, artificial
  peptide fold or domain or sub-domain
TAVKYTWNGNILSISNKSWDLL

SEQ ID NO: 19159 - protein, 21 aa, artificial
  peptide fold or domain or sub-domain
TAVLAPLLGGKHSEGEHFIVQ

SEQ ID NO: 19160 - protein, 27 aa, artificial
  peptide fold or domain or sub-domain
TAVVGMKQTKDGWIVETDKGAIECEHV

SEQ ID NO: 19161 - protein, 20 aa, artificial
  peptide fold or domain or sub-domain
TAYAQRLFAEGQYTDYLYFH

SEQ ID NO: 19162 - protein, 24 aa, artificial
  peptide fold or domain or sub-domain
TAYLAAAAPDAWPHDPDGQWPFPP

SEQ ID NO: 19163 - protein, 30 aa, artificial
  peptide fold or domain or sub-domain
TAYVIGVAIPDSHPYIYRTRDGGKSWQKIV

SEQ ID NO: 19164 - protein, 23 aa, artificial
  peptide fold or domain or sub-domain
TCANLRRNDRRVIEQGERVVEEE

SEQ ID NO: 19165 - protein, 25 aa, artificial
  peptide fold or domain or sub-domain
TCANNRHQCSVHAECRDYATGFCCR

SEQ ID NO: 19166 - protein, 20 aa, artificial
  peptide fold or domain or sub-domain
TCAPNQFTCANDVCIPGSWH

SEQ ID NO: 19167 - protein, 25 aa, artificial
  peptide fold or domain or sub-domain
TCASSGNKCSQFADCKDYSSGYCCH

SEQ ID NO: 19168 - protein, 27 aa, artificial
  peptide fold or domain or sub-domain
TCDTPEEDGITWTLDQSSEVLGSGKTL

SEQ ID NO: 19169 - protein, 20 aa, artificial
  peptide fold or domain or sub-domain
TCEASNFQCRNGHCIPQRWA

SEQ ID NO: 19170 - protein, 23 aa, artificial
  peptide fold or domain or sub-domain
TCESGAAMAASLANGGLCPLSGD

SEQ ID NO: 19171 - protein, 20 aa, artificial
  peptide fold or domain or sub-domain
TCGSCKMCQVSKFGQCLDGG

SEQ ID NO: 19172 - protein, 28 aa, artificial
  peptide fold or domain or sub-domain
TCIGNDDYSDLLIENYEKLGITGYIRVS

SEQ ID NO: 19173 - protein, 30 aa, artificial
  peptide fold or domain or sub-domain
TCISQCDWDEKTNRWTIQSKDGKRFSAQYL

SEQ ID NO: 19174 - protein, 22 aa, artificial
  peptide fold or domain or sub-domain
TCISVIYDEDKSMKVGVASPHL

SEQ ID NO: 19175 - protein, 23 aa, artificial
  peptide fold or domain or sub-domain
TCKEVITSEDATIEEKRFYLKML

SEQ ID NO: 19176 - protein, 20 aa, artificial
  peptide fold or domain or sub-domain
TCKNLHVPCKNGVKKCHRSK

SEQ ID NO: 19177 - protein, 21 aa, artificial
  peptide fold or domain or sub-domain
TCKVDRVIKHNGYNSNNYNSD

SEQ ID NO: 19178 - protein, 22 aa, artificial
  peptide fold or domain or sub-domain
TCLKAMKILRHDKDVASTLKRQ

SEQ ID NO: 19179 - protein, 20 aa, artificial
  peptide fold or domain or sub-domain
TCLPNYYRCSSGTCVMDTWV

SEQ ID NO: 19180 - protein, 29 aa, artificial
  peptide fold or domain or sub-domain
TCLTGTRRALATPQCSSLHAHLDSLDALC

SEQ ID NO: 19181 - protein, 30 aa, artificial
  peptide fold or domain or sub-domain
TCMDEVFECPKTCKSCGPSMGDPSRRICQD

SEQ ID NO: 19182 - protein, 20 aa, artificial
  peptide fold or domain or sub-domain
TCPLDEFQCNNTLCKPLAWK

SEQ ID NO: 19183 - protein, 23 aa, artificial
  peptide fold or domain or sub-domain
TCPPDYAYDKFPRPPGVSEGAHV

SEQ ID NO: 19184 - protein, 20 aa, artificial
  peptide fold or domain or sub-domain
TCQPGFFLCPDHRCIYNSYV

SEQ ID NO: 19185 - protein, 23 aa, artificial
  peptide fold or domain or sub-domain
TCRVMNYPFKPTQAVQTTDWELY

SEQ ID NO: 19186 - protein, 20 aa, artificial
  peptide fold or domain or sub-domain
TCSAQEFTCQNFKCIRNQSR

SEQ ID NO: 19187 - protein, 22 aa, artificial
  peptide fold or domain or sub-domain
TCSQCHSNCTQCTDYTVCQACQ

SEQ ID NO: 19188 - protein, 20 aa, artificial
  peptide fold or domain or sub-domain
TCSSHQITCSNGQCIPSEYR

SEQ ID NO: 19189 - protein, 20 aa, artificial
  peptide fold or domain or sub-domain
TCSTSDDADDPTPPNERDDE

SEQ ID NO: 19190 - protein, 20 aa, artificial
  peptide fold or domain or sub-domain
TCTDEHFTCNDGYCISLAFR

SEQ ID NO: 19191 - protein, 29 aa, artificial
  peptide fold or domain or sub-domain
TCTTTSRATSEVARDVGIELSDPNEMNEI

SEQ ID NO: 19192 - protein, 30 aa, artificial
  peptide fold or domain or sub-domain
TCVDAVEKKTAFVRQMAGALGLPNLQAAHT

SEQ ID NO: 19193 - protein, 29 aa, artificial
  peptide fold or domain or sub-domain
TCVFSEPPLRPRLAETLSAGLPVKLAELD

SEQ ID NO: 19194 - protein, 29 aa, artificial
  peptide fold or domain or sub-domain
TCVFSEPQFEPKLVKTVVDGTKARTGVLD

SEQ ID NO: 19195 - protein, 28 aa, artificial
  peptide fold or domain or sub-domain
TCVGPDPMGQIALEYLRSAGVDLSHLIS

SEQ ID NO: 19196 - protein, 29 aa, artificial
  peptide fold or domain or sub-domain
TCVPSSDATEKLAKELGIKIVALDEIEKI

SEQ ID NO: 19197 - protein, 30 aa, artificial
  peptide fold or domain or sub-domain
TCVQQEALEAHDGASKGKYTIGLGQDCLAF

SEQ ID NO: 19198 - protein, 20 aa, artificial
  peptide fold or domain or sub-domain
TCYNCWYCLVAKASTRCPKR

SEQ ID NO: 19199 - protein, 23 aa, artificial
  peptide fold or domain or sub-domain
TDAASKALAGGETFYTWQRGIPD

SEQ ID NO: 19200 - protein, 25 aa, artificial
  peptide fold or domain or sub-domain
TDACIDALLAAGPPADLHRLVSLPA

SEQ ID NO: 19201 - protein, 26 aa, artificial
  peptide fold or domain or sub-domain
TDACVQIHGAMGVAVGFAAERLYRDC

SEQ ID NO: 19202 - protein, 26 aa, artificial
  peptide fold or domain or sub-domain
TDAFRVRDTEQKGIITIGFEDFLGIA

SEQ ID NO: 19203 - protein, 26 aa, artificial
  peptide fold or domain or sub-domain
TDALVWVIAKSGISSQQQSMRLANLL

SEQ ID NO: 19204 - protein, 30 aa, artificial
  peptide fold or domain or sub-domain
TDANKQADVTWDENSLFKYLENPKKFIPGT

SEQ ID NO: 19205 - protein, 27 aa, artificial
  peptide fold or domain or sub-domain
TDDAEQEAVARLVALGYKPQEASRMVS

SEQ ID NO: 19206 - protein, 30 aa, artificial
  peptide fold or domain or sub-domain
TDDKPSFKYARQLISNEGVLVGGSSGSAFT

SEQ ID NO: 19207 - protein, 20 aa, artificial
  peptide fold or domain or sub-domain
TDDMKSKYQTYWIIPRYNLP

SEQ ID NO: 19208 - protein, 25 aa, artificial
  peptide fold or domain or sub-domain
TDDQEIRELNKTYRKKDKPTDVLSF

SEQ ID NO: 19209 - protein, 30 aa, artificial
  peptide fold or domain or sub-domain
TDELELNDLFNKVCEGYIPNQSEISKWQTA

SEQ ID NO: 19210 - protein, 25 aa, artificial
  peptide fold or domain or sub-domain
TDELLDEMAAMPKPVDFHSVFALPL

SEQ ID NO: 19211 - protein, 29 aa, artificial
  peptide fold or domain or sub-domain
TDEMTLFEVAVEAGAEEVDETDGTYVVTT

SEQ ID NO: 19212 - protein, 27 aa, artificial
  peptide fold or domain or sub-domain
TDEQLVERAQEGDRCALGELISRYEQR

SEQ ID NO: 19213 - protein, 25 aa, artificial
  peptide fold or domain or sub-domain
TDFATFEGLIEGAVNPLTAFMTGSL

SEQ ID NO: 19214 - protein, 26 aa, artificial
  peptide fold or domain or sub-domain
TDFFRKRDHLQQGSANFIYDDFLQGT

SEQ ID NO: 19215 - protein, 21 aa, artificial
  peptide fold or domain or sub-domain
TDFFVAEKNWGKGLGWYSNQF

SEQ ID NO: 19216 - protein, 24 aa, artificial
  peptide fold or domain or sub-domain
TDFLSKVSPDWLQVAGKGTAVKWP

SEQ ID NO: 19217 - protein, 24 aa, artificial
  peptide fold or domain or sub-domain
TDFQARRAQIRYRDEDGKLHLAHT

SEQ ID NO: 19218 - protein, 22 aa, artificial
  peptide fold or domain or sub-domain
TDFVLRRPLSDASRTIVDTAND

SEQ ID NO: 19219 - protein, 23 aa, artificial
  peptide fold or domain or sub-domain
TDFYKNFYNLDENLGSRISEQAV

SEQ ID NO: 19220 - protein, 25 aa, artificial
  peptide fold or domain or sub-domain
TDGVLRFFAKEEISARQFANQMMHV

SEQ ID NO: 19221 - protein, 26 aa, artificial
  peptide fold or domain or sub-domain
TDIFRRYDTDQDGWIQVSYEQYLSMV

SEQ ID NO: 19222 - protein, 28 aa, artificial
  peptide fold or domain or sub-domain
TDIGQELAAEHYYRPREEDILAKYSEVF

SEQ ID NO: 19223 - protein, 27 aa, artificial
  peptide fold or domain or sub-domain
TDIPPGGVEEKAKNNAVLLREFVGCFI

SEQ ID NO: 19224 - protein, 28 aa, artificial
  peptide fold or domain or sub-domain
TDKFTDIALGQWIGSTPKQIVADTLKLP

SEQ ID NO: 19225 - protein, 29 aa, artificial
  peptide fold or domain or sub-domain
TDKKILKKITAMEEVGIGYVTLGQALSTL

SEQ ID NO: 19226 - protein, 27 aa, artificial
  peptide fold or domain or sub-domain
TDLDERREWDGEKIWHPLEDGRFYRGL

SEQ ID NO: 19227 - protein, 30 aa, artificial
  peptide fold or domain or sub-domain
TDLDKLIEEEIEMPIATFFELFGEADFRKI

SEQ ID NO: 19228 - protein, 25 aa, artificial
  peptide fold or domain or sub-domain
TDLDLMVVKLSDPRKFNKENILEQI

SEQ ID NO: 19229 - protein, 29 aa, artificial
  peptide fold or domain or sub-domain
TDLECHGFELTGEYDWISNDPEWETAYVS

SEQ ID NO: 19230 - protein, 29 aa, artificial
  peptide fold or domain or sub-domain
TDLESVCDQAIERYGSARGQPFAAIKKQL

SEQ ID NO: 19231 - protein, 27 aa, artificial
  peptide fold or domain or sub-domain
TDLEYVTRARAGDTDAFRVLVERHSRA

SEQ ID NO: 19232 - protein, 26 aa, artificial
  peptide fold or domain or sub-domain
TDLMLDLGLLSGRKDDLIQALAQKKY

SEQ ID NO: 19233 - protein, 27 aa, artificial
  peptide fold or domain or sub-domain
TDLTEKSGMQAPVLHWTPSIAPSGMAY

SEQ ID NO: 19234 - protein, 28 aa, artificial
  peptide fold or domain or sub-domain
TDLVGPEDVTGPEGVTGPEGVTGPEDVT

SEQ ID NO: 19235 - protein, 29 aa, artificial
  peptide fold or domain or sub-domain
TDMDNYAVQLVKELPKDQTGVLKHVHEML

SEQ ID NO: 19236 - protein, 25 aa, artificial
  peptide fold or domain or sub-domain
TDMETFKGMYDKSVSPQAAFMTGKL

SEQ ID NO: 19237 - protein, 30 aa, artificial
  peptide fold or domain or sub-domain
TDMTSAVWDEGTSTWRVSCKTGDVFHVRYL

SEQ ID NO: 19238 - protein, 27 aa, artificial
  peptide fold or domain or sub-domain
TDNKFAISENPLITLREFMKYRRDFIK

SEQ ID NO: 19239 - protein, 24 aa, artificial
  peptide fold or domain or sub-domain
TDNVVKVMAQFAVEMIAVLDKLKM

SEQ ID NO: 19240 - protein, 27 aa, artificial
  peptide fold or domain or sub-domain
TDPDQILMRRLGDASRARDMEGYRAIA

SEQ ID NO: 19241 - protein, 22 aa, artificial
  peptide fold or domain or sub-domain
TDPDVLARTDIADHALESLRPR

SEQ ID NO: 19242 - protein, 20 aa, artificial
  peptide fold or domain or sub-domain
TDPELPHWRDPEVMLDIDQR

SEQ ID NO: 19243 - protein, 23 aa, artificial
  peptide fold or domain or sub-domain
TDPKEVQKIRDAIKKGEACSVRL

SEQ ID NO: 19244 - protein, 20 aa, artificial
  peptide fold or domain or sub-domain
TDPQLLRKCGLSRQKIAYIT

SEQ ID NO: 19245 - protein, 26 aa, artificial
  peptide fold or domain or sub-domain
TDQADAEAMLKEASDPDMKEMMQEEI

SEQ ID NO: 19246 - protein, 23 aa, artificial
  peptide fold or domain or sub-domain
TDQPGLWELRSALREKKECHVII

SEQ ID NO: 19247 - protein, 27 aa, artificial
  peptide fold or domain or sub-domain
TDQVLVERVQKGDQKAFNLLVVRYQHK

SEQ ID NO: 19248 - protein, 20 aa, artificial
  peptide fold or domain or sub-domain
TDRASELSGDLQSKFSTLRN

SEQ ID NO: 19249 - protein, 27 aa, artificial
  peptide fold or domain or sub-domain
TDRELVEGCRRGEREAFRVLFETYKDK

SEQ ID NO: 19250 - protein, 30 aa, artificial
  peptide fold or domain or sub-domain
TDREYPLKQVGEAIEREEARRVARPAIVPD

SEQ ID NO: 19251 - protein, 23 aa, artificial
  peptide fold or domain or sub-domain
TDRGTVDQIRAAIKEGSELTVRI

SEQ ID NO: 19252 - protein, 30 aa, artificial
  peptide fold or domain or sub-domain
TDRIKELFAAARAENDPLGEQFMLWFLKEQ

SEQ ID NO: 19253 - protein, 26 aa, artificial
  peptide fold or domain or sub-domain
TDSLIQLLEQHLQSPSDIVLATRSLL

SEQ ID NO: 19254 - protein, 25 aa, artificial
  peptide fold or domain or sub-domain
TDSQEPRIKDHLRAETWGRETDDLQ

SEQ ID NO: 19255 - protein, 30 aa, artificial
  peptide fold or domain or sub-domain
TDSTCIIAASYDAKRSGVKVGTKVYDARRL

SEQ ID NO: 19256 - protein, 27 aa, artificial
  peptide fold or domain or sub-domain
TDTFPELDPATSFPYTPVLDEAEKDLK

SEQ ID NO: 19257 - protein, 28 aa, artificial
  peptide fold or domain or sub-domain
TDTREKLFGYAKTGLLSSSAASGVPQVE

SEQ ID NO: 19258 - protein, 27 aa, artificial
  peptide fold or domain or sub-domain
TDTYYQKLVSSGFSSEKSAELSLILQL

SEQ ID NO: 19259 - protein, 20 aa, artificial
  peptide fold or domain or sub-domain
TDVETLHECGFSKLKSQEIH

SEQ ID NO: 19260 - protein, 29 aa, artificial
  peptide fold or domain or sub-domain
TDVIKDHLNSIVSGARAKEPDAVLADMTR

SEQ ID NO: 19261 - protein, 27 aa, artificial
  peptide fold or domain or sub-domain
TDVKGLRIEEDYKVVSTFRVDYYAKAV

SEQ ID NO: 19262 - protein, 22 aa, artificial
  peptide fold or domain or sub-domain
TDWLEAGPMTDEELTALNTFMV

SEQ ID NO: 19263 - protein, 29 aa, artificial
  peptide fold or domain or sub-domain
TDWLLDCLTFLQAAENMSNLLISFREFAE

SEQ ID NO: 19264 - protein, 24 aa, artificial
  peptide fold or domain or sub-domain
TDWMLKGTGLSFEEFCEKGILTGK

SEQ ID NO: 19265 - protein, 24 aa, artificial
  peptide fold or domain or sub-domain
TDYLDAVAGDVWDAGVVETWPSNY

SEQ ID NO: 19266 - protein, 24 aa, artificial
  peptide fold or domain or sub-domain
TDYLERTSTSWHDLVGRDVLPIWP

SEQ ID NO: 19267 - protein, 24 aa, artificial
  peptide fold or domain or sub-domain
TDYLSLVDSDWASKIGRATSISWP

SEQ ID NO: 19268 - protein, 27 aa, artificial
  peptide fold or domain or sub-domain
TEAEAIERAKNGDPESFEALYGLHKRR

SEQ ID NO: 19269 - protein, 27 aa, artificial
  peptide fold or domain or sub-domain
TEAELVQGLQSGDPAAFERLVRDYSGR

SEQ ID NO: 19270 - protein, 26 aa, artificial
  peptide fold or domain or sub-domain
TEAFREKDTAVQGNIRLSFEDFVTMT

SEQ ID NO: 19271 - protein, 26 aa, artificial
  peptide fold or domain or sub-domain
TEAFRKRDKSMNGVINVHYEDFLEMV

SEQ ID NO: 19272 - protein, 26 aa, artificial
  peptide fold or domain or sub-domain
TEAFRRLDPENTGFITVAYNDYMDIV

SEQ ID NO: 19273 - protein, 23 aa, artificial
  peptide fold or domain or sub-domain
TEAKAVLMKTHNVSEGQAYDLIR

SEQ ID NO: 19274 - protein, 30 aa, artificial
  peptide fold or domain or sub-domain
TEALASSEITWDAAHLDAYLADPEGYVPGT

SEQ ID NO: 19275 - protein, 26 aa, artificial
  peptide fold or domain or sub-domain
TEANGRPAVKLSDNPAKATGDEKEIE

SEQ ID NO: 19276 - protein, 21 aa, artificial
  peptide fold or domain or sub-domain
TEAPYKSTYMTDADGNPFVYP

SEQ ID NO: 19277 - protein, 28 aa, artificial
  peptide fold or domain or sub-domain
TEAPYKSTYMTDADGNPFVYPYFIHDSY

SEQ ID NO: 19278 - protein, 24 aa, artificial
  peptide fold or domain or sub-domain
TEAVFSDPEKLDYMLKRIPLGRTG

SEQ ID NO: 19279 - protein, 27 aa, artificial
  peptide fold or domain or sub-domain
TEAVGKRMGLDVARNSSLWKDAVFVEV

SEQ ID NO: 19280 - protein, 25 aa, artificial
  peptide fold or domain or sub-domain
TEAVGSFSDEFRNELKSGFGSEGQP

SEQ ID NO: 19281 - protein, 25 aa, artificial
  peptide fold or domain or sub-domain
TECKVPEGLENGKISERQDTNLTFV

SEQ ID NO: 19282 - protein, 20 aa, artificial
  peptide fold or domain or sub-domain
TEEGARRLLSDLEDHDPVVV

SEQ ID NO: 19283 - protein, 26 aa, artificial
  peptide fold or domain or sub-domain
TEELRAVLKSLGEDMTDADVDEMIKL

SEQ ID NO: 19284 - protein, 30 aa, artificial
  peptide fold or domain or sub-domain
TEEQQERYREGKMRYIPGPPSVLEVPLNIG

SEQ ID NO: 19285 - protein, 22 aa, artificial
  peptide fold or domain or sub-domain
TEERAAAELAASLDTDPVATLR

SEQ ID NO: 19286 - protein, 21 aa, artificial
  peptide fold or domain or sub-domain
TEEWIGASYTPADQRTEAQNQ

SEQ ID NO: 19287 - protein, 29 aa, artificial
  peptide fold or domain or sub-domain
TEEYKERSLAPMRELFDEDLVKVAEEQLS

SEQ ID NO: 19288 - protein, 29 aa, artificial
  peptide fold or domain or sub-domain
TEEYKQNILKDAESKFDPTTIMAMKEELD

SEQ ID NO: 19289 - protein, 23 aa, artificial
  peptide fold or domain or sub-domain
TEFHMNRMIKEGASRAEAYKKAK

SEQ ID NO: 19290 - protein, 28 aa, artificial
  peptide fold or domain or sub-domain
TEFIQFNYSTNEFLATKPAAEALVQSLN

SEQ ID NO: 19291 - protein, 21 aa, artificial
  peptide fold or domain or sub-domain
TEFVQSFYPALQSNRGTISSF

SEQ ID NO: 19292 - protein, 21 aa, artificial
  peptide fold or domain or sub-domain
TEFVVIDNIGVFAIGMEPKEF

SEQ ID NO: 19293 - protein, 24 aa, artificial
  peptide fold or domain or sub-domain
TEGCVDYWGIYYMNEHLKVYYEVF

SEQ ID NO: 19294 - protein, 26 aa, artificial
  peptide fold or domain or sub-domain
TEGLLRLGLLHGTLEDNLADQSYKRF

SEQ ID NO: 19295 - protein, 24 aa, artificial
  peptide fold or domain or sub-domain
TEIDVKATLKKKIDVDRKPYVILG

SEQ ID NO: 19296 - protein, 24 aa, artificial
  peptide fold or domain or sub-domain
TEIDVTEKFREKLGRDFRDYIILG

SEQ ID NO: 19297 - protein, 20 aa, artificial
  peptide fold or domain or sub-domain
TEIGAMAALPRRSFLKVATA

SEQ ID NO: 19298 - protein, 28 aa, artificial
  peptide fold or domain or sub-domain
TEIGENRLLPITIREKFSQITNEDLVLL

SEQ ID NO: 19299 - protein, 21 aa, artificial
  peptide fold or domain or sub-domain
TEIVSIARKLAMQAQQAHTAY

SEQ ID NO: 19300 - protein, 23 aa, artificial
  peptide fold or domain or sub-domain
TEKFFESATNVRLEGSVLHAQML

SEQ ID NO: 19301 - protein, 26 aa, artificial
  peptide fold or domain or sub-domain
TEKFKEKDTAYSGSATFNYESFMLTV

SEQ ID NO: 19302 - protein, 21 aa, artificial
  peptide fold or domain or sub-domain
TELFSFEYAGRERSLPRNRLL

SEQ ID NO: 19303 - protein, 22 aa, artificial
  peptide fold or domain or sub-domain
TELQQRVGSNRLPRLLLRLAPL

SEQ ID NO: 19304 - protein, 22 aa, artificial
  peptide fold or domain or sub-domain
TELSTQLLGLNVLNDKQKCNVI

SEQ ID NO: 19305 - protein, 29 aa, artificial
  peptide fold or domain or sub-domain
TELVSFAEDPEGVTAVLDDGTGGTRTFRS

SEQ ID NO: 19306 - protein, 30 aa, artificial
  peptide fold or domain or sub-domain
TEMIEAVVRAASEAGDMASQDFFWKYIREQ

SEQ ID NO: 19307 - protein, 28 aa, artificial
  peptide fold or domain or sub-domain
TEMIKKLHSMGFVEYKPYQGVELTEKGA

SEQ ID NO: 19308 - protein, 28 aa, artificial
  peptide fold or domain or sub-domain
TEMILRRDRGEAIPIGWAQDGNGQPTTD

SEQ ID NO: 19309 - protein, 24 aa, artificial
  peptide fold or domain or sub-domain
TEMNLQKAFQQKLHQDFRRYQVLG

SEQ ID NO: 19310 - protein, 23 aa, artificial
  peptide fold or domain or sub-domain
TENIIMAMVKAGGSRQDCHEKIR

SEQ ID NO: 19311 - protein, 20 aa, artificial
  peptide fold or domain or sub-domain
TEQPKPDYVACRDFLFKYAD

SEQ ID NO: 19312 - protein, 28 aa, artificial
  peptide fold or domain or sub-domain
TERHLQHEETLMATANHPLYLSHRAAHQ

SEQ ID NO: 19313 - protein, 29 aa, artificial
  peptide fold or domain or sub-domain
TERYRQHVLETKGKELDEAGKRLLEEDLR

SEQ ID NO: 19314 - protein, 20 aa, artificial
  peptide fold or domain or sub-domain
TESASQRSSGIKSLYVRLRN

SEQ ID NO: 19315 - protein, 26 aa, artificial
  peptide fold or domain or sub-domain
TESFQRQDTNRSGWVQINYDTFMEMC

SEQ ID NO: 19316 - protein, 25 aa, artificial
  peptide fold or domain or sub-domain
TESLLQDMTALGAPADLVEHYAVPI

SEQ ID NO: 19317 - protein, 28 aa, artificial
  peptide fold or domain or sub-domain
TESRALIIRNPKNQLTLDSTLSKSTSHA

SEQ ID NO: 19318 - protein, 24 aa, artificial
  peptide fold or domain or sub-domain
TESVLDNQDFLKLVLSQTPMGRVG

SEQ ID NO: 19319 - protein, 22 aa, artificial
  peptide fold or domain or sub-domain
TESVWFTEDPSPEAAAFWNDCY

SEQ ID NO: 19320 - protein, 30 aa, artificial
  peptide fold or domain or sub-domain
TETASGNNKVMYLSKSEGGSPILVNEDAAK

SEQ ID NO: 19321 - protein, 21 aa, artificial
  peptide fold or domain or sub-domain
TETMKEVRAALDKIDPSIIIL

SEQ ID NO: 19322 - protein, 24 aa, artificial
  peptide fold or domain or sub-domain
TETNLDYVKWDLNRSITEAFSPYL

SEQ ID NO: 19323 - protein, 20 aa, artificial
  peptide fold or domain or sub-domain
TEVAQLKKAGEEEKKMHEAQ

SEQ ID NO: 19324 - protein, 27 aa, artificial
  peptide fold or domain or sub-domain
TEVARWGHDGAGYCVSTSTGEYRAAKL

SEQ ID NO: 19325 - protein, 30 aa, artificial
  peptide fold or domain or sub-domain
TEVKSAHYSDHDSIWKITTASGKVATARYF

SEQ ID NO: 19326 - protein, 28 aa, artificial
  peptide fold or domain or sub-domain
TEVLKRLDELGLIVRVPYRLPVLTPAGE

SEQ ID NO: 19327 - protein, 27 aa, artificial
  peptide fold or domain or sub-domain
TEVLSVRTEGAKKIVSTDSGDLEAKTL

SEQ ID NO: 19328 - protein, 30 aa, artificial
  peptide fold or domain or sub-domain
TEVTSQELDARWQLPPGTTFARLGVATRHY

SEQ ID NO: 19329 - protein, 30 aa, artificial
  peptide fold or domain or sub-domain
TEVVSIGGKTYAASKAEGHNFKAQPDLAEA

SEQ ID NO: 19330 - protein, 28 aa, artificial
  peptide fold or domain or sub-domain
TEYHFQIEERLMRLAGYAELDKHKEMHA

SEQ ID NO: 19331 - protein, 30 aa, artificial
  peptide fold or domain or sub-domain
TFAACAEKSAVTWGGGQYGELGYGPKGKKS

SEQ ID NO: 19332 - protein, 29 aa, artificial
  peptide fold or domain or sub-domain
TFADLRSRVQWLEARGIFVRAIPQPLCLR

SEQ ID NO: 19333 - protein, 22 aa, artificial
  peptide fold or domain or sub-domain
TFAVDWKPGEITWFVDGQQFHR

SEQ ID NO: 19334 - protein, 30 aa, artificial
  peptide fold or domain or sub-domain
TFDDMRKAKIVATSNKAVELGIQVGESGQD

SEQ ID NO: 19335 - protein, 30 aa, artificial
  peptide fold or domain or sub-domain
TFDWKPCSCLGRYLDVQRIKRPHDWENYSD

SEQ ID NO: 19336 - protein, 24 aa, artificial
  peptide fold or domain or sub-domain
TFGEADNWGLHYTVAGEKVYYVQF

SEQ ID NO: 19337 - protein, 30 aa, artificial
  peptide fold or domain or sub-domain
TFGIAAEKAYEEAKYPGSFHVKLYDWLYRI

SEQ ID NO: 19338 - protein, 22 aa, artificial
  peptide fold or domain or sub-domain
TFGNNGLFSSIENNDMPYADLT

SEQ ID NO: 19339 - protein, 24 aa, artificial
  peptide fold or domain or sub-domain
TFGRNPACDYHLGNISRLSNKHFQ

SEQ ID NO: 19340 - protein, 22 aa, artificial
  peptide fold or domain or sub-domain
TFITTQELEDRWPDLAPEERED

SEQ ID NO: 19341 - protein, 29 aa, artificial
  peptide fold or domain or sub-domain
TFIVVTRQRDFAPPGVQVAHSVDEALSLA

SEQ ID NO: 19342 - protein, 27 aa, artificial
  peptide fold or domain or sub-domain
TFKNLKRVAQELGENMTDSEIQEMIDE

SEQ ID NO: 19343 - protein, 28 aa, artificial
  peptide fold or domain or sub-domain
TFLKDFSYNREDFAKAGLQVEFINPIFE

SEQ ID NO: 19344 - protein, 24 aa, artificial
  peptide fold or domain or sub-domain
TFLSNEKTSEIPEVSKGPYPMIVK

SEQ ID NO: 19345 - protein, 28 aa, artificial
  peptide fold or domain or sub-domain
TFLSVGGLTINTETRDVHRSGQKIQLSV

SEQ ID NO: 19346 - protein, 26 aa, artificial
  peptide fold or domain or sub-domain
TFLTARGEDYSMIAGFDAGADDYIAK

SEQ ID NO: 19347 - protein, 24 aa, artificial
  peptide fold or domain or sub-domain
TFLWNGAQPDLEKPEDMYPKVVVQ

SEQ ID NO: 19348 - protein, 24 aa, artificial
  peptide fold or domain or sub-domain
TFLYNGTADGFPDDPEDTYPIVVE

SEQ ID NO: 19349 - protein, 24 aa, artificial
  peptide fold or domain or sub-domain
TFLYSGKQPSVEEIQGPYPEIYKD

SEQ ID NO: 19350 - protein, 24 aa, artificial
  peptide fold or domain or sub-domain
TFLYTGEPVPGPATPSGPYPTIIN

SEQ ID NO: 19351 - protein, 20 aa, artificial
  peptide fold or domain or sub-domain
TFNVEGTPQYENPEFLKIAD

SEQ ID NO: 19352 - protein, 29 aa, artificial
  peptide fold or domain or sub-domain
TFPLWGFLANTDISYDPQQIDAQTCMAWM

SEQ ID NO: 19353 - protein, 28 aa, artificial
  peptide fold or domain or sub-domain
TFQSLIRQRRTIRSYNGGDQGFLNEVFV

SEQ ID NO: 19354 - protein, 29 aa, artificial
  peptide fold or domain or sub-domain
TFRALSNEIVAPTGGDAELAAYERLAAYL

SEQ ID NO: 19355 - protein, 30 aa, artificial
  peptide fold or domain or sub-domain
TFSFAQRLGMDRAAAAQVLAHGSGGTRASA

SEQ ID NO: 19356 - protein, 23 aa, artificial
  peptide fold or domain or sub-domain
TFSITDWITHMPKEVLEKSVNMP

SEQ ID NO: 19357 - protein, 23 aa, artificial
  peptide fold or domain or sub-domain
TFSLLDVETLNTTNKSSIIEYSS

SEQ ID NO: 19358 - protein, 29 aa, artificial
  peptide fold or domain or sub-domain
TFSVDSRDTSLMERVTEYAEKLNLCAEYK

SEQ ID NO: 19359 - protein, 23 aa, artificial
  peptide fold or domain or sub-domain
TFSVTDWLSHTPIAWVEENLGWT

SEQ ID NO: 19360 - protein, 26 aa, artificial
  peptide fold or domain or sub-domain
TFTKDWNVPGFAGEYWFSTHYDLYEK

SEQ ID NO: 19361 - protein, 30 aa, artificial
  peptide fold or domain or sub-domain
TFTWEYRDKDKNYEKIGPITPLEFYREHVK

SEQ ID NO: 19362 - protein, 22 aa, artificial
  peptide fold or domain or sub-domain
TFVAGGESSESERELTVGNVDR

SEQ ID NO: 19363 - protein, 29 aa, artificial
  peptide fold or domain or sub-domain
TFVIMVSPADDPGHPKELVLGSEKRSVAI

SEQ ID NO: 19364 - protein, 26 aa, artificial
  peptide fold or domain or sub-domain
TFVNNVKILGEHYVHYLENTEIGKEL

SEQ ID NO: 19365 - protein, 30 aa, artificial
  peptide fold or domain or sub-domain
TFVSSATWNDGQGRWTVNTEAGEIYKAKYL

SEQ ID NO: 19366 - protein, 27 aa, artificial
  peptide fold or domain or sub-domain
TFVVYMASSHNKITWDEKLNSSKLFSA

SEQ ID NO: 19367 - protein, 24 aa, artificial
  peptide fold or domain or sub-domain
TFYCHKCDGMASLRTCPHTKKDRV

SEQ ID NO: 19368 - protein, 25 aa, artificial
  peptide fold or domain or sub-domain
TFYRFSDFTHISVPGVTTVSMTTDS

SEQ ID NO: 19369 - protein, 29 aa, artificial
  peptide fold or domain or sub-domain
TGADDRWPTWTRDGNHLFFHRLVDEGAGI

SEQ ID NO: 19370 - protein, 23 aa, artificial
  peptide fold or domain or sub-domain
TGALNPLFLDEEYGKKTRFKGRI

SEQ ID NO: 19371 - protein, 24 aa, artificial
  peptide fold or domain or sub-domain
TGAVTGELQQTGGYIDHSSRYKKL

SEQ ID NO: 19372 - protein, 27 aa, artificial
  peptide fold or domain or sub-domain
TGAWAAENGTGIPWFTAGTLCTPDDCT

SEQ ID NO: 19373 - protein, 27 aa, artificial
  peptide fold or domain or sub-domain
TGCLVQEVIHLPESAEAKKLALDAWAS

SEQ ID NO: 19374 - protein, 23 aa, artificial
  peptide fold or domain or sub-domain
TGDFGPVHVDEVYAGATRFGRRL

SEQ ID NO: 19375 - protein, 23 aa, artificial
  peptide fold or domain or sub-domain
TGDFNPVHINQIEAEKTMFKGRI

SEQ ID NO: 19376 - protein, 23 aa, artificial
  peptide fold or domain or sub-domain
TGDFSWLHVNEVRSRQGHFKKRV

SEQ ID NO: 19377 - protein, 24 aa, artificial
  peptide fold or domain or sub-domain
TGDSHPWFDKYNNFSSQGAYESQS

SEQ ID NO: 19378 - protein, 24 aa, artificial
  peptide fold or domain or sub-domain
TGEALNEYPVTFEWPAFRERQAMM

SEQ ID NO: 19379 - protein, 26 aa, artificial
  peptide fold or domain or sub-domain
TGEALNQSVPYVAQYQGPLNSAINYP

SEQ ID NO: 19380 - protein, 25 aa, artificial
  peptide fold or domain or sub-domain
TGEANFLGGVAKLKGVKDFNAESAK

SEQ ID NO: 19381 - protein, 29 aa, artificial
  peptide fold or domain or sub-domain
TGEDLIRAMDELDMPYYAELARKYYIQYR

SEQ ID NO: 19382 - protein, 20 aa, artificial
  peptide fold or domain or sub-domain
TGEFWLDQAKWFPWMQNHQG

SEQ ID NO: 19383 - protein, 30 aa, artificial
  peptide fold or domain or sub-domain
TGEIWTRNSVSVGDGLYRTKDGGNNWQKIP

SEQ ID NO: 19384 - protein, 26 aa, artificial
  peptide fold or domain or sub-domain
TGELEWLMSLLGINPTKSELASMAKD

SEQ ID NO: 19385 - protein, 24 aa, artificial
  peptide fold or domain or sub-domain
TGERLDEQAATDTFGNYRERHDRL

SEQ ID NO: 19386 - protein, 26 aa, artificial
  peptide fold or domain or sub-domain
TGEVFEPSVKTICGYQKDLPSVPNYP

SEQ ID NO: 19387 - protein, 28 aa, artificial
  peptide fold or domain or sub-domain
TGFDCASNTEIQRVRGIGVPPEKIIYAN

SEQ ID NO: 19388 - protein, 22 aa, artificial
  peptide fold or domain or sub-domain
TGFLHTWFQKALKGDPHYRDYY

SEQ ID NO: 19389 - protein, 21 aa, artificial
  peptide fold or domain or sub-domain
TGFYRLARGGDDTTGDALRQV

SEQ ID NO: 19390 - protein, 24 aa, artificial
  peptide fold or domain or sub-domain
TGGAGNDLLNGGAGADRLVGGVGN

SEQ ID NO: 19391 - protein, 22 aa, artificial
  peptide fold or domain or sub-domain
TGGGPFEIAVAQDCLPAYLDLC

SEQ ID NO: 19392 - protein, 27 aa, artificial
  peptide fold or domain or sub-domain
TGGGPFEIAVAQDCLPAYLDLCADIGF

SEQ ID NO: 19393 - protein, 24 aa, artificial
  peptide fold or domain or sub-domain
TGGRPTEQAMYGDYLDHDSRYRRT

SEQ ID NO: 19394 - protein, 28 aa, artificial
  peptide fold or domain or sub-domain
TGGVYSRKREHLEWARREFHVGNLYFNR

SEQ ID NO: 19395 - protein, 21 aa, artificial
  peptide fold or domain or sub-domain
TGILGTYAGHTPRRWVWFTIS

SEQ ID NO: 19396 - protein, 22 aa, artificial
  peptide fold or domain or sub-domain
TGISGSINTLPGLVSTSILDLF

SEQ ID NO: 19397 - protein, 20 aa, artificial
  peptide fold or domain or sub-domain
TGKAEDSVSPHDRDQTKRLI

SEQ ID NO: 19398 - protein, 28 aa, artificial
  peptide fold or domain or sub-domain
TGKHFLNEQVLMQASQYQFYDEHKKEHE

SEQ ID NO: 19399 - protein, 25 aa, artificial
  peptide fold or domain or sub-domain
TGLDTKWGLIVTDEKGNTTKKGTFA

SEQ ID NO: 19400 - protein, 26 aa, artificial
  peptide fold or domain or sub-domain
TGLFEVLRTMPEVAKPLGEEALRDLT

SEQ ID NO: 19401 - protein, 21 aa, artificial
  peptide fold or domain or sub-domain
TGLGDLTDLPAVRQAGLEGAN

SEQ ID NO: 19402 - protein, 20 aa, artificial
  peptide fold or domain or sub-domain
TGLIDPDSKAPLTVVQSIDR

SEQ ID NO: 19403 - protein, 21 aa, artificial
  peptide fold or domain or sub-domain
TGLIGALSHTPLARYTWWLFS

SEQ ID NO: 19404 - protein, 27 aa, artificial
  peptide fold or domain or sub-domain
TGLNAVLTKCGVPKGSFYYYFSSKNDF

SEQ ID NO: 19405 - protein, 27 aa, artificial
  peptide fold or domain or sub-domain
TGLNDIADAVGLSRPALYYYFKSKEAI

SEQ ID NO: 19406 - protein, 28 aa, artificial
  peptide fold or domain or sub-domain
TGLTLQGFAYPLENDVMEVGRPYGISNV

SEQ ID NO: 19407 - protein, 21 aa, artificial
  peptide fold or domain or sub-domain
TGLVGALTKVYSYRFVWWAIS

SEQ ID NO: 19408 - protein, 24 aa, artificial
  peptide fold or domain or sub-domain
TGLVGGENFNHPEPLSHAERYARA

SEQ ID NO: 19409 - protein, 21 aa, artificial
  peptide fold or domain or sub-domain
TGLWAGATVNVAGRAILFIIS

SEQ ID NO: 19410 - protein, 23 aa, artificial
  peptide fold or domain or sub-domain
TGLYTHQIKLLTQANVENNKEKI

SEQ ID NO: 19411 - protein, 28 aa, artificial
  peptide fold or domain or sub-domain
TGMLRKLTEQGLVSHAPYQGARLTAEGE

SEQ ID NO: 19412 - protein, 30 aa, artificial
  peptide fold or domain or sub-domain
TGNAAFFFEKADDPVWKDAAKAYETAKKLD

SEQ ID NO: 19413 - protein, 23 aa, artificial
  peptide fold or domain or sub-domain
TGNWIEIHSNVQYASKTRFGKRL

SEQ ID NO: 19414 - protein, 27 aa, artificial
  peptide fold or domain or sub-domain
TGPAIGVCLDKAFEQQLERQLQSRDEA

SEQ ID NO: 19415 - protein, 20 aa, artificial
  peptide fold or domain or sub-domain
TGPDVVQTVLGESISFEDLG

SEQ ID NO: 19416 - protein, 20 aa, artificial
  peptide fold or domain or sub-domain
TGPQVIKSVTGEDVTADELG

SEQ ID NO: 19417 - protein, 20 aa, artificial
  peptide fold or domain or sub-domain
TGPTMVAEFTGVEISNDELG

SEQ ID NO: 19418 - protein, 27 aa, artificial
  peptide fold or domain or sub-domain
TGQISEPYTIDFKTGNPKLNGLFCERI

SEQ ID NO: 19419 - protein, 25 aa, artificial
  peptide fold or domain or sub-domain
TGQWSGLPKAELAARHPGMLEGEGL

SEQ ID NO: 19420 - protein, 27 aa, artificial
  peptide fold or domain or sub-domain
TGRKYDEAIEALVALGFTQKEAEKALK

SEQ ID NO: 19421 - protein, 24 aa, artificial
  peptide fold or domain or sub-domain
TGSDPQELAGDGVFLDHSERYEAS

SEQ ID NO: 19422 - protein, 24 aa, artificial
  peptide fold or domain or sub-domain
TGSDSRYFNKYGNYGELGAYESKY

SEQ ID NO: 19423 - protein, 22 aa, artificial
  peptide fold or domain or sub-domain
TGSDSVYFNKFGNFHSNGAWQA

SEQ ID NO: 19424 - protein, 24 aa, artificial
  peptide fold or domain or sub-domain
TGSDSVYFNKFGNFHSNGAWQAYL

SEQ ID NO: 19425 - protein, 22 aa, artificial
  peptide fold or domain or sub-domain
TGSGDIGTFQLIVYSPLVDLVS

SEQ ID NO: 19426 - protein, 29 aa, artificial
  peptide fold or domain or sub-domain
TGSGNLDQTAASLEQIDYSYWRKQKVNAL

SEQ ID NO: 19427 - protein, 28 aa, artificial
  peptide fold or domain or sub-domain
TGSMSVEAWARARKESDFKIMAPWLKKM

SEQ ID NO: 19428 - protein, 25 aa, artificial
  peptide fold or domain or sub-domain
TGSPLDEPAKTLKAGVHGVPGGENM

SEQ ID NO: 19429 - protein, 23 aa, artificial
  peptide fold or domain or sub-domain
TGSRTALCTAETNARHLGFEHRP

SEQ ID NO: 19430 - protein, 26 aa, artificial
  peptide fold or domain or sub-domain
TGSSVAAWRKAEYHLKPEYANVATLL

SEQ ID NO: 19431 - protein, 24 aa, artificial
  peptide fold or domain or sub-domain
TGTAVSDLQGLGDDHSHANRYVRL

SEQ ID NO: 19432 - protein, 30 aa, artificial
  peptide fold or domain or sub-domain
TGTAYNVILRKQPPELWDQQYIFDEVKKGL

SEQ ID NO: 19433 - protein, 24 aa, artificial
  peptide fold or domain or sub-domain
TGTDFFAFKDVVARGAGSPYKDWY

SEQ ID NO: 19434 - protein, 29 aa, artificial
  peptide fold or domain or sub-domain
TGTDIIDALDRLGFEDYCLSLQKHLKHFH

SEQ ID NO: 19435 - protein, 30 aa, artificial
  peptide fold or domain or sub-domain
TGTGYLNILKQPYDPKKTPEQIYNETKKLY

SEQ ID NO: 19436 - protein, 30 aa, artificial
  peptide fold or domain or sub-domain
TGTIYSQILKKPPLEEWDPEVVYEESEKGM

SEQ ID NO: 19437 - protein, 30 aa, artificial
  peptide fold or domain or sub-domain
TGTVLQTLVKTGKKTGNDPNQVYVEARSDL

SEQ ID NO: 19438 - protein, 29 aa, artificial
  peptide fold or domain or sub-domain
TGVCTSNKTAFLAKELAMNIVDVNDVEKI

SEQ ID NO: 19439 - protein, 27 aa, artificial
  peptide fold or domain or sub-domain
TGVEEISKETQLGKGALYHHIGNKEAV

SEQ ID NO: 19440 - protein, 21 aa, artificial
  peptide fold or domain or sub-domain
TGVIAGVHPTKTGKWGFFTFS

SEQ ID NO: 19441 - protein, 26 aa, artificial
  peptide fold or domain or sub-domain
TGVIIWRPYFAQYFPMQVVRYSLLIH

SEQ ID NO: 19442 - protein, 27 aa, artificial
  peptide fold or domain or sub-domain
TGVQEIVQEDGGWKVITDTDTFYSDKL

SEQ ID NO: 19443 - protein, 28 aa, artificial
  peptide fold or domain or sub-domain
TGVSLKGFRYPLEGATLEGNWQWAVSNV

SEQ ID NO: 19444 - protein, 28 aa, artificial
  peptide fold or domain or sub-domain
TGVTVTGVHWPLGGAALRWGESLGISNR

SEQ ID NO: 19445 - protein, 30 aa, artificial
  peptide fold or domain or sub-domain
TGVVAYETGGNTAQISLRSSTGDEISIEYG

SEQ ID NO: 19446 - protein, 27 aa, artificial
  peptide fold or domain or sub-domain
TGWAWVSSGGPLFPGYLSASEGVTFES

SEQ ID NO: 19447 - protein, 27 aa, artificial
  peptide fold or domain or sub-domain
TGYFFQEFLALPGFPGYTPNGIEAATS

SEQ ID NO: 19448 - protein, 21 aa, artificial
  peptide fold or domain or sub-domain
TGYPGEISDDITTRIIWGTVS

SEQ ID NO: 19449 - protein, 27 aa, artificial
  peptide fold or domain or sub-domain
TGYSYYKNLTEKTEGETKALFERLAEQ

SEQ ID NO: 19450 - protein, 22 aa, artificial
  peptide fold or domain or sub-domain
THCPIDGDTRKEGKCSCLAEET

SEQ ID NO: 19451 - protein, 22 aa, artificial
  peptide fold or domain or sub-domain
THCPTGDKLREKLKCTCNPKDN

SEQ ID NO: 19452 - protein, 20 aa, artificial
  peptide fold or domain or sub-domain
THDEIRQMDPIAFDHFWNAP

SEQ ID NO: 19453 - protein, 27 aa, artificial
  peptide fold or domain or sub-domain
THDPDILLEVGSFMAIPDFTDLHLWTL

SEQ ID NO: 19454 - protein, 24 aa, artificial
  peptide fold or domain or sub-domain
THETLAAENGADVAKYHKGIGQRS

SEQ ID NO: 19455 - protein, 25 aa, artificial
  peptide fold or domain or sub-domain
THFTYDSGQLLLGYNWMRQATERTL

SEQ ID NO: 19456 - protein, 26 aa, artificial
  peptide fold or domain or sub-domain
THGNTQIKNWSDRWDVTQNSLLGLYD

SEQ ID NO: 19457 - protein, 25 aa, artificial
  peptide fold or domain or sub-domain
THGTPIELNAAKQGLKPEEFIARFH

SEQ ID NO: 19458 - protein, 25 aa, artificial
  peptide fold or domain or sub-domain
THHEATTYWRAMPELKSFEDVQLVE

SEQ ID NO: 19459 - protein, 27 aa, artificial
  peptide fold or domain or sub-domain
THHNMLLATARTLLSAADAEEAVQDAW

SEQ ID NO: 19460 - protein, 25 aa, artificial
  peptide fold or domain or sub-domain
THILKELAEYCGEEKDKEFLRFISS

SEQ ID NO: 19461 - protein, 28 aa, artificial
  peptide fold or domain or sub-domain
THIVSRLLEKGLIERNAHGEITLTATGF

SEQ ID NO: 19462 - protein, 24 aa, artificial
  peptide fold or domain or sub-domain
THKYQFLYKEGEFYYFMHVEDFTQ

SEQ ID NO: 19463 - protein, 22 aa, artificial
  peptide fold or domain or sub-domain
THLHDFVFTLDIPDEAMSAIIT

SEQ ID NO: 19464 - protein, 29 aa, artificial
  peptide fold or domain or sub-domain
THLSEEDFRRKSELYSKMARWEGFEAHAR

SEQ ID NO: 19465 - protein, 28 aa, artificial
  peptide fold or domain or sub-domain
THLWEQCPKCQKIYKQENMTSWHELQDY

SEQ ID NO: 19466 - protein, 29 aa, artificial
  peptide fold or domain or sub-domain
THMNIQVVYENLLKLGVICDYRLPNFLRI

SEQ ID NO: 19467 - protein, 26 aa, artificial
  peptide fold or domain or sub-domain
THNAVNLLRRLHGLSRADAEHQITRA

SEQ ID NO: 19468 - protein, 29 aa, artificial
  peptide fold or domain or sub-domain
THPNAESVARALDARGVAVDVRPPDVLRV

SEQ ID NO: 19469 - protein, 29 aa, artificial
  peptide fold or domain or sub-domain
THQIEEIYSEPELFDPDRFSPQRQEHKKY

SEQ ID NO: 19470 - protein, 23 aa, artificial
  peptide fold or domain or sub-domain
THQPILEKLFKSQSMTQEESHQL

SEQ ID NO: 19471 - protein, 21 aa, artificial
  peptide fold or domain or sub-domain
THQPTIEAHGSDWTQPENIVS

SEQ ID NO: 19472 - protein, 20 aa, artificial
  peptide fold or domain or sub-domain
THRAANNEEKERVKATGAFI

SEQ ID NO: 19473 - protein, 29 aa, artificial
  peptide fold or domain or sub-domain
THSQAYAICQALIAKGIVADFRAPNVLRL

SEQ ID NO: 19474 - protein, 21 aa, artificial
  peptide fold or domain or sub-domain
THTSLFLDINTPKDNEHYKEL

SEQ ID NO: 19475 - protein, 29 aa, artificial
  peptide fold or domain or sub-domain
THVVVVDAGKTGLLPGDIVDIRRIEQLEH

SEQ ID NO: 19476 - protein, 24 aa, artificial
  peptide fold or domain or sub-domain
TIADLAAHLKLTKGTISAVLNNSP

SEQ ID NO: 19477 - protein, 24 aa, artificial
  peptide fold or domain or sub-domain
TIADVARTAGVSTATAGRVLGGYG

SEQ ID NO: 19478 - protein, 22 aa, artificial
  peptide fold or domain or sub-domain
TIAFAMELNEKGLWENGLRFGR

SEQ ID NO: 19479 - protein, 23 aa, artificial
  peptide fold or domain or sub-domain
TIAKNLIGKTVEQMREYLNEEND

SEQ ID NO: 19480 - protein, 29 aa, artificial
  peptide fold or domain or sub-domain
TIALDNGRQFVSTHFENYCSTKGIVLNKT

SEQ ID NO: 19481 - protein, 21 aa, artificial
  peptide fold or domain or sub-domain
TIASHGNKGLLISTSSGNMDS

SEQ ID NO: 19482 - protein, 27 aa, artificial
  peptide fold or domain or sub-domain
TIASSSLKESKGMLGAKVSPDILFTDI

SEQ ID NO: 19483 - protein, 25 aa, artificial
  peptide fold or domain or sub-domain
TIATATSDKTARLWDTENGKVLATL

SEQ ID NO: 19484 - protein, 20 aa, artificial
  peptide fold or domain or sub-domain
TIDQIFEIHGEKKFRECEKR

SEQ ID NO: 19485 - protein, 30 aa, artificial
  peptide fold or domain or sub-domain
TIDQLLDAPLESVTYAAEDLGIKVGMSGRE

SEQ ID NO: 19486 - protein, 28 aa, artificial
  peptide fold or domain or sub-domain
TIDWLVKHGITTEREFCHANRPLYLSML

SEQ ID NO: 19487 - protein, 29 aa, artificial
  peptide fold or domain or sub-domain
TIEFARNICDLPDANSTEFNKRTRFPVID

SEQ ID NO: 19488 - protein, 29 aa, artificial
  peptide fold or domain or sub-domain
TIEIAQNLIGIKDAVTEEFKVDGTKIIEK

SEQ ID NO: 19489 - protein, 25 aa, artificial
  peptide fold or domain or sub-domain
TIEKLDNYEWFSQQDLIIQDTLIAG

SEQ ID NO: 19490 - protein, 29 aa, artificial
  peptide fold or domain or sub-domain
TIESDRGTHFTGQVFAEMLKGLQIHQHLH

SEQ ID NO: 19491 - protein, 29 aa, artificial
  peptide fold or domain or sub-domain
TIFDIQREQGRVSTTVLAERLRNSPASVT

SEQ ID NO: 19492 - protein, 22 aa, artificial
  peptide fold or domain or sub-domain
TIFGVYSDWKNNVKVTVTSPYM

SEQ ID NO: 19493 - protein, 23 aa, artificial
  peptide fold or domain or sub-domain
TIFIKGETVGHASVYGGTQNSVP

SEQ ID NO: 19494 - protein, 24 aa, artificial
  peptide fold or domain or sub-domain
TIFLHKGAPDVWTEDLVGKSVDWP

SEQ ID NO: 19495 - protein, 29 aa, artificial
  peptide fold or domain or sub-domain
TIFSLCEAFGSANENMVSKDLGVSMATVS

SEQ ID NO: 19496 - protein, 30 aa, artificial
  peptide fold or domain or sub-domain
TIFVTCGDKAKIYDDPCETATALTMCGRDE

SEQ ID NO: 19497 - protein, 23 aa, artificial
  peptide fold or domain or sub-domain
TIGAVENNPTKFHLCDKDVSARR

SEQ ID NO: 19498 - protein, 30 aa, artificial
  peptide fold or domain or sub-domain
TIGLFKNGKMVGKLIGARPKADFVKFIEKY

SEQ ID NO: 19499 - protein, 28 aa, artificial
  peptide fold or domain or sub-domain
TIGNDAWATGNPVFKGSSLMFLKPGMQV

SEQ ID NO: 19500 - protein, 20 aa, artificial
  peptide fold or domain or sub-domain
TIGNREEIREAMHGYDLDFA

SEQ ID NO: 19501 - protein, 20 aa, artificial
  peptide fold or domain or sub-domain
TIGNSNEIVEMVRDHQLDVG

SEQ ID NO: 19502 - protein, 23 aa, artificial
  peptide fold or domain or sub-domain
TIGPETLVLPDVEVWLGEARAVP

SEQ ID NO: 19503 - protein, 23 aa, artificial
  peptide fold or domain or sub-domain
TIHDKHEIVVKGGDLMAAFDLKP

SEQ ID NO: 19504 - protein, 29 aa, artificial
  peptide fold or domain or sub-domain
TIHTDNGSNFTGATVRAACDWAGIKQEDG

SEQ ID NO: 19505 - protein, 25 aa, artificial
  peptide fold or domain or sub-domain
TIHVIMTKYAFQIIDNFNETKIIQF

SEQ ID NO: 19506 - protein, 21 aa, artificial
  peptide fold or domain or sub-domain
TIIEIAREKKYLSEEQIKEIL

SEQ ID NO: 19507 - protein, 26 aa, artificial
  peptide fold or domain or sub-domain
TIIRLGVRVPNIGSKKSTWDDIAAQR

SEQ ID NO: 19508 - protein, 24 aa, artificial
  peptide fold or domain or sub-domain
TIITYDDVTHAKPHPEPVQMAMQK

SEQ ID NO: 19509 - protein, 27 aa, artificial
  peptide fold or domain or sub-domain
TIIYVNDTHYWYQSGAFFESNNSIQDA

SEQ ID NO: 19510 - protein, 24 aa, artificial
  peptide fold or domain or sub-domain
TIKDVAKRANVSTTTVSHVINKTR

SEQ ID NO: 19511 - protein, 24 aa, artificial
  peptide fold or domain or sub-domain
TIKEMLAANEQWANDIKEADPQYF

SEQ ID NO: 19512 - protein, 28 aa, artificial
  peptide fold or domain or sub-domain
TIKLIEKNQKEIENANEGDQTILNRMFE

SEQ ID NO: 19513 - protein, 21 aa, artificial
  peptide fold or domain or sub-domain
TIKNHSPDCISVYSPLPGTAP

SEQ ID NO: 19514 - protein, 21 aa, artificial
  peptide fold or domain or sub-domain
TIKQVVIESGILSPTEAERYL

SEQ ID NO: 19515 - protein, 29 aa, artificial
  peptide fold or domain or sub-domain
TIKTDNGPGYVAHTTRSFFQQWGIQHLTG

SEQ ID NO: 19516 - protein, 30 aa, artificial
  peptide fold or domain or sub-domain
TIKVFVPGKPPIDYQGARDAKSISQFAIKQ

SEQ ID NO: 19517 - protein, 28 aa, artificial
  peptide fold or domain or sub-domain
TIKVLRKSLSENSKQKRESIIKRLEIIE

SEQ ID NO: 19518 - protein, 29 aa, artificial
  peptide fold or domain or sub-domain
TILAFRGKMFFELKTTRKWLLPRKINRIF

SEQ ID NO: 19519 - protein, 25 aa, artificial
  peptide fold or domain or sub-domain
TILDNSINGTFLNGKRIGKGNKVII

SEQ ID NO: 19520 - protein, 20 aa, artificial
  peptide fold or domain or sub-domain
TILEFIQKYSWDVFRRKELH

SEQ ID NO: 19521 - protein, 30 aa, artificial
  peptide fold or domain or sub-domain
TILFFKDGEIVDQMIGASSKQAFKEKLDSL

SEQ ID NO: 19522 - protein, 23 aa, artificial
  peptide fold or domain or sub-domain
TILFMTKKSSITSTISEEDVYEI

SEQ ID NO: 19523 - protein, 27 aa, artificial
  peptide fold or domain or sub-domain
TILHYLYHLREQGRAETSIARAVAAIR

SEQ ID NO: 19524 - protein, 25 aa, artificial
  peptide fold or domain or sub-domain
TILVDRNEGGWAHSETGASLELKGL

SEQ ID NO: 19525 - protein, 29 aa, artificial
  peptide fold or domain or sub-domain
TILYLTRGGARAKTRDIAQAMGIKPPSVS

SEQ ID NO: 19526 - protein, 30 aa, artificial
  peptide fold or domain or sub-domain
TIMIFKNGQVVDMLNGAVPKAPFDSWLNES

SEQ ID NO: 19527 - protein, 30 aa, artificial
  peptide fold or domain or sub-domain
TIMLFKNGEQKDTKIGLQQKNSLLDWINKS

SEQ ID NO: 19528 - protein, 22 aa, artificial
  peptide fold or domain or sub-domain
TIMRRAFVKLNASNRIAAVLKA

SEQ ID NO: 19529 - protein, 27 aa, artificial
  peptide fold or domain or sub-domain
TIMSYVQYLQKNGRANSSIVRNIVSIR

SEQ ID NO: 19530 - protein, 30 aa, artificial
  peptide fold or domain or sub-domain
TIMTFSENTKSNGRYTATLDADTKQSSLHI

SEQ ID NO: 19531 - protein, 27 aa, artificial
  peptide fold or domain or sub-domain
TINEIRMVMTNLGEKMSEEDLRELFQD

SEQ ID NO: 19532 - protein, 28 aa, artificial
  peptide fold or domain or sub-domain
TINNLKFARHVEPGNAAIREKLAWAKEK

SEQ ID NO: 19533 - protein, 22 aa, artificial
  peptide fold or domain or sub-domain
TINSIPVSKMTYEEICLLMQCL

SEQ ID NO: 19534 - protein, 22 aa, artificial
  peptide fold or domain or sub-domain
TINWASYMQSQMISEEDYKAIS

SEQ ID NO: 19535 - protein, 23 aa, artificial
  peptide fold or domain or sub-domain
TIPEGFNVIASTSQCSISGIENT

SEQ ID NO: 19536 - protein, 23 aa, artificial
  peptide fold or domain or sub-domain
TIPPELGYGSRGAGNVIPANATL

SEQ ID NO: 19537 - protein, 27 aa, artificial
  peptide fold or domain or sub-domain
TIQLTNSNIFLKDKNTSQEGSLLDEKL

SEQ ID NO: 19538 - protein, 30 aa, artificial
  peptide fold or domain or sub-domain
TIQVWQGGQLVKSLQGGKTKKALVKIIEEF

SEQ ID NO: 19539 - protein, 27 aa, artificial
  peptide fold or domain or sub-domain
TIRDAMVTARKTHLAPKSIQRILSSWR

SEQ ID NO: 19540 - protein, 24 aa, artificial
  peptide fold or domain or sub-domain
TIRDIAEKAGVSINTVSRALNNKP

SEQ ID NO: 19541 - protein, 21 aa, artificial
  peptide fold or domain or sub-domain
TIRDIAVSGGLVTNKEMDKLL

SEQ ID NO: 19542 - protein, 20 aa, artificial
  peptide fold or domain or sub-domain
TIREFFAKEGEPRFRDVEQE

SEQ ID NO: 19543 - protein, 21 aa, artificial
  peptide fold or domain or sub-domain
TIRELCKEKGILADDVLTEAL

SEQ ID NO: 19544 - protein, 20 aa, artificial
  peptide fold or domain or sub-domain
TIRMQVVKKTSSLEGEVVPL

SEQ ID NO: 19545 - protein, 21 aa, artificial
  peptide fold or domain or sub-domain
TIRRGWRYEGQFWAVKGEEHE

SEQ ID NO: 19546 - protein, 23 aa, artificial
  peptide fold or domain or sub-domain
TIRSKYAFGAIGNGDSVPPNSTV

SEQ ID NO: 19547 - protein, 26 aa, artificial
  peptide fold or domain or sub-domain
TISDLFDVLCLNRYYGWYVQSGDLET

SEQ ID NO: 19548 - protein, 27 aa, artificial
  peptide fold or domain or sub-domain
TISDVLIELTKTGKSPRSIARSLSALR

SEQ ID NO: 19549 - protein, 20 aa, artificial
  peptide fold or domain or sub-domain
TISEMFKSKGEEVFRLMETN

SEQ ID NO: 19550 - protein, 22 aa, artificial
  peptide fold or domain or sub-domain
TISIACKLKEALNPQVQAVWQK

SEQ ID NO: 19551 - protein, 23 aa, artificial
  peptide fold or domain or sub-domain
TISIVEANPRKFNLDATELSIRK

SEQ ID NO: 19552 - protein, 22 aa, artificial
  peptide fold or domain or sub-domain
TISKLRHSNPPAAWKGPLKNCA

SEQ ID NO: 19553 - protein, 23 aa, artificial
  peptide fold or domain or sub-domain
TISPDYAYGATGVPGIIPPHATL

SEQ ID NO: 19554 - protein, 23 aa, artificial
  peptide fold or domain or sub-domain
TISRTISTQGMLAVYNSLSEEGK

SEQ ID NO: 19555 - protein, 21 aa, artificial
  peptide fold or domain or sub-domain
TISSVGWFKDERLFSSDSFSV

SEQ ID NO: 19556 - protein, 29 aa, artificial
  peptide fold or domain or sub-domain
TISSVGWFKDERLFSSDSFSVWARNPKQN

SEQ ID NO: 19557 - protein, 24 aa, artificial
  peptide fold or domain or sub-domain
TITDIARRVNMTTITVSRALTKPE

SEQ ID NO: 19558 - protein, 23 aa, artificial
  peptide fold or domain or sub-domain
TITEALKQGGITLMMDRLSNPAK

SEQ ID NO: 19559 - protein, 28 aa, artificial
  peptide fold or domain or sub-domain
TITEALKQGGITLMMDRLSNPAKLRAYA

SEQ ID NO: 19560 - protein, 20 aa, artificial
  peptide fold or domain or sub-domain
TITPKECGIFEYIKSLFPAF

SEQ ID NO: 19561 - protein, 26 aa, artificial
  peptide fold or domain or sub-domain
TITQIIKHAETGYGTAYVYFKNKDDL

SEQ ID NO: 19562 - protein, 28 aa, artificial
  peptide fold or domain or sub-domain
TIVARARDRYHAYKLHALGVEQVIRESF

SEQ ID NO: 19563 - protein, 28 aa, artificial
  peptide fold or domain or sub-domain
TIVARASEPSHIGKLKLAGADRVFLPHH

SEQ ID NO: 19564 - protein, 30 aa, artificial
  peptide fold or domain or sub-domain
TIVDSLNKRITFLEKLSEALQLENTTFCHD

SEQ ID NO: 19565 - protein, 29 aa, artificial
  peptide fold or domain or sub-domain
TIVFAEPEESTKQAETLARELNGTMVLIS

SEQ ID NO: 19566 - protein, 30 aa, artificial
  peptide fold or domain or sub-domain
TIVNETIAEVGASSKADMGKVMGAIMPKVK

SEQ ID NO: 19567 - protein, 27 aa, artificial
  peptide fold or domain or sub-domain
TIVNYLYFLKQQGKSQATISRALSSIK

SEQ ID NO: 19568 - protein, 28 aa, artificial
  peptide fold or domain or sub-domain
TIVQKYALECWETGKSFKEMLKKDENIS

SEQ ID NO: 19569 - protein, 29 aa, artificial
  peptide fold or domain or sub-domain
TIVSQVILKADDELRYPSGGELKNITDFF

SEQ ID NO: 19570 - protein, 28 aa, artificial
  peptide fold or domain or sub-domain
TIVSSIGLKYEMENLALEFGKLISTSNE

SEQ ID NO: 19571 - protein, 29 aa, artificial
  peptide fold or domain or sub-domain
TIYDLEEEGVTPLRARIAERLDQSGPTVS

SEQ ID NO: 19572 - protein, 23 aa, artificial
  peptide fold or domain or sub-domain
TIYDRNGVPIAEDATSPNRSYPN

SEQ ID NO: 19573 - protein, 29 aa, artificial
  peptide fold or domain or sub-domain
TIYKKSLKDNMAKTTEISKDLNIAPGSVT

SEQ ID NO: 19574 - protein, 29 aa, artificial
  peptide fold or domain or sub-domain
TIYQPESQLLLMDEWNTYTHSSNGLLKEV

SEQ ID NO: 19575 - protein, 29 aa, artificial
  peptide fold or domain or sub-domain
TIYRLSDSRKPVTTTDISREMKIAPASVT

SEQ ID NO: 19576 - protein, 20 aa, artificial
  peptide fold or domain or sub-domain
TKAAENKPAPIRDALLKMRL

SEQ ID NO: 19577 - protein, 21 aa, artificial
  peptide fold or domain or sub-domain
TKAIRQSAVKINGEIVKSGSV

SEQ ID NO: 19578 - protein, 26 aa, artificial
  peptide fold or domain or sub-domain
TKALSEYVLSRETSELKAMERMATLM

SEQ ID NO: 19579 - protein, 21 aa, artificial
  peptide fold or domain or sub-domain
TKAQHGAEATAIYTGRGSFDM

SEQ ID NO: 19580 - protein, 27 aa, artificial
  peptide fold or domain or sub-domain
TKATKISTASGRVEVETTRGTIRARHA

SEQ ID NO: 19581 - protein, 21 aa, artificial
  peptide fold or domain or sub-domain
TKAVLAEFGTPARSDKGQSLY

SEQ ID NO: 19582 - protein, 21 aa, artificial
  peptide fold or domain or sub-domain
TKAYHYGKQLIPVTQALEAQM

SEQ ID NO: 19583 - protein, 21 aa, artificial
  peptide fold or domain or sub-domain
TKAYRYGADYVVLPELLEHER

SEQ ID NO: 19584 - protein, 23 aa, artificial
  peptide fold or domain or sub-domain
TKDIESETSGVFKKFLVAIMKAN

SEQ ID NO: 19585 - protein, 29 aa, artificial
  peptide fold or domain or sub-domain
TKDRIFEVGDNRGVTSAETKLATQRVDDA

SEQ ID NO: 19586 - protein, 28 aa, artificial
  peptide fold or domain or sub-domain
TKEAQELGQKYGSYQSLTNVEATNPPEA

SEQ ID NO: 19587 - protein, 28 aa, artificial
  peptide fold or domain or sub-domain
TKEAQQIWLDGLGLPGVIPGITPPADLV

SEQ ID NO: 19588 - protein, 24 aa, artificial
  peptide fold or domain or sub-domain
TKEIIEQGQKLGEIKPDIDAEAAS

SEQ ID NO: 19589 - protein, 30 aa, artificial
  peptide fold or domain or sub-domain
TKEKMHEVMKKNENKYAQIEHPEEVADLVG

SEQ ID NO: 19590 - protein, 26 aa, artificial
  peptide fold or domain or sub-domain
TKELGTVMRSLGQNPTEAELQDMINE

SEQ ID NO: 19591 - protein, 27 aa, artificial
  peptide fold or domain or sub-domain
TKETEAEGMAQPETYWVPSIAPAGLTM

SEQ ID NO: 19592 - protein, 20 aa, artificial
  peptide fold or domain or sub-domain
TKEYERGKEKCARYWPDEGR

SEQ ID NO: 19593 - protein, 24 aa, artificial
  peptide fold or domain or sub-domain
TKFLSQESEIFSQEIGQTYNPDLS

SEQ ID NO: 19594 - protein, 27 aa, artificial
  peptide fold or domain or sub-domain
TKGEDLREQGYMGLHTVGRGSERSPVL

SEQ ID NO: 19595 - protein, 26 aa, artificial
  peptide fold or domain or sub-domain
TKGLVDLGLLEGKPARLIKSEAYKKF

SEQ ID NO: 19596 - protein, 30 aa, artificial
  peptide fold or domain or sub-domain
TKHINSVLAGDQDIGDLLPFPTDTFQLFDE

SEQ ID NO: 19597 - protein, 26 aa, artificial
  peptide fold or domain or sub-domain
TKHLFNAGLIKGSMEDLIKNSICRLF

SEQ ID NO: 19598 - protein, 21 aa, artificial
  peptide fold or domain or sub-domain
TKHYTEAIKRNPKDAKAYSNR

SEQ ID NO: 19599 - protein, 24 aa, artificial
  peptide fold or domain or sub-domain
TKIDHQAAAKAVGLTMQPATVLIY

SEQ ID NO: 19600 - protein, 26 aa, artificial
  peptide fold or domain or sub-domain
TKIEARRLTDVKGRKAVTLRGEVLGI

SEQ ID NO: 19601 - protein, 23 aa, artificial
  peptide fold or domain or sub-domain
TKIGDECIVQSGAVVGGEGFGFV

SEQ ID NO: 19602 - protein, 27 aa, artificial
  peptide fold or domain or sub-domain
TKIIDQDGDNFKTKTNSTFRNYELDFT

SEQ ID NO: 19603 - protein, 22 aa, artificial
  peptide fold or domain or sub-domain
TKILASFFGELLGQEIDPLRNV

SEQ ID NO: 19604 - protein, 30 aa, artificial
  peptide fold or domain or sub-domain
TKILQNIANNVRETKEPWMTNSLPYVMSRG

SEQ ID NO: 19605 - protein, 28 aa, artificial
  peptide fold or domain or sub-domain
TKITIKNLKYECENLSLSAYSNSCLSNA

SEQ ID NO: 19606 - protein, 25 aa, artificial
  peptide fold or domain or sub-domain
TKIVAKPEFANRVSKEFIYVNYENI

SEQ ID NO: 19607 - protein, 24 aa, artificial
  peptide fold or domain or sub-domain
TKIVQGKLVKEPILFEYFHKVSLK

SEQ ID NO: 19608 - protein, 24 aa, artificial
  peptide fold or domain or sub-domain
TKKHFKTFDGDHFAAMKATGMGKA

SEQ ID NO: 19609 - protein, 21 aa, artificial
  peptide fold or domain or sub-domain
TKKLGFADQLFKNVRVVNNQP

SEQ ID NO: 19610 - protein, 26 aa, artificial
  peptide fold or domain or sub-domain
TKLFRKFDTNQEGIATIQYKDFIYAT

SEQ ID NO: 19611 - protein, 23 aa, artificial
  peptide fold or domain or sub-domain
TKLGVVRGEGAYLYTEDGRKVLD

SEQ ID NO: 19612 - protein, 27 aa, artificial
  peptide fold or domain or sub-domain
TKLVASSAILPHVELPWWVREEQVLYG

SEQ ID NO: 19613 - protein, 28 aa, artificial
  peptide fold or domain or sub-domain
TKLVCGDLILDTATKKAYRGSKEIDLTK

SEQ ID NO: 19614 - protein, 28 aa, artificial
  peptide fold or domain or sub-domain
TKMVQKLDKDEYLIYEKYRGLVLTSKGK

SEQ ID NO: 19615 - protein, 24 aa, artificial
  peptide fold or domain or sub-domain
TKNFQVYGGPVAQRVRADIKLRGL

SEQ ID NO: 19616 - protein, 30 aa, artificial
  peptide fold or domain or sub-domain
TKNVDLDSILQKAKENQTLTDLEYNQYITA

SEQ ID NO: 19617 - protein, 27 aa, artificial
  peptide fold or domain or sub-domain
TKPWNYTYDTKTKSVRTHPQFLNVWWD

SEQ ID NO: 19618 - protein, 27 aa, artificial
  peptide fold or domain or sub-domain
TKQKIQIIQYTDKKPHKICLNCSDDYQ

SEQ ID NO: 19619 - protein, 30 aa, artificial
  peptide fold or domain or sub-domain
TKRADFNYGFWTKEDVNGLIALNNTNRPQL

SEQ ID NO: 19620 - protein, 28 aa, artificial
  peptide fold or domain or sub-domain
TKRHFAAEIASMDRTAYPERGAHAYEHE

SEQ ID NO: 19621 - protein, 25 aa, artificial
  peptide fold or domain or sub-domain
TKRLLRLKAGKVTEAKKEELLRKLN

SEQ ID NO: 19622 - protein, 20 aa, artificial
  peptide fold or domain or sub-domain
TKRNMYESKGSSAVADDSKL

SEQ ID NO: 19623 - protein, 20 aa, artificial
  peptide fold or domain or sub-domain
TKSAAQAQKWGGTAGQAFDR

SEQ ID NO: 19624 - protein, 24 aa, artificial
  peptide fold or domain or sub-domain
TKSNVDNDGLWFWDNCEKRYYVRF

SEQ ID NO: 19625 - protein, 24 aa, artificial
  peptide fold or domain or sub-domain
TKTLLEDEAYVNDILAVTPLKRIG

SEQ ID NO: 19626 - protein, 28 aa, artificial
  peptide fold or domain or sub-domain
TKTLNELAAAGYLNHIPYRGVDLTEMGK

SEQ ID NO: 19627 - protein, 21 aa, artificial
  peptide fold or domain or sub-domain
TKTLVEDMAIFCKRKYGRISS

SEQ ID NO: 19628 - protein, 28 aa, artificial
  peptide fold or domain or sub-domain
TKVGEDEFGDFALKKLKEFGVNVIADRI

SEQ ID NO: 19629 - protein, 30 aa, artificial
  peptide fold or domain or sub-domain
TKVLQNIANQVTTAKEKYLEKTFQFCKEHF

SEQ ID NO: 19630 - protein, 29 aa, artificial
  peptide fold or domain or sub-domain
TKVLQRMRKDGGHPARWTGANRTDIALHW

SEQ ID NO: 19631 - protein, 30 aa, artificial
  peptide fold or domain or sub-domain
TKVTEAKWNEAAERWQLTTDNGAPVSCRHY

SEQ ID NO: 19632 - protein, 30 aa, artificial
  peptide fold or domain or sub-domain
TKVVGATFDEEQRMWSLETQDGATFRARFV

SEQ ID NO: 19633 - protein, 28 aa, artificial
  peptide fold or domain or sub-domain
TKYHFDEEEQYFTTLSQGGIEQHKSEHQ

SEQ ID NO: 19634 - protein, 25 aa, artificial
  peptide fold or domain or sub-domain
TKYILISHEENLIMAKKGKEGMVIT

SEQ ID NO: 19635 - protein, 24 aa, artificial
  peptide fold or domain or sub-domain
TKYVKGSYAFDQEVAGFEFVEGAS

SEQ ID NO: 19636 - protein, 21 aa, artificial
  peptide fold or domain or sub-domain
TLAALIYNDDEEILTDACWTL

SEQ ID NO: 19637 - protein, 25 aa, artificial
  peptide fold or domain or sub-domain
TLADLLGKVREQGAMDIMADLACPL

SEQ ID NO: 19638 - protein, 23 aa, artificial
  peptide fold or domain or sub-domain
TLAEAGQGIKGYDSVKVNRGQSR

SEQ ID NO: 19639 - protein, 22 aa, artificial
  peptide fold or domain or sub-domain
TLAELEAQFGPEKARVLFDQMF

SEQ ID NO: 19640 - protein, 22 aa, artificial
  peptide fold or domain or sub-domain
TLAFDPKKGFWCQLLEGGKTKC

SEQ ID NO: 19641 - protein, 27 aa, artificial
  peptide fold or domain or sub-domain
TLAKIFDRAAHEDTTPEHVADTMVEER

SEQ ID NO: 19642 - protein, 24 aa, artificial
  peptide fold or domain or sub-domain
TLAQVAQRANVTAATVSNVLRNPQ

SEQ ID NO: 19643 - protein, 29 aa, artificial
  peptide fold or domain or sub-domain
TLAVATITQAEQQDRFLGRGELDELASYF

SEQ ID NO: 19644 - protein, 29 aa, artificial
  peptide fold or domain or sub-domain
TLCGKELKNGEEGVEIVGHDGFYRISIPN

SEQ ID NO: 19645 - protein, 26 aa, artificial
  peptide fold or domain or sub-domain
TLCSTIAAGSRCEYANDGLAETHWVS

SEQ ID NO: 19646 - protein, 27 aa, artificial
  peptide fold or domain or sub-domain
TLCYCPEPECKYTGVYTDLYRHYHAEH

SEQ ID NO: 19647 - protein, 30 aa, artificial
  peptide fold or domain or sub-domain
TLDDMLSAKVVEASQEAQKVGINPGDVLRN

SEQ ID NO: 19648 - protein, 24 aa, artificial
  peptide fold or domain or sub-domain
TLDDVDSEGNSPTLPHLHGLQNGD

SEQ ID NO: 19649 - protein, 29 aa, artificial
  peptide fold or domain or sub-domain
TLDFHNINSEGFFGYPFLGWATYGRTKMA

SEQ ID NO: 19650 - protein, 20 aa, artificial
  peptide fold or domain or sub-domain
TLDTPMNRKSMPEADFSSWT

SEQ ID NO: 19651 - protein, 25 aa, artificial
  peptide fold or domain or sub-domain
TLDVAGLAIDPIAREASVDGARIDL

SEQ ID NO: 19652 - protein, 25 aa, artificial
  peptide fold or domain or sub-domain
TLEDTSTSGTVINKLKVVKKQTCPL

SEQ ID NO: 19653 - protein, 24 aa, artificial
  peptide fold or domain or sub-domain
TLEEIARRSKGPLWFQLYPWGKGA

SEQ ID NO: 19654 - protein, 20 aa, artificial
  peptide fold or domain or sub-domain
TLEELADEEQDLILHRRADK

SEQ ID NO: 19655 - protein, 30 aa, artificial
  peptide fold or domain or sub-domain
TLEGKRVPVMPSVRTLPCFAFGDFGSRAGG

SEQ ID NO: 19656 - protein, 23 aa, artificial
  peptide fold or domain or sub-domain
TLEGYAKGKRTTDALYDNQMQII

SEQ ID NO: 19657 - protein, 29 aa, artificial
  peptide fold or domain or sub-domain
TLEIAEANLRKAEGKRQTIEANLALRRAR

SEQ ID NO: 19658 - protein, 24 aa, artificial
  peptide fold or domain or sub-domain
TLEMVAALAGVGRGTVSRVINGSD

SEQ ID NO: 19659 - protein, 27 aa, artificial
  peptide fold or domain or sub-domain
TLEPMGMVARDRKDYNPREFHVSALAL

SEQ ID NO: 19660 - protein, 28 aa, artificial
  peptide fold or domain or sub-domain
TLESKNGSSHRILTHSGLNDELLRSVVN

SEQ ID NO: 19661 - protein, 24 aa, artificial
  peptide fold or domain or sub-domain
TLESVAAEIGEALWFQLYPSRDRQ

SEQ ID NO: 19662 - protein, 30 aa, artificial
  peptide fold or domain or sub-domain
TLEYLHPGVEEETVIEESGFEIHIGDYERS

SEQ ID NO: 19663 - protein, 30 aa, artificial
  peptide fold or domain or sub-domain
TLFLWGIPSASQPEGLYMSTDNGGLWTRLN

SEQ ID NO: 19664 - protein, 23 aa, artificial
  peptide fold or domain or sub-domain
TLGCGHCEYCRSGHSNVCPTVSM

SEQ ID NO: 19665 - protein, 30 aa, artificial
  peptide fold or domain or sub-domain
TLGCGHCEYCRSGHSNVCPTVSMPGFSYDG

SEQ ID NO: 19666 - protein, 24 aa, artificial
  peptide fold or domain or sub-domain
TLGGETSRERLAVNAEPSLKTILG

SEQ ID NO: 19667 - protein, 24 aa, artificial
  peptide fold or domain or sub-domain
TLGHIADQLGISTATVSLALRDSP

SEQ ID NO: 19668 - protein, 22 aa, artificial
  peptide fold or domain or sub-domain
TLGTFLELVKRGKIQYDTNWGD

SEQ ID NO: 19669 - protein, 30 aa, artificial
  peptide fold or domain or sub-domain
TLGTFLELVKRGKIQYDTNWGDPAALVDLV

SEQ ID NO: 19670 - protein, 27 aa, artificial
  peptide fold or domain or sub-domain
TLHAPLVRLASIYVSRATAEDAVQNAW

SEQ ID NO: 19671 - protein, 23 aa, artificial
  peptide fold or domain or sub-domain
TLHNSYSSKDGSLRITPELLEKV

SEQ ID NO: 19672 - protein, 23 aa, artificial
  peptide fold or domain or sub-domain
TLIAADQPVGYAKVFGGESRSVK

SEQ ID NO: 19673 - protein, 30 aa, artificial
  peptide fold or domain or sub-domain
TLIDSKAKKTAFLLQAASRFKITNVTIIQE

SEQ ID NO: 19674 - protein, 30 aa, artificial
  peptide fold or domain or sub-domain
TLIDSNNKKINFLNIVIKKLNLKQIEAKHA

SEQ ID NO: 19675 - protein, 30 aa, artificial
  peptide fold or domain or sub-domain
TLILFKDGKPINTIVGTKGKAALLKELADV

SEQ ID NO: 19676 - protein, 30 aa, artificial
  peptide fold or domain or sub-domain
TLILFKDGKVMDTLVGVVSKERLETFVNQS

SEQ ID NO: 19677 - protein, 30 aa, artificial
  peptide fold or domain or sub-domain
TLILFKGGQEVERSIGYKTKDELRRLLEKH

SEQ ID NO: 19678 - protein, 29 aa, artificial
  peptide fold or domain or sub-domain
TLITSDVDERDQPFITGERTREGFYRTKN

SEQ ID NO: 19679 - protein, 30 aa, artificial
  peptide fold or domain or sub-domain
TLIVFKDGKPVAQQMGALPKSQLKAWIDQS

SEQ ID NO: 19680 - protein, 25 aa, artificial
  peptide fold or domain or sub-domain
TLKDSSKYGTFVNGEKLESGSTKTL

SEQ ID NO: 19681 - protein, 24 aa, artificial
  peptide fold or domain or sub-domain
TLKDVSKAAGLSLITVSRALRQPE

SEQ ID NO: 19682 - protein, 20 aa, artificial
  peptide fold or domain or sub-domain
TLKELKATQAERVAERNASK

SEQ ID NO: 19683 - protein, 27 aa, artificial
  peptide fold or domain or sub-domain
TLKFTQDGDSYTVTTITPKTKSEVTFK

SEQ ID NO: 19684 - protein, 30 aa, artificial
  peptide fold or domain or sub-domain
TLKIFRDGEEAGAYDGPRTADGIVSHLKKQ

SEQ ID NO: 19685 - protein, 24 aa, artificial
  peptide fold or domain or sub-domain
TLKLFPKFSGISQGDLAGSPAVAA

SEQ ID NO: 19686 - protein, 30 aa, artificial
  peptide fold or domain or sub-domain
TLKLFRHSEVVEELVGVQPESAIRAAIDRH

SEQ ID NO: 19687 - protein, 21 aa, artificial
  peptide fold or domain or sub-domain
TLKQAALELGYLTEEEFDRIV

SEQ ID NO: 19688 - protein, 29 aa, artificial
  peptide fold or domain or sub-domain
TLKTAQLQKIAQATGIRSAGPKAALISRL

SEQ ID NO: 19689 - protein, 30 aa, artificial
  peptide fold or domain or sub-domain
TLLAARSYGLDETVLASASKTLTRPFMDTV

SEQ ID NO: 19690 - protein, 27 aa, artificial
  peptide fold or domain or sub-domain
TLLAIFNIAQQQSITTNDASKRLADER

SEQ ID NO: 19691 - protein, 28 aa, artificial
  peptide fold or domain or sub-domain
TLLANVIVVQAIVERGSISSTTKSIING

SEQ ID NO: 19692 - protein, 30 aa, artificial
  peptide fold or domain or sub-domain
TLLDANTKKTAFLQQAVIELGLDNVRVVSG

SEQ ID NO: 19693 - protein, 21 aa, artificial
  peptide fold or domain or sub-domain
TLLDEVRDGKRSLDQGSQDLL

SEQ ID NO: 19694 - protein, 22 aa, artificial
  peptide fold or domain or sub-domain
TLLDFFAQNVAVRESFETFKKA

SEQ ID NO: 19695 - protein, 30 aa, artificial
  peptide fold or domain or sub-domain
TLLDSLGKRVRFLRQVQHELKLENIEPVQS

SEQ ID NO: 19696 - protein, 30 aa, artificial
  peptide fold or domain or sub-domain
TLLDSNGKKTRFLTYILQTLMISNVDIISL

SEQ ID NO: 19697 - protein, 30 aa, artificial
  peptide fold or domain or sub-domain
TLLEASKKKVNFLNFLSQVLLFEGIEVIHG

SEQ ID NO: 19698 - protein, 30 aa, artificial
  peptide fold or domain or sub-domain
TLLEATQKKVKFLHSLGSAVGLANIYPEWG

SEQ ID NO: 19699 - protein, 30 aa, artificial
  peptide fold or domain or sub-domain
TLLESINKRCVFLEHVVNVTGLTNVTIVRG

SEQ ID NO: 19700 - protein, 24 aa, artificial
  peptide fold or domain or sub-domain
TLLGDFSDFGMESDGPYPTELTNA

SEQ ID NO: 19701 - protein, 24 aa, artificial
  peptide fold or domain or sub-domain
TLLGSFPHKELSPAGPYPTVVKNP

SEQ ID NO: 19702 - protein, 24 aa, artificial
  peptide fold or domain or sub-domain
TLLGSQNLEKVGMTPEAPYPTTLQ

SEQ ID NO: 19703 - protein, 30 aa, artificial
  peptide fold or domain or sub-domain
TLLLFKNGEVAATKVGALSKGQLKEFLDAN

SEQ ID NO: 19704 - protein, 30 aa, artificial
  peptide fold or domain or sub-domain
TLLLIRGGREVNRLVGAQPKQDIARWLARS

SEQ ID NO: 19705 - protein, 21 aa, artificial
  peptide fold or domain or sub-domain
TLLNMLRSNDMKIVECVVSTL

SEQ ID NO: 19706 - protein, 21 aa, artificial
  peptide fold or domain or sub-domain
TLLNNIRRGEMQSSAELVDLL

SEQ ID NO: 19707 - protein, 20 aa, artificial
  peptide fold or domain or sub-domain
TLLPALYDKQLIDSLKKYWL

SEQ ID NO: 19708 - protein, 21 aa, artificial
  peptide fold or domain or sub-domain
TLLVLDGLVAAEEVAPSQQAI

SEQ ID NO: 19709 - protein, 30 aa, artificial
  peptide fold or domain or sub-domain
TLLVLKDGEVVETSVGFKPKEALQELVNKH

SEQ ID NO: 19710 - protein, 27 aa, artificial
  peptide fold or domain or sub-domain
TLMEVYTRADEQNLATNRVANTIAEEK

SEQ ID NO: 19711 - protein, 24 aa, artificial
  peptide fold or domain or sub-domain
TLMGGETFTQLGFNVVSDYPKKAT

SEQ ID NO: 19712 - protein, 24 aa, artificial
  peptide fold or domain or sub-domain
TLMGNWTEISETSSLSYPTKTQDA

SEQ ID NO: 19713 - protein, 20 aa, artificial
  peptide fold or domain or sub-domain
TLMNWTEGQVIPINDRKIRV

SEQ ID NO: 19714 - protein, 27 aa, artificial
  peptide fold or domain or sub-domain
TLNAMTAMHGIKVAIDIWKDVDPFHDA

SEQ ID NO: 19715 - protein, 20 aa, artificial
  peptide fold or domain or sub-domain
TLNPHNTGHSPGGSSSGSAA

SEQ ID NO: 19716 - protein, 27 aa, artificial
  peptide fold or domain or sub-domain
TLNQVFEISDNDGVTPDEAARTLAGRR

SEQ ID NO: 19717 - protein, 25 aa, artificial
  peptide fold or domain or sub-domain
TLNTCSPITGSMIFSHATEEEMLSN

SEQ ID NO: 19718 - protein, 23 aa, artificial
  peptide fold or domain or sub-domain
TLNTHPMHFDAEFAKASEFKRNL

SEQ ID NO: 19719 - protein, 23 aa, artificial
  peptide fold or domain or sub-domain
TLNTNGQIVKKNDIKVADGDRKT

SEQ ID NO: 19720 - protein, 27 aa, artificial
  peptide fold or domain or sub-domain
TLPEDGIPYWDYNAPKIPNEPRDVSAA

SEQ ID NO: 19721 - protein, 23 aa, artificial
  peptide fold or domain or sub-domain
TLPEVLEVTATTDDGVIMGVRHK

SEQ ID NO: 19722 - protein, 30 aa, artificial
  peptide fold or domain or sub-domain
TLPFGKIPILEVDGLTLHQSLAIARYLTKN

SEQ ID NO: 19723 - protein, 22 aa, artificial
  peptide fold or domain or sub-domain
TLPSSIVSLILQGKELGEASDI

SEQ ID NO: 19724 - protein, 26 aa, artificial
  peptide fold or domain or sub-domain
TLPWAGDADNPEIVAKKKQRAMADVE

SEQ ID NO: 19725 - protein, 26 aa, artificial
  peptide fold or domain or sub-domain
TLPWEDKLTDLNYVMNQKIKYSKDIS

SEQ ID NO: 19726 - protein, 26 aa, artificial
  peptide fold or domain or sub-domain
TLPWMNLQIEQKDLKYAKIHHMKKTI

SEQ ID NO: 19727 - protein, 26 aa, artificial
  peptide fold or domain or sub-domain
TLPWMNLVCNNKNDKYVLIKEKKIKT

SEQ ID NO: 19728 - protein, 28 aa, artificial
  peptide fold or domain or sub-domain
TLQNEVRGLAQGKSEITEDDLKNMQYLR

SEQ ID NO: 19729 - protein, 23 aa, artificial
  peptide fold or domain or sub-domain
TLQPESKNEMSALSYINGKRLNI

SEQ ID NO: 19730 - protein, 20 aa, artificial
  peptide fold or domain or sub-domain
TLQTIVDNEGHIVLREIEER

SEQ ID NO: 19731 - protein, 29 aa, artificial
  peptide fold or domain or sub-domain
TLQVFGIVPDGTLQLLKEALPHLQINCSH

SEQ ID NO: 19732 - protein, 21 aa, artificial
  peptide fold or domain or sub-domain
TLREACARFGVISMQDYDALI

SEQ ID NO: 19733 - protein, 21 aa, artificial
  peptide fold or domain or sub-domain
TLREAGVQLGLLTNEQFDEWI

SEQ ID NO: 19734 - protein, 25 aa, artificial
  peptide fold or domain or sub-domain
TLRFGHLEINKSTRTVHVGDRNPEL

SEQ ID NO: 19735 - protein, 27 aa, artificial
  peptide fold or domain or sub-domain
TLRIDYRSFLDKLWEAMPAEEFVGMVS

SEQ ID NO: 19736 - protein, 24 aa, artificial
  peptide fold or domain or sub-domain
TLRMIATELGISPSTISRVLNTEG

SEQ ID NO: 19737 - protein, 29 aa, artificial
  peptide fold or domain or sub-domain
TLRTDHSGEFLSGEFARVCDEAGIERHLT

SEQ ID NO: 19738 - protein, 30 aa, artificial
  peptide fold or domain or sub-domain
TLRVHEYNGEMHTFSDQWGERMWLAEPERY

SEQ ID NO: 19739 - protein, 28 aa, artificial
  peptide fold or domain or sub-domain
TLRWQYWQGRSEIALGKKKEGTERLKAL

SEQ ID NO: 19740 - protein, 20 aa, artificial
  peptide fold or domain or sub-domain
TLSAHPNLSNAELRSHLQNT

SEQ ID NO: 19741 - protein, 25 aa, artificial
  peptide fold or domain or sub-domain
TLSDALSARKDELPKDLYEDAVTAL

SEQ ID NO: 19742 - protein, 23 aa, artificial
  peptide fold or domain or sub-domain
TLSDFHDNKCPNMPRMTALVRNL

SEQ ID NO: 19743 - protein, 28 aa, artificial
  peptide fold or domain or sub-domain
TLSDGFWKKDIRCHGKTLNFLCEKKILQ

SEQ ID NO: 19744 - protein, 28 aa, artificial
  peptide fold or domain or sub-domain
TLSEAQDFWARAREANDYKVYQPYLERI

SEQ ID NO: 19745 - protein, 24 aa, artificial
  peptide fold or domain or sub-domain
TLSELFEHNRQWAAEKQEKDPEYF

SEQ ID NO: 19746 - protein, 29 aa, artificial
  peptide fold or domain or sub-domain
TLSGSYHELKKWIYEEDLTLFGVTLGSGF

SEQ ID NO: 19747 - protein, 28 aa, artificial
  peptide fold or domain or sub-domain
TLSHFAFEEELMQEAGYPFSQAHQRVHA

SEQ ID NO: 19748 - protein, 27 aa, artificial
  peptide fold or domain or sub-domain
TLSHIAGQYDITMAELMKANGLANPDF

SEQ ID NO: 19749 - protein, 26 aa, artificial
  peptide fold or domain or sub-domain
TLSIDWEAERPRVVWDGGVPINESSC

SEQ ID NO: 19750 - protein, 26 aa, artificial
  peptide fold or domain or sub-domain
TLSKSEIDDVHKDSEHKRFSEEFKIS

SEQ ID NO: 19751 - protein, 20 aa, artificial
  peptide fold or domain or sub-domain
TLSSTYLRQQIQKGGSIRYL

SEQ ID NO: 19752 - protein, 21 aa, artificial
  peptide fold or domain or sub-domain
TLSYVYYGEDSILVGKTAKYM

SEQ ID NO: 19753 - protein, 29 aa, artificial
  peptide fold or domain or sub-domain
TLSYVYYGEDSILVGKTAKYMASANPSNG

SEQ ID NO: 19754 - protein, 21 aa, artificial
  peptide fold or domain or sub-domain
TLSYYYAYGLPTVVVRPFNTY

SEQ ID NO: 19755 - protein, 30 aa, artificial
  peptide fold or domain or sub-domain
TLTAAHRLGLEEDVLEMLEYTEGNDFRESA

SEQ ID NO: 19756 - protein, 30 aa, artificial
  peptide fold or domain or sub-domain
TLTEVAPGIDPGAVIAQLGFDPAVADPLGV

SEQ ID NO: 19757 - protein, 24 aa, artificial
  peptide fold or domain or sub-domain
TLTHDTRVANSRFFDNDVNQVPKY

SEQ ID NO: 19758 - protein, 28 aa, artificial
  peptide fold or domain or sub-domain
TLTHFKEEEDLFDRYDVPGARDHKKIHQ

SEQ ID NO: 19759 - protein, 26 aa, artificial
  peptide fold or domain or sub-domain
TLTKNDLDKANKDKANRYFSPNFKVK

SEQ ID NO: 19760 - protein, 23 aa, artificial
  peptide fold or domain or sub-domain
TLTQFHQGKRSADKKMDKAIKAL

SEQ ID NO: 19761 - protein, 28 aa, artificial
  peptide fold or domain or sub-domain
TLTSDHYGEQFLSSGTLDLWGASPANLC

SEQ ID NO: 19762 - protein, 21 aa, artificial
  peptide fold or domain or sub-domain
TLTTWREDADVVHHGGLTHYI

SEQ ID NO: 19763 - protein, 29 aa, artificial
  peptide fold or domain or sub-domain
TLVAFRGHYFWMLSPFSPPSPARRITEVW

SEQ ID NO: 19764 - protein, 30 aa, artificial
  peptide fold or domain or sub-domain
TLVDSTRKKITFIDTILSELALTNAKTLVS

SEQ ID NO: 19765 - protein, 30 aa, artificial
  peptide fold or domain or sub-domain
TLVDSVGKKIMFLKNVKKSLSLNNINPLNT

SEQ ID NO: 19766 - protein, 23 aa, artificial
  peptide fold or domain or sub-domain
TLVDYLQFGRPFTEGKRSQFMEI

SEQ ID NO: 19767 - protein, 30 aa, artificial
  peptide fold or domain or sub-domain
TLVESNGKKARFLREVVRQLGLSNVGVSEV

SEQ ID NO: 19768 - protein, 24 aa, artificial
  peptide fold or domain or sub-domain
TLVHLYQDGESRAEVQQQDYHDRA

SEQ ID NO: 19769 - protein, 30 aa, artificial
  peptide fold or domain or sub-domain
TLVIFKDGREVGRLVGARPEAMYREIFDKV

SEQ ID NO: 19770 - protein, 30 aa, artificial
  peptide fold or domain or sub-domain
TLVNEAAINALRNHRVIIQNDDFKAVENRV

SEQ ID NO: 19771 - protein, 21 aa, artificial
  peptide fold or domain or sub-domain
TLVRLLHHDDPEVLADTCWAI

SEQ ID NO: 19772 - protein, 26 aa, artificial
  peptide fold or domain or sub-domain
TLVWQNLQFKEKEERFKKIAELKQTT

SEQ ID NO: 19773 - protein, 23 aa, artificial
  peptide fold or domain or sub-domain
TLWAPAASRLTLHHRRAPGAEPA

SEQ ID NO: 19774 - protein, 25 aa, artificial
  peptide fold or domain or sub-domain
TLYDRSANGTYVNVKKLGKDKSCVL

SEQ ID NO: 19775 - protein, 20 aa, artificial
  peptide fold or domain or sub-domain
TLYEAFLDEPLSEMAEFTLH

SEQ ID NO: 19776 - protein, 23 aa, artificial
  peptide fold or domain or sub-domain
TLYNEGEAISDARVWKGLTDKVS

SEQ ID NO: 19777 - protein, 24 aa, artificial
  peptide fold or domain or sub-domain
TLYNRSQAVVDELVAEGGRRAAGP

SEQ ID NO: 19778 - protein, 23 aa, artificial
  peptide fold or domain or sub-domain
TLYPKGYQLKGKETLPVVKGKEK

SEQ ID NO: 19779 - protein, 25 aa, artificial
  peptide fold or domain or sub-domain
TMAASLRMIDVKEPAFMEIHGSLRD

SEQ ID NO: 19780 - protein, 28 aa, artificial
  peptide fold or domain or sub-domain
TMAIKRLRRDALIHVAAEGQLSLTAPGR

SEQ ID NO: 19781 - protein, 26 aa, artificial
  peptide fold or domain or sub-domain
TMASIYELWKAGEFAEAKKVQDSIRE

SEQ ID NO: 19782 - protein, 20 aa, artificial
  peptide fold or domain or sub-domain
TMDLCSKLKDYGLWQLFRTL

SEQ ID NO: 19783 - protein, 30 aa, artificial
  peptide fold or domain or sub-domain
TMDTNSSRLIVGMNNSQVQWFRLPLCNGTI

SEQ ID NO: 19784 - protein, 30 aa, artificial
  peptide fold or domain or sub-domain
TMECLQQCTLFPKDVIQADPGGQDSLLHTA

SEQ ID NO: 19785 - protein, 26 aa, artificial
  peptide fold or domain or sub-domain
TMEQSLRLFFEQKNISKVKSYLYRQW

SEQ ID NO: 19786 - protein, 28 aa, artificial
  peptide fold or domain or sub-domain
TMFFDGKFASPQLFKALGCDDLVNAVFE

SEQ ID NO: 19787 - protein, 28 aa, artificial
  peptide fold or domain or sub-domain
TMGFDTDPQLIGTTIAGVPIYDLAALSE

SEQ ID NO: 19788 - protein, 24 aa, artificial
  peptide fold or domain or sub-domain
TMHDVGKLAQVSAMTVSRVLKDDP

SEQ ID NO: 19789 - protein, 30 aa, artificial
  peptide fold or domain or sub-domain
TMILFHKGKPVGQLVGFRPKHEMYQILDSA

SEQ ID NO: 19790 - protein, 30 aa, artificial
  peptide fold or domain or sub-domain
TMITSAHYDERADKWIVRTDRGETITTRFL

SEQ ID NO: 19791 - protein, 28 aa, artificial
  peptide fold or domain or sub-domain
TMKKQFKKGSGESLDLGEKCTGQANTHD

SEQ ID NO: 19792 - protein, 30 aa, artificial
  peptide fold or domain or sub-domain
TMLIIKGGKVVDQMVGALPKNMIAKKLDEH

SEQ ID NO: 19793 - protein, 20 aa, artificial
  peptide fold or domain or sub-domain
TMLLLTASKTYLRHPDCDSA

SEQ ID NO: 19794 - protein, 29 aa, artificial
  peptide fold or domain or sub-domain
TMLSLSESVNEIRVTDIAAKLSIAKATVT

SEQ ID NO: 19795 - protein, 29 aa, artificial
  peptide fold or domain or sub-domain
TMLSPELFSNPTQFDPDRFAPDRAEDRIH

SEQ ID NO: 19796 - protein, 30 aa, artificial
  peptide fold or domain or sub-domain
TMLVVRDGKVVDTLNGAMPAAALAQRLQPW

SEQ ID NO: 19797 - protein, 29 aa, artificial
  peptide fold or domain or sub-domain
TMMECRRDFLSNLRNIYTDGPMELVKKDP

SEQ ID NO: 19798 - protein, 23 aa, artificial
  peptide fold or domain or sub-domain
TMNANPMHFNAAYASGTEFDERL

SEQ ID NO: 19799 - protein, 23 aa, artificial
  peptide fold or domain or sub-domain
TMNTQALHLDAAWSAGQPFGQRL

SEQ ID NO: 19800 - protein, 21 aa, artificial
  peptide fold or domain or sub-domain
TMPDDEGIKLLDTDPHKAHAR

SEQ ID NO: 19801 - protein, 30 aa, artificial
  peptide fold or domain or sub-domain
TMPFSQLPVFKIDGDIICQSGAILRYAAQK

SEQ ID NO: 19802 - protein, 21 aa, artificial
  peptide fold or domain or sub-domain
TMPNIKSIDDFETNKEDAIAD

SEQ ID NO: 19803 - protein, 21 aa, artificial
  peptide fold or domain or sub-domain
TMPTAETLDTFDKDPANAKAI

SEQ ID NO: 19804 - protein, 24 aa, artificial
  peptide fold or domain or sub-domain
TMQKLISGLSQFQKSDYQHKQSLF

SEQ ID NO: 19805 - protein, 29 aa, artificial
  peptide fold or domain or sub-domain
TMSRPWFEQLEAGIRSGTPPFQLSHGEDL

SEQ ID NO: 19806 - protein, 29 aa, artificial
  peptide fold or domain or sub-domain
TMVFGETQFSTKSSEAIAAEIGAGVELLD

SEQ ID NO: 19807 - protein, 21 aa, artificial
  peptide fold or domain or sub-domain
TMVKLKDYEKLEKTPEKCLGR

SEQ ID NO: 19808 - protein, 21 aa, artificial
  peptide fold or domain or sub-domain
TMYDESTLVDGKISYEKTKAK

SEQ ID NO: 19809 - protein, 27 aa, artificial
  peptide fold or domain or sub-domain
TMYHEESQNLIHLKTQREKSHYLSHCN

SEQ ID NO: 19810 - protein, 22 aa, artificial
  peptide fold or domain or sub-domain
TMYRSYNKSVPYEERINTVLRW

SEQ ID NO: 19811 - protein, 30 aa, artificial
  peptide fold or domain or sub-domain
TMYSNAMPVLDIDGTKMSQSMCIARHLARE

SEQ ID NO: 19812 - protein, 26 aa, artificial
  peptide fold or domain or sub-domain
TNAEIAKEAGVTAAALYYYFPSKEEL

SEQ ID NO: 19813 - protein, 30 aa, artificial
  peptide fold or domain or sub-domain
TNAHENCQNLINSASTDEAAHFSYQECENI

SEQ ID NO: 19814 - protein, 27 aa, artificial
  peptide fold or domain or sub-domain
TNARIWLYRDLTSQPFVQYIAWVSLPV

SEQ ID NO: 19815 - protein, 20 aa, artificial
  peptide fold or domain or sub-domain
TNCHDDNFDRHLAGAPITQA

SEQ ID NO: 19816 - protein, 27 aa, artificial
  peptide fold or domain or sub-domain
TNCQYGFIKDEQEDTNQNDFIGVEFND

SEQ ID NO: 19817 - protein, 20 aa, artificial
  peptide fold or domain or sub-domain
TNDKQLCFYAGSGHDIVNDC

SEQ ID NO: 19818 - protein, 24 aa, artificial
  peptide fold or domain or sub-domain
TNDLVYDDFEINTENPVAHVALAD

SEQ ID NO: 19819 - protein, 26 aa, artificial
  peptide fold or domain or sub-domain
TNDQLKKMEKNGDLTEDDLRGFQDDV

SEQ ID NO: 19820 - protein, 29 aa, artificial
  peptide fold or domain or sub-domain
TNEEEIRSKLSHRAPAHAASIQDKWFGTF

SEQ ID NO: 19821 - protein, 24 aa, artificial
  peptide fold or domain or sub-domain
TNEELASRFGITTEWIFERTGIRQ

SEQ ID NO: 19822 - protein, 20 aa, artificial
  peptide fold or domain or sub-domain
TNEFFKNVVKPILTQQGDKL

SEQ ID NO: 19823 - protein, 27 aa, artificial
  peptide fold or domain or sub-domain
TNETLGYIEAEQVDESHQPLSGVIIPD

SEQ ID NO: 19824 - protein, 27 aa, artificial
  peptide fold or domain or sub-domain
TNFRNYALIFIKNNSIVYVGMWFLFLI

SEQ ID NO: 19825 - protein, 29 aa, artificial
  peptide fold or domain or sub-domain
TNGYFHHNGGSDFSTLENGIYKNLYDLAD

SEQ ID NO: 19826 - protein, 28 aa, artificial
  peptide fold or domain or sub-domain
TNHDVKAVEYYIKEQLEKIFNQVKEYVH

SEQ ID NO: 19827 - protein, 28 aa, artificial
  peptide fold or domain or sub-domain
TNHFQVDLDQHQASRYQGDRQEELELTG

SEQ ID NO: 19828 - protein, 22 aa, artificial
  peptide fold or domain or sub-domain
TNIHFHGTTLPPVCHQDDVLNT

SEQ ID NO: 19829 - protein, 23 aa, artificial
  peptide fold or domain or sub-domain
TNIKEVASQLNLTKTPIYERIKR

SEQ ID NO: 19830 - protein, 25 aa, artificial
  peptide fold or domain or sub-domain
TNILLNFFARRLTNAAEFAQAIGTQ

SEQ ID NO: 19831 - protein, 29 aa, artificial
  peptide fold or domain or sub-domain
TNIVITRNCAFKAESAVITHSLSHACSIA

SEQ ID NO: 19832 - protein, 29 aa, artificial
  peptide fold or domain or sub-domain
TNIVLSRDQSFEPEGAVACETWMEAFEIA

SEQ ID NO: 19833 - protein, 29 aa, artificial
  peptide fold or domain or sub-domain
TNIVVTRKTDWFEEGILIVNTLKEALKHA

SEQ ID NO: 19834 - protein, 24 aa, artificial
  peptide fold or domain or sub-domain
TNKITLGDKHAAIEEDFTGYDLSY

SEQ ID NO: 19835 - protein, 25 aa, artificial
  peptide fold or domain or sub-domain
TNKLIDQILEQDGPVDLVQALALPL

SEQ ID NO: 19836 - protein, 23 aa, artificial
  peptide fold or domain or sub-domain
TNKNDVRELREAIKNGDRWSVRL

SEQ ID NO: 19837 - protein, 25 aa, artificial
  peptide fold or domain or sub-domain
TNKRATTHWASLPRLRELDDVEVVE

SEQ ID NO: 19838 - protein, 24 aa, artificial
  peptide fold or domain or sub-domain
TNKYMIKKENSSENKQLNDNDEDI

SEQ ID NO: 19839 - protein, 27 aa, artificial
  peptide fold or domain or sub-domain
TNLATVAVRTGMTKGALYGHFPSKKAL

SEQ ID NO: 19840 - protein, 29 aa, artificial
  peptide fold or domain or sub-domain
TNLFTHPVFKDGGFTANDRDVRRYALRKT

SEQ ID NO: 19841 - protein, 24 aa, artificial
  peptide fold or domain or sub-domain
TNLLFALDPEQWDYAAMERAIDDE

SEQ ID NO: 19842 - protein, 22 aa, artificial
  peptide fold or domain or sub-domain
TNLMAGEHMKPEFLKINPQHCI

SEQ ID NO: 19843 - protein, 24 aa, artificial
  peptide fold or domain or sub-domain
TNLNRLKGLADGMVGNPQGQAALL

SEQ ID NO: 19844 - protein, 29 aa, artificial
  peptide fold or domain or sub-domain
TNLNRLKGLADGMVGNPQGQAALLRPGEL

SEQ ID NO: 19845 - protein, 29 aa, artificial
  peptide fold or domain or sub-domain
TNLVLTRSGHVPFSEMRAVDSLDVAIVQA

SEQ ID NO: 19846 - protein, 22 aa, artificial
  peptide fold or domain or sub-domain
TNMFLSINNITINHTNQDILTY

SEQ ID NO: 19847 - protein, 30 aa, artificial
  peptide fold or domain or sub-domain
TNNRGLFFEVTKSNYAQVPPHFMESQALNS

SEQ ID NO: 19848 - protein, 22 aa, artificial
  peptide fold or domain or sub-domain
TNNRGVVSNADGSNTRSFNIAK

SEQ ID NO: 19849 - protein, 24 aa, artificial
  peptide fold or domain or sub-domain
TNPDCGSSDKGLGMKAGGHWDPQN

SEQ ID NO: 19850 - protein, 29 aa, artificial
  peptide fold or domain or sub-domain
TNPEADYWAENIRMTESGSAFTLHSPDGS

SEQ ID NO: 19851 - protein, 29 aa, artificial
  peptide fold or domain or sub-domain
TNPKADILVLDYRATSNSYAFKIRIFSQE

SEQ ID NO: 19852 - protein, 28 aa, artificial
  peptide fold or domain or sub-domain
TNQIISDQWRITRDRGKWIKRKGCFITA

SEQ ID NO: 19853 - protein, 20 aa, artificial
  peptide fold or domain or sub-domain
TNRVLKDWKEKDSTHVEWAR

SEQ ID NO: 19854 - protein, 24 aa, artificial
  peptide fold or domain or sub-domain
TNSAKRNPIQEAINTVKMGFQMVE

SEQ ID NO: 19855 - protein, 21 aa, artificial
  peptide fold or domain or sub-domain
TNSHISAVYAPEETHTPEQKE

SEQ ID NO: 19856 - protein, 25 aa, artificial
  peptide fold or domain or sub-domain
TNTAEILTLNQQFRSIEKATNVLSF

SEQ ID NO: 19857 - protein, 22 aa, artificial
  peptide fold or domain or sub-domain
TNTAVISDTKEHRKIPILEDYL

SEQ ID NO: 19858 - protein, 23 aa, artificial
  peptide fold or domain or sub-domain
TNTAVLVAHDSADADRAESFRSL

SEQ ID NO: 19859 - protein, 26 aa, artificial
  peptide fold or domain or sub-domain
TNTCTQVLGGMGLLQPYGLDRLSRLA

SEQ ID NO: 19860 - protein, 22 aa, artificial
  peptide fold or domain or sub-domain
TNTFNKVIQNHNGDRDLQFEFL

SEQ ID NO: 19861 - protein, 27 aa, artificial
  peptide fold or domain or sub-domain
TNTFTTSTSANDLLDDVQTQVAGGNLP

SEQ ID NO: 19862 - protein, 26 aa, artificial
  peptide fold or domain or sub-domain
TNTKQEIFTDQNLPLMTKRNLMKFIK

SEQ ID NO: 19863 - protein, 28 aa, artificial
  peptide fold or domain or sub-domain
TNVLDVDLDKIGNRIGPITVESMKDLDK

SEQ ID NO: 19864 - protein, 25 aa, artificial
  peptide fold or domain or sub-domain
TNVLYELAQYASEPSEQEHLHKMAS

SEQ ID NO: 19865 - protein, 30 aa, artificial
  peptide fold or domain or sub-domain
TNVPLLVLIEAAKNGNEKEVKEYAQVFREH

SEQ ID NO: 19866 - protein, 26 aa, artificial
  peptide fold or domain or sub-domain
TNVSRLSGRLDDLYQLEPGFHLSVLR

SEQ ID NO: 19867 - protein, 28 aa, artificial
  peptide fold or domain or sub-domain
TNVTISGCQYPLSSYTLQLGYSLTISNI

SEQ ID NO: 19868 - protein, 24 aa, artificial
  peptide fold or domain or sub-domain
TNVVGGHFLKEDVGLFDANFFSLS

SEQ ID NO: 19869 - protein, 29 aa, artificial
  peptide fold or domain or sub-domain
TNVVLTHQEDYQAQGAVVVHDVAAVFAYA

SEQ ID NO: 19870 - protein, 27 aa, artificial
  peptide fold or domain or sub-domain
TNYFVATNGDDSNAGTLDKPFATLQKA

SEQ ID NO: 19871 - protein, 20 aa, artificial
  peptide fold or domain or sub-domain
TPAAGIHKLYRNDELDVFKY

SEQ ID NO: 19872 - protein, 21 aa, artificial
  peptide fold or domain or sub-domain
TPACISFGPKNRSIGAAAKSQ

SEQ ID NO: 19873 - protein, 29 aa, artificial
  peptide fold or domain or sub-domain
TPACISFGPKNRSIGAAAKSQVISNAKNT

SEQ ID NO: 19874 - protein, 27 aa, artificial
  peptide fold or domain or sub-domain
TPAELARVLRGIGEAATVAQCRRMIDG

SEQ ID NO: 19875 - protein, 20 aa, artificial
  peptide fold or domain or sub-domain
TPAEQMKAEREQRTESKHRK

SEQ ID NO: 19876 - protein, 27 aa, artificial
  peptide fold or domain or sub-domain
TPAETIERVGSQWHVTTPRGVFTAPWL

SEQ ID NO: 19877 - protein, 21 aa, artificial
  peptide fold or domain or sub-domain
TPAILAFRDGTRTIGEDAQTI

SEQ ID NO: 19878 - protein, 21 aa, artificial
  peptide fold or domain or sub-domain
TPAIVCFGDNERFIGTAGAAS

SEQ ID NO: 19879 - protein, 29 aa, artificial
  peptide fold or domain or sub-domain
TPAIVCFGDNERFIGTAGAASTMMNPKNS

SEQ ID NO: 19880 - protein, 20 aa, artificial
  peptide fold or domain or sub-domain
TPARKLQQAGISAMKADYIR

SEQ ID NO: 19881 - protein, 27 aa, artificial
  peptide fold or domain or sub-domain
TPASGKYNIWGDDLDGDGNLEPAGANP

SEQ ID NO: 19882 - protein, 21 aa, artificial
  peptide fold or domain or sub-domain
TPAVVAYSENEEIVGLAAKQS

SEQ ID NO: 19883 - protein, 29 aa, artificial
  peptide fold or domain or sub-domain
TPAVVAYSENEEIVGLAAKQSRIRNISNT

SEQ ID NO: 19884 - protein, 24 aa, artificial
  peptide fold or domain or sub-domain
TPDASVRYAKLQKNECQVMPYPNP

SEQ ID NO: 19885 - protein, 20 aa, artificial
  peptide fold or domain or sub-domain
TPDETLRSAGLSGNKTKSVK

SEQ ID NO: 19886 - protein, 24 aa, artificial
  peptide fold or domain or sub-domain
TPDSDIADWLATIHLERYRDLFKQ

SEQ ID NO: 19887 - protein, 28 aa, artificial
  peptide fold or domain or sub-domain
TPEAQQIFAETGFRPVNEEVLAKFASQY

SEQ ID NO: 19888 - protein, 30 aa, artificial
  peptide fold or domain or sub-domain
TPEERARRRCQQLWQRGEQCDERAILAQIQ

SEQ ID NO: 19889 - protein, 30 aa, artificial
  peptide fold or domain or sub-domain
TPEVGLKRARARGELDRIEQESFDFFNRTR

SEQ ID NO: 19890 - protein, 21 aa, artificial
  peptide fold or domain or sub-domain
TPEYELELGKPWTNPKLYLKL

SEQ ID NO: 19891 - protein, 27 aa, artificial
  peptide fold or domain or sub-domain
TPFDTYAGIDEPIHVWTPSIAPAGMAL

SEQ ID NO: 19892 - protein, 21 aa, artificial
  peptide fold or domain or sub-domain
TPFPWDSSYNAGFSNSSSLWL

SEQ ID NO: 19893 - protein, 27 aa, artificial
  peptide fold or domain or sub-domain
TPFQESATTIRVRQEDGSLSDVELPLF

SEQ ID NO: 19894 - protein, 26 aa, artificial
  peptide fold or domain or sub-domain
TPFRTLIEEDATITDLLTKEDLDECF

SEQ ID NO: 19895 - protein, 28 aa, artificial
  peptide fold or domain or sub-domain
TPGARDPQTGLMKNCNTTELNGKPFKED

SEQ ID NO: 19896 - protein, 28 aa, artificial
  peptide fold or domain or sub-domain
TPGAVSPYTGRLKGSNSVCLINQPLRED

SEQ ID NO: 19897 - protein, 27 aa, artificial
  peptide fold or domain or sub-domain
TPGEDPYPSTDYWLVGCEECVRDKDPR

SEQ ID NO: 19898 - protein, 26 aa, artificial
  peptide fold or domain or sub-domain
TPGKAATSELLREHYQTVKEFYVRSI

SEQ ID NO: 19899 - protein, 27 aa, artificial
  peptide fold or domain or sub-domain
TPGKYDIPRKESHVGYSLKSVVSRDRR

SEQ ID NO: 19900 - protein, 28 aa, artificial
  peptide fold or domain or sub-domain
TPGRADGSDGVISNSNTICLNGMPLLRD

SEQ ID NO: 19901 - protein, 30 aa, artificial
  peptide fold or domain or sub-domain
TPIGDCRVCSFRMSLLLTGRCTPGDACVAV

SEQ ID NO: 19902 - protein, 23 aa, artificial
  peptide fold or domain or sub-domain
TPIKDFADYMAHATTADAEHREW

SEQ ID NO: 19903 - protein, 28 aa, artificial
  peptide fold or domain or sub-domain
TPILESPLIRERVLQDEATQTEMKTIQE

SEQ ID NO: 19904 - protein, 29 aa, artificial
  peptide fold or domain or sub-domain
TPITEAIAAADTQGRFLSNTELQAVDGRF

SEQ ID NO: 19905 - protein, 27 aa, artificial
  peptide fold or domain or sub-domain
TPIYCTANAIDSINGHHHHPEWNFNVV

SEQ ID NO: 19906 - protein, 28 aa, artificial
  peptide fold or domain or sub-domain
TPKAQAIYAEAGYRPFDRQVFQRYAKQF

SEQ ID NO: 19907 - protein, 24 aa, artificial
  peptide fold or domain or sub-domain
TPKSEIAKDIKEIGLSNQRAEQLK

SEQ ID NO: 19908 - protein, 23 aa, artificial
  peptide fold or domain or sub-domain
TPKVLNIIVKNERINPNIITMAL

SEQ ID NO: 19909 - protein, 26 aa, artificial
  peptide fold or domain or sub-domain
TPLDRLRRAEEPRFGGKSANLGELLS

SEQ ID NO: 19910 - protein, 30 aa, artificial
  peptide fold or domain or sub-domain
TPLDSIRKKIDFVRETAAELGLSNVTPQVG

SEQ ID NO: 19911 - protein, 30 aa, artificial
  peptide fold or domain or sub-domain
TPLENVTALITEYGVIYPPYEVNVPKVLKF

SEQ ID NO: 19912 - protein, 26 aa, artificial
  peptide fold or domain or sub-domain
TPLIDALNQFDNQYNLDQGQAMVYFK

SEQ ID NO: 19913 - protein, 20 aa, artificial
  peptide fold or domain or sub-domain
TPLRDAFYQNSNVPDQDKYT

SEQ ID NO: 19914 - protein, 20 aa, artificial
  peptide fold or domain or sub-domain
TPLRPELFAYVTSEEDVWTA

SEQ ID NO: 19915 - protein, 26 aa, artificial
  peptide fold or domain or sub-domain
TPLSIATSHTDDRLGLEPGTSLAMIR

SEQ ID NO: 19916 - protein, 23 aa, artificial
  peptide fold or domain or sub-domain
TPLSRPNFPLAGRDLLAAGLAVP

SEQ ID NO: 19917 - protein, 22 aa, artificial
  peptide fold or domain or sub-domain
TPLSVMYDEEGAMIRYDVFASS

SEQ ID NO: 19918 - protein, 23 aa, artificial
  peptide fold or domain or sub-domain
TPLVVDHALGSWIHATDGKSYLD

SEQ ID NO: 19919 - protein, 24 aa, artificial
  peptide fold or domain or sub-domain
TPMGPMINPPDPNRPYPEVIASPS

SEQ ID NO: 19920 - protein, 21 aa, artificial
  peptide fold or domain or sub-domain
TPMPWTKDKPNAGFTGPDVKP

SEQ ID NO: 19921 - protein, 21 aa, artificial
  peptide fold or domain or sub-domain
TPMQWDAGKHAGFTAGDPWIP

SEQ ID NO: 19922 - protein, 21 aa, artificial
  peptide fold or domain or sub-domain
TPMQWDDSETAGFSTALPEDF

SEQ ID NO: 19923 - protein, 21 aa, artificial
  peptide fold or domain or sub-domain
TPMQWSPDKNGGFSRAPHHKL

SEQ ID NO: 19924 - protein, 23 aa, artificial
  peptide fold or domain or sub-domain
TPMTILASEGSYVWDGAGNRMLD

SEQ ID NO: 19925 - protein, 24 aa, artificial
  peptide fold or domain or sub-domain
TPNANKRMLKLVTGECDIIPYPLV

SEQ ID NO: 19926 - protein, 27 aa, artificial
  peptide fold or domain or sub-domain
TPNGDPYVGDASLLVGCEACEARGEPR

SEQ ID NO: 19927 - protein, 30 aa, artificial
  peptide fold or domain or sub-domain
TPNLGHICHVKGKDARAPLDGIRSLSSSRS

SEQ ID NO: 19928 - protein, 21 aa, artificial
  peptide fold or domain or sub-domain
TPNVISFKNDERFFAEAAAAM

SEQ ID NO: 19929 - protein, 21 aa, artificial
  peptide fold or domain or sub-domain
TPNVVMIQDGHRTFADAAIGM

SEQ ID NO: 19930 - protein, 29 aa, artificial
  peptide fold or domain or sub-domain
TPNVVMIQDGHRTFADAAIGMQVRYPHLV

SEQ ID NO: 19931 - protein, 27 aa, artificial
  peptide fold or domain or sub-domain
TPPELYIGHHGEKMLESFCKWQHEEFG

SEQ ID NO: 19932 - protein, 27 aa, artificial
  peptide fold or domain or sub-domain
TPPIFEYNHTADGASVIGGYVYRGSEI

SEQ ID NO: 19933 - protein, 30 aa, artificial
  peptide fold or domain or sub-domain
TPPKYSALKYQGRRIGDWTREGMDIEMKPR

SEQ ID NO: 19934 - protein, 30 aa, artificial
  peptide fold or domain or sub-domain
TPPPFSAKKIKGRRAYELARKGKKVELKPV

SEQ ID NO: 19935 - protein, 29 aa, artificial
  peptide fold or domain or sub-domain
TPQDVFVALKDVDLAQFVPSVTQSVNEFE

SEQ ID NO: 19936 - protein, 29 aa, artificial
  peptide fold or domain or sub-domain
TPQDVLSALKEIEFDSFRPQLEQELVIYM

SEQ ID NO: 19937 - protein, 23 aa, artificial
  peptide fold or domain or sub-domain
TPRDILAKNFGVDASVFDKVPEK

SEQ ID NO: 19938 - protein, 20 aa, artificial
  peptide fold or domain or sub-domain
TPSLQRLADTTGVQLTDLTS

SEQ ID NO: 19939 - protein, 21 aa, artificial
  peptide fold or domain or sub-domain
TPSLVSYGERSRFLGEAAKSA

SEQ ID NO: 19940 - protein, 29 aa, artificial
  peptide fold or domain or sub-domain
TPSLVSYGERSRFLGEAAKSAEASNFRNT

SEQ ID NO: 19941 - protein, 29 aa, artificial
  peptide fold or domain or sub-domain
TPSMVNFGEKQRFIGSAAADKINMKPRNT

SEQ ID NO: 19942 - protein, 28 aa, artificial
  peptide fold or domain or sub-domain
TPSNAEARRLIQNRGLRLDGEVLTDPML

SEQ ID NO: 19943 - protein, 22 aa, artificial
  peptide fold or domain or sub-domain
TPSNVLCSYFEGCSINPQSAVE

SEQ ID NO: 19944 - protein, 21 aa, artificial
  peptide fold or domain or sub-domain
TPSVIFFEDGSPVIGSTAKSI

SEQ ID NO: 19945 - protein, 29 aa, artificial
  peptide fold or domain or sub-domain
TPSVIFFEDGSPVIGSTAKSISVSDPTNT

SEQ ID NO: 19946 - protein, 21 aa, artificial
  peptide fold or domain or sub-domain
TPSVINISGENVIVGKPAQRK

SEQ ID NO: 19947 - protein, 29 aa, artificial
  peptide fold or domain or sub-domain
TPSVINISGENVIVGKPAQRKLLTDPEHT

SEQ ID NO: 19948 - protein, 29 aa, artificial
  peptide fold or domain or sub-domain
TPSVIYFSGEEIIVGDDAKEMQAMGDNNI

SEQ ID NO: 19949 - protein, 29 aa, artificial
  peptide fold or domain or sub-domain
TPSVVFFDGDNVIVGDVAKENSKMYPEDV

SEQ ID NO: 19950 - protein, 29 aa, artificial
  peptide fold or domain or sub-domain
TPSVVSFAEDKIFVGEQAIHQYQNNPSRS

SEQ ID NO: 19951 - protein, 21 aa, artificial
  peptide fold or domain or sub-domain
TPSVVSFKNDDIIVGEVAKRQ

SEQ ID NO: 19952 - protein, 21 aa, artificial
  peptide fold or domain or sub-domain
TPSYVAFTDTERLIGDAAKNQ

SEQ ID NO: 19953 - protein, 29 aa, artificial
  peptide fold or domain or sub-domain
TPSYVAFTDTERLIGDAAKNQVAMNPTNT

SEQ ID NO: 19954 - protein, 24 aa, artificial
  peptide fold or domain or sub-domain
TPTCDTAGVVAPIVNVIASLEALE

SEQ ID NO: 19955 - protein, 20 aa, artificial
  peptide fold or domain or sub-domain
TPTEKMREERMDGVASARRD

SEQ ID NO: 19956 - protein, 29 aa, artificial
  peptide fold or domain or sub-domain
TPTFVSFNDKERAIGEAGFSLYLRNVKNT

SEQ ID NO: 19957 - protein, 24 aa, artificial
  peptide fold or domain or sub-domain
TPTPAARLTKLKAGECHISAFPSP

SEQ ID NO: 19958 - protein, 22 aa, artificial
  peptide fold or domain or sub-domain
TPVAIVTTGATTKAGVVAPSLL

SEQ ID NO: 19959 - protein, 27 aa, artificial
  peptide fold or domain or sub-domain
TPVALVDHNESAQSAPNLAELTVTRVV

SEQ ID NO: 19960 - protein, 27 aa, artificial
  peptide fold or domain or sub-domain
TPVASNEVIKALVNLGFSRFEAQNAVQ

SEQ ID NO: 19961 - protein, 26 aa, artificial
  peptide fold or domain or sub-domain
TPVFVSEFGITDASGWGGIDIANAND

SEQ ID NO: 19962 - protein, 28 aa, artificial
  peptide fold or domain or sub-domain
TPVIVHANCVRIGSHSNSDKHTLYRDEN

SEQ ID NO: 19963 - protein, 21 aa, artificial
  peptide fold or domain or sub-domain
TPVIVTLKENERFFGDSAASM

SEQ ID NO: 19964 - protein, 29 aa, artificial
  peptide fold or domain or sub-domain
TPVIVTLKENERFFGDSAASMAIKNPKAT

SEQ ID NO: 19965 - protein, 21 aa, artificial
  peptide fold or domain or sub-domain
TPVLTVPNWDRVPWLEEHRAI

SEQ ID NO: 19966 - protein, 27 aa, artificial
  peptide fold or domain or sub-domain
TPVRSVRPSGAGVEVVTDHETFFADRV

SEQ ID NO: 19967 - protein, 30 aa, artificial
  peptide fold or domain or sub-domain
TPVSVSQKAWKIGGSTMFLDPRMHPTVGQL

SEQ ID NO: 19968 - protein, 23 aa, artificial
  peptide fold or domain or sub-domain
TPYAQIASQLGISEATVHLRIKK

SEQ ID NO: 19969 - protein, 23 aa, artificial
  peptide fold or domain or sub-domain
TPYKAGDSFVTQQIWYGDKSTVD

SEQ ID NO: 19970 - protein, 20 aa, artificial
  peptide fold or domain or sub-domain
TQAGILSAVEKNIIVKTATV

SEQ ID NO: 19971 - protein, 30 aa, artificial
  peptide fold or domain or sub-domain
TQAINKVIAKCRAENDYATEDFMMWYVAEQ

SEQ ID NO: 19972 - protein, 26 aa, artificial
  peptide fold or domain or sub-domain
TQARVLEAILKHGDVEEAVRIVKEVT

SEQ ID NO: 19973 - protein, 20 aa, artificial
  peptide fold or domain or sub-domain
TQAVEGQTPDTNPAFIGFKS

SEQ ID NO: 19974 - protein, 22 aa, artificial
  peptide fold or domain or sub-domain
TQAWADSFGLLDDLETRLSFNQ

SEQ ID NO: 19975 - protein, 29 aa, artificial
  peptide fold or domain or sub-domain
TQAYVAGVLAAREKELSADDLELLKEELR

SEQ ID NO: 19976 - protein, 23 aa, artificial
  peptide fold or domain or sub-domain
TQDAVYADLWRTITAGGTWEGEL

SEQ ID NO: 19977 - protein, 20 aa, artificial
  peptide fold or domain or sub-domain
TQDGNNNAYCQDNDITWLKW

SEQ ID NO: 19978 - protein, 28 aa, artificial
  peptide fold or domain or sub-domain
TQEGQIVYVDGAKITLSLNDNETIDTEL

SEQ ID NO: 19979 - protein, 21 aa, artificial
  peptide fold or domain or sub-domain
TQEVADAVEAATNQSLDRRGI

SEQ ID NO: 19980 - protein, 26 aa, artificial
  peptide fold or domain or sub-domain
TQFKVAEIVLKTGSVDEAVDYVRNII

SEQ ID NO: 19981 - protein, 23 aa, artificial
  peptide fold or domain or sub-domain
TQFLGDGPPVPLQAASRAERHRM

SEQ ID NO: 19982 - protein, 21 aa, artificial
  peptide fold or domain or sub-domain
TQFVNVFYNAFDTNKANLANF

SEQ ID NO: 19983 - protein, 21 aa, artificial
  peptide fold or domain or sub-domain
TQGAFEDGSDWKENPEKMMSR

SEQ ID NO: 19984 - protein, 28 aa, artificial
  peptide fold or domain or sub-domain
TQGIEYLKKHGLVLQEKYGPVELTASGK

SEQ ID NO: 19985 - protein, 26 aa, artificial
  peptide fold or domain or sub-domain
TQGLLDLGILTGNLHDNIERLTYRQY

SEQ ID NO: 19986 - protein, 26 aa, artificial
  peptide fold or domain or sub-domain
TQGLVRLRILQGEVDQLIEEGVYKRF

SEQ ID NO: 19987 - protein, 27 aa, artificial
  peptide fold or domain or sub-domain
TQGRIALTAEDNAPQVRVCDRCMAEVS

SEQ ID NO: 19988 - protein, 29 aa, artificial
  peptide fold or domain or sub-domain
TQGSAGTSGSYPCVGGWGWKGWYGYETIP

SEQ ID NO: 19989 - protein, 27 aa, artificial
  peptide fold or domain or sub-domain
TQGVTRPRLDEAQALGLPHRTHVWHRE

SEQ ID NO: 19990 - protein, 29 aa, artificial
  peptide fold or domain or sub-domain
TQIAICPNNHEVHIYEKSGNKWVQVHELK

SEQ ID NO: 19991 - protein, 30 aa, artificial
  peptide fold or domain or sub-domain
TQIWKIDGFNKIEIKPEEKGVLFEAESYII

SEQ ID NO: 19992 - protein, 22 aa, artificial
  peptide fold or domain or sub-domain
TQKLKSAQFRVNQSHHRVFAIP

SEQ ID NO: 19993 - protein, 24 aa, artificial
  peptide fold or domain or sub-domain
TQKRLDDPEGREKSMSRIPWHRAG

SEQ ID NO: 19994 - protein, 20 aa, artificial
  peptide fold or domain or sub-domain
TQKSGSHENQNILTNGSNQT

SEQ ID NO: 19995 - protein, 27 aa, artificial
  peptide fold or domain or sub-domain
TQLELGSLLRALGVKPSPDQFETLIDK

SEQ ID NO: 19996 - protein, 25 aa, artificial
  peptide fold or domain or sub-domain
TQLGNGLSINNNAIAINAGGGLTIS

SEQ ID NO: 19997 - protein, 23 aa, artificial
  peptide fold or domain or sub-domain
TQLIKEECKAEYRDGLTMLVKGN

SEQ ID NO: 19998 - protein, 22 aa, artificial
  peptide fold or domain or sub-domain
TQLNKCILESNKLDVNQISKII

SEQ ID NO: 19999 - protein, 29 aa, artificial
  peptide fold or domain or sub-domain
TQLPQIMDFKTTDGKGTLLQYVAEILDTV

SEQ ID NO: 20000 - protein, 29 aa, artificial
  peptide fold or domain or sub-domain
TQLTSTSEQIMKDELLIEKSLIDTVVHYS

SEQ ID NO: 20001 - protein, 26 aa, artificial
  peptide fold or domain or sub-domain
TQMDPNVSQIDDTYAEKGWFVSTMPD

SEQ ID NO: 20002 - protein, 30 aa, artificial
  peptide fold or domain or sub-domain
TQMLLTHFNDAERESMRLAEAGVAQPAYDQ

SEQ ID NO: 20003 - protein, 24 aa, artificial
  peptide fold or domain or sub-domain
TQMTNNSGAPMYVQGGGNINSTPS

SEQ ID NO: 20004 - protein, 27 aa, artificial
  peptide fold or domain or sub-domain
TQMTTEPQSDELNLIQQSDQTEAVVRE

SEQ ID NO: 20005 - protein, 22 aa, artificial
  peptide fold or domain or sub-domain
TQNSIVLVPERELKVGIVDEKM

SEQ ID NO: 20006 - protein, 23 aa, artificial
  peptide fold or domain or sub-domain
TQNTARLHFDQHYAAQTGFGRTL

SEQ ID NO: 20007 - protein, 21 aa, artificial
  peptide fold or domain or sub-domain
TQNVVGFTVEERFIGEQGALQ

SEQ ID NO: 20008 - protein, 29 aa, artificial
  peptide fold or domain or sub-domain
TQPVSEWITGKDYQNNSASISTTQFDSWL

SEQ ID NO: 20009 - protein, 26 aa, artificial
  peptide fold or domain or sub-domain
TQQAVIRALLEDGDVNLAKKIIKNTI

SEQ ID NO: 20010 - protein, 21 aa, artificial
  peptide fold or domain or sub-domain
TQRFPFLEFHLFVHDEVKAEF

SEQ ID NO: 20011 - protein, 26 aa, artificial
  peptide fold or domain or sub-domain
TQRRVLKRILADNDPEAALKEIHEVL

SEQ ID NO: 20012 - protein, 29 aa, artificial
  peptide fold or domain or sub-domain
TQRYLEQVKATLRPLVSGERSATVFRQLD

SEQ ID NO: 20013 - protein, 30 aa, artificial
  peptide fold or domain or sub-domain
TQSIYNILELASEEKDHATVSFLKWFVDEQ

SEQ ID NO: 20014 - protein, 27 aa, artificial
  peptide fold or domain or sub-domain
TQSLLTALFESLKSQQWARASQYCDKL

SEQ ID NO: 20015 - protein, 27 aa, artificial
  peptide fold or domain or sub-domain
TQTPERLLAAGARLVVDDFNDAALWAL

SEQ ID NO: 20016 - protein, 22 aa, artificial
  peptide fold or domain or sub-domain
TQVTFYRDGSALGPPGPNREFS

SEQ ID NO: 20017 - protein, 24 aa, artificial
  peptide fold or domain or sub-domain
TRADVARVAGTSVAVVSYVINNGP

SEQ ID NO: 20018 - protein, 20 aa, artificial
  peptide fold or domain or sub-domain
TRAEAEARFPSFLAEAAEDP

SEQ ID NO: 20019 - protein, 21 aa, artificial
  peptide fold or domain or sub-domain
TRAKGVTDEAGLPRLAASFGH

SEQ ID NO: 20020 - protein, 25 aa, artificial
  peptide fold or domain or sub-domain
TRARDMWQQIKKTHGATFEVSAVLN

SEQ ID NO: 20021 - protein, 23 aa, artificial
  peptide fold or domain or sub-domain
TRCVRCGRARSVYRFFGLCRICL

SEQ ID NO: 20022 - protein, 25 aa, artificial
  peptide fold or domain or sub-domain
TRDRNIEQLRKLQGQAQVNRLAEFN

SEQ ID NO: 20023 - protein, 23 aa, artificial
  peptide fold or domain or sub-domain
TRDVVGDTSFGYKGFLLALVGRE

SEQ ID NO: 20024 - protein, 21 aa, artificial
  peptide fold or domain or sub-domain
TREATFVTKNAKGQVVNRCDG

SEQ ID NO: 20025 - protein, 26 aa, artificial
  peptide fold or domain or sub-domain
TREFSRYDCRGIGHTVFSFEQFLTSA

SEQ ID NO: 20026 - protein, 27 aa, artificial
  peptide fold or domain or sub-domain
TREIVEEVRGRHPHAPWAPRIDGIAAS

SEQ ID NO: 20027 - protein, 23 aa, artificial
  peptide fold or domain or sub-domain
TREKVDSMGPIRCPDASVAGLMV

SEQ ID NO: 20028 - protein, 24 aa, artificial
  peptide fold or domain or sub-domain
TRELFDDTDFDTSFTDSIPLKRWG

SEQ ID NO: 20029 - protein, 25 aa, artificial
  peptide fold or domain or sub-domain
TRELQAGDSIGYGAAWTADAPTRMG

SEQ ID NO: 20030 - protein, 24 aa, artificial
  peptide fold or domain or sub-domain
TREMLKDEKIKQAIISKIPLQRIG

SEQ ID NO: 20031 - protein, 21 aa, artificial
  peptide fold or domain or sub-domain
TRFCKENINDKNFPFWLWIES

SEQ ID NO: 20032 - protein, 28 aa, artificial
  peptide fold or domain or sub-domain
TRFILNTKEGITKLRGTWGSFFGIPVMP

SEQ ID NO: 20033 - protein, 22 aa, artificial
  peptide fold or domain or sub-domain
TRFKKHLDKKTAMTPVGTPCWT

SEQ ID NO: 20034 - protein, 24 aa, artificial
  peptide fold or domain or sub-domain
TRGLEHRGKLDGNQDLIRFAQTLE

SEQ ID NO: 20035 - protein, 24 aa, artificial
  peptide fold or domain or sub-domain
TRHLNSICPTRFATNSTFTNARLP

SEQ ID NO: 20036 - protein, 30 aa, artificial
  peptide fold or domain or sub-domain
TRIAKMEWQEEARRWRLTTEAGETVTAKYV

SEQ ID NO: 20037 - protein, 30 aa, artificial
  peptide fold or domain or sub-domain
TRIKSAHWQDAERTWLFVDEAGFHYRARFF

SEQ ID NO: 20038 - protein, 30 aa, artificial
  peptide fold or domain or sub-domain
TRISDRIRRLQELVPNMDKQTNTADMLEEA

SEQ ID NO: 20039 - protein, 25 aa, artificial
  peptide fold or domain or sub-domain
TRKAHWDGDKPLPYTVTCGAAENYH

SEQ ID NO: 20040 - protein, 29 aa, artificial
  peptide fold or domain or sub-domain
TRKVTINGSVMKEYWGEGSSRGVDSYVPY

SEQ ID NO: 20041 - protein, 28 aa, artificial
  peptide fold or domain or sub-domain
TRLGDDDAGRSLLQALREAGVRLDAIEV

SEQ ID NO: 20042 - protein, 27 aa, artificial
  peptide fold or domain or sub-domain
TRLILVDTATVPRLPLLGDTPIPTIII

SEQ ID NO: 20043 - protein, 30 aa, artificial
  peptide fold or domain or sub-domain
TRLMEIIPIQDLCGIGVKTRKQLNSLGIQT

SEQ ID NO: 20044 - protein, 26 aa, artificial
  peptide fold or domain or sub-domain
TRLQAMVSLANTKHDLDLVKEQLEEE

SEQ ID NO: 20045 - protein, 28 aa, artificial
  peptide fold or domain or sub-domain
TRLTLQRVKYPLTQHDVPVGGSLTVSNE

SEQ ID NO: 20046 - protein, 27 aa, artificial
  peptide fold or domain or sub-domain
TRMDDVADAVGLNKATVYHYYASKSLI

SEQ ID NO: 20047 - protein, 21 aa, artificial
  peptide fold or domain or sub-domain
TRNDITGAPSNPDVFSYGIET

SEQ ID NO: 20048 - protein, 21 aa, artificial
  peptide fold or domain or sub-domain
TRNIVGYGPAQRFTGEAANAQ

SEQ ID NO: 20049 - protein, 29 aa, artificial
  peptide fold or domain or sub-domain
TRNRIIETEEESRPSASEVANATQRVDDA

SEQ ID NO: 20050 - protein, 29 aa, artificial
  peptide fold or domain or sub-domain
TRNRVIEVENSTNVTTAEQLNAVRRTDDA

SEQ ID NO: 20051 - protein, 24 aa, artificial
  peptide fold or domain or sub-domain
TRNVQYLYREDNYIYVMNTETYDQ

SEQ ID NO: 20052 - protein, 24 aa, artificial
  peptide fold or domain or sub-domain
TRNYFTHFGNMSDAEMKTTGVGKA

SEQ ID NO: 20053 - protein, 21 aa, artificial
  peptide fold or domain or sub-domain
TRPHPDDVDKLETDPLAVRSR

SEQ ID NO: 20054 - protein, 22 aa, artificial
  peptide fold or domain or sub-domain
TRPTEWFEYDGSVPGTTRVDQA

SEQ ID NO: 20055 - protein, 29 aa, artificial
  peptide fold or domain or sub-domain
TRPVWGWLTEPGDTSHVTADGSIDPEAWF

SEQ ID NO: 20056 - protein, 25 aa, artificial
  peptide fold or domain or sub-domain
TRQTLLTNAAKWFPFGSDDSASTTT

SEQ ID NO: 20057 - protein, 25 aa, artificial
  peptide fold or domain or sub-domain
TRRLVLDNYSHLEGEDLIEVAVAEN

SEQ ID NO: 20058 - protein, 25 aa, artificial
  peptide fold or domain or sub-domain
TRRLVMDNYQGYSHEKLLKIAIEQN

SEQ ID NO: 20059 - protein, 27 aa, artificial
  peptide fold or domain or sub-domain
TRRRKLLKYLKKSSVLRYNNLIESLAL

SEQ ID NO: 20060 - protein, 23 aa, artificial
  peptide fold or domain or sub-domain
TRSDEEWRTLLDEQQYYVMRQHG

SEQ ID NO: 20061 - protein, 28 aa, artificial
  peptide fold or domain or sub-domain
TRSGLAEQQRLAVANCLAHRRLMSDGSE

SEQ ID NO: 20062 - protein, 21 aa, artificial
  peptide fold or domain or sub-domain
TRSLVAYDQDKLLVGNQAYNQ

SEQ ID NO: 20063 - protein, 27 aa, artificial
  peptide fold or domain or sub-domain
TRSSPATYPEALFRAPEQAADLGLYIR

SEQ ID NO: 20064 - protein, 21 aa, artificial
  peptide fold or domain or sub-domain
TRSVAFAHAHVGYDPVSLVHD

SEQ ID NO: 20065 - protein, 29 aa, artificial
  peptide fold or domain or sub-domain
TRTFADTVQNVTLYKKNPNVQKVMNEQAK

SEQ ID NO: 20066 - protein, 28 aa, artificial
  peptide fold or domain or sub-domain
TRTGEDAFGKYLHRELRKFNVDDTFVTS

SEQ ID NO: 20067 - protein, 30 aa, artificial
  peptide fold or domain or sub-domain
TRTPLILLIEAAKEGHEENTRYRSKMFQEH

SEQ ID NO: 20068 - protein, 20 aa, artificial
  peptide fold or domain or sub-domain
TRTVQVKGARVSKLWASLTI

SEQ ID NO: 20069 - protein, 22 aa, artificial
  peptide fold or domain or sub-domain
TRTWLLEKRLMPADKVEEYADG

SEQ ID NO: 20070 - protein, 30 aa, artificial
  peptide fold or domain or sub-domain
TRVEAARYDDSNSCWQVTLDSGEIVSCRFL

SEQ ID NO: 20071 - protein, 27 aa, artificial
  peptide fold or domain or sub-domain
TRVEDFDISPDSVKIETANGSYTADKL

SEQ ID NO: 20072 - protein, 27 aa, artificial
  peptide fold or domain or sub-domain
TRVEDIAERVGVTKGTVYVYFETKEAL

SEQ ID NO: 20073 - protein, 21 aa, artificial
  peptide fold or domain or sub-domain
TRVFLDSITQFRYLTPDTFQF

SEQ ID NO: 20074 - protein, 28 aa, artificial
  peptide fold or domain or sub-domain
TRVGDDLLGRALVDDMRREGVEVHAAVD

SEQ ID NO: 20075 - protein, 22 aa, artificial
  peptide fold or domain or sub-domain
TRVPEDGVIYGSLYSSVDEAQD

SEQ ID NO: 20076 - protein, 30 aa, artificial
  peptide fold or domain or sub-domain
TRVPVRDADLLSHAPVTRRHAGKDMTVRDL

SEQ ID NO: 20077 - protein, 30 aa, artificial
  peptide fold or domain or sub-domain
TRVQSASFDESNGVWRVETVDGQVVTARFC

SEQ ID NO: 20078 - protein, 30 aa, artificial
  peptide fold or domain or sub-domain
TRVRSAHYNEEENHWTITTEQGESYTCTYF

SEQ ID NO: 20079 - protein, 30 aa, artificial
  peptide fold or domain or sub-domain
TRVTSMVWNDEGQYWTVGTDDGRTCTARYV

SEQ ID NO: 20080 - protein, 30 aa, artificial
  peptide fold or domain or sub-domain
TRVVGATWNAAERLWEVQLDNGETRRGRYL

SEQ ID NO: 20081 - protein, 27 aa, artificial
  peptide fold or domain or sub-domain
TRWSDFEKRKETIENFNKTSKIVKRGI

SEQ ID NO: 20082 - protein, 25 aa, artificial
  peptide fold or domain or sub-domain
TRYVTIRADDRSVYGKKGSAGVITV

SEQ ID NO: 20083 - protein, 20 aa, artificial
  peptide fold or domain or sub-domain
TRYYSIEHCAREIGVDGETL

SEQ ID NO: 20084 - protein, 25 aa, artificial
  peptide fold or domain or sub-domain
TSAELDLHRLNTERRVPVVCASMML

SEQ ID NO: 20085 - protein, 30 aa, artificial
  peptide fold or domain or sub-domain
TSAFIRNRADFFRHFIDEEMDIKDFCTHEV

SEQ ID NO: 20086 - protein, 30 aa, artificial
  peptide fold or domain or sub-domain
TSAFLKQNSEEYAPFIDEGMTVAQYCEQEI

SEQ ID NO: 20087 - protein, 28 aa, artificial
  peptide fold or domain or sub-domain
TSAIDAIVNVNAASSKREAREFINAKAI

SEQ ID NO: 20088 - protein, 30 aa, artificial
  peptide fold or domain or sub-domain
TSAIFTNNVNYMMRASNELEFGETYVNRES

SEQ ID NO: 20089 - protein, 25 aa, artificial
  peptide fold or domain or sub-domain
TSAIIEAGLKQGMAVASLMEQWELL

SEQ ID NO: 20090 - protein, 22 aa, artificial
  peptide fold or domain or sub-domain
TSAKHPWFLEAVSYLESLKEGE

SEQ ID NO: 20091 - protein, 24 aa, artificial
  peptide fold or domain or sub-domain
TSALSSMDQDWKNGPGNGRLVNWP

SEQ ID NO: 20092 - protein, 22 aa, artificial
  peptide fold or domain or sub-domain
TSATVVTDTETKTKHIIFDDVM

SEQ ID NO: 20093 - protein, 30 aa, artificial
  peptide fold or domain or sub-domain
TSAVITNDLQMSIFFSENLESGMVHINGPS

SEQ ID NO: 20094 - protein, 23 aa, artificial
  peptide fold or domain or sub-domain
TSAVLLELVETGLSREDAYAVTQ

SEQ ID NO: 20095 - protein, 21 aa, artificial
  peptide fold or domain or sub-domain
TSCHEEDMGKLESDPGGVRAL

SEQ ID NO: 20096 - protein, 20 aa, artificial
  peptide fold or domain or sub-domain
TSCHLGNGSEAYAAPWNNTP

SEQ ID NO: 20097 - protein, 25 aa, artificial
  peptide fold or domain or sub-domain
TSCKVRKEKTCLRHPECDPAKKTRD

SEQ ID NO: 20098 - protein, 20 aa, artificial
  peptide fold or domain or sub-domain
TSCNTQITKKYLFKNQCLSS

SEQ ID NO: 20099 - protein, 22 aa, artificial
  peptide fold or domain or sub-domain
TSDAHPWFQASRSDPDGPYGDF

SEQ ID NO: 20100 - protein, 24 aa, artificial
  peptide fold or domain or sub-domain
TSDEHAWFQASRDKNDPHADWYWW

SEQ ID NO: 20101 - protein, 22 aa, artificial
  peptide fold or domain or sub-domain
TSDEHAWFQDVLKNPQSRFRDF

SEQ ID NO: 20102 - protein, 23 aa, artificial
  peptide fold or domain or sub-domain
TSDEHNWFIESRKSKDNKYRDYY

SEQ ID NO: 20103 - protein, 22 aa, artificial
  peptide fold or domain or sub-domain
TSDEHPWAEAAKVGAEEFTDFY

SEQ ID NO: 20104 - protein, 22 aa, artificial
  peptide fold or domain or sub-domain
TSDEHPWFIESRAERNSGKRDW

SEQ ID NO: 20105 - protein, 24 aa, artificial
  peptide fold or domain or sub-domain
TSDEHPWFKDAVENTTSSPYWDYY

SEQ ID NO: 20106 - protein, 24 aa, artificial
  peptide fold or domain or sub-domain
TSDEHPWFTASANDPDDHRYIWAP

SEQ ID NO: 20107 - protein, 24 aa, artificial
  peptide fold or domain or sub-domain
TSDQHAWFRRARRAPAGSEERDFY

SEQ ID NO: 20108 - protein, 22 aa, artificial
  peptide fold or domain or sub-domain
TSDQHEWFQLSLKNIEPYNNYY

SEQ ID NO: 20109 - protein, 24 aa, artificial
  peptide fold or domain or sub-domain
TSDQHPWFKAALDPKDAHRSWYTW

SEQ ID NO: 20110 - protein, 22 aa, artificial
  peptide fold or domain or sub-domain
TSDQHPWFVEAKKSLDNPYREY

SEQ ID NO: 20111 - protein, 30 aa, artificial
  peptide fold or domain or sub-domain
TSEAAQQFWEQLSLEANFTQSVDKIRSTLN

SEQ ID NO: 20112 - protein, 27 aa, artificial
  peptide fold or domain or sub-domain
TSEDLGGMLRGRLPFDGVKFADGALKL

SEQ ID NO: 20113 - protein, 23 aa, artificial
  peptide fold or domain or sub-domain
TSEKDWQGFLELYLQNSPEACDY

SEQ ID NO: 20114 - protein, 29 aa, artificial
  peptide fold or domain or sub-domain
TSELREAMKKLLGQQVGHRDIEEIIRDVD

SEQ ID NO: 20115 - protein, 27 aa, artificial
  peptide fold or domain or sub-domain
TSEPAIGAIQKHADKCFLPSDLGGDLE

SEQ ID NO: 20116 - protein, 28 aa, artificial
  peptide fold or domain or sub-domain
TSFAVADAPIYVKNAVDHVLSTHGGKGA

SEQ ID NO: 20117 - protein, 24 aa, artificial
  peptide fold or domain or sub-domain
TSFFHPYFQDVVRKGENSSFKNFY

SEQ ID NO: 20118 - protein, 29 aa, artificial
  peptide fold or domain or sub-domain
TSFFSGSAWNHYPEEDLWGLHLFSKKQMD

SEQ ID NO: 20119 - protein, 21 aa, artificial
  peptide fold or domain or sub-domain
TSFKDLYHSLVEDKRGPVVNF

SEQ ID NO: 20120 - protein, 22 aa, artificial
  peptide fold or domain or sub-domain
TSFLNPVFLDASSSPNHPLRDW

SEQ ID NO: 20121 - protein, 24 aa, artificial
  peptide fold or domain or sub-domain
TSFNTVDEWLEAIKMGQYKESFAN

SEQ ID NO: 20122 - protein, 22 aa, artificial
  peptide fold or domain or sub-domain
TSFQWIFNNQRLQVTKRMKLSW

SEQ ID NO: 20123 - protein, 22 aa, artificial
  peptide fold or domain or sub-domain
TSFSVITDKKYNVKYPLVEEIM

SEQ ID NO: 20124 - protein, 23 aa, artificial
  peptide fold or domain or sub-domain
TSFVESKAKKIAVSNAMEFKLIN

SEQ ID NO: 20125 - protein, 20 aa, artificial
  peptide fold or domain or sub-domain
TSGDEVAANDEPHDVYQVHD

SEQ ID NO: 20126 - protein, 25 aa, artificial
  peptide fold or domain or sub-domain
TSGFVDEMVEHGPPADLIAHLALPL

SEQ ID NO: 20127 - protein, 25 aa, artificial
  peptide fold or domain or sub-domain
TSGIKAIGEIQLDAAIDLKVREAKF

SEQ ID NO: 20128 - protein, 21 aa, artificial
  peptide fold or domain or sub-domain
TSGMSSDRSSFVSKLDFIPNE

SEQ ID NO: 20129 - protein, 30 aa, artificial
  peptide fold or domain or sub-domain
TSGYLKMNAALFENYIDNGMTIEKFCACEV

SEQ ID NO: 20130 - protein, 30 aa, artificial
  peptide fold or domain or sub-domain
TSGYLQRESKFFEHFIEGGRTVKEFCQQEV

SEQ ID NO: 20131 - protein, 27 aa, artificial
  peptide fold or domain or sub-domain
TSHKCPIKKYRINTPVRVCDKCFNDLQ

SEQ ID NO: 20132 - protein, 28 aa, artificial
  peptide fold or domain or sub-domain
TSHSDPGLTHAVREGRRAEFAVFPQFQD

SEQ ID NO: 20133 - protein, 27 aa, artificial
  peptide fold or domain or sub-domain
TSHSGRSIDEVTVEAARGGDLTLDDIR

SEQ ID NO: 20134 - protein, 29 aa, artificial
  peptide fold or domain or sub-domain
TSHVMLCGNPQMVRDTQQLLKETRQMTKH

SEQ ID NO: 20135 - protein, 27 aa, artificial
  peptide fold or domain or sub-domain
TSIDALCEATGVFRGSLYRTFGDKHGL

SEQ ID NO: 20136 - protein, 22 aa, artificial
  peptide fold or domain or sub-domain
TSIIQEDGTKVDLRFSNTSNNS

SEQ ID NO: 20137 - protein, 27 aa, artificial
  peptide fold or domain or sub-domain
TSINDLLEATNIKKGCLYFHFPGKDAL

SEQ ID NO: 20138 - protein, 27 aa, artificial
  peptide fold or domain or sub-domain
TSIQDICQAAEVSVGSMYFYFPSKEDI

SEQ ID NO: 20139 - protein, 21 aa, artificial
  peptide fold or domain or sub-domain
TSIQIYNHLMEKYGGEKSIGY

SEQ ID NO: 20140 - protein, 20 aa, artificial
  peptide fold or domain or sub-domain
TSKAESMRPEVASTFKVLRN

SEQ ID NO: 20141 - protein, 30 aa, artificial
  peptide fold or domain or sub-domain
TSKINELVEVTFESKDYSTFNFLQWYVAEQ

SEQ ID NO: 20142 - protein, 22 aa, artificial
  peptide fold or domain or sub-domain
TSKPENQDAIKADNNLRKQGKM

SEQ ID NO: 20143 - protein, 30 aa, artificial
  peptide fold or domain or sub-domain
TSKQEAEKVFKKVLTEQHLTKEEIDSFKTY

SEQ ID NO: 20144 - protein, 27 aa, artificial
  peptide fold or domain or sub-domain
TSLDDVAKSLGISKPTIYHYLGNKEQV

SEQ ID NO: 20145 - protein, 27 aa, artificial
  peptide fold or domain or sub-domain
TSLDDVARQLNVTKPTLYHYFRSKDDV

SEQ ID NO: 20146 - protein, 23 aa, artificial
  peptide fold or domain or sub-domain
TSLEENKARKLLKSSGADFVGHN

SEQ ID NO: 20147 - protein, 25 aa, artificial
  peptide fold or domain or sub-domain
TSLEVFGKILTKEVSPVTVYMNGNL

SEQ ID NO: 20148 - protein, 28 aa, artificial
  peptide fold or domain or sub-domain
TSLKMVETKLRCRNTEANDEIHRRVILA

SEQ ID NO: 20149 - protein, 20 aa, artificial
  peptide fold or domain or sub-domain
TSLQALIDIGLTGRRALTIQ

SEQ ID NO: 20150 - protein, 28 aa, artificial
  peptide fold or domain or sub-domain
TSLQEALTKSKLATSRSQARYFIKSNAI

SEQ ID NO: 20151 - protein, 27 aa, artificial
  peptide fold or domain or sub-domain
TSLTDIARAAELTRGAIYWHFKNKEEL

SEQ ID NO: 20152 - protein, 28 aa, artificial
  peptide fold or domain or sub-domain
TSMAKKLEKEKYIEYQNRIGCRLTEKGK

SEQ ID NO: 20153 - protein, 27 aa, artificial
  peptide fold or domain or sub-domain
TSMDELVRVSKVSKSNVYYHFSNKEQL

SEQ ID NO: 20154 - protein, 24 aa, artificial
  peptide fold or domain or sub-domain
TSMDVAKLAGVSQSSVSRAFGHGA

SEQ ID NO: 20155 - protein, 28 aa, artificial
  peptide fold or domain or sub-domain
TSMLKTLSEAGLAEYMKYEGVSLTQAGR

SEQ ID NO: 20156 - protein, 27 aa, artificial
  peptide fold or domain or sub-domain
TSMRDIALACGISKSLLYHHFSNKDEI

SEQ ID NO: 20157 - protein, 27 aa, artificial
  peptide fold or domain or sub-domain
TSMRELARHLNLQGGSLYAHIQSKEEL

SEQ ID NO: 20158 - protein, 22 aa, artificial
  peptide fold or domain or sub-domain
TSNAVIIDSARKVKEVIIDPNI

SEQ ID NO: 20159 - protein, 22 aa, artificial
  peptide fold or domain or sub-domain
TSNEHEWAQRCAAGDPLFDNFY

SEQ ID NO: 20160 - protein, 27 aa, artificial
  peptide fold or domain or sub-domain
TSPKAILERADAGQGSMYHHFKGKPDL

SEQ ID NO: 20161 - protein, 21 aa, artificial
  peptide fold or domain or sub-domain
TSPKDEDIDLLEKEPLKVRAK

SEQ ID NO: 20162 - protein, 21 aa, artificial
  peptide fold or domain or sub-domain
TSPKDMTAAELKAAPENAVAN

SEQ ID NO: 20163 - protein, 21 aa, artificial
  peptide fold or domain or sub-domain
TSPKEECLTDFDTNKKDALTC

SEQ ID NO: 20164 - protein, 26 aa, artificial
  peptide fold or domain or sub-domain
TSPQEGAARNHSKSNLPEHTERYEIA

SEQ ID NO: 20165 - protein, 20 aa, artificial
  peptide fold or domain or sub-domain
TSPTVVQQAISEKVTMGELG

SEQ ID NO: 20166 - protein, 29 aa, artificial
  peptide fold or domain or sub-domain
TSQDATFFPDPLKWDPHRWDIGSGKVLGN

SEQ ID NO: 20167 - protein, 29 aa, artificial
  peptide fold or domain or sub-domain
TSQFELDGETIRVIDNKLINSRGNLAGAH

SEQ ID NO: 20168 - protein, 27 aa, artificial
  peptide fold or domain or sub-domain
TSQLLENVVLKGSGKNAFVDGYRAAGK

SEQ ID NO: 20169 - protein, 23 aa, artificial
  peptide fold or domain or sub-domain
TSQSLANLGAVLANDGIKPWNNE

SEQ ID NO: 20170 - protein, 28 aa, artificial
  peptide fold or domain or sub-domain
TSRALEKIADPVLDLRYSDQDALNLVLD

SEQ ID NO: 20171 - protein, 24 aa, artificial
  peptide fold or domain or sub-domain
TSRFDAFVGGKHDALTEQEQRGLQ

SEQ ID NO: 20172 - protein, 30 aa, artificial
  peptide fold or domain or sub-domain
TSRINDLVKQAREEGDQRVLNLLAWFVDEQ

SEQ ID NO: 20173 - protein, 29 aa, artificial
  peptide fold or domain or sub-domain
TSRKRIKEELEREKDSALRACLNGRQLAF

SEQ ID NO: 20174 - protein, 28 aa, artificial
  peptide fold or domain or sub-domain
TSRWDPDFQFSKTAGSNGFKYGQPAPVT

SEQ ID NO: 20175 - protein, 24 aa, artificial
  peptide fold or domain or sub-domain
TSSAGERNFGTTPLPAHSERYRRG

SEQ ID NO: 20176 - protein, 24 aa, artificial
  peptide fold or domain or sub-domain
TSSEHPWFKQALKGNPKYLKYYYF

SEQ ID NO: 20177 - protein, 27 aa, artificial
  peptide fold or domain or sub-domain
TSSEKEKKLLDQVQANQLEKKFGGTCE

SEQ ID NO: 20178 - protein, 20 aa, artificial
  peptide fold or domain or sub-domain
TSSEQLGELAQVTAFQVRKD

SEQ ID NO: 20179 - protein, 27 aa, artificial
  peptide fold or domain or sub-domain
TSSIEWYLRSMELDPEIKADIEQQINS

SEQ ID NO: 20180 - protein, 27 aa, artificial
  peptide fold or domain or sub-domain
TSSKRTKPGYWIQVSGATLLSAVDIEK

SEQ ID NO: 20181 - protein, 25 aa, artificial
  peptide fold or domain or sub-domain
TSSLIKAGLDKGISINNMMEHWDYL

SEQ ID NO: 20182 - protein, 30 aa, artificial
  peptide fold or domain or sub-domain
TSSLQQLYSISDRISDTRTNVFLDPIVDAQ

SEQ ID NO: 20183 - protein, 24 aa, artificial
  peptide fold or domain or sub-domain
TSSLSEENYSDRDLPSPEERYARA

SEQ ID NO: 20184 - protein, 25 aa, artificial
  peptide fold or domain or sub-domain
TSSMKEMATLLTSLGVIQSAQEFES

SEQ ID NO: 20185 - protein, 28 aa, artificial
  peptide fold or domain or sub-domain
TSSNPLAIAANEAHKKAYGSDPGAFYLN

SEQ ID NO: 20186 - protein, 20 aa, artificial
  peptide fold or domain or sub-domain
TSSPDSVLQSINDLFIGNCS

SEQ ID NO: 20187 - protein, 21 aa, artificial
  peptide fold or domain or sub-domain
TSSYRNSFFNPANYGQHGTAV

SEQ ID NO: 20188 - protein, 27 aa, artificial
  peptide fold or domain or sub-domain
TSTAQISKEAGVATGTLFHYFPTKEDL

SEQ ID NO: 20189 - protein, 24 aa, artificial
  peptide fold or domain or sub-domain
TSTDFPYFLDALKNGKNSKYWNWY

SEQ ID NO: 20190 - protein, 23 aa, artificial
  peptide fold or domain or sub-domain
TSTFARPSLDERGEFFYSRIGNP

SEQ ID NO: 20191 - protein, 21 aa, artificial
  peptide fold or domain or sub-domain
TSTFRNEYTGRGKLAERQQKL

SEQ ID NO: 20192 - protein, 22 aa, artificial
  peptide fold or domain or sub-domain
TSTNHVWFKKAIESENNPEHNY

SEQ ID NO: 20193 - protein, 22 aa, artificial
  peptide fold or domain or sub-domain
TSTQHAWFREALNKESPYRQFY

SEQ ID NO: 20194 - protein, 23 aa, artificial
  peptide fold or domain or sub-domain
TSTYRQDAIGRHKGYEYSRSGNP

SEQ ID NO: 20195 - protein, 30 aa, artificial
  peptide fold or domain or sub-domain
TSVDTVSKKIQFQKHCVRKLHLTHYQALST

SEQ ID NO: 20196 - protein, 24 aa, artificial
  peptide fold or domain or sub-domain
TSVGTVGDWMDGMRTLPCKEAFSG

SEQ ID NO: 20197 - protein, 24 aa, artificial
  peptide fold or domain or sub-domain
TSVHHSWFQQAQAGDERYRAFYNF

SEQ ID NO: 20198 - protein, 27 aa, artificial
  peptide fold or domain or sub-domain
TSVNDISARSGRTSGAVYFHYTGKEGI

SEQ ID NO: 20199 - protein, 27 aa, artificial
  peptide fold or domain or sub-domain
TSVQEIVEAIGATKGAFYYYYKSKEEL

SEQ ID NO: 20200 - protein, 27 aa, artificial
  peptide fold or domain or sub-domain
TSVSDILSRSQVHSGSLYHFFPGKQDV

SEQ ID NO: 20201 - protein, 21 aa, artificial
  peptide fold or domain or sub-domain
TSWKNKEWSSEDGEPCAHPNS

SEQ ID NO: 20202 - protein, 23 aa, artificial
  peptide fold or domain or sub-domain
TSWQGGRNNVGNVQGDILSENIS

SEQ ID NO: 20203 - protein, 25 aa, artificial
  peptide fold or domain or sub-domain
TSYAGMVWLMIRGQRPTPWQERLLD

SEQ ID NO: 20204 - protein, 22 aa, artificial
  peptide fold or domain or sub-domain
TSYAIISEPERGIKHPLRSEEI

SEQ ID NO: 20205 - protein, 20 aa, artificial
  peptide fold or domain or sub-domain
TSYDSSKHHYKNHSEGFEAL

SEQ ID NO: 20206 - protein, 24 aa, artificial
  peptide fold or domain or sub-domain
TSYGLVNDAWLSVYPDQVEHPPNR

SEQ ID NO: 20207 - protein, 25 aa, artificial
  peptide fold or domain or sub-domain
TSYKLTPVVDPYSSKIDLHETVDGW

SEQ ID NO: 20208 - protein, 24 aa, artificial
  peptide fold or domain or sub-domain
TSYLAKADESWAKEYGANKTINWG

SEQ ID NO: 20209 - protein, 24 aa, artificial
  peptide fold or domain or sub-domain
TSYLAKVNEEWKNNVGTGSTVKWP

SEQ ID NO: 20210 - protein, 21 aa, artificial
  peptide fold or domain or sub-domain
TSYLSGDFDNNGTIDIAAGTE

SEQ ID NO: 20211 - protein, 24 aa, artificial
  peptide fold or domain or sub-domain
TSYMDHQSKTWSESIGKGKALAWP

SEQ ID NO: 20212 - protein, 21 aa, artificial
  peptide fold or domain or sub-domain
TSYYRFELEDEDTGIKSRREL

SEQ ID NO: 20213 - protein, 28 aa, artificial
  peptide fold or domain or sub-domain
TTAAQGLWAQAGFRPVDPAVSADFSDQF

SEQ ID NO: 20214 - protein, 26 aa, artificial
  peptide fold or domain or sub-domain
TTAEIASASGISEGNLYRHFKGKEEI

SEQ ID NO: 20215 - protein, 22 aa, artificial
  peptide fold or domain or sub-domain
TTAGVAGDGGGAVVQRLLATCA

SEQ ID NO: 20216 - protein, 26 aa, artificial
  peptide fold or domain or sub-domain
TTAHIEGQLAAGSSKFEARNNSQVAG

SEQ ID NO: 20217 - protein, 29 aa, artificial
  peptide fold or domain or sub-domain
TTAVYVCGPPGMLEAVRVARNQHADAPLH

SEQ ID NO: 20218 - protein, 26 aa, artificial
  peptide fold or domain or sub-domain
TTDAVQLFGGAGYTVDFPVERMMRDA

SEQ ID NO: 20219 - protein, 20 aa, artificial
  peptide fold or domain or sub-domain
TTDGHNIASPIFNSDNSCSG

SEQ ID NO: 20220 - protein, 22 aa, artificial
  peptide fold or domain or sub-domain
TTDHHVFVAHKGGKQHNVHFLP

SEQ ID NO: 20221 - protein, 28 aa, artificial
  peptide fold or domain or sub-domain
TTDSHSYLDYDLRHAVVRKGDVLGVYTN

SEQ ID NO: 20222 - protein, 23 aa, artificial
  peptide fold or domain or sub-domain
TTEDIALIGLILAHDGYHPIRHE

SEQ ID NO: 20223 - protein, 25 aa, artificial
  peptide fold or domain or sub-domain
TTEKTLKETEGKVPETETKNVQDAL

SEQ ID NO: 20224 - protein, 30 aa, artificial
  peptide fold or domain or sub-domain
TTENLEEISPSTIGPNTKVFVNGAWIGIHR

SEQ ID NO: 20225 - protein, 25 aa, artificial
  peptide fold or domain or sub-domain
TTFEFMWQAMKEEFGLPKTVKEYIA

SEQ ID NO: 20226 - protein, 25 aa, artificial
  peptide fold or domain or sub-domain
TTFRKQFWRKGQEEETTVFDYASVK

SEQ ID NO: 20227 - protein, 27 aa, artificial
  peptide fold or domain or sub-domain
TTGDEILMRRMSDETRVRDLDTASTIE

SEQ ID NO: 20228 - protein, 20 aa, artificial
  peptide fold or domain or sub-domain
TTGDELREPGEALEEGCLYD

SEQ ID NO: 20229 - protein, 25 aa, artificial
  peptide fold or domain or sub-domain
TTGDTASYNSLTKYHTYMNAIATDT

SEQ ID NO: 20230 - protein, 27 aa, artificial
  peptide fold or domain or sub-domain
TTGLARANFDEMVLVGLSGRQLAYVRD

SEQ ID NO: 20231 - protein, 24 aa, artificial
  peptide fold or domain or sub-domain
TTHLNAISPEWRQKVGRGSSVNWP

SEQ ID NO: 20232 - protein, 25 aa, artificial
  peptide fold or domain or sub-domain
TTIAKIQQSTVGNTGAFKDEVLSHW

SEQ ID NO: 20233 - protein, 30 aa, artificial
  peptide fold or domain or sub-domain
TTICGNNKELFKEISEIKKSNPKIHVLQFT

SEQ ID NO: 20234 - protein, 27 aa, artificial
  peptide fold or domain or sub-domain
TTIDDIASKLLITKGTVYYYFQDKQDL

SEQ ID NO: 20235 - protein, 25 aa, artificial
  peptide fold or domain or sub-domain
TTIDSLQKNLQKKYTQFSDFSDFFR

SEQ ID NO: 20236 - protein, 29 aa, artificial
  peptide fold or domain or sub-domain
TTIFVQPQFSRRAAQTIATEIGARLVDAD

SEQ ID NO: 20237 - protein, 23 aa, artificial
  peptide fold or domain or sub-domain
TTIGDHSRVFSYAIVGDIPQDIS

SEQ ID NO: 20238 - protein, 30 aa, artificial
  peptide fold or domain or sub-domain
TTILLQNHEVWVFSQYGYSRLSFPLDISSS

SEQ ID NO: 20239 - protein, 26 aa, artificial
  peptide fold or domain or sub-domain
TTINRVTTALDKEMNINSGTSLYVFK

SEQ ID NO: 20240 - protein, 27 aa, artificial
  peptide fold or domain or sub-domain
TTIPEIARVANVGAGTIYRYFISKEDL

SEQ ID NO: 20241 - protein, 27 aa, artificial
  peptide fold or domain or sub-domain
TTISFEKGTVEGKHGTQINVDKSIDEV

SEQ ID NO: 20242 - protein, 26 aa, artificial
  peptide fold or domain or sub-domain
TTISQSHIRKVQNNEIILYRNETLPI

SEQ ID NO: 20243 - protein, 30 aa, artificial
  peptide fold or domain or sub-domain
TTIYKQGMQFETDSPTGYKVLIDTSPENGG

SEQ ID NO: 20244 - protein, 30 aa, artificial
  peptide fold or domain or sub-domain
TTKEEAGRIFSDRLQGTEVSCEDEKKFKTY

SEQ ID NO: 20245 - protein, 27 aa, artificial
  peptide fold or domain or sub-domain
TTKELGTMMKSLGENTTEAGLKDMLKE

SEQ ID NO: 20246 - protein, 25 aa, artificial
  peptide fold or domain or sub-domain
TTKESLVYSLEHTNQEGLDHILLLN

SEQ ID NO: 20247 - protein, 28 aa, artificial
  peptide fold or domain or sub-domain
TTKRESHQRTFWDGCNQQQVANYPLYYT

SEQ ID NO: 20248 - protein, 23 aa, artificial
  peptide fold or domain or sub-domain
TTKVLIAAVRAGMGREAAHHVIR

SEQ ID NO: 20249 - protein, 30 aa, artificial
  peptide fold or domain or sub-domain
TTKWIGGRAFTATGDSGYEVNMDATEAYGG

SEQ ID NO: 20250 - protein, 30 aa, artificial
  peptide fold or domain or sub-domain
TTKWLGGMAFESNNTSGNSFKIEDAEEGDG

SEQ ID NO: 20251 - protein, 27 aa, artificial
  peptide fold or domain or sub-domain
TTLAIFARAKEDGIPPAAAADRIAEQR

SEQ ID NO: 20252 - protein, 27 aa, artificial
  peptide fold or domain or sub-domain
TTLEDVKGAAEVSGSQLYHYFPDKNEL

SEQ ID NO: 20253 - protein, 28 aa, artificial
  peptide fold or domain or sub-domain
TTLLDLCRKANAIPHGPSGYQKITDGGV

SEQ ID NO: 20254 - protein, 27 aa, artificial
  peptide fold or domain or sub-domain
TTLPPEYLKEADDIMQSFAEIEDCLAR

SEQ ID NO: 20255 - protein, 27 aa, artificial
  peptide fold or domain or sub-domain
TTLSEIVAHAGVTKGALYFHFAAKEDL

SEQ ID NO: 20256 - protein, 27 aa, artificial
  peptide fold or domain or sub-domain
TTMEQIAEAVDLSKVTLYNYFPSKELI

SEQ ID NO: 20257 - protein, 20 aa, artificial
  peptide fold or domain or sub-domain
TTMSKGGFYHSMRFTKPHDG

SEQ ID NO: 20258 - protein, 27 aa, artificial
  peptide fold or domain or sub-domain
TTNTFCGTTEYLAPEVLLEDKGYTKQV

SEQ ID NO: 20259 - protein, 26 aa, artificial
  peptide fold or domain or sub-domain
TTNYVIVLQRATGCDELTALEQVQAQ

SEQ ID NO: 20260 - protein, 28 aa, artificial
  peptide fold or domain or sub-domain
TTPAGSPSAVPLDPDIVNRLQAAGLDVK

SEQ ID NO: 20261 - protein, 24 aa, artificial
  peptide fold or domain or sub-domain
TTPEVIFEYIRSVSYPNNKSKHLV

SEQ ID NO: 20262 - protein, 25 aa, artificial
  peptide fold or domain or sub-domain
TTPEVIFEYIRSVSYPNNKSKHLVG

SEQ ID NO: 20263 - protein, 23 aa, artificial
  peptide fold or domain or sub-domain
TTPVAEEVLEAMLPYFREKFGNP

SEQ ID NO: 20264 - protein, 27 aa, artificial
  peptide fold or domain or sub-domain
TTQAEYLSKVEQYKALNASDNTVKYGI

SEQ ID NO: 20265 - protein, 21 aa, artificial
  peptide fold or domain or sub-domain
TTQLSTLWNVKARSWTHQIVQ

SEQ ID NO: 20266 - protein, 30 aa, artificial
  peptide fold or domain or sub-domain
TTQRDGSLRQQARIHDVAELAVDAPRVVGG

SEQ ID NO: 20267 - protein, 21 aa, artificial
  peptide fold or domain or sub-domain
TTRDFANWLPDENAPDVVEKV

SEQ ID NO: 20268 - protein, 26 aa, artificial
  peptide fold or domain or sub-domain
TTRDIAALAGQNIAAITYYFGSKEDL

SEQ ID NO: 20269 - protein, 26 aa, artificial
  peptide fold or domain or sub-domain
TTREISTKCKISQPALYYHYPDKQSL

SEQ ID NO: 20270 - protein, 27 aa, artificial
  peptide fold or domain or sub-domain
TTRYVSVTGSDANRGTKQSPFSTVQQC

SEQ ID NO: 20271 - protein, 26 aa, artificial
  peptide fold or domain or sub-domain
TTSANTSGHPPSTDASQVTAYFKDEI

SEQ ID NO: 20272 - protein, 26 aa, artificial
  peptide fold or domain or sub-domain
TTSANVSGRPAPTDPDEVFEQLGDRL

SEQ ID NO: 20273 - protein, 24 aa, artificial
  peptide fold or domain or sub-domain
TTSGADATGIFVNMQGSRQYYELF

SEQ ID NO: 20274 - protein, 24 aa, artificial
  peptide fold or domain or sub-domain
TTSHTDINGIYFNKSGDKEYYVRF

SEQ ID NO: 20275 - protein, 28 aa, artificial
  peptide fold or domain or sub-domain
TTSKAHSIWAKARKENRFEDFAPILSKI

SEQ ID NO: 20276 - protein, 28 aa, artificial
  peptide fold or domain or sub-domain
TTSLATKAWEEAKAKDDFSKFEPWLDKI

SEQ ID NO: 20277 - protein, 20 aa, artificial
  peptide fold or domain or sub-domain
TTSLKQEAEKHQGSVAEQLN

SEQ ID NO: 20278 - protein, 28 aa, artificial
  peptide fold or domain or sub-domain
TTSLKQEAEKHQGSVAEQLNAFARNLNN

SEQ ID NO: 20279 - protein, 26 aa, artificial
  peptide fold or domain or sub-domain
TTSNYDNRKGEIGTLGVDVNGRGGYE

SEQ ID NO: 20280 - protein, 20 aa, artificial
  peptide fold or domain or sub-domain
TTSRNSNLSLIEYLANGLND

SEQ ID NO: 20281 - protein, 28 aa, artificial
  peptide fold or domain or sub-domain
TTSTDNMHHSGNGTLLVIPLRSDSGQWT

SEQ ID NO: 20282 - protein, 27 aa, artificial
  peptide fold or domain or sub-domain
TTTGEIVKLSESSKGNLYYHFKTKENL

SEQ ID NO: 20283 - protein, 21 aa, artificial
  peptide fold or domain or sub-domain
TTTIKENTLAKKIYQKDQVIE

SEQ ID NO: 20284 - protein, 27 aa, artificial
  peptide fold or domain or sub-domain
TTTKDLAQAANVAEGTLFRYFTNKKAI

SEQ ID NO: 20285 - protein, 24 aa, artificial
  peptide fold or domain or sub-domain
TTTVQFLYRQGQDYVFMDGTTFEQ

SEQ ID NO: 20286 - protein, 27 aa, artificial
  peptide fold or domain or sub-domain
TTVADIAKQAGLAYGLIYWYFDSKDDL

SEQ ID NO: 20287 - protein, 28 aa, artificial
  peptide fold or domain or sub-domain
TTVAHVDGKTYMLFGSDRMELLAYLLGE

SEQ ID NO: 20288 - protein, 30 aa, artificial
  peptide fold or domain or sub-domain
TTVEEALSRGWSVKSGTGTEDATKKEVPLG

SEQ ID NO: 20289 - protein, 29 aa, artificial
  peptide fold or domain or sub-domain
TTVFYETLVSDKTAKTLAKDAGLKTDVLD

SEQ ID NO: 20290 - protein, 23 aa, artificial
  peptide fold or domain or sub-domain
TTVQDATWYYNITEGNPYRTESS

SEQ ID NO: 20291 - protein, 27 aa, artificial
  peptide fold or domain or sub-domain
TTVRDIARRAGVTVPALYYHYANKQGI

SEQ ID NO: 20292 - protein, 30 aa, artificial
  peptide fold or domain or sub-domain
TTVTAAAFDEATNTWTVDTNHGDRIRARYL

SEQ ID NO: 20293 - protein, 30 aa, artificial
  peptide fold or domain or sub-domain
TTVTTTNAFNTTAPADSASSLQEVAGLDVT

SEQ ID NO: 20294 - protein, 27 aa, artificial
  peptide fold or domain or sub-domain
TTYYVATNGNNNGNGSSGSPWASINFA

SEQ ID NO: 20295 - protein, 27 aa, artificial
  peptide fold or domain or sub-domain
TVAAESENTAKGALGGTIKPDIRISEA

SEQ ID NO: 20296 - protein, 27 aa, artificial
  peptide fold or domain or sub-domain
TVAALADLAVQGSHGITLVADTRLDEI

SEQ ID NO: 20297 - protein, 20 aa, artificial
  peptide fold or domain or sub-domain
TVADVVAAEGWPGFRRRESE

SEQ ID NO: 20298 - protein, 30 aa, artificial
  peptide fold or domain or sub-domain
TVAFDKMTDAAQKAKDHATFAFLQWFVSEQ

SEQ ID NO: 20299 - protein, 30 aa, artificial
  peptide fold or domain or sub-domain
TVAFFKDGQPVDSFAGVKSETEIMTMLEPH

SEQ ID NO: 20300 - protein, 23 aa, artificial
  peptide fold or domain or sub-domain
TVANMIKGKTPEEIRKTFNIKND

SEQ ID NO: 20301 - protein, 20 aa, artificial
  peptide fold or domain or sub-domain
TVATEFVRNLFQMDIKELNV

SEQ ID NO: 20302 - protein, 20 aa, artificial
  peptide fold or domain or sub-domain
TVAVEGVSSPDNPEHQKFKA

SEQ ID NO: 20303 - protein, 30 aa, artificial
  peptide fold or domain or sub-domain
TVAVHNRSVAKTDALLKEHSSDGKFVRSET

SEQ ID NO: 20304 - protein, 20 aa, artificial
  peptide fold or domain or sub-domain
TVCSQRLRELQAHHVHNNSG

SEQ ID NO: 20305 - protein, 28 aa, artificial
  peptide fold or domain or sub-domain
TVDARNAGHSSALGMPFLPKSLKLLAEN

SEQ ID NO: 20306 - protein, 30 aa, artificial
  peptide fold or domain or sub-domain
TVDDLLRGEIKGANRHASERGVAVGMTGRE

SEQ ID NO: 20307 - protein, 24 aa, artificial
  peptide fold or domain or sub-domain
TVDDMITGYRRFRSGVYAEQVELY

SEQ ID NO: 20308 - protein, 26 aa, artificial
  peptide fold or domain or sub-domain
TVDEVMRRTGLKRPAFYVHFRDKHDL

SEQ ID NO: 20309 - protein, 21 aa, artificial
  peptide fold or domain or sub-domain
TVDFKELHMHNWVIAPKKFEA

SEQ ID NO: 20310 - protein, 25 aa, artificial
  peptide fold or domain or sub-domain
TVDHLLEAMAGRDRVDLIADFASTI

SEQ ID NO: 20311 - protein, 29 aa, artificial
  peptide fold or domain or sub-domain
TVDHVLAGLEEIEFDSFIEPLKKDLETYR

SEQ ID NO: 20312 - protein, 29 aa, artificial
  peptide fold or domain or sub-domain
TVDLSPLGLNESDTEFCWRIVKDYKVAAI

SEQ ID NO: 20313 - protein, 23 aa, artificial
  peptide fold or domain or sub-domain
TVDNINNLVVDGASFREAYKTIG

SEQ ID NO: 20314 - protein, 25 aa, artificial
  peptide fold or domain or sub-domain
TVDQLLDARSGQEEFDVVRDYAEGI

SEQ ID NO: 20315 - protein, 24 aa, artificial
  peptide fold or domain or sub-domain
TVDYAICSSSSYWGSTVKNSMVCA

SEQ ID NO: 20316 - protein, 29 aa, artificial
  peptide fold or domain or sub-domain
TVDYTAIRPDLNDLEMCYFLAEQYGVVAI

SEQ ID NO: 20317 - protein, 27 aa, artificial
  peptide fold or domain or sub-domain
TVEELATVIRSLDQNPTEEELQDMISE

SEQ ID NO: 20318 - protein, 22 aa, artificial
  peptide fold or domain or sub-domain
TVEEMRKAEKDFRDGRQLISTL

SEQ ID NO: 20319 - protein, 21 aa, artificial
  peptide fold or domain or sub-domain
TVEIKEGSRLYNILGKTIAVN

SEQ ID NO: 20320 - protein, 27 aa, artificial
  peptide fold or domain or sub-domain
TVELVKNGDEYTFNTLSPSRTRRSSSS

SEQ ID NO: 20321 - protein, 26 aa, artificial
  peptide fold or domain or sub-domain
TVEQISELANVSKSNLLYYFKSKDGL

SEQ ID NO: 20322 - protein, 24 aa, artificial
  peptide fold or domain or sub-domain
TVESLVVEALAAGRKGPDAIPAVR

SEQ ID NO: 20323 - protein, 27 aa, artificial
  peptide fold or domain or sub-domain
TVEVSRRDLYTMTDRSPAEHGALDLHM

SEQ ID NO: 20324 - protein, 27 aa, artificial
  peptide fold or domain or sub-domain
TVEVTLEGDTYTLTTTSTFKTSAISFK

SEQ ID NO: 20325 - protein, 22 aa, artificial
  peptide fold or domain or sub-domain
TVEWAEGFGLLGPGDGHRMMRD

SEQ ID NO: 20326 - protein, 29 aa, artificial
  peptide fold or domain or sub-domain
TVEYPVQNKQTSLPTLRKLPEFKHRTTYL

SEQ ID NO: 20327 - protein, 24 aa, artificial
  peptide fold or domain or sub-domain
TVFDVSRAKAENLIALGATWVGSL

SEQ ID NO: 20328 - protein, 22 aa, artificial
  peptide fold or domain or sub-domain
TVFESFDRYDQEKDMAMYVKKQ

SEQ ID NO: 20329 - protein, 29 aa, artificial
  peptide fold or domain or sub-domain
TVFVFRANVYWTVSTEGRVGGPLPLLRRW

SEQ ID NO: 20330 - protein, 27 aa, artificial
  peptide fold or domain or sub-domain
TVGATQSTTSPYYPWFTFIHYPHDYDS

SEQ ID NO: 20331 - protein, 22 aa, artificial
  peptide fold or domain or sub-domain
TVGDASGQRLYHVNPDEIGKSM

SEQ ID NO: 20332 - protein, 24 aa, artificial
  peptide fold or domain or sub-domain
TVGGVIPEQDFDELRKDGAVEIYT

SEQ ID NO: 20333 - protein, 27 aa, artificial
  peptide fold or domain or sub-domain
TVGLRSGSATVAKAEAHGLKVADVKTA

SEQ ID NO: 20334 - protein, 25 aa, artificial
  peptide fold or domain or sub-domain
TVHHLLDQVQGKKKMEVISDFAFPL

SEQ ID NO: 20335 - protein, 21 aa, artificial
  peptide fold or domain or sub-domain
TVHYDTARSSGPGGQAANVTE

SEQ ID NO: 20336 - protein, 30 aa, artificial
  peptide fold or domain or sub-domain
TVIAETTSESKKEMLEKIGADYIVDGNGKF

SEQ ID NO: 20337 - protein, 30 aa, artificial
  peptide fold or domain or sub-domain
TVIALDVKEEKLKLAERLGADHVVDARRDP

SEQ ID NO: 20338 - protein, 30 aa, artificial
  peptide fold or domain or sub-domain
TVICGRNEALLDQIRRRHGSDARLTALGFT

SEQ ID NO: 20339 - protein, 30 aa, artificial
  peptide fold or domain or sub-domain
TVIESLKRTLMKQDLVPYIMSFAIVNIAHF

SEQ ID NO: 20340 - protein, 27 aa, artificial
  peptide fold or domain or sub-domain
TVIISQEGDKVVIRTLSTFKNTEISFQ

SEQ ID NO: 20341 - protein, 30 aa, artificial
  peptide fold or domain or sub-domain
TVILVSQGQVLDQFTGALPEGELRRFLEQH

SEQ ID NO: 20342 - protein, 29 aa, artificial
  peptide fold or domain or sub-domain
TVISNLPEDDIKQLEQRLGDNADVIPGDS

SEQ ID NO: 20343 - protein, 26 aa, artificial
  peptide fold or domain or sub-domain
TVKATNDYHEKVLKKIGADQIVHPER

SEQ ID NO: 20344 - protein, 26 aa, artificial
  peptide fold or domain or sub-domain
TVKAVSLPVTLKMRMGWDLNSLNAPE

SEQ ID NO: 20345 - protein, 23 aa, artificial
  peptide fold or domain or sub-domain
TVKDLVKMGSILANGGIDATTGK

SEQ ID NO: 20346 - protein, 23 aa, artificial
  peptide fold or domain or sub-domain
TVKELNKSMDEGNDERALKMYHL

SEQ ID NO: 20347 - protein, 20 aa, artificial
  peptide fold or domain or sub-domain
TVKGRGKVPELAAYYAGVLK

SEQ ID NO: 20348 - protein, 29 aa, artificial
  peptide fold or domain or sub-domain
TVKLSFLQHICKLTGLSRSGRKDELLRRI

SEQ ID NO: 20349 - protein, 29 aa, artificial
  peptide fold or domain or sub-domain
TVKRITGNSSVEAVELADGRKIEADVVIM

SEQ ID NO: 20350 - protein, 26 aa, artificial
  peptide fold or domain or sub-domain
TVKRVEEQQREGKDAFETRNNIQVFA

SEQ ID NO: 20351 - protein, 21 aa, artificial
  peptide fold or domain or sub-domain
TVKRYGPDRVIGFSPIPAMSQ

SEQ ID NO: 20352 - protein, 27 aa, artificial
  peptide fold or domain or sub-domain
TVLDRNARGLDELVESFKGRVAGSPGD

SEQ ID NO: 20353 - protein, 30 aa, artificial
  peptide fold or domain or sub-domain
TVLDTVGKKCRFMQFAKTQLQLKNLNVIKN

SEQ ID NO: 20354 - protein, 30 aa, artificial
  peptide fold or domain or sub-domain
TVLFFRNGKVVGGFIGAMPESAVRAEIEKA

SEQ ID NO: 20355 - protein, 24 aa, artificial
  peptide fold or domain or sub-domain
TVLFNGDATDFPLEVEGDYPTVEF

SEQ ID NO: 20356 - protein, 23 aa, artificial
  peptide fold or domain or sub-domain
TVLFPFCYVGAKTILGEHCLLYP

SEQ ID NO: 20357 - protein, 23 aa, artificial
  peptide fold or domain or sub-domain
TVLGKLPFKSAISAVTEEKEFPP

SEQ ID NO: 20358 - protein, 24 aa, artificial
  peptide fold or domain or sub-domain
TVLKIDTKNKKLLSEDGEELVDVS

SEQ ID NO: 20359 - protein, 30 aa, artificial
  peptide fold or domain or sub-domain
TVLLDARVCCDHADKPAIDADDVKLALRSR

SEQ ID NO: 20360 - protein, 28 aa, artificial
  peptide fold or domain or sub-domain
TVLLTCELLGQVQVPEARGYFSFTMCME

SEQ ID NO: 20361 - protein, 29 aa, artificial
  peptide fold or domain or sub-domain
TVLNKLDKPEGLYPNYLNPSSGQWGQHHV

SEQ ID NO: 20362 - protein, 28 aa, artificial
  peptide fold or domain or sub-domain
TVLRIGDLRLDPAEHRVLRAGSPLDLSA

SEQ ID NO: 20363 - protein, 28 aa, artificial
  peptide fold or domain or sub-domain
TVLRTDLLSLPGRDYDASVYQYATEGEL

SEQ ID NO: 20364 - protein, 23 aa, artificial
  peptide fold or domain or sub-domain
TVLTDPSVLAAAQRNGVTAAQVV

SEQ ID NO: 20365 - protein, 20 aa, artificial
  peptide fold or domain or sub-domain
TVLVNGTPTLLDGEFTKNHA

SEQ ID NO: 20366 - protein, 26 aa, artificial
  peptide fold or domain or sub-domain
TVLYSWHMELELNEANFQLLERQNIV

SEQ ID NO: 20367 - protein, 30 aa, artificial
  peptide fold or domain or sub-domain
TVMACGFSACLGCAVKPGGQRAGYLHACKD

SEQ ID NO: 20368 - protein, 30 aa, artificial
  peptide fold or domain or sub-domain
TVMFFKGGQKVDTVIGAVPKSTLTGTIEKY

SEQ ID NO: 20369 - protein, 27 aa, artificial
  peptide fold or domain or sub-domain
TVMSKRKLNLLVTDKHVEGWDDPRMPT

SEQ ID NO: 20370 - protein, 29 aa, artificial
  peptide fold or domain or sub-domain
TVMTETINGINAEDRYPNSGEVSQLDQFF

SEQ ID NO: 20371 - protein, 25 aa, artificial
  peptide fold or domain or sub-domain
TVMVRKDDGKIYTFPLEKPEDERTV

SEQ ID NO: 20372 - protein, 29 aa, artificial
  peptide fold or domain or sub-domain
TVNDVEADKNEAKKFFGLDLIDTKELKMV

SEQ ID NO: 20373 - protein, 28 aa, artificial
  peptide fold or domain or sub-domain
TVNHFKDEEAFMRRNHFPGLQAHLPEHI

SEQ ID NO: 20374 - protein, 23 aa, artificial
  peptide fold or domain or sub-domain
TVNKEELRKRLTPVQYQVTQEAG

SEQ ID NO: 20375 - protein, 20 aa, artificial
  peptide fold or domain or sub-domain
TVNKSDISAPQNPDFIGFKA

SEQ ID NO: 20376 - protein, 20 aa, artificial
  peptide fold or domain or sub-domain
TVPELFERYGEAEFRALEQR

SEQ ID NO: 20377 - protein, 21 aa, artificial
  peptide fold or domain or sub-domain
TVPPSAADSAKVPHGKELFTK

SEQ ID NO: 20378 - protein, 23 aa, artificial
  peptide fold or domain or sub-domain
TVQLPGKKIMHANNLCNSKNKWC

SEQ ID NO: 20379 - protein, 25 aa, artificial
  peptide fold or domain or sub-domain
TVQRILKHCLRLDPTISSDGTIEGI

SEQ ID NO: 20380 - protein, 21 aa, artificial
  peptide fold or domain or sub-domain
TVREVAGERTDLPAEQLDEIL

SEQ ID NO: 20381 - protein, 30 aa, artificial
  peptide fold or domain or sub-domain
TVRHTGNMSFSAHTSTGLTIPIDAHVHLGG

SEQ ID NO: 20382 - protein, 21 aa, artificial
  peptide fold or domain or sub-domain
TVRIGSSIRNKGGRVHKVIDF

SEQ ID NO: 20383 - protein, 30 aa, artificial
  peptide fold or domain or sub-domain
TVRIVELDGQNYALCSEGCEWIFGKWPDAY

SEQ ID NO: 20384 - protein, 30 aa, artificial
  peptide fold or domain or sub-domain
TVRWTGEGLYCQGQARGFQVAVDEPQELGG

SEQ ID NO: 20385 - protein, 26 aa, artificial
  peptide fold or domain or sub-domain
TVSDIDETRRPLADEIGAAWVSPEEA

SEQ ID NO: 20386 - protein, 30 aa, artificial
  peptide fold or domain or sub-domain
TVSERAMRRHRELIEAGLPSQLEIVESKME

SEQ ID NO: 20387 - protein, 30 aa, artificial
  peptide fold or domain or sub-domain
TVSESKQRMMDRGALDRIEQRDDAFRQRVY

SEQ ID NO: 20388 - protein, 30 aa, artificial
  peptide fold or domain or sub-domain
TVSRNMVTSLRRTNAPLYLLNFAWVNLVHI

SEQ ID NO: 20389 - protein, 28 aa, artificial
  peptide fold or domain or sub-domain
TVSYFEWLQNSLLESWRIHQINKRLEDI

SEQ ID NO: 20390 - protein, 28 aa, artificial
  peptide fold or domain or sub-domain
TVSYFEWVQDLQSFFWDLDQVRNALEKM

SEQ ID NO: 20391 - protein, 28 aa, artificial
  peptide fold or domain or sub-domain
TVSYFEWVQNNQGYYWSEEEVAEKLRSV

SEQ ID NO: 20392 - protein, 26 aa, artificial
  peptide fold or domain or sub-domain
TVTDVNLDRKLLAAELDANWVDADEA

SEQ ID NO: 20393 - protein, 30 aa, artificial
  peptide fold or domain or sub-domain
TVTFNEKMPLSGIDGKGHQTLFDTSPEFSG

SEQ ID NO: 20394 - protein, 27 aa, artificial
  peptide fold or domain or sub-domain
TVTFTMDGDKMTMLTESTFKNLSCTFK

SEQ ID NO: 20395 - protein, 30 aa, artificial
  peptide fold or domain or sub-domain
TVTHIKGMHFEGEGQSKLKTQIDSSVTTGG

SEQ ID NO: 20396 - protein, 21 aa, artificial
  peptide fold or domain or sub-domain
TVTIKKNTLLHKVVGEEHIEV

SEQ ID NO: 20397 - protein, 27 aa, artificial
  peptide fold or domain or sub-domain
TVTILAKHDAVIAEMQQLGVRVFAIPD

SEQ ID NO: 20398 - protein, 27 aa, artificial
  peptide fold or domain or sub-domain
TVTKSASEEPYMVHIKGYEQYRNILYG

SEQ ID NO: 20399 - protein, 30 aa, artificial
  peptide fold or domain or sub-domain
TVTNQDVAEVVASKAGITIDRREITIEEPI

SEQ ID NO: 20400 - protein, 22 aa, artificial
  peptide fold or domain or sub-domain
TVTSNGKSASAKDLFKLQTLGL

SEQ ID NO: 20401 - protein, 26 aa, artificial
  peptide fold or domain or sub-domain
TVTSRTFADQPVGAAHPSLRGQVDHT

SEQ ID NO: 20402 - protein, 30 aa, artificial
  peptide fold or domain or sub-domain
TVTWTGNMAFAGAAPSGHKIVMDASGEAGG

SEQ ID NO: 20403 - protein, 21 aa, artificial
  peptide fold or domain or sub-domain
TVVIDSINGYQAAMPEENALI

SEQ ID NO: 20404 - protein, 29 aa, artificial
  peptide fold or domain or sub-domain
TVVKVNGDDTVSSVVLKSGKEIPTKLLVI

SEQ ID NO: 20405 - protein, 20 aa, artificial
  peptide fold or domain or sub-domain
TVVNRRRILDELKQNQYDLA

SEQ ID NO: 20406 - protein, 25 aa, artificial
  peptide fold or domain or sub-domain
TVVQISDRNWFDMQPSIVQDTLIAG

SEQ ID NO: 20407 - protein, 30 aa, artificial
  peptide fold or domain or sub-domain
TVVSECRYDSSTQRWMVLSADGRRASCKYL

SEQ ID NO: 20408 - protein, 24 aa, artificial
  peptide fold or domain or sub-domain
TVVTYHIPQNSSLENVDSRYRNRA

SEQ ID NO: 20409 - protein, 30 aa, artificial
  peptide fold or domain or sub-domain
TVVWDSGYHTTANVTDGQTIIGDEPPRYGG

SEQ ID NO: 20410 - protein, 21 aa, artificial
  peptide fold or domain or sub-domain
TVWFMMKQNPTWTEEQAKRRV

SEQ ID NO: 20411 - protein, 24 aa, artificial
  peptide fold or domain or sub-domain
TVWNRTPGRADEFIAAGAQLATSP

SEQ ID NO: 20412 - protein, 28 aa, artificial
  peptide fold or domain or sub-domain
TVYHFDTEEKLFHKHGYPATAEHIQEHR

SEQ ID NO: 20413 - protein, 28 aa, artificial
  peptide fold or domain or sub-domain
TVYHFRYEEEQLEKANYSDIEAHKMEHQ

SEQ ID NO: 20414 - protein, 24 aa, artificial
  peptide fold or domain or sub-domain
TVYNRTIEKAEKLGKMGAKVAHSP

SEQ ID NO: 20415 - protein, 21 aa, artificial
  peptide fold or domain or sub-domain
TVYVGSLYKSTGGTRYSVKSL

SEQ ID NO: 20416 - protein, 24 aa, artificial
  peptide fold or domain or sub-domain
TWAGPGTNLKAVSAVGGPAWHANG

SEQ ID NO: 20417 - protein, 22 aa, artificial
  peptide fold or domain or sub-domain
TWALMGDTNASIAYAQPVLYKP

SEQ ID NO: 20418 - protein, 26 aa, artificial
  peptide fold or domain or sub-domain
TWDSELGKQIEEGKADFEYLEKKAKE

SEQ ID NO: 20419 - protein, 24 aa, artificial
  peptide fold or domain or sub-domain
TWESYYVRDVAPNVFLVGNLGAPQ

SEQ ID NO: 20420 - protein, 23 aa, artificial
  peptide fold or domain or sub-domain
TWGDLTCRYCREGKFNICKNQII

SEQ ID NO: 20421 - protein, 30 aa, artificial
  peptide fold or domain or sub-domain
TWGDLTCRYCREGKFNICKNQIIPGQTTNG

SEQ ID NO: 20422 - protein, 26 aa, artificial
  peptide fold or domain or sub-domain
TWLDDLRNDDVDIAGGKGASLGEMWN

SEQ ID NO: 20423 - protein, 20 aa, artificial
  peptide fold or domain or sub-domain
TWPELRRRDQLNVRKRDLDP

SEQ ID NO: 20424 - protein, 28 aa, artificial
  peptide fold or domain or sub-domain
TWRANNVSMTSLGEMRLSLTSPSYNKFD

SEQ ID NO: 20425 - protein, 22 aa, artificial
  peptide fold or domain or sub-domain
TWRSFPTRKRSSRKALVSDYLL

SEQ ID NO: 20426 - protein, 30 aa, artificial
  peptide fold or domain or sub-domain
TWVTGAAYDEAANVWRVTVDDGRVFEATYC

SEQ ID NO: 20427 - protein, 22 aa, artificial
  peptide fold or domain or sub-domain
TYAIEWEADQIRWFVDGVHTQT

SEQ ID NO: 20428 - protein, 26 aa, artificial
  peptide fold or domain or sub-domain
TYAKTVLLKQKGKSSFEARNESQSFY

SEQ ID NO: 20429 - protein, 26 aa, artificial
  peptide fold or domain or sub-domain
TYASSVEGGNAADLAVDGSTGSRWAS

SEQ ID NO: 20430 - protein, 27 aa, artificial
  peptide fold or domain or sub-domain
TYEELKAGLAKLGSKLSEAEVKQLMEA

SEQ ID NO: 20431 - protein, 30 aa, artificial
  peptide fold or domain or sub-domain
TYEKSLVGLESTIDEIFDHTYKVLPPELEE

SEQ ID NO: 20432 - protein, 28 aa, artificial
  peptide fold or domain or sub-domain
TYELAYTDDWSGFWRSFNGSIVGAVTAG

SEQ ID NO: 20433 - protein, 26 aa, artificial
  peptide fold or domain or sub-domain
TYEQTQNLKRKGCDDFDIRNNTQVFF

SEQ ID NO: 20434 - protein, 28 aa, artificial
  peptide fold or domain or sub-domain
TYESLLQTLQVTPPTPFAEQDFLNMFFG

SEQ ID NO: 20435 - protein, 25 aa, artificial
  peptide fold or domain or sub-domain
TYETTLQESGELVREELKSSGKQKK

SEQ ID NO: 20436 - protein, 21 aa, artificial
  peptide fold or domain or sub-domain
TYEVLSISGKDHAQTFEVCCK

SEQ ID NO: 20437 - protein, 28 aa, artificial
  peptide fold or domain or sub-domain
TYFKLLHQYSLQQSEAILYEASKLSKAL

SEQ ID NO: 20438 - protein, 22 aa, artificial
  peptide fold or domain or sub-domain
TYGFEWRPDYIDFYVDGKKVYR

SEQ ID NO: 20439 - protein, 23 aa, artificial
  peptide fold or domain or sub-domain
TYGGAGYPQLAGAEAIIRYVVKG

SEQ ID NO: 20440 - protein, 22 aa, artificial
  peptide fold or domain or sub-domain
TYGVNVTKDKITWYVDGEIVGE

SEQ ID NO: 20441 - protein, 22 aa, artificial
  peptide fold or domain or sub-domain
TYHSDSIFEFFRLGLLPPAVLV

SEQ ID NO: 20442 - protein, 24 aa, artificial
  peptide fold or domain or sub-domain
TYINSEHSRGEGRKLSLEESVEEP

SEQ ID NO: 20443 - protein, 23 aa, artificial
  peptide fold or domain or sub-domain
TYITDSDWHTVYDRTQRSDRVTP

SEQ ID NO: 20444 - protein, 24 aa, artificial
  peptide fold or domain or sub-domain
TYLDKDCTTSQGRKVNLSVAVSKP

SEQ ID NO: 20445 - protein, 28 aa, artificial
  peptide fold or domain or sub-domain
TYLGEFSLRGKELRENGINRIGNLLVPN

SEQ ID NO: 20446 - protein, 27 aa, artificial
  peptide fold or domain or sub-domain
TYLLPDPVRNITRVSLCGTLGSFYKYL

SEQ ID NO: 20447 - protein, 29 aa, artificial
  peptide fold or domain or sub-domain
TYLLSIGDPATRLRDTLDRAAAYIAAGAD

SEQ ID NO: 20448 - protein, 22 aa, artificial
  peptide fold or domain or sub-domain
TYMNNAMRKLDCVNRTQLVAKT

SEQ ID NO: 20449 - protein, 30 aa, artificial
  peptide fold or domain or sub-domain
TYMTSEDIARETGIPEEIIRTKFGIIKKPI

SEQ ID NO: 20450 - protein, 28 aa, artificial
  peptide fold or domain or sub-domain
TYNQLLHVASEQGSFDGGDQGLLNTFFN

SEQ ID NO: 20451 - protein, 29 aa, artificial
  peptide fold or domain or sub-domain
TYPDRAERIADAWQAGDRGEATELVTDEM

SEQ ID NO: 20452 - protein, 25 aa, artificial
  peptide fold or domain or sub-domain
TYPLAGPNASLTGGKIHAHLRRSRF

SEQ ID NO: 20453 - protein, 26 aa, artificial
  peptide fold or domain or sub-domain
TYQGEIARYTLNDGHGPVNIYLLPFV

SEQ ID NO: 20454 - protein, 26 aa, artificial
  peptide fold or domain or sub-domain
TYQKLNQEKRSGSSDFEARNKCQVSH

SEQ ID NO: 20455 - protein, 27 aa, artificial
  peptide fold or domain or sub-domain
TYQSAMRAVAYAIVGNRHADEVVQDAW

SEQ ID NO: 20456 - protein, 29 aa, artificial
  peptide fold or domain or sub-domain
TYRRWVWAITHVENPEEGAEIFAELVAHA

SEQ ID NO: 20457 - protein, 20 aa, artificial
  peptide fold or domain or sub-domain
TYSLEWFKEKFLSEDYETIN

SEQ ID NO: 20458 - protein, 22 aa, artificial
  peptide fold or domain or sub-domain
TYSYDAKREDFGAQDATKLDTW

SEQ ID NO: 20459 - protein, 28 aa, artificial
  peptide fold or domain or sub-domain
TYSYDAKREDFGAQDATKLDTWVFDNVK

SEQ ID NO: 20460 - protein, 28 aa, artificial
  peptide fold or domain or sub-domain
TYTEGSIKQPEYTLRSFLKGKLKVGDTM

SEQ ID NO: 20461 - protein, 22 aa, artificial
  peptide fold or domain or sub-domain
TYTLIWYPERMIWQVDGRTFAE

SEQ ID NO: 20462 - protein, 28 aa, artificial
  peptide fold or domain or sub-domain
TYTPDDYVYEISQDNSLSNVPLRKDGKY

SEQ ID NO: 20463 - protein, 22 aa, artificial
  peptide fold or domain or sub-domain
TYVASTIIREVSMLGGDVSKFV

SEQ ID NO: 20464 - protein, 30 aa, artificial
  peptide fold or domain or sub-domain
TYVLTVDGADIGVADGGDGVINAQDVVDAL

SEQ ID NO: 20465 - protein, 20 aa, artificial
  peptide fold or domain or sub-domain
TYYTIDSNGDYHHTPDGNWN

SEQ ID NO: 20466 - protein, 28 aa, artificial
  peptide fold or domain or sub-domain
TYYTIDSNGDYHHTPDGNWNQAMFDNKE

SEQ ID NO: 20467 - protein, 24 aa, artificial
  peptide fold or domain or sub-domain
VAAAAAAPTGGVLGAYYPGFNPPL

SEQ ID NO: 20468 - protein, 26 aa, artificial
  peptide fold or domain or sub-domain
VAAANILVPVLVSGRAIRDDDLAAIE

SEQ ID NO: 20469 - protein, 28 aa, artificial
  peptide fold or domain or sub-domain
VAAAVAMDARYSGIRPEPAAVFDNISNK

SEQ ID NO: 20470 - protein, 22 aa, artificial
  peptide fold or domain or sub-domain
VAAERVESLQKANDYSESFFSH

SEQ ID NO: 20471 - protein, 25 aa, artificial
  peptide fold or domain or sub-domain
VAAEVGCSDNATALACLRGKTVDEL

SEQ ID NO: 20472 - protein, 28 aa, artificial
  peptide fold or domain or sub-domain
VAAFDIDESKIGTEICGRKIFPLDKMKE

SEQ ID NO: 20473 - protein, 30 aa, artificial
  peptide fold or domain or sub-domain
VAALGHAFGPNAERGVFRTIDGGKTWEKVL

SEQ ID NO: 20474 - protein, 23 aa, artificial
  peptide fold or domain or sub-domain
VAALPQEEEIKAAHILVASEDEA

SEQ ID NO: 20475 - protein, 23 aa, artificial
  peptide fold or domain or sub-domain
VAASADPGFLVNVFGTSIYNDID

SEQ ID NO: 20476 - protein, 28 aa, artificial
  peptide fold or domain or sub-domain
VAASGMSAPEHLAAAATAGYDAALVGTA

SEQ ID NO: 20477 - protein, 24 aa, artificial
  peptide fold or domain or sub-domain
VAATSSSTFQPSESYGPFSTSEDY

SEQ ID NO: 20478 - protein, 27 aa, artificial
  peptide fold or domain or sub-domain
VAAVDGNVRRVLSRLFARESPKEKELF

SEQ ID NO: 20479 - protein, 28 aa, artificial
  peptide fold or domain or sub-domain
VAAVDSDPAKHGKTLDGIEIRPISQLPE

SEQ ID NO: 20480 - protein, 25 aa, artificial
  peptide fold or domain or sub-domain
VACGGSWFVEKKLIQSNNWDEIGRL

SEQ ID NO: 20481 - protein, 25 aa, artificial
  peptide fold or domain or sub-domain
VACGGTWMVPTAMMDSGDWEGIAEL

SEQ ID NO: 20482 - protein, 24 aa, artificial
  peptide fold or domain or sub-domain
VACNPDFVKTGPNGTCTTALDPTL

SEQ ID NO: 20483 - protein, 29 aa, artificial
  peptide fold or domain or sub-domain
VACYMGREWELSFRLGMRPWIAVAYSAPV

SEQ ID NO: 20484 - protein, 30 aa, artificial
  peptide fold or domain or sub-domain
VADEEAFRQAREAAQTHGMPVGPSAGAALS

SEQ ID NO: 20485 - protein, 30 aa, artificial
  peptide fold or domain or sub-domain
VADIPEYMKYVTGGRGLPESVVKEVQHRYG

SEQ ID NO: 20486 - protein, 21 aa, artificial
  peptide fold or domain or sub-domain
VADMQAARRALDALTPAKDGV

SEQ ID NO: 20487 - protein, 25 aa, artificial
  peptide fold or domain or sub-domain
VAEEILKQCHTLCPRLDGKGGKGTW

SEQ ID NO: 20488 - protein, 30 aa, artificial
  peptide fold or domain or sub-domain
VAEFGQLPMLQIDGHNLVQSRAIEKYLLRR

SEQ ID NO: 20489 - protein, 27 aa, artificial
  peptide fold or domain or sub-domain
VAEGAAYFQRRGLPEAHARELILAILA

SEQ ID NO: 20490 - protein, 22 aa, artificial
  peptide fold or domain or sub-domain
VAEGKSAWVIGQLVNVTDNTVN

SEQ ID NO: 20491 - protein, 28 aa, artificial
  peptide fold or domain or sub-domain
VAEGLDSRAAREAAEALSPVRHEVRGEQ

SEQ ID NO: 20492 - protein, 26 aa, artificial
  peptide fold or domain or sub-domain
VAEGPGTHTDNVLKLVGEDRQELNMN

SEQ ID NO: 20493 - protein, 21 aa, artificial
  peptide fold or domain or sub-domain
VAEHQYKDKGDIVNPLLVPIG

SEQ ID NO: 20494 - protein, 21 aa, artificial
  peptide fold or domain or sub-domain
VAEILVETKQFTTKKEALISL

SEQ ID NO: 20495 - protein, 21 aa, artificial
  peptide fold or domain or sub-domain
VAEMLVKSGIAASSEEADAMA

SEQ ID NO: 20496 - protein, 25 aa, artificial
  peptide fold or domain or sub-domain
VAEQDFLGIMAGIANVEELFASGRL

SEQ ID NO: 20497 - protein, 30 aa, artificial
  peptide fold or domain or sub-domain
VAEQYFKRPSIGYREGLIGVLTKRRVTRYH

SEQ ID NO: 20498 - protein, 28 aa, artificial
  peptide fold or domain or sub-domain
VAESGIQTATQAQQLAAAGFDAMLVGET

SEQ ID NO: 20499 - protein, 28 aa, artificial
  peptide fold or domain or sub-domain
VAESGISERNEIEELRKLGVNAFLIGSS

SEQ ID NO: 20500 - protein, 28 aa, artificial
  peptide fold or domain or sub-domain
VAESGLKRRDDVLLMQDAGFDAVLIGEG

SEQ ID NO: 20501 - protein, 26 aa, artificial
  peptide fold or domain or sub-domain
VAETPFTTTLDGRYYSHPDRHEVSMI

SEQ ID NO: 20502 - protein, 26 aa, artificial
  peptide fold or domain or sub-domain
VAETSDGGVYWEGIDEPLASGVTITS

SEQ ID NO: 20503 - protein, 30 aa, artificial
  peptide fold or domain or sub-domain
VAEVQEYPFKALDSRKISKTIAERYGVRVG

SEQ ID NO: 20504 - protein, 28 aa, artificial
  peptide fold or domain or sub-domain
VAFCPADAVPLVVRQAHYMCEYSGGHGA

SEQ ID NO: 20505 - protein, 25 aa, artificial
  peptide fold or domain or sub-domain
VAFDHARGVIPHQHGRVTGHRDCTA

SEQ ID NO: 20506 - protein, 27 aa, artificial
  peptide fold or domain or sub-domain
VAFDKSGEKLSALKTHHGDAVETVTGD

SEQ ID NO: 20507 - protein, 30 aa, artificial
  peptide fold or domain or sub-domain
VAFDPAFKDGPGPVDGVALLPTLAELLPLA

SEQ ID NO: 20508 - protein, 30 aa, artificial
  peptide fold or domain or sub-domain
VAFDPFLTDDQAESLKVRRVATVDDMLPQI

SEQ ID NO: 20509 - protein, 27 aa, artificial
  peptide fold or domain or sub-domain
VAFEMEKAGKAGDLDTVRKQMEELIAA

SEQ ID NO: 20510 - protein, 28 aa, artificial
  peptide fold or domain or sub-domain
VAFIDDDPTKQGCVIQGCTVYHSAQLPT

SEQ ID NO: 20511 - protein, 29 aa, artificial
  peptide fold or domain or sub-domain
VAFTGEYMEVSPNNKMFSQMKAKGVPMNK

SEQ ID NO: 20512 - protein, 28 aa, artificial
  peptide fold or domain or sub-domain
VAFVDDDPRAQHAVINGLQVAWPKDLER

SEQ ID NO: 20513 - protein, 30 aa, artificial
  peptide fold or domain or sub-domain
VAGDDAIETALKLTRSDGVFCGFSGGANVY

SEQ ID NO: 20514 - protein, 30 aa, artificial
  peptide fold or domain or sub-domain
VAGIDYLIEVANKDTKKLPLEWTKISGTKS

SEQ ID NO: 20515 - protein, 25 aa, artificial
  peptide fold or domain or sub-domain
VAGKLLKAIAADWGVTEQEAAQRIR

SEQ ID NO: 20516 - protein, 21 aa, artificial
  peptide fold or domain or sub-domain
VAGNKTWKYQTDNIETLVDRK

SEQ ID NO: 20517 - protein, 28 aa, artificial
  peptide fold or domain or sub-domain
VAGQAKDIQSEHVNLPLSQLRVLHKEKT

SEQ ID NO: 20518 - protein, 24 aa, artificial
  peptide fold or domain or sub-domain
VAGQIMQSPAGQTQQGQALAATAN

SEQ ID NO: 20519 - protein, 28 aa, artificial
  peptide fold or domain or sub-domain
VAGQVADVLGAGQHLALPALQQLHREKT

SEQ ID NO: 20520 - protein, 25 aa, artificial
  peptide fold or domain or sub-domain
VAGRVDAMLAGGTTADLMTEFAFPA

SEQ ID NO: 20521 - protein, 24 aa, artificial
  peptide fold or domain or sub-domain
VAGWKKRDWKLKNNQPVKNVVDFK

SEQ ID NO: 20522 - protein, 25 aa, artificial
  peptide fold or domain or sub-domain
VAHEEIDLRNPKGNKKNAGFTPQER

SEQ ID NO: 20523 - protein, 28 aa, artificial
  peptide fold or domain or sub-domain
VAHKESYSGPDNPEGKVGAGANKTLPFT

SEQ ID NO: 20524 - protein, 25 aa, artificial
  peptide fold or domain or sub-domain
VAHQKMDVKNWRECQQMPGFLAPER

SEQ ID NO: 20525 - protein, 30 aa, artificial
  peptide fold or domain or sub-domain
VAHRGDPYRHRENTLDSLRSALERGADAVE

SEQ ID NO: 20526 - protein, 30 aa, artificial
  peptide fold or domain or sub-domain
VAHRGGGKLAPENTLASIDVGAKYGHKMIE

SEQ ID NO: 20527 - protein, 30 aa, artificial
  peptide fold or domain or sub-domain
VAHRGLPEDYPENTIIAYRHALMLHIDMLE

SEQ ID NO: 20528 - protein, 29 aa, artificial
  peptide fold or domain or sub-domain
VAIEIDTDMEPILKKEITNDNFELFLSDV

SEQ ID NO: 20529 - protein, 28 aa, artificial
  peptide fold or domain or sub-domain
VAIFDADQMVVGNEVGWLRVSDVADLET

SEQ ID NO: 20530 - protein, 28 aa, artificial
  peptide fold or domain or sub-domain
VAIFDNDPAKIGQMVGELMILPLKDIPR

SEQ ID NO: 20531 - protein, 28 aa, artificial
  peptide fold or domain or sub-domain
VAIFDNDREKVGKKIAGITVYHMSDLKE

SEQ ID NO: 20532 - protein, 23 aa, artificial
  peptide fold or domain or sub-domain
VAIGKVVEAPEREQLDWYESKPL

SEQ ID NO: 20533 - protein, 26 aa, artificial
  peptide fold or domain or sub-domain
VAITAKALPAEREKILATGADDYLSK

SEQ ID NO: 20534 - protein, 29 aa, artificial
  peptide fold or domain or sub-domain
VAIVDKENDEWWLVKDSNGQQGVVPAAYL

SEQ ID NO: 20535 - protein, 26 aa, artificial
  peptide fold or domain or sub-domain
VAKAANVVYSLGGSAKDYLWPRNVEE

SEQ ID NO: 20536 - protein, 30 aa, artificial
  peptide fold or domain or sub-domain
VAKADCIEMAKTTLRRESISLGISSAANLV

SEQ ID NO: 20537 - protein, 26 aa, artificial
  peptide fold or domain or sub-domain
VAKAEKPSTLDKLIKAGADRAVCPYI

SEQ ID NO: 20538 - protein, 24 aa, artificial
  peptide fold or domain or sub-domain
VAKAFPPDGKRFEGIRNEGLPRSL

SEQ ID NO: 20539 - protein, 29 aa, artificial
  peptide fold or domain or sub-domain
VAKAMAFLADDFYMGLSQAVRGQKNFKGQ

SEQ ID NO: 20540 - protein, 26 aa, artificial
  peptide fold or domain or sub-domain
VAKAVKVFYDAPGLDFDSVAIFSRFK

SEQ ID NO: 20541 - protein, 26 aa, artificial
  peptide fold or domain or sub-domain
VAKAVSILLTNGGKAADYIGLGKITK

SEQ ID NO: 20542 - protein, 25 aa, artificial
  peptide fold or domain or sub-domain
VAKEVIDAGAGIDLATACLMERDAF

SEQ ID NO: 20543 - protein, 28 aa, artificial
  peptide fold or domain or sub-domain
VAKIKQLIAGMTKVQIANYNAPEQVVLS

SEQ ID NO: 20544 - protein, 27 aa, artificial
  peptide fold or domain or sub-domain
VAKIRFPETMDETQTRAKIGGLNDPRL

SEQ ID NO: 20545 - protein, 25 aa, artificial
  peptide fold or domain or sub-domain
VAKKALNASINMPLKEGLRYEASLF

SEQ ID NO: 20546 - protein, 27 aa, artificial
  peptide fold or domain or sub-domain
VAKLSLFVRDQPEDDIKKRFALIGIAD

SEQ ID NO: 20547 - protein, 21 aa, artificial
  peptide fold or domain or sub-domain
VAKQLVAGHLSIQPETFSRIM

SEQ ID NO: 20548 - protein, 27 aa, artificial
  peptide fold or domain or sub-domain
VAKQVIAHFAHEQAYEVADLAYFEDLV

SEQ ID NO: 20549 - protein, 26 aa, artificial
  peptide fold or domain or sub-domain
VALAEQVIKIAEQGKDIGLTKNLREY

SEQ ID NO: 20550 - protein, 24 aa, artificial
  peptide fold or domain or sub-domain
VALAMRQGTGTAKSLTESVTWFAK

SEQ ID NO: 20551 - protein, 26 aa, artificial
  peptide fold or domain or sub-domain
VALAQVLLSADDIGCPLKLNEYEKSR

SEQ ID NO: 20552 - protein, 25 aa, artificial
  peptide fold or domain or sub-domain
VALDERGRVKVDPLTHRTGNPKVWS

SEQ ID NO: 20553 - protein, 27 aa, artificial
  peptide fold or domain or sub-domain
VALEKRSADILVRLFGPFRWTFSEPLY

SEQ ID NO: 20554 - protein, 30 aa, artificial
  peptide fold or domain or sub-domain
VALGGTLLAKPADEAENAAFLRQQSGKTQQ

SEQ ID NO: 20555 - protein, 29 aa, artificial
  peptide fold or domain or sub-domain
VALKRERIGLADNWLRHVRDVADKHEAYL

SEQ ID NO: 20556 - protein, 28 aa, artificial
  peptide fold or domain or sub-domain
VALMRKEGKLPMVKEYLLSVQGANLTAV

SEQ ID NO: 20557 - protein, 25 aa, artificial
  peptide fold or domain or sub-domain
VALQALYQWQVNHSETVDIIKQFSE

SEQ ID NO: 20558 - protein, 25 aa, artificial
  peptide fold or domain or sub-domain
VALRDIDVHRSQNKPGAIGLRPEER

SEQ ID NO: 20559 - protein, 25 aa, artificial
  peptide fold or domain or sub-domain
VALRWIDVAKPMTRLRCAGFTKEER

SEQ ID NO: 20560 - protein, 28 aa, artificial
  peptide fold or domain or sub-domain
VALSGVRNAKELLDYASAGADAVVIGQS

SEQ ID NO: 20561 - protein, 27 aa, artificial
  peptide fold or domain or sub-domain
VALSSAESAGKRLGYGENSEIRCGSLD

SEQ ID NO: 20562 - protein, 26 aa, artificial
  peptide fold or domain or sub-domain
VALTAFADDSNIKECLESGMNGFLSK

SEQ ID NO: 20563 - protein, 26 aa, artificial
  peptide fold or domain or sub-domain
VALTASAMEEDEERCRQAGMDSFVAK

SEQ ID NO: 20564 - protein, 26 aa, artificial
  peptide fold or domain or sub-domain
VALTASVTEDDRRRCLEAGMDAFLSK

SEQ ID NO: 20565 - protein, 26 aa, artificial
  peptide fold or domain or sub-domain
VALTGYGGPEARAKAKRAGFDLHLTK

SEQ ID NO: 20566 - protein, 24 aa, artificial
  peptide fold or domain or sub-domain
VALTYEETRVLLEDNDWDTLLERD

SEQ ID NO: 20567 - protein, 24 aa, artificial
  peptide fold or domain or sub-domain
VALVYPHEVGDADHKVSILAPAGA

SEQ ID NO: 20568 - protein, 29 aa, artificial
  peptide fold or domain or sub-domain
VAMANAIDPLKALANDITLSNEDDGIAVY

SEQ ID NO: 20569 - protein, 29 aa, artificial
  peptide fold or domain or sub-domain
VAMANGQDIVKKRADFITASNDEDGVVKA

SEQ ID NO: 20570 - protein, 26 aa, artificial
  peptide fold or domain or sub-domain
VAMDLKSDLLQQAFGSEEHVLCIPTD

SEQ ID NO: 20571 - protein, 29 aa, artificial
  peptide fold or domain or sub-domain
VAMENAIEKVKEASDIVTLTNNDSGVSYV

SEQ ID NO: 20572 - protein, 20 aa, artificial
  peptide fold or domain or sub-domain
VAMEREMRDKWKERVMIGNI

SEQ ID NO: 20573 - protein, 29 aa, artificial
  peptide fold or domain or sub-domain
VAMGNAIDEAKQIARYETKTNVEDGVAHA

SEQ ID NO: 20574 - protein, 29 aa, artificial
  peptide fold or domain or sub-domain
VAMGNALPEVKRRADLVVPANDEDGIAYL

SEQ ID NO: 20575 - protein, 29 aa, artificial
  peptide fold or domain or sub-domain
VAMGNAPAGVQAVADWVAPTVEQDGVARA

SEQ ID NO: 20576 - protein, 29 aa, artificial
  peptide fold or domain or sub-domain
VAMGNASPSIQKVATMVTDTNDNDGIWKA

SEQ ID NO: 20577 - protein, 29 aa, artificial
  peptide fold or domain or sub-domain
VAMGNSPEQIKAEADLVTLSNKENGVARI

SEQ ID NO: 20578 - protein, 27 aa, artificial
  peptide fold or domain or sub-domain
VAMSTSTIKERIAAGELEGWDDPRAPT

SEQ ID NO: 20579 - protein, 23 aa, artificial
  peptide fold or domain or sub-domain
VANAINKYLTEANKPKESILRKA

SEQ ID NO: 20580 - protein, 25 aa, artificial
  peptide fold or domain or sub-domain
VANALNCQFGKDFADCLRRRRLDEI

SEQ ID NO: 20581 - protein, 30 aa, artificial
  peptide fold or domain or sub-domain
VANAQLERSKLEALAKANGEKYNNLMDRLY

SEQ ID NO: 20582 - protein, 26 aa, artificial
  peptide fold or domain or sub-domain
VANAVEVPVTVKTRLGWSDQEINILD

SEQ ID NO: 20583 - protein, 20 aa, artificial
  peptide fold or domain or sub-domain
VANAYATAGASDHAMAFVIP

SEQ ID NO: 20584 - protein, 24 aa, artificial
  peptide fold or domain or sub-domain
VANCEEAGTLNAIAGMIATQQVNE

SEQ ID NO: 20585 - protein, 24 aa, artificial
  peptide fold or domain or sub-domain
VANEGEIGAYKELIRGGSFATKRG

SEQ ID NO: 20586 - protein, 23 aa, artificial
  peptide fold or domain or sub-domain
VANIAEALSQADPAGAAVYRQNA

SEQ ID NO: 20587 - protein, 24 aa, artificial
  peptide fold or domain or sub-domain
VANTETELSELAKGDLDIVELSST

SEQ ID NO: 20588 - protein, 24 aa, artificial
  peptide fold or domain or sub-domain
VAPAIAGLPAPTQAAINGAFANGM

SEQ ID NO: 20589 - protein, 25 aa, artificial
  peptide fold or domain or sub-domain
VAPEAIDLFDPKRLAGKVSFHPREH

SEQ ID NO: 20590 - protein, 28 aa, artificial
  peptide fold or domain or sub-domain
VAPELSRAVHPPFLAHRLREAGYLLEAD

SEQ ID NO: 20591 - protein, 25 aa, artificial
  peptide fold or domain or sub-domain
VAPEPIDVHSPDKLKNHVCFHEDAR

SEQ ID NO: 20592 - protein, 25 aa, artificial
  peptide fold or domain or sub-domain
VAPEPIDVYDPAVWEGQTLFTLKER

SEQ ID NO: 20593 - protein, 26 aa, artificial
  peptide fold or domain or sub-domain
VAQESGVSGRGFSIFSHHPVFRECGK

SEQ ID NO: 20594 - protein, 21 aa, artificial
  peptide fold or domain or sub-domain
VAQIAGACGVNPLWLAEGRGE

SEQ ID NO: 20595 - protein, 24 aa, artificial
  peptide fold or domain or sub-domain
VAQMFPFGENLSYSQLVQNPTLRA

SEQ ID NO: 20596 - protein, 22 aa, artificial
  peptide fold or domain or sub-domain
VAQNHMVMCTNKGKSKERDCLN

SEQ ID NO: 20597 - protein, 22 aa, artificial
  peptide fold or domain or sub-domain
VARGKSSWVIANMLDISKYTVD

SEQ ID NO: 20598 - protein, 24 aa, artificial
  peptide fold or domain or sub-domain
VARTIAHRYQAGFVLLDPVRRIAR

SEQ ID NO: 20599 - protein, 30 aa, artificial
  peptide fold or domain or sub-domain
VARVAGGSGVRPVSIREFTIVTDSAPALAG

SEQ ID NO: 20600 - protein, 20 aa, artificial
  peptide fold or domain or sub-domain
VASADLRRLAAAGYPLRYLV

SEQ ID NO: 20601 - protein, 23 aa, artificial
  peptide fold or domain or sub-domain
VASALFNGRGVAKDRRQAYQWYK

SEQ ID NO: 20602 - protein, 24 aa, artificial
  peptide fold or domain or sub-domain
VASALFNGRGVAKDRRQAYQWYKK

SEQ ID NO: 20603 - protein, 24 aa, artificial
  peptide fold or domain or sub-domain
VASAVAAAQKRGQIRTDINDEALA

SEQ ID NO: 20604 - protein, 28 aa, artificial
  peptide fold or domain or sub-domain
VASFLNYSRDFVYNSPNLGLENIPIRNL

SEQ ID NO: 20605 - protein, 28 aa, artificial
  peptide fold or domain or sub-domain
VASFQQYYQLNPTGNVDSQTWQALNING

SEQ ID NO: 20606 - protein, 21 aa, artificial
  peptide fold or domain or sub-domain
VASHEFAQSLGLTPETLSRSI

SEQ ID NO: 20607 - protein, 28 aa, artificial
  peptide fold or domain or sub-domain
VASKGDAKRAFAEGSIYVNGERVLDSTT

SEQ ID NO: 20608 - protein, 28 aa, artificial
  peptide fold or domain or sub-domain
VASNGEARRQIKAGGLKVNDAPVTDEKM

SEQ ID NO: 20609 - protein, 23 aa, artificial
  peptide fold or domain or sub-domain
VASPARMTLGPLSQAERDRRACT

SEQ ID NO: 20610 - protein, 21 aa, artificial
  peptide fold or domain or sub-domain
VASWRSSFCGDAAHQTPYLAI

SEQ ID NO: 20611 - protein, 20 aa, artificial
  peptide fold or domain or sub-domain
VATAQIVRLQQQTSGEVGVV

SEQ ID NO: 20612 - protein, 25 aa, artificial
  peptide fold or domain or sub-domain
VATCASAPAPGNPQPFLSQAVATKC

SEQ ID NO: 20613 - protein, 26 aa, artificial
  peptide fold or domain or sub-domain
VATTFQVANYPGTNGVVRGIDLMENM

SEQ ID NO: 20614 - protein, 27 aa, artificial
  peptide fold or domain or sub-domain
VATTKDIAEHLGIQQGSLYYYIKSKEA

SEQ ID NO: 20615 - protein, 27 aa, artificial
  peptide fold or domain or sub-domain
VATVGDIAQQAGLSVGAIYRYFPTKAD

SEQ ID NO: 20616 - protein, 29 aa, artificial
  peptide fold or domain or sub-domain
VAVANAREDVKKKAGYVTSAAYGDGVVEA

SEQ ID NO: 20617 - protein, 26 aa, artificial
  peptide fold or domain or sub-domain
VAVANSREGAKMMERAGADEVLFLYD

SEQ ID NO: 20618 - protein, 29 aa, artificial
  peptide fold or domain or sub-domain
VAVDNARDEVKAVANYHTDHHKKDGVAQW

SEQ ID NO: 20619 - protein, 29 aa, artificial
  peptide fold or domain or sub-domain
VAVENATEKLKEVASFITLSCDNSGFAHA

SEQ ID NO: 20620 - protein, 28 aa, artificial
  peptide fold or domain or sub-domain
VAVFDTERENVGKFIGEFAVRELDVLER

SEQ ID NO: 20621 - protein, 25 aa, artificial
  peptide fold or domain or sub-domain
VAVGGSWLCPTAEIRAGNWAGITAI

SEQ ID NO: 20622 - protein, 27 aa, artificial
  peptide fold or domain or sub-domain
VAVGRREAALRELTGDGGGQVATVAAD

SEQ ID NO: 20623 - protein, 30 aa, artificial
  peptide fold or domain or sub-domain
VAVGRRILPKAELTDEASQCLRLLSGRNHR

SEQ ID NO: 20624 - protein, 22 aa, artificial
  peptide fold or domain or sub-domain
VAVIMTEWDDIKHVTPQQLTAN

SEQ ID NO: 20625 - protein, 24 aa, artificial
  peptide fold or domain or sub-domain
VAVTASTTAGKRSQAALRHCSAPA

SEQ ID NO: 20626 - protein, 26 aa, artificial
  peptide fold or domain or sub-domain
VAVTRTNSDLVSLAKECPGIEPVCVD

SEQ ID NO: 20627 - protein, 24 aa, artificial
  peptide fold or domain or sub-domain
VAWAQLLGHPVHMDTEAAKKTFLE

SEQ ID NO: 20628 - protein, 28 aa, artificial
  peptide fold or domain or sub-domain
VAWFFERPVTLAQVRGRVHELRGWRVVP

SEQ ID NO: 20629 - protein, 26 aa, artificial
  peptide fold or domain or sub-domain
VAWFRDNRILSPPEYKIKDDGTLVIP

SEQ ID NO: 20630 - protein, 26 aa, artificial
  peptide fold or domain or sub-domain
VAWLTETGMPLAETDWNDPARHRLVM

SEQ ID NO: 20631 - protein, 26 aa, artificial
  peptide fold or domain or sub-domain
VAWLTPAGAELEEKEWADPQMRCFGM

SEQ ID NO: 20632 - protein, 23 aa, artificial
  peptide fold or domain or sub-domain
VAWSTVRVMGQPIVTLIDLAAIE

SEQ ID NO: 20633 - protein, 30 aa, artificial
  peptide fold or domain or sub-domain
VAYDPFINKDRAISLGLEMVDKLEDLWPRV

SEQ ID NO: 20634 - protein, 26 aa, artificial
  peptide fold or domain or sub-domain
VAYDPQSTPNLYKELAMKLCDEDRVR

SEQ ID NO: 20635 - protein, 29 aa, artificial
  peptide fold or domain or sub-domain
VAYDPVAEDLPDDVGARRAATLADAVPAP

SEQ ID NO: 20636 - protein, 30 aa, artificial
  peptide fold or domain or sub-domain
VAYDPYVPENKFERLGVQRAASLDELLGQV

SEQ ID NO: 20637 - protein, 21 aa, artificial
  peptide fold or domain or sub-domain
VAYFDGRMNNCPPPVPQVELM

SEQ ID NO: 20638 - protein, 30 aa, artificial
  peptide fold or domain or sub-domain
VAYLHSLPVNALWGVGAKTGEVLARMGIRS

SEQ ID NO: 20639 - protein, 28 aa, artificial
  peptide fold or domain or sub-domain
VAYVVTENGARQLRMGRALDYGMVAINR

SEQ ID NO: 20640 - protein, 27 aa, artificial
  peptide fold or domain or sub-domain
VAYYLEQVGRRDRMELASDKFEEIKAR

SEQ ID NO: 20641 - protein, 28 aa, artificial
  peptide fold or domain or sub-domain
VCAFDNDSALVGTTINGLLVHDMSELEA

SEQ ID NO: 20642 - protein, 26 aa, artificial
  peptide fold or domain or sub-domain
VCASVSGRAVDVAAEIGDGALGVKAD

SEQ ID NO: 20643 - protein, 23 aa, artificial
  peptide fold or domain or sub-domain
VCCATPVMRSAGVAGENLSSCFI

SEQ ID NO: 20644 - protein, 20 aa, artificial
  peptide fold or domain or sub-domain
VCDLLSIVCKNRRHNCHQSS

SEQ ID NO: 20645 - protein, 23 aa, artificial
  peptide fold or domain or sub-domain
VCDPDHVDYQAMKDAGILSEHYD

SEQ ID NO: 20646 - protein, 28 aa, artificial
  peptide fold or domain or sub-domain
VCDYLNTLDLNALENGRHDINDQIYMNV

SEQ ID NO: 20647 - protein, 27 aa, artificial
  peptide fold or domain or sub-domain
VCEDCDSQCLGGCVNGTDPYHCIRCRN

SEQ ID NO: 20648 - protein, 24 aa, artificial
  peptide fold or domain or sub-domain
VCEEELVRYIAENVCVQKRLYGGV

SEQ ID NO: 20649 - protein, 22 aa, artificial
  peptide fold or domain or sub-domain
VCELCPATCISCITNDQCTECQ

SEQ ID NO: 20650 - protein, 20 aa, artificial
  peptide fold or domain or sub-domain
VCGQCRWCASGMEYLCDVGI

SEQ ID NO: 20651 - protein, 29 aa, artificial
  peptide fold or domain or sub-domain
VCIPTSFQARQLILQYGLTLSDLDRHPEI

SEQ ID NO: 20652 - protein, 29 aa, artificial
  peptide fold or domain or sub-domain
VCKDCLQRSFKAQVFSCPACRHDLGQNYI

SEQ ID NO: 20653 - protein, 30 aa, artificial
  peptide fold or domain or sub-domain
VCLDGECLGKPQDQEEAASMLRRLSGRSHS

SEQ ID NO: 20654 - protein, 25 aa, artificial
  peptide fold or domain or sub-domain
VCLVAKSDLRHVERALRTTPAENLA

SEQ ID NO: 20655 - protein, 25 aa, artificial
  peptide fold or domain or sub-domain
VCLVGKAHDYHVTQALGIELAENTE

SEQ ID NO: 20656 - protein, 20 aa, artificial
  peptide fold or domain or sub-domain
VCNSPVIACELKGGKCHKSS

SEQ ID NO: 20657 - protein, 22 aa, artificial
  peptide fold or domain or sub-domain
VCNVEQVRILRGLGAIQPGVNR

SEQ ID NO: 20658 - protein, 22 aa, artificial
  peptide fold or domain or sub-domain
VCPADAALNGWVTAMASLREVL

SEQ ID NO: 20659 - protein, 21 aa, artificial
  peptide fold or domain or sub-domain
VCSIHPGYTRTDLNDGHGDQD

SEQ ID NO: 20660 - protein, 20 aa, artificial
  peptide fold or domain or sub-domain
VCSQKNVACKNGQTNCYQSY

SEQ ID NO: 20661 - protein, 27 aa, artificial
  peptide fold or domain or sub-domain
VCSTPQSQYYLAEKHLFSTIPELINYH

SEQ ID NO: 20662 - protein, 27 aa, artificial
  peptide fold or domain or sub-domain
VCVALELAVSNRELANVPVLLECLKQQ

SEQ ID NO: 20663 - protein, 29 aa, artificial
  peptide fold or domain or sub-domain
VCVEIDSTLVEYLTLKFKDQNLTIIQADI

SEQ ID NO: 20664 - protein, 26 aa, artificial
  peptide fold or domain or sub-domain
VCVFVTEYGTVSADGNGGMDQASSNE

SEQ ID NO: 20665 - protein, 26 aa, artificial
  peptide fold or domain or sub-domain
VCYNSQITAPYADRVTFSSSGITFSS

SEQ ID NO: 20666 - protein, 21 aa, artificial
  peptide fold or domain or sub-domain
VDAATTSGLVVAGKEYPLDIL

SEQ ID NO: 20667 - protein, 26 aa, artificial
  peptide fold or domain or sub-domain
VDACLQMHGGMGLTEDSPIERFWRDL

SEQ ID NO: 20668 - protein, 30 aa, artificial
  peptide fold or domain or sub-domain
VDADAVIEQAAGCSIPEIFERDGDAGFRSL

SEQ ID NO: 20669 - protein, 20 aa, artificial
  peptide fold or domain or sub-domain
VDADTLKHQLALTGDEDRLE

SEQ ID NO: 20670 - protein, 20 aa, artificial
  peptide fold or domain or sub-domain
VDAEVASGHLPAERYNDMLD

SEQ ID NO: 20671 - protein, 28 aa, artificial
  peptide fold or domain or sub-domain
VDAFIKNIARDEQVLPYFRKSDVTHFRN

SEQ ID NO: 20672 - protein, 24 aa, artificial
  peptide fold or domain or sub-domain
VDAIRKFRDQFNLPVADDQLEEVP

SEQ ID NO: 20673 - protein, 25 aa, artificial
  peptide fold or domain or sub-domain
VDAKIQAPKNPEEEKNRLRLIELEN

SEQ ID NO: 20674 - protein, 28 aa, artificial
  peptide fold or domain or sub-domain
VDALKKLSKKGLIEYEKYDRITLTEEGK

SEQ ID NO: 20675 - protein, 29 aa, artificial
  peptide fold or domain or sub-domain
VDALYTCGAPAMLKAVAKKYDQLERLYIS

SEQ ID NO: 20676 - protein, 23 aa, artificial
  peptide fold or domain or sub-domain
VDAMVEQRGYTSRSEAFRDLVRE

SEQ ID NO: 20677 - protein, 21 aa, artificial
  peptide fold or domain or sub-domain
VDANRAQELWPLIEVDDVIGA

SEQ ID NO: 20678 - protein, 28 aa, artificial
  peptide fold or domain or sub-domain
VDANVRRVVRRSTGRPVGDVGAEWVRAA

SEQ ID NO: 20679 - protein, 24 aa, artificial
  peptide fold or domain or sub-domain
VDANYDSTRNAADPILGPIVGIIA

SEQ ID NO: 20680 - protein, 30 aa, artificial
  peptide fold or domain or sub-domain
VDASGRVLGKPDSLEGAVRQLRGMAGKSHT

SEQ ID NO: 20681 - protein, 20 aa, artificial
  peptide fold or domain or sub-domain
VDATRDDGQFVDSGEQYRPV

SEQ ID NO: 20682 - protein, 28 aa, artificial
  peptide fold or domain or sub-domain
VDAYTKRLLERLWNIKGSYEEIKRLFEK

SEQ ID NO: 20683 - protein, 28 aa, artificial
  peptide fold or domain or sub-domain
VDAYTLRFFKRFYGKEFSRKEIRNYAEE

SEQ ID NO: 20684 - protein, 28 aa, artificial
  peptide fold or domain or sub-domain
VDDLVERSLNDPRIADIFAASDLVRLRR

SEQ ID NO: 20685 - protein, 20 aa, artificial
  peptide fold or domain or sub-domain
VDDTPSMKFTTSMDLMLLLN

SEQ ID NO: 20686 - protein, 30 aa, artificial
  peptide fold or domain or sub-domain
VDEAAIRATEQAGGEWLSHGRTYAEQRFSP

SEQ ID NO: 20687 - protein, 29 aa, artificial
  peptide fold or domain or sub-domain
VDEAKLPSRPKTLDDIDFYQWKQLGVDNL

SEQ ID NO: 20688 - protein, 29 aa, artificial
  peptide fold or domain or sub-domain
VDEDELLLLAIEAGAEEMETTDESFEIYT

SEQ ID NO: 20689 - protein, 25 aa, artificial
  peptide fold or domain or sub-domain
VDEDLAATRTQRPSGFREAAVLQEI

SEQ ID NO: 20690 - protein, 27 aa, artificial
  peptide fold or domain or sub-domain
VDEEEMAKLGMNAYLAVSKGSENRAYM

SEQ ID NO: 20691 - protein, 26 aa, artificial
  peptide fold or domain or sub-domain
VDEFEKVIQSTMERQHISLRNSDYFK

SEQ ID NO: 20692 - protein, 28 aa, artificial
  peptide fold or domain or sub-domain
VDEFLYALADNDRSLPLFANTNIERFRT

SEQ ID NO: 20693 - protein, 28 aa, artificial
  peptide fold or domain or sub-domain
VDEFYAGVADDPLLRPMYPEEDLGPAAE

SEQ ID NO: 20694 - protein, 29 aa, artificial
  peptide fold or domain or sub-domain
VDEHFAQVERTITSYANPDMMPKIREHLR

SEQ ID NO: 20695 - protein, 28 aa, artificial
  peptide fold or domain or sub-domain
VDELHKRIATDSLLAPVFAGTDMVKQRN

SEQ ID NO: 20696 - protein, 26 aa, artificial
  peptide fold or domain or sub-domain
VDELRKGLAKKGTKLTEAEVQQLMEA

SEQ ID NO: 20697 - protein, 26 aa, artificial
  peptide fold or domain or sub-domain
VDELRRAMAGLGQPLPQEELDAMIRE

SEQ ID NO: 20698 - protein, 28 aa, artificial
  peptide fold or domain or sub-domain
VDEMYVRVLADPELTHFFDGVPIEKLAR

SEQ ID NO: 20699 - protein, 30 aa, artificial
  peptide fold or domain or sub-domain
VDENRARAVHEKAFSGEKLTQDEINDYKAF

SEQ ID NO: 20700 - protein, 29 aa, artificial
  peptide fold or domain or sub-domain
VDEQATDLDDALVRIAKYTAEGKAISIAL

SEQ ID NO: 20701 - protein, 23 aa, artificial
  peptide fold or domain or sub-domain
VDEQTLQQIKMSQGRGPSEVRVT

SEQ ID NO: 20702 - protein, 25 aa, artificial
  peptide fold or domain or sub-domain
VDEREMKNINLKYRGKNKSTNILSF

SEQ ID NO: 20703 - protein, 24 aa, artificial
  peptide fold or domain or sub-domain
VDESELVEHVGRFLTKEKHLHGGV

SEQ ID NO: 20704 - protein, 25 aa, artificial
  peptide fold or domain or sub-domain
VDETLEEMAAKGSPADLVTDWAEVF

SEQ ID NO: 20705 - protein, 29 aa, artificial
  peptide fold or domain or sub-domain
VDEVRETAHQMIEADTKIKVDDLYNLLIS

SEQ ID NO: 20706 - protein, 25 aa, artificial
  peptide fold or domain or sub-domain
VDFAAAMTLLAEGRIRSAIPIIGLQ

SEQ ID NO: 20707 - protein, 25 aa, artificial
  peptide fold or domain or sub-domain
VDFAAFQKGTAGEREQFVRQVGEAL

SEQ ID NO: 20708 - protein, 22 aa, artificial
  peptide fold or domain or sub-domain
VDFCAMEHRSEEYSKMNPQKEI

SEQ ID NO: 20709 - protein, 29 aa, artificial
  peptide fold or domain or sub-domain
VDFDKLFETAAEAGAEDVTDDGEVFTVVT

SEQ ID NO: 20710 - protein, 25 aa, artificial
  peptide fold or domain or sub-domain
VDFDLYNEEKSKPRNFNRENTLNQV

SEQ ID NO: 20711 - protein, 22 aa, artificial
  peptide fold or domain or sub-domain
VDFLNGEHKKPPLSDLNPLGEL

SEQ ID NO: 20712 - protein, 28 aa, artificial
  peptide fold or domain or sub-domain
VDFPAAILHVLAGRMPDAGDVRALDRAL

SEQ ID NO: 20713 - protein, 21 aa, artificial
  peptide fold or domain or sub-domain
VDFQNIRHSSKGRVDVTLQDG

SEQ ID NO: 20714 - protein, 21 aa, artificial
  peptide fold or domain or sub-domain
VDFRFLAELLEVSDSTLSQSL

SEQ ID NO: 20715 - protein, 25 aa, artificial
  peptide fold or domain or sub-domain
VDFSDFLSGDPERKKNCTEAIGDAC

SEQ ID NO: 20716 - protein, 27 aa, artificial
  peptide fold or domain or sub-domain
VDFVKAHGNEHFKKQDYKMALRKYRKA

SEQ ID NO: 20717 - protein, 20 aa, artificial
  peptide fold or domain or sub-domain
VDFVQSHFSFEVNELQATLE

SEQ ID NO: 20718 - protein, 24 aa, artificial
  peptide fold or domain or sub-domain
VDGALDTTLPDHLKGKIAIALAKA

SEQ ID NO: 20719 - protein, 26 aa, artificial
  peptide fold or domain or sub-domain
VDGDEPAAKCGEFFGTGDGKQWLDDQ

SEQ ID NO: 20720 - protein, 26 aa, artificial
  peptide fold or domain or sub-domain
VDGDPKGSAENYAVEAERMMREAGCR

SEQ ID NO: 20721 - protein, 25 aa, artificial
  peptide fold or domain or sub-domain
VDGLIDDLLRKSPPVDLVDEFALPV

SEQ ID NO: 20722 - protein, 28 aa, artificial
  peptide fold or domain or sub-domain
VDGLLARIARDPRIVHHFDETDIAIFRE

SEQ ID NO: 20723 - protein, 28 aa, artificial
  peptide fold or domain or sub-domain
VDGNIERVVSRLFAVEEELPQSKPLIQQ

SEQ ID NO: 20724 - protein, 30 aa, artificial
  peptide fold or domain or sub-domain
VDGQTLAAALAPFGRVNVVGRSFGVLKMRL

SEQ ID NO: 20725 - protein, 20 aa, artificial
  peptide fold or domain or sub-domain
VDGRDGEGQYCNRGLAFAPA

SEQ ID NO: 20726 - protein, 30 aa, artificial
  peptide fold or domain or sub-domain
VDGRNAYSGVNLCDYVGDDALRVLDARLTL

SEQ ID NO: 20727 - protein, 29 aa, artificial
  peptide fold or domain or sub-domain
VDGSDSRMLRAARIKDPVKRFQAVFQLCN

SEQ ID NO: 20728 - protein, 24 aa, artificial
  peptide fold or domain or sub-domain
VDGTMGRAMREYVLPTFRMFGMTK

SEQ ID NO: 20729 - protein, 22 aa, artificial
  peptide fold or domain or sub-domain
VDGYFLENWKFPSFKAVRTFLD

SEQ ID NO: 20730 - protein, 21 aa, artificial
  peptide fold or domain or sub-domain
VDHGMYTKYSSNFKKIRKRVH

SEQ ID NO: 20731 - protein, 30 aa, artificial
  peptide fold or domain or sub-domain
VDHIIHMSCALAYHRQKDTVEVCDVKLALK

SEQ ID NO: 20732 - protein, 21 aa, artificial
  peptide fold or domain or sub-domain
VDHSMVTKYNNDSTAIRTWIY

SEQ ID NO: 20733 - protein, 30 aa, artificial
  peptide fold or domain or sub-domain
VDIDKVIEAHEKKSINDIFHEKGQIYFRDL

SEQ ID NO: 20734 - protein, 22 aa, artificial
  peptide fold or domain or sub-domain
VDILAGDTNAHAFLAKNPNGKI

SEQ ID NO: 20735 - protein, 28 aa, artificial
  peptide fold or domain or sub-domain
VDILDSGDSAHLTLMKRPELGVTLTKLH

SEQ ID NO: 20736 - protein, 28 aa, artificial
  peptide fold or domain or sub-domain
VDIREAPIQGFEAGGIRTADAFYDLDVV

SEQ ID NO: 20737 - protein, 25 aa, artificial
  peptide fold or domain or sub-domain
VDISGLQSDDRAEHERVAADLGAAA

SEQ ID NO: 20738 - protein, 26 aa, artificial
  peptide fold or domain or sub-domain
VDITDLPLGDLQKFSPLFGSDIVAVA

SEQ ID NO: 20739 - protein, 22 aa, artificial
  peptide fold or domain or sub-domain
VDIVARAQLSPEYLEKNPQHTV

SEQ ID NO: 20740 - protein, 21 aa, artificial
  peptide fold or domain or sub-domain
VDKAMFDKRNGSTRAEVIHDA

SEQ ID NO: 20741 - protein, 21 aa, artificial
  peptide fold or domain or sub-domain
VDKERYDMMGRNQTAVREEMI

SEQ ID NO: 20742 - protein, 29 aa, artificial
  peptide fold or domain or sub-domain
VDKILSKNEAAELYHLPINSIGDYVIFAS

SEQ ID NO: 20743 - protein, 22 aa, artificial
  peptide fold or domain or sub-domain
VDKNNEGTYYSPTGSGPPPSGS

SEQ ID NO: 20744 - protein, 26 aa, artificial
  peptide fold or domain or sub-domain
VDKPNGQRYRSWFGAYDATRWNQAET

SEQ ID NO: 20745 - protein, 21 aa, artificial
  peptide fold or domain or sub-domain
VDKTLYDYWGSDSMIVTNKVI

SEQ ID NO: 20746 - protein, 22 aa, artificial
  peptide fold or domain or sub-domain
VDKTPSEKAQKMLTEDEIAGQA

SEQ ID NO: 20747 - protein, 28 aa, artificial
  peptide fold or domain or sub-domain
VDKYSYLFLKKLGIEIEDYDELQHFFEK

SEQ ID NO: 20748 - protein, 28 aa, artificial
  peptide fold or domain or sub-domain
VDKYTLRIFEFLDFTFESYDEARQWLED

SEQ ID NO: 20749 - protein, 25 aa, artificial
  peptide fold or domain or sub-domain
VDLAAALRDAAGMRRAVAQVAAACA

SEQ ID NO: 20750 - protein, 22 aa, artificial
  peptide fold or domain or sub-domain
VDLAAGAHKAPDFLKLNPFGQV

SEQ ID NO: 20751 - protein, 26 aa, artificial
  peptide fold or domain or sub-domain
VDLAELASGSLALVGGKALNLGKLAA

SEQ ID NO: 20752 - protein, 25 aa, artificial
  peptide fold or domain or sub-domain
VDLERLTRGGAGERKACAGAMARAA

SEQ ID NO: 20753 - protein, 21 aa, artificial
  peptide fold or domain or sub-domain
VDLFADPRLNHHAAVFGGVEA

SEQ ID NO: 20754 - protein, 25 aa, artificial
  peptide fold or domain or sub-domain
VDLGVLINGAADERSRAIRDLGRAC

SEQ ID NO: 20755 - protein, 28 aa, artificial
  peptide fold or domain or sub-domain
VDLKQTPIDRVVPEGIVTSEGLHELDVL

SEQ ID NO: 20756 - protein, 28 aa, artificial
  peptide fold or domain or sub-domain
VDLLESPLERITEKGIVVGGEEIELDVI

SEQ ID NO: 20757 - protein, 30 aa, artificial
  peptide fold or domain or sub-domain
VDLLFTFFNSYEAEAKKMIDAQLALPAYEL

SEQ ID NO: 20758 - protein, 22 aa, artificial
  peptide fold or domain or sub-domain
VDLMKDEQLRPTFTVLNPFHCV

SEQ ID NO: 20759 - protein, 22 aa, artificial
  peptide fold or domain or sub-domain
VDLMKGEQRQPEYLAIQPFGKI

SEQ ID NO: 20760 - protein, 26 aa, artificial
  peptide fold or domain or sub-domain
VDLRDATRKIIHMVGGKAASLGELLE

SEQ ID NO: 20761 - protein, 29 aa, artificial
  peptide fold or domain or sub-domain
VDLSLDKATACRLFDLPEDREADVAVIAR

SEQ ID NO: 20762 - protein, 25 aa, artificial
  peptide fold or domain or sub-domain
VDLSLPVSDLMLHHKLNRDRDWALR

SEQ ID NO: 20763 - protein, 25 aa, artificial
  peptide fold or domain or sub-domain
VDLSRLSASNGEDSAGELAKLRSAL

SEQ ID NO: 20764 - protein, 29 aa, artificial
  peptide fold or domain or sub-domain
VDLTIAQFRDKYGPLCTEKGKIHEDFVSV

SEQ ID NO: 20765 - protein, 21 aa, artificial
  peptide fold or domain or sub-domain
VDNHRFLQKNSDPAAVQKETV

SEQ ID NO: 20766 - protein, 25 aa, artificial
  peptide fold or domain or sub-domain
VDNKNIQHINRIYRDRNVPTDVLSF

SEQ ID NO: 20767 - protein, 21 aa, artificial
  peptide fold or domain or sub-domain
VDNKVYKNFQENTKKVHQYCK

SEQ ID NO: 20768 - protein, 21 aa, artificial
  peptide fold or domain or sub-domain
VDNRMYRYYNYDKPAIKIRVY

SEQ ID NO: 20769 - protein, 21 aa, artificial
  peptide fold or domain or sub-domain
VDNSLYRYFNSDIWTVHRYCT

SEQ ID NO: 20770 - protein, 21 aa, artificial
  peptide fold or domain or sub-domain
VDNTEYRNFGSSMDSIRARML

SEQ ID NO: 20771 - protein, 30 aa, artificial
  peptide fold or domain or sub-domain
VDNVISSACKLSKLRESPQLDIRDLQLILE

SEQ ID NO: 20772 - protein, 28 aa, artificial
  peptide fold or domain or sub-domain
VDNYSLRLAFYLGYEFENYEELREFFQS

SEQ ID NO: 20773 - protein, 23 aa, artificial
  peptide fold or domain or sub-domain
VDPDGILTVPAASHSFYNEEVPF

SEQ ID NO: 20774 - protein, 22 aa, artificial
  peptide fold or domain or sub-domain
VDPFNPNIYNRPEYVWLLQKNQ

SEQ ID NO: 20775 - protein, 22 aa, artificial
  peptide fold or domain or sub-domain
VDPHHPVIKSDPKIAWIALKHH

SEQ ID NO: 20776 - protein, 23 aa, artificial
  peptide fold or domain or sub-domain
VDPIQLYYLMSRGIPKEEAERLV

SEQ ID NO: 20777 - protein, 21 aa, artificial
  peptide fold or domain or sub-domain
VDPKSEFKVVCYFTNWAWYRQ

SEQ ID NO: 20778 - protein, 28 aa, artificial
  peptide fold or domain or sub-domain
VDPQKLDDVSDAVQKEDVRRLIDEGVIK

SEQ ID NO: 20779 - protein, 22 aa, artificial
  peptide fold or domain or sub-domain
VDQAVDRMALKYPLIIRRKKDD

SEQ ID NO: 20780 - protein, 20 aa, artificial
  peptide fold or domain or sub-domain
VDQDWMDSSNPGTWTDEARH

SEQ ID NO: 20781 - protein, 20 aa, artificial
  peptide fold or domain or sub-domain
VDQEDADGRFATPEAKAAND

SEQ ID NO: 20782 - protein, 23 aa, artificial
  peptide fold or domain or sub-domain
VDQETLFYMQDRGLTAQQATDML

SEQ ID NO: 20783 - protein, 23 aa, artificial
  peptide fold or domain or sub-domain
VDQLQRAFTELDPDGADQFASNA

SEQ ID NO: 20784 - protein, 23 aa, artificial
  peptide fold or domain or sub-domain
VDQPAIMSYWDLPQEERLKYGIK

SEQ ID NO: 20785 - protein, 27 aa, artificial
  peptide fold or domain or sub-domain
VDQSLVSRCLGGDEAAWEELVRQHTRQ

SEQ ID NO: 20786 - protein, 23 aa, artificial
  peptide fold or domain or sub-domain
VDRAVEEYGFKSRSDLIKTALQT

SEQ ID NO: 20787 - protein, 30 aa, artificial
  peptide fold or domain or sub-domain
VDRCLNGAALIAKNRRVNTIEVKDVQQFLN

SEQ ID NO: 20788 - protein, 25 aa, artificial
  peptide fold or domain or sub-domain
VDRDDDGYVVVQGASTVTSAPGIFA

SEQ ID NO: 20789 - protein, 20 aa, artificial
  peptide fold or domain or sub-domain
VDREALQRQLKEENEEERLK

SEQ ID NO: 20790 - protein, 26 aa, artificial
  peptide fold or domain or sub-domain
VDREWAENQGINTISDLEPYASEMSV

SEQ ID NO: 20791 - protein, 28 aa, artificial
  peptide fold or domain or sub-domain
VDRFMEEISYSEDIAPFFADTDPDRFRE

SEQ ID NO: 20792 - protein, 24 aa, artificial
  peptide fold or domain or sub-domain
VDRFMELRLQFPTRDSGDMEERIG

SEQ ID NO: 20793 - protein, 20 aa, artificial
  peptide fold or domain or sub-domain
VDRIAPAVTQHDLDSVEQWF

SEQ ID NO: 20794 - protein, 20 aa, artificial
  peptide fold or domain or sub-domain
VDRIAPQVTDAIRLRANRLS

SEQ ID NO: 20795 - protein, 20 aa, artificial
  peptide fold or domain or sub-domain
VDRIAPTVTEEEAEAVRKLT

SEQ ID NO: 20796 - protein, 20 aa, artificial
  peptide fold or domain or sub-domain
VDRITPKPSAEHQDDVLSRF

SEQ ID NO: 20797 - protein, 20 aa, artificial
  peptide fold or domain or sub-domain
VDRITPMTSTAHRLQLHDEH

SEQ ID NO: 20798 - protein, 20 aa, artificial
  peptide fold or domain or sub-domain
VDRITPQTSILLQEELSSLI

SEQ ID NO: 20799 - protein, 20 aa, artificial
  peptide fold or domain or sub-domain
VDRITPTVSAEIAKKLNAAS

SEQ ID NO: 20800 - protein, 20 aa, artificial
  peptide fold or domain or sub-domain
VDRITPVSKKSDIDYVVDAY

SEQ ID NO: 20801 - protein, 20 aa, artificial
  peptide fold or domain or sub-domain
VDRITPVTTPEVISTVEREF

SEQ ID NO: 20802 - protein, 20 aa, artificial
  peptide fold or domain or sub-domain
VDRIVDEINNNNASFGVVLD

SEQ ID NO: 20803 - protein, 20 aa, artificial
  peptide fold or domain or sub-domain
VDRIVPAATPETLQEIADQL

SEQ ID NO: 20804 - protein, 20 aa, artificial
  peptide fold or domain or sub-domain
VDRIVPALRPGDTDRVAALT

SEQ ID NO: 20805 - protein, 20 aa, artificial
  peptide fold or domain or sub-domain
VDRIVPATTHAESVTVAHAI

SEQ ID NO: 20806 - protein, 20 aa, artificial
  peptide fold or domain or sub-domain
VDRIVPGFPKENAHRLEEAA

SEQ ID NO: 20807 - protein, 20 aa, artificial
  peptide fold or domain or sub-domain
VDRIVPGYPRDTIEEVHAEL

SEQ ID NO: 20808 - protein, 20 aa, artificial
  peptide fold or domain or sub-domain
VDRIVPSGSDRYNETALAHL

SEQ ID NO: 20809 - protein, 20 aa, artificial
  peptide fold or domain or sub-domain
VDRIVSGFPENRKNEIQQKT

SEQ ID NO: 20810 - protein, 20 aa, artificial
  peptide fold or domain or sub-domain
VDRIVTGFPHGEEETWANRL

SEQ ID NO: 20811 - protein, 28 aa, artificial
  peptide fold or domain or sub-domain
VDRLIDAAVVHPQIGPIFKGVRPRALKD

SEQ ID NO: 20812 - protein, 25 aa, artificial
  peptide fold or domain or sub-domain
VDRLLAEMAQRGGSADLMSEFAAPL

SEQ ID NO: 20813 - protein, 23 aa, artificial
  peptide fold or domain or sub-domain
VDRLLEKKMIKSCFGVSTITEIA

SEQ ID NO: 20814 - protein, 30 aa, artificial
  peptide fold or domain or sub-domain
VDRLQKHFDYFDEEARSLLALGLPIPAYDQ

SEQ ID NO: 20815 - protein, 25 aa, artificial
  peptide fold or domain or sub-domain
VDRQIDEMIAEGAPVDLLKKFASPV

SEQ ID NO: 20816 - protein, 25 aa, artificial
  peptide fold or domain or sub-domain
VDRSIDEMLAAPQPADLVEHVSQAV

SEQ ID NO: 20817 - protein, 20 aa, artificial
  peptide fold or domain or sub-domain
VDRVTPATDELLKTEVAQEL

SEQ ID NO: 20818 - protein, 20 aa, artificial
  peptide fold or domain or sub-domain
VDRVTPRCTDKERKYVADTW

SEQ ID NO: 20819 - protein, 25 aa, artificial
  peptide fold or domain or sub-domain
VDSALDGLEQAGQPADLMDRYALPV

SEQ ID NO: 20820 - protein, 25 aa, artificial
  peptide fold or domain or sub-domain
VDSDITNEADGEPQTFDKEKVLQDI

SEQ ID NO: 20821 - protein, 25 aa, artificial
  peptide fold or domain or sub-domain
VDSDTIAELHVKWLDLEGPTDVMSF

SEQ ID NO: 20822 - protein, 30 aa, artificial
  peptide fold or domain or sub-domain
VDSDVLIEQLQGKPCGVVFAELGEPNFRDL

SEQ ID NO: 20823 - protein, 24 aa, artificial
  peptide fold or domain or sub-domain
VDSFAVFDRDFDIVTDRYGVVLHE

SEQ ID NO: 20824 - protein, 27 aa, artificial
  peptide fold or domain or sub-domain
VDSFLDIFINSFINNRRRSYLILILPA

SEQ ID NO: 20825 - protein, 20 aa, artificial
  peptide fold or domain or sub-domain
VDSITPATDDALRARTLAAT

SEQ ID NO: 20826 - protein, 21 aa, artificial
  peptide fold or domain or sub-domain
VDSSMFAKYNGDAKKIVTVLD

SEQ ID NO: 20827 - protein, 24 aa, artificial
  peptide fold or domain or sub-domain
VDSVPYNQAVNDNIGSGVVLGNPE

SEQ ID NO: 20828 - protein, 25 aa, artificial
  peptide fold or domain or sub-domain
VDTATICKLHLDYFNDDTPTDCISF

SEQ ID NO: 20829 - protein, 24 aa, artificial
  peptide fold or domain or sub-domain
VDTDAECQVTYSGQTNNFCKQEGT

SEQ ID NO: 20830 - protein, 28 aa, artificial
  peptide fold or domain or sub-domain
VDTDGKGPSRVTETGLVVGEKVYLLGVE

SEQ ID NO: 20831 - protein, 30 aa, artificial
  peptide fold or domain or sub-domain
VDTDLLIQQAVGMSLQQYLEENGYLALREQ

SEQ ID NO: 20832 - protein, 30 aa, artificial
  peptide fold or domain or sub-domain
VDTDQWLQSQLNMTVAEIVEREEWAGFRAR

SEQ ID NO: 20833 - protein, 30 aa, artificial
  peptide fold or domain or sub-domain
VDTDRLVEADAGRTVADIFAAEGEEGFRRR

SEQ ID NO: 20834 - protein, 30 aa, artificial
  peptide fold or domain or sub-domain
VDTDSEIIKEFKLTIDQIFEIHGEKKFREC

SEQ ID NO: 20835 - protein, 28 aa, artificial
  peptide fold or domain or sub-domain
VDTGGKGVQEITKTGVVANREHFDLDVL

SEQ ID NO: 20836 - protein, 28 aa, artificial
  peptide fold or domain or sub-domain
VDTGGRGVESITPEGFSVNGKQYDVDCI

SEQ ID NO: 20837 - protein, 28 aa, artificial
  peptide fold or domain or sub-domain
VDTHVLRITNAIGWVPATASRERAYLHL

SEQ ID NO: 20838 - protein, 28 aa, artificial
  peptide fold or domain or sub-domain
VDTLSAPIETITPRGVRTSEREYELDSL

SEQ ID NO: 20839 - protein, 28 aa, artificial
  peptide fold or domain or sub-domain
VDTNIARIVVRLGWVPLEPLPGDLQIHL

SEQ ID NO: 20840 - protein, 30 aa, artificial
  peptide fold or domain or sub-domain
VDTVLDHSLMLAKHRGSEEIEPKDVLMHLE

SEQ ID NO: 20841 - protein, 25 aa, artificial
  peptide fold or domain or sub-domain
VDVADMDSDSPQDRQRLAKEIYRVA

SEQ ID NO: 20842 - protein, 26 aa, artificial
  peptide fold or domain or sub-domain
VDVAELRAGLKAMGIFRLGAAQKIVS

SEQ ID NO: 20843 - protein, 27 aa, artificial
  peptide fold or domain or sub-domain
VDVDAIPIEEFPLYHHWTYDRIYRNDM

SEQ ID NO: 20844 - protein, 30 aa, artificial
  peptide fold or domain or sub-domain
VDVDTAIEEHIGCTIREFFAKEGEPRFRDV

SEQ ID NO: 20845 - protein, 25 aa, artificial
  peptide fold or domain or sub-domain
VDVGVLRDGDAEGLRRAAAQVAAAC

SEQ ID NO: 20846 - protein, 30 aa, artificial
  peptide fold or domain or sub-domain
VDVQGTDVGNLGLDNLGDGEEKTLASVDIS

SEQ ID NO: 20847 - protein, 24 aa, artificial
  peptide fold or domain or sub-domain
VDVQTRKEGPKTIESVTKRELYST

SEQ ID NO: 20848 - protein, 28 aa, artificial
  peptide fold or domain or sub-domain
VDVRDSPIVAITREGVQTEARHHPVDVL

SEQ ID NO: 20849 - protein, 28 aa, artificial
  peptide fold or domain or sub-domain
VDVRSTPIERVTEHALKTTAAEYEIDVL

SEQ ID NO: 20850 - protein, 24 aa, artificial
  peptide fold or domain or sub-domain
VDVTQRNPAQEAKNVVELGFKMID

SEQ ID NO: 20851 - protein, 30 aa, artificial
  peptide fold or domain or sub-domain
VDVWHILEFDYSRLPKQSIGQFHEGDAYVV

SEQ ID NO: 20852 - protein, 26 aa, artificial
  peptide fold or domain or sub-domain
VDWDELEIRWYFDNQLIRRKKNIHWH

SEQ ID NO: 20853 - protein, 20 aa, artificial
  peptide fold or domain or sub-domain
VDWSKTGDYAAIHQQQISNN

SEQ ID NO: 20854 - protein, 29 aa, artificial
  peptide fold or domain or sub-domain
VDYPLYGAVKQSLARRDASLRPLYDVWEY

SEQ ID NO: 20855 - protein, 22 aa, artificial
  peptide fold or domain or sub-domain
VDYSHPVIRSDPELKWLQDSVN

SEQ ID NO: 20856 - protein, 26 aa, artificial
  peptide fold or domain or sub-domain
VEADNRGDKQEGASVTQKLISRDGVV

SEQ ID NO: 20857 - protein, 25 aa, artificial
  peptide fold or domain or sub-domain
VEAEMRLYELDSNISPKVWTVAKLL

SEQ ID NO: 20858 - protein, 28 aa, artificial
  peptide fold or domain or sub-domain
VEAFQEATEQRVDGIAGPVTMNLLDFQA

SEQ ID NO: 20859 - protein, 20 aa, artificial
  peptide fold or domain or sub-domain
VEAITRDLKISPQEYLDRAA

SEQ ID NO: 20860 - protein, 29 aa, artificial
  peptide fold or domain or sub-domain
VEAVLTRSQACQRFELPEDRIGDLVVLGE

SEQ ID NO: 20861 - protein, 29 aa, artificial
  peptide fold or domain or sub-domain
VEAYLERVSAQMRRFATPDQFRELDKQLR

SEQ ID NO: 20862 - protein, 24 aa, artificial
  peptide fold or domain or sub-domain
VEAYRLGMEAIAQGAGEAWLLGCN

SEQ ID NO: 20863 - protein, 24 aa, artificial
  peptide fold or domain or sub-domain
VECLFRRYTESGMSEDLAYKNTVE

SEQ ID NO: 20864 - protein, 21 aa, artificial
  peptide fold or domain or sub-domain
VECYSQGMEADSMNILLPANR

SEQ ID NO: 20865 - protein, 30 aa, artificial
  peptide fold or domain or sub-domain
VEDEEAYEMARYLAKKEGLLVGISSGANVA

SEQ ID NO: 20866 - protein, 28 aa, artificial
  peptide fold or domain or sub-domain
VEDFYVRVLADDQLSAFFSGTNMSRLKG

SEQ ID NO: 20867 - protein, 23 aa, artificial
  peptide fold or domain or sub-domain
VEDIYEGLAKIDPENETYYAQNR

SEQ ID NO: 20868 - protein, 26 aa, artificial
  peptide fold or domain or sub-domain
VEDQGAAMALQPHHRIVGEFSGAFTD

SEQ ID NO: 20869 - protein, 25 aa, artificial
  peptide fold or domain or sub-domain
VEECLDDLEDVGSPVDFVRYAAWPI

SEQ ID NO: 20870 - protein, 28 aa, artificial
  peptide fold or domain or sub-domain
VEECNRAECIQRGVSPSQAQGLGSNLVT

SEQ ID NO: 20871 - protein, 27 aa, artificial
  peptide fold or domain or sub-domain
VEEENIIPYITNVLQNPDLALRMAVRN

SEQ ID NO: 20872 - protein, 28 aa, artificial
  peptide fold or domain or sub-domain
VEELEGIGRVTGAKLKERGYYTVRDIAF

SEQ ID NO: 20873 - protein, 21 aa, artificial
  peptide fold or domain or sub-domain
VEELLEYLGEDLTKPGVLNTP

SEQ ID NO: 20874 - protein, 28 aa, artificial
  peptide fold or domain or sub-domain
VEEMLYRVGGDERIAHHFDGVDIMRVHK

SEQ ID NO: 20875 - protein, 29 aa, artificial
  peptide fold or domain or sub-domain
VEERTENDRPIVVITDIDPEVSKETGLKV

SEQ ID NO: 20876 - protein, 29 aa, artificial
  peptide fold or domain or sub-domain
VEETGVDNGLIGPCAKGNFADDQKLKCYF

SEQ ID NO: 20877 - protein, 30 aa, artificial
  peptide fold or domain or sub-domain
VEFKTNGSQTIAIINDERISLGQWHTRNRV

SEQ ID NO: 20878 - protein, 24 aa, artificial
  peptide fold or domain or sub-domain
VEFSPAELLNEKIDADRDPYYVLG

SEQ ID NO: 20879 - protein, 26 aa, artificial
  peptide fold or domain or sub-domain
VEGLKDLGLLEGSMDFILEQNTFKKY

SEQ ID NO: 20880 - protein, 26 aa, artificial
  peptide fold or domain or sub-domain
VEGLKEAGIMKGNTQDAVAEGAHALF

SEQ ID NO: 20881 - protein, 30 aa, artificial
  peptide fold or domain or sub-domain
VEGNINLDPRLQDSPSLELKQSLTEEAERL

SEQ ID NO: 20882 - protein, 25 aa, artificial
  peptide fold or domain or sub-domain
VEGQMRLASLETGKPATVRNVAKFL

SEQ ID NO: 20883 - protein, 24 aa, artificial
  peptide fold or domain or sub-domain
VEGQVDYYGLYYVHEGIRTYFVQF

SEQ ID NO: 20884 - protein, 24 aa, artificial
  peptide fold or domain or sub-domain
VEGTHETKQFWHLPEEKFFVPPAV

SEQ ID NO: 20885 - protein, 27 aa, artificial
  peptide fold or domain or sub-domain
VEHHELRQAIGLMGYRLSPQTLTTIVK

SEQ ID NO: 20886 - protein, 23 aa, artificial
  peptide fold or domain or sub-domain
VEHIRDSLSADYPDKKETFEKNA

SEQ ID NO: 20887 - protein, 23 aa, artificial
  peptide fold or domain or sub-domain
VEHLFFYCPLPRHKRRLLHNLYE

SEQ ID NO: 20888 - protein, 27 aa, artificial
  peptide fold or domain or sub-domain
VEHVKEECDRLGPGMADICKNYISQYS

SEQ ID NO: 20889 - protein, 30 aa, artificial
  peptide fold or domain or sub-domain
VEHVNFLLKKEKLLKSRIPIDPKSDLIFDS

SEQ ID NO: 20890 - protein, 21 aa, artificial
  peptide fold or domain or sub-domain
VEIAFVTTNSIHINTKQKRSE

SEQ ID NO: 20891 - protein, 27 aa, artificial
  peptide fold or domain or sub-domain
VEIFENIKKLDKRKSPFDYQLMLNAFN

SEQ ID NO: 20892 - protein, 28 aa, artificial
  peptide fold or domain or sub-domain
VEIFYKRMLEDPKVSGFFKPIDMTKQKQ

SEQ ID NO: 20893 - protein, 20 aa, artificial
  peptide fold or domain or sub-domain
VEIHHDLGVELNYATYIRGG

SEQ ID NO: 20894 - protein, 30 aa, artificial
  peptide fold or domain or sub-domain
VEIKESTGGKVTVETKDKQTRVVKEDELQA

SEQ ID NO: 20895 - protein, 25 aa, artificial
  peptide fold or domain or sub-domain
VEISKLRRLPCNCIHCRNRVVDEVE

SEQ ID NO: 20896 - protein, 24 aa, artificial
  peptide fold or domain or sub-domain
VEKFPAWKGKSLDEIKASDKITNH

SEQ ID NO: 20897 - protein, 24 aa, artificial
  peptide fold or domain or sub-domain
VEKGVIALDDGKTEYKVPEIKTES

SEQ ID NO: 20898 - protein, 23 aa, artificial
  peptide fold or domain or sub-domain
VEKHYSAHEGKPFFDELVSFVGQ

SEQ ID NO: 20899 - protein, 21 aa, artificial
  peptide fold or domain or sub-domain
VEKIYQEGYERWAKDDDGKLK

SEQ ID NO: 20900 - protein, 24 aa, artificial
  peptide fold or domain or sub-domain
VEKMVHTWEAYMTARPEQYAGYAD

SEQ ID NO: 20901 - protein, 21 aa, artificial
  peptide fold or domain or sub-domain
VEKQLYNHMGSDTTVVAQKVF

SEQ ID NO: 20902 - protein, 29 aa, artificial
  peptide fold or domain or sub-domain
VEKTGVTEAAIKEFSDGEIHEDEKLKCYM

SEQ ID NO: 20903 - protein, 24 aa, artificial
  peptide fold or domain or sub-domain
VEKVLQDPYWGNLIINKTPMRRPG

SEQ ID NO: 20904 - protein, 29 aa, artificial
  peptide fold or domain or sub-domain
VELAMLGEEAAAMFDMPADREGDLVVISK

SEQ ID NO: 20905 - protein, 28 aa, artificial
  peptide fold or domain or sub-domain
VELENLESYFDFEVDTNGWASVVLARLL

SEQ ID NO: 20906 - protein, 23 aa, artificial
  peptide fold or domain or sub-domain
VELGEHCLIQSGTVIGSDGFGYA

SEQ ID NO: 20907 - protein, 30 aa, artificial
  peptide fold or domain or sub-domain
VELIKNNKYNFINNVHNIKYRTKIRAIYGK

SEQ ID NO: 20908 - protein, 24 aa, artificial
  peptide fold or domain or sub-domain
VELIVEDESTLKVKFGSVEYKVAL

SEQ ID NO: 20909 - protein, 22 aa, artificial
  peptide fold or domain or sub-domain
VELKDGEHKKEPFLSRNPFGQV

SEQ ID NO: 20910 - protein, 22 aa, artificial
  peptide fold or domain or sub-domain
VELKLYQGKEHLRSLRQKTMSY

SEQ ID NO: 20911 - protein, 28 aa, artificial
  peptide fold or domain or sub-domain
VELLVDGFPIPEGMGDNHHWKDQYTKLH

SEQ ID NO: 20912 - protein, 30 aa, artificial
  peptide fold or domain or sub-domain
VELRRDYDDLRVQYEQLRRPFGVTADVPYT

SEQ ID NO: 20913 - protein, 25 aa, artificial
  peptide fold or domain or sub-domain
VELTPAGTIKVDRATLATTAPGVYA

SEQ ID NO: 20914 - protein, 21 aa, artificial
  peptide fold or domain or sub-domain
VELYTCAIALSRNNAIYYCNR

SEQ ID NO: 20915 - protein, 29 aa, artificial
  peptide fold or domain or sub-domain
VENFKWDNFDAHLENGFYRNEDGNLAGAT

SEQ ID NO: 20916 - protein, 23 aa, artificial
  peptide fold or domain or sub-domain
VENICAGLAKADPASKEFYDANA

SEQ ID NO: 20917 - protein, 23 aa, artificial
  peptide fold or domain or sub-domain
VENICRALIEVDPDGREIYESNR

SEQ ID NO: 20918 - protein, 30 aa, artificial
  peptide fold or domain or sub-domain
VENKVPENFVLYAENVMKIAEVPAEEQQSR

SEQ ID NO: 20919 - protein, 20 aa, artificial
  peptide fold or domain or sub-domain
VENPTGDADDGVIHQSGGIT

SEQ ID NO: 20920 - protein, 20 aa, artificial
  peptide fold or domain or sub-domain
VENVDMDGNLVDCFEGRQVT

SEQ ID NO: 20921 - protein, 24 aa, artificial
  peptide fold or domain or sub-domain
VENWKTNGWRTSSGGSVINKEDFQ

SEQ ID NO: 20922 - protein, 24 aa, artificial
  peptide fold or domain or sub-domain
VEPDEAKRRQQGDFVAQADLYPRV

SEQ ID NO: 20923 - protein, 25 aa, artificial
  peptide fold or domain or sub-domain
VEPKAMTDLHVRYMGEEGPTDVLSF

SEQ ID NO: 20924 - protein, 22 aa, artificial
  peptide fold or domain or sub-domain
VEPPELIGTGRAVSRYKPEAIV

SEQ ID NO: 20925 - protein, 21 aa, artificial
  peptide fold or domain or sub-domain
VEPRNDLEMPDGTKASGQWHL

SEQ ID NO: 20926 - protein, 21 aa, artificial
  peptide fold or domain or sub-domain
VEQFTKNLMRDGKLATAQKNM

SEQ ID NO: 20927 - protein, 24 aa, artificial
  peptide fold or domain or sub-domain
VERALQRAQGRFAARVGRAERLAD

SEQ ID NO: 20928 - protein, 25 aa, artificial
  peptide fold or domain or sub-domain
VERDNRSNFKADYGRFSTSVDGVFA

SEQ ID NO: 20929 - protein, 21 aa, artificial
  peptide fold or domain or sub-domain
VERHEGDNYGFIAYEDFRKDP

SEQ ID NO: 20930 - protein, 23 aa, artificial
  peptide fold or domain or sub-domain
VERIRDGLAAADPGNADVYRTSA

SEQ ID NO: 20931 - protein, 21 aa, artificial
  peptide fold or domain or sub-domain
VERITENAVIVDGKAYELDCL

SEQ ID NO: 20932 - protein, 23 aa, artificial
  peptide fold or domain or sub-domain
VERLRAVMVLKATGDRTLLDLSD

SEQ ID NO: 20933 - protein, 28 aa, artificial
  peptide fold or domain or sub-domain
VERLYVKLLADVKLKDFFKTADMQNLKN

SEQ ID NO: 20934 - protein, 26 aa, artificial
  peptide fold or domain or sub-domain
VERTEKEVIFYVDGKETWRYGNQYLD

SEQ ID NO: 20935 - protein, 27 aa, artificial
  peptide fold or domain or sub-domain
VERWGRPSIDEARAVELSDGRHARIRE

SEQ ID NO: 20936 - protein, 27 aa, artificial
  peptide fold or domain or sub-domain
VESADCEWFNTIVDKKDIPSYLGGLCK

SEQ ID NO: 20937 - protein, 20 aa, artificial
  peptide fold or domain or sub-domain
VESGVVQKRFKRREMLQEKF

SEQ ID NO: 20938 - protein, 21 aa, artificial
  peptide fold or domain or sub-domain
VESLLLTSKIATTEKDANTLI

SEQ ID NO: 20939 - protein, 26 aa, artificial
  peptide fold or domain or sub-domain
VESYILILSCRGTEGEKVVGLRAGAD

SEQ ID NO: 20940 - protein, 28 aa, artificial
  peptide fold or domain or sub-domain
VETAGFGVDEVTSHSVRVHDVEYELDLL

SEQ ID NO: 20941 - protein, 24 aa, artificial
  peptide fold or domain or sub-domain
VETAKQRWNFDFQRDQPVPGRVEW

SEQ ID NO: 20942 - protein, 25 aa, artificial
  peptide fold or domain or sub-domain
VETDGRRRLVTETRSGRTSHPKIYA

SEQ ID NO: 20943 - protein, 24 aa, artificial
  peptide fold or domain or sub-domain
VETDPADARSRGDRVTGRDRYARA

SEQ ID NO: 20944 - protein, 30 aa, artificial
  peptide fold or domain or sub-domain
VETHRRRFELADAEATRMLDARLPLPAFDN

SEQ ID NO: 20945 - protein, 24 aa, artificial
  peptide fold or domain or sub-domain
VETLLEKKEFVEAVVSRTPLGRVG

SEQ ID NO: 20946 - protein, 28 aa, artificial
  peptide fold or domain or sub-domain
VETMLSRIADDQRIVDKFARVNIVMLNE

SEQ ID NO: 20947 - protein, 24 aa, artificial
  peptide fold or domain or sub-domain
VETNATHAKSLVDQNNIDGLMAFD

SEQ ID NO: 20948 - protein, 30 aa, artificial
  peptide fold or domain or sub-domain
VETSLFYINRILMAHKTSKNEHFEWAKTLK

SEQ ID NO: 20949 - protein, 28 aa, artificial
  peptide fold or domain or sub-domain
VETVRALEKQNVSQEPEIQRKRNVCPAT

SEQ ID NO: 20950 - protein, 27 aa, artificial
  peptide fold or domain or sub-domain
VEVPLTAVDRRRVRRRLHAPDGAELQL

SEQ ID NO: 20951 - protein, 23 aa, artificial
  peptide fold or domain or sub-domain
VEVPSIMTHRGYPKEKLEDFGFK

SEQ ID NO: 20952 - protein, 28 aa, artificial
  peptide fold or domain or sub-domain
VEVRIYKVSSAFIDIFPSLKQWSYATFF

SEQ ID NO: 20953 - protein, 29 aa, artificial
  peptide fold or domain or sub-domain
VEVRQTRDSMGFALKADQRRGGDTIALKC

SEQ ID NO: 20954 - protein, 28 aa, artificial
  peptide fold or domain or sub-domain
VEVSAKAKAFLDAYRAKYNEEPSTFAAL

SEQ ID NO: 20955 - protein, 27 aa, artificial
  peptide fold or domain or sub-domain
VEVSQVETLIAQGIISDGMIPKVASCT

SEQ ID NO: 20956 - protein, 29 aa, artificial
  peptide fold or domain or sub-domain
VEVVEKSESGWWLVCNTYGSNGWVPGAYL

SEQ ID NO: 20957 - protein, 27 aa, artificial
  peptide fold or domain or sub-domain
VEVVTPNHIQKYISPTTLPEELGGTSN

SEQ ID NO: 20958 - protein, 30 aa, artificial
  peptide fold or domain or sub-domain
VEVWCIQDLHRQPVDPKRHGQLCAGNCYLV

SEQ ID NO: 20959 - protein, 26 aa, artificial
  peptide fold or domain or sub-domain
VEWVKMGQRLPTKATIESHGKLLFVP

SEQ ID NO: 20960 - protein, 26 aa, artificial
  peptide fold or domain or sub-domain
VEYDHRPVLKLSSGKKTWVGRKQIYR

SEQ ID NO: 20961 - protein, 21 aa, artificial
  peptide fold or domain or sub-domain
VEYLGGDLYEARGADWYFGLL

SEQ ID NO: 20962 - protein, 23 aa, artificial
  peptide fold or domain or sub-domain
VFACVTSNGWYAIDDEDFYPWTP

SEQ ID NO: 20963 - protein, 23 aa, artificial
  peptide fold or domain or sub-domain
VFAGTQDRLEARAVPEAGYALHP

SEQ ID NO: 20964 - protein, 20 aa, artificial
  peptide fold or domain or sub-domain
VFAHNPREVLAKDLGVPIAS

SEQ ID NO: 20965 - protein, 26 aa, artificial
  peptide fold or domain or sub-domain
VFATEIGYQRATDKGAHIPVIDEGGY

SEQ ID NO: 20966 - protein, 21 aa, artificial
  peptide fold or domain or sub-domain
VFCVSPGWLKTDLGGPRADLP

SEQ ID NO: 20967 - protein, 26 aa, artificial
  peptide fold or domain or sub-domain
VFDDTIKMLSRIDQSITNNILINKEG

SEQ ID NO: 20968 - protein, 24 aa, artificial
  peptide fold or domain or sub-domain
VFDVDASRRAAFEAIGASWADSPQ

SEQ ID NO: 20969 - protein, 30 aa, artificial
  peptide fold or domain or sub-domain
VFDVPWTELVKRNSKRGTKAVPIDVLRSMY

SEQ ID NO: 20970 - protein, 26 aa, artificial
  peptide fold or domain or sub-domain
VFEDDQADPNSSMQAFNKLVDDEKVS

SEQ ID NO: 20971 - protein, 29 aa, artificial
  peptide fold or domain or sub-domain
VFEGQKKKAKAKLDTELTAKDLQEVIEGY

SEQ ID NO: 20972 - protein, 27 aa, artificial
  peptide fold or domain or sub-domain
VFFSTSQLGQAAPSFGGTTGTLQDAFD

SEQ ID NO: 20973 - protein, 22 aa, artificial
  peptide fold or domain or sub-domain
VFGIEWSPTSVNFYVDGNIYQT

SEQ ID NO: 20974 - protein, 27 aa, artificial
  peptide fold or domain or sub-domain
VFHVFERNLYQMPQRTPMVNGILDPRM

SEQ ID NO: 20975 - protein, 20 aa, artificial
  peptide fold or domain or sub-domain
VFIDGNGKHEEGKLPSSSWR

SEQ ID NO: 20976 - protein, 29 aa, artificial
  peptide fold or domain or sub-domain
VFILAAILDDKRFEAMLTELVDLKQVELT

SEQ ID NO: 20977 - protein, 30 aa, artificial
  peptide fold or domain or sub-domain
VFLGNEIIGKPKDEKDAVNILKKLSGKWHS

SEQ ID NO: 20978 - protein, 29 aa, artificial
  peptide fold or domain or sub-domain
VFLMQAKDDATKRQYERETADLRNLKLCF

SEQ ID NO: 20979 - protein, 23 aa, artificial
  peptide fold or domain or sub-domain
VFLRYFIQHLAYDASAITDEDIA

SEQ ID NO: 20980 - protein, 26 aa, artificial
  peptide fold or domain or sub-domain
VFLSGETDRSAQLAALARGGDDFLTK

SEQ ID NO: 20981 - protein, 25 aa, artificial
  peptide fold or domain or sub-domain
VFMLTSSKDIKIAQKLCGPNVQLIE

SEQ ID NO: 20982 - protein, 22 aa, artificial
  peptide fold or domain or sub-domain
VFPPGMNWTDLITNYSPSREDN

SEQ ID NO: 20983 - protein, 22 aa, artificial
  peptide fold or domain or sub-domain
VFQPGFPWEHTLSNYTVAQEDN

SEQ ID NO: 20984 - protein, 30 aa, artificial
  peptide fold or domain or sub-domain
VFSELVGVREIGKRSGAIGVLSNGKVLRED

SEQ ID NO: 20985 - protein, 28 aa, artificial
  peptide fold or domain or sub-domain
VFSHFSTEQGLMDESEYPDRDRHRQIHD

SEQ ID NO: 20986 - protein, 22 aa, artificial
  peptide fold or domain or sub-domain
VFSLVWTSSRLTWYIDDVQYHT

SEQ ID NO: 20987 - protein, 30 aa, artificial
  peptide fold or domain or sub-domain
VFSVANKLGLIDELLEILEETEGKKFVDLC

SEQ ID NO: 20988 - protein, 27 aa, artificial
  peptide fold or domain or sub-domain
VFSWREAFMSLTENYFLQYLSFIAWTV

SEQ ID NO: 20989 - protein, 26 aa, artificial
  peptide fold or domain or sub-domain
VFTALLIDRFVRLGTYPEECGELRED

SEQ ID NO: 20990 - protein, 21 aa, artificial
  peptide fold or domain or sub-domain
VFTTVLSHVLYKAYDKKCIVL

SEQ ID NO: 20991 - protein, 30 aa, artificial
  peptide fold or domain or sub-domain
VFTWSFYDHKKRYQCLNDMTAVHFYEVMVG

SEQ ID NO: 20992 - protein, 26 aa, artificial
  peptide fold or domain or sub-domain
VFVDGGADPSAVAACIADQTKRRELD

SEQ ID NO: 20993 - protein, 27 aa, artificial
  peptide fold or domain or sub-domain
VFVGLNSDTAIGAHNISMKADTAFDDI

SEQ ID NO: 20994 - protein, 23 aa, artificial
  peptide fold or domain or sub-domain
VFVGSMERMEKDLVPESGHKFIG

SEQ ID NO: 20995 - protein, 23 aa, artificial
  peptide fold or domain or sub-domain
VFVGTARGLEASVVPAAGFPIEL

SEQ ID NO: 20996 - protein, 21 aa, artificial
  peptide fold or domain or sub-domain
VFWIPKLLKSVSEIPFELKNQ

SEQ ID NO: 20997 - protein, 21 aa, artificial
  peptide fold or domain or sub-domain
VFYLNEYQCTAAELPAKIKNR

SEQ ID NO: 20998 - protein, 29 aa, artificial
  peptide fold or domain or sub-domain
VGAAELRRVMRARGVADADIPQDPGAFFG

SEQ ID NO: 20999 - protein, 28 aa, artificial
  peptide fold or domain or sub-domain
VGAFDCDPFKIGEEISGLEVICTKRLKE

SEQ ID NO: 21000 - protein, 20 aa, artificial
  peptide fold or domain or sub-domain
VGAGPSDMKHKEMQAIFDVY

SEQ ID NO: 21001 - protein, 23 aa, artificial
  peptide fold or domain or sub-domain
VGALCPQQWIQDVFGVGAANQID

SEQ ID NO: 21002 - protein, 24 aa, artificial
  peptide fold or domain or sub-domain
VGAQDHVSFVPSSDYGPFSSPSDF

SEQ ID NO: 21003 - protein, 23 aa, artificial
  peptide fold or domain or sub-domain
VGAQVPACTLVQLFNTNCFFSLS

SEQ ID NO: 21004 - protein, 23 aa, artificial
  peptide fold or domain or sub-domain
VGASVQQGVVQSLFNVSSFSQIT

SEQ ID NO: 21005 - protein, 30 aa, artificial
  peptide fold or domain or sub-domain
VGAVFTKDINKSIIVSDQVQSGLVWVNSFN

SEQ ID NO: 21006 - protein, 25 aa, artificial
  peptide fold or domain or sub-domain
VGDDEIERINREYRETDRVTDVISF

SEQ ID NO: 21007 - protein, 25 aa, artificial
  peptide fold or domain or sub-domain
VGDGEMAELNESWRSQQGPTDVLAF

SEQ ID NO: 21008 - protein, 23 aa, artificial
  peptide fold or domain or sub-domain
VGDNNPIHFDENAAKAAGFPSTV

SEQ ID NO: 21009 - protein, 25 aa, artificial
  peptide fold or domain or sub-domain
VGDRTIRALKREHWGEDAPTDVLSF

SEQ ID NO: 21010 - protein, 28 aa, artificial
  peptide fold or domain or sub-domain
VGDSAANTMLGYSGTNQVSFEEMVMLTA

SEQ ID NO: 21011 - protein, 28 aa, artificial
  peptide fold or domain or sub-domain
VGDSAANVVYGYDTTVPISIDELIPLVR

SEQ ID NO: 21012 - protein, 28 aa, artificial
  peptide fold or domain or sub-domain
VGDSLAMTSLGYDSTITLSLNEFKYHVA

SEQ ID NO: 21013 - protein, 28 aa, artificial
  peptide fold or domain or sub-domain
VGDSLGMVVLGYDSTVPVTVEDMIHHTK

SEQ ID NO: 21014 - protein, 28 aa, artificial
  peptide fold or domain or sub-domain
VGDSVAMMLLGHEDTLSISVEEMLVFTK

SEQ ID NO: 21015 - protein, 24 aa, artificial
  peptide fold or domain or sub-domain
VGDVAGQDDIKSGLQFDPDGRAIP

SEQ ID NO: 21016 - protein, 28 aa, artificial
  peptide fold or domain or sub-domain
VGDVALRSAVAHALDLEVRPDAKWLAER

SEQ ID NO: 21017 - protein, 21 aa, artificial
  peptide fold or domain or sub-domain
VGDVYILNNEVVKNVYDLVAI

SEQ ID NO: 21018 - protein, 25 aa, artificial
  peptide fold or domain or sub-domain
VGEAEGRRLNRDYRGKDYATNVLTF

SEQ ID NO: 21019 - protein, 24 aa, artificial
  peptide fold or domain or sub-domain
VGEALITGIGTSPNYTEARSFLTK

SEQ ID NO: 21020 - protein, 26 aa, artificial
  peptide fold or domain or sub-domain
VGEANGVSAEEAEDWVGEPNGIFSMI

SEQ ID NO: 21021 - protein, 25 aa, artificial
  peptide fold or domain or sub-domain
VGEISEDSPLERMAEYTANGDKLHM

SEQ ID NO: 21022 - protein, 26 aa, artificial
  peptide fold or domain or sub-domain
VGEISEDSPLERMAEYTANGDKLHMA

SEQ ID NO: 21023 - protein, 23 aa, artificial
  peptide fold or domain or sub-domain
VGEKPYWKDPNNDFRKNLKVTAV

SEQ ID NO: 21024 - protein, 25 aa, artificial
  peptide fold or domain or sub-domain
VGELAGLTRAEAEARFPSFLAEAAE

SEQ ID NO: 21025 - protein, 30 aa, artificial
  peptide fold or domain or sub-domain
VGELRAAIALVEKEQDYETRAILRELLSDT

SEQ ID NO: 21026 - protein, 29 aa, artificial
  peptide fold or domain or sub-domain
VGELRAALKALLGERLSQREVDEILQDVD

SEQ ID NO: 21027 - protein, 26 aa, artificial
  peptide fold or domain or sub-domain
VGELSSTSIKQAILYTKPVSQELNMA

SEQ ID NO: 21028 - protein, 30 aa, artificial
  peptide fold or domain or sub-domain
VGELTGLVVTEIRERYPDYLAALQADPWTT

SEQ ID NO: 21029 - protein, 28 aa, artificial
  peptide fold or domain or sub-domain
VGEMEKDDLLRHGSINFLQERMLTLSDK

SEQ ID NO: 21030 - protein, 28 aa, artificial
  peptide fold or domain or sub-domain
VGEMEQWCKLSHGASAALKESLFDMSDK

SEQ ID NO: 21031 - protein, 22 aa, artificial
  peptide fold or domain or sub-domain
VGEMERDGLLSHGISEVVVDRL

SEQ ID NO: 21032 - protein, 26 aa, artificial
  peptide fold or domain or sub-domain
VGEMPGVTTEEAKLYTGEERKELQMV

SEQ ID NO: 21033 - protein, 30 aa, artificial
  peptide fold or domain or sub-domain
VGENLKIGGWSTNRIVTAIYNEVLRIYGVQ

SEQ ID NO: 21034 - protein, 23 aa, artificial
  peptide fold or domain or sub-domain
VGERPEWKSAENKFRKEYAINCI

SEQ ID NO: 21035 - protein, 28 aa, artificial
  peptide fold or domain or sub-domain
VGESGIFTHEDCLRLEKSGIGTFLIGES

SEQ ID NO: 21036 - protein, 26 aa, artificial
  peptide fold or domain or sub-domain
VGETPGIGMKMGKLLTDDSRGELNMM

SEQ ID NO: 21037 - protein, 26 aa, artificial
  peptide fold or domain or sub-domain
VGEVFDGDMNFLKQFVGPVDALLNYP

SEQ ID NO: 21038 - protein, 26 aa, artificial
  peptide fold or domain or sub-domain
VGEVFSTASAIDDIYQSGIDSLFDFP

SEQ ID NO: 21039 - protein, 26 aa, artificial
  peptide fold or domain or sub-domain
VGEVFSYDPDTMCSYMSVLPGVTNYF

SEQ ID NO: 21040 - protein, 26 aa, artificial
  peptide fold or domain or sub-domain
VGEVSAKQPGELAPYLPALGSVFDFP

SEQ ID NO: 21041 - protein, 26 aa, artificial
  peptide fold or domain or sub-domain
VGEVWDISETVAPYFKYGFDSTFNFK

SEQ ID NO: 21042 - protein, 25 aa, artificial
  peptide fold or domain or sub-domain
VGEVYFDTAAQMATIYGKNNDEINL

SEQ ID NO: 21043 - protein, 27 aa, artificial
  peptide fold or domain or sub-domain
VGFCVQSNGIHFPFDLQGGGVAQAQYA

SEQ ID NO: 21044 - protein, 29 aa, artificial
  peptide fold or domain or sub-domain
VGFDPHYLLQPKGSPMFGRAHQFGALSLG

SEQ ID NO: 21045 - protein, 25 aa, artificial
  peptide fold or domain or sub-domain
VGFDTRGRMIRDAGYRSPTNSRVYI

SEQ ID NO: 21046 - protein, 28 aa, artificial
  peptide fold or domain or sub-domain
VGFLDDDPHLHGRELNGLRIYNPAQLPQ

SEQ ID NO: 21047 - protein, 30 aa, artificial
  peptide fold or domain or sub-domain
VGGDSAMATAQVLAQKEGIFTGTSGGGVLA

SEQ ID NO: 21048 - protein, 24 aa, artificial
  peptide fold or domain or sub-domain
VGGEDHEQRAFADYSSKEERYHKA

SEQ ID NO: 21049 - protein, 23 aa, artificial
  peptide fold or domain or sub-domain
VGGESVPQLLLDVFGVDNPGYIK

SEQ ID NO: 21050 - protein, 24 aa, artificial
  peptide fold or domain or sub-domain
VGGGIIPDDDKPLLEKIGITGNYG

SEQ ID NO: 21051 - protein, 30 aa, artificial
  peptide fold or domain or sub-domain
VGGIQYYGNKVLKEYKEKDQTHIQYIQAYY

SEQ ID NO: 21052 - protein, 28 aa, artificial
  peptide fold or domain or sub-domain
VGGQAIDLGSVGQQLDQAALETMHRHKT

SEQ ID NO: 21053 - protein, 27 aa, artificial
  peptide fold or domain or sub-domain
VGGQRCHDLSETTCLLPQYGQGPDVYG

SEQ ID NO: 21054 - protein, 28 aa, artificial
  peptide fold or domain or sub-domain
VGGQVEDLAWEGRQADEPQLRRIHSLKT

SEQ ID NO: 21055 - protein, 22 aa, artificial
  peptide fold or domain or sub-domain
VGGTFLEAFIARNKMADFHKIM

SEQ ID NO: 21056 - protein, 27 aa, artificial
  peptide fold or domain or sub-domain
VGGTFLEAFIARNKMADFHKIMKEFGI

SEQ ID NO: 21057 - protein, 22 aa, artificial
  peptide fold or domain or sub-domain
VGGYRWGEERKLDLIGWESARL

SEQ ID NO: 21058 - protein, 23 aa, artificial
  peptide fold or domain or sub-domain
VGHDAVPRLIQDVFDLASYHELQ

SEQ ID NO: 21059 - protein, 29 aa, artificial
  peptide fold or domain or sub-domain
VGHDFVVPSARIEALGVRAVDLTEGFTGA

SEQ ID NO: 21060 - protein, 21 aa, artificial
  peptide fold or domain or sub-domain
VGHTFFVPGHTRVTSGGTDTV

SEQ ID NO: 21061 - protein, 30 aa, artificial
  peptide fold or domain or sub-domain
VGIEFDEPVGKNNGLILGTKIFECRENHGS

SEQ ID NO: 21062 - protein, 27 aa, artificial
  peptide fold or domain or sub-domain
VGIGLMTNGYKINDTSDEGLKKAEDFL

SEQ ID NO: 21063 - protein, 23 aa, artificial
  peptide fold or domain or sub-domain
VGIPAFMTHACIPKTQREAAGIR

SEQ ID NO: 21064 - protein, 29 aa, artificial
  peptide fold or domain or sub-domain
VGIPASKKSERLATELGIPLTTFATYQNV

SEQ ID NO: 21065 - protein, 29 aa, artificial
  peptide fold or domain or sub-domain
VGIPTSIQTTMRAGALGIPLIGLEQAEKI

SEQ ID NO: 21066 - protein, 29 aa, artificial
  peptide fold or domain or sub-domain
VGITENVKGDTKKFEIWYNAREEVYIIQA

SEQ ID NO: 21067 - protein, 26 aa, artificial
  peptide fold or domain or sub-domain
VGKAVLDEVLSEKPLEEKLDAVHAQL

SEQ ID NO: 21068 - protein, 30 aa, artificial
  peptide fold or domain or sub-domain
VGKDEYLLEVPESLSGSVPHDYELCSSKKG

SEQ ID NO: 21069 - protein, 22 aa, artificial
  peptide fold or domain or sub-domain
VGKDMLIPLTESLYVPGKIAKT

SEQ ID NO: 21070 - protein, 23 aa, artificial
  peptide fold or domain or sub-domain
VGKGCDNNFIEDVLGYTNFASIP

SEQ ID NO: 21071 - protein, 22 aa, artificial
  peptide fold or domain or sub-domain
VGKGKAYFEVAIICAISEHTVK

SEQ ID NO: 21072 - protein, 30 aa, artificial
  peptide fold or domain or sub-domain
VGKLAAEARGTLVLEFLGTRELAHRVLWSD

SEQ ID NO: 21073 - protein, 27 aa, artificial
  peptide fold or domain or sub-domain
VGKLVQEGLAKHTPYAGISLTKKGIRY

SEQ ID NO: 21074 - protein, 23 aa, artificial
  peptide fold or domain or sub-domain
VGKNVPNNLLQTTFDAPSFEHLN

SEQ ID NO: 21075 - protein, 26 aa, artificial
  peptide fold or domain or sub-domain
VGKNVPNNLLQTTFDAPSFEHLNVAL

SEQ ID NO: 21076 - protein, 26 aa, artificial
  peptide fold or domain or sub-domain
VGKTAQEVGDLKDENLNEYNATFERL

SEQ ID NO: 21077 - protein, 25 aa, artificial
  peptide fold or domain or sub-domain
VGKTDRHTIDAAKGFYRTSEEGVFA

SEQ ID NO: 21078 - protein, 29 aa, artificial
  peptide fold or domain or sub-domain
VGKTKAPLDLIDGLGRGEFVENKDLKCYA

SEQ ID NO: 21079 - protein, 24 aa, artificial
  peptide fold or domain or sub-domain
VGLGFWAFQDVYRNGRNSTYWSWF

SEQ ID NO: 21080 - protein, 30 aa, artificial
  peptide fold or domain or sub-domain
VGLLFRHFDEYEKEFYRLVEKNLYLPAYDY

SEQ ID NO: 21081 - protein, 28 aa, artificial
  peptide fold or domain or sub-domain
VGLLVDRIYSDQRINSFFATVESQKHKE

SEQ ID NO: 21082 - protein, 27 aa, artificial
  peptide fold or domain or sub-domain
VGLQSSIQDECEGRKRDKLRRVILDLQ

SEQ ID NO: 21083 - protein, 23 aa, artificial
  peptide fold or domain or sub-domain
VGNAVNPATLEQIFGVSSLAGVP

SEQ ID NO: 21084 - protein, 24 aa, artificial
  peptide fold or domain or sub-domain
VGNDDTGYDRAMGRQGCGVMNENG

SEQ ID NO: 21085 - protein, 23 aa, artificial
  peptide fold or domain or sub-domain
VGNMPQWKTPHNEFRVKFGISAV

SEQ ID NO: 21086 - protein, 23 aa, artificial
  peptide fold or domain or sub-domain
VGNQTAQAIRNAATGSVGVESPV

SEQ ID NO: 21087 - protein, 28 aa, artificial
  peptide fold or domain or sub-domain
VGNVCDKDFDNDTIVDTVDVCPENAEVT

SEQ ID NO: 21088 - protein, 22 aa, artificial
  peptide fold or domain or sub-domain
VGNYSGGLAVKEWLLAHEGHRL

SEQ ID NO: 21089 - protein, 23 aa, artificial
  peptide fold or domain or sub-domain
VGPARTTSHVECTPEERAAMGIP

SEQ ID NO: 21090 - protein, 27 aa, artificial
  peptide fold or domain or sub-domain
VGPIYGKIIEDLKEKVILGKINNNKQR

SEQ ID NO: 21091 - protein, 23 aa, artificial
  peptide fold or domain or sub-domain
VGPKTLAAMEKAARSQGTGDIDA

SEQ ID NO: 21092 - protein, 28 aa, artificial
  peptide fold or domain or sub-domain
VGPRECVIPQGEAPDLIELKKVLERNSV

SEQ ID NO: 21093 - protein, 23 aa, artificial
  peptide fold or domain or sub-domain
VGPRPGWRKPDNVHKRTWNISAI

SEQ ID NO: 21094 - protein, 25 aa, artificial
  peptide fold or domain or sub-domain
VGPSDLAAALGHLGNASHPDVQKAI

SEQ ID NO: 21095 - protein, 30 aa, artificial
  peptide fold or domain or sub-domain
VGPSDLAAALGHLGNASHPDVQKAIQHIFN

SEQ ID NO: 21096 - protein, 25 aa, artificial
  peptide fold or domain or sub-domain
VGPSDPGGGRGSSVSERERRPRRRQ

SEQ ID NO: 21097 - protein, 23 aa, artificial
  peptide fold or domain or sub-domain
VGQKPEWRDLSNVYRTKWNVNNV

SEQ ID NO: 21098 - protein, 25 aa, artificial
  peptide fold or domain or sub-domain
VGQLLDELETLPRPVDLVKNFSVPL

SEQ ID NO: 21099 - protein, 23 aa, artificial
  peptide fold or domain or sub-domain
VGQNADQQLLQNLFGVNSFAELN

SEQ ID NO: 21100 - protein, 23 aa, artificial
  peptide fold or domain or sub-domain
VGQPWTMSHGSLPEADRLAREIT

SEQ ID NO: 21101 - protein, 27 aa, artificial
  peptide fold or domain or sub-domain
VGQTNPAEAQAGTVRGDFSLHVSRNVV

SEQ ID NO: 21102 - protein, 20 aa, artificial
  peptide fold or domain or sub-domain
VGRDDLRSLSETYKTPQERW

SEQ ID NO: 21103 - protein, 24 aa, artificial
  peptide fold or domain or sub-domain
VGRDWLADYGTDLNSYSLQTFIHE

SEQ ID NO: 21104 - protein, 21 aa, artificial
  peptide fold or domain or sub-domain
VGRLVNLVMVSGKKTVAARIV

SEQ ID NO: 21105 - protein, 24 aa, artificial
  peptide fold or domain or sub-domain
VGRNFPQFMDLIINKQTSSFATWF

SEQ ID NO: 21106 - protein, 27 aa, artificial
  peptide fold or domain or sub-domain
VGRVTQPSTFHRGSDEPERDGTSRERI

SEQ ID NO: 21107 - protein, 30 aa, artificial
  peptide fold or domain or sub-domain
VGSELKVIARSSAGIISAVQHRSRPLFGVQ

SEQ ID NO: 21108 - protein, 27 aa, artificial
  peptide fold or domain or sub-domain
VGSKRAQTLVGNKFERFPYFFDGNPYG

SEQ ID NO: 21109 - protein, 25 aa, artificial
  peptide fold or domain or sub-domain
VGSLQGLYWKEGAEKEPEAYSAFFS

SEQ ID NO: 21110 - protein, 24 aa, artificial
  peptide fold or domain or sub-domain
VGSQHPWFKKAKKNDPEYVNRFFL

SEQ ID NO: 21111 - protein, 24 aa, artificial
  peptide fold or domain or sub-domain
VGSRIIPAYHRFLQHQGEEGLKDK

SEQ ID NO: 21112 - protein, 28 aa, artificial
  peptide fold or domain or sub-domain
VGTEVFAQAPTTDRYPDTIYYRLLAHKF

SEQ ID NO: 21113 - protein, 29 aa, artificial
  peptide fold or domain or sub-domain
VGTKGDLEITRLNGSLKGQNINFTFNNRE

SEQ ID NO: 21114 - protein, 30 aa, artificial
  peptide fold or domain or sub-domain
VGTVVALTRSSECPSLAKLLGAYPDRTSHV

SEQ ID NO: 21115 - protein, 30 aa, artificial
  peptide fold or domain or sub-domain
VGVDLDEPLGNSDGFYQKKKIFECKGDKYG

SEQ ID NO: 21116 - protein, 30 aa, artificial
  peptide fold or domain or sub-domain
VGVELPYSNGCSDGTFHGRRFFDCDPDRAI

SEQ ID NO: 21117 - protein, 28 aa, artificial
  peptide fold or domain or sub-domain
VGVFDRDPEKVSRLVGGQQVSPMQAMPG

SEQ ID NO: 21118 - protein, 30 aa, artificial
  peptide fold or domain or sub-domain
VGVKYDEPVGKNDGSVAGVRYFDCDPKYGG

SEQ ID NO: 21119 - protein, 22 aa, artificial
  peptide fold or domain or sub-domain
VGVLSEMYPSEMNAQAQEAFSG

SEQ ID NO: 21120 - protein, 20 aa, artificial
  peptide fold or domain or sub-domain
VGVNHDIDEVLEDQLHFDMA

SEQ ID NO: 21121 - protein, 29 aa, artificial
  peptide fold or domain or sub-domain
VGVNYMLGKDSIQSRLEHGISYTEFTYTI

SEQ ID NO: 21122 - protein, 29 aa, artificial
  peptide fold or domain or sub-domain
VGVPCAEGTAALARELGIPLTTLDDVERV

SEQ ID NO: 21123 - protein, 29 aa, artificial
  peptide fold or domain or sub-domain
VGVTTSFQGEVLAAELNIPLLSLNAVDRI

SEQ ID NO: 21124 - protein, 29 aa, artificial
  peptide fold or domain or sub-domain
VGVTTSNRTTEQARGLGIPLKSADDIDVI

SEQ ID NO: 21125 - protein, 22 aa, artificial
  peptide fold or domain or sub-domain
VGVWTYSPVEIGNMKPEEALPL

SEQ ID NO: 21126 - protein, 27 aa, artificial
  peptide fold or domain or sub-domain
  misc_feature (14)..(14): Xaa can be any naturally occurring amino acid
VGWFVQEVFHLPNXIYSASDPTEAFWK

SEQ ID NO: 21127 - protein, 23 aa, artificial
  peptide fold or domain or sub-domain
VHADMRGYSYDRRDVTGRSLANA

SEQ ID NO: 21128 - protein, 22 aa, artificial
  peptide fold or domain or sub-domain
VHAYYNKLVPFVYGNGPLNILA

SEQ ID NO: 21129 - protein, 29 aa, artificial
  peptide fold or domain or sub-domain
VHCEAEREEEEKKLTFSCKKGGITIFTAD

SEQ ID NO: 21130 - protein, 27 aa, artificial
  peptide fold or domain or sub-domain
VHCLQEVLKDYYTLVDRVPTLLQHLAS

SEQ ID NO: 21131 - protein, 25 aa, artificial
  peptide fold or domain or sub-domain
VHCPTNELLTDSTGVILSQSYPGSY

SEQ ID NO: 21132 - protein, 27 aa, artificial
  peptide fold or domain or sub-domain
VHEISSKDLYDISTRAPLPNGPLDLRL

SEQ ID NO: 21133 - protein, 21 aa, artificial
  peptide fold or domain or sub-domain
VHFFDWEEHYSQGLGWYLTQM

SEQ ID NO: 21134 - protein, 25 aa, artificial
  peptide fold or domain or sub-domain
VHFYNSTSILQRRVVFRANRAEVQA

SEQ ID NO: 21135 - protein, 28 aa, artificial
  peptide fold or domain or sub-domain
VHGELAAHVETALSIDGADQGLLNLFFN

SEQ ID NO: 21136 - protein, 25 aa, artificial
  peptide fold or domain or sub-domain
VHGNLACVYYEQGLIDLAIDTYRRA

SEQ ID NO: 21137 - protein, 25 aa, artificial
  peptide fold or domain or sub-domain
VHGTPVEVEAIQLGVDPAEYSMKMH

SEQ ID NO: 21138 - protein, 24 aa, artificial
  peptide fold or domain or sub-domain
VHHASEVVEMHDQPSKALRNKKDS

SEQ ID NO: 21139 - protein, 30 aa, artificial
  peptide fold or domain or sub-domain
VHICGKGNIDEALSKLKGYKQFDYISTELP

SEQ ID NO: 21140 - protein, 21 aa, artificial
  peptide fold or domain or sub-domain
VHIIEPGFHRTEITNEENALR

SEQ ID NO: 21141 - protein, 21 aa, artificial
  peptide fold or domain or sub-domain
VHKASVEEHGSDFVKPENMVT

SEQ ID NO: 21142 - protein, 21 aa, artificial
  peptide fold or domain or sub-domain
VHKFVNVMNKKGQKETVSKIM

SEQ ID NO: 21143 - protein, 26 aa, artificial
  peptide fold or domain or sub-domain
VHKKEDEVRNVQGKEIVLYRGRVIPI

SEQ ID NO: 21144 - protein, 23 aa, artificial
  peptide fold or domain or sub-domain
VHLLGYDHEKGGEEEKKFRELEN

SEQ ID NO: 21145 - protein, 22 aa, artificial
  peptide fold or domain or sub-domain
VHLRSAREKLGTLSTVQAVGRA

SEQ ID NO: 21146 - protein, 25 aa, artificial
  peptide fold or domain or sub-domain
VHLYNAVAPAFREIVFGMEVPQIIA

SEQ ID NO: 21147 - protein, 25 aa, artificial
  peptide fold or domain or sub-domain
VHMYTATAPTWRSVVLGRDRKALHR

SEQ ID NO: 21148 - protein, 26 aa, artificial
  peptide fold or domain or sub-domain
VHNAIAYGTRNNDELIQRNYKLAAQE

SEQ ID NO: 21149 - protein, 26 aa, artificial
  peptide fold or domain or sub-domain
VHNLGISLITHHSLTLEEAIGEVRRR

SEQ ID NO: 21150 - protein, 26 aa, artificial
  peptide fold or domain or sub-domain
VHNLVFVIHHHQKIPLEKAMLAAAAM

SEQ ID NO: 21151 - protein, 26 aa, artificial
  peptide fold or domain or sub-domain
VHNLVLAIRQEYQCSLSEALQQALLL

SEQ ID NO: 21152 - protein, 26 aa, artificial
  peptide fold or domain or sub-domain
VHNLVLVLRASRRLTTREAVAEAARM

SEQ ID NO: 21153 - protein, 22 aa, artificial
  peptide fold or domain or sub-domain
VHNPDGSETMWCYTKPSDLYGD

SEQ ID NO: 21154 - protein, 20 aa, artificial
  peptide fold or domain or sub-domain
VHPDAVPADKRDQYTAMHEN

SEQ ID NO: 21155 - protein, 30 aa, artificial
  peptide fold or domain or sub-domain
VHPIQFKLPQAQVAAKLSTILETKTPQELI

SEQ ID NO: 21156 - protein, 25 aa, artificial
  peptide fold or domain or sub-domain
VHPIRDVLTQPEDDSRDLNLVEKAL

SEQ ID NO: 21157 - protein, 28 aa, artificial
  peptide fold or domain or sub-domain
VHPKEILLLNSISDDIAHICKNLKFAEI

SEQ ID NO: 21158 - protein, 30 aa, artificial
  peptide fold or domain or sub-domain
VHPMGLLPAIEDNGFPLFESAAIVMQLADK

SEQ ID NO: 21159 - protein, 29 aa, artificial
  peptide fold or domain or sub-domain
VHQEADYRAVNLKFSSLGSTFDILYQGNV

SEQ ID NO: 21160 - protein, 30 aa, artificial
  peptide fold or domain or sub-domain
VHQTGGDDLQRIREGYARAGWPQESVVPFI

SEQ ID NO: 21161 - protein, 29 aa, artificial
  peptide fold or domain or sub-domain
VHREAQALSLALRARSITPDFRSPDILRL

SEQ ID NO: 21162 - protein, 23 aa, artificial
  peptide fold or domain or sub-domain
VHRNHDTAAFHRFGADIGSDVPV

SEQ ID NO: 21163 - protein, 25 aa, artificial
  peptide fold or domain or sub-domain
VHSMFATVRPGEQLTQRIYSPGSDL

SEQ ID NO: 21164 - protein, 22 aa, artificial
  peptide fold or domain or sub-domain
VHSQELLSRYPDLDAKGRERAI

SEQ ID NO: 21165 - protein, 21 aa, artificial
  peptide fold or domain or sub-domain
VHSYQKSFKLPAIIVRSNNVY

SEQ ID NO: 21166 - protein, 25 aa, artificial
  peptide fold or domain or sub-domain
VHTFIATSEIHMKYKLKMSREQVVE

SEQ ID NO: 21167 - protein, 21 aa, artificial
  peptide fold or domain or sub-domain
VHTIAPGLFKTGFVKNGLKAN

SEQ ID NO: 21168 - protein, 20 aa, artificial
  peptide fold or domain or sub-domain
VHTKDAPFYVSKDVVKSVPM

SEQ ID NO: 21169 - protein, 20 aa, artificial
  peptide fold or domain or sub-domain
VHTMVQNIIYEKLDSSVPRP

SEQ ID NO: 21170 - protein, 27 aa, artificial
  peptide fold or domain or sub-domain
VHTNAENKLYLAENYCFDSIPKLIHYH

SEQ ID NO: 21171 - protein, 29 aa, artificial
  peptide fold or domain or sub-domain
VHVDPTQWKEPEKFMPERFLSDEGGVIHN

SEQ ID NO: 21172 - protein, 25 aa, artificial
  peptide fold or domain or sub-domain
VHVFIPTSEVQRVHTIRKSHEEVVA

SEQ ID NO: 21173 - protein, 29 aa, artificial
  peptide fold or domain or sub-domain
VHVLFAALTDKPLERMIRPLDELAETITF

SEQ ID NO: 21174 - protein, 23 aa, artificial
  peptide fold or domain or sub-domain
VHVPKRHLTKCSTSSDPTQCGCR

SEQ ID NO: 21175 - protein, 25 aa, artificial
  peptide fold or domain or sub-domain
VHVYNATAPSFRRIVFNQDKQGVVD

SEQ ID NO: 21176 - protein, 25 aa, artificial
  peptide fold or domain or sub-domain
VHVYNSTCRIQREKVYAKDKAEIKE

SEQ ID NO: 21177 - protein, 26 aa, artificial
  peptide fold or domain or sub-domain
VHWHSVWGLPMTAEEWDDPQSRCVAA

SEQ ID NO: 21178 - protein, 29 aa, artificial
  peptide fold or domain or sub-domain
VHYDSDQFKTPQEFNPEHFLDDNHSFKKS

SEQ ID NO: 21179 - protein, 25 aa, artificial
  peptide fold or domain or sub-domain
VHYVVPRTEESLIFGKKENTGFFAV

SEQ ID NO: 21180 - protein, 27 aa, artificial
  peptide fold or domain or sub-domain
VIACQCHISAAINAADLEEAGHLTIRL

SEQ ID NO: 21181 - protein, 27 aa, artificial
  peptide fold or domain or sub-domain
VIADLDQMAAERAAEAMGGDVLGLPVD

SEQ ID NO: 21182 - protein, 27 aa, artificial
  peptide fold or domain or sub-domain
VIADVQDELGEALAEQCGPNALFHHTD

SEQ ID NO: 21183 - protein, 25 aa, artificial
  peptide fold or domain or sub-domain
VIAFGKFKLNLGTREMFREDEPMPL

SEQ ID NO: 21184 - protein, 28 aa, artificial
  peptide fold or domain or sub-domain
VIAFQKQNNLNSDGIVGRLTWDKLFDHR

SEQ ID NO: 21185 - protein, 21 aa, artificial
  peptide fold or domain or sub-domain
VIAKLNHNQFECKGCDNKIDI

SEQ ID NO: 21186 - protein, 24 aa, artificial
  peptide fold or domain or sub-domain
VIARLQRQALERGDVAPRFHALTR

SEQ ID NO: 21187 - protein, 30 aa, artificial
  peptide fold or domain or sub-domain
VICHDGDSICTGGIIPNDPHKNYQIDAQTA

SEQ ID NO: 21188 - protein, 27 aa, artificial
  peptide fold or domain or sub-domain
VIDIKQTGEHFVIVVKTSQQTVTNEFT

SEQ ID NO: 21189 - protein, 21 aa, artificial
  peptide fold or domain or sub-domain
VIDKWGIERPGWGKEGHAVFA

SEQ ID NO: 21190 - protein, 24 aa, artificial
  peptide fold or domain or sub-domain
VIDRIAADLYAQGKTGPGTHEIAR

SEQ ID NO: 21191 - protein, 24 aa, artificial
  peptide fold or domain or sub-domain
VIDSCGHCKMCTHHIEQHCMNGAT

SEQ ID NO: 21192 - protein, 24 aa, artificial
  peptide fold or domain or sub-domain
VIDSTRCNADDAYQGEVTEKMMCA

SEQ ID NO: 21193 - protein, 24 aa, artificial
  peptide fold or domain or sub-domain
VIDTLTEDFKTEGKLSAWYHYESR

SEQ ID NO: 21194 - protein, 20 aa, artificial
  peptide fold or domain or sub-domain
VIDTPANRQAMGTENADKWV

SEQ ID NO: 21195 - protein, 24 aa, artificial
  peptide fold or domain or sub-domain
VIDYFIKKLLKEGKTKPKYHAISR

SEQ ID NO: 21196 - protein, 20 aa, artificial
  peptide fold or domain or sub-domain
VIEAVEQAQAKAPKAGKNQG

SEQ ID NO: 21197 - protein, 27 aa, artificial
  peptide fold or domain or sub-domain
VIEIQQNGNDFVVTLKTPKNSQSNSFT

SEQ ID NO: 21198 - protein, 29 aa, artificial
  peptide fold or domain or sub-domain
VIEMCRNILGMSDAFSEEFQPSGKNLVVR

SEQ ID NO: 21199 - protein, 24 aa, artificial
  peptide fold or domain or sub-domain
VIENKICNRPAYLNGRVRDHEMCA

SEQ ID NO: 21200 - protein, 29 aa, artificial
  peptide fold or domain or sub-domain
VIEYVRNVLGIDTAGSAELDANCKDPVVI

SEQ ID NO: 21201 - protein, 29 aa, artificial
  peptide fold or domain or sub-domain
VIFEPTMQDGETFFGSQVINNLVEFKEIS

SEQ ID NO: 21202 - protein, 29 aa, artificial
  peptide fold or domain or sub-domain
VIFHLEQSNRVARAKDIADQMSVQRASVT

SEQ ID NO: 21203 - protein, 26 aa, artificial
  peptide fold or domain or sub-domain
VIGLARRGADTAIVFDFDDAMGTSSC

SEQ ID NO: 21204 - protein, 27 aa, artificial
  peptide fold or domain or sub-domain
VIGMMETVVTRGGAKAAAILGYHVAGK

SEQ ID NO: 21205 - protein, 28 aa, artificial
  peptide fold or domain or sub-domain
VIGRGGERIRVLREELAKLTGKNVALNV

SEQ ID NO: 21206 - protein, 30 aa, artificial
  peptide fold or domain or sub-domain
VIGYGMDYAESYRELRDICVLKKEYYEKPE

SEQ ID NO: 21207 - protein, 29 aa, artificial
  peptide fold or domain or sub-domain
VIHADDAALAAMPPVVAEMHARSGLTDEV

SEQ ID NO: 21208 - protein, 29 aa, artificial
  peptide fold or domain or sub-domain
VIHEPEEVLNAMNEWCQTNHSKTGLIQAV

SEQ ID NO: 21209 - protein, 23 aa, artificial
  peptide fold or domain or sub-domain
VIHPASTTHSRMGAQALQDAGIT

SEQ ID NO: 21210 - protein, 29 aa, artificial
  peptide fold or domain or sub-domain
VIHQPDEILDGMDAWNKGTHGRSGLIDKV

SEQ ID NO: 21211 - protein, 29 aa, artificial
  peptide fold or domain or sub-domain
VIHQPKEVLDNMEEWPRKTFLENGLMEKI

SEQ ID NO: 21212 - protein, 26 aa, artificial
  peptide fold or domain or sub-domain
VIHTTTGNMNDGIRLMDDDPNTFWST

SEQ ID NO: 21213 - protein, 28 aa, artificial
  peptide fold or domain or sub-domain
VIIAGHGADAVGAVARDYSETAQVVLQS

SEQ ID NO: 21214 - protein, 26 aa, artificial
  peptide fold or domain or sub-domain
VIIDAKSDFSVYSEKARELILRDQVI

SEQ ID NO: 21215 - protein, 26 aa, artificial
  peptide fold or domain or sub-domain
VIIGRNEATLEESAEQHENITYLVAD

SEQ ID NO: 21216 - protein, 28 aa, artificial
  peptide fold or domain or sub-domain
VIINAEDCPDFTNIIEAPSTVVKTECEM

SEQ ID NO: 21217 - protein, 25 aa, artificial
  peptide fold or domain or sub-domain
VIIPNTAEDSRWMVRTDYDKKGRSA

SEQ ID NO: 21218 - protein, 30 aa, artificial
  peptide fold or domain or sub-domain
VIIPQVLEGNPNTLSKIEKITEINSADMLE

SEQ ID NO: 21219 - protein, 22 aa, artificial
  peptide fold or domain or sub-domain
VIKEIIGFGLIKENDQELKMIV

SEQ ID NO: 21220 - protein, 24 aa, artificial
  peptide fold or domain or sub-domain
VIKEKEIDLLAKGVTGPEGHTQSR

SEQ ID NO: 21221 - protein, 27 aa, artificial
  peptide fold or domain or sub-domain
VIKKIDIGSVTDDSSNAASVVMATKAN

SEQ ID NO: 21222 - protein, 29 aa, artificial
  peptide fold or domain or sub-domain
VIKLDEKQLSEMNDWCIEQHGKSGLTERC

SEQ ID NO: 21223 - protein, 29 aa, artificial
  peptide fold or domain or sub-domain
VIKMDNSSAYTSTRFAAFLKEFRISHITS

SEQ ID NO: 21224 - protein, 27 aa, artificial
  peptide fold or domain or sub-domain
VIKMLGEVVRFGTGKPAHIPGYRLGGK

SEQ ID NO: 21225 - protein, 29 aa, artificial
  peptide fold or domain or sub-domain
VIKPSEKAVNHMNDFVRQMHTRSGLINEW

SEQ ID NO: 21226 - protein, 29 aa, artificial
  peptide fold or domain or sub-domain
VIKTDNGSAFTSKAATAWAQRWHITLKHG

SEQ ID NO: 21227 - protein, 23 aa, artificial
  peptide fold or domain or sub-domain
VILECKTLKAIADAKGTSPHCVA

SEQ ID NO: 21228 - protein, 23 aa, artificial
  peptide fold or domain or sub-domain
VILGRQCHELELEYLLEFADDKE

SEQ ID NO: 21229 - protein, 25 aa, artificial
  peptide fold or domain or sub-domain
VILNFARAAKSLPMEKVVEFAHRFT

SEQ ID NO: 21230 - protein, 27 aa, artificial
  peptide fold or domain or sub-domain
VILSKSKTRKGIEEGKYLGWDDPRLGT

SEQ ID NO: 21231 - protein, 27 aa, artificial
  peptide fold or domain or sub-domain
VILSQKKKLLDKKLKTQVPEEIYQILL

SEQ ID NO: 21232 - protein, 25 aa, artificial
  peptide fold or domain or sub-domain
VILTVDRQYSDRSNADVIYVNARFL

SEQ ID NO: 21233 - protein, 25 aa, artificial
  peptide fold or domain or sub-domain
VILVTLVKSGEVKEQKRMTAKFGEA

SEQ ID NO: 21234 - protein, 26 aa, artificial
  peptide fold or domain or sub-domain
VIMTTSSNPKDIEICYSYSISSYIVK

SEQ ID NO: 21235 - protein, 21 aa, artificial
  peptide fold or domain or sub-domain
VINAGWNKVLEESFSTDLSNW

SEQ ID NO: 21236 - protein, 21 aa, artificial
  peptide fold or domain or sub-domain
VINFRRDLKWNWIRQPRNYSP

SEQ ID NO: 21237 - protein, 28 aa, artificial
  peptide fold or domain or sub-domain
VINFYQKLMADENLKKFFTNSDMKVLIS

SEQ ID NO: 21238 - protein, 24 aa, artificial
  peptide fold or domain or sub-domain
VINSSTAVAKAREQYGCDTLEYLE

SEQ ID NO: 21239 - protein, 25 aa, artificial
  peptide fold or domain or sub-domain
VINTDSDEIAESAKKNFQVTILERP

SEQ ID NO: 21240 - protein, 23 aa, artificial
  peptide fold or domain or sub-domain
VINTGGRSGEVHSPDNVFYFEIS

SEQ ID NO: 21241 - protein, 20 aa, artificial
  peptide fold or domain or sub-domain
VINVNRGLNKYEQFNFPVIP

SEQ ID NO: 21242 - protein, 24 aa, artificial
  peptide fold or domain or sub-domain
VIPAEHVIASDAKPSQAIRASRGT

SEQ ID NO: 21243 - protein, 30 aa, artificial
  peptide fold or domain or sub-domain
VIPDMISREKLRELARILEADVESVMERYD

SEQ ID NO: 21244 - protein, 29 aa, artificial
  peptide fold or domain or sub-domain
VIPNETEAEALAGTPVHALEDAQRCAQKL

SEQ ID NO: 21245 - protein, 25 aa, artificial
  peptide fold or domain or sub-domain
VIPQAEDVHNPAAWTEDALFRPETR

SEQ ID NO: 21246 - protein, 23 aa, artificial
  peptide fold or domain or sub-domain
VIPSDFGYGDDGRAPAIPGKARL

SEQ ID NO: 21247 - protein, 23 aa, artificial
  peptide fold or domain or sub-domain
VIPSNQAYGEEGAGDLIPPHAPL

SEQ ID NO: 21248 - protein, 25 aa, artificial
  peptide fold or domain or sub-domain
VIQLIKGYLALERYDRIEEVLEIAI

SEQ ID NO: 21249 - protein, 29 aa, artificial
  peptide fold or domain or sub-domain
VIRASSSAQYSAPGYLLFLRESTLMAQSF

SEQ ID NO: 21250 - protein, 25 aa, artificial
  peptide fold or domain or sub-domain
VIRDRAWVKSDQGYQLVTEQGAKPL

SEQ ID NO: 21251 - protein, 25 aa, artificial
  peptide fold or domain or sub-domain
VIRDVSLNGTSVNGRYLGRGNSALL

SEQ ID NO: 21252 - protein, 26 aa, artificial
  peptide fold or domain or sub-domain
VISDVNLAYSEHARKYLHECGLPKER

SEQ ID NO: 21253 - protein, 28 aa, artificial
  peptide fold or domain or sub-domain
VISFQRNNGLSADGVVGESTWNKILSNL

SEQ ID NO: 21254 - protein, 27 aa, artificial
  peptide fold or domain or sub-domain
VISGLFDVYNKGTAYALRVEGIDICGK

SEQ ID NO: 21255 - protein, 30 aa, artificial
  peptide fold or domain or sub-domain
VISISPEGVIRHHRSITQASKETGVTNASI

SEQ ID NO: 21256 - protein, 27 aa, artificial
  peptide fold or domain or sub-domain
VISLTGSSETGVKVMRSAGIKQLIMEL

SEQ ID NO: 21257 - protein, 27 aa, artificial
  peptide fold or domain or sub-domain
VISTSDNQVTVDEEAFFPTLIELIKHY

SEQ ID NO: 21258 - protein, 29 aa, artificial
  peptide fold or domain or sub-domain
VITDNIAKDRPHWSEMTKAQYLYSLTDEG

SEQ ID NO: 21259 - protein, 27 aa, artificial
  peptide fold or domain or sub-domain
VITGRNQEKGRQTALEIAGDILFIQQD

SEQ ID NO: 21260 - protein, 27 aa, artificial
  peptide fold or domain or sub-domain
VITGRREKELKEAAAFIMRNVTTVVGD

SEQ ID NO: 21261 - protein, 21 aa, artificial
  peptide fold or domain or sub-domain
VITIEPGPINSRFRDNAVDLS

SEQ ID NO: 21262 - protein, 26 aa, artificial
  peptide fold or domain or sub-domain
VITSRAEAGRQVSELFPNLRGHYDLA

SEQ ID NO: 21263 - protein, 24 aa, artificial
  peptide fold or domain or sub-domain
VIVALEDTEKHKPNPEPILKALEL

SEQ ID NO: 21264 - protein, 26 aa, artificial
  peptide fold or domain or sub-domain
VIVDPASDWDLFAEKSKELILDKKVT

SEQ ID NO: 21265 - protein, 28 aa, artificial
  peptide fold or domain or sub-domain
VIVETDKTLFANAPVVKHYSSEMYYRLL

SEQ ID NO: 21266 - protein, 20 aa, artificial
  peptide fold or domain or sub-domain
VIVGKYYRELLEVLLDEIVI

SEQ ID NO: 21267 - protein, 27 aa, artificial
  peptide fold or domain or sub-domain
VIVHDTLGKVSGTEGVTYEVHDSFLTG

SEQ ID NO: 21268 - protein, 30 aa, artificial
  peptide fold or domain or sub-domain
VIVKEAGIFVLRRRGKEITMADFMKAYDKV

SEQ ID NO: 21269 - protein, 29 aa, artificial
  peptide fold or domain or sub-domain
VIVNQSECELLTGIYPEDEKSYHIALEVF

SEQ ID NO: 21270 - protein, 26 aa, artificial
  peptide fold or domain or sub-domain
VIVTAYDKEDVLDATNDLDIAGFLSK

SEQ ID NO: 21271 - protein, 25 aa, artificial
  peptide fold or domain or sub-domain
VIVTGADDALITSSESVTAHNLRSV

SEQ ID NO: 21272 - protein, 27 aa, artificial
  peptide fold or domain or sub-domain
VIVVEVDPIRALEAVFDGYEVMPMDKA

SEQ ID NO: 21273 - protein, 26 aa, artificial
  peptide fold or domain or sub-domain
VIWLKDNNELPDDERFLVGKDNLTIM

SEQ ID NO: 21274 - protein, 26 aa, artificial
  peptide fold or domain or sub-domain
VIWLNENNEPMSHEDWHLKDRDFISL

SEQ ID NO: 21275 - protein, 29 aa, artificial
  peptide fold or domain or sub-domain
VIWQPEEVLLRMEPVVREMHTRNELLEKV

SEQ ID NO: 21276 - protein, 29 aa, artificial
  peptide fold or domain or sub-domain
VIWRLTEREREVSVSDIAKAIGHSLSTVS

SEQ ID NO: 21277 - protein, 26 aa, artificial
  peptide fold or domain or sub-domain
VIYSGSAMQRDVKLAYRLGGNCYIRK

SEQ ID NO: 21278 - protein, 29 aa, artificial
  peptide fold or domain or sub-domain
VIYSLRNTDYFKIYADHTEQVTITKLEHF

SEQ ID NO: 21279 - protein, 29 aa, artificial
  peptide fold or domain or sub-domain
VIYYLASRNEPVIAARLARWMKVQPPTVT

SEQ ID NO: 21280 - protein, 30 aa, artificial
  peptide fold or domain or sub-domain
VKAEGPPVSQVYKNVKVLGNLTEAEFLRTM

SEQ ID NO: 21281 - protein, 28 aa, artificial
  peptide fold or domain or sub-domain
VKAFQRAHGLTANGVVESATYAKLDEVL

SEQ ID NO: 21282 - protein, 25 aa, artificial
  peptide fold or domain or sub-domain
VKAKELLGAISDWNAANIQAAINQT

SEQ ID NO: 21283 - protein, 22 aa, artificial
  peptide fold or domain or sub-domain
VKALSYLYEKLYQKQIDSNKEI

SEQ ID NO: 21284 - protein, 28 aa, artificial
  peptide fold or domain or sub-domain
VKAVEYFIREKLESLKNEEITKVIPYVH

SEQ ID NO: 21285 - protein, 20 aa, artificial
  peptide fold or domain or sub-domain
VKDFFACDPEAKPRAVKNAA

SEQ ID NO: 21286 - protein, 24 aa, artificial
  peptide fold or domain or sub-domain
VKDNQITSALSTQQEPFRDLKKYL

SEQ ID NO: 21287 - protein, 28 aa, artificial
  peptide fold or domain or sub-domain
VKDRVMLMISDKDREVAGEALLCIQKLM

SEQ ID NO: 21288 - protein, 26 aa, artificial
  peptide fold or domain or sub-domain
VKEDGASDWPTFATKAEKLLTQDRVA

SEQ ID NO: 21289 - protein, 25 aa, artificial
  peptide fold or domain or sub-domain
VKELDEDMYVSYGRTYKTEKKSKIA

SEQ ID NO: 21290 - protein, 25 aa, artificial
  peptide fold or domain or sub-domain
VKELEPGHGIGYGSTFVTKKTMTIA

SEQ ID NO: 21291 - protein, 28 aa, artificial
  peptide fold or domain or sub-domain
VKELQKKAGLSPTGVFDKNTYNALLKMI

SEQ ID NO: 21292 - protein, 23 aa, artificial
  peptide fold or domain or sub-domain
VKESDPDEPETRAMNYNQKAIQQ

SEQ ID NO: 21293 - protein, 29 aa, artificial
  peptide fold or domain or sub-domain
VKESGVSTEVINAAKTGQYSEDKAFKKFV

SEQ ID NO: 21294 - protein, 21 aa, artificial
  peptide fold or domain or sub-domain
VKESVITAKGNLWTEAGNLIG

SEQ ID NO: 21295 - protein, 21 aa, artificial
  peptide fold or domain or sub-domain
VKGFQVSGTKLLDASGNELVM

SEQ ID NO: 21296 - protein, 25 aa, artificial
  peptide fold or domain or sub-domain
VKGFSFLNDKISPTKRGKYSGLVEL

SEQ ID NO: 21297 - protein, 20 aa, artificial
  peptide fold or domain or sub-domain
VKGLSQTMLSERQETLKLSK

SEQ ID NO: 21298 - protein, 25 aa, artificial
  peptide fold or domain or sub-domain
VKGMTQTHPSIPPELRGTYAGLAHP

SEQ ID NO: 21299 - protein, 27 aa, artificial
  peptide fold or domain or sub-domain
VKHLTHDGYLVHEWREHVSLSEKGQIT

SEQ ID NO: 21300 - protein, 29 aa, artificial
  peptide fold or domain or sub-domain
VKHSQSRRPSSWRQEKITRTKEEALELIN

SEQ ID NO: 21301 - protein, 25 aa, artificial
  peptide fold or domain or sub-domain
VKHVDKGQPIGYGGRYVATRDMKLG

SEQ ID NO: 21302 - protein, 28 aa, artificial
  peptide fold or domain or sub-domain
VKIAVRDAHPYVSQQANWVTQLDGGFGA

SEQ ID NO: 21303 - protein, 29 aa, artificial
  peptide fold or domain or sub-domain
VKIHEKDEIKEWVMRNCVKDGSFVRSSDS

SEQ ID NO: 21304 - protein, 27 aa, artificial
  peptide fold or domain or sub-domain
VKIICTEKALMFMNQFGFNIDEKVIEV

SEQ ID NO: 21305 - protein, 23 aa, artificial
  peptide fold or domain or sub-domain
VKILEDYELQNEETRVHLLTKLA

SEQ ID NO: 21306 - protein, 22 aa, artificial
  peptide fold or domain or sub-domain
VKILKGQLRSQEYKRINPNMRV

SEQ ID NO: 21307 - protein, 29 aa, artificial
  peptide fold or domain or sub-domain
VKKEGAAAFAEGFLPAVFSEASITNNVPG

SEQ ID NO: 21308 - protein, 29 aa, artificial
  peptide fold or domain or sub-domain
VKKEMDFFANNICIYPHGVRFILSSPYGV

SEQ ID NO: 21309 - protein, 30 aa, artificial
  peptide fold or domain or sub-domain
VKKHPDWDELRRHWLADPDDAVRAAGWSLN

SEQ ID NO: 21310 - protein, 21 aa, artificial
  peptide fold or domain or sub-domain
VKKLIENGPDVYPGALSYKDG

SEQ ID NO: 21311 - protein, 27 aa, artificial
  peptide fold or domain or sub-domain
VKKLLLEDLVLKDKQAGYLLTKKGQIL

SEQ ID NO: 21312 - protein, 25 aa, artificial
  peptide fold or domain or sub-domain
VKKLQPGEKVSYGATYTAQTEEWIG

SEQ ID NO: 21313 - protein, 27 aa, artificial
  peptide fold or domain or sub-domain
VKKMEERGWLLYEKYKPIKLTSKGEKL

SEQ ID NO: 21314 - protein, 25 aa, artificial
  peptide fold or domain or sub-domain
VKKTTNYYQAGALKERNLFQLFVII

SEQ ID NO: 21315 - protein, 25 aa, artificial
  peptide fold or domain or sub-domain
VKKVPAGFTVSYGSTYVTSKATLIV

SEQ ID NO: 21316 - protein, 24 aa, artificial
  peptide fold or domain or sub-domain
VKLGAWSGADEHLSILESWLESYK

SEQ ID NO: 21317 - protein, 30 aa, artificial
  peptide fold or domain or sub-domain
VKLINHLGIEYEFISMSRAGKFLGRSHSYI

SEQ ID NO: 21318 - protein, 27 aa, artificial
  peptide fold or domain or sub-domain
VKLPEKSDFYPEGDKPKVLNPNIFFKH

SEQ ID NO: 21319 - protein, 21 aa, artificial
  peptide fold or domain or sub-domain
VKLQLENEDKPEQGFEYIYID

SEQ ID NO: 21320 - protein, 22 aa, artificial
  peptide fold or domain or sub-domain
VKLREAMKRFDVRSKAHLTALA

SEQ ID NO: 21321 - protein, 24 aa, artificial
  peptide fold or domain or sub-domain
VKLSDLAAESSSFNKGESYADTFN

SEQ ID NO: 21322 - protein, 30 aa, artificial
  peptide fold or domain or sub-domain
VKLTRDIEKDNWSYNKCRKITQELLKEIYY

SEQ ID NO: 21323 - protein, 24 aa, artificial
  peptide fold or domain or sub-domain
VKLTTTAGSQSGGDASSALAWNAD

SEQ ID NO: 21324 - protein, 25 aa, artificial
  peptide fold or domain or sub-domain
VKLVTQDIAKRAGRANCFWVSYPNL

SEQ ID NO: 21325 - protein, 25 aa, artificial
  peptide fold or domain or sub-domain
VKMVVDPSAIASAKALCGPNIELIP

SEQ ID NO: 21326 - protein, 28 aa, artificial
  peptide fold or domain or sub-domain
VKNARSFVYDESLEDFASANDHGALDEW

SEQ ID NO: 21327 - protein, 23 aa, artificial
  peptide fold or domain or sub-domain
VKNIAGAFCEVDKAGCTTYTANS

SEQ ID NO: 21328 - protein, 23 aa, artificial
  peptide fold or domain or sub-domain
VKNITAQIVKQDPDNKEYYEKNS

SEQ ID NO: 21329 - protein, 25 aa, artificial
  peptide fold or domain or sub-domain
VKNLYLCGGSIRKFTLANSQTTNIG

SEQ ID NO: 21330 - protein, 29 aa, artificial
  peptide fold or domain or sub-domain
VKNVSKAKEEGWLEGDLRGKRGMFPGNFV

SEQ ID NO: 21331 - protein, 24 aa, artificial
  peptide fold or domain or sub-domain
VKPMFNMEKQISGEQPKALAMAIL

SEQ ID NO: 21332 - protein, 27 aa, artificial
  peptide fold or domain or sub-domain
VKPSMRCDGWNDCGDTSDEQNCQCDAK

SEQ ID NO: 21333 - protein, 21 aa, artificial
  peptide fold or domain or sub-domain
VKQELAEGNKNWAADAEGYVS

SEQ ID NO: 21334 - protein, 28 aa, artificial
  peptide fold or domain or sub-domain
VKQFQARNGLKVDGVVGRATARTMIAQV

SEQ ID NO: 21335 - protein, 28 aa, artificial
  peptide fold or domain or sub-domain
VKQGHYDVDDDILHKKNIVRIYDVYIKE

SEQ ID NO: 21336 - protein, 25 aa, artificial
  peptide fold or domain or sub-domain
VKQIEAGQGTSYGLTWRAEDRGFVA

SEQ ID NO: 21337 - protein, 27 aa, artificial
  peptide fold or domain or sub-domain
VKQIHSSTCLAAGGRRGVIGEGDALLE

SEQ ID NO: 21338 - protein, 20 aa, artificial
  peptide fold or domain or sub-domain
VKQKLPQKNSSEGNKHHKST

SEQ ID NO: 21339 - protein, 20 aa, artificial
  peptide fold or domain or sub-domain
VKQKNPSWSNVQIRNHLKNT

SEQ ID NO: 21340 - protein, 25 aa, artificial
  peptide fold or domain or sub-domain
VKQVPGGHGVSYGHHYTTPGETTLG

SEQ ID NO: 21341 - protein, 28 aa, artificial
  peptide fold or domain or sub-domain
VKRFQNDFGRPVTGVVDRATFEFIQKMV

SEQ ID NO: 21342 - protein, 27 aa, artificial
  peptide fold or domain or sub-domain
VKRLAAQGLVEYQPYKPVMLTERGEKY

SEQ ID NO: 21343 - protein, 26 aa, artificial
  peptide fold or domain or sub-domain
VKRLKHIGLLSGNIKDLIYQKSYKKY

SEQ ID NO: 21344 - protein, 24 aa, artificial
  peptide fold or domain or sub-domain
VKSCNISKIVKDVEGIVSFDFDKS

SEQ ID NO: 21345 - protein, 23 aa, artificial
  peptide fold or domain or sub-domain
VKSIRDALIETYPQDQEIFKTNA

SEQ ID NO: 21346 - protein, 25 aa, artificial
  peptide fold or domain or sub-domain
VKSISMRHPEVPEKEQGTYVGATHP

SEQ ID NO: 21347 - protein, 24 aa, artificial
  peptide fold or domain or sub-domain
VKSITVALQESENKERSFFDFEPQ

SEQ ID NO: 21348 - protein, 24 aa, artificial
  peptide fold or domain or sub-domain
VKSIVSHEGIYYDCEGYRDMYVDF

SEQ ID NO: 21349 - protein, 29 aa, artificial
  peptide fold or domain or sub-domain
VKSKRSHALDLLAQVGLDETHAEKKVLQL

SEQ ID NO: 21350 - protein, 29 aa, artificial
  peptide fold or domain or sub-domain
VKSLGVSDELVEKYKSWNFPEDDTTQCYI

SEQ ID NO: 21351 - protein, 21 aa, artificial
  peptide fold or domain or sub-domain
VKSRSIDVTKEPEQVFREVER

SEQ ID NO: 21352 - protein, 21 aa, artificial
  peptide fold or domain or sub-domain
VKSWYQSFMREGNVRNHSAGL

SEQ ID NO: 21353 - protein, 25 aa, artificial
  peptide fold or domain or sub-domain
VKSYASVKNQKLGELLSEEEFEDLE

SEQ ID NO: 21354 - protein, 23 aa, artificial
  peptide fold or domain or sub-domain
VKTDAEWQAQLTPEQYYVTRKKG

SEQ ID NO: 21355 - protein, 25 aa, artificial
  peptide fold or domain or sub-domain
VKTIAAGTGVSYGHQFIAPHEMRLA

SEQ ID NO: 21356 - protein, 25 aa, artificial
  peptide fold or domain or sub-domain
VKTIHQGDGVGYGSTFVADEDTIIG

SEQ ID NO: 21357 - protein, 29 aa, artificial
  peptide fold or domain or sub-domain
VKTKEEIAQDPVQIAPVLDAIKNMNKLYY

SEQ ID NO: 21358 - protein, 21 aa, artificial
  peptide fold or domain or sub-domain
VKTLIAYSGDNPYREGLRGTP

SEQ ID NO: 21359 - protein, 21 aa, artificial
  peptide fold or domain or sub-domain
VKTMNAVKKTTTKIDPSILVF

SEQ ID NO: 21360 - protein, 26 aa, artificial
  peptide fold or domain or sub-domain
VKTQPLQDRNLRFWPDQPAGFRMALD

SEQ ID NO: 21361 - protein, 29 aa, artificial
  peptide fold or domain or sub-domain
VKVDKQDIAKLGQAAATIAKAEGLECHAE

SEQ ID NO: 21362 - protein, 29 aa, artificial
  peptide fold or domain or sub-domain
VKVEELRKYYEEGHFKAGSMGPKVLAAIR

SEQ ID NO: 21363 - protein, 30 aa, artificial
  peptide fold or domain or sub-domain
VKVGMELFYQEGPSIVKQLKERNCELFLDL

SEQ ID NO: 21364 - protein, 29 aa, artificial
  peptide fold or domain or sub-domain
VKVNTINDIPLRKHYSKSKRVGDIIIEGK

SEQ ID NO: 21365 - protein, 22 aa, artificial
  peptide fold or domain or sub-domain
VKVTFFQNGKSKKFSRSDPNFS

SEQ ID NO: 21366 - protein, 30 aa, artificial
  peptide fold or domain or sub-domain
VKVWKIEDYEKIDHPQHLYSQFFSSDSYIV

SEQ ID NO: 21367 - protein, 26 aa, artificial
  peptide fold or domain or sub-domain
VKWLRASNWLTGGRYNVQANGDLEIQ

SEQ ID NO: 21368 - protein, 28 aa, artificial
  peptide fold or domain or sub-domain
VKYDDWAKHLDQFAKYLKITGHVSFGYD

SEQ ID NO: 21369 - protein, 25 aa, artificial
  peptide fold or domain or sub-domain
VKYMGIKGDPQSIYGKKGATGCVLV

SEQ ID NO: 21370 - protein, 27 aa, artificial
  peptide fold or domain or sub-domain
VLADLSEEKTTERAAELGAGAHGRRCD

SEQ ID NO: 21371 - protein, 26 aa, artificial
  peptide fold or domain or sub-domain
VLADVHCAPTTGNAAHLLREGIHPAQ

SEQ ID NO: 21372 - protein, 27 aa, artificial
  peptide fold or domain or sub-domain
VLADVNDNGGKSIAADLGPTAMAVKCD

SEQ ID NO: 21373 - protein, 27 aa, artificial
  peptide fold or domain or sub-domain
VLADVNVKRVEDGLADISSNGISIQAD

SEQ ID NO: 21374 - protein, 26 aa, artificial
  peptide fold or domain or sub-domain
VLAFSGRGFDTKVVFDGDASIAESKC

SEQ ID NO: 21375 - protein, 20 aa, artificial
  peptide fold or domain or sub-domain
VLAGFDPNMLAEALGVRRQV

SEQ ID NO: 21376 - protein, 29 aa, artificial
  peptide fold or domain or sub-domain
VLAGKYTPRAVSYRIIHGFADTETPMAVL

SEQ ID NO: 21377 - protein, 29 aa, artificial
  peptide fold or domain or sub-domain
VLAHFYGVKLEGKVPMHKLFLEMLEAMMD

SEQ ID NO: 21378 - protein, 28 aa, artificial
  peptide fold or domain or sub-domain
VLALRDVAQQAGLGWDELGSRLKREGRL

SEQ ID NO: 21379 - protein, 25 aa, artificial
  peptide fold or domain or sub-domain
VLATDDERIAQAAHRLDVPFVMTRP

SEQ ID NO: 21380 - protein, 28 aa, artificial
  peptide fold or domain or sub-domain
VLCDRSADAVRHEARHLNERGHSAVAHT

SEQ ID NO: 21381 - protein, 25 aa, artificial
  peptide fold or domain or sub-domain
VLCVGPVQLDRNSRRVWYKDREIEL

SEQ ID NO: 21382 - protein, 25 aa, artificial
  peptide fold or domain or sub-domain
VLDDDVIAMANKTLNPQQAFMSGKM

SEQ ID NO: 21383 - protein, 26 aa, artificial
  peptide fold or domain or sub-domain
VLDFANRGSKSIVAPAFNKDLIEVDC

SEQ ID NO: 21384 - protein, 24 aa, artificial
  peptide fold or domain or sub-domain
VLDIIRKGFGSVDEFIALANSVSN

SEQ ID NO: 21385 - protein, 21 aa, artificial
  peptide fold or domain or sub-domain
VLDKILTHPERDELITLFQLL

SEQ ID NO: 21386 - protein, 27 aa, artificial
  peptide fold or domain or sub-domain
VLDKILTHPERDELITLFQLLLTEEER

SEQ ID NO: 21387 - protein, 21 aa, artificial
  peptide fold or domain or sub-domain
VLDLVKQAVQQEQHEMLLTML

SEQ ID NO: 21388 - protein, 27 aa, artificial
  peptide fold or domain or sub-domain
VLDLVKQAVQQEQHEMLLTMLMTPDER

SEQ ID NO: 21389 - protein, 23 aa, artificial
  peptide fold or domain or sub-domain
VLDPQYAYGDLGLPGLITAHTRL

SEQ ID NO: 21390 - protein, 24 aa, artificial
  peptide fold or domain or sub-domain
VLDRATCNRRTHHDGAITERLMCA

SEQ ID NO: 21391 - protein, 23 aa, artificial
  peptide fold or domain or sub-domain
VLDSVRRCWGSLWELPAIRYRQR

SEQ ID NO: 21392 - protein, 24 aa, artificial
  peptide fold or domain or sub-domain
VLDVLQQGVDDGTLRSDVSVQLMS

SEQ ID NO: 21393 - protein, 29 aa, artificial
  peptide fold or domain or sub-domain
VLEARMRDITGSADLDSVKTLTDDFFGHA

SEQ ID NO: 21394 - protein, 29 aa, artificial
  peptide fold or domain or sub-domain
VLEDEKARLGHEQDTELSAVEWQHVISRY

SEQ ID NO: 21395 - protein, 27 aa, artificial
  peptide fold or domain or sub-domain
VLEDVYNLERANVTFGLPFPPEIKEES

SEQ ID NO: 21396 - protein, 29 aa, artificial
  peptide fold or domain or sub-domain
VLEFARSVCGFADAAHAEVDPDAPHPLIV

SEQ ID NO: 21397 - protein, 28 aa, artificial
  peptide fold or domain or sub-domain
VLEMAIAYQTEGTTLYQQALVRENILTA

SEQ ID NO: 21398 - protein, 20 aa, artificial
  peptide fold or domain or sub-domain
VLEQFSRWNLPHEALQGILS

SEQ ID NO: 21399 - protein, 23 aa, artificial
  peptide fold or domain or sub-domain
VLESCHKCFASLFTDRAISYRHH

SEQ ID NO: 21400 - protein, 25 aa, artificial
  peptide fold or domain or sub-domain
VLESGPVRMDVERHVVSVNGDTITL

SEQ ID NO: 21401 - protein, 24 aa, artificial
  peptide fold or domain or sub-domain
VLGGIFPAADARHLKAKGVAASFG

SEQ ID NO: 21402 - protein, 24 aa, artificial
  peptide fold or domain or sub-domain
VLGGTIPIPDLEPLRSLGIREIFL

SEQ ID NO: 21403 - protein, 27 aa, artificial
  peptide fold or domain or sub-domain
VLGKRKLIELLQQISPNEKMDEDAEDI

SEQ ID NO: 21404 - protein, 24 aa, artificial
  peptide fold or domain or sub-domain
VLGNRHCNCLNGVGTITENMICAG

SEQ ID NO: 21405 - protein, 28 aa, artificial
  peptide fold or domain or sub-domain
VLGQFRDLNDAALDRTPDAILSTNHLKT

SEQ ID NO: 21406 - protein, 29 aa, artificial
  peptide fold or domain or sub-domain
VLGTDNGPAFVSQVSQSVAKLLGIDWKLH

SEQ ID NO: 21407 - protein, 27 aa, artificial
  peptide fold or domain or sub-domain
VLGTYDNTPKTPEWASEICGVPAVKIA

SEQ ID NO: 21408 - protein, 23 aa, artificial
  peptide fold or domain or sub-domain
VLGVASDVDDYQIRRHLVENVYE

SEQ ID NO: 21409 - protein, 26 aa, artificial
  peptide fold or domain or sub-domain
VLGVCLEKLLIERDQQSALDFAKRTI

SEQ ID NO: 21410 - protein, 23 aa, artificial
  peptide fold or domain or sub-domain
VLHEFKNAPSFGGIPQPEAMRIV

SEQ ID NO: 21411 - protein, 30 aa, artificial
  peptide fold or domain or sub-domain
VLHNNEVYGKPKDEDDARRMLFLLNNSVHE

SEQ ID NO: 21412 - protein, 29 aa, artificial
  peptide fold or domain or sub-domain
VLHSDQGSAFTSEEFAQWAKERNIQLEFS

SEQ ID NO: 21413 - protein, 24 aa, artificial
  peptide fold or domain or sub-domain
VLIDGTQVSKAKPDPEVFLKGAQQ

SEQ ID NO: 21414 - protein, 30 aa, artificial
  peptide fold or domain or sub-domain
VLIISPSGIAYRFVSQSEAARFIGAAASNV

SEQ ID NO: 21415 - protein, 26 aa, artificial
  peptide fold or domain or sub-domain
VLIRDLLRPLRDLHDSSTLCKYLESF

SEQ ID NO: 21416 - protein, 25 aa, artificial
  peptide fold or domain or sub-domain
VLITNTHQDPRFNELRRFGWQDGSW

SEQ ID NO: 21417 - protein, 20 aa, artificial
  peptide fold or domain or sub-domain
VLKAMPQEVVMNAYRINEKD

SEQ ID NO: 21418 - protein, 20 aa, artificial
  peptide fold or domain or sub-domain
VLKAQKYDPISLNTWRYYGQ

SEQ ID NO: 21419 - protein, 29 aa, artificial
  peptide fold or domain or sub-domain
VLKDPEIYKQPEIFNPERFNPTNAEDKKK

SEQ ID NO: 21420 - protein, 29 aa, artificial
  peptide fold or domain or sub-domain
VLKDPKYFRYPEAFYPQHFLDEQGRFKKN

SEQ ID NO: 21421 - protein, 30 aa, artificial
  peptide fold or domain or sub-domain
VLKELAPGYTVEDIKACTEADFILADEIGV

SEQ ID NO: 21422 - protein, 25 aa, artificial
  peptide fold or domain or sub-domain
VLKFAGIVMDLTTHEVRRQGVKIDL

SEQ ID NO: 21423 - protein, 25 aa, artificial
  peptide fold or domain or sub-domain
VLKGCSPIPGAIIYDYDTEEELLKG

SEQ ID NO: 21424 - protein, 20 aa, artificial
  peptide fold or domain or sub-domain
VLKSLQTQPDVLKYWHEHDQ

SEQ ID NO: 21425 - protein, 26 aa, artificial
  peptide fold or domain or sub-domain
VLKSLTVNGKSVVQTVTGKPLAETNC

SEQ ID NO: 21426 - protein, 28 aa, artificial
  peptide fold or domain or sub-domain
VLKYQKDKNLTIDGVVGCGTFSSLKKDV

SEQ ID NO: 21427 - protein, 29 aa, artificial
  peptide fold or domain or sub-domain
VLLAHAKGLGLDPCGLYKSQLGFRESVAL

SEQ ID NO: 21428 - protein, 30 aa, artificial
  peptide fold or domain or sub-domain
VLLDSLKKRINVLDDILNKIGINDVETIHG

SEQ ID NO: 21429 - protein, 24 aa, artificial
  peptide fold or domain or sub-domain
VLLEMVQTAAAGDYTKAAELHHRL

SEQ ID NO: 21430 - protein, 26 aa, artificial
  peptide fold or domain or sub-domain
VLLEMVQTAAAGDYTKAAELHHRLYS

SEQ ID NO: 21431 - protein, 30 aa, artificial
  peptide fold or domain or sub-domain
VLLIKQDGTFSRFKSSSEGARQMGVNVATV

SEQ ID NO: 21432 - protein, 27 aa, artificial
  peptide fold or domain or sub-domain
VLLNYLQYLDEAGKSRNTIIHSVSSLR

SEQ ID NO: 21433 - protein, 27 aa, artificial
  peptide fold or domain or sub-domain
VLLSSQRSEGKIVKWKGEEIITKKASK

SEQ ID NO: 21434 - protein, 26 aa, artificial
  peptide fold or domain or sub-domain
VLLTDWIDNYPGFPDGISGFDLIEKM

SEQ ID NO: 21435 - protein, 25 aa, artificial
  peptide fold or domain or sub-domain
VLMQGQGIDTDTLDYCADETTLIHK

SEQ ID NO: 21436 - protein, 26 aa, artificial
  peptide fold or domain or sub-domain
VLMTSMLLNSDHKAIAKMGFCGYFSK

SEQ ID NO: 21437 - protein, 26 aa, artificial
  peptide fold or domain or sub-domain
VLNDLDASRAEDAASEVKADLWVAAD

SEQ ID NO: 21438 - protein, 30 aa, artificial
  peptide fold or domain or sub-domain
VLNDSNKKKCNFMNEAKDHLGLSGIEVVCQ

SEQ ID NO: 21439 - protein, 22 aa, artificial
  peptide fold or domain or sub-domain
VLNETIQEGGTREDGLRIVEKM

SEQ ID NO: 21440 - protein, 22 aa, artificial
  peptide fold or domain or sub-domain
VLNETMATAGDRPAGKLVNARM

SEQ ID NO: 21441 - protein, 25 aa, artificial
  peptide fold or domain or sub-domain
VLNKTGCSDSKDSLNCLRAAPAELL

SEQ ID NO: 21442 - protein, 23 aa, artificial
  peptide fold or domain or sub-domain
VLNNLNDILRFIKLSDADLRSLQ

SEQ ID NO: 21443 - protein, 28 aa, artificial
  peptide fold or domain or sub-domain
VLNQAHTDWLKARAAQDFGLLEETLTKV

SEQ ID NO: 21444 - protein, 21 aa, artificial
  peptide fold or domain or sub-domain
VLNTGRLQHQWHTMTKTGKVA

SEQ ID NO: 21445 - protein, 21 aa, artificial
  peptide fold or domain or sub-domain
VLNYCHLYDVPTSAVRFFNVY

SEQ ID NO: 21446 - protein, 25 aa, artificial
  peptide fold or domain or sub-domain
VLPAAKITPEIAETRGVPMGKDCIS

SEQ ID NO: 21447 - protein, 26 aa, artificial
  peptide fold or domain or sub-domain
VLPDFLNDSTSSLYDSNRNQSHLPPV

SEQ ID NO: 21448 - protein, 26 aa, artificial
  peptide fold or domain or sub-domain
VLPIFTHMQQLGNISQDEMLRTFNMG

SEQ ID NO: 21449 - protein, 21 aa, artificial
  peptide fold or domain or sub-domain
VLPQPAQLGPAGQGVEPTIPA

SEQ ID NO: 21450 - protein, 21 aa, artificial
  peptide fold or domain or sub-domain
VLPYYGNTHTVDSYVGLHTSK

SEQ ID NO: 21451 - protein, 23 aa, artificial
  peptide fold or domain or sub-domain
VLQISGKKKIHVKDLMNAYSSLF

SEQ ID NO: 21452 - protein, 26 aa, artificial
  peptide fold or domain or sub-domain
VLQNVVDQVLRSDKINEAVRYVKSVI

SEQ ID NO: 21453 - protein, 23 aa, artificial
  peptide fold or domain or sub-domain
VLQPATTTHRQLNEKEQISSGVY

SEQ ID NO: 21454 - protein, 22 aa, artificial
  peptide fold or domain or sub-domain
VLQSGSGSSIYGLEFAKSLHMD

SEQ ID NO: 21455 - protein, 27 aa, artificial
  peptide fold or domain or sub-domain
VLQTDQNRFYVEPGRRFSSLAELVDYY

SEQ ID NO: 21456 - protein, 27 aa, artificial
  peptide fold or domain or sub-domain
VLQWMESVVDQGSGKGVQTPGYRIGGK

SEQ ID NO: 21457 - protein, 20 aa, artificial
  peptide fold or domain or sub-domain
VLQYGDQDLADPGIPDVEIR

SEQ ID NO: 21458 - protein, 20 aa, artificial
  peptide fold or domain or sub-domain
VLRAIPADVLANAFQLRQED

SEQ ID NO: 21459 - protein, 27 aa, artificial
  peptide fold or domain or sub-domain
VLRELEGAAEQADRPALAALGVSLQTS

SEQ ID NO: 21460 - protein, 25 aa, artificial
  peptide fold or domain or sub-domain
VLRFDNLTLDLLTRRAERNGRIIDL

SEQ ID NO: 21461 - protein, 20 aa, artificial
  peptide fold or domain or sub-domain
VLRGLPLDVIQNSFQVSRDE

SEQ ID NO: 21462 - protein, 26 aa, artificial
  peptide fold or domain or sub-domain
VLRGWRATLAAPFSESGYRDMATLTM

SEQ ID NO: 21463 - protein, 29 aa, artificial
  peptide fold or domain or sub-domain
VLRIIDAIAHHKKHGEVCPAGWTEGKVAM

SEQ ID NO: 21464 - protein, 25 aa, artificial
  peptide fold or domain or sub-domain
VLRKALAEHEPLLVSNEKETIDEHM

SEQ ID NO: 21465 - protein, 24 aa, artificial
  peptide fold or domain or sub-domain
VLRNIATGSLCRQTPIAEGTPINP

SEQ ID NO: 21466 - protein, 27 aa, artificial
  peptide fold or domain or sub-domain
VLRQWGIEGVHHTYVKGKRVFTPKYDQ

SEQ ID NO: 21467 - protein, 29 aa, artificial
  peptide fold or domain or sub-domain
VLRVTKAIQLHDRTGAYTPADWDHGDLVI

SEQ ID NO: 21468 - protein, 25 aa, artificial
  peptide fold or domain or sub-domain
VLRYEGLKLFPEECRVLLDDRELTL

SEQ ID NO: 21469 - protein, 20 aa, artificial
  peptide fold or domain or sub-domain
VLSDLPAAVIASSYAISMEE

SEQ ID NO: 21470 - protein, 22 aa, artificial
  peptide fold or domain or sub-domain
VLSESEESECRSTASDERLCRP

SEQ ID NO: 21471 - protein, 29 aa, artificial
  peptide fold or domain or sub-domain
VLSGWCERITRLGEGGPDQRAWQELSAYI

SEQ ID NO: 21472 - protein, 22 aa, artificial
  peptide fold or domain or sub-domain
VLSLLLSLDDETMDRERLGHQL

SEQ ID NO: 21473 - protein, 27 aa, artificial
  peptide fold or domain or sub-domain
VLSPDVMNQPVTPTWYGKDIVAACAAH

SEQ ID NO: 21474 - protein, 21 aa, artificial
  peptide fold or domain or sub-domain
VLSQCPGWVSTSMGGPTATRT

SEQ ID NO: 21475 - protein, 25 aa, artificial
  peptide fold or domain or sub-domain
VLSSDGDDILEYGQTQGVDVLKRPK

SEQ ID NO: 21476 - protein, 22 aa, artificial
  peptide fold or domain or sub-domain
VLSTTMEATELGLVKDGIAWGD

SEQ ID NO: 21477 - protein, 30 aa, artificial
  peptide fold or domain or sub-domain
VLSTTMEATELGLVKDGIAWGDAARMIEVA

SEQ ID NO: 21478 - protein, 26 aa, artificial
  peptide fold or domain or sub-domain
VLTANSHAGKPMRQVFRHLSHIDLPD

SEQ ID NO: 21479 - protein, 28 aa, artificial
  peptide fold or domain or sub-domain
VLTARDVARGQAAVKQLQAEGLSPRFHQ

SEQ ID NO: 21480 - protein, 23 aa, artificial
  peptide fold or domain or sub-domain
VLTCGHCPACRQGRENICSNMTM

SEQ ID NO: 21481 - protein, 30 aa, artificial
  peptide fold or domain or sub-domain
VLTCGHCPACRQGRENICSNMTMLGNHFDG

SEQ ID NO: 21482 - protein, 26 aa, artificial
  peptide fold or domain or sub-domain
VLTDLDFAPTPLAKANLLKEGKREEG

SEQ ID NO: 21483 - protein, 25 aa, artificial
  peptide fold or domain or sub-domain
VLTEGDLTLYPHKREVFLKGKPLDL

SEQ ID NO: 21484 - protein, 30 aa, artificial
  peptide fold or domain or sub-domain
VLTEVAPGWTIDQVIALMDFRPKLADDVRL

SEQ ID NO: 21485 - protein, 25 aa, artificial
  peptide fold or domain or sub-domain
VLTGKRALDYSGSVSAEDNHGIGGY

SEQ ID NO: 21486 - protein, 26 aa, artificial
  peptide fold or domain or sub-domain
VLTGLALDQLAEQKLLPEPLQHLVET

SEQ ID NO: 21487 - protein, 27 aa, artificial
  peptide fold or domain or sub-domain
VLTKKKLQDLVREVDPNEQLDEDVEEM

SEQ ID NO: 21488 - protein, 28 aa, artificial
  peptide fold or domain or sub-domain
VLTRIGADQEATVLDASSNGLINLYRRG

SEQ ID NO: 21489 - protein, 21 aa, artificial
  peptide fold or domain or sub-domain
VLTTSLGIMDHEEARSRNTGG

SEQ ID NO: 21490 - protein, 28 aa, artificial
  peptide fold or domain or sub-domain
VLVAKDILLNPEHSFNMVLEQWSSQLAC

SEQ ID NO: 21491 - protein, 26 aa, artificial
  peptide fold or domain or sub-domain
VLVAVNERGVFVIDPYECTLLLGLRY

SEQ ID NO: 21492 - protein, 24 aa, artificial
  peptide fold or domain or sub-domain
VLVCPDHVTRSKPDPEPLLLACSQ

SEQ ID NO: 21493 - protein, 29 aa, artificial
  peptide fold or domain or sub-domain
VLVERDEARLRAFLEKAPVANLRALPGSA

SEQ ID NO: 21494 - protein, 29 aa, artificial
  peptide fold or domain or sub-domain
VLVKLPTDPSGDEPIFHISHIDRVYTLRA

SEQ ID NO: 21495 - protein, 29 aa, artificial
  peptide fold or domain or sub-domain
VLVSDNGTQFTSLEFAEFCKQNGIEHVRT

SEQ ID NO: 21496 - protein, 25 aa, artificial
  peptide fold or domain or sub-domain
VLVTVDPAFRTRGNANTVWVDYPNI

SEQ ID NO: 21497 - protein, 26 aa, artificial
  peptide fold or domain or sub-domain
VLWLTPGADEMTQQDWAFPDGRFLAY

SEQ ID NO: 21498 - protein, 26 aa, artificial
  peptide fold or domain or sub-domain
VLWTPAGYTFYVDQQPLWSTSAAVSH

SEQ ID NO: 21499 - protein, 30 aa, artificial
  peptide fold or domain or sub-domain
VLYNGEVLGKPNFPEKAEEMLKKLNGRKFR

SEQ ID NO: 21500 - protein, 29 aa, artificial
  peptide fold or domain or sub-domain
VLYNYKNSKGILRDHDLSISDLHELIEAF

SEQ ID NO: 21501 - protein, 23 aa, artificial
  peptide fold or domain or sub-domain
VLYYTDFIRKEGVVIAPDFADPL

SEQ ID NO: 21502 - protein, 28 aa, artificial
  peptide fold or domain or sub-domain
VMACRDLEKAEAARRELMDNSGNQNIVV

SEQ ID NO: 21503 - protein, 28 aa, artificial
  peptide fold or domain or sub-domain
VMAFDVDREKIGNTVSGVKIENLDNLEN

SEQ ID NO: 21504 - protein, 28 aa, artificial
  peptide fold or domain or sub-domain
VMAFQRKAGLPITGVVNQQTWNALGGVA

SEQ ID NO: 21505 - protein, 27 aa, artificial
  peptide fold or domain or sub-domain
VMAMDAYTRRIFARLGVFAPDARYEAM

SEQ ID NO: 21506 - protein, 30 aa, artificial
  peptide fold or domain or sub-domain
VMDELTGVDELGRKRGAVSFLSGGLLDRTG

SEQ ID NO: 21507 - protein, 30 aa, artificial
  peptide fold or domain or sub-domain
VMDEVFGTENIKQKGGAIGLLTRHHLTRST

SEQ ID NO: 21508 - protein, 25 aa, artificial
  peptide fold or domain or sub-domain
VMDHIRQKFVCPKELPLTGEQLIQI

SEQ ID NO: 21509 - protein, 22 aa, artificial
  peptide fold or domain or sub-domain
VMDQIMKTVPNQYKNGTAFPRK

SEQ ID NO: 21510 - protein, 28 aa, artificial
  peptide fold or domain or sub-domain
VMEFFMKVYGYRGKHLGGSRKPDGAIYT

SEQ ID NO: 21511 - protein, 30 aa, artificial
  peptide fold or domain or sub-domain
VMEKVSGIKNLGKKVGAVHYLSKGAISRTD

SEQ ID NO: 21512 - protein, 26 aa, artificial
  peptide fold or domain or sub-domain
VMGAELRHVLTTLGEKMTEEEVETVL

SEQ ID NO: 21513 - protein, 24 aa, artificial
  peptide fold or domain or sub-domain
VMGSPDVVLERHGIDTEKAEQIAE

SEQ ID NO: 21514 - protein, 26 aa, artificial
  peptide fold or domain or sub-domain
VMGSSLRRHATLLWPDDHAEFCNVME

SEQ ID NO: 21515 - protein, 21 aa, artificial
  peptide fold or domain or sub-domain
VMGYYRDAASSVIDPALKAEN

SEQ ID NO: 21516 - protein, 23 aa, artificial
  peptide fold or domain or sub-domain
VMIADSDWHGIYNRVRPYKCDGE

SEQ ID NO: 21517 - protein, 29 aa, artificial
  peptide fold or domain or sub-domain
VMIAELEQLPLNELQTVDQNRLYFYSGDY

SEQ ID NO: 21518 - protein, 30 aa, artificial
  peptide fold or domain or sub-domain
VMICGKSKELKRSLTAKFKLTRMYLILGYT

SEQ ID NO: 21519 - protein, 28 aa, artificial
  peptide fold or domain or sub-domain
VMIHFKDEEKIMEEINYPNIKEHKQHHE

SEQ ID NO: 21520 - protein, 21 aa, artificial
  peptide fold or domain or sub-domain
VMILITGLLIPMGYIDRSHFS

SEQ ID NO: 21521 - protein, 21 aa, artificial
  peptide fold or domain or sub-domain
VMILLVGILLPLGLFPGDALS

SEQ ID NO: 21522 - protein, 23 aa, artificial
  peptide fold or domain or sub-domain
VMKDANPQLFEQLYGTSDYEQLR

SEQ ID NO: 21523 - protein, 26 aa, artificial
  peptide fold or domain or sub-domain
VMLAGALSEVLDGAPDTALDDYAADR

SEQ ID NO: 21524 - protein, 30 aa, artificial
  peptide fold or domain or sub-domain
VMLNYREKYGKDPSPSERGSEKFKVEASAI

SEQ ID NO: 21525 - protein, 26 aa, artificial
  peptide fold or domain or sub-domain
VMLSAKGKQTLEVKQVASEFTAFLHK

SEQ ID NO: 21526 - protein, 25 aa, artificial
  peptide fold or domain or sub-domain
VMLVGDLQIDQNKYRVARNGKNISL

SEQ ID NO: 21527 - protein, 26 aa, artificial
  peptide fold or domain or sub-domain
VMMDLKGYVTMEPFKGMHRFDCRREI

SEQ ID NO: 21528 - protein, 26 aa, artificial
  peptide fold or domain or sub-domain
VMMTSLGLGEHSRRAAEIGFAAYLVK

SEQ ID NO: 21529 - protein, 30 aa, artificial
  peptide fold or domain or sub-domain
VMPFVSAEVKYMPADEEDRYIIAQANTRLD

SEQ ID NO: 21530 - protein, 21 aa, artificial
  peptide fold or domain or sub-domain
VMQTSCGVISHRDCIRMGIGG

SEQ ID NO: 21531 - protein, 24 aa, artificial
  peptide fold or domain or sub-domain
VMRRLPAGSYLRRHPEAAGQRFDP

SEQ ID NO: 21532 - protein, 27 aa, artificial
  peptide fold or domain or sub-domain
VMSKFFPAMINPNWESSIIPSNKGETE

SEQ ID NO: 21533 - protein, 30 aa, artificial
  peptide fold or domain or sub-domain
VMSQYTGIDEIGRKEGAIGVFTAGKLTRSS

SEQ ID NO: 21534 - protein, 26 aa, artificial
  peptide fold or domain or sub-domain
VMTADRKASEQFGSVFPHLITQDLPN

SEQ ID NO: 21535 - protein, 20 aa, artificial
  peptide fold or domain or sub-domain
VMTIRPDLSSADVRCILSVA

SEQ ID NO: 21536 - protein, 22 aa, artificial
  peptide fold or domain or sub-domain
VMVEYEDGTIKRINTNNTTQQE

SEQ ID NO: 21537 - protein, 30 aa, artificial
  peptide fold or domain or sub-domain
VMVPLEQNAEPGWLAGEIHGHTGWFPETYV

SEQ ID NO: 21538 - protein, 26 aa, artificial
  peptide fold or domain or sub-domain
VMVSTSSTDADIDECYNLGANSYITK

SEQ ID NO: 21539 - protein, 26 aa, artificial
  peptide fold or domain or sub-domain
VMVTALDQRSDRIRGLEAGADEFLTK

SEQ ID NO: 21540 - protein, 29 aa, artificial
  peptide fold or domain or sub-domain
VMYLLQKNKGVIRVKDIARVLKVKPPSVV

SEQ ID NO: 21541 - protein, 25 aa, artificial
  peptide fold or domain or sub-domain
VMYNMAVSYSNMAQYPLAAKHITRA

SEQ ID NO: 21542 - protein, 20 aa, artificial
  peptide fold or domain or sub-domain
VNAGFSVSNTLFRSLSANAT

SEQ ID NO: 21543 - protein, 21 aa, artificial
  peptide fold or domain or sub-domain
VNAICPGYVRTPMAESIARQS

SEQ ID NO: 21544 - protein, 23 aa, artificial
  peptide fold or domain or sub-domain
VNAKQLETLMAKGLTEEEATEMI

SEQ ID NO: 21545 - protein, 28 aa, artificial
  peptide fold or domain or sub-domain
VNALASILTTVDVDGMKAVKALRDDNRF

SEQ ID NO: 21546 - protein, 29 aa, artificial
  peptide fold or domain or sub-domain
VNASEILQLTDETESIGYPQWSTDGDKII

SEQ ID NO: 21547 - protein, 21 aa, artificial
  peptide fold or domain or sub-domain
VNAVAPGFINTDMTASLSEKV

SEQ ID NO: 21548 - protein, 21 aa, artificial
  peptide fold or domain or sub-domain
VNAVDPGGMRTKMRAAAYPEE

SEQ ID NO: 21549 - protein, 21 aa, artificial
  peptide fold or domain or sub-domain
VNAVDPGLTSTDMTGNGPGHS

SEQ ID NO: 21550 - protein, 21 aa, artificial
  peptide fold or domain or sub-domain
VNAVSPGFTRTNLNGYAGTET

SEQ ID NO: 21551 - protein, 25 aa, artificial
  peptide fold or domain or sub-domain
VNDLVDAMEAGERPVDLVAEFGNAI

SEQ ID NO: 21552 - protein, 25 aa, artificial
  peptide fold or domain or sub-domain
VNDNDIFDLLTGKLNPQKAFFQGKV

SEQ ID NO: 21553 - protein, 25 aa, artificial
  peptide fold or domain or sub-domain
VNDRLDEMERAGSPADLIAFVADKV

SEQ ID NO: 21554 - protein, 30 aa, artificial
  peptide fold or domain or sub-domain
VNDVCANGEDLIKKNNHHVENITAKMKGLK

SEQ ID NO: 21555 - protein, 26 aa, artificial
  peptide fold or domain or sub-domain
VNEAVQIFGGMGYMRESEIERHYRDC

SEQ ID NO: 21556 - protein, 25 aa, artificial
  peptide fold or domain or sub-domain
VNEEDFVQILEGKLSEQTAFMKKKL

SEQ ID NO: 21557 - protein, 21 aa, artificial
  peptide fold or domain or sub-domain
VNEKVDKDNPKWFAESDTFVG

SEQ ID NO: 21558 - protein, 23 aa, artificial
  peptide fold or domain or sub-domain
VNELIASGYFASRSEIFRQALRE

SEQ ID NO: 21559 - protein, 30 aa, artificial
  peptide fold or domain or sub-domain
VNEMGECPVLVDGETTLTQSGVIQQYLSDT

SEQ ID NO: 21560 - protein, 21 aa, artificial
  peptide fold or domain or sub-domain
VNFLEESIKEAKDLENVHNLY

SEQ ID NO: 21561 - protein, 26 aa, artificial
  peptide fold or domain or sub-domain
VNFLKIKKGFVFYEIQHQEEKLFIAH

SEQ ID NO: 21562 - protein, 30 aa, artificial
  peptide fold or domain or sub-domain
VNGPGDLVNFTFLMSVIKTFFTSSRLSQFM

SEQ ID NO: 21563 - protein, 24 aa, artificial
  peptide fold or domain or sub-domain
VNGPRERRALGLLPVPLPPEAPVA

SEQ ID NO: 21564 - protein, 26 aa, artificial
  peptide fold or domain or sub-domain
VNGRLLEAVLTAYVAEAFPDLLDWMA

SEQ ID NO: 21565 - protein, 23 aa, artificial
  peptide fold or domain or sub-domain
VNHCYSQSHSGVPHDVKMEMGIK

SEQ ID NO: 21566 - protein, 29 aa, artificial
  peptide fold or domain or sub-domain
VNHDETIWDNPSLFRPDRFLNENRELNKS

SEQ ID NO: 21567 - protein, 29 aa, artificial
  peptide fold or domain or sub-domain
VNHDPELWEDPSEFRPERFLTADGTAINK

SEQ ID NO: 21568 - protein, 21 aa, artificial
  peptide fold or domain or sub-domain
VNHQRFQMWGSNINETVQAVM

SEQ ID NO: 21569 - protein, 24 aa, artificial
  peptide fold or domain or sub-domain
VNIDADQLLGIGQNWSTISQQALM

SEQ ID NO: 21570 - protein, 29 aa, artificial
  peptide fold or domain or sub-domain
VNIDADQLLGIGQNWSTISQQALMQNEAI

SEQ ID NO: 21571 - protein, 28 aa, artificial
  peptide fold or domain or sub-domain
VNIFYDKLQYDHRLNILFKTIPVAKQKE

SEQ ID NO: 21572 - protein, 22 aa, artificial
  peptide fold or domain or sub-domain
VNIGVGEQFKPEFLAISPNNRM

SEQ ID NO: 21573 - protein, 25 aa, artificial
  peptide fold or domain or sub-domain
VNIKKATVLYNGRKTKVDDIAHGMI

SEQ ID NO: 21574 - protein, 27 aa, artificial
  peptide fold or domain or sub-domain
VNIKTIESIFFDKDLNDLEVLDKLDNL

SEQ ID NO: 21575 - protein, 29 aa, artificial
  peptide fold or domain or sub-domain
VNILYRENDWVYVIGQDSRQEGFIPFSYC

SEQ ID NO: 21576 - protein, 25 aa, artificial
  peptide fold or domain or sub-domain
VNIPDVKHDPRWLKEPGRADDVQSV

SEQ ID NO: 21577 - protein, 29 aa, artificial
  peptide fold or domain or sub-domain
VNIVLTRNENLKFDGCLIAHSPEEALQLA

SEQ ID NO: 21578 - protein, 20 aa, artificial
  peptide fold or domain or sub-domain
VNKGAVIDAKLGQWSGINQF

SEQ ID NO: 21579 - protein, 22 aa, artificial
  peptide fold or domain or sub-domain
VNKNDLVTAVAGAAGLSKADAA

SEQ ID NO: 21580 - protein, 21 aa, artificial
  peptide fold or domain or sub-domain
VNKQRIKELYPVINDDDILGG

SEQ ID NO: 21581 - protein, 27 aa, artificial
  peptide fold or domain or sub-domain
VNLDQIDSLIEEGIISGGMIPKIKGAA

SEQ ID NO: 21582 - protein, 29 aa, artificial
  peptide fold or domain or sub-domain
VNLIHISGPNILTSKILDVVDEDIKISCS

SEQ ID NO: 21583 - protein, 24 aa, artificial
  peptide fold or domain or sub-domain
VNLKDLVETLRDAGLYRQKAKMIK

SEQ ID NO: 21584 - protein, 25 aa, artificial
  peptide fold or domain or sub-domain
VNLKDLVETLRDAGLYRQKAKMIKE

SEQ ID NO: 21585 - protein, 25 aa, artificial
  peptide fold or domain or sub-domain
VNLLVNAKDIGQASQLLEDKVNLIE

SEQ ID NO: 21586 - protein, 28 aa, artificial
  peptide fold or domain or sub-domain
VNLRAEPLVGFNAQGIETSKKAYAFDAV

SEQ ID NO: 21587 - protein, 28 aa, artificial
  peptide fold or domain or sub-domain
VNLRQEPIKAITATGITTARRSVDVDVI

SEQ ID NO: 21588 - protein, 28 aa, artificial
  peptide fold or domain or sub-domain
VNLRRTPITEITEAGVLTTNSFYGLDML

SEQ ID NO: 21589 - protein, 28 aa, artificial
  peptide fold or domain or sub-domain
VNLVNFLVENKILQSKRLAREFIASKSL

SEQ ID NO: 21590 - protein, 27 aa, artificial
  peptide fold or domain or sub-domain
VNMREAVNLFSDGTLTGGMIPKVKCCL

SEQ ID NO: 21591 - protein, 25 aa, artificial
  peptide fold or domain or sub-domain
VNMVVNQHQLDIAKKYLGKNMTLIS

SEQ ID NO: 21592 - protein, 23 aa, artificial
  peptide fold or domain or sub-domain
VNNTMRGLQEIDPTGSRYYQENA

SEQ ID NO: 21593 - protein, 22 aa, artificial
  peptide fold or domain or sub-domain
VNNYYKQHLFTHKKRHFTYCIP

SEQ ID NO: 21594 - protein, 22 aa, artificial
  peptide fold or domain or sub-domain
VNPLAGETRTEEFMRMNPEHTI

SEQ ID NO: 21595 - protein, 30 aa, artificial
  peptide fold or domain or sub-domain
VNPQQLNSEQGPALAKAMGISHSELKKRLK

SEQ ID NO: 21596 - protein, 20 aa, artificial
  peptide fold or domain or sub-domain
VNQDILENKESWDKILALVP

SEQ ID NO: 21597 - protein, 23 aa, artificial
  peptide fold or domain or sub-domain
VNQEALFFLRSRGIHKELAEKML

SEQ ID NO: 21598 - protein, 20 aa, artificial
  peptide fold or domain or sub-domain
VNQEQSRLMKQAEDDSRTPG

SEQ ID NO: 21599 - protein, 21 aa, artificial
  peptide fold or domain or sub-domain
VNQKAISQFGKQWTQPGKLVS

SEQ ID NO: 21600 - protein, 23 aa, artificial
  peptide fold or domain or sub-domain
VNQPCQIRYVYYFHQILTERNIY

SEQ ID NO: 21601 - protein, 21 aa, artificial
  peptide fold or domain or sub-domain
VNQQNINRIRELWKQGKIKSI

SEQ ID NO: 21602 - protein, 23 aa, artificial
  peptide fold or domain or sub-domain
VNQWYAHGTCSDQLFKFISYFEE

SEQ ID NO: 21603 - protein, 20 aa, artificial
  peptide fold or domain or sub-domain
VNRDVLKNQLAVTKETSKLR

SEQ ID NO: 21604 - protein, 28 aa, artificial
  peptide fold or domain or sub-domain
VNRFYDRILMDPRIKKFFQGVDMTRLRD

SEQ ID NO: 21605 - protein, 23 aa, artificial
  peptide fold or domain or sub-domain
VNRSINGPALSKIGENTGFDSMG

SEQ ID NO: 21606 - protein, 26 aa, artificial
  peptide fold or domain or sub-domain
VNRTRGQIKQSGLYPVSSSQCWPRII

SEQ ID NO: 21607 - protein, 23 aa, artificial
  peptide fold or domain or sub-domain
VNSAKFLIKDQPLDDKMAAYGAL

SEQ ID NO: 21608 - protein, 24 aa, artificial
  peptide fold or domain or sub-domain
VNSCTVTSFPRNHKHIIEFSKSVY

SEQ ID NO: 21609 - protein, 27 aa, artificial
  peptide fold or domain or sub-domain
VNSLIKTIEANYVQTEKVASINAQLLQ

SEQ ID NO: 21610 - protein, 28 aa, artificial
  peptide fold or domain or sub-domain
VNSLNKARNMIISGAIKINGIVQTQKDY

SEQ ID NO: 21611 - protein, 28 aa, artificial
  peptide fold or domain or sub-domain
VNSWLESPKAQRLMDEKGLADTMEVQAY

SEQ ID NO: 21612 - protein, 25 aa, artificial
  peptide fold or domain or sub-domain
VNTANIVENYATLTRSETLLPLVGD

SEQ ID NO: 21613 - protein, 24 aa, artificial
  peptide fold or domain or sub-domain
VNTKDLEEYFKGKVAHYKQLKGGI

SEQ ID NO: 21614 - protein, 26 aa, artificial
  peptide fold or domain or sub-domain
VNTPVLMLTALSDVEYRVKGLNMGAD

SEQ ID NO: 21615 - protein, 23 aa, artificial
  peptide fold or domain or sub-domain
VNTTAEAMADARPEMRDTFYSNR

SEQ ID NO: 21616 - protein, 21 aa, artificial
  peptide fold or domain or sub-domain
VNTVHPGYVKTDMNGGGGEIE

SEQ ID NO: 21617 - protein, 30 aa, artificial
  peptide fold or domain or sub-domain
VNTYNIDPDKKELFINLFSIYSGISKEELK

SEQ ID NO: 21618 - protein, 26 aa, artificial
  peptide fold or domain or sub-domain
VNVTKDKITWYVDGEIVGEKDNLYWH

SEQ ID NO: 21619 - protein, 30 aa, artificial
  peptide fold or domain or sub-domain
VNWINKALENDPDCRHVIPMNPNTDDLFKA

SEQ ID NO: 21620 - protein, 26 aa, artificial
  peptide fold or domain or sub-domain
VNWPAYHEETRETVILDSEITIENDP

SEQ ID NO: 21621 - protein, 26 aa, artificial
  peptide fold or domain or sub-domain
VNWYHPDGHQLTDQDWHAPMGQAFAM

SEQ ID NO: 21622 - protein, 28 aa, artificial
  peptide fold or domain or sub-domain
VNYFSKVKQLPLVKPYLRSVQNHNNKSV

SEQ ID NO: 21623 - protein, 28 aa, artificial
  peptide fold or domain or sub-domain
VNYRKDLKGAEETKKTIEERGGYCRIIK

SEQ ID NO: 21624 - protein, 24 aa, artificial
  peptide fold or domain or sub-domain
VNYVSDELDITSNKTDYISNELYN

SEQ ID NO: 21625 - protein, 20 aa, artificial
  peptide fold or domain or sub-domain
VPAGVASFLAKHFESVDNFK

SEQ ID NO: 21626 - protein, 22 aa, artificial
  peptide fold or domain or sub-domain
VPAHITRKPQEGEKEGQDYYFV

SEQ ID NO: 21627 - protein, 28 aa, artificial
  peptide fold or domain or sub-domain
VPALILIDVVRLSSHSNSDNQEKYRSAL

SEQ ID NO: 21628 - protein, 20 aa, artificial
  peptide fold or domain or sub-domain
VPALLAAARGHLRHPHDQQL

SEQ ID NO: 21629 - protein, 26 aa, artificial
  peptide fold or domain or sub-domain
VPAPEMKATKEKFIETITDPTTLNSF

SEQ ID NO: 21630 - protein, 21 aa, artificial
  peptide fold or domain or sub-domain
VPAQAIARHGDCWARPGKMIS

SEQ ID NO: 21631 - protein, 27 aa, artificial
  peptide fold or domain or sub-domain
VPARWRCDGEPECADGSDEADATCSRQ

SEQ ID NO: 21632 - protein, 21 aa, artificial
  peptide fold or domain or sub-domain
VPASIGAAKVADFNSGKAAIG

SEQ ID NO: 21633 - protein, 30 aa, artificial
  peptide fold or domain or sub-domain
VPAVAFGDYDSVTDDELAWMQKQTDDLHIV

SEQ ID NO: 21634 - protein, 29 aa, artificial
  peptide fold or domain or sub-domain
VPCTTQSKGYPFEVVLSGQERDGVALADQ

SEQ ID NO: 21635 - protein, 28 aa, artificial
  peptide fold or domain or sub-domain
VPDALDRDNDNDGVADALDLSPLTHSGS

SEQ ID NO: 21636 - protein, 30 aa, artificial
  peptide fold or domain or sub-domain
VPDALLGDLDSAEPETLEICRQKGTVIVCY

SEQ ID NO: 21637 - protein, 26 aa, artificial
  peptide fold or domain or sub-domain
VPDDPEELITILKDQDGRPELIICPV

SEQ ID NO: 21638 - protein, 29 aa, artificial
  peptide fold or domain or sub-domain
VPDEMSADLEKRRPELIPEDLHRHYIQTM

SEQ ID NO: 21639 - protein, 24 aa, artificial
  peptide fold or domain or sub-domain
VPDETTQALELRKGSADAVINALK

SEQ ID NO: 21640 - protein, 30 aa, artificial
  peptide fold or domain or sub-domain
VPDFFIGDADSAKEETMEWLKQHGVTLKIF

SEQ ID NO: 21641 - protein, 30 aa, artificial
  peptide fold or domain or sub-domain
VPDFITGDCDSVTNEIKQYYILKGTVVIPQ

SEQ ID NO: 21642 - protein, 29 aa, artificial
  peptide fold or domain or sub-domain
VPDPEHFRKTTDNPFKALGGNLVDMGRVK

SEQ ID NO: 21643 - protein, 29 aa, artificial
  peptide fold or domain or sub-domain
VPDPWQQFPPKRGKITSVGANRVDLCQAV

SEQ ID NO: 21644 - protein, 21 aa, artificial
  peptide fold or domain or sub-domain
VPDVLSDASTKEEYLERLEEG

SEQ ID NO: 21645 - protein, 22 aa, artificial
  peptide fold or domain or sub-domain
VPDYQWTSYTPQNTQRQLPLTS

SEQ ID NO: 21646 - protein, 28 aa, artificial
  peptide fold or domain or sub-domain
VPEAVVNWLFKVIQPIYNDGRTTFHDSL

SEQ ID NO: 21647 - protein, 23 aa, artificial
  peptide fold or domain or sub-domain
VPEDLIFYLESRGFSRKEAESLI

SEQ ID NO: 21648 - protein, 21 aa, artificial
  peptide fold or domain or sub-domain
VPEEFGGYPWEPEIRKLLDEE

SEQ ID NO: 21649 - protein, 22 aa, artificial
  peptide fold or domain or sub-domain
VPEEKQRECTYKGKQAEVECRN

SEQ ID NO: 21650 - protein, 26 aa, artificial
  peptide fold or domain or sub-domain
VPEEVARQRNLQKISDLKSVAGEMVL

SEQ ID NO: 21651 - protein, 27 aa, artificial
  peptide fold or domain or sub-domain
VPEIAPGEECPSDPVTDPAHPLHPANL

SEQ ID NO: 21652 - protein, 26 aa, artificial
  peptide fold or domain or sub-domain
VPEIFQFVESQLEGGKEMMLSVFNYG

SEQ ID NO: 21653 - protein, 26 aa, artificial
  peptide fold or domain or sub-domain
VPELGLKFMSSYKDMFRKERFVEIMK

SEQ ID NO: 21654 - protein, 21 aa, artificial
  peptide fold or domain or sub-domain
VPEPLKGCTSVEEFMEKLPQY

SEQ ID NO: 21655 - protein, 21 aa, artificial
  peptide fold or domain or sub-domain
VPEPLRGEMSPAEFLDQLSSI

SEQ ID NO: 21656 - protein, 20 aa, artificial
  peptide fold or domain or sub-domain
VPESLESSDLAHFILHSDLV

SEQ ID NO: 21657 - protein, 24 aa, artificial
  peptide fold or domain or sub-domain
VPEWKGLGWVKSRGQPIPQVNQLK

SEQ ID NO: 21658 - protein, 24 aa, artificial
  peptide fold or domain or sub-domain
VPFCTLENVPRSPEHCVLYVQFRL

SEQ ID NO: 21659 - protein, 25 aa, artificial
  peptide fold or domain or sub-domain
VPFDQAIQMIFEGKIQDGKTIAGLL

SEQ ID NO: 21660 - protein, 25 aa, artificial
  peptide fold or domain or sub-domain
VPFDSKLGVIPNVEGRVMDVPGLYC

SEQ ID NO: 21661 - protein, 26 aa, artificial
  peptide fold or domain or sub-domain
VPFEAACADDFPRIGGKCASLARMIA

SEQ ID NO: 21662 - protein, 21 aa, artificial
  peptide fold or domain or sub-domain
VPFFHQRECDAAAWSAFADQY

SEQ ID NO: 21663 - protein, 30 aa, artificial
  peptide fold or domain or sub-domain
VPFFLNGVAGVKKLNQKDGIHPTAEGHRIL

SEQ ID NO: 21664 - protein, 21 aa, artificial
  peptide fold or domain or sub-domain
VPFLECPDVPDAGVYKTEAEL

SEQ ID NO: 21665 - protein, 26 aa, artificial
  peptide fold or domain or sub-domain
VPFREALLGQPRLRGCFSAEALEELL

SEQ ID NO: 21666 - protein, 22 aa, artificial
  peptide fold or domain or sub-domain
VPFSDLASVCTLPERRLRSVAR

SEQ ID NO: 21667 - protein, 28 aa, artificial
  peptide fold or domain or sub-domain
VPFVKPKSTPKHGYAHDPRFEDAWNKLV

SEQ ID NO: 21668 - protein, 27 aa, artificial
  peptide fold or domain or sub-domain
VPGLADSLANSPFWTYLPPVQNDEIYR

SEQ ID NO: 21669 - protein, 25 aa, artificial
  peptide fold or domain or sub-domain
VPGLVRFLEAHHRDPDAKAIADELT

SEQ ID NO: 21670 - protein, 28 aa, artificial
  peptide fold or domain or sub-domain
VPGTSDKKGTLLLAGALTDLYGYPLGTE

SEQ ID NO: 21671 - protein, 28 aa, artificial
  peptide fold or domain or sub-domain
VPGVADNEKGIVIRAVNLFWTKVPLAKE

SEQ ID NO: 21672 - protein, 29 aa, artificial
  peptide fold or domain or sub-domain
VPHDKEGQQKLAEKLNISFASVKNRVDQL

SEQ ID NO: 21673 - protein, 21 aa, artificial
  peptide fold or domain or sub-domain
VPHHVIAKHGDSWSKPENMVY

SEQ ID NO: 21674 - protein, 28 aa, artificial
  peptide fold or domain or sub-domain
VPHMQSESYPEEAEDFASDASKLDTWVF

SEQ ID NO: 21675 - protein, 29 aa, artificial
  peptide fold or domain or sub-domain
VPHTEEEQAELAKNMGLTLAEVKAKVDEL

SEQ ID NO: 21676 - protein, 25 aa, artificial
  peptide fold or domain or sub-domain
VPIENVKSMLMNKEIEDAKTIIALQ

SEQ ID NO: 21677 - protein, 26 aa, artificial
  peptide fold or domain or sub-domain
VPIFVSEWGTSLASGDGGPYLDEADK

SEQ ID NO: 21678 - protein, 20 aa, artificial
  peptide fold or domain or sub-domain
VPILYTASQACLQHPDVAAY

SEQ ID NO: 21679 - protein, 24 aa, artificial
  peptide fold or domain or sub-domain
VPIPFFINFRFYPPHVDPEYTGRA

SEQ ID NO: 21680 - protein, 27 aa, artificial
  peptide fold or domain or sub-domain
VPITLNALGLAPHSEQPADLKKAEAAL

SEQ ID NO: 21681 - protein, 29 aa, artificial
  peptide fold or domain or sub-domain
VPKDISSAFIWSRNGKIYFTKGDEYYRYT

SEQ ID NO: 21682 - protein, 26 aa, artificial
  peptide fold or domain or sub-domain
VPKIFGWLAGKLKLSAQTILERHNCG

SEQ ID NO: 21683 - protein, 23 aa, artificial
  peptide fold or domain or sub-domain
VPKLTEVLTDTHPKVQSAGQLAL

SEQ ID NO: 21684 - protein, 21 aa, artificial
  peptide fold or domain or sub-domain
VPKSAVEKFGDKWTQPANIVT

SEQ ID NO: 21685 - protein, 25 aa, artificial
  peptide fold or domain or sub-domain
VPKSLANIYTNLIKFNHMRKAPKHG

SEQ ID NO: 21686 - protein, 24 aa, artificial
  peptide fold or domain or sub-domain
VPLEELEQDIRSIGLYRNKARNIQ

SEQ ID NO: 21687 - protein, 28 aa, artificial
  peptide fold or domain or sub-domain
VPLFYKKVLADERVKHFFKNTDMDHQTK

SEQ ID NO: 21688 - protein, 21 aa, artificial
  peptide fold or domain or sub-domain
VPLKDLADVANISPDEAQQLL

SEQ ID NO: 21689 - protein, 27 aa, artificial
  peptide fold or domain or sub-domain
VPLRNHCDGQSDCEDGSDEDSCAVTAE

SEQ ID NO: 21690 - protein, 22 aa, artificial
  peptide fold or domain or sub-domain
VPLTSNSACETCHRKHPECPGH

SEQ ID NO: 21691 - protein, 23 aa, artificial
  peptide fold or domain or sub-domain
VPLVQVIDGDSLIVRHDGARVTI

SEQ ID NO: 21692 - protein, 22 aa, artificial
  peptide fold or domain or sub-domain
VPLVRERRTLPDGTEVPLYRYP

SEQ ID NO: 21693 - protein, 26 aa, artificial
  peptide fold or domain or sub-domain
VPMDQLSLEQLKSVDDRFGDDIQECL

SEQ ID NO: 21694 - protein, 20 aa, artificial
  peptide fold or domain or sub-domain
VPMLYTAIQSDMMHPQNDQI

SEQ ID NO: 21695 - protein, 29 aa, artificial
  peptide fold or domain or sub-domain
VPMTSGSRPAPFRVNVRFQDKDGLLLPEQ

SEQ ID NO: 21696 - protein, 24 aa, artificial
  peptide fold or domain or sub-domain
VPNNSLREWLHAIALAEYIPMFES

SEQ ID NO: 21697 - protein, 25 aa, artificial
  peptide fold or domain or sub-domain
VPPFYSNSPQKTYKLALNNEVAFGR

SEQ ID NO: 21698 - protein, 30 aa, artificial
  peptide fold or domain or sub-domain
VPPGFEIMGHTGGSSAAVIADRSRSIYGIQ

SEQ ID NO: 21699 - protein, 26 aa, artificial
  peptide fold or domain or sub-domain
VPPIMTLLAELGGLTATDLRSTFNLG

SEQ ID NO: 21700 - protein, 23 aa, artificial
  peptide fold or domain or sub-domain
VPPIQARINAKVQGFNFTAGDVQ

SEQ ID NO: 21701 - protein, 23 aa, artificial
  peptide fold or domain or sub-domain
VPPKDFFVIASSQHCPIAAIECP

SEQ ID NO: 21702 - protein, 26 aa, artificial
  peptide fold or domain or sub-domain
VPPLFELIVREAGVERQEAFRALNMG

SEQ ID NO: 21703 - protein, 29 aa, artificial
  peptide fold or domain or sub-domain
VPPNVAFELDRTRADLISEDVQRRFVQEV

SEQ ID NO: 21704 - protein, 20 aa, artificial
  peptide fold or domain or sub-domain
VPPRLLKLIRARWGNVDEMK

SEQ ID NO: 21705 - protein, 25 aa, artificial
  peptide fold or domain or sub-domain
VPPSLRNIYKEIEAEYGRKLSAGSG

SEQ ID NO: 21706 - protein, 25 aa, artificial
  peptide fold or domain or sub-domain
VPPSLRNIYSAVQKSYPSFRHPMHG

SEQ ID NO: 21707 - protein, 30 aa, artificial
  peptide fold or domain or sub-domain
VPPSMEVTSSNPEGIVMSIRHRSSPWWGVQ

SEQ ID NO: 21708 - protein, 30 aa, artificial
  peptide fold or domain or sub-domain
VPPVFSALRVDGERAYKRARRGEEVQLASR

SEQ ID NO: 21709 - protein, 26 aa, artificial
  peptide fold or domain or sub-domain
VPPVLRFIAEHAGHDAREAYSTLNMG

SEQ ID NO: 21710 - protein, 23 aa, artificial
  peptide fold or domain or sub-domain
VPQCGECKFCKNPKTNLCQKIRL

SEQ ID NO: 21711 - protein, 21 aa, artificial
  peptide fold or domain or sub-domain
VPQFEASLYGGKDPVLTQVDV

SEQ ID NO: 21712 - protein, 25 aa, artificial
  peptide fold or domain or sub-domain
VPQIENGNITVASHDRDHINNVTVV

SEQ ID NO: 21713 - protein, 28 aa, artificial
  peptide fold or domain or sub-domain
VPQRTLNWLYSVLIRTYQDPNRTYYDVA

SEQ ID NO: 21714 - protein, 30 aa, artificial
  peptide fold or domain or sub-domain
VPRALVPGLDVSALHEWISGPVRLDGPVAV

SEQ ID NO: 21715 - protein, 29 aa, artificial
  peptide fold or domain or sub-domain
VPRDRDELMKLPGVGRKTANVVVSVAFGV

SEQ ID NO: 21716 - protein, 20 aa, artificial
  peptide fold or domain or sub-domain
VPREGGMHQNVSMSDYGIFP

SEQ ID NO: 21717 - protein, 24 aa, artificial
  peptide fold or domain or sub-domain
VPREVDLCERFALNRSAVRSDLRQ

SEQ ID NO: 21718 - protein, 24 aa, artificial
  peptide fold or domain or sub-domain
VPRSIGQNPNPSQLKFTGKKPYDP

SEQ ID NO: 21719 - protein, 23 aa, artificial
  peptide fold or domain or sub-domain
VPSIRQRLENDLSGVTLTDTEVT

SEQ ID NO: 21720 - protein, 30 aa, artificial
  peptide fold or domain or sub-domain
VPSIYCANLIDLKTEITNLTKAQINQIHFD

SEQ ID NO: 21721 - protein, 26 aa, artificial
  peptide fold or domain or sub-domain
VPSKLAQANNLKTMADFARYVNSGKP

SEQ ID NO: 21722 - protein, 30 aa, artificial
  peptide fold or domain or sub-domain
VPSLLAFDKKYPYEQLKIFKKHHLQTIHYD

SEQ ID NO: 21723 - protein, 30 aa, artificial
  peptide fold or domain or sub-domain
VPSMIIGDLDSIRPEVREYFTAKQVEMRKY

SEQ ID NO: 21724 - protein, 25 aa, artificial
  peptide fold or domain or sub-domain
VPSNECGSLACFLHSKYDHEASSSY

SEQ ID NO: 21725 - protein, 29 aa, artificial
  peptide fold or domain or sub-domain
VPSNIAPEIDRLRPELINEEQQKRYANEI

SEQ ID NO: 21726 - protein, 25 aa, artificial
  peptide fold or domain or sub-domain
VPSQCFVTIDGEQRRLADLVPPEKI

SEQ ID NO: 21727 - protein, 28 aa, artificial
  peptide fold or domain or sub-domain
VPSTSEALRNIEQGGVKIDGATVSDKAL

SEQ ID NO: 21728 - protein, 30 aa, artificial
  peptide fold or domain or sub-domain
VPSVFGADIGRINEQLQVLEKNDIDLLHVD

SEQ ID NO: 21729 - protein, 30 aa, artificial
  peptide fold or domain or sub-domain
VPTKTAAIDVFDCEPVTTDSEPLLSLTNVT

SEQ ID NO: 21730 - protein, 29 aa, artificial
  peptide fold or domain or sub-domain
VPTNKMPQTPFNESEVNFDSWTSLGVDAL

SEQ ID NO: 21731 - protein, 29 aa, artificial
  peptide fold or domain or sub-domain
VPTSTSAQPAVFRPELEVMGTKTRFLVDQ

SEQ ID NO: 21732 - protein, 30 aa, artificial
  peptide fold or domain or sub-domain
VPTVAMGDFDSLTKEELAHLKTKVADVHEF

SEQ ID NO: 21733 - protein, 23 aa, artificial
  peptide fold or domain or sub-domain
VPVAEIGRRVGLSTTPCWRRIQK

SEQ ID NO: 21734 - protein, 25 aa, artificial
  peptide fold or domain or sub-domain
VPVAELAETIRPAGYYNVKSARLKD

SEQ ID NO: 21735 - protein, 25 aa, artificial
  peptide fold or domain or sub-domain
VPVKKATVVYQGERVKIQEKFKNGM

SEQ ID NO: 21736 - protein, 21 aa, artificial
  peptide fold or domain or sub-domain
VPVQDIVIHKHFNPIGIIEND

SEQ ID NO: 21737 - protein, 29 aa, artificial
  peptide fold or domain or sub-domain
VPVRKAGKLPGECFKATYESDLFEIQKNA

SEQ ID NO: 21738 - protein, 27 aa, artificial
  peptide fold or domain or sub-domain
VPVVDTNVERVLGRAAGASSREEAEAF

SEQ ID NO: 21739 - protein, 27 aa, artificial
  peptide fold or domain or sub-domain
VPVVDTNVRRVYRRLVDGRYLQGPARA

SEQ ID NO: 21740 - protein, 30 aa, artificial
  peptide fold or domain or sub-domain
VPWIAIGDETSVTSPGALRRMTSKDIDEPL

SEQ ID NO: 21741 - protein, 25 aa, artificial
  peptide fold or domain or sub-domain
VPWREIETQLDEGSITNATTLIALQ

SEQ ID NO: 21742 - protein, 24 aa, artificial
  peptide fold or domain or sub-domain
VQAANDGGTTEYATGGGPVHRDVQ

SEQ ID NO: 21743 - protein, 28 aa, artificial
  peptide fold or domain or sub-domain
VQAFQRARGLQVDGIVGPKTWSALNSAG

SEQ ID NO: 21744 - protein, 25 aa, artificial
  peptide fold or domain or sub-domain
VQAGVVSQPAKDFLESRGIKVAYKK

SEQ ID NO: 21745 - protein, 24 aa, artificial
  peptide fold or domain or sub-domain
VQAKIEELSDDEMFPIKLKLNNFT

SEQ ID NO: 21746 - protein, 26 aa, artificial
  peptide fold or domain or sub-domain
VQALRNHTVSGEATSAGGCSGVSSVS

SEQ ID NO: 21747 - protein, 26 aa, artificial
  peptide fold or domain or sub-domain
VQCSSQYRGYACDYAIDDRDDRYWLS

SEQ ID NO: 21748 - protein, 21 aa, artificial
  peptide fold or domain or sub-domain
VQDCERAIGIDPGYSKAYGRM

SEQ ID NO: 21749 - protein, 25 aa, artificial
  peptide fold or domain or sub-domain
VQDLQPGATVGYGSRFEAEQPMRIG

SEQ ID NO: 21750 - protein, 27 aa, artificial
  peptide fold or domain or sub-domain
VQDYIIDTQLGVREPIGMSGVRLDTRV

SEQ ID NO: 21751 - protein, 27 aa, artificial
  peptide fold or domain or sub-domain
VQEGMHRVMTDGTGRWVQIPDIPSAGK

SEQ ID NO: 21752 - protein, 24 aa, artificial
  peptide fold or domain or sub-domain
VQGHVDYFGAYYFEGTVKTYYINF

SEQ ID NO: 21753 - protein, 28 aa, artificial
  peptide fold or domain or sub-domain
VQGTSSGLEWPIDGLRFRPDHRIGTSNR

SEQ ID NO: 21754 - protein, 25 aa, artificial
  peptide fold or domain or sub-domain
VQGVLDRLAETAPPQDMFEAFAVPV

SEQ ID NO: 21755 - protein, 21 aa, artificial
  peptide fold or domain or sub-domain
VQGYSPSGVIVDGSEYDLDVL

SEQ ID NO: 21756 - protein, 24 aa, artificial
  peptide fold or domain or sub-domain
VQHAADFIGMDEKPGEALARKPNA

SEQ ID NO: 21757 - protein, 24 aa, artificial
  peptide fold or domain or sub-domain
VQHDMDCRPIFPQFEIPLLDVVTF

SEQ ID NO: 21758 - protein, 24 aa, artificial
  peptide fold or domain or sub-domain
VQHDVDLSAFDHPLGFIPESAIFI

SEQ ID NO: 21759 - protein, 30 aa, artificial
  peptide fold or domain or sub-domain
VQHINRYLGDDPFLKQFLPLDPHSNQLYEL

SEQ ID NO: 21760 - protein, 20 aa, artificial
  peptide fold or domain or sub-domain
VQHMMRDVHHIPEEMRKIRQ

SEQ ID NO: 21761 - protein, 26 aa, artificial
  peptide fold or domain or sub-domain
VQKEVIDLVVREGDVDAVEEYVHGVI

SEQ ID NO: 21762 - protein, 27 aa, artificial
  peptide fold or domain or sub-domain
VQKLDKDEYLIYEKYRGLVLTSKGKKI

SEQ ID NO: 21763 - protein, 26 aa, artificial
  peptide fold or domain or sub-domain
VQKLLETTDRPDGHQNNLRSSAYESL

SEQ ID NO: 21764 - protein, 24 aa, artificial
  peptide fold or domain or sub-domain
VQKTSFLSRIRKNYSVELQEDRIL

SEQ ID NO: 21765 - protein, 22 aa, artificial
  peptide fold or domain or sub-domain
VQLETGKARLHVFEEVMDVAIA

SEQ ID NO: 21766 - protein, 24 aa, artificial
  peptide fold or domain or sub-domain
VQLLATVAAQKQSFHEALELFDHA

SEQ ID NO: 21767 - protein, 29 aa, artificial
  peptide fold or domain or sub-domain
VQLSDSLTDLLDKFSNISEGLSNYSIIDK

SEQ ID NO: 21768 - protein, 24 aa, artificial
  peptide fold or domain or sub-domain
VQLSSATNSTSEVLAATPKAVKAA

SEQ ID NO: 21769 - protein, 24 aa, artificial
  peptide fold or domain or sub-domain
VQLVGEDQADAANGLINWASPLGR

SEQ ID NO: 21770 - protein, 27 aa, artificial
  peptide fold or domain or sub-domain
VQMVTRGNIQKYIDRYVLTQELGGSNT

SEQ ID NO: 21771 - protein, 24 aa, artificial
  peptide fold or domain or sub-domain
VQNAPDLKTWQRCVSSGLLPVSWG

SEQ ID NO: 21772 - protein, 24 aa, artificial
  peptide fold or domain or sub-domain
VQNARTLDEYYGALDHGRLPLARG

SEQ ID NO: 21773 - protein, 24 aa, artificial
  peptide fold or domain or sub-domain
VQNASATPAYVKQIEAGQLAGARG

SEQ ID NO: 21774 - protein, 24 aa, artificial
  peptide fold or domain or sub-domain
VQNEVQIGAYAQSIGASRLATAKG

SEQ ID NO: 21775 - protein, 24 aa, artificial
  peptide fold or domain or sub-domain
VQNITETGAWARAVEAGHLPVAKG

SEQ ID NO: 21776 - protein, 24 aa, artificial
  peptide fold or domain or sub-domain
VQNLTPTDAWAARIARDELPLGRA

SEQ ID NO: 21777 - protein, 28 aa, artificial
  peptide fold or domain or sub-domain
VQNNKYEMFYSRLAKRVRALKLSNFDQY

SEQ ID NO: 21778 - protein, 27 aa, artificial
  peptide fold or domain or sub-domain
VQPILTPDRVNKRQNGRRLKEKGEPMF

SEQ ID NO: 21779 - protein, 20 aa, artificial
  peptide fold or domain or sub-domain
VQPKNQPYAPFYFDLQMIVN

SEQ ID NO: 21780 - protein, 28 aa, artificial
  peptide fold or domain or sub-domain
VQPSEVLLSASVLRSLPELAAILSLYPR

SEQ ID NO: 21781 - protein, 28 aa, artificial
  peptide fold or domain or sub-domain
VQPTVAKCHNMPVADSRPELAETFTKIQ

SEQ ID NO: 21782 - protein, 21 aa, artificial
  peptide fold or domain or sub-domain
VQPVRKADQFEYELDVRPDAV

SEQ ID NO: 21783 - protein, 25 aa, artificial
  peptide fold or domain or sub-domain
VQQKVVQATTLKQIEQAFNDKKAVL

SEQ ID NO: 21784 - protein, 29 aa, artificial
  peptide fold or domain or sub-domain
VQQYTEEVLAKAGSHLDAGGRAMLEEDLR

SEQ ID NO: 21785 - protein, 26 aa, artificial
  peptide fold or domain or sub-domain
VQRAVIEMILRGDAFSDVQAYLRDVI

SEQ ID NO: 21786 - protein, 24 aa, artificial
  peptide fold or domain or sub-domain
VQRDMDISPLGFKVGETPFDPLPG

SEQ ID NO: 21787 - protein, 26 aa, artificial
  peptide fold or domain or sub-domain
VQRETLETIVRGGESDDIRRIIREGA

SEQ ID NO: 21788 - protein, 26 aa, artificial
  peptide fold or domain or sub-domain
VQREVIEVILKEKNPEKALSLVKDVI

SEQ ID NO: 21789 - protein, 28 aa, artificial
  peptide fold or domain or sub-domain
VQRFQSAYGLAADGIAGPATFNKIYQLQ

SEQ ID NO: 21790 - protein, 27 aa, artificial
  peptide fold or domain or sub-domain
VQRLMRQNEAEALFRLGIGKEVGHALR

SEQ ID NO: 21791 - protein, 26 aa, artificial
  peptide fold or domain or sub-domain
VQRRVSTDVLSAISPPTTLGLTTYDR

SEQ ID NO: 21792 - protein, 25 aa, artificial
  peptide fold or domain or sub-domain
VQRYMDPAAKHYCPYLPEDVIAKVK

SEQ ID NO: 21793 - protein, 22 aa, artificial
  peptide fold or domain or sub-domain
VQSIAQFESVYGRSDARTIITN

SEQ ID NO: 21794 - protein, 22 aa, artificial
  peptide fold or domain or sub-domain
VQSISQAVDKYNKDKANAIIGN

SEQ ID NO: 21795 - protein, 21 aa, artificial
  peptide fold or domain or sub-domain
VQSLLEASGIEIDTAHTGKTA

SEQ ID NO: 21796 - protein, 24 aa, artificial
  peptide fold or domain or sub-domain
VQSLTPMDSIQERTRIWHAETGRR

SEQ ID NO: 21797 - protein, 28 aa, artificial
  peptide fold or domain or sub-domain
VQSTADFTVVNDNVIGFHRGDRAWIGIN

SEQ ID NO: 21798 - protein, 28 aa, artificial
  peptide fold or domain or sub-domain
VQTLKKSNNLPLIQKYLEDIQAQNITAV

SEQ ID NO: 21799 - protein, 22 aa, artificial
  peptide fold or domain or sub-domain
VQTPAQLADIYGQDGADAYMDN

SEQ ID NO: 21800 - protein, 27 aa, artificial
  peptide fold or domain or sub-domain
VQTTNDPSGIAANSKSDQGHYTELQKK

SEQ ID NO: 21801 - protein, 29 aa, artificial
  peptide fold or domain or sub-domain
VQVDSIDESGPYVVARGFYSNNKPFTASG

SEQ ID NO: 21802 - protein, 29 aa, artificial
  peptide fold or domain or sub-domain
VQVIDDSNEEWWKVGKSGDRVGFFPSNFV

SEQ ID NO: 21803 - protein, 24 aa, artificial
  peptide fold or domain or sub-domain
VQVPFGVVECDDVRITGLKEKPSL

SEQ ID NO: 21804 - protein, 24 aa, artificial
  peptide fold or domain or sub-domain
VQWDVDLTPFGRKPGETAFGVAFF

SEQ ID NO: 21805 - protein, 26 aa, artificial
  peptide fold or domain or sub-domain
VQWFREGQPISPGEGTYLLAVPPMFQ

SEQ ID NO: 21806 - protein, 26 aa, artificial
  peptide fold or domain or sub-domain
VQWLNIVGEPMTVEDWQNQQTKALQV

SEQ ID NO: 21807 - protein, 24 aa, artificial
  peptide fold or domain or sub-domain
VQYDFGKTIIGGFQQRIGSLNAPS

SEQ ID NO: 21808 - protein, 27 aa, artificial
  peptide fold or domain or sub-domain
VQYKPIPVTEIVQMHVIGLTSNQDRFI

SEQ ID NO: 21809 - protein, 30 aa, artificial
  peptide fold or domain or sub-domain
VQYLQKGISLFNRKPSKGVEFLISTKKIGS

SEQ ID NO: 21810 - protein, 20 aa, artificial
  peptide fold or domain or sub-domain
VQYLQQLEQQFPDQGASALA

SEQ ID NO: 21811 - protein, 29 aa, artificial
  peptide fold or domain or sub-domain
VQYTPQALAEVGEAIDALTAAEGLPSHGD

SEQ ID NO: 21812 - protein, 30 aa, artificial
  peptide fold or domain or sub-domain
VRAADDCRMALRHDPNYSKAWGRLGLAYSK

SEQ ID NO: 21813 - protein, 27 aa, artificial
  peptide fold or domain or sub-domain
VRAAIARKQFARAFKGEGSVAPVDALI

SEQ ID NO: 21814 - protein, 30 aa, artificial
  peptide fold or domain or sub-domain
VRAEIKGETAIGKEMRALAAAGALVPDETV

SEQ ID NO: 21815 - protein, 25 aa, artificial
  peptide fold or domain or sub-domain
VRAFSQLHPEIPDQFRGTVSALAEK

SEQ ID NO: 21816 - protein, 22 aa, artificial
  peptide fold or domain or sub-domain
VRAGGHDLKELQSHLDDGKMAM

SEQ ID NO: 21817 - protein, 21 aa, artificial
  peptide fold or domain or sub-domain
VRAGHLALAGGVREAVVAARK

SEQ ID NO: 21818 - protein, 27 aa, artificial
  peptide fold or domain or sub-domain
VRAGMRASASAGTAGQLADLPVPAGAK

SEQ ID NO: 21819 - protein, 21 aa, artificial
  peptide fold or domain or sub-domain
VRALAEMTGAASTSTVQRRIS

SEQ ID NO: 21820 - protein, 26 aa, artificial
  peptide fold or domain or sub-domain
VRALKMHGGVPKSDLATENLEALREG

SEQ ID NO: 21821 - protein, 21 aa, artificial
  peptide fold or domain or sub-domain
VRAYENGLELDPDNANMKTAL

SEQ ID NO: 21822 - protein, 25 aa, artificial
  peptide fold or domain or sub-domain
VRDAINANSQYTDQLSRYNGCEQQG

SEQ ID NO: 21823 - protein, 30 aa, artificial
  peptide fold or domain or sub-domain
VRDELKSSGPLSKQLAEIVNQGKLVSDEII

SEQ ID NO: 21824 - protein, 28 aa, artificial
  peptide fold or domain or sub-domain
VRDFQFLNNLVVDGIAGPNTLKKMDELL

SEQ ID NO: 21825 - protein, 25 aa, artificial
  peptide fold or domain or sub-domain
VRDFSANDETVEPENRGGYLAFTSK

SEQ ID NO: 21826 - protein, 21 aa, artificial
  peptide fold or domain or sub-domain
VRDITKGVGLNSPATTKHHLD

SEQ ID NO: 21827 - protein, 25 aa, artificial
  peptide fold or domain or sub-domain
VRDKNAAKLHGLSADDAWDKMVELN

SEQ ID NO: 21828 - protein, 24 aa, artificial
  peptide fold or domain or sub-domain
VRDTMKRAEPGKNAIAHTVDRNGL

SEQ ID NO: 21829 - protein, 20 aa, artificial
  peptide fold or domain or sub-domain
VRDVIRLGDTYAIEAGLTRE

SEQ ID NO: 21830 - protein, 23 aa, artificial
  peptide fold or domain or sub-domain
VRDVKTDDHQLGGNNRQVGLVER

SEQ ID NO: 21831 - protein, 21 aa, artificial
  peptide fold or domain or sub-domain
VREDDPRKLVVQRTTTVSASR

SEQ ID NO: 21832 - protein, 21 aa, artificial
  peptide fold or domain or sub-domain
VREEDVAKGDDWWYYPENYIG

SEQ ID NO: 21833 - protein, 20 aa, artificial
  peptide fold or domain or sub-domain
VREGRKKENGQDTDPQDEST

SEQ ID NO: 21834 - protein, 25 aa, artificial
  peptide fold or domain or sub-domain
VREHKAGEPVGYGGTWVSERDTRLG

SEQ ID NO: 21835 - protein, 21 aa, artificial
  peptide fold or domain or sub-domain
VREIGELVGEKTPGAVQGILN

SEQ ID NO: 21836 - protein, 21 aa, artificial
  peptide fold or domain or sub-domain
VREIGEQFEISSPNGVMCHLK

SEQ ID NO: 21837 - protein, 21 aa, artificial
  peptide fold or domain or sub-domain
VREIGQAVGLASSSTVHGHLS

SEQ ID NO: 21838 - protein, 28 aa, artificial
  peptide fold or domain or sub-domain
VREILFNLINSDNDDIKFHAIQALYTCI

SEQ ID NO: 21839 - protein, 25 aa, artificial
  peptide fold or domain or sub-domain
VRERVLSEFAEDEPTVREWMMEQIN

SEQ ID NO: 21840 - protein, 21 aa, artificial
  peptide fold or domain or sub-domain
VRFSFMILKSNADPCYKFEPQ

SEQ ID NO: 21841 - protein, 25 aa, artificial
  peptide fold or domain or sub-domain
VRGFTEQDTSIPAQYRGTYYGAGLK

SEQ ID NO: 21842 - protein, 20 aa, artificial
  peptide fold or domain or sub-domain
VRGGELAEKLGVSKVAIHRA

SEQ ID NO: 21843 - protein, 25 aa, artificial
  peptide fold or domain or sub-domain
VRGLTRLHPAVLARLRGSFAGLGSP

SEQ ID NO: 21844 - protein, 24 aa, artificial
  peptide fold or domain or sub-domain
VRGNLERECKEEKCSFEEAREVFE

SEQ ID NO: 21845 - protein, 21 aa, artificial
  peptide fold or domain or sub-domain
VRGPDARLEVAESRTQLAGFV

SEQ ID NO: 21846 - protein, 28 aa, artificial
  peptide fold or domain or sub-domain
VRGQQYDLFSQDKVESIDDLEFIHLMKT

SEQ ID NO: 21847 - protein, 24 aa, artificial
  peptide fold or domain or sub-domain
VRHCDKAIGMDEKPAQAMRRGKGS

SEQ ID NO: 21848 - protein, 24 aa, artificial
  peptide fold or domain or sub-domain
VRHSDSHVIDSDKPSAVIRHKRDS

SEQ ID NO: 21849 - protein, 21 aa, artificial
  peptide fold or domain or sub-domain
VRIPFLEICAPPPIPSGLELL

SEQ ID NO: 21850 - protein, 27 aa, artificial
  peptide fold or domain or sub-domain
VRIQMRDVVDFGTGQSAKIEGYEIAGK

SEQ ID NO: 21851 - protein, 26 aa, artificial
  peptide fold or domain or sub-domain
VRISQDEIYTVDGKSVLRLRDEVLSL

SEQ ID NO: 21852 - protein, 30 aa, artificial
  peptide fold or domain or sub-domain
VRIYSRIGGDQGWWKGETNGRIGWFPSTYV

SEQ ID NO: 21853 - protein, 21 aa, artificial
  peptide fold or domain or sub-domain
VRKFTNFIMRKGKRQLAKKIL

SEQ ID NO: 21854 - protein, 26 aa, artificial
  peptide fold or domain or sub-domain
VRKPKNEIEYIKNQSVVVIRDKVHPL

SEQ ID NO: 21855 - protein, 25 aa, artificial
  peptide fold or domain or sub-domain
VRLDNAAEHPSAVGFPQHHPAMRAF

SEQ ID NO: 21856 - protein, 26 aa, artificial
  peptide fold or domain or sub-domain
VRLEPGMIETIQEGEVIEHRDQVIPV

SEQ ID NO: 21857 - protein, 23 aa, artificial
  peptide fold or domain or sub-domain
VRLFYQHKAGEEAFEKLVHHMCS

SEQ ID NO: 21858 - protein, 30 aa, artificial
  peptide fold or domain or sub-domain
VRLSIDAAGRRHAFCSEACQHIFRQAPHRH

SEQ ID NO: 21859 - protein, 28 aa, artificial
  peptide fold or domain or sub-domain
VRLVALLTKSGLAPSNSEAMRKLKERAV

SEQ ID NO: 21860 - protein, 28 aa, artificial
  peptide fold or domain or sub-domain
VRMFVQSDNLPMIKPFLISVLDKNNSVV

SEQ ID NO: 21861 - protein, 27 aa, artificial
  peptide fold or domain or sub-domain
VRMRSAELGFYNLFGPTELGGEGMGAV

SEQ ID NO: 21862 - protein, 26 aa, artificial
  peptide fold or domain or sub-domain
VRNPIAYESREEIVLAERNLQITKQE

SEQ ID NO: 21863 - protein, 30 aa, artificial
  peptide fold or domain or sub-domain
VRNRLSAKQMMDIQLHEPTMWKHSPSRSRP

SEQ ID NO: 21864 - protein, 30 aa, artificial
  peptide fold or domain or sub-domain
VRNSSWRYHRDLETKKKWYGEPWGGADSEI

SEQ ID NO: 21865 - protein, 30 aa, artificial
  peptide fold or domain or sub-domain
VRNVVQFSGRLAKHRKLDRIDVRDVQLNLE

SEQ ID NO: 21866 - protein, 27 aa, artificial
  peptide fold or domain or sub-domain
VRPEDVEELEEKGIVTGGMVPKLEAAK

SEQ ID NO: 21867 - protein, 26 aa, artificial
  peptide fold or domain or sub-domain
VRPQWNELMHGRIELSEFKALCHRIE

SEQ ID NO: 21868 - protein, 30 aa, artificial
  peptide fold or domain or sub-domain
VRPSKLIGEPAELARKLHEIFPDEAEATFY

SEQ ID NO: 21869 - protein, 22 aa, artificial
  peptide fold or domain or sub-domain
VRPTYCLEYKNVPTDINFANAV

SEQ ID NO: 21870 - protein, 28 aa, artificial
  peptide fold or domain or sub-domain
VRQFQEYYNLNVTGKADEATQNKLDEVY

SEQ ID NO: 21871 - protein, 28 aa, artificial
  peptide fold or domain or sub-domain
VRQFQQKYGLSSTGIADQKTVDQLRALA

SEQ ID NO: 21872 - protein, 23 aa, artificial
  peptide fold or domain or sub-domain
VRQQIAELREARYLKSGIGSSYL

SEQ ID NO: 21873 - protein, 26 aa, artificial
  peptide fold or domain or sub-domain
VRQWDRQAKELAFGVESRLVDEVFNN

SEQ ID NO: 21874 - protein, 26 aa, artificial
  peptide fold or domain or sub-domain
VRREAAKRYDLRTLEDLAEASPNLVF

SEQ ID NO: 21875 - protein, 28 aa, artificial
  peptide fold or domain or sub-domain
VRRFQQAAKLPATGIVDSETYERLLGQA

SEQ ID NO: 21876 - protein, 30 aa, artificial
  peptide fold or domain or sub-domain
VRRGAQPMMYQEFVGNPAARQRYWARAMLG

SEQ ID NO: 21877 - protein, 25 aa, artificial
  peptide fold or domain or sub-domain
VRRIVQDHELETGEDTKVKSVASVA

SEQ ID NO: 21878 - protein, 27 aa, artificial
  peptide fold or domain or sub-domain
VRRLLCEDADRARAILGISNELAIRLV

SEQ ID NO: 21879 - protein, 27 aa, artificial
  peptide fold or domain or sub-domain
VRRNEKGLVTVDDDEYFDNLIKLVEHY

SEQ ID NO: 21880 - protein, 26 aa, artificial
  peptide fold or domain or sub-domain
VRRTAADLVEESSANQLLLPSPLRAL

SEQ ID NO: 21881 - protein, 20 aa, artificial
  peptide fold or domain or sub-domain
VRSAAAEALGIDRGTLARRM

SEQ ID NO: 21882 - protein, 21 aa, artificial
  peptide fold or domain or sub-domain
VRSILVGVGEDPEREGLLKTP

SEQ ID NO: 21883 - protein, 26 aa, artificial
  peptide fold or domain or sub-domain
VRSLKMHGGADVKNLGADDLKSLNLG

SEQ ID NO: 21884 - protein, 24 aa, artificial
  peptide fold or domain or sub-domain
VRSVHPDRFADAPEREQRLALERA

SEQ ID NO: 21885 - protein, 25 aa, artificial
  peptide fold or domain or sub-domain
VRTKADRAGNLEVADHKQLQRIRTK

SEQ ID NO: 21886 - protein, 27 aa, artificial
  peptide fold or domain or sub-domain
VRVDRLLPDGSGVRVDAAGATYRAQRV

SEQ ID NO: 21887 - protein, 23 aa, artificial
  peptide fold or domain or sub-domain
VRVETKIPFNPDTLSRTDTQEEA

SEQ ID NO: 21888 - protein, 26 aa, artificial
  peptide fold or domain or sub-domain
VRWLRDGQPLASQNRIEVSGGELRFS

SEQ ID NO: 21889 - protein, 26 aa, artificial
  peptide fold or domain or sub-domain
VRWRKDDGELPKSRYEIRDDHTLKIR

SEQ ID NO: 21890 - protein, 29 aa, artificial
  peptide fold or domain or sub-domain
VRWVVGIKGQRCIDDILTPLLPHTAHLYA

SEQ ID NO: 21891 - protein, 23 aa, artificial
  peptide fold or domain or sub-domain
VRYARALLLFTQGITNESLVGIA

SEQ ID NO: 21892 - protein, 25 aa, artificial
  peptide fold or domain or sub-domain
VRYFLHQHTIQHGQPATVKVSANLI

SEQ ID NO: 21893 - protein, 25 aa, artificial
  peptide fold or domain or sub-domain
VRYNLAIAYMNKGDYVKASKMLIEV

SEQ ID NO: 21894 - protein, 25 aa, artificial
  peptide fold or domain or sub-domain
VRYVVAGGAEQGIYARKGKEGVYIA

SEQ ID NO: 21895 - protein, 27 aa, artificial
  peptide fold or domain or sub-domain
VSAAPKLGEYKGKKGMTFRPDKTIKDV

SEQ ID NO: 21896 - protein, 24 aa, artificial
  peptide fold or domain or sub-domain
VSAEELREWINARVEAGYQKVSQV

SEQ ID NO: 21897 - protein, 28 aa, artificial
  peptide fold or domain or sub-domain
VSAFPQAKALAERFKAKYGKDIEGFGIY

SEQ ID NO: 21898 - protein, 30 aa, artificial
  peptide fold or domain or sub-domain
VSAFQGSKEVPDPEGRLWVSADRRSSALWL

SEQ ID NO: 21899 - protein, 25 aa, artificial
  peptide fold or domain or sub-domain
VSAFSDQYQQETGDQLTDFNKGNVK

SEQ ID NO: 21900 - protein, 23 aa, artificial
  peptide fold or domain or sub-domain
VSAIEKSLVETFPKDKERFEANA

SEQ ID NO: 21901 - protein, 30 aa, artificial
  peptide fold or domain or sub-domain
VSAIREAIKESEIHKDYVSRNALRDILDSQ

SEQ ID NO: 21902 - protein, 20 aa, artificial
  peptide fold or domain or sub-domain
VSAMRRDLGLTEQQVHQRLS

SEQ ID NO: 21903 - protein, 24 aa, artificial
  peptide fold or domain or sub-domain
VSANQPSNFQLDEGLYGIHTLTHE

SEQ ID NO: 21904 - protein, 27 aa, artificial
  peptide fold or domain or sub-domain
VSAQARHGQRTDWRLEAAGDTVEAWQV

SEQ ID NO: 21905 - protein, 20 aa, artificial
  peptide fold or domain or sub-domain
VSASEIRQRLAQGQNTEGLL

SEQ ID NO: 21906 - protein, 26 aa, artificial
  peptide fold or domain or sub-domain
VSASSASGEDGAENALDGQTQTVWRS

SEQ ID NO: 21907 - protein, 20 aa, artificial
  peptide fold or domain or sub-domain
VSATMIASALGLNDVQVRKD

SEQ ID NO: 21908 - protein, 23 aa, artificial
  peptide fold or domain or sub-domain
VSAVGGREGKVISSDRVLELDVA

SEQ ID NO: 21909 - protein, 23 aa, artificial
  peptide fold or domain or sub-domain
VSAYHLSPDEAQPLDTYGRSSNP

SEQ ID NO: 21910 - protein, 30 aa, artificial
  peptide fold or domain or sub-domain
VSAYIQKNAGYFVNFIDEDKTVSQFCETEV

SEQ ID NO: 21911 - protein, 21 aa, artificial
  peptide fold or domain or sub-domain
VSCIEPGLFKTNLADPVKVIE

SEQ ID NO: 21912 - protein, 30 aa, artificial
  peptide fold or domain or sub-domain
VSDADCVAGCHSLLDQEAIFAGGSSGGVIR

SEQ ID NO: 21913 - protein, 28 aa, artificial
  peptide fold or domain or sub-domain
VSDAITGITPSGITTTTTTPSPATPTHA

SEQ ID NO: 21914 - protein, 24 aa, artificial
  peptide fold or domain or sub-domain
VSDDSIYFDRYHRYPTVGAYEYWE

SEQ ID NO: 21915 - protein, 25 aa, artificial
  peptide fold or domain or sub-domain
VSDEEGARRELERGDRHPGWNRGSA

SEQ ID NO: 21916 - protein, 28 aa, artificial
  peptide fold or domain or sub-domain
VSDFYDRVRDDPLLEPYFEETDMDQLRS

SEQ ID NO: 21917 - protein, 29 aa, artificial
  peptide fold or domain or sub-domain
VSDIEMVDKDWWLGSNSRGERGLFPSNYV

SEQ ID NO: 21918 - protein, 30 aa, artificial
  peptide fold or domain or sub-domain
VSDIFPLSQAARAYELAAGTSRGKVCLVPD

SEQ ID NO: 21919 - protein, 30 aa, artificial
  peptide fold or domain or sub-domain
VSDQGSFLMARRLARDEGIFAGGSSGAAML

SEQ ID NO: 21920 - protein, 24 aa, artificial
  peptide fold or domain or sub-domain
VSDTIKRVSPDGGVVVDTPNRAEL

SEQ ID NO: 21921 - protein, 27 aa, artificial
  peptide fold or domain or sub-domain
VSEALEKTVHFGSPKRAYIEGYGIAGK

SEQ ID NO: 21922 - protein, 26 aa, artificial
  peptide fold or domain or sub-domain
VSEALQVLGGLGFTKNYPYERYLRDC

SEQ ID NO: 21923 - protein, 23 aa, artificial
  peptide fold or domain or sub-domain
VSEAMANFREWQYMQSMGGSTYL

SEQ ID NO: 21924 - protein, 26 aa, artificial
  peptide fold or domain or sub-domain
VSEDDQNQAATAPNAITKLITQDKVS

SEQ ID NO: 21925 - protein, 22 aa, artificial
  peptide fold or domain or sub-domain
VSEDKKAKCAEKGKSKQTECLN

SEQ ID NO: 21926 - protein, 29 aa, artificial
  peptide fold or domain or sub-domain
VSEEAIMEAALEAGAEDIATEDGVITVTT

SEQ ID NO: 21927 - protein, 20 aa, artificial
  peptide fold or domain or sub-domain
VSEELRATFGLSRAKATTLE

SEQ ID NO: 21928 - protein, 20 aa, artificial
  peptide fold or domain or sub-domain
VSEESLKTQLKKAHAEERAA

SEQ ID NO: 21929 - protein, 25 aa, artificial
  peptide fold or domain or sub-domain
VSEIDRGATVGYGRTWAANRATRVA

SEQ ID NO: 21930 - protein, 27 aa, artificial
  peptide fold or domain or sub-domain
VSEIVHEGKKVKLTITYGSKVIHNEFT

SEQ ID NO: 21931 - protein, 25 aa, artificial
  peptide fold or domain or sub-domain
VSEKQSLQLNSSLRNKEYVADIISV

SEQ ID NO: 21932 - protein, 30 aa, artificial
  peptide fold or domain or sub-domain
VSEMLKMDEFRNEFISKRLIERAVYENLDE

SEQ ID NO: 21933 - protein, 22 aa, artificial
  peptide fold or domain or sub-domain
VSEQNGMPISTARAVEGGFPGA

SEQ ID NO: 21934 - protein, 24 aa, artificial
  peptide fold or domain or sub-domain
VSERDVAAYCAARMSDYKVPESII

SEQ ID NO: 21935 - protein, 28 aa, artificial
  peptide fold or domain or sub-domain
VSESGIFTPDHVAEVRGYGADAILVGEA

SEQ ID NO: 21936 - protein, 28 aa, artificial
  peptide fold or domain or sub-domain
VSESGIRSKEDIKALMTAGYHGILIGEA

SEQ ID NO: 21937 - protein, 28 aa, artificial
  peptide fold or domain or sub-domain
VSESGVMGPEDAEILAGCGADALLIGTS

SEQ ID NO: 21938 - protein, 29 aa, artificial
  peptide fold or domain or sub-domain
VSEVEQMEGLYEAEKAHKSFQIYLTLMRK

SEQ ID NO: 21939 - protein, 22 aa, artificial
  peptide fold or domain or sub-domain
VSEWVPESRSLLCFCHFSRFDP

SEQ ID NO: 21940 - protein, 28 aa, artificial
  peptide fold or domain or sub-domain
VSFCPNDAYPYVAERANIQLNVSGGQGV

SEQ ID NO: 21941 - protein, 22 aa, artificial
  peptide fold or domain or sub-domain
VSFRWEALGNTLSSQPNLTVSW

SEQ ID NO: 21942 - protein, 29 aa, artificial
  peptide fold or domain or sub-domain
VSFVPLTEELGRNFDQEDLELLLSSYDII

SEQ ID NO: 21943 - protein, 25 aa, artificial
  peptide fold or domain or sub-domain
VSFWELANSFQSDGMKAYVEKVQKR

SEQ ID NO: 21944 - protein, 20 aa, artificial
  peptide fold or domain or sub-domain
VSGDDLRGVGLSWAKVRTVQ

SEQ ID NO: 21945 - protein, 20 aa, artificial
  peptide fold or domain or sub-domain
VSGEAMASHFHVTRATISTW

SEQ ID NO: 21946 - protein, 28 aa, artificial
  peptide fold or domain or sub-domain
VSGFKQAAGLTPDGIVDAATWQRLFPSQ

SEQ ID NO: 21947 - protein, 28 aa, artificial
  peptide fold or domain or sub-domain
VSGLLKDHRGITKIRGQWIEWQGRWCMP

SEQ ID NO: 21948 - protein, 26 aa, artificial
  peptide fold or domain or sub-domain
VSGLVKLGILKGDVDELIAQNAHRPF

SEQ ID NO: 21949 - protein, 20 aa, artificial
  peptide fold or domain or sub-domain
VSGNEIADSLGVTRETIWKN

SEQ ID NO: 21950 - protein, 20 aa, artificial
  peptide fold or domain or sub-domain
VSGNVLASMTGMTEATIAAC

SEQ ID NO: 21951 - protein, 30 aa, artificial
  peptide fold or domain or sub-domain
VSGQEFMIEIKNSAVSCIPTDWVKVGSTKA

SEQ ID NO: 21952 - protein, 28 aa, artificial
  peptide fold or domain or sub-domain
VSGQTDDILGESKKYNLEELKHLHAGKT

SEQ ID NO: 21953 - protein, 29 aa, artificial
  peptide fold or domain or sub-domain
VSHDQMMQDISNNEYLEYGSHEDAMYGTK

SEQ ID NO: 21954 - protein, 23 aa, artificial
  peptide fold or domain or sub-domain
VSHLKHAVQSVEQFDFLQDIVEK

SEQ ID NO: 21955 - protein, 30 aa, artificial
  peptide fold or domain or sub-domain
VSHRADWRNAPENSLQGIRNCIDMGVDMVE

SEQ ID NO: 21956 - protein, 30 aa, artificial
  peptide fold or domain or sub-domain
VSHRLPLSAAEDAFEMALNGQSLKILFEPN

SEQ ID NO: 21957 - protein, 22 aa, artificial
  peptide fold or domain or sub-domain
VSHRRVAVDLDLSEEAALTLLR

SEQ ID NO: 21958 - protein, 26 aa, artificial
  peptide fold or domain or sub-domain
VSICDLTLEELKNISSSFDVDIGRVW

SEQ ID NO: 21959 - protein, 20 aa, artificial
  peptide fold or domain or sub-domain
VSIDKIAGITGIPAGTVKSH

SEQ ID NO: 21960 - protein, 25 aa, artificial
  peptide fold or domain or sub-domain
VSIFIAMSDMHLKYKYHRSLEDMLG

SEQ ID NO: 21961 - protein, 20 aa, artificial
  peptide fold or domain or sub-domain
VSIKKSSGLNFDNTAIAINA

SEQ ID NO: 21962 - protein, 26 aa, artificial
  peptide fold or domain or sub-domain
VSIPTIVLTANTDFDTKLECLDIGAD

SEQ ID NO: 21963 - protein, 21 aa, artificial
  peptide fold or domain or sub-domain
VSKASDDICAKLGATPEQTKR

SEQ ID NO: 21964 - protein, 22 aa, artificial
  peptide fold or domain or sub-domain
VSKDAEGAIYPSDPKENITHGK

SEQ ID NO: 21965 - protein, 26 aa, artificial
  peptide fold or domain or sub-domain
VSKDFAAANDITDIADLGRPDVAALM

SEQ ID NO: 21966 - protein, 29 aa, artificial
  peptide fold or domain or sub-domain
VSKFGGNAWAPFGETGKYYLHLYDVTQAD

SEQ ID NO: 21967 - protein, 26 aa, artificial
  peptide fold or domain or sub-domain
VSKKEADKYNITSLEDFKRPEVKKAF

SEQ ID NO: 21968 - protein, 24 aa, artificial
  peptide fold or domain or sub-domain
VSKKIIPNYFKLQQSQTESDQVAA

SEQ ID NO: 21969 - protein, 30 aa, artificial
  peptide fold or domain or sub-domain
VSKRGDALLFAKKWIESEYDLTKSMGWQIY

SEQ ID NO: 21970 - protein, 25 aa, artificial
  peptide fold or domain or sub-domain
VSLAVICSKNQQDESLVKYQKAILE

SEQ ID NO: 21971 - protein, 26 aa, artificial
  peptide fold or domain or sub-domain
VSLEEVPRAELAAAHPALGELPEGLL

SEQ ID NO: 21972 - protein, 24 aa, artificial
  peptide fold or domain or sub-domain
VSLFKPEVLRVHNLKEIEGFDFVK

SEQ ID NO: 21973 - protein, 21 aa, artificial
  peptide fold or domain or sub-domain
VSLIEPGYFKTNFNHAMLPPT

SEQ ID NO: 21974 - protein, 23 aa, artificial
  peptide fold or domain or sub-domain
VSLNELAEAVNLTTTPCWKRLKK

SEQ ID NO: 21975 - protein, 20 aa, artificial
  peptide fold or domain or sub-domain
VSLPDEPAEVMQTPSKYATY

SEQ ID NO: 21976 - protein, 29 aa, artificial
  peptide fold or domain or sub-domain
VSLPEFQQFLLDYQGELWAVDRLQVQEFM

SEQ ID NO: 21977 - protein, 24 aa, artificial
  peptide fold or domain or sub-domain
VSLPNDQCRYFIENGAFDELTAVD

SEQ ID NO: 21978 - protein, 24 aa, artificial
  peptide fold or domain or sub-domain
VSLPNLEVRDLVKANSLDALLGAD

SEQ ID NO: 21979 - protein, 26 aa, artificial
  peptide fold or domain or sub-domain
VSLPVIIMTSRDEIDDRIAALETGAD

SEQ ID NO: 21980 - protein, 26 aa, artificial
  peptide fold or domain or sub-domain
VSLSDLAARCDERLALEAGSSLAVAR

SEQ ID NO: 21981 - protein, 22 aa, artificial
  peptide fold or domain or sub-domain
VSLSWYKGNSVLSNISVSNLSI

SEQ ID NO: 21982 - protein, 24 aa, artificial
  peptide fold or domain or sub-domain
VSLVTTMDAEPEKMHISVESDLGK

SEQ ID NO: 21983 - protein, 24 aa, artificial
  peptide fold or domain or sub-domain
VSLVYPGEADIAQGRVSVTTPVGT

SEQ ID NO: 21984 - protein, 22 aa, artificial
  peptide fold or domain or sub-domain
VSLYEHRTHRLLCPCHQSQFDI

SEQ ID NO: 21985 - protein, 25 aa, artificial
  peptide fold or domain or sub-domain
VSLYIATSDNFIDTIFSTTREAQLR

SEQ ID NO: 21986 - protein, 27 aa, artificial
  peptide fold or domain or sub-domain
VSMAADGSLYLQKGRLFPGLEELLTYY

SEQ ID NO: 21987 - protein, 23 aa, artificial
  peptide fold or domain or sub-domain
VSMDEQWLDTMVRTRGTDLVRFT

SEQ ID NO: 21988 - protein, 27 aa, artificial
  peptide fold or domain or sub-domain
VSMDEVAKVCGVTKATVYYYFSTKADL

SEQ ID NO: 21989 - protein, 27 aa, artificial
  peptide fold or domain or sub-domain
VSMEEIAREAGVKKALIYYYFPSKDKL

SEQ ID NO: 21990 - protein, 21 aa, artificial
  peptide fold or domain or sub-domain
VSMIIRRIMRHGKKSLAARIV

SEQ ID NO: 21991 - protein, 23 aa, artificial
  peptide fold or domain or sub-domain
VSMNDIEANIVRCPEASVANQMI

SEQ ID NO: 21992 - protein, 27 aa, artificial
  peptide fold or domain or sub-domain
VSMRQIAGAVGVQAGALYNYTADKQSL

SEQ ID NO: 21993 - protein, 29 aa, artificial
  peptide fold or domain or sub-domain
VSMRRIAAHLGVGTMTLYHHVRDKDELTG

SEQ ID NO: 21994 - protein, 28 aa, artificial
  peptide fold or domain or sub-domain
VSNCIKYLLSEEKSELLTTPRYNNGHDE

SEQ ID NO: 21995 - protein, 25 aa, artificial
  peptide fold or domain or sub-domain
VSNDEIQQINKQFRNKDKPTNIISF

SEQ ID NO: 21996 - protein, 23 aa, artificial
  peptide fold or domain or sub-domain
VSNGVNKYLSLTKTPSEGLLLKA

SEQ ID NO: 21997 - protein, 20 aa, artificial
  peptide fold or domain or sub-domain
VSNIAAALGGKWKDVQPFVI

SEQ ID NO: 21998 - protein, 27 aa, artificial
  peptide fold or domain or sub-domain
VSNNQIDILIDKYKGKVVYNSNSQSPM

SEQ ID NO: 21999 - protein, 24 aa, artificial
  peptide fold or domain or sub-domain
VSNTLAGTVAGLAPTAEALGITLP

SEQ ID NO: 22000 - protein, 25 aa, artificial
  peptide fold or domain or sub-domain
VSNYLGSYQTDIGADVNVATAANLF

SEQ ID NO: 22001 - protein, 26 aa, artificial
  peptide fold or domain or sub-domain
VSPFVRLPPKAGNFDSYEINGRKDYI

SEQ ID NO: 22002 - protein, 28 aa, artificial
  peptide fold or domain or sub-domain
VSPKEIVLDRTITPYASEELLTLLAEER

SEQ ID NO: 22003 - protein, 27 aa, artificial
  peptide fold or domain or sub-domain
VSPMAKARLGDTSDKVGFAGPSTKENG

SEQ ID NO: 22004 - protein, 25 aa, artificial
  peptide fold or domain or sub-domain
VSPWKMKRLNRQFLNRKGVTDVISI

SEQ ID NO: 22005 - protein, 26 aa, artificial
  peptide fold or domain or sub-domain
VSQEEVKKWAESLENLINHECGLAAF

SEQ ID NO: 22006 - protein, 28 aa, artificial
  peptide fold or domain or sub-domain
VSQEWVIQCLIVGERIGFKQHPKYKHDY

SEQ ID NO: 22007 - protein, 28 aa, artificial
  peptide fold or domain or sub-domain
VSQFPKAAKYAADYQAAYGEGAPPFSAQ

SEQ ID NO: 22008 - protein, 26 aa, artificial
  peptide fold or domain or sub-domain
VSQIMDDYVSYDPKAIIGKETGKVLE

SEQ ID NO: 22009 - protein, 28 aa, artificial
  peptide fold or domain or sub-domain
VSQQVSNWLFNVIQPSYEHKKEVYAHVF

SEQ ID NO: 22010 - protein, 21 aa, artificial
  peptide fold or domain or sub-domain
VSQTINKILSKGKKNIARYIF

SEQ ID NO: 22011 - protein, 22 aa, artificial
  peptide fold or domain or sub-domain
VSQWVADEEAALCPCHGGVYDL

SEQ ID NO: 22012 - protein, 25 aa, artificial
  peptide fold or domain or sub-domain
VSREERRWLNQKYPNWEESWGVLWD

SEQ ID NO: 22013 - protein, 25 aa, artificial
  peptide fold or domain or sub-domain
VSREQAYQWVEEGKIDNAASVIALQ

SEQ ID NO: 22014 - protein, 25 aa, artificial
  peptide fold or domain or sub-domain
VSRFHAEELSQLEGDEKFNRLCELN

SEQ ID NO: 22015 - protein, 21 aa, artificial
  peptide fold or domain or sub-domain
VSRIVGMMTIRGEREVARNAM

SEQ ID NO: 22016 - protein, 27 aa, artificial
  peptide fold or domain or sub-domain
VSRLLEKGLIERNAHGEITLTATGFQL

SEQ ID NO: 22017 - protein, 27 aa, artificial
  peptide fold or domain or sub-domain
VSRMERDGLLRVAGDRHLELTEKGRAL

SEQ ID NO: 22018 - protein, 25 aa, artificial
  peptide fold or domain or sub-domain
VSRRDALALLAEDRINNGHTLVALQ

SEQ ID NO: 22019 - protein, 25 aa, artificial
  peptide fold or domain or sub-domain
VSRRESLMRIIGDRPYSEVQIQEMM

SEQ ID NO: 22020 - protein, 27 aa, artificial
  peptide fold or domain or sub-domain
VSRRWAKKHHPRWYREIEKAEAKKESE

SEQ ID NO: 22021 - protein, 28 aa, artificial
  peptide fold or domain or sub-domain
VSRVVNICPANLYLMDRPDLISTFTKIE

SEQ ID NO: 22022 - protein, 20 aa, artificial
  peptide fold or domain or sub-domain
VSSEELARRLDLKASQIRKD

SEQ ID NO: 22023 - protein, 20 aa, artificial
  peptide fold or domain or sub-domain
VSSKELGDFTGINPVQVRRD

SEQ ID NO: 22024 - protein, 30 aa, artificial
  peptide fold or domain or sub-domain
VSSLIDKACKMIKNREVKKIESRDIEFILK

SEQ ID NO: 22025 - protein, 26 aa, artificial
  peptide fold or domain or sub-domain
VSSLLVFGPSSETSLVGRNYDVTIQG

SEQ ID NO: 22026 - protein, 22 aa, artificial
  peptide fold or domain or sub-domain
VSSQSAWFNAYRQGQPPYDRFF

SEQ ID NO: 22027 - protein, 20 aa, artificial
  peptide fold or domain or sub-domain
VSSSELSEAVKVDSATIRRD

SEQ ID NO: 22028 - protein, 20 aa, artificial
  peptide fold or domain or sub-domain
VSSTEVRRTFEKSGDLYQKL

SEQ ID NO: 22029 - protein, 20 aa, artificial
  peptide fold or domain or sub-domain
VSSTMVKEIARYGGDVSKLV

SEQ ID NO: 22030 - protein, 20 aa, artificial
  peptide fold or domain or sub-domain
VSSTQISKEINIDASQIAKD

SEQ ID NO: 22031 - protein, 24 aa, artificial
  peptide fold or domain or sub-domain
VSSTSANAQRTGDAQLLESASILA

SEQ ID NO: 22032 - protein, 20 aa, artificial
  peptide fold or domain or sub-domain
VSSVYLAEKTQAQPILVRKD

SEQ ID NO: 22033 - protein, 30 aa, artificial
  peptide fold or domain or sub-domain
VSTDACIETREGLSISHIFKENGEDYFRQM

SEQ ID NO: 22034 - protein, 27 aa, artificial
  peptide fold or domain or sub-domain
VSTDWLCDGDHDCVDKSDELNCSCKSQ

SEQ ID NO: 22035 - protein, 21 aa, artificial
  peptide fold or domain or sub-domain
VSTIDPHIIKTGMANSNSPAD

SEQ ID NO: 22036 - protein, 28 aa, artificial
  peptide fold or domain or sub-domain
VSTQELYRMLQNQGTSVSLATAYRILQS

SEQ ID NO: 22037 - protein, 29 aa, artificial
  peptide fold or domain or sub-domain
VSTRAIAERLGVRMNTVLWHVKTKTGLLE

SEQ ID NO: 22038 - protein, 27 aa, artificial
  peptide fold or domain or sub-domain
VSTREIAKIANITQPALYHHFEDKESL

SEQ ID NO: 22039 - protein, 27 aa, artificial
  peptide fold or domain or sub-domain
VSTRQIAEIAGISQPALYAYFATKDDI

SEQ ID NO: 22040 - protein, 29 aa, artificial
  peptide fold or domain or sub-domain
VSTRRVAEAVGISPMSFYTHIPGKAELLD

SEQ ID NO: 22041 - protein, 20 aa, artificial
  peptide fold or domain or sub-domain
VSTTQLTKSLNVDASLGNTY

SEQ ID NO: 22042 - protein, 24 aa, artificial
  peptide fold or domain or sub-domain
VSVDHPAFQDVIAHGNESQYANWF

SEQ ID NO: 22043 - protein, 25 aa, artificial
  peptide fold or domain or sub-domain
VSVDQLKQQDAEDEALKRYKESLLG

SEQ ID NO: 22044 - protein, 22 aa, artificial
  peptide fold or domain or sub-domain
VSVEWQATGNISLGGPNVTIFW

SEQ ID NO: 22045 - protein, 26 aa, artificial
  peptide fold or domain or sub-domain
VSVGDTPEYRRWFGPYSKENAAVVRA

SEQ ID NO: 22046 - protein, 25 aa, artificial
  peptide fold or domain or sub-domain
VSVLVDPLSKPIATKLLTGDAVLID

SEQ ID NO: 22047 - protein, 28 aa, artificial
  peptide fold or domain or sub-domain
VSVMRKTGYIALITPFLKSVQNANNKEV

SEQ ID NO: 22048 - protein, 29 aa, artificial
  peptide fold or domain or sub-domain
VSVRKVAARLDAGPMRLYGFISTKDELFD

SEQ ID NO: 22049 - protein, 26 aa, artificial
  peptide fold or domain or sub-domain
VSVRVRRQLQTVGQDLTDEDINRIME

SEQ ID NO: 22050 - protein, 21 aa, artificial
  peptide fold or domain or sub-domain
VSVSEIAEKFNMSVSNAYKYM

SEQ ID NO: 22051 - protein, 27 aa, artificial
  peptide fold or domain or sub-domain
VSVSEIAEKFNMSVSNAYKYMVVLEEK

SEQ ID NO: 22052 - protein, 26 aa, artificial
  peptide fold or domain or sub-domain
VSVVQDPDNMELFRRIGVNVLENPQR

SEQ ID NO: 22053 - protein, 30 aa, artificial
  peptide fold or domain or sub-domain
VSVWQIENFIPIQVDEAFHGKFYEADCYII

SEQ ID NO: 22054 - protein, 26 aa, artificial
  peptide fold or domain or sub-domain
VSWLKDDEPLYIGNRMKKEDDSLTIF

SEQ ID NO: 22055 - protein, 26 aa, artificial
  peptide fold or domain or sub-domain
VSWLRPTGEPMTDEDWSDPGFKSFGL

SEQ ID NO: 22056 - protein, 26 aa, artificial
  peptide fold or domain or sub-domain
VSWSREIGELPDGRTQQLPDNSLRIR

SEQ ID NO: 22057 - protein, 26 aa, artificial
  peptide fold or domain or sub-domain
VSWYGPSGDPLNWDQGELAMAAYIAA

SEQ ID NO: 22058 - protein, 23 aa, artificial
  peptide fold or domain or sub-domain
VSYAELGDRVGLSPPAAHERVKR

SEQ ID NO: 22059 - protein, 30 aa, artificial
  peptide fold or domain or sub-domain
VSYDGRIFTKPQDKADAIQMLKTLRNQTHD

SEQ ID NO: 22060 - protein, 26 aa, artificial
  peptide fold or domain or sub-domain
VSYDTQSNMQLYAQYAQQAALQDRVD

SEQ ID NO: 22061 - protein, 25 aa, artificial
  peptide fold or domain or sub-domain
VSYETNVELSKGSLNGQTAAMTGQM

SEQ ID NO: 22062 - protein, 23 aa, artificial
  peptide fold or domain or sub-domain
VSYLRGLMLLKSGGAADLLDVGH

SEQ ID NO: 22063 - protein, 21 aa, artificial
  peptide fold or domain or sub-domain
VSYQWTWNGNSVGADLVKLEV

SEQ ID NO: 22064 - protein, 22 aa, artificial
  peptide fold or domain or sub-domain
VSYTRRDECKWAGKDILKECAN

SEQ ID NO: 22065 - protein, 22 aa, artificial
  peptide fold or domain or sub-domain
VTACAMDRFQVDMEVANFIKTK

SEQ ID NO: 22066 - protein, 29 aa, artificial
  peptide fold or domain or sub-domain
VTAFDIDPDAIETAKRNCGGVNFMVADVS

SEQ ID NO: 22067 - protein, 25 aa, artificial
  peptide fold or domain or sub-domain
VTAFLLQEARQKSTIDIIEDFAGPL

SEQ ID NO: 22068 - protein, 26 aa, artificial
  peptide fold or domain or sub-domain
VTAKGNTEGNTADLTIDGDLSTYWES

SEQ ID NO: 22069 - protein, 21 aa, artificial
  peptide fold or domain or sub-domain
VTALCPWGVRTDFLDESSLKK

SEQ ID NO: 22070 - protein, 30 aa, artificial
  peptide fold or domain or sub-domain
VTAQEAAAMIGVASGDPRGGMKQVLGASRL

SEQ ID NO: 22071 - protein, 28 aa, artificial
  peptide fold or domain or sub-domain
VTAQELYEKLNKENPDIGFATVYRFLRT

SEQ ID NO: 22072 - protein, 29 aa, artificial
  peptide fold or domain or sub-domain
VTASGDTARVWDLSAPKSQAFLLEGHEGS

SEQ ID NO: 22073 - protein, 29 aa, artificial
  peptide fold or domain or sub-domain
VTAVGSRSAAAAERFADTWGIPNRHVGVT

SEQ ID NO: 22074 - protein, 26 aa, artificial
  peptide fold or domain or sub-domain
VTCDSAQSGNECNKAIDGNKDTFWHT

SEQ ID NO: 22075 - protein, 20 aa, artificial
  peptide fold or domain or sub-domain
VTCSQHMQNLQNFQMSKQKF

SEQ ID NO: 22076 - protein, 21 aa, artificial
  peptide fold or domain or sub-domain
VTDCKSALVYNNNYSKAYCRL

SEQ ID NO: 22077 - protein, 30 aa, artificial
  peptide fold or domain or sub-domain
VTDDEALQWMSRIVREEGILAGISSGAAAC

SEQ ID NO: 22078 - protein, 30 aa, artificial
  peptide fold or domain or sub-domain
VTDEEALEAFKRVSRLEGIIPALETSHALA

SEQ ID NO: 22079 - protein, 22 aa, artificial
  peptide fold or domain or sub-domain
VTDLGSGAGVISCCAEHSVYDP

SEQ ID NO: 22080 - protein, 23 aa, artificial
  peptide fold or domain or sub-domain
VTDMKKETCGDYEYALLSLVQAE

SEQ ID NO: 22081 - protein, 30 aa, artificial
  peptide fold or domain or sub-domain
VTDPQAIKMAKFLSINEGLFIGSSTAINAV

SEQ ID NO: 22082 - protein, 21 aa, artificial
  peptide fold or domain or sub-domain
VTDQMDDTLTADQGMDHYWFH

SEQ ID NO: 22083 - protein, 25 aa, artificial
  peptide fold or domain or sub-domain
VTDRILRDCRRIEPRLADAPVIETI

SEQ ID NO: 22084 - protein, 29 aa, artificial
  peptide fold or domain or sub-domain
VTDTTIHDIEGSPKVWFTDADGVEYELQA

SEQ ID NO: 22085 - protein, 22 aa, artificial
  peptide fold or domain or sub-domain
VTEEMGCPISISRWMQAGGPIS

SEQ ID NO: 22086 - protein, 21 aa, artificial
  peptide fold or domain or sub-domain
VTEILIETKRAPNKRAAVALY

SEQ ID NO: 22087 - protein, 26 aa, artificial
  peptide fold or domain or sub-domain
VTEKLSDSVSEGSAIMDAWNDNGTYI

SEQ ID NO: 22088 - protein, 28 aa, artificial
  peptide fold or domain or sub-domain
VTESGILNRADVELMEVSEVYAFLVGEA

SEQ ID NO: 22089 - protein, 25 aa, artificial
  peptide fold or domain or sub-domain
VTETLDAMEAQGGTVDLVQSFALPI

SEQ ID NO: 22090 - protein, 21 aa, artificial
  peptide fold or domain or sub-domain
VTFSFLRDTIGTSDSALSKQV

SEQ ID NO: 22091 - protein, 30 aa, artificial
  peptide fold or domain or sub-domain
VTGKFRLEEINEAVKLLEQGEAIRSLIIPN

SEQ ID NO: 22092 - protein, 25 aa, artificial
  peptide fold or domain or sub-domain
VTGLLDDLTARGDEADLLADFALPM

SEQ ID NO: 22093 - protein, 20 aa, artificial
  peptide fold or domain or sub-domain
VTGNELVDPSDDLEPGKVPN

SEQ ID NO: 22094 - protein, 20 aa, artificial
  peptide fold or domain or sub-domain
VTGPTEQQIQAVLHYELNGA

SEQ ID NO: 22095 - protein, 28 aa, artificial
  peptide fold or domain or sub-domain
VTGQMRETVGPRDTDPIEHYTNVIREKT

SEQ ID NO: 22096 - protein, 30 aa, artificial
  peptide fold or domain or sub-domain
VTGRYDLDHVAEALDSDSDPASLKSIVVPE

SEQ ID NO: 22097 - protein, 30 aa, artificial
  peptide fold or domain or sub-domain
VTHEFPFTQAEDAFQNVVSRAGIKSVIYGP

SEQ ID NO: 22098 - protein, 23 aa, artificial
  peptide fold or domain or sub-domain
VTHPASTTHSKLSDADRESVGIF

SEQ ID NO: 22099 - protein, 30 aa, artificial
  peptide fold or domain or sub-domain
VTHRFPLENIAEAFDAAHRGEGLKICIKPN

SEQ ID NO: 22100 - protein, 30 aa, artificial
  peptide fold or domain or sub-domain
VTHRFPLTRVSEALETVAGGKAVKVVIEPQ

SEQ ID NO: 22101 - protein, 30 aa, artificial
  peptide fold or domain or sub-domain
VTHRMPLEQIDAAMELMGSGQSGKIVLVPD

SEQ ID NO: 22102 - protein, 30 aa, artificial
  peptide fold or domain or sub-domain
VTHVYKIEEYQEALDKMASRQCLKIAVKPN

SEQ ID NO: 22103 - protein, 26 aa, artificial
  peptide fold or domain or sub-domain
VTIDDKDVTLPNGYHFKTGIEVRNHF

SEQ ID NO: 22104 - protein, 25 aa, artificial
  peptide fold or domain or sub-domain
VTIFAKSWDFHVTHALEITLDDNLD

SEQ ID NO: 22105 - protein, 27 aa, artificial
  peptide fold or domain or sub-domain
VTILFDGRTAYRFRWNRKHRRFQLAKN

SEQ ID NO: 22106 - protein, 24 aa, artificial
  peptide fold or domain or sub-domain
VTIMGIHDADPFNKKISNYSPLAT

SEQ ID NO: 22107 - protein, 23 aa, artificial
  peptide fold or domain or sub-domain
VTIPSQIRYVRYFEALLQYGKPI

SEQ ID NO: 22108 - protein, 29 aa, artificial
  peptide fold or domain or sub-domain
VTIRKVAAVLGVQHPAVHYHFPRRHDLVD

SEQ ID NO: 22109 - protein, 27 aa, artificial
  peptide fold or domain or sub-domain
VTISYLHKLLRKEKNNNFNFFEKIDNL

SEQ ID NO: 22110 - protein, 24 aa, artificial
  peptide fold or domain or sub-domain
VTIVGVDEVDLDRGHVSWISPVAR

SEQ ID NO: 22111 - protein, 29 aa, artificial
  peptide fold or domain or sub-domain
VTKADLVDQVAQATGLKKKDVKAMVDALL

SEQ ID NO: 22112 - protein, 26 aa, artificial
  peptide fold or domain or sub-domain
VTKEFSDKYGVTSLDDLKKVTEPLAV

SEQ ID NO: 22113 - protein, 21 aa, artificial
  peptide fold or domain or sub-domain
VTKEKLEAEKTHLEGFSPEVA

SEQ ID NO: 22114 - protein, 26 aa, artificial
  peptide fold or domain or sub-domain
VTKETAQKYNLKTYSDLVGVSEQLVL

SEQ ID NO: 22115 - protein, 23 aa, artificial
  peptide fold or domain or sub-domain
VTKQLLTELEKQATGPLKMGMYR

SEQ ID NO: 22116 - protein, 23 aa, artificial
  peptide fold or domain or sub-domain
VTLDRAVDGDTIKVTYNGNVDTV

SEQ ID NO: 22117 - protein, 25 aa, artificial
  peptide fold or domain or sub-domain
VTLEDALKLVESREVYDAKTAYAIQ

SEQ ID NO: 22118 - protein, 24 aa, artificial
  peptide fold or domain or sub-domain
VTLEELRTYAAEYVADYKLPRDLI

SEQ ID NO: 22119 - protein, 27 aa, artificial
  peptide fold or domain or sub-domain
VTLEHLRELVEQAEQQDIPAAELLDPL

SEQ ID NO: 22120 - protein, 27 aa, artificial
  peptide fold or domain or sub-domain
VTLEQLTAMVEAAQAEGRSPNPELDSL

SEQ ID NO: 22121 - protein, 23 aa, artificial
  peptide fold or domain or sub-domain
VTLGAMHFQEEGGILKRGTKRHP

SEQ ID NO: 22122 - protein, 25 aa, artificial
  peptide fold or domain or sub-domain
VTLIAGPDQGATAARLVPPAVTVIE

SEQ ID NO: 22123 - protein, 30 aa, artificial
  peptide fold or domain or sub-domain
VTLINKDCIDVGWWEGELNGRRGVFPDNFV

SEQ ID NO: 22124 - protein, 25 aa, artificial
  peptide fold or domain or sub-domain
VTLLAAAEDHARARRKLSDKVTLWD

SEQ ID NO: 22125 - protein, 22 aa, artificial
  peptide fold or domain or sub-domain
VTLSQLVTHLPLKSTSIDRFHH

SEQ ID NO: 22126 - protein, 25 aa, artificial
  peptide fold or domain or sub-domain
VTLSTKKEMADKSNKDNIYVDYQRL

SEQ ID NO: 22127 - protein, 21 aa, artificial
  peptide fold or domain or sub-domain
VTLVEPGGFSTDWSGASAKVS

SEQ ID NO: 22128 - protein, 24 aa, artificial
  peptide fold or domain or sub-domain
VTLVYPEAADVEANKISIITPIGA

SEQ ID NO: 22129 - protein, 30 aa, artificial
  peptide fold or domain or sub-domain
VTLWRIKQHNLVEIPKERHGFFFNGDCYIV

SEQ ID NO: 22130 - protein, 27 aa, artificial
  peptide fold or domain or sub-domain
VTMEELTGRPSTDRLTVDDRPAEPAQF

SEQ ID NO: 22131 - protein, 25 aa, artificial
  peptide fold or domain or sub-domain
VTMLVNQGQYTHARTVLSPAVRVVE

SEQ ID NO: 22132 - protein, 25 aa, artificial
  peptide fold or domain or sub-domain
VTMVAPPGYGDAARARCGDGVDVLE

SEQ ID NO: 22133 - protein, 24 aa, artificial
  peptide fold or domain or sub-domain
VTNAQTLLQELMAGTVDIDRVGAK

SEQ ID NO: 22134 - protein, 24 aa, artificial
  peptide fold or domain or sub-domain
VTNCGDGGVLGAVTGTIGAMQALE

SEQ ID NO: 22135 - protein, 30 aa, artificial
  peptide fold or domain or sub-domain
VTNDEICAAIKDTFEDTRSIPEPSGALAVA

SEQ ID NO: 22136 - protein, 25 aa, artificial
  peptide fold or domain or sub-domain
VTNDNVLLPTDPIGGKTGINYTNIF

SEQ ID NO: 22137 - protein, 23 aa, artificial
  peptide fold or domain or sub-domain
VTNIQNGLTKADKTNADTYKKNA

SEQ ID NO: 22138 - protein, 30 aa, artificial
  peptide fold or domain or sub-domain
VTNIWHGRDEAKRQGNKPLSQALKIIMNAF

SEQ ID NO: 22139 - protein, 28 aa, artificial
  peptide fold or domain or sub-domain
VTPNNTNGGSNFDSTRGAFDPAVLGEYL

SEQ ID NO: 22140 - protein, 30 aa, artificial
  peptide fold or domain or sub-domain
VTPRLIEPFDTTELCRLLDLSREGVRERLQ

SEQ ID NO: 22141 - protein, 21 aa, artificial
  peptide fold or domain or sub-domain
VTPSEIEKLVPYLRTTDLVGG

SEQ ID NO: 22142 - protein, 22 aa, artificial
  peptide fold or domain or sub-domain
VTPYGLSVRLGVPVKEAEKMIV

SEQ ID NO: 22143 - protein, 24 aa, artificial
  peptide fold or domain or sub-domain
VTQGFLSSPQVVGLQQGLAAANSA

SEQ ID NO: 22144 - protein, 25 aa, artificial
  peptide fold or domain or sub-domain
VTQKESAKLNTLYRHKKGATNILSF

SEQ ID NO: 22145 - protein, 23 aa, artificial
  peptide fold or domain or sub-domain
VTQWKKHGACALPMYSFNDYFVK

SEQ ID NO: 22146 - protein, 22 aa, artificial
  peptide fold or domain or sub-domain
VTRDQQNDCSNKGKDATNDCKN

SEQ ID NO: 22147 - protein, 21 aa, artificial
  peptide fold or domain or sub-domain
VTREDLAGLIGIAKETLCRTL

SEQ ID NO: 22148 - protein, 28 aa, artificial
  peptide fold or domain or sub-domain
VTRFQKERGLKVDGIAGAQTIKELKLLT

SEQ ID NO: 22149 - protein, 26 aa, artificial
  peptide fold or domain or sub-domain
VTRGTAERTGIKALSELSDPDMAAKF

SEQ ID NO: 22150 - protein, 21 aa, artificial
  peptide fold or domain or sub-domain
VTRLINKIMIDGKKSKAQKIL

SEQ ID NO: 22151 - protein, 23 aa, artificial
  peptide fold or domain or sub-domain
VTRNDEGGFEYLDGEPVNYVNWG

SEQ ID NO: 22152 - protein, 24 aa, artificial
  peptide fold or domain or sub-domain
VTRNIAAGHFSSRYGMGEGEKFDT

SEQ ID NO: 22153 - protein, 24 aa, artificial
  peptide fold or domain or sub-domain
VTRNYASGHFVSKFNATPMQKLTP

SEQ ID NO: 22154 - protein, 22 aa, artificial
  peptide fold or domain or sub-domain
VTRSRKEGIAHNYKNETEWRAN

SEQ ID NO: 22155 - protein, 28 aa, artificial
  peptide fold or domain or sub-domain
VTRSRKEGIAHNYKNETEWRANIDTVMA

SEQ ID NO: 22156 - protein, 28 aa, artificial
  peptide fold or domain or sub-domain
VTSEAQGKWAQARADEDVAAFLPVLSEV

SEQ ID NO: 22157 - protein, 27 aa, artificial
  peptide fold or domain or sub-domain
VTSHMLKYSVKNLSVFFEKDWISQEFK

SEQ ID NO: 22158 - protein, 29 aa, artificial
  peptide fold or domain or sub-domain
VTSKRQLEAKFGLGFEKVSAKLNVDFDAI

SEQ ID NO: 22159 - protein, 24 aa, artificial
  peptide fold or domain or sub-domain
VTSLEGRSPSTIERARTVGVTETS

SEQ ID NO: 22160 - protein, 22 aa, artificial
  peptide fold or domain or sub-domain
VTSLHPSKTQLVCNCHGSVFDA

SEQ ID NO: 22161 - protein, 27 aa, artificial
  peptide fold or domain or sub-domain
VTSPKVIPEQPEPTFYSREMVAIPSAH

SEQ ID NO: 22162 - protein, 24 aa, artificial
  peptide fold or domain or sub-domain
VTTGQVGIEPFVFDSANADNTYSS

SEQ ID NO: 22163 - protein, 23 aa, artificial
  peptide fold or domain or sub-domain
VTTHGGRNGHTRSEDGILDMELK

SEQ ID NO: 22164 - protein, 23 aa, artificial
  peptide fold or domain or sub-domain
VTTQRYAFGKLGLPPFIPPNVSV

SEQ ID NO: 22165 - protein, 26 aa, artificial
  peptide fold or domain or sub-domain
VTTSSNDGVFTGPSAVDGDAGTRWSS

SEQ ID NO: 22166 - protein, 25 aa, artificial
  peptide fold or domain or sub-domain
VTVCASPAQWENARKQLPEDIRVVE

SEQ ID NO: 22167 - protein, 27 aa, artificial
  peptide fold or domain or sub-domain
VTVDIPSVDRLGALGDLTDSGRELLVI

SEQ ID NO: 22168 - protein, 27 aa, artificial
  peptide fold or domain or sub-domain
VTVDRIVQESGTSKGGFYHNFKSKDEL

SEQ ID NO: 22169 - protein, 25 aa, artificial
  peptide fold or domain or sub-domain
VTVGVNDDQYINAKNLLPDNVEVVE

SEQ ID NO: 22170 - protein, 22 aa, artificial
  peptide fold or domain or sub-domain
VTVLAIHFGKEFTPEVQASWQK

SEQ ID NO: 22171 - protein, 29 aa, artificial
  peptide fold or domain or sub-domain
VTVLNREDPDWFWIMRSDGQEGFVPASFI

SEQ ID NO: 22172 - protein, 23 aa, artificial
  peptide fold or domain or sub-domain
VTVLRVNNGQEVLVEMNGTGLSV

SEQ ID NO: 22173 - protein, 22 aa, artificial
  peptide fold or domain or sub-domain
VTVPELVAELALPRSREPFLRR

SEQ ID NO: 22174 - protein, 29 aa, artificial
  peptide fold or domain or sub-domain
VTVRWTGNRGDGTSTYRGYSRDHDIEIPG

SEQ ID NO: 22175 - protein, 30 aa, artificial
  peptide fold or domain or sub-domain
VTVSYFYDSTRNVYRIISLDGSKAIINSTI

SEQ ID NO: 22176 - protein, 26 aa, artificial
  peptide fold or domain or sub-domain
VTVTIKKLAMERKIDEALKLQFLHDE

SEQ ID NO: 22177 - protein, 30 aa, artificial
  peptide fold or domain or sub-domain
VTVVTGGEVKKLKRLTFQFGDARKDSSLHI

SEQ ID NO: 22178 - protein, 25 aa, artificial
  peptide fold or domain or sub-domain
VTVVVDPGQVSAAKEYLSADIDIVE

SEQ ID NO: 22179 - protein, 26 aa, artificial
  peptide fold or domain or sub-domain
VTWAKDGLDLRNHNNTRFLLSNLLID

SEQ ID NO: 22180 - protein, 25 aa, artificial
  peptide fold or domain or sub-domain
VTWDDFTKLAAGALDPTMAFMQGKL

SEQ ID NO: 22181 - protein, 25 aa, artificial
  peptide fold or domain or sub-domain
VTWDKVAIDLFTRFSISMPIEHMLQ

SEQ ID NO: 22182 - protein, 26 aa, artificial
  peptide fold or domain or sub-domain
VTWYKNGLQLAPRNGFEMDRYQLEIV

SEQ ID NO: 22183 - protein, 26 aa, artificial
  peptide fold or domain or sub-domain
VTWYKSGNPISVTSSMVITQDSLDIY

SEQ ID NO: 22184 - protein, 25 aa, artificial
  peptide fold or domain or sub-domain
VTYDEALAMVADGRMDGGPPILALQ

SEQ ID NO: 22185 - protein, 30 aa, artificial
  peptide fold or domain or sub-domain
VTYESRILGKPSNKAEAKEMLQLLSGKTHE

SEQ ID NO: 22186 - protein, 26 aa, artificial
  peptide fold or domain or sub-domain
VTYEVVYGWSLSFENLMKHRSGQKYF

SEQ ID NO: 22187 - protein, 24 aa, artificial
  peptide fold or domain or sub-domain
VTYLPDEDRYAPIDQIDTTKTRTL

SEQ ID NO: 22188 - protein, 25 aa, artificial
  peptide fold or domain or sub-domain
VTYQLGFHSIELNEPPLVHTAASLF

SEQ ID NO: 22189 - protein, 29 aa, artificial
  peptide fold or domain or sub-domain
VVAAAERVSPDADEQLRRAAELVLLLAET

SEQ ID NO: 22190 - protein, 24 aa, artificial
  peptide fold or domain or sub-domain
VVADLSRTAAEEFTVRGATWAETP

SEQ ID NO: 22191 - protein, 24 aa, artificial
  peptide fold or domain or sub-domain
VVADRNPEAIADVIAAGAETASTA

SEQ ID NO: 22192 - protein, 30 aa, artificial
  peptide fold or domain or sub-domain
VVAGRNHALGTALADLEDGPAMRLRSLGQI

SEQ ID NO: 22193 - protein, 21 aa, artificial
  peptide fold or domain or sub-domain
VVAINPGPIQTPIWDKAETMD

SEQ ID NO: 22194 - protein, 29 aa, artificial
  peptide fold or domain or sub-domain
VVALMSGSPDKAKLTASQYGIPSDAIYGY

SEQ ID NO: 22195 - protein, 29 aa, artificial
  peptide fold or domain or sub-domain
VVANETEFDLYGEALALNGRDRAARMRDF

SEQ ID NO: 22196 - protein, 20 aa, artificial
  peptide fold or domain or sub-domain
VVARAAKLLSLRRTTLVEKL

SEQ ID NO: 22197 - protein, 29 aa, artificial
  peptide fold or domain or sub-domain
VVAVCTTEPHEIEWAKSNAEYTEFGIAVY

SEQ ID NO: 22198 - protein, 30 aa, artificial
  peptide fold or domain or sub-domain
VVCAFNRTVSKVDDFLANEAKGTKVLGAHS

SEQ ID NO: 22199 - protein, 30 aa, artificial
  peptide fold or domain or sub-domain
VVCDDRVLEKPKSFEDSKRMLTDLSGRRHQ

SEQ ID NO: 22200 - protein, 25 aa, artificial
  peptide fold or domain or sub-domain
VVCGGTWLTPGDAVARKDWAHITKL

SEQ ID NO: 22201 - protein, 22 aa, artificial
  peptide fold or domain or sub-domain
VVCPADDIMWREYKCECDQGSD

SEQ ID NO: 22202 - protein, 27 aa, artificial
  peptide fold or domain or sub-domain
VVDAFLATQKDKGKATTSISRMISSLR

SEQ ID NO: 22203 - protein, 23 aa, artificial
  peptide fold or domain or sub-domain
VVDETSESYDASVKVGAVGKNEL

SEQ ID NO: 22204 - protein, 21 aa, artificial
  peptide fold or domain or sub-domain
VVDLLRQAALEQKDDVMLKLL

SEQ ID NO: 22205 - protein, 29 aa, artificial
  peptide fold or domain or sub-domain
VVDNKQQKSGAKSLADLDVDVLKEIVNNF

SEQ ID NO: 22206 - protein, 28 aa, artificial
  peptide fold or domain or sub-domain
VVDVQYNSTVGKYVGYTEQGVIFARNFN

SEQ ID NO: 22207 - protein, 27 aa, artificial
  peptide fold or domain or sub-domain
VVECVEKLANAFDAGDLESARQECVRL

SEQ ID NO: 22208 - protein, 28 aa, artificial
  peptide fold or domain or sub-domain
VVEDYIEDVQSSLTRDEIRNLIKDGKII

SEQ ID NO: 22209 - protein, 30 aa, artificial
  peptide fold or domain or sub-domain
VVEEFLTMPPPKATDMFDYLYAELPVSLEK

SEQ ID NO: 22210 - protein, 29 aa, artificial
  peptide fold or domain or sub-domain
VVEFSRNVLGWQDANSTEFDPTTSHPVVV

SEQ ID NO: 22211 - protein, 20 aa, artificial
  peptide fold or domain or sub-domain
VVEGLISLGWRQQDAQQAVA

SEQ ID NO: 22212 - protein, 24 aa, artificial
  peptide fold or domain or sub-domain
VVEHSICSTPEWWGSIARETMVCA

SEQ ID NO: 22213 - protein, 26 aa, artificial
  peptide fold or domain or sub-domain
VVEQVESGQFPGVCWDDTAKTMFRIP

SEQ ID NO: 22214 - protein, 30 aa, artificial
  peptide fold or domain or sub-domain
VVETDWDEREVLIRFDKWSSRFDEWIPMDS

SEQ ID NO: 22215 - protein, 26 aa, artificial
  peptide fold or domain or sub-domain
VVETVLEKILKERDVQGAVKYVQNTI

SEQ ID NO: 22216 - protein, 24 aa, artificial
  peptide fold or domain or sub-domain
VVFGGDAFPCQKPDPLPVIRTCEA

SEQ ID NO: 22217 - protein, 30 aa, artificial
  peptide fold or domain or sub-domain
VVFNRRIYGKPTGPADAGRMLGELQGQWHT

SEQ ID NO: 22218 - protein, 21 aa, artificial
  peptide fold or domain or sub-domain
VVFPAGRDPQWGNLETPVNAS

SEQ ID NO: 22219 - protein, 24 aa, artificial
  peptide fold or domain or sub-domain
VVGCCGSCKPCSSELEQYCNKRIW

SEQ ID NO: 22220 - protein, 20 aa, artificial
  peptide fold or domain or sub-domain
VVGDELQSPGEGVSDAEIYD

SEQ ID NO: 22221 - protein, 24 aa, artificial
  peptide fold or domain or sub-domain
VVGGGDSVAAVNRLGLKERFGHVS

SEQ ID NO: 22222 - protein, 24 aa, artificial
  peptide fold or domain or sub-domain
VVGGIISTEDELVLKNMGVTAVYT

SEQ ID NO: 22223 - protein, 22 aa, artificial
  peptide fold or domain or sub-domain
VVGKPGLDGHSNGAEQIALRAR

SEQ ID NO: 22224 - protein, 27 aa, artificial
  peptide fold or domain or sub-domain
VVGLEREGKSWELAKSDGITPLHTKDA

SEQ ID NO: 22225 - protein, 21 aa, artificial
  peptide fold or domain or sub-domain
VVGQERKHLAHSLSLTETQVK

SEQ ID NO: 22226 - protein, 24 aa, artificial
  peptide fold or domain or sub-domain
VVGSIRQLQLLGLADPDVDPAIAA

SEQ ID NO: 22227 - protein, 25 aa, artificial
  peptide fold or domain or sub-domain
VVGVGGSLVSRQMIQEGKWELITEK

SEQ ID NO: 22228 - protein, 30 aa, artificial
  peptide fold or domain or sub-domain
VVGYSLDYNEIFRDLDHCCLVNDEGKKKYK

SEQ ID NO: 22229 - protein, 29 aa, artificial
  peptide fold or domain or sub-domain
VVHATDEELARMDDFVTRMHDSSGLTPLI

SEQ ID NO: 22230 - protein, 29 aa, artificial
  peptide fold or domain or sub-domain
VVHQDDEHIARSHEWAIDVHTKSGLLAAV

SEQ ID NO: 22231 - protein, 26 aa, artificial
  peptide fold or domain or sub-domain
VVHTTSGSPDDVKFCYEAGANSYLVK

SEQ ID NO: 22232 - protein, 30 aa, artificial
  peptide fold or domain or sub-domain
VVICGNNHKLFRMMKQRFRYHTNVHIIGYT

SEQ ID NO: 22233 - protein, 27 aa, artificial
  peptide fold or domain or sub-domain
VVIDRDKRALQQAVEALGPTTAGITAD

SEQ ID NO: 22234 - protein, 29 aa, artificial
  peptide fold or domain or sub-domain
VVIDVNEQFISELAIDDLHLFVPGLSADA

SEQ ID NO: 22235 - protein, 29 aa, artificial
  peptide fold or domain or sub-domain
VVIEKDELRVEELDLLDFKTDTPAFAADA

SEQ ID NO: 22236 - protein, 24 aa, artificial
  peptide fold or domain or sub-domain
VVIGGDDVQNKKPHPDPLLLVAER

SEQ ID NO: 22237 - protein, 23 aa, artificial
  peptide fold or domain or sub-domain
VVIRERVLMGNRVVVQPGAVLGS

SEQ ID NO: 22238 - protein, 29 aa, artificial
  peptide fold or domain or sub-domain
VVIVNDTASSDWWKCSVDGKEGVVPSNFI

SEQ ID NO: 22239 - protein, 26 aa, artificial
  peptide fold or domain or sub-domain
VVKDAQAQGLDAKDYVVKSLKDGSLK

SEQ ID NO: 22240 - protein, 24 aa, artificial
  peptide fold or domain or sub-domain
VVKFHPDKFVSGSNKERALALQNT

SEQ ID NO: 22241 - protein, 24 aa, artificial
  peptide fold or domain or sub-domain
VVKGLIDAMKAGNLEEARAINRKY

SEQ ID NO: 22242 - protein, 26 aa, artificial
  peptide fold or domain or sub-domain
VVKGLIDAMKAGNLEEARAINRKYRK

SEQ ID NO: 22243 - protein, 30 aa, artificial
  peptide fold or domain or sub-domain
VVKGNKILGKPSSHEEAIDMLSGLQGEKHT

SEQ ID NO: 22244 - protein, 26 aa, artificial
  peptide fold or domain or sub-domain
VVKLAEEQSGKKPITQRPADLLPPEW

SEQ ID NO: 22245 - protein, 30 aa, artificial
  peptide fold or domain or sub-domain
VVKWEENMNFRGYDSGQRDVLMDASAIYGG

SEQ ID NO: 22246 - protein, 23 aa, artificial
  peptide fold or domain or sub-domain
VVLAKTLHFMEFECLREFADAPA

SEQ ID NO: 22247 - protein, 30 aa, artificial
  peptide fold or domain or sub-domain
VVLASKSICSIDRANEIAAGDPRLLVTDRF

SEQ ID NO: 22248 - protein, 29 aa, artificial
  peptide fold or domain or sub-domain
VVLDIRQDRIDLLGTRDLVSYVPGLRTDA

SEQ ID NO: 22249 - protein, 29 aa, artificial
  peptide fold or domain or sub-domain
VVLDQKEAAINRLNLTDYQLDVPALYGDA

SEQ ID NO: 22250 - protein, 27 aa, artificial
  peptide fold or domain or sub-domain
VVLDTNGAAAEQVANEIGSMAQHAVAD

SEQ ID NO: 22251 - protein, 29 aa, artificial
  peptide fold or domain or sub-domain
VVLEDSELDRSVANCFTLYGGNKTVVIAA

SEQ ID NO: 22252 - protein, 27 aa, artificial
  peptide fold or domain or sub-domain
VVLGGNYQDVLKEAIGEDLPAHFGGTV

SEQ ID NO: 22253 - protein, 20 aa, artificial
  peptide fold or domain or sub-domain
VVLIPVDPNNPNGPKMPFRQ

SEQ ID NO: 22254 - protein, 30 aa, artificial
  peptide fold or domain or sub-domain
VVLLDTVGEDRGWWKGQVNNKSGFFPLSYV

SEQ ID NO: 22255 - protein, 21 aa, artificial
  peptide fold or domain or sub-domain
VVLLHPGFVQTEMVNHAGDIP

SEQ ID NO: 22256 - protein, 30 aa, artificial
  peptide fold or domain or sub-domain
VVLNGQVLEKPRDKEHAQQILSALSGQKHQ

SEQ ID NO: 22257 - protein, 30 aa, artificial
  peptide fold or domain or sub-domain
VVLSTASEEMGRTVQVLLLNFGILASRCAN

SEQ ID NO: 22258 - protein, 28 aa, artificial
  peptide fold or domain or sub-domain
VVLTAGSLSLDPARHTVQRGSTPIALTP

SEQ ID NO: 22259 - protein, 26 aa, artificial
  peptide fold or domain or sub-domain
VVLTTSDAGTDVDTAFSLGCRGFITK

SEQ ID NO: 22260 - protein, 26 aa, artificial
  peptide fold or domain or sub-domain
VVLTTSRNEDDIFHSYDLHVNCYITK

SEQ ID NO: 22261 - protein, 27 aa, artificial
  peptide fold or domain or sub-domain
VVLVDGCYLNKWYYPKISNLKLVVQAA

SEQ ID NO: 22262 - protein, 21 aa, artificial
  peptide fold or domain or sub-domain
VVLVEPGPVETNFDNRADEEL

SEQ ID NO: 22263 - protein, 22 aa, artificial
  peptide fold or domain or sub-domain
VVLYSERAPRPHERDGVDYHFR

SEQ ID NO: 22264 - protein, 28 aa, artificial
  peptide fold or domain or sub-domain
VVMHFKAEEDLFAKVNFSDSTSHKETHD

SEQ ID NO: 22265 - protein, 25 aa, artificial
  peptide fold or domain or sub-domain
VVMMARPDQLKAAQKACGRDVEVIP

SEQ ID NO: 22266 - protein, 24 aa, artificial
  peptide fold or domain or sub-domain
VVMSGEEVANGKPAPDVYRETAEK

SEQ ID NO: 22267 - protein, 26 aa, artificial
  peptide fold or domain or sub-domain
VVMTELQDIESAQHFRTRGIASIFPK

SEQ ID NO: 22268 - protein, 26 aa, artificial
  peptide fold or domain or sub-domain
VVMTSSKEEQDLIQSYSLGANSYVRK

SEQ ID NO: 22269 - protein, 30 aa, artificial
  peptide fold or domain or sub-domain
VVNALGDDTLLVTEALAAHPAFADYRRIAI

SEQ ID NO: 22270 - protein, 20 aa, artificial
  peptide fold or domain or sub-domain
VVNANRHQEIYQASGLKVIE

SEQ ID NO: 22271 - protein, 23 aa, artificial
  peptide fold or domain or sub-domain
VVNFYSRIADQCDFEEFVSFMTS

SEQ ID NO: 22272 - protein, 28 aa, artificial
  peptide fold or domain or sub-domain
VVNIHYLPDMIATHVAHRPVRLSDERDA

SEQ ID NO: 22273 - protein, 21 aa, artificial
  peptide fold or domain or sub-domain
VVNITENDYLRYHTEVEWLYS

SEQ ID NO: 22274 - protein, 22 aa, artificial
  peptide fold or domain or sub-domain
VVNLAEKTEKLYGLSYDPDTEI

SEQ ID NO: 22275 - protein, 30 aa, artificial
  peptide fold or domain or sub-domain
VVNTGNAMDPKRLKRALNGLCSGIVVKRFF

SEQ ID NO: 22276 - protein, 21 aa, artificial
  peptide fold or domain or sub-domain
VVNYREAYKMFACNGILFNHE

SEQ ID NO: 22277 - protein, 23 aa, artificial
  peptide fold or domain or sub-domain
VVPSGRGDCFEKEPIESVPRDCY

SEQ ID NO: 22278 - protein, 25 aa, artificial
  peptide fold or domain or sub-domain
VVPTDFDIYNPKSWLKDALLQPESR

SEQ ID NO: 22279 - protein, 23 aa, artificial
  peptide fold or domain or sub-domain
VVPYQYGYGEQGIPPTIPPRSTL

SEQ ID NO: 22280 - protein, 22 aa, artificial
  peptide fold or domain or sub-domain
VVQGQRDKEIAYFLGLSPHNVD

SEQ ID NO: 22281 - protein, 27 aa, artificial
  peptide fold or domain or sub-domain
VVQMVTRGNIQKYIDRYVLTQELGGSN

SEQ ID NO: 22282 - protein, 30 aa, artificial
  peptide fold or domain or sub-domain
VVQRRDVFNKPGSAEEAKDMLRKLSNNMHE

SEQ ID NO: 22283 - protein, 26 aa, artificial
  peptide fold or domain or sub-domain
VVRDACSDPAVYARLAEELIATERVN

SEQ ID NO: 22284 - protein, 22 aa, artificial
  peptide fold or domain or sub-domain
VVREAQRLYNIDKDVAAFVKEE

SEQ ID NO: 22285 - protein, 24 aa, artificial
  peptide fold or domain or sub-domain
VVRLKKAGSFVRRYGGAEGEDLPV

SEQ ID NO: 22286 - protein, 26 aa, artificial
  peptide fold or domain or sub-domain
VVRMSDGDFAEPYRLAGATHIISTTE

SEQ ID NO: 22287 - protein, 24 aa, artificial
  peptide fold or domain or sub-domain
VVRNAASGSFERKFAVPHLTKFAE

SEQ ID NO: 22288 - protein, 24 aa, artificial
  peptide fold or domain or sub-domain
VVRNVVAGSMSKRLGIPEGTELEQ

SEQ ID NO: 22289 - protein, 29 aa, artificial
  peptide fold or domain or sub-domain
VVRQTKDCLDKMDDWCQTHHGASGLTKKV

SEQ ID NO: 22290 - protein, 26 aa, artificial
  peptide fold or domain or sub-domain
VVRVPTNEPVIIKRLLDIGFYNFLIP

SEQ ID NO: 22291 - protein, 25 aa, artificial
  peptide fold or domain or sub-domain
VVSEAGCAGTSDTLACLRTVDYTKF

SEQ ID NO: 22292 - protein, 27 aa, artificial
  peptide fold or domain or sub-domain
VVSFTGSRKVGDIIARQVGIKKLVLEL

SEQ ID NO: 22293 - protein, 27 aa, artificial
  peptide fold or domain or sub-domain
VVSIKFNEEVDKEKLREARKEYGKVAI

SEQ ID NO: 22294 - protein, 21 aa, artificial
  peptide fold or domain or sub-domain
VVSNKKQNNFECRNCSNRSMI

SEQ ID NO: 22295 - protein, 21 aa, artificial
  peptide fold or domain or sub-domain
VVSTSKGLMSDRAARKAGLGG

SEQ ID NO: 22296 - protein, 25 aa, artificial
  peptide fold or domain or sub-domain
VVSTSVVVFNHPQHRGESFDMEGSE

SEQ ID NO: 22297 - protein, 22 aa, artificial
  peptide fold or domain or sub-domain
VVSVVVEKNSPGRRGEQVGAGS

SEQ ID NO: 22298 - protein, 29 aa, artificial
  peptide fold or domain or sub-domain
VVTEVDQDRVNDLELEDYQFDIPVLCADA

SEQ ID NO: 22299 - protein, 25 aa, artificial
  peptide fold or domain or sub-domain
VVTSNDARVLEYAKEVGVEVIKRPD

SEQ ID NO: 22300 - protein, 24 aa, artificial
  peptide fold or domain or sub-domain
VVTVDEEFVLETFSYPSFVETLNS

SEQ ID NO: 22301 - protein, 27 aa, artificial
  peptide fold or domain or sub-domain
VVTVGLRNKLTCTWNFTVIPEKTVDDI

SEQ ID NO: 22302 - protein, 28 aa, artificial
  peptide fold or domain or sub-domain
VVVEALRFMRAANRTTLTVQDVSQALRV

SEQ ID NO: 22303 - protein, 29 aa, artificial
  peptide fold or domain or sub-domain
VVVECDEVKAGEIDLHSYRADVPTMCADA

SEQ ID NO: 22304 - protein, 28 aa, artificial
  peptide fold or domain or sub-domain
VVVGRRLEVLEKLKESIEKLGQRALAVK

SEQ ID NO: 22305 - protein, 25 aa, artificial
  peptide fold or domain or sub-domain
VVVKTDAAGRLIGVDRKKIERMRMQ

SEQ ID NO: 22306 - protein, 23 aa, artificial
  peptide fold or domain or sub-domain
VVVQDATWRFNNTPNDAYYTQFS

SEQ ID NO: 22307 - protein, 29 aa, artificial
  peptide fold or domain or sub-domain
VVVRLGNDRPEFVQQIGQLEGVADVIGDA

SEQ ID NO: 22308 - protein, 29 aa, artificial
  peptide fold or domain or sub-domain
VVVRNAHPGVRAVAQRETLSNEEDGVAAV

SEQ ID NO: 22309 - protein, 24 aa, artificial
  peptide fold or domain or sub-domain
VVVSGDTCGEPKPSVKPMLYACGQ

SEQ ID NO: 22310 - protein, 28 aa, artificial
  peptide fold or domain or sub-domain
VVVVGHRGEEVAGHCKARGLPVRVVENP

SEQ ID NO: 22311 - protein, 28 aa, artificial
  peptide fold or domain or sub-domain
VVVVGHRREQVEAHLAEDAPDVTTAVQA

SEQ ID NO: 22312 - protein, 28 aa, artificial
  peptide fold or domain or sub-domain
VVVVGYRKEEVIRHLNRLDAPIQVVVQE

SEQ ID NO: 22313 - protein, 26 aa, artificial
  peptide fold or domain or sub-domain
VVWLHNAQPLSPSPRHRVSAQVLRVL

SEQ ID NO: 22314 - protein, 24 aa, artificial
  peptide fold or domain or sub-domain
VVWNRSAHKCRKFQEVGAEVADTP

SEQ ID NO: 22315 - protein, 26 aa, artificial
  peptide fold or domain or sub-domain
VVYADSDADGSMKLAADGDINTFWHT

SEQ ID NO: 22316 - protein, 26 aa, artificial
  peptide fold or domain or sub-domain
VVYDPKSDPDEYRRLASRMLQEDDVT

SEQ ID NO: 22317 - protein, 30 aa, artificial
  peptide fold or domain or sub-domain
VVYDPYASAEVAKQAGVELRPELSGLLPEV

SEQ ID NO: 22318 - protein, 29 aa, artificial
  peptide fold or domain or sub-domain
VVYVRSPQKFANMAPEGVRSRVTVFHGDA

SEQ ID NO: 22319 - protein, 22 aa, artificial
  peptide fold or domain or sub-domain
VWAAMGDGNGSLGLSEPMIQKR

SEQ ID NO: 22320 - protein, 28 aa, artificial
  peptide fold or domain or sub-domain
VWAEDMVFVPMAVPWSPEHQLQRLQVTR

SEQ ID NO: 22321 - protein, 24 aa, artificial
  peptide fold or domain or sub-domain
VWAENEEQVKELGPWGQPVWHRSP

SEQ ID NO: 22322 - protein, 26 aa, artificial
  peptide fold or domain or sub-domain
VWAFSDRGIKTRVSTAFEKSMQDGGC

SEQ ID NO: 22323 - protein, 24 aa, artificial
  peptide fold or domain or sub-domain
VWAGPDTDTKETKLDGGRVWHHSP

SEQ ID NO: 22324 - protein, 22 aa, artificial
  peptide fold or domain or sub-domain
VWAVCGDPNASVSQPEPFWGRT

SEQ ID NO: 22325 - protein, 27 aa, artificial
  peptide fold or domain or sub-domain
VWCTLIGKTLYYFRSQEDKFPLGQIKL

SEQ ID NO: 22326 - protein, 26 aa, artificial
  peptide fold or domain or sub-domain
VWDFKNRGSRTDIVAAMDQPLSESAC

SEQ ID NO: 22327 - protein, 25 aa, artificial
  peptide fold or domain or sub-domain
VWDYTNIGGKPILDWIPKDRQDKDL

SEQ ID NO: 22328 - protein, 26 aa, artificial
  peptide fold or domain or sub-domain
VWIAVNEDGVSILDHNTMQVHITYPY

SEQ ID NO: 22329 - protein, 26 aa, artificial
  peptide fold or domain or sub-domain
VWLAVHEDGLSVLELSSVKLLVSHPY

SEQ ID NO: 22330 - protein, 23 aa, artificial
  peptide fold or domain or sub-domain
VWLGTCNGMEKQWVDAAKIPFYT

SEQ ID NO: 22331 - protein, 24 aa, artificial
  peptide fold or domain or sub-domain
VWNECGRRVEIRNTWDPMHNPNAR

SEQ ID NO: 22332 - protein, 30 aa, artificial
  peptide fold or domain or sub-domain
VWNEWDIERCATRTALEQSPQLVWQAFGPL

SEQ ID NO: 22333 - protein, 24 aa, artificial
  peptide fold or domain or sub-domain
VWNNRLDRLSLCGKQTSLSALKAT

SEQ ID NO: 22334 - protein, 26 aa, artificial
  peptide fold or domain or sub-domain
VWQFTDRGSHAHLTSGMFQTIGDSSC

SEQ ID NO: 22335 - protein, 22 aa, artificial
  peptide fold or domain or sub-domain
VWRLDWTKDGMEFYVDEVLQLT

SEQ ID NO: 22336 - protein, 24 aa, artificial
  peptide fold or domain or sub-domain
VWRQDDPGWTQPWNPAQGTWYRRG

SEQ ID NO: 22337 - protein, 25 aa, artificial
  peptide fold or domain or sub-domain
VWSGMNVASIKLHPLDGTNKDKQDW

SEQ ID NO: 22338 - protein, 25 aa, artificial
  peptide fold or domain or sub-domain
VWSHAQIAGEPVLDLLPSNTNLEAF

SEQ ID NO: 22339 - protein, 30 aa, artificial
  peptide fold or domain or sub-domain
VWSKVDPQAMASIDAWARDPEPMWAWYRWR

SEQ ID NO: 22340 - protein, 29 aa, artificial
  peptide fold or domain or sub-domain
VWSWWGRTYLRAQALGMGKHTAWAFLSAI

SEQ ID NO: 22341 - protein, 20 aa, artificial
  peptide fold or domain or sub-domain
VWSYFPQCSNNQIRSALNAT

SEQ ID NO: 22342 - protein, 30 aa, artificial
  peptide fold or domain or sub-domain
VWTKYRTIYFDEFRQSAEARREYWRQKSEA

SEQ ID NO: 22343 - protein, 20 aa, artificial
  peptide fold or domain or sub-domain
VWTVRPELSARQVAEVLMLG

SEQ ID NO: 22344 - protein, 25 aa, artificial
  peptide fold or domain or sub-domain
VWVSYIGSSTMYYADSVKGRFTISR

SEQ ID NO: 22345 - protein, 25 aa, artificial
  peptide fold or domain or sub-domain
VWWEFGKAGDTHLLGDNPRWLGFGG

SEQ ID NO: 22346 - protein, 26 aa, artificial
  peptide fold or domain or sub-domain
VYADHLKQAAHKSLTHLDDTEFKDYK

SEQ ID NO: 22347 - protein, 25 aa, artificial
  peptide fold or domain or sub-domain
VYADVISQPALALLHNANIEVSYVR

SEQ ID NO: 22348 - protein, 23 aa, artificial
  peptide fold or domain or sub-domain
VYALKDEFNDMNEAEQFCVQVGS

SEQ ID NO: 22349 - protein, 25 aa, artificial
  peptide fold or domain or sub-domain
VYAQVIGDCAKDVLEHHGIEVEYNR

SEQ ID NO: 22350 - protein, 26 aa, artificial
  peptide fold or domain or sub-domain
VYASTEVGGNYAQAVADGDDETRWES

SEQ ID NO: 22351 - protein, 22 aa, artificial
  peptide fold or domain or sub-domain
VYAVEWSPEAIVWFLDGREYAR

SEQ ID NO: 22352 - protein, 26 aa, artificial
  peptide fold or domain or sub-domain
VYDKNSIFRSKYLSLIEKRLLYKFFT

SEQ ID NO: 22353 - protein, 29 aa, artificial
  peptide fold or domain or sub-domain
VYEEASKQITGEQEVRARHILVETEDEAK

SEQ ID NO: 22354 - protein, 25 aa, artificial
  peptide fold or domain or sub-domain
VYELGKYLGEDIPKTGNLENIFIIL

SEQ ID NO: 22355 - protein, 21 aa, artificial
  peptide fold or domain or sub-domain
VYELIFESGDPHTKHFRVSCT

SEQ ID NO: 22356 - protein, 29 aa, artificial
  peptide fold or domain or sub-domain
VYFSAAGLNRLGRDIVSIAEMEGLEAHGR

SEQ ID NO: 22357 - protein, 22 aa, artificial
  peptide fold or domain or sub-domain
VYGIMWNEDEVVWYVNDKIYHR

SEQ ID NO: 22358 - protein, 28 aa, artificial
  peptide fold or domain or sub-domain
VYGQMLDMQGEHKTLTLNELERIHIHKT

SEQ ID NO: 22359 - protein, 30 aa, artificial
  peptide fold or domain or sub-domain
VYHGRNRLDPADEQRLRARYLPLHELLREA

SEQ ID NO: 22360 - protein, 24 aa, artificial
  peptide fold or domain or sub-domain
VYIDASVPRSRGRVLPRGLAVEKP

SEQ ID NO: 22361 - protein, 26 aa, artificial
  peptide fold or domain or sub-domain
VYKCTICNDTFTSKKSMEAHIKSHSE

SEQ ID NO: 22362 - protein, 22 aa, artificial
  peptide fold or domain or sub-domain
VYKDAYIPFSRKALVRGRLIHT

SEQ ID NO: 22363 - protein, 30 aa, artificial
  peptide fold or domain or sub-domain
VYKEGKVFGKPRSKEEAFQNLRELAGHWHS

SEQ ID NO: 22364 - protein, 20 aa, artificial
  peptide fold or domain or sub-domain
VYKGLLSLGLSAAEAREILG

SEQ ID NO: 22365 - protein, 22 aa, artificial
  peptide fold or domain or sub-domain
VYKLTWSQSEIKMFIDDIQYMV

SEQ ID NO: 22366 - protein, 29 aa, artificial
  peptide fold or domain or sub-domain
VYKNEKEIAALIKNKQGKQRFAEIRSICK

SEQ ID NO: 22367 - protein, 22 aa, artificial
  peptide fold or domain or sub-domain
VYKTIWSPESISIYVDDTLIHT

SEQ ID NO: 22368 - protein, 24 aa, artificial
  peptide fold or domain or sub-domain
VYLDANKARNEGRLTPMSCSVKTP

SEQ ID NO: 22369 - protein, 26 aa, artificial
  peptide fold or domain or sub-domain
VYLNQVKDQAEKALDNLDGTDYEQYK

SEQ ID NO: 22370 - protein, 30 aa, artificial
  peptide fold or domain or sub-domain
VYLQKENIIDESGMPKERFSAEFPKEGPSI

SEQ ID NO: 22371 - protein, 25 aa, artificial
  peptide fold or domain or sub-domain
VYMGVPQAFLAEAQKVMPSHVTLVE

SEQ ID NO: 22372 - protein, 30 aa, artificial
  peptide fold or domain or sub-domain
VYNFKILRKELETLGYSFFSNTDTEVVLNA

SEQ ID NO: 22373 - protein, 30 aa, artificial
  peptide fold or domain or sub-domain
VYNKFDADLIFSIDHFNKDPAYFYAHSKSF

SEQ ID NO: 22374 - protein, 21 aa, artificial
  peptide fold or domain or sub-domain
VYNLVKHEGPPHRRKFFTDLL

SEQ ID NO: 22375 - protein, 26 aa, artificial
  peptide fold or domain or sub-domain
VYPCPFCFKEFTRKDNMTAHVKIIHK

SEQ ID NO: 22376 - protein, 21 aa, artificial
  peptide fold or domain or sub-domain
VYREVERTGPHHDPQFRVAVI

SEQ ID NO: 22377 - protein, 22 aa, artificial
  peptide fold or domain or sub-domain
VYRLTWDPQFIRVSIDGQQYFE

SEQ ID NO: 22378 - protein, 28 aa, artificial
  peptide fold or domain or sub-domain
VYRQVWAADAEAFRDHWGYSEPTEADFQ

SEQ ID NO: 22379 - protein, 22 aa, artificial
  peptide fold or domain or sub-domain
VYSIEWEPGEIRWYIDGKLYHV

SEQ ID NO: 22380 - protein, 29 aa, artificial
  peptide fold or domain or sub-domain
VYSKSQISSALNVNAKVLENSLGVDFNAV

SEQ ID NO: 22381 - protein, 25 aa, artificial
  peptide fold or domain or sub-domain
VYSNRGIALQELKRYDEALVSYEKA

SEQ ID NO: 22382 - protein, 20 aa, artificial
  peptide fold or domain or sub-domain
VYSQKNEKELVDLQISMDMA

SEQ ID NO: 22383 - protein, 29 aa, artificial
  peptide fold or domain or sub-domain
VYSQSQLSAAVGCNFKALNKALNIDFDSI

SEQ ID NO: 22384 - protein, 22 aa, artificial
  peptide fold or domain or sub-domain
VYSVEWGEGIIRFLVNDRVHAV

SEQ ID NO: 22385 - protein, 22 aa, artificial
  peptide fold or domain or sub-domain
VYSVSWTDEKIEFLIDNSVYHS

SEQ ID NO: 22386 - protein, 24 aa, artificial
  peptide fold or domain or sub-domain
VYTDVDITPLGFAYGELLGEPKSW

SEQ ID NO: 22387 - protein, 29 aa, artificial
  peptide fold or domain or sub-domain
VYTETWHHLSEWFRNDAVAAFDTKYGMTF

SEQ ID NO: 22388 - protein, 21 aa, artificial
  peptide fold or domain or sub-domain
VYTVTNIKGEAHNQEFTVACE

SEQ ID NO: 22389 - protein, 26 aa, artificial
  peptide fold or domain or sub-domain
VYVDVLKDSGRDYVSQFEGSALGKQL

SEQ ID NO: 22390 - protein, 26 aa, artificial
  peptide fold or domain or sub-domain
VYVGVNIKGLHLLNMETKALLISLKY

SEQ ID NO: 22391 - protein, 29 aa, artificial
  peptide fold or domain or sub-domain
VYVILAILADKQPNEMLDELLKLPNVHVT

SEQ ID NO: 22392 - protein, 21 aa, artificial
  peptide fold or domain or sub-domain
VYVLDREEGPDHDKTFHMNVV

SEQ ID NO: 22393 - protein, 28 aa, artificial
  peptide fold or domain or sub-domain
VYYITDKFDINPDTLVLGIPLSTCLRFL

SEQ ID NO: 22394 - protein, 27 aa, artificial
  peptide fold or domain or sub-domain
WAALTREHPTADDDLAKGNFAAINGWR

SEQ ID NO: 22395 - protein, 24 aa, artificial
  peptide fold or domain or sub-domain
WAALWWRRAQASGNAVDVAEARTW

SEQ ID NO: 22396 - protein, 29 aa, artificial
  peptide fold or domain or sub-domain
WAAMEKGYQRFKDGLSAKESARYMQKVAD

SEQ ID NO: 22397 - protein, 27 aa, artificial
  peptide fold or domain or sub-domain
WAASVNAAAGRQSADPALAAKMRTVAG

SEQ ID NO: 22398 - protein, 26 aa, artificial
  peptide fold or domain or sub-domain
WACANDRYAPRIERFFLLGPELADAF

SEQ ID NO: 22399 - protein, 20 aa, artificial
  peptide fold or domain or sub-domain
WADNTKSGSQVYASDNLIQR

SEQ ID NO: 22400 - protein, 20 aa, artificial
  peptide fold or domain or sub-domain
WADVSNAGGSVGFVPPVTVD

SEQ ID NO: 22401 - protein, 25 aa, artificial
  peptide fold or domain or sub-domain
WAFRHRIFREQLQWVPLCEDGFDRD

SEQ ID NO: 22402 - protein, 24 aa, artificial
  peptide fold or domain or sub-domain
WAGCWGLRALVSESAKDRDKALTL

SEQ ID NO: 22403 - protein, 23 aa, artificial
  peptide fold or domain or sub-domain
WAGMHALRLLHTDLGRDADDLLN

SEQ ID NO: 22404 - protein, 25 aa, artificial
  peptide fold or domain or sub-domain
WAIDIDKDAVLTYKENLGDHIILGD

SEQ ID NO: 22405 - protein, 25 aa, artificial
  peptide fold or domain or sub-domain
WAIEYEEPAGQAFKQNHPESTVFVD

SEQ ID NO: 22406 - protein, 25 aa, artificial
  peptide fold or domain or sub-domain
WAKDCVNLVLDHDLLSGIDKELTQF

SEQ ID NO: 22407 - protein, 30 aa, artificial
  peptide fold or domain or sub-domain
WALGEPNNDLFNDDCVYFDAQFSAWRDVAC

SEQ ID NO: 22408 - protein, 25 aa, artificial
  peptide fold or domain or sub-domain
WANDFNSCAAESYNANFGHHCRVGD

SEQ ID NO: 22409 - protein, 25 aa, artificial
  peptide fold or domain or sub-domain
WANDFSHWACESFRKNIGDVIVEGD

SEQ ID NO: 22410 - protein, 25 aa, artificial
  peptide fold or domain or sub-domain
WANDIDEDACATHRLWSDAEVVQGD

SEQ ID NO: 22411 - protein, 25 aa, artificial
  peptide fold or domain or sub-domain
WANEMDKHACETYRQNFESKLIEDD

SEQ ID NO: 22412 - protein, 24 aa, artificial
  peptide fold or domain or sub-domain
WANKAKFAVKPPSGTFETVEDLEG

SEQ ID NO: 22413 - protein, 30 aa, artificial
  peptide fold or domain or sub-domain
WAPGKPRPVGKDKKCVYMTASREDWGDQRC

SEQ ID NO: 22414 - protein, 30 aa, artificial
  peptide fold or domain or sub-domain
WATGEPNFANEDENCVTMYSNSGFWNDINC

SEQ ID NO: 22415 - protein, 25 aa, artificial
  peptide fold or domain or sub-domain
WAVELDSKACITYKANHKHKIINND

SEQ ID NO: 22416 - protein, 29 aa, artificial
  peptide fold or domain or sub-domain
WAVWYRKSQIGLIGAGVDAEQGNWIGSYA

SEQ ID NO: 22417 - protein, 22 aa, artificial
  peptide fold or domain or sub-domain
WAYTARMVRDIVASEQNLQVDS

SEQ ID NO: 22418 - protein, 28 aa, artificial
  peptide fold or domain or sub-domain
WCEGGVQSPEQVALAFARGARAVVVGTA

SEQ ID NO: 22419 - protein, 24 aa, artificial
  peptide fold or domain or sub-domain
WCNLGVILLKQGQIELAIEYFRKS

SEQ ID NO: 22420 - protein, 24 aa, artificial
  peptide fold or domain or sub-domain
WCRLGNILQKQGQFELAIEYCQKS

SEQ ID NO: 22421 - protein, 27 aa, artificial
  peptide fold or domain or sub-domain
WCSAFLGHWTGEHAPGLRNLEAALRAA

SEQ ID NO: 22422 - protein, 27 aa, artificial
  peptide fold or domain or sub-domain
WCSAMLGHGMGSKAPGRVSKDEPYIAA

SEQ ID NO: 22423 - protein, 23 aa, artificial
  peptide fold or domain or sub-domain
WCTEALDGGGSDVTAPKTVATAV

SEQ ID NO: 22424 - protein, 28 aa, artificial
  peptide fold or domain or sub-domain
WDADELARSLSDNGQPIGIATVYRGLAT

SEQ ID NO: 22425 - protein, 30 aa, artificial
  peptide fold or domain or sub-domain
WDAGNPSNSGGLENVGTIQFGDGSWNDVAT

SEQ ID NO: 22426 - protein, 27 aa, artificial
  peptide fold or domain or sub-domain
WDAPSLTIRTQFLKPEKGRYLHPEADR

SEQ ID NO: 22427 - protein, 27 aa, artificial
  peptide fold or domain or sub-domain
WDEKKLEAENCRAILAVGRASTSPPRL

SEQ ID NO: 22428 - protein, 29 aa, artificial
  peptide fold or domain or sub-domain
WDELISRFAPPEQRERILSNRFYQSLSTV

SEQ ID NO: 22429 - protein, 27 aa, artificial
  peptide fold or domain or sub-domain
WDFANTAPEQYPLLLHFPYFDLYRKQV

SEQ ID NO: 22430 - protein, 27 aa, artificial
  peptide fold or domain or sub-domain
WDFESRGTARFPLDDHVHYVELYRRQV

SEQ ID NO: 22431 - protein, 24 aa, artificial
  peptide fold or domain or sub-domain
WDFQARRMQARCRSKSDKKTRLVH

SEQ ID NO: 22432 - protein, 27 aa, artificial
  peptide fold or domain or sub-domain
WDGFCVTLRAGSGNRTALRPLHPEQPR

SEQ ID NO: 22433 - protein, 20 aa, artificial
  peptide fold or domain or sub-domain
WDHMYEEKRISKEELDKVYN

SEQ ID NO: 22434 - protein, 21 aa, artificial
  peptide fold or domain or sub-domain
WDIPRDPHIGHSPEVHGGVLE

SEQ ID NO: 22435 - protein, 26 aa, artificial
  peptide fold or domain or sub-domain
WDISSHESTTPGIARLIQEDKLPAWY

SEQ ID NO: 22436 - protein, 27 aa, artificial
  peptide fold or domain or sub-domain
WDKARIKKEKMGGLLGVSNGSDQEPRF

SEQ ID NO: 22437 - protein, 27 aa, artificial
  peptide fold or domain or sub-domain
WDKVAPTITTQCNGYGNGRFGHPEQDR

SEQ ID NO: 22438 - protein, 27 aa, artificial
  peptide fold or domain or sub-domain
WDLKNTPGNKRPLLLHYHPLVIYRFQV

SEQ ID NO: 22439 - protein, 27 aa, artificial
  peptide fold or domain or sub-domain
WDLPLTAEERGRTRYRFDKPGFPSLFI

SEQ ID NO: 22440 - protein, 24 aa, artificial
  peptide fold or domain or sub-domain
WDMNRDLNHQGNHSGKPGGHNQIH

SEQ ID NO: 22441 - protein, 24 aa, artificial
  peptide fold or domain or sub-domain
WDMNRELVQAGHEGRAAADAQTRQ

SEQ ID NO: 22442 - protein, 24 aa, artificial
  peptide fold or domain or sub-domain
WDMNRHLSDIYSVALPPERQGEVY

SEQ ID NO: 22443 - protein, 27 aa, artificial
  peptide fold or domain or sub-domain
WDTKKLVSEKMGLHVAVGQGAEHGPCM

SEQ ID NO: 22444 - protein, 24 aa, artificial
  peptide fold or domain or sub-domain
WDYNRNITNIGNGRTYLETQMQSH

SEQ ID NO: 22445 - protein, 24 aa, artificial
  peptide fold or domain or sub-domain
WEADDDGFYDVQYDDDRTAARAHL

SEQ ID NO: 22446 - protein, 30 aa, artificial
  peptide fold or domain or sub-domain
WEANQPAFKNSEERCAKMTISQGLWETVNC

SEQ ID NO: 22447 - protein, 28 aa, artificial
  peptide fold or domain or sub-domain
WECGPLQYCMDDAFRAGFQHHLLDPMMN

SEQ ID NO: 22448 - protein, 29 aa, artificial
  peptide fold or domain or sub-domain
WECSDECVGTINECGVFTALAAGTATITA

SEQ ID NO: 22449 - protein, 27 aa, artificial
  peptide fold or domain or sub-domain
WEIITTDEQGNITEHYLKRSSDGIKLG

SEQ ID NO: 22450 - protein, 24 aa, artificial
  peptide fold or domain or sub-domain
WEITGEDEAQATARRIAPQAPLAR

SEQ ID NO: 22451 - protein, 30 aa, artificial
  peptide fold or domain or sub-domain
WEKNQPHFLNNDEHCVAMSSVTECWHNLNC

SEQ ID NO: 22452 - protein, 27 aa, artificial
  peptide fold or domain or sub-domain
WEKPAPTITRNFSTPSSSRCIHPRDSR

SEQ ID NO: 22453 - protein, 22 aa, artificial
  peptide fold or domain or sub-domain
WELNGFYFYKGMKSHGLEPDFL

SEQ ID NO: 22454 - protein, 24 aa, artificial
  peptide fold or domain or sub-domain
WELNVNQTLESKGFDLGHEVRILE

SEQ ID NO: 22455 - protein, 21 aa, artificial
  peptide fold or domain or sub-domain
WENNATAAPDAKEAQKLAFDS

SEQ ID NO: 22456 - protein, 28 aa, artificial
  peptide fold or domain or sub-domain
WEPEQVIYLLYHGYVGKPEEVSRFSQDL

SEQ ID NO: 22457 - protein, 30 aa, artificial
  peptide fold or domain or sub-domain
WEQELAQLEAWVGRDRASYEARERHVAERL

SEQ ID NO: 22458 - protein, 27 aa, artificial
  peptide fold or domain or sub-domain
WEQHAKWYPGCKYLLEQKGQEYINNIH

SEQ ID NO: 22459 - protein, 20 aa, artificial
  peptide fold or domain or sub-domain
WERYEAQHLFSQEQAVDTKL

SEQ ID NO: 22460 - protein, 27 aa, artificial
  peptide fold or domain or sub-domain
WESGLKGSYITHALKIAITPENREELL

SEQ ID NO: 22461 - protein, 24 aa, artificial
  peptide fold or domain or sub-domain
WFLKGNALGNLERYEEAVAAFEKA

SEQ ID NO: 22462 - protein, 21 aa, artificial
  peptide fold or domain or sub-domain
WFNNWEFKGTPWTNPEMYKKW

SEQ ID NO: 22463 - protein, 30 aa, artificial
  peptide fold or domain or sub-domain
WFYFNDNKIGQGREQLKNTLSKNNELFIQI

SEQ ID NO: 22464 - protein, 30 aa, artificial
  peptide fold or domain or sub-domain
WFYYNETKLAQGRNNLDSYLKENNEIYDEI

SEQ ID NO: 22465 - protein, 27 aa, artificial
  peptide fold or domain or sub-domain
WGEADGAELVAAGPDAVLRRPAELLSL

SEQ ID NO: 22466 - protein, 29 aa, artificial
  peptide fold or domain or sub-domain
WGGVDGAINEILQDPQNADIEGILKKYQQ

SEQ ID NO: 22467 - protein, 30 aa, artificial
  peptide fold or domain or sub-domain
WGINQAIAVLSSKKASIADKKLSLRILVHL

SEQ ID NO: 22468 - protein, 20 aa, artificial
  peptide fold or domain or sub-domain
WGKEPIGGEAAAGEQKGLWE

SEQ ID NO: 22469 - protein, 29 aa, artificial
  peptide fold or domain or sub-domain
WGVDSAQVVTDQLFQCVRTELGYPKFWGR

SEQ ID NO: 22470 - protein, 29 aa, artificial
  peptide fold or domain or sub-domain
WGVDSVNVTDSSFLDCVTTNFGSPTIWGR

SEQ ID NO: 22471 - protein, 24 aa, artificial
  peptide fold or domain or sub-domain
WGVEHLFTEASDDTDNEEDFVDRF

SEQ ID NO: 22472 - protein, 30 aa, artificial
  peptide fold or domain or sub-domain
WGYGNPQLKSDQEDCVFIRGEKGNWADGFC

SEQ ID NO: 22473 - protein, 25 aa, artificial
  peptide fold or domain or sub-domain
WGYIKDGDNISRYAAATNSGISTNS

SEQ ID NO: 22474 - protein, 24 aa, artificial
  peptide fold or domain or sub-domain
WHAAGDDDNAATKIGRPRCDGRNY

SEQ ID NO: 22475 - protein, 24 aa, artificial
  peptide fold or domain or sub-domain
WHADARGIYSGEAAAMCNADDSAA

SEQ ID NO: 22476 - protein, 24 aa, artificial
  peptide fold or domain or sub-domain
WHADPRGNYDLEGFRFRTRHASDR

SEQ ID NO: 22477 - protein, 24 aa, artificial
  peptide fold or domain or sub-domain
WHCDAQGFYSDVRDPRRDTTGEQW

SEQ ID NO: 22478 - protein, 24 aa, artificial
  peptide fold or domain or sub-domain
WHCDATGDYSAFTDSGGGKDEGKG

SEQ ID NO: 22479 - protein, 24 aa, artificial
  peptide fold or domain or sub-domain
WHGIVIDEAWDAVINGEYTAGVRG

SEQ ID NO: 22480 - protein, 24 aa, artificial
  peptide fold or domain or sub-domain
WHNLGLILRDKGQFEAAIEHYQKS

SEQ ID NO: 22481 - protein, 24 aa, artificial
  peptide fold or domain or sub-domain
WHNLGQIFKGKGEITESIRCYQKA

SEQ ID NO: 22482 - protein, 26 aa, artificial
  peptide fold or domain or sub-domain
WHNYGAIVALKRGMSIPEALEIVANE

SEQ ID NO: 22483 - protein, 30 aa, artificial
  peptide fold or domain or sub-domain
WHQSGKGSQQSVEQAYAEAGQPQHKVTEFI

SEQ ID NO: 22484 - protein, 30 aa, artificial
  peptide fold or domain or sub-domain
WHQTGNYELEKTKKKYNKLRLNQNLITSFI

SEQ ID NO: 22485 - protein, 30 aa, artificial
  peptide fold or domain or sub-domain
WHQVGKRNYEAVKNDYHEKGIKHVRVAAFI

SEQ ID NO: 22486 - protein, 26 aa, artificial
  peptide fold or domain or sub-domain
WHVRKQVVDQELGDAPFLDRLRRDQK

SEQ ID NO: 22487 - protein, 20 aa, artificial
  peptide fold or domain or sub-domain
WIAGNPSDVLATNFSRPPAL

SEQ ID NO: 22488 - protein, 30 aa, artificial
  peptide fold or domain or sub-domain
WIGCGKCATCLGGDENMCLTPRSLGVYCDG

SEQ ID NO: 22489 - protein, 20 aa, artificial
  peptide fold or domain or sub-domain
WIGSTPKQIVADTLKLPESA

SEQ ID NO: 22490 - protein, 25 aa, artificial
  peptide fold or domain or sub-domain
WIKDTSTNGTHLNNSRLVKGSNYLL

SEQ ID NO: 22491 - protein, 20 aa, artificial
  peptide fold or domain or sub-domain
WIKHRDSLVPKEEQLNVSEY

SEQ ID NO: 22492 - protein, 20 aa, artificial
  peptide fold or domain or sub-domain
WINANGDPQAYASFGCELVP

SEQ ID NO: 22493 - protein, 29 aa, artificial
  peptide fold or domain or sub-domain
WISAKVSGNPSNVKDGYKLNGTVTGSGGS

SEQ ID NO: 22494 - protein, 30 aa, artificial
  peptide fold or domain or sub-domain
WISGEPSAGQADEDYGRLRHTDGQWLDTNS

SEQ ID NO: 22495 - protein, 20 aa, artificial
  peptide fold or domain or sub-domain
WITHMPKEVLEKSVNMPASV

SEQ ID NO: 22496 - protein, 28 aa, artificial
  peptide fold or domain or sub-domain
WIVAAARSKTGARTLLRAGADEVVRVYE

SEQ ID NO: 22497 - protein, 28 aa, artificial
  peptide fold or domain or sub-domain
WIVAAVREQENVALMRQSGANSVITSSD

SEQ ID NO: 22498 - protein, 28 aa, artificial
  peptide fold or domain or sub-domain
WIVTRASKRENIKRLYRAGANRVISPEI

SEQ ID NO: 22499 - protein, 27 aa, artificial
  peptide fold or domain or sub-domain
WKDGEHAFMNQNSVHYNADVAHKALEE

SEQ ID NO: 22500 - protein, 22 aa, artificial
  peptide fold or domain or sub-domain
WKELVEVGHGDKKNEPWWPKMQ

SEQ ID NO: 22501 - protein, 27 aa, artificial
  peptide fold or domain or sub-domain
WKFDELKKKKSLLFRTFDPSVVYRHQV

SEQ ID NO: 22502 - protein, 30 aa, artificial
  peptide fold or domain or sub-domain
WKGGGLIAVSYEARKFGVKRSMRGDEAKMV

SEQ ID NO: 22503 - protein, 27 aa, artificial
  peptide fold or domain or sub-domain
WKHIAPHFDVKLAIDDRTQVVEMWRRI

SEQ ID NO: 22504 - protein, 30 aa, artificial
  peptide fold or domain or sub-domain
WKKGEPNDHLTNEDCAHLWNPTGEWNDVHC

SEQ ID NO: 22505 - protein, 30 aa, artificial
  peptide fold or domain or sub-domain
WKKGQPDKHVPAEHCAETNFKGAFWNNALC

SEQ ID NO: 22506 - protein, 24 aa, artificial
  peptide fold or domain or sub-domain
WKLETERGVIMDGDKPEHLLEAIP

SEQ ID NO: 22507 - protein, 27 aa, artificial
  peptide fold or domain or sub-domain
WKLSSSKNKYDIKKLKDNDANTYWQSS

SEQ ID NO: 22508 - protein, 29 aa, artificial
  peptide fold or domain or sub-domain
WKLWSSRLALDLMPMSIDPIANKWKDQIT

SEQ ID NO: 22509 - protein, 27 aa, artificial
  peptide fold or domain or sub-domain
WKPSSFKAGYPIENALDDNPATFWQSD

SEQ ID NO: 22510 - protein, 21 aa, artificial
  peptide fold or domain or sub-domain
WKQVSGPQVSLLDATQAKARV

SEQ ID NO: 22511 - protein, 29 aa, artificial
  peptide fold or domain or sub-domain
WKSSDESIATVDANGVITAKKAGKVVITA

SEQ ID NO: 22512 - protein, 29 aa, artificial
  peptide fold or domain or sub-domain
WKVLKVADYTAVIKPDINMADEDVTVEAI

SEQ ID NO: 22513 - protein, 24 aa, artificial
  peptide fold or domain or sub-domain
WKVLNVIDGKPSIEEQFDIFKNRA

SEQ ID NO: 22514 - protein, 20 aa, artificial
  peptide fold or domain or sub-domain
WLAHTPKEVIAANFGVTKEE

SEQ ID NO: 22515 - protein, 20 aa, artificial
  peptide fold or domain or sub-domain
WLAHTPPQLVEAHLNVAPDV

SEQ ID NO: 22516 - protein, 20 aa, artificial
  peptide fold or domain or sub-domain
WLANTPRAIVKATLQLSDNV

SEQ ID NO: 22517 - protein, 20 aa, artificial
  peptide fold or domain or sub-domain
WLEEAAARLEPALRARYLLF

SEQ ID NO: 22518 - protein, 21 aa, artificial
  peptide fold or domain or sub-domain
WLFVSQYFKRLHSDPSELHHF

SEQ ID NO: 22519 - protein, 28 aa, artificial
  peptide fold or domain or sub-domain
WLGCRDMSRGEMAAFELRENGVDARAVQ

SEQ ID NO: 22520 - protein, 29 aa, artificial
  peptide fold or domain or sub-domain
WLGLYLPKATHSMGWVRTAGNAMRMGIPY

SEQ ID NO: 22521 - protein, 22 aa, artificial
  peptide fold or domain or sub-domain
WLNDDVARLTAATGQTDLELMN

SEQ ID NO: 22522 - protein, 20 aa, artificial
  peptide fold or domain or sub-domain
WLRDLNQLYRQFPALSVLDY

SEQ ID NO: 22523 - protein, 20 aa, artificial
  peptide fold or domain or sub-domain
WLSHTPIAWVEENLGWTAAQ

SEQ ID NO: 22524 - protein, 30 aa, artificial
  peptide fold or domain or sub-domain
WLTMLDKDKFLYSPIANDVFKFWDYDLVNG

SEQ ID NO: 22525 - protein, 20 aa, artificial
  peptide fold or domain or sub-domain
WMGHVPTPLLAKNFGMPEST

SEQ ID NO: 22526 - protein, 27 aa, artificial
  peptide fold or domain or sub-domain
WNAMLGNPDFEGQDLPYSMAVPVHEML

SEQ ID NO: 22527 - protein, 20 aa, artificial
  peptide fold or domain or sub-domain
WNEVVATGIAFPQMEPLDEK

SEQ ID NO: 22528 - protein, 27 aa, artificial
  peptide fold or domain or sub-domain
WNKISPTIDTRFDTPSNGTNSHPELHR

SEQ ID NO: 22529 - protein, 20 aa, artificial
  peptide fold or domain or sub-domain
WNKVYEDGNITKERLDQILG

SEQ ID NO: 22530 - protein, 21 aa, artificial
  peptide fold or domain or sub-domain
WNKYIRNDCNHRFVIKSGVLE

SEQ ID NO: 22531 - protein, 20 aa, artificial
  peptide fold or domain or sub-domain
WNNDPQNAGFSTAQPFRELS

SEQ ID NO: 22532 - protein, 24 aa, artificial
  peptide fold or domain or sub-domain
WNNIAGLLMQWGDFNKAALYYKEA

SEQ ID NO: 22533 - protein, 24 aa, artificial
  peptide fold or domain or sub-domain
WNNRGIALQELKRYDEALQCYDNA

SEQ ID NO: 22534 - protein, 27 aa, artificial
  peptide fold or domain or sub-domain
WNNSFAGYGHGVFAPGVKSHEAALKAA

SEQ ID NO: 22535 - protein, 30 aa, artificial
  peptide fold or domain or sub-domain
WNPYCGECRECLAGRETRCHQVATVINTTG

SEQ ID NO: 22536 - protein, 27 aa, artificial
  peptide fold or domain or sub-domain
WNTARRKIPGLEDRIASGDTRTLLDWL

SEQ ID NO: 22537 - protein, 24 aa, artificial
  peptide fold or domain or sub-domain
WNVLDYVDQGKLREVATFTQLALT

SEQ ID NO: 22538 - protein, 20 aa, artificial
  peptide fold or domain or sub-domain
WPAENFERCFRNPAEEVEAL

SEQ ID NO: 22539 - protein, 26 aa, artificial
  peptide fold or domain or sub-domain
WPEVFNWLQTAGNVEHHEMYRTFNCG

SEQ ID NO: 22540 - protein, 24 aa, artificial
  peptide fold or domain or sub-domain
WPGILWHHYHATQDQATAALAEQL

SEQ ID NO: 22541 - protein, 24 aa, artificial
  peptide fold or domain or sub-domain
WPGMLFLAKELTNSTEFDEVIATQ

SEQ ID NO: 22542 - protein, 24 aa, artificial
  peptide fold or domain or sub-domain
WPGTLWMAWLYSKDEQLRTLALES

SEQ ID NO: 22543 - protein, 24 aa, artificial
  peptide fold or domain or sub-domain
WPGVLWYDYEYTQDKHILEEAEKF

SEQ ID NO: 22544 - protein, 24 aa, artificial
  peptide fold or domain or sub-domain
WPIEFDTGTVMEAETEEHICEVAR

SEQ ID NO: 22545 - protein, 29 aa, artificial
  peptide fold or domain or sub-domain
WPIPEFTPLLEPGVEEKTTTDELVSILKD

SEQ ID NO: 22546 - protein, 24 aa, artificial
  peptide fold or domain or sub-domain
WPREVLDLVRKVAEENGRSVNSEI

SEQ ID NO: 22547 - protein, 28 aa, artificial
  peptide fold or domain or sub-domain
WPVAVASAHDVVRGAARAVTTVPGGDGA

SEQ ID NO: 22548 - protein, 30 aa, artificial
  peptide fold or domain or sub-domain
WPVLALADGELNPAFTEDRLHLNDEGYRAW

SEQ ID NO: 22549 - protein, 28 aa, artificial
  peptide fold or domain or sub-domain
WPVVDLLIATGLASSKRDAREHLGNHAV

SEQ ID NO: 22550 - protein, 24 aa, artificial
  peptide fold or domain or sub-domain
WQADTNGVYPSQADTQGKQVDPNF

SEQ ID NO: 22551 - protein, 24 aa, artificial
  peptide fold or domain or sub-domain
WQANAAGRYNHPADRSAGALEQEF

SEQ ID NO: 22552 - protein, 24 aa, artificial
  peptide fold or domain or sub-domain
WQANAGGRYRHKKESYLAPLDPNF

SEQ ID NO: 22553 - protein, 20 aa, artificial
  peptide fold or domain or sub-domain
WQATYRGLLPDAFLDGEVAQ

SEQ ID NO: 22554 - protein, 24 aa, artificial
  peptide fold or domain or sub-domain
WQCDAEGIYSGVTDAGFQTEGLKF

SEQ ID NO: 22555 - protein, 24 aa, artificial
  peptide fold or domain or sub-domain
WQCDGQGIYDHPNQPSQNKFDPSF

SEQ ID NO: 22556 - protein, 30 aa, artificial
  peptide fold or domain or sub-domain
WQDFVGKDGKLDLTLCTDGLHFNRKGYEVL

SEQ ID NO: 22557 - protein, 27 aa, artificial
  peptide fold or domain or sub-domain
WQEFLAEGAPSSINLDSHSYERTSQNL

SEQ ID NO: 22558 - protein, 27 aa, artificial
  peptide fold or domain or sub-domain
WQEFLAPEAPCPVNVDSKSVELAREAV

SEQ ID NO: 22559 - protein, 24 aa, artificial
  peptide fold or domain or sub-domain
WQFSVTEKLQEKGLDFSTPMVILE

SEQ ID NO: 22560 - protein, 21 aa, artificial
  peptide fold or domain or sub-domain
WQFVPQYYNFVNSQPHRLHCF

SEQ ID NO: 22561 - protein, 23 aa, artificial
  peptide fold or domain or sub-domain
WQGEGNCYYCRIGEEHLCDSPRW

SEQ ID NO: 22562 - protein, 30 aa, artificial
  peptide fold or domain or sub-domain
WQGEGNCYYCRIGEEHLCDSPRWLGINFDG

SEQ ID NO: 22563 - protein, 24 aa, artificial
  peptide fold or domain or sub-domain
WQIVGEHEANIEKGLLNIKSPIAR

SEQ ID NO: 22564 - protein, 28 aa, artificial
  peptide fold or domain or sub-domain
WQLEQEDVHLNIERRLTALTGDAGKKLH

SEQ ID NO: 22565 - protein, 30 aa, artificial
  peptide fold or domain or sub-domain
WQMAEFYNNKVLVEYRNKDADHVEWAKALK

SEQ ID NO: 22566 - protein, 26 aa, artificial
  peptide fold or domain or sub-domain
WQNLVYLVHTQHQLPIGEALNYVARL

SEQ ID NO: 22567 - protein, 22 aa, artificial
  peptide fold or domain or sub-domain
WQNMGQLEKIYGKEISKAILGA

SEQ ID NO: 22568 - protein, 26 aa, artificial
  peptide fold or domain or sub-domain
WQPSEACEPYQDEEGRLLHRPLAEHV

SEQ ID NO: 22569 - protein, 25 aa, artificial
  peptide fold or domain or sub-domain
WQQILKYQVLMRYVQLYEEQNKAAA

SEQ ID NO: 22570 - protein, 30 aa, artificial
  peptide fold or domain or sub-domain
WQQRQPTHTPNKADCIVMNGEDGFWADSTC

SEQ ID NO: 22571 - protein, 21 aa, artificial
  peptide fold or domain or sub-domain
WQTKWGYITSAPGSDSAWLKV

SEQ ID NO: 22572 - protein, 24 aa, artificial
  peptide fold or domain or sub-domain
WQVDANGIYLHSRGGDRQRLDPGF

SEQ ID NO: 22573 - protein, 30 aa, artificial
  peptide fold or domain or sub-domain
WRAGEPNNALGGQGCAQVYSTTNDMDDVGC

SEQ ID NO: 22574 - protein, 24 aa, artificial
  peptide fold or domain or sub-domain
WRCTPWYVLDGTHPEVQAHLERVF

SEQ ID NO: 22575 - protein, 30 aa, artificial
  peptide fold or domain or sub-domain
WREEEPNNADGDEDCVEFLQSVSAWNDMPC

SEQ ID NO: 22576 - protein, 26 aa, artificial
  peptide fold or domain or sub-domain
WRHWSGTAELVGPDPAAVQQPLADAI

SEQ ID NO: 22577 - protein, 20 aa, artificial
  peptide fold or domain or sub-domain
WRKIGPHLTLSEARRHAIEH

SEQ ID NO: 22578 - protein, 30 aa, artificial
  peptide fold or domain or sub-domain
WRKNEPKYNNPTQHCAYVFGHENIMIVLSC

SEQ ID NO: 22579 - protein, 23 aa, artificial
  peptide fold or domain or sub-domain
WRLSVKWGALASAARPKARRWER

SEQ ID NO: 22580 - protein, 25 aa, artificial
  peptide fold or domain or sub-domain
WRPYDIHSSNAVESLVQLFSTVSVQ

SEQ ID NO: 22581 - protein, 29 aa, artificial
  peptide fold or domain or sub-domain
WRRDQIGLFMHHVQAENPNGLAAYLTDNE

SEQ ID NO: 22582 - protein, 20 aa, artificial
  peptide fold or domain or sub-domain
WRTTYDGIIKQSFLKSLSYE

SEQ ID NO: 22583 - protein, 30 aa, artificial
  peptide fold or domain or sub-domain
WRYKGKKPEALGSNTRIYDWIPQNDLLGHP

SEQ ID NO: 22584 - protein, 23 aa, artificial
  peptide fold or domain or sub-domain
WSAAQTLGLTNNARARRNAKSLG

SEQ ID NO: 22585 - protein, 29 aa, artificial
  peptide fold or domain or sub-domain
WSDVDEKAVNDAIEVTNVGDYLDLPLEQL

SEQ ID NO: 22586 - protein, 28 aa, artificial
  peptide fold or domain or sub-domain
WSFAPKNATNQVLPLVDVVLSKDSGNGA

SEQ ID NO: 22587 - protein, 25 aa, artificial
  peptide fold or domain or sub-domain
WSFDDAMDAMKNGLIKNASTIIALQ

SEQ ID NO: 22588 - protein, 24 aa, artificial
  peptide fold or domain or sub-domain
WSGILWLCYEYTGDEQYREGAVRT

SEQ ID NO: 22589 - protein, 24 aa, artificial
  peptide fold or domain or sub-domain
WSGILWQLFHKTKREKFKEAAIQQ

SEQ ID NO: 22590 - protein, 20 aa, artificial
  peptide fold or domain or sub-domain
WSHYQQTHEFDDNARSAVVS

SEQ ID NO: 22591 - protein, 20 aa, artificial
  peptide fold or domain or sub-domain
WSKIKARYSWPETLTGPVER

SEQ ID NO: 22592 - protein, 26 aa, artificial
  peptide fold or domain or sub-domain
WSKKLDNGNLQHLSGNATLTLIAMRM

SEQ ID NO: 22593 - protein, 29 aa, artificial
  peptide fold or domain or sub-domain
WSLLLRVSDFGLDGSTVAKRLLEQGVCAT

SEQ ID NO: 22594 - protein, 27 aa, artificial
  peptide fold or domain or sub-domain
WSLSSCKPGFGVDQLRDDNLETYWQSD

SEQ ID NO: 22595 - protein, 24 aa, artificial
  peptide fold or domain or sub-domain
WSLTAVLRGTSEVEQDRVDVLQPV

SEQ ID NO: 22596 - protein, 23 aa, artificial
  peptide fold or domain or sub-domain
WSMFQTLGWNNRTYDRLLRGLAI

SEQ ID NO: 22597 - protein, 24 aa, artificial
  peptide fold or domain or sub-domain
WSNLGCVFNAQGEIWLAIHHFEKA

SEQ ID NO: 22598 - protein, 30 aa, artificial
  peptide fold or domain or sub-domain
WSPNEPNNFDNKEDCGTLFKNDGNFNDVIC

SEQ ID NO: 22599 - protein, 30 aa, artificial
  peptide fold or domain or sub-domain
WSPNEPSNPQSWQLCVQIWSKYNLLDDVGC

SEQ ID NO: 22600 - protein, 30 aa, artificial
  peptide fold or domain or sub-domain
WSPNQPVQPTQETSCVFYSGETHGWKIGQC

SEQ ID NO: 22601 - protein, 30 aa, artificial
  peptide fold or domain or sub-domain
WSRREPKSDRTGQDACLVLGTDNLWHSEPC

SEQ ID NO: 22602 - protein, 29 aa, artificial
  peptide fold or domain or sub-domain
WSSNQPAAVTVNSSGQVTFNGPPSGTVTI

SEQ ID NO: 22603 - protein, 29 aa, artificial
  peptide fold or domain or sub-domain
WSSSFTPNVSVNDQGQVTITYQTYSEVAV

SEQ ID NO: 22604 - protein, 22 aa, artificial
  peptide fold or domain or sub-domain
WSTQSAESAMIGQDMSRAKRAE

SEQ ID NO: 22605 - protein, 25 aa, artificial
  peptide fold or domain or sub-domain
WSYDEIMSAFSQGLLNSAAMSVALF

SEQ ID NO: 22606 - protein, 21 aa, artificial
  peptide fold or domain or sub-domain
WSYEQIAARAGVSREQVRRIE

SEQ ID NO: 22607 - protein, 22 aa, artificial
  peptide fold or domain or sub-domain
WSYSSRVVAKQLQGEGRSGVKT

SEQ ID NO: 22608 - protein, 24 aa, artificial
  peptide fold or domain or sub-domain
WTAEDVVGAVRRGLAETHEVQLHT

SEQ ID NO: 22609 - protein, 20 aa, artificial
  peptide fold or domain or sub-domain
WTAGRNADFSQGENTWLPLN

SEQ ID NO: 22610 - protein, 24 aa, artificial
  peptide fold or domain or sub-domain
WTGELWLAYEYSQQDAFKNIAHKN

SEQ ID NO: 22611 - protein, 24 aa, artificial
  peptide fold or domain or sub-domain
WTGINWLLFEKTGDPLFQQTAEKA

SEQ ID NO: 22612 - protein, 24 aa, artificial
  peptide fold or domain or sub-domain
WTGQIWLAYEYTKNPKYLEVGLEH

SEQ ID NO: 22613 - protein, 24 aa, artificial
  peptide fold or domain or sub-domain
WTNLANAYTRKGNLSQAAECCHQA

SEQ ID NO: 22614 - protein, 29 aa, artificial
  peptide fold or domain or sub-domain
WTPEEFAEFMHEEQKRLEVTPEWCATNIE

SEQ ID NO: 22615 - protein, 30 aa, artificial
  peptide fold or domain or sub-domain
WTPFANEKGDAKVEEFPDLLHPNEVGYQKW

SEQ ID NO: 22616 - protein, 29 aa, artificial
  peptide fold or domain or sub-domain
WTQDNKDIFFWAKGKINRLNVANKTVTNI

SEQ ID NO: 22617 - protein, 26 aa, artificial
  peptide fold or domain or sub-domain
WTSSLIRAALSKGTPISNLMEQWEFM

SEQ ID NO: 22618 - protein, 27 aa, artificial
  peptide fold or domain or sub-domain
WTVSTHKPGCGVTALRHPSPSQFWQSD

SEQ ID NO: 22619 - protein, 24 aa, artificial
  peptide fold or domain or sub-domain
WTVVYPPNADFAHGRLNVFSPAGI

SEQ ID NO: 22620 - protein, 29 aa, artificial
  peptide fold or domain or sub-domain
WTYVVTNTGNVDLANVVVTDDKLGAICTI

SEQ ID NO: 22621 - protein, 21 aa, artificial
  peptide fold or domain or sub-domain
WVDFEEMGWSDWVIAPRAFQS

SEQ ID NO: 22622 - protein, 24 aa, artificial
  peptide fold or domain or sub-domain
WVEKFPAWKGKSLDEIKASDKITN

SEQ ID NO: 22623 - protein, 27 aa, artificial
  peptide fold or domain or sub-domain
WVGLTGNPAHGGMGMPKMLAVQFEEMM

SEQ ID NO: 22624 - protein, 24 aa, artificial
  peptide fold or domain or sub-domain
WVGMLWLAALRTGEQKYRDSARMW

SEQ ID NO: 22625 - protein, 26 aa, artificial
  peptide fold or domain or sub-domain
WVIGGFFGTVERINTSIENNSIEVHN

SEQ ID NO: 22626 - protein, 27 aa, artificial
  peptide fold or domain or sub-domain
WVIMDAGYVSGVHPPGHRSLKDAPWVT

SEQ ID NO: 22627 - protein, 29 aa, artificial
  peptide fold or domain or sub-domain
WVISKIARYAVGKNVFILDLGNHSTNYIT

SEQ ID NO: 22628 - protein, 23 aa, artificial
  peptide fold or domain or sub-domain
WVPAALAYGERQIGNMIPPNSDL

SEQ ID NO: 22629 - protein, 25 aa, artificial
  peptide fold or domain or sub-domain
WVRTHLLNNGYEKVNELHRLATQYV

SEQ ID NO: 22630 - protein, 25 aa, artificial
  peptide fold or domain or sub-domain
WVSTDDKRIAIEAQKYGAIIHHRPE

SEQ ID NO: 22631 - protein, 25 aa, artificial
  peptide fold or domain or sub-domain
WVSTDHDEIENVAKQFGAQVHRRSS

SEQ ID NO: 22632 - protein, 27 aa, artificial
  peptide fold or domain or sub-domain
WVVAIVGHLYGVHAPGMRDIYVAFRAV

SEQ ID NO: 22633 - protein, 27 aa, artificial
  peptide fold or domain or sub-domain
WVVAVLGNQIGNFAPGIKSRAVSLQVA

SEQ ID NO: 22634 - protein, 28 aa, artificial
  peptide fold or domain or sub-domain
WVYHEQDIQLERKHSRSNNGPNICTTTS

SEQ ID NO: 22635 - protein, 30 aa, artificial
  peptide fold or domain or sub-domain
WWRSIDPRTVANIDTFYENYSLFHEFYDMR

SEQ ID NO: 22636 - protein, 30 aa, artificial
  peptide fold or domain or sub-domain
WWTCGECEFCTTGREQLCHERIITGEHVDG

SEQ ID NO: 22637 - protein, 21 aa, artificial
  peptide fold or domain or sub-domain
WYDVPCSHSESIVYATGMVSG

SEQ ID NO: 22638 - protein, 21 aa, artificial
  peptide fold or domain or sub-domain
WYFIESYYDFYNKSIESIYKL

SEQ ID NO: 22639 - protein, 26 aa, artificial
  peptide fold or domain or sub-domain
WYGPSDLTTARGSFTPEDAATPEALM

SEQ ID NO: 22640 - protein, 26 aa, artificial
  peptide fold or domain or sub-domain
WYGPTDFKQMDTQLRDQGCSTGGHSS

SEQ ID NO: 22641 - protein, 22 aa, artificial
  peptide fold or domain or sub-domain
WYINGIQRRFSAKNRQHTVALA

SEQ ID NO: 22642 - protein, 30 aa, artificial
  peptide fold or domain or sub-domain
WYKTPFAYEQALKWTYREEEYVKRAGFVLL

SEQ ID NO: 22643 - protein, 25 aa, artificial
  peptide fold or domain or sub-domain
WYREKPIDVYKEFIENSELKRVGME

SEQ ID NO: 22644 - protein, 24 aa, artificial
  peptide fold or domain or sub-domain
WYRNLAEFTLEWEFPHASEQEREK

SEQ ID NO: 22645 - protein, 30 aa, artificial
  peptide fold or domain or sub-domain
WYSFKDEKIGQGTENVKKYLTNNPKIYNHL

SEQ ID NO: 22646 - protein, 30 aa, artificial
  peptide fold or domain or sub-domain
WYSFNGQKLGRGIFGVKEYLSHHPSVFNAL

SEQ ID NO: 22647 - protein, 30 aa, artificial
  peptide fold or domain or sub-domain
WYSYEDQRLGQGREKALQHLRENPALQDEI

SEQ ID NO: 22648 - protein, 30 aa, artificial
  peptide fold or domain or sub-domain
WYSYKGEKIGQGKANATAWLKDNPETAKEI

SEQ ID NO: 22649 - protein, 27 aa, artificial
  peptide fold or domain or sub-domain
  misc_feature (1)..(1): Xaa can be any naturally occurring amino acid
XHHLKNVIKAKFGLDATAVGDEGGLAL

SEQ ID NO: 22650 - protein, 20 aa, artificial
  peptide fold or domain or sub-domain
  misc_feature (1)..(20): Xaa can be any naturally occurring amino acid
XXXXXXXXXXXXXXXXXXXX

SEQ ID NO: 22651 - protein, 24 aa, artificial
  peptide fold or domain or sub-domain
  misc_feature (1)..(24): Xaa can be any naturally occurring amino acid
XXXXXXXXXXXXXXXXXXXXXXXX

SEQ ID NO: 22652 - protein, 28 aa, artificial
  peptide fold or domain or sub-domain
  misc_feature (1)..(28): Xaa can be any naturally occurring amino acid
XXXXXXXXXXXXXXXXXXXXXXXXXXXX

SEQ ID NO: 22653 - protein, 27 aa, artificial
  peptide fold or domain or sub-domain
YAAAEAANPGLEADFARKDFSRLHGWL

SEQ ID NO: 22654 - protein, 27 aa, artificial
  peptide fold or domain or sub-domain
YAAAEESIVELDSKVAAGSFDEIRRWL

SEQ ID NO: 22655 - protein, 23 aa, artificial
  peptide fold or domain or sub-domain
YAAAHLLDRLKGKEEKRRMSPYI

SEQ ID NO: 22656 - protein, 30 aa, artificial
  peptide fold or domain or sub-domain
YAAANTLRLDDMNPHFWRTHDGGKTWTEIN

SEQ ID NO: 22657 - protein, 26 aa, artificial
  peptide fold or domain or sub-domain
YAAARRLDRLDALAAENPRIVPVRCD

SEQ ID NO: 22658 - protein, 27 aa, artificial
  peptide fold or domain or sub-domain
YAAEKAITGFDDPFSGKTVSVSEAIKK

SEQ ID NO: 22659 - protein, 30 aa, artificial
  peptide fold or domain or sub-domain
YAAIYRFLLGDFRPYIYRTDDFGKSWTLLT

SEQ ID NO: 22660 - protein, 30 aa, artificial
  peptide fold or domain or sub-domain
YACPGFRTGEMEKTCGDITHLYCYSWSCVT

SEQ ID NO: 22661 - protein, 20 aa, artificial
  peptide fold or domain or sub-domain
YADAVTHGTASYELEPPSRA

SEQ ID NO: 22662 - protein, 25 aa, artificial
  peptide fold or domain or sub-domain
YADFDKMKEAFVEVRKGKATLEDAD

SEQ ID NO: 22663 - protein, 23 aa, artificial
  peptide fold or domain or sub-domain
YADLTVRLEAFETLYGSTEEGRA

SEQ ID NO: 22664 - protein, 25 aa, artificial
  peptide fold or domain or sub-domain
YADSILRKSNKNVDIDDVEDCLSSI

SEQ ID NO: 22665 - protein, 20 aa, artificial
  peptide fold or domain or sub-domain
YADSVKNNNPYVYKWFNDGQ

SEQ ID NO: 22666 - protein, 20 aa, artificial
  peptide fold or domain or sub-domain
YAELMASNRGLLRQWEQFGQ

SEQ ID NO: 22667 - protein, 21 aa, artificial
  peptide fold or domain or sub-domain
YAERYLSFPNVTDNYKGYEES

SEQ ID NO: 22668 - protein, 25 aa, artificial
  peptide fold or domain or sub-domain
YAFAKALQDVKKGVIKDAKTIILLQ

SEQ ID NO: 22669 - protein, 24 aa, artificial
  peptide fold or domain or sub-domain
YAFDLMEANVAAVVAQGAQACENN

SEQ ID NO: 22670 - protein, 29 aa, artificial
  peptide fold or domain or sub-domain
YAFEVLSSTGRAVYLGEGGLADTLDAVQP

SEQ ID NO: 22671 - protein, 29 aa, artificial
  peptide fold or domain or sub-domain
YAFRVPVENSNYLLIDPYAKSIYSSPDWG

SEQ ID NO: 22672 - protein, 21 aa, artificial
  peptide fold or domain or sub-domain
YAFVRTYYERMNNNPSKMSNL

SEQ ID NO: 22673 - protein, 27 aa, artificial
  peptide fold or domain or sub-domain
YAGADHGFMCEARSNFHPQASAQGWSL

SEQ ID NO: 22674 - protein, 27 aa, artificial
  peptide fold or domain or sub-domain
YAGAHHGYTQADTSAYDPEATERHWTA

SEQ ID NO: 22675 - protein, 27 aa, artificial
  peptide fold or domain or sub-domain
YAGEVAAPLAPDIDTPALSTKAAAVAN

SEQ ID NO: 22676 - protein, 21 aa, artificial
  peptide fold or domain or sub-domain
YAGFYTDGATLKDGNGNPFVM

SEQ ID NO: 22677 - protein, 24 aa, artificial
  peptide fold or domain or sub-domain
YAGGHWKGCIASIKGDELPQKNRT

SEQ ID NO: 22678 - protein, 21 aa, artificial
  peptide fold or domain or sub-domain
YAGIAELLGMKSRASVQQLVS

SEQ ID NO: 22679 - protein, 26 aa, artificial
  peptide fold or domain or sub-domain
YAGRDTRHQNACRENPYKCRSCQVER

SEQ ID NO: 22680 - protein, 30 aa, artificial
  peptide fold or domain or sub-domain
YAHVQQADIPAIVKQHLRQNRPVKQKLYGK

SEQ ID NO: 22681 - protein, 22 aa, artificial
  peptide fold or domain or sub-domain
YAIEGLGLHQEDRELVKWLKQR

SEQ ID NO: 22682 - protein, 20 aa, artificial
  peptide fold or domain or sub-domain
YAIINGQLSIDNASYTQLKN

SEQ ID NO: 22683 - protein, 20 aa, artificial
  peptide fold or domain or sub-domain
YAKALNQTPKTLKRWLKYGG

SEQ ID NO: 22684 - protein, 25 aa, artificial
  peptide fold or domain or sub-domain
YAKKLLHLATSLDLNTFFEYERLYQ

SEQ ID NO: 22685 - protein, 28 aa, artificial
  peptide fold or domain or sub-domain
YAKVTSENDNFQNVRGHVIDFKSYKLVP

SEQ ID NO: 22686 - protein, 27 aa, artificial
  peptide fold or domain or sub-domain
YALARNESAGEQLRFGGKTITVQDAAE

SEQ ID NO: 22687 - protein, 22 aa, artificial
  peptide fold or domain or sub-domain
YALNDCVLLLRHNQAVSHQQQL

SEQ ID NO: 22688 - protein, 25 aa, artificial
  peptide fold or domain or sub-domain
YALQALYQWFFCETKPDALISQFME

SEQ ID NO: 22689 - protein, 29 aa, artificial
  peptide fold or domain or sub-domain
YAMANAHPEVKALARFIAPSNEESGVLQV

SEQ ID NO: 22690 - protein, 29 aa, artificial
  peptide fold or domain or sub-domain
YAMENGSNEVKMLAKRIADTNTSDGVGKA

SEQ ID NO: 22691 - protein, 28 aa, artificial
  peptide fold or domain or sub-domain
YAMGDAPDYDRSQWLNEKFKLGLDFPNL

SEQ ID NO: 22692 - protein, 29 aa, artificial
  peptide fold or domain or sub-domain
YAMSNAPEEIKAIAKYQTVSNDQDGVLET

SEQ ID NO: 22693 - protein, 27 aa, artificial
  peptide fold or domain or sub-domain
YANLALNKLLEQYQPGKLDRAFATEIV

SEQ ID NO: 22694 - protein, 30 aa, artificial
  peptide fold or domain or sub-domain
YANLDHIAVSIEFGAVLRTEDHGFTWHDRS

SEQ ID NO: 22695 - protein, 24 aa, artificial
  peptide fold or domain or sub-domain
YAPIYSVPFPNCQELVKFSNIILN

SEQ ID NO: 22696 - protein, 27 aa, artificial
  peptide fold or domain or sub-domain
YAQDHYGWWRDRLPGHRLLESPGAFGE

SEQ ID NO: 22697 - protein, 22 aa, artificial
  peptide fold or domain or sub-domain
YAQRFAIETKDIELRQKFVSCA

SEQ ID NO: 22698 - protein, 29 aa, artificial
  peptide fold or domain or sub-domain
YARDVALSHRFIYDEPIDVEFLTKAVCNL

SEQ ID NO: 22699 - protein, 29 aa, artificial
  peptide fold or domain or sub-domain
YAREAAANHRYQFQDNIALEQLIINICDY

SEQ ID NO: 22700 - protein, 23 aa, artificial
  peptide fold or domain or sub-domain
YARTLRAWRAAFEDHLDAVRAQG

SEQ ID NO: 22701 - protein, 23 aa, artificial
  peptide fold or domain or sub-domain
YARTLREWKLRFQANFDPIIRPA

SEQ ID NO: 22702 - protein, 29 aa, artificial
  peptide fold or domain or sub-domain
YARVFTVRHRLLYGEPPPVELVAKVVADV

SEQ ID NO: 22703 - protein, 27 aa, artificial
  peptide fold or domain or sub-domain
YASPIEIGGLQTADPLDAKVREWWNIQ

SEQ ID NO: 22704 - protein, 20 aa, artificial
  peptide fold or domain or sub-domain
YASYQKADRFSDYQGRKLSR

SEQ ID NO: 22705 - protein, 26 aa, artificial
  peptide fold or domain or sub-domain
YATAGSQKKIEYLHSLGVRNTICYLE

SEQ ID NO: 22706 - protein, 20 aa, artificial
  peptide fold or domain or sub-domain
YATNFGAGSQNGLPAVNNYS

SEQ ID NO: 22707 - protein, 25 aa, artificial
  peptide fold or domain or sub-domain
YAVDNDAYATKIYNDNFAHKCETKD

SEQ ID NO: 22708 - protein, 28 aa, artificial
  peptide fold or domain or sub-domain
YAVNHYLCPADTPLPVFAARVAQAGFGG

SEQ ID NO: 22709 - protein, 27 aa, artificial
  peptide fold or domain or sub-domain
YAVNQENNPIRNYEDKLKRDDTGELTY

SEQ ID NO: 22710 - protein, 25 aa, artificial
  peptide fold or domain or sub-domain
YAVYNFVKDLATRQEEALWELQKLK

SEQ ID NO: 22711 - protein, 20 aa, artificial
  peptide fold or domain or sub-domain
YAWAYEKYGDEVPDPLDPAT

SEQ ID NO: 22712 - protein, 29 aa, artificial
  peptide fold or domain or sub-domain
YAYKLRQSDSAFPNFSTNAYIADPYSKNI

SEQ ID NO: 22713 - protein, 27 aa, artificial
  peptide fold or domain or sub-domain
YCAAHYDAWNAQLPGRHDLFKIGGFGE

SEQ ID NO: 22714 - protein, 24 aa, artificial
  peptide fold or domain or sub-domain
YCATPNLLPAGRPAPYMIFENLTK

SEQ ID NO: 22715 - protein, 23 aa, artificial
  peptide fold or domain or sub-domain
YCCKFGHACEMDMYMRRKCQECR

SEQ ID NO: 22716 - protein, 25 aa, artificial
  peptide fold or domain or sub-domain
YCDLLLRKSNKDSDAESLEASLSKA

SEQ ID NO: 22717 - protein, 25 aa, artificial
  peptide fold or domain or sub-domain
YCDSLLKKSSKNPEEAELEDTLNQV

SEQ ID NO: 22718 - protein, 21 aa, artificial
  peptide fold or domain or sub-domain
YCEGISNISAADIEAAQQAGH

SEQ ID NO: 22719 - protein, 30 aa, artificial
  peptide fold or domain or sub-domain
YCHLDEAGIDRIVNEHFRGGKVVESLAFHQ

SEQ ID NO: 22720 - protein, 27 aa, artificial
  peptide fold or domain or sub-domain
YCIAFLGYFHGIHAPGIKDFKVAMDVV

SEQ ID NO: 22721 - protein, 23 aa, artificial
  peptide fold or domain or sub-domain
YCKTLECWAKNFENSLDEVKKLD

SEQ ID NO: 22722 - protein, 24 aa, artificial
  peptide fold or domain or sub-domain
YCNLAHCHQIICDWNDYDKRVRKL

SEQ ID NO: 22723 - protein, 24 aa, artificial
  peptide fold or domain or sub-domain
YCNLAHCLQIVCDWTDYDERMKKL

SEQ ID NO: 22724 - protein, 24 aa, artificial
  peptide fold or domain or sub-domain
YCNLANALKEKGSVAEAEDCYNTA

SEQ ID NO: 22725 - protein, 23 aa, artificial
  peptide fold or domain or sub-domain
YCPANTAYGSRGVPGVIPPDTPL

SEQ ID NO: 22726 - protein, 24 aa, artificial
  peptide fold or domain or sub-domain
YCPGIKIEGIPQEEYWDPHMCVYP

SEQ ID NO: 22727 - protein, 29 aa, artificial
  peptide fold or domain or sub-domain
YCQTCIMKILKSSSSRCPICRRSLCKEDL

SEQ ID NO: 22728 - protein, 23 aa, artificial
  peptide fold or domain or sub-domain
YCQVCMEPELGEMYMNDREKFDE

SEQ ID NO: 22729 - protein, 27 aa, artificial
  peptide fold or domain or sub-domain
YCSSHYPTWATEHPSAGAAFVPGGFGE

SEQ ID NO: 22730 - protein, 27 aa, artificial
  peptide fold or domain or sub-domain
YDAAKHSLGDIDSMVREGNFAPLRNWL

SEQ ID NO: 22731 - protein, 27 aa, artificial
  peptide fold or domain or sub-domain
YDAAMGPSGKGEVCATCVKDMNQCEGH

SEQ ID NO: 22732 - protein, 29 aa, artificial
  peptide fold or domain or sub-domain
YDAIYACGPKGLLMAVDNRFSAHPNAYIS

SEQ ID NO: 22733 - protein, 24 aa, artificial
  peptide fold or domain or sub-domain
YDAPLPDGADQYRLPGDDEHDLTP

SEQ ID NO: 22734 - protein, 27 aa, artificial
  peptide fold or domain or sub-domain
YDARMGTTDHHYKCITCSHQRKQCMGH

SEQ ID NO: 22735 - protein, 27 aa, artificial
  peptide fold or domain or sub-domain
YDDETFKKYSKDFNVFKKDLFENKANE

SEQ ID NO: 22736 - protein, 24 aa, artificial
  peptide fold or domain or sub-domain
YDDGKLLGTYSNDSLKLFHHNGSI

SEQ ID NO: 22737 - protein, 25 aa, artificial
  peptide fold or domain or sub-domain
YDDIMVFYGEDNTDDGARRDFFAKL

SEQ ID NO: 22738 - protein, 25 aa, artificial
  peptide fold or domain or sub-domain
YDEDAGDPDNGISPGTKFEELPDDW

SEQ ID NO: 22739 - protein, 29 aa, artificial
  peptide fold or domain or sub-domain
YDEIARQLPLPDYFGRNLDALWDVLSTDI

SEQ ID NO: 22740 - protein, 25 aa, artificial
  peptide fold or domain or sub-domain
YDEQLAEYYLTRGSNNRRDTWSDHI

SEQ ID NO: 22741 - protein, 28 aa, artificial
  peptide fold or domain or sub-domain
YDFENNCFAQDSIDLLSKSKLLFETNNK

SEQ ID NO: 22742 - protein, 22 aa, artificial
  peptide fold or domain or sub-domain
YDFQKGEQKCKEHLALNPNGRV

SEQ ID NO: 22743 - protein, 26 aa, artificial
  peptide fold or domain or sub-domain
YDGIPAVGRRPADIPISTFLGWGGDN

SEQ ID NO: 22744 - protein, 20 aa, artificial
  peptide fold or domain or sub-domain
YDGPINKLRETNHQRYISYN

SEQ ID NO: 22745 - protein, 25 aa, artificial
  peptide fold or domain or sub-domain
YDHLPEQAFYMVGPIEEAVAKADKL

SEQ ID NO: 22746 - protein, 21 aa, artificial
  peptide fold or domain or sub-domain
YDILTDERLNHRVEVERGILE

SEQ ID NO: 22747 - protein, 22 aa, artificial
  peptide fold or domain or sub-domain
YDKANEGSNYVDGTDEAEQADG

SEQ ID NO: 22748 - protein, 28 aa, artificial
  peptide fold or domain or sub-domain
YDKEGVMRDLINQGIEHEKAEKLATYRL

SEQ ID NO: 22749 - protein, 27 aa, artificial
  peptide fold or domain or sub-domain
YDKYFSLQATHPLGFDDVVRLEIESNI

SEQ ID NO: 22750 - protein, 27 aa, artificial
  peptide fold or domain or sub-domain
YDKYFSLQSECRLWMSQKLRLRVEQAI

SEQ ID NO: 22751 - protein, 27 aa, artificial
  peptide fold or domain or sub-domain
YDLKLGPKDDKQACNSCGQLKLACPGH

SEQ ID NO: 22752 - protein, 27 aa, artificial
  peptide fold or domain or sub-domain
YDLRMGPLDLSSNCKTCNLSFLNCPGH

SEQ ID NO: 22753 - protein, 28 aa, artificial
  peptide fold or domain or sub-domain
YDMPEDNYIEDALTPEEAQQGYVLACQC

SEQ ID NO: 22754 - protein, 26 aa, artificial
  peptide fold or domain or sub-domain
YDNKQGQLGTITSPGRTPGSLTGGYA

SEQ ID NO: 22755 - protein, 23 aa, artificial
  peptide fold or domain or sub-domain
YDNLSTAVCNQKRYKFLSDFVPQ

SEQ ID NO: 22756 - protein, 23 aa, artificial
  peptide fold or domain or sub-domain
YDNSIIKNGKVDREKFKEIQKKF

SEQ ID NO: 22757 - protein, 28 aa, artificial
  peptide fold or domain or sub-domain
YDNSTFASHFYDPDNGKTYIPFAKQAKE

SEQ ID NO: 22758 - protein, 27 aa, artificial
  peptide fold or domain or sub-domain
YDPALGPTDAKTTCVTCKYPGGMCDGH

SEQ ID NO: 22759 - protein, 27 aa, artificial
  peptide fold or domain or sub-domain
YDPILGPDNTFDMCMTCNQYERHCPGH

SEQ ID NO: 22760 - protein, 27 aa, artificial
  peptide fold or domain or sub-domain
YDPKYGTIDHNQICSVCFERHENCTGH

SEQ ID NO: 22761 - protein, 27 aa, artificial
  peptide fold or domain or sub-domain
YDPLANNPGWKKNGAGLMVNSRFGFGL

SEQ ID NO: 22762 - protein, 23 aa, artificial
  peptide fold or domain or sub-domain
YDPLTARLDRAERAGTATADDRA

SEQ ID NO: 22763 - protein, 28 aa, artificial
  peptide fold or domain or sub-domain
YDQDPANQGIVDALKADKKDPSGPYVWI

SEQ ID NO: 22764 - protein, 26 aa, artificial
  peptide fold or domain or sub-domain
YDRICDIVKREAKNKDEAIEIFLSLH

SEQ ID NO: 22765 - protein, 23 aa, artificial
  peptide fold or domain or sub-domain
YDRIRKLCKEHNVDENIGIKIFQ

SEQ ID NO: 22766 - protein, 27 aa, artificial
  peptide fold or domain or sub-domain
YDSDERENSFLIRKKLSKKYKLAEKFI

SEQ ID NO: 22767 - protein, 30 aa, artificial
  peptide fold or domain or sub-domain
YDSDQEIEKAAQMTITEFFKVYGESEFRAL

SEQ ID NO: 22768 - protein, 30 aa, artificial
  peptide fold or domain or sub-domain
YDSDQEIEKRTGADVGWVFDLEGEEGFRDR

SEQ ID NO: 22769 - protein, 24 aa, artificial
  peptide fold or domain or sub-domain
YDSIRYAKKKGGSHKFKLENAIDK

SEQ ID NO: 22770 - protein, 20 aa, artificial
  peptide fold or domain or sub-domain
YDSMKDFEEMRKAGIFQSAK

SEQ ID NO: 22771 - protein, 27 aa, artificial
  peptide fold or domain or sub-domain
YDTFIAAESPLAINIDHDTRTDIIGLV

SEQ ID NO: 22772 - protein, 30 aa, artificial
  peptide fold or domain or sub-domain
YDVDEEVQKREGLSIPQIFEKKGEAYFRKL

SEQ ID NO: 22773 - protein, 21 aa, artificial
  peptide fold or domain or sub-domain
YDVEHPSLASYFNRFPARQYM

SEQ ID NO: 22774 - protein, 25 aa, artificial
  peptide fold or domain or sub-domain
YDVFMKHKIYETEGFVLKDNFSNFN

SEQ ID NO: 22775 - protein, 28 aa, artificial
  peptide fold or domain or sub-domain
YDVGLQRAAQWLYQTTKAERKKQLTICK

SEQ ID NO: 22776 - protein, 22 aa, artificial
  peptide fold or domain or sub-domain
YDVLQGEGGEVRYPVPWADDPS

SEQ ID NO: 22777 - protein, 26 aa, artificial
  peptide fold or domain or sub-domain
YDWSENLVSFYLDGSWMGDLNQSVPA

SEQ ID NO: 22778 - protein, 25 aa, artificial
  peptide fold or domain or sub-domain
YEAELGNTPTSDELWALAVQERRRP

SEQ ID NO: 22779 - protein, 24 aa, artificial
  peptide fold or domain or sub-domain
YEAKGSDLVLPEYRADREKHRVTP

SEQ ID NO: 22780 - protein, 30 aa, artificial
  peptide fold or domain or sub-domain
YECTAEECLGPIANVLDKECSDFVIRVAKV

SEQ ID NO: 22781 - protein, 21 aa, artificial
  peptide fold or domain or sub-domain
YEDGCKTVDLKPDWGKGYSRK

SEQ ID NO: 22782 - protein, 27 aa, artificial
  peptide fold or domain or sub-domain
YEDYISILSPKEVSLDSRVREVINRNL

SEQ ID NO: 22783 - protein, 27 aa, artificial
  peptide fold or domain or sub-domain
YEEAGHSFARTSSSGYVASAAALANER

SEQ ID NO: 22784 - protein, 27 aa, artificial
  peptide fold or domain or sub-domain
YEEFIQTEAPKEVNIDHFTKDITMKNL

SEQ ID NO: 22785 - protein, 21 aa, artificial
  peptide fold or domain or sub-domain
YEEMVALLGVRSKSVVHFWIN

SEQ ID NO: 22786 - protein, 20 aa, artificial
  peptide fold or domain or sub-domain
YEEQTQVLLKRLEEGELDCL

SEQ ID NO: 22787 - protein, 22 aa, artificial
  peptide fold or domain or sub-domain
YEETLFEQFGYPQDKQHTDSHH

SEQ ID NO: 22788 - protein, 22 aa, artificial
  peptide fold or domain or sub-domain
YEEYKKLYKKYKEENPTSKVKM

SEQ ID NO: 22789 - protein, 30 aa, artificial
  peptide fold or domain or sub-domain
YEGKKRVSKDKIKQILEMVNVEKLSDKEKE

SEQ ID NO: 22790 - protein, 20 aa, artificial
  peptide fold or domain or sub-domain
YEGLKLLGVLNKQEYDDMVH

SEQ ID NO: 22791 - protein, 27 aa, artificial
  peptide fold or domain or sub-domain
YEGRDHAFAREGGAHYDAADAAKANGR

SEQ ID NO: 22792 - protein, 22 aa, artificial
  peptide fold or domain or sub-domain
YEGSCQACHGPDLKGDRGPAVD

SEQ ID NO: 22793 - protein, 24 aa, artificial
  peptide fold or domain or sub-domain
YEGSEDADSLPPNTAHGPNNPAEN

SEQ ID NO: 22794 - protein, 23 aa, artificial
  peptide fold or domain or sub-domain
YEHLSQVVNKNKNLEFLLQIVPQ

SEQ ID NO: 22795 - protein, 20 aa, artificial
  peptide fold or domain or sub-domain
YEHNEIAEMMGCSIGNSKSQ

SEQ ID NO: 22796 - protein, 25 aa, artificial
  peptide fold or domain or sub-domain
YEIELGPQPSMEALQRWVAHAKQRP

SEQ ID NO: 22797 - protein, 22 aa, artificial
  peptide fold or domain or sub-domain
YEKDSEGTVYNDGEQAGFQKMW

SEQ ID NO: 22798 - protein, 30 aa, artificial
  peptide fold or domain or sub-domain
YEKETLQYFSTLKAVDPMRAAYLDDLRSKF

SEQ ID NO: 22799 - protein, 20 aa, artificial
  peptide fold or domain or sub-domain
YEKLCNAMFTEKVLTLYYKV

SEQ ID NO: 22800 - protein, 20 aa, artificial
  peptide fold or domain or sub-domain
YEKLIDTNPDILETWEHQGQ

SEQ ID NO: 22801 - protein, 24 aa, artificial
  peptide fold or domain or sub-domain
YEKSSEFKRKVEQGLSPYPAKASW

SEQ ID NO: 22802 - protein, 22 aa, artificial
  peptide fold or domain or sub-domain
YEKSSEGKTYEDDSPEWFKEDN

SEQ ID NO: 22803 - protein, 25 aa, artificial
  peptide fold or domain or sub-domain
YELELEGNVTLERLILYVCEMDRRP

SEQ ID NO: 22804 - protein, 28 aa, artificial
  peptide fold or domain or sub-domain
YELKKNMSGFQKFVSSSYKNQGIDSGMA

SEQ ID NO: 22805 - protein, 30 aa, artificial
  peptide fold or domain or sub-domain
YELLLSQFNDNVAQAKIFIERKLPLAAYDH

SEQ ID NO: 22806 - protein, 25 aa, artificial
  peptide fold or domain or sub-domain
YELRARQFKDRRGWRVDVTNGLERD

SEQ ID NO: 22807 - protein, 24 aa, artificial
  peptide fold or domain or sub-domain
YELVFPSDARLEENRISILAPVGT

SEQ ID NO: 22808 - protein, 24 aa, artificial
  peptide fold or domain or sub-domain
YELVGPAEAGMGQDKLAINSPLGA

SEQ ID NO: 22809 - protein, 20 aa, artificial
  peptide fold or domain or sub-domain
YENMLYDWAIGNYNKVFEYN

SEQ ID NO: 22810 - protein, 24 aa, artificial
  peptide fold or domain or sub-domain
YEPAWAGEVDPSLADSDDDKAYWP

SEQ ID NO: 22811 - protein, 22 aa, artificial
  peptide fold or domain or sub-domain
YEPIWAIGTGKTATNEQAEEVC

SEQ ID NO: 22812 - protein, 22 aa, artificial
  peptide fold or domain or sub-domain
YEPQWAIGAPEPASADHIATVC

SEQ ID NO: 22813 - protein, 21 aa, artificial
  peptide fold or domain or sub-domain
YEPREGGTAPDGKAMDGKWLE

SEQ ID NO: 22814 - protein, 22 aa, artificial
  peptide fold or domain or sub-domain
YEPSKTVPTLIIRNDDYGRIER

SEQ ID NO: 22815 - protein, 22 aa, artificial
  peptide fold or domain or sub-domain
YEPVWAIGSGSSASPRNVQSIH

SEQ ID NO: 22816 - protein, 20 aa, artificial
  peptide fold or domain or sub-domain
YEQLAPAIDGRGLRKLYDEI

SEQ ID NO: 22817 - protein, 26 aa, artificial
  peptide fold or domain or sub-domain
YEQLQTGLSRLRSRLSETEVQQLVEA

SEQ ID NO: 22818 - protein, 26 aa, artificial
  peptide fold or domain or sub-domain
YEQRMRRQLEIANPRATEDDFQTAIN

SEQ ID NO: 22819 - protein, 24 aa, artificial
  peptide fold or domain or sub-domain
YERIKTKNCYRPLNEVLSTATLKE

SEQ ID NO: 22820 - protein, 24 aa, artificial
  peptide fold or domain or sub-domain
YESLKGFRDFFELPLTDEQVEKLE

SEQ ID NO: 22821 - protein, 27 aa, artificial
  peptide fold or domain or sub-domain
YESSGHGFNNDGRPDSDLADAELARQR

SEQ ID NO: 22822 - protein, 20 aa, artificial
  peptide fold or domain or sub-domain
YEVDKFGKLVRDDDGNLIKT

SEQ ID NO: 22823 - protein, 28 aa, artificial
  peptide fold or domain or sub-domain
YEVGTTTAVWKAPAAADFLHAKAIGVKY

SEQ ID NO: 22824 - protein, 26 aa, artificial
  peptide fold or domain or sub-domain
YEWEYVQLPAHIKEQRKKAEQSIPCQ

SEQ ID NO: 22825 - protein, 26 aa, artificial
  peptide fold or domain or sub-domain
YEYAFTPDWFAGGGYIRKDFDKPGLK

SEQ ID NO: 22826 - protein, 24 aa, artificial
  peptide fold or domain or sub-domain
YEYETEDLLNLAKHGSFKDPLWDE

SEQ ID NO: 22827 - protein, 21 aa, artificial
  peptide fold or domain or sub-domain
YEYPEFPVLECGDSEKYQRMK

SEQ ID NO: 22828 - protein, 22 aa, artificial
  peptide fold or domain or sub-domain
YFAGQEPWALRKTDPARMGTVL

SEQ ID NO: 22829 - protein, 29 aa, artificial
  peptide fold or domain or sub-domain
YFASYIIVHVDEEVKAHRREALQAEYREK

SEQ ID NO: 22830 - protein, 22 aa, artificial
  peptide fold or domain or sub-domain
YFDERQPWKEREDDPVSCEETI

SEQ ID NO: 22831 - protein, 25 aa, artificial
  peptide fold or domain or sub-domain
YFDQLLIKKQENKDFEKVKERIKQS

SEQ ID NO: 22832 - protein, 27 aa, artificial
  peptide fold or domain or sub-domain
YFEKFLRKIFIPFDSGNNAFKKILFFV

SEQ ID NO: 22833 - protein, 29 aa, artificial
  peptide fold or domain or sub-domain
YFFIQVQEADTVEAAQNLTVPGGLRSTDL

SEQ ID NO: 22834 - protein, 29 aa, artificial
  peptide fold or domain or sub-domain
YFFRLREGDGDDRYIFAGGTGQQGRPFTY

SEQ ID NO: 22835 - protein, 25 aa, artificial
  peptide fold or domain or sub-domain
YFHPYCLIDWDITDNETNVMDCWQD

SEQ ID NO: 22836 - protein, 25 aa, artificial
  peptide fold or domain or sub-domain
YFHPYCWIDYGSNNNTDIEDCWTGD

SEQ ID NO: 22837 - protein, 30 aa, artificial
  peptide fold or domain or sub-domain
YFHVKSEDAADVIEKTIKTGELVERLLYAD

SEQ ID NO: 22838 - protein, 30 aa, artificial
  peptide fold or domain or sub-domain
YFIDQAGGYLVEFFDRTWRPDESDDGIVVE

SEQ ID NO: 22839 - protein, 25 aa, artificial
  peptide fold or domain or sub-domain
YFIPTNQINNYTETDTSVVPFPVSN

SEQ ID NO: 22840 - protein, 26 aa, artificial
  peptide fold or domain or sub-domain
YFLSKAMAEYFATRSRAGLEGYTDSV

SEQ ID NO: 22841 - protein, 23 aa, artificial
  peptide fold or domain or sub-domain
YFLVIEKAEGVYWIDVDGNVILD

SEQ ID NO: 22842 - protein, 22 aa, artificial
  peptide fold or domain or sub-domain
YFNDTEPWHTHESDPQACANTI

SEQ ID NO: 22843 - protein, 24 aa, artificial
  peptide fold or domain or sub-domain
YFNLGIALRELKRYDEALINFDKT

SEQ ID NO: 22844 - protein, 25 aa, artificial
  peptide fold or domain or sub-domain
YFPEELWKMILENKIKDSKTIIGVL

SEQ ID NO: 22845 - protein, 25 aa, artificial
  peptide fold or domain or sub-domain
YFPQDTGPDYGLVSVSGNTVNTRSD

SEQ ID NO: 22846 - protein, 29 aa, artificial
  peptide fold or domain or sub-domain
YFQERTEQATRPAAGEEALEALLELRDYL

SEQ ID NO: 22847 - protein, 24 aa, artificial
  peptide fold or domain or sub-domain
YFQQGQQAVAAGQLEKAVTLYKKT

SEQ ID NO: 22848 - protein, 22 aa, artificial
  peptide fold or domain or sub-domain
YFQSHEPWKLIKEDRDACGQVV

SEQ ID NO: 22849 - protein, 26 aa, artificial
  peptide fold or domain or sub-domain
YFSYPVRNRDYSRWPDKPEGWVKVTE

SEQ ID NO: 22850 - protein, 26 aa, artificial
  peptide fold or domain or sub-domain
YFVEDLCSQLISRNITSHEDALLLVR

SEQ ID NO: 22851 - protein, 21 aa, artificial
  peptide fold or domain or sub-domain
YFVEDQHLANPWDNFEKLWWH

SEQ ID NO: 22852 - protein, 25 aa, artificial
  peptide fold or domain or sub-domain
YGALEGMRPWAAIRKFGIWSTMKSQ

SEQ ID NO: 22853 - protein, 25 aa, artificial
  peptide fold or domain or sub-domain
YGALQGLNKAETAEKYGDEQVKQWR

SEQ ID NO: 22854 - protein, 25 aa, artificial
  peptide fold or domain or sub-domain
YGALQGRNRMQVRAEYGADLLRFWR

SEQ ID NO: 22855 - protein, 25 aa, artificial
  peptide fold or domain or sub-domain
YGALRGINKDVSKKIFGTNQVLEWR

SEQ ID NO: 22856 - protein, 21 aa, artificial
  peptide fold or domain or sub-domain
YGALSVSGSKVVGKSGSPAAL

SEQ ID NO: 22857 - protein, 26 aa, artificial
  peptide fold or domain or sub-domain
YGASIAAWKKASYAEHEDYTHFKKFL

SEQ ID NO: 22858 - protein, 30 aa, artificial
  peptide fold or domain or sub-domain
YGATVDEKGALKEGYSADGLHPNDKGYALM

SEQ ID NO: 22859 - protein, 30 aa, artificial
  peptide fold or domain or sub-domain
YGAVTLQDVPRIVEETVVNGRVLEDLRIPE

SEQ ID NO: 22860 - protein, 30 aa, artificial
  peptide fold or domain or sub-domain
YGDLSGLNKDDARAKWGEEQVHIWRRSYDV

SEQ ID NO: 22861 - protein, 26 aa, artificial
  peptide fold or domain or sub-domain
YGEHVQKWIEEGYYDNPEYEYIKELI

SEQ ID NO: 22862 - protein, 26 aa, artificial
  peptide fold or domain or sub-domain
YGEMIYQWREQGFHEKPEYEHFRQLL

SEQ ID NO: 22863 - protein, 24 aa, artificial
  peptide fold or domain or sub-domain
YGFDLSQTAIAHFVEAGGIASDSP

SEQ ID NO: 22864 - protein, 29 aa, artificial
  peptide fold or domain or sub-domain
YGFNVHANGESAVYTERGWYDEVPLDHPG

SEQ ID NO: 22865 - protein, 26 aa, artificial
  peptide fold or domain or sub-domain
YGFSRDDSDAFIKPYIAKGLLRDDPF

SEQ ID NO: 22866 - protein, 29 aa, artificial
  peptide fold or domain or sub-domain
YGFVLYSGEEKLVYTEKGFYFEVPTDDTA

SEQ ID NO: 22867 - protein, 30 aa, artificial
  peptide fold or domain or sub-domain
YGGDMKSLVLNFAKNEELNNKEIEELRDIL

SEQ ID NO: 22868 - protein, 25 aa, artificial
  peptide fold or domain or sub-domain
YGGDRLLIGEIYLPIARLVAYYGRD

SEQ ID NO: 22869 - protein, 25 aa, artificial
  peptide fold or domain or sub-domain
YGGGLSGDPADSLLRFKAGYSPERA

SEQ ID NO: 22870 - protein, 20 aa, artificial
  peptide fold or domain or sub-domain
YGGLVKMGRMTEEIKDSYVA

SEQ ID NO: 22871 - protein, 30 aa, artificial
  peptide fold or domain or sub-domain
YGGVSPERMDIILREHVLEGRPCQQWILKQ

SEQ ID NO: 22872 - protein, 27 aa, artificial
  peptide fold or domain or sub-domain
YGHESKFYLDDQVVTGSQEIVKLYNHL

SEQ ID NO: 22873 - protein, 30 aa, artificial
  peptide fold or domain or sub-domain
YGHRGAKGEAPENTLVGFQRCLEHGVRRCE

SEQ ID NO: 22874 - protein, 30 aa, artificial
  peptide fold or domain or sub-domain
YGHRGVPVKFPENSLAGFAYAISHHIDGLE

SEQ ID NO: 22875 - protein, 25 aa, artificial
  peptide fold or domain or sub-domain
YGHVENYYYMLTGEQPSEAKKKALE

SEQ ID NO: 22876 - protein, 25 aa, artificial
  peptide fold or domain or sub-domain
YGIAENFLYTLNGEEPSPIEVEAFN

SEQ ID NO: 22877 - protein, 24 aa, artificial
  peptide fold or domain or sub-domain
YGICLHMRMHSCDWANFDHYLSVI

SEQ ID NO: 22878 - protein, 26 aa, artificial
  peptide fold or domain or sub-domain
YGIDKAFPDHGVDEGRFHGLHGSVDS

SEQ ID NO: 22879 - protein, 30 aa, artificial
  peptide fold or domain or sub-domain
YGIHLDNKVGSHNGTLQGKEYFTCPEGHGL

SEQ ID NO: 22880 - protein, 25 aa, artificial
  peptide fold or domain or sub-domain
YGILQGKKKDKMKAKYGEEQILHWC

SEQ ID NO: 22881 - protein, 27 aa, artificial
  peptide fold or domain or sub-domain
YGKEKIKELGMEAFLAVSKGSFEESQL

SEQ ID NO: 22882 - protein, 21 aa, artificial
  peptide fold or domain or sub-domain
YGKLAVEGSHLVDADGHEVLL

SEQ ID NO: 22883 - protein, 21 aa, artificial
  peptide fold or domain or sub-domain
YGKLSVKGNYMVGQYGDTVQL

SEQ ID NO: 22884 - protein, 25 aa, artificial
  peptide fold or domain or sub-domain
YGLDEAFAMIASGEITDSKTIILLQ

SEQ ID NO: 22885 - protein, 26 aa, artificial
  peptide fold or domain or sub-domain
YGLSRDDAGRFMSAYVRQGVFSEDPF

SEQ ID NO: 22886 - protein, 30 aa, artificial
  peptide fold or domain or sub-domain
YGMEEGVPMTMICHQLNYNAPEDVMFGEAR

SEQ ID NO: 22887 - protein, 20 aa, artificial
  peptide fold or domain or sub-domain
YGPAVEAGGMTEDLFDSIKG

SEQ ID NO: 22888 - protein, 23 aa, artificial
  peptide fold or domain or sub-domain
YGPRFSLFSSDAFAQGCGLMSAP

SEQ ID NO: 22889 - protein, 23 aa, artificial
  peptide fold or domain or sub-domain
YGPTMNAFEAAEKSGRAQELHEQ

SEQ ID NO: 22890 - protein, 21 aa, artificial
  peptide fold or domain or sub-domain
YGQLKIFNGKVSDQNNNPVVL

SEQ ID NO: 22891 - protein, 25 aa, artificial
  peptide fold or domain or sub-domain
YGQLTGINKNVARERWGQDVVQVWR

SEQ ID NO: 22892 - protein, 27 aa, artificial
  peptide fold or domain or sub-domain
YGQTSMLSFEGHMVAGAEEIGRKLLGL

SEQ ID NO: 22893 - protein, 30 aa, artificial
  peptide fold or domain or sub-domain
YGQVKPEDVDEIVEKHLKGGEPVERLVISK

SEQ ID NO: 22894 - protein, 30 aa, artificial
  peptide fold or domain or sub-domain
YGQWEGKTPKQINQEYHDDYIRWSADPAWY

SEQ ID NO: 22895 - protein, 23 aa, artificial
  peptide fold or domain or sub-domain
YGRTLWDWSDALEARLDEARQVL

SEQ ID NO: 22896 - protein, 30 aa, artificial
  peptide fold or domain or sub-domain
YGRVTPENAKRIVKMHILEGRVVEDLVVKR

SEQ ID NO: 22897 - protein, 24 aa, artificial
  peptide fold or domain or sub-domain
YGSAILNAIGRLYSAPTEAGFLAE

SEQ ID NO: 22898 - protein, 25 aa, artificial
  peptide fold or domain or sub-domain
YGSWQGQRKPNVLKEYGKDKYMFIR

SEQ ID NO: 22899 - protein, 25 aa, artificial
  peptide fold or domain or sub-domain
YGVFQGHDSTEIEARFPDAFAQWQT

SEQ ID NO: 22900 - protein, 30 aa, artificial
  peptide fold or domain or sub-domain
YGVFQGHDSTEIEARFPDAFAQWQTRDPGF

SEQ ID NO: 22901 - protein, 27 aa, artificial
  peptide fold or domain or sub-domain
YGVGKSLQQIPHIELSLVSDLSQLIRK

SEQ ID NO: 22902 - protein, 26 aa, artificial
  peptide fold or domain or sub-domain
YGVPALNGRKLDGVSRHDYFGWRNLD

SEQ ID NO: 22903 - protein, 20 aa, artificial
  peptide fold or domain or sub-domain
YGVPETDVTHEMRDKAKVVN

SEQ ID NO: 22904 - protein, 23 aa, artificial
  peptide fold or domain or sub-domain
YGYLEFKEGLSGKEIMKTLNLPE

SEQ ID NO: 22905 - protein, 24 aa, artificial
  peptide fold or domain or sub-domain
YGYLGKAYASQKQWDEAIVNYGHA

SEQ ID NO: 22906 - protein, 28 aa, artificial
  peptide fold or domain or sub-domain
YGYLLKGIQKAWPELSRRDRVFFDLHAM

SEQ ID NO: 22907 - protein, 30 aa, artificial
  peptide fold or domain or sub-domain
YGYVTPEDVPILLEQHINKGEIVDRLWRGE

SEQ ID NO: 22908 - protein, 20 aa, artificial
  peptide fold or domain or sub-domain
YHAIVAAQETYAFDAAPTQE

SEQ ID NO: 22909 - protein, 22 aa, artificial
  peptide fold or domain or sub-domain
YHCPMPNAFWDSHKCACSRSGQ

SEQ ID NO: 22910 - protein, 22 aa, artificial
  peptide fold or domain or sub-domain
YHCPTDVQSHATARCLCDPTGT

SEQ ID NO: 22911 - protein, 29 aa, artificial
  peptide fold or domain or sub-domain
YHDEALLELLIDYELIDINSDEEGYEIIT

SEQ ID NO: 22912 - protein, 24 aa, artificial
  peptide fold or domain or sub-domain
YHHLGDALTQQQNWEEAVGAYRKV

SEQ ID NO: 22913 - protein, 27 aa, artificial
  peptide fold or domain or sub-domain
YHHLKDIILEKYGSNSCNIGDDGGFAP

SEQ ID NO: 22914 - protein, 25 aa, artificial
  peptide fold or domain or sub-domain
YHHNGAIAENGKDWEWNDAWAVRNK

SEQ ID NO: 22915 - protein, 22 aa, artificial
  peptide fold or domain or sub-domain
YHHRNIQRKIGASNRVQAVSYA

SEQ ID NO: 22916 - protein, 26 aa, artificial
  peptide fold or domain or sub-domain
YHHYGEVNNWDDEWQVQNCDLAGLAT

SEQ ID NO: 22917 - protein, 26 aa, artificial
  peptide fold or domain or sub-domain
YHIPVIMLTARDALSDKERAFLSGTD

SEQ ID NO: 22918 - protein, 30 aa, artificial
  peptide fold or domain or sub-domain
YHKQWSDFRGTIIERGCGCPTVKPGIKLSC

SEQ ID NO: 22919 - protein, 21 aa, artificial
  peptide fold or domain or sub-domain
YHLDATLPENILLNGQYRDEA

SEQ ID NO: 22920 - protein, 23 aa, artificial
  peptide fold or domain or sub-domain
YHLLGFDHQDEKTNKLMDEKVEN

SEQ ID NO: 22921 - protein, 22 aa, artificial
  peptide fold or domain or sub-domain
YHLNQVTRKTGSMNRYQAIAKG

SEQ ID NO: 22922 - protein, 25 aa, artificial
  peptide fold or domain or sub-domain
YHNCTTCPQYCTIDDFTNYPQVEEC

SEQ ID NO: 22923 - protein, 26 aa, artificial
  peptide fold or domain or sub-domain
YHNDLLQKQIKEGKDGMSILKTQFLT

SEQ ID NO: 22924 - protein, 26 aa, artificial
  peptide fold or domain or sub-domain
YHNKGNIQNYGNQQEVEDGDLLGLDD

SEQ ID NO: 22925 - protein, 27 aa, artificial
  peptide fold or domain or sub-domain
YHNLKSLTKKRYGASAGNVGDEGGVAP

SEQ ID NO: 22926 - protein, 27 aa, artificial
  peptide fold or domain or sub-domain
YHNQARMTYEGDVLEGQDKIGEKFLSL

SEQ ID NO: 22927 - protein, 26 aa, artificial
  peptide fold or domain or sub-domain
YHNQGSCNDYKDRYQVTQKDIGGLLD

SEQ ID NO: 22928 - protein, 30 aa, artificial
  peptide fold or domain or sub-domain
YHNVSADRIEPIVKGHVVEGTPIKEWVFKE

SEQ ID NO: 22929 - protein, 24 aa, artificial
  peptide fold or domain or sub-domain
YHPTSVAEWLDSIELGDYTKAFLI

SEQ ID NO: 22930 - protein, 25 aa, artificial
  peptide fold or domain or sub-domain
YHPWVPMDPPIDDMRRIVCIEKRRP

SEQ ID NO: 22931 - protein, 24 aa, artificial
  peptide fold or domain or sub-domain
YHQFGYVLTQKQQWEEAISAYRQA

SEQ ID NO: 22932 - protein, 27 aa, artificial
  peptide fold or domain or sub-domain
YHQIGKLLFTKLGVPGYYVNDNGTFTP

SEQ ID NO: 22933 - protein, 27 aa, artificial
  peptide fold or domain or sub-domain
YHQQAVSNWNGNFFSGIAQIRNHLISL

SEQ ID NO: 22934 - protein, 30 aa, artificial
  peptide fold or domain or sub-domain
YHSCRPEVLDRIVDEHLIGGQPVEEFRLKA

SEQ ID NO: 22935 - protein, 24 aa, artificial
  peptide fold or domain or sub-domain
YHSLGTISLELGKLSESQKYYQEA

SEQ ID NO: 22936 - protein, 25 aa, artificial
  peptide fold or domain or sub-domain
YHSQAPLNPTIEQMKEIVVMSNLRP

SEQ ID NO: 22937 - protein, 30 aa, artificial
  peptide fold or domain or sub-domain
YHSVTPEVVEEILQKHILGGIPVVEYLVAQ

SEQ ID NO: 22938 - protein, 22 aa, artificial
  peptide fold or domain or sub-domain
YHVKKAMEALNIWGRTAAAVQA

SEQ ID NO: 22939 - protein, 24 aa, artificial
  peptide fold or domain or sub-domain
YHVLGESLAQLEKWDEAVAAYTKA

SEQ ID NO: 22940 - protein, 22 aa, artificial
  peptide fold or domain or sub-domain
YHVTNFMRKFNAESRQHAVISG

SEQ ID NO: 22941 - protein, 26 aa, artificial
  peptide fold or domain or sub-domain
YHWTPDINNYSDPVQKLNYQMSGLDD

SEQ ID NO: 22942 - protein, 24 aa, artificial
  peptide fold or domain or sub-domain
YIASYLKAIYGAKATKENDFGYQW

SEQ ID NO: 22943 - protein, 27 aa, artificial
  peptide fold or domain or sub-domain
YIDASCLTWEGQQFQGKAAIVEKLSSL

SEQ ID NO: 22944 - protein, 25 aa, artificial
  peptide fold or domain or sub-domain
YIDCRIQEISTDYYNLQALGHLQQF

SEQ ID NO: 22945 - protein, 25 aa, artificial
  peptide fold or domain or sub-domain
YIDEAFQKDFKNKSEQQIEEVLNSV

SEQ ID NO: 22946 - protein, 21 aa, artificial
  peptide fold or domain or sub-domain
YIDFKRDLGWKWIHEPKGYNA

SEQ ID NO: 22947 - protein, 24 aa, artificial
  peptide fold or domain or sub-domain
YIDKKIYDTWKKMWLSKGEEHEEG

SEQ ID NO: 22948 - protein, 22 aa, artificial
  peptide fold or domain or sub-domain
YIDKSAPWTLSKTDRERVNLVI

SEQ ID NO: 22949 - protein, 25 aa, artificial
  peptide fold or domain or sub-domain
YIDNLMKKALKGKSDEEVAAILDST

SEQ ID NO: 22950 - protein, 25 aa, artificial
  peptide fold or domain or sub-domain
YIDYLLRVGEQASGGKPLKEVFSEI

SEQ ID NO: 22951 - protein, 22 aa, artificial
  peptide fold or domain or sub-domain
YIEASKTRLYHSGDDSASSMAQ

SEQ ID NO: 22952 - protein, 25 aa, artificial
  peptide fold or domain or sub-domain
YIEDHSGNGTFVNTELVGKGKRRPL

SEQ ID NO: 22953 - protein, 25 aa, artificial
  peptide fold or domain or sub-domain
YIEDKSSNGTYIQNNLIGKDQKVKV

SEQ ID NO: 22954 - protein, 26 aa, artificial
  peptide fold or domain or sub-domain
YIEDTASNESVAVGNVRKLIQRDKVD

SEQ ID NO: 22955 - protein, 22 aa, artificial
  peptide fold or domain or sub-domain
YIELVKPRAYGKVSPRSAEVAK

SEQ ID NO: 22956 - protein, 22 aa, artificial
  peptide fold or domain or sub-domain
YIELVKSRLQKDADPLSRKAAQ

SEQ ID NO: 22957 - protein, 21 aa, artificial
  peptide fold or domain or sub-domain
YIEQARSRPDMFNQTLMSKLF

SEQ ID NO: 22958 - protein, 27 aa, artificial
  peptide fold or domain or sub-domain
YIEVESQSKDLQDKPAQSKNKIIRGRI

SEQ ID NO: 22959 - protein, 25 aa, artificial
  peptide fold or domain or sub-domain
YIEWTDRDPQDAQMFDVVCTRRLRP

SEQ ID NO: 22960 - protein, 29 aa, artificial
  peptide fold or domain or sub-domain
YIFKIEEEGQTYYFSEDGLTTSYDFSNGF

SEQ ID NO: 22961 - protein, 27 aa, artificial
  peptide fold or domain or sub-domain
YIHGSDMTSLHKHINPEHLPKRYGGLH

SEQ ID NO: 22962 - protein, 29 aa, artificial
  peptide fold or domain or sub-domain
YIHTIKEIKKLYNNYTKKELEKINYKTKI

SEQ ID NO: 22963 - protein, 30 aa, artificial
  peptide fold or domain or sub-domain
YIIKRIEEHNTVEYPKELYGHFFSKEAFLI

SEQ ID NO: 22964 - protein, 30 aa, artificial
  peptide fold or domain or sub-domain
YIILGSVIFKNPEFVEDVLKRFGNERFIAS

SEQ ID NO: 22965 - protein, 20 aa, artificial
  peptide fold or domain or sub-domain
YIKAEEHCTDYLKRWIKTGQ

SEQ ID NO: 22966 - protein, 21 aa, artificial
  peptide fold or domain or sub-domain
YIKPLREREDVFPAESVNIIF

SEQ ID NO: 22967 - protein, 26 aa, artificial
  peptide fold or domain or sub-domain
YILKCSHTFNLLDARGAISVSQRQTY

SEQ ID NO: 22968 - protein, 27 aa, artificial
  peptide fold or domain or sub-domain
YILSDPVIMSQVQSYGPADLGPDGIRS

SEQ ID NO: 22969 - protein, 30 aa, artificial
  peptide fold or domain or sub-domain
YILYKPGKRTVKQSVRKSSEFSLEEWRIWT

SEQ ID NO: 22970 - protein, 27 aa, artificial
  peptide fold or domain or sub-domain
YIMLFIIWLRKRGDSSRTLARRLSSIR

SEQ ID NO: 22971 - protein, 22 aa, artificial
  peptide fold or domain or sub-domain
YINEKKPWELFKKEPEEARAVL

SEQ ID NO: 22972 - protein, 21 aa, artificial
  peptide fold or domain or sub-domain
YINFSEINFDLWILQPPGYEA

SEQ ID NO: 22973 - protein, 24 aa, artificial
  peptide fold or domain or sub-domain
YINLGNVLKEARIFDRAVAAYLRA

SEQ ID NO: 22974 - protein, 29 aa, artificial
  peptide fold or domain or sub-domain
YINTDNGPAYISQDFLNMCTSLAIRHTTH

SEQ ID NO: 22975 - protein, 30 aa, artificial
  peptide fold or domain or sub-domain
YIPCGKCEYCRSGNENLCPYKKSIGEEVQG

SEQ ID NO: 22976 - protein, 23 aa, artificial
  peptide fold or domain or sub-domain
YIPPELAYGENGSPPKIGPNEVL

SEQ ID NO: 22977 - protein, 22 aa, artificial
  peptide fold or domain or sub-domain
YIQDEKAWEKEQKESKRSDVIL

SEQ ID NO: 22978 - protein, 28 aa, artificial
  peptide fold or domain or sub-domain
YIQKNDDDDAASDTFLTMRTMRMPGFQS

SEQ ID NO: 22979 - protein, 30 aa, artificial
  peptide fold or domain or sub-domain
YIQKNQSELMPQRSSEFQNKLEWIKKLLQI

SEQ ID NO: 22980 - protein, 22 aa, artificial
  peptide fold or domain or sub-domain
YIQLIRPRTWTEADDPDKLAAY

SEQ ID NO: 22981 - protein, 21 aa, artificial
  peptide fold or domain or sub-domain
YIQQIGPFGTEAGNWITRQTQ

SEQ ID NO: 22982 - protein, 22 aa, artificial
  peptide fold or domain or sub-domain
YIQRNEPWNLVDDDPEEAEQVI

SEQ ID NO: 22983 - protein, 22 aa, artificial
  peptide fold or domain or sub-domain
YIQSLIKHAHDPAAERALAQCA

SEQ ID NO: 22984 - protein, 27 aa, artificial
  peptide fold or domain or sub-domain
YIRESRENPARTMIGTGKPKIHPTQPR

SEQ ID NO: 22985 - protein, 25 aa, artificial
  peptide fold or domain or sub-domain
YIRRHLVKGGIVKPQMLQRYATHYV

SEQ ID NO: 22986 - protein, 25 aa, artificial
  peptide fold or domain or sub-domain
YIRYHLLQKGKVRPNQLHRLGTSFV

SEQ ID NO: 22987 - protein, 20 aa, artificial
  peptide fold or domain or sub-domain
YISCKEKSKFNFEAAFIEDI

SEQ ID NO: 22988 - protein, 25 aa, artificial
  peptide fold or domain or sub-domain
YISDVSTNGTMVNGNKILKNQPVAI

SEQ ID NO: 22989 - protein, 24 aa, artificial
  peptide fold or domain or sub-domain
YISLGSALVQKGLLYEAIANFQKA

SEQ ID NO: 22990 - protein, 26 aa, artificial
  peptide fold or domain or sub-domain
YITARKAQACLDAAEELRQFGDCVAL

SEQ ID NO: 22991 - protein, 22 aa, artificial
  peptide fold or domain or sub-domain
YITNEAPWNLKTTDPDKMLEVL

SEQ ID NO: 22992 - protein, 27 aa, artificial
  peptide fold or domain or sub-domain
YITSNHAELVDKHWAYRSADSITMIRG

SEQ ID NO: 22993 - protein, 28 aa, artificial
  peptide fold or domain or sub-domain
YIVARADCDGSESKLRRAGAEKVVMLYR

SEQ ID NO: 22994 - protein, 28 aa, artificial
  peptide fold or domain or sub-domain
YIVVRTRYMREMLLMHKLGADEVIPDEL

SEQ ID NO: 22995 - protein, 30 aa, artificial
  peptide fold or domain or sub-domain
YKAETVADIDEIVTSHFGNDTPVERLIVTP

SEQ ID NO: 22996 - protein, 27 aa, artificial
  peptide fold or domain or sub-domain
YKAFVHSDAAKQINIDFRTRESTAKKI

SEQ ID NO: 22997 - protein, 28 aa, artificial
  peptide fold or domain or sub-domain
YKAGQRFYYTVFDSQDRRAALDTYVLRT

SEQ ID NO: 22998 - protein, 27 aa, artificial
  peptide fold or domain or sub-domain
YKAHILQQNYTPEWAEPITGISASDIR

SEQ ID NO: 22999 - protein, 21 aa, artificial
  peptide fold or domain or sub-domain
YKAKWWTQGDKPGASDVWELI

SEQ ID NO: 23000 - protein, 22 aa, artificial
  peptide fold or domain or sub-domain
YKANCIACHGENYEGVSGPSLK

SEQ ID NO: 23001 - protein, 23 aa, artificial
  peptide fold or domain or sub-domain
YKCKSIERCEISKISRNICQFCR

SEQ ID NO: 23002 - protein, 23 aa, artificial
  peptide fold or domain or sub-domain
YKCLKGGNCIITNESRCICRYCR

SEQ ID NO: 23003 - protein, 23 aa, artificial
  peptide fold or domain or sub-domain
YKCSFNNECIIEFKYRNRCRACR

SEQ ID NO: 23004 - protein, 20 aa, artificial
  peptide fold or domain or sub-domain
YKCSIKMRTIQDSAIAEKGL

SEQ ID NO: 23005 - protein, 24 aa, artificial
  peptide fold or domain or sub-domain
YKDATTLRLALERGEVDIAWRTLS

SEQ ID NO: 23006 - protein, 27 aa, artificial
  peptide fold or domain or sub-domain
YKDDSSMIREDTPVCGQRMIHEKIMSM

SEQ ID NO: 23007 - protein, 27 aa, artificial
  peptide fold or domain or sub-domain
YKDHSVSIWNGTECKGPEHIGKLLAEI

SEQ ID NO: 23008 - protein, 27 aa, artificial
  peptide fold or domain or sub-domain
YKDISMMSFENDQCRGTNQIIERLNKL

SEQ ID NO: 23009 - protein, 23 aa, artificial
  peptide fold or domain or sub-domain
YKDVAAAVSHHDNLEFLEDVVPK

SEQ ID NO: 23010 - protein, 25 aa, artificial
  peptide fold or domain or sub-domain
YKDVLKYFGENVSKPPAPEEFFKPL

SEQ ID NO: 23011 - protein, 24 aa, artificial
  peptide fold or domain or sub-domain
YKDYKIHWWENVYGFDMSCIKDVA

SEQ ID NO: 23012 - protein, 27 aa, artificial
  peptide fold or domain or sub-domain
YKEFITDNSAQQINIPGTISKQIEENY

SEQ ID NO: 23013 - protein, 23 aa, artificial
  peptide fold or domain or sub-domain
YKEHNGDESNIGVAEQFAYALSN

SEQ ID NO: 23014 - protein, 28 aa, artificial
  peptide fold or domain or sub-domain
YKEILLPDIKIFSQQDPSDVSEGYRRRT

SEQ ID NO: 23015 - protein, 26 aa, artificial
  peptide fold or domain or sub-domain
YKFEEGNASMRNLLGGKGCNLAEMTI

SEQ ID NO: 23016 - protein, 29 aa, artificial
  peptide fold or domain or sub-domain
YKFELVGADGHLLVKADPVARRTEAPPAT

SEQ ID NO: 23017 - protein, 29 aa, artificial
  peptide fold or domain or sub-domain
YKGNTTAIDKEIARFVPNSNMNFTGQAYS

SEQ ID NO: 23018 - protein, 23 aa, artificial
  peptide fold or domain or sub-domain
YKGPKKYRSLVRKTPAYYVPFTL

SEQ ID NO: 23019 - protein, 23 aa, artificial
  peptide fold or domain or sub-domain
YKHLASYVESEGSLEFLEQILPK

SEQ ID NO: 23020 - protein, 20 aa, artificial
  peptide fold or domain or sub-domain
YKIASAVDPDLVRIWENAGQ

SEQ ID NO: 23021 - protein, 27 aa, artificial
  peptide fold or domain or sub-domain
YKIYIQPQSPREINIDSSTRETIIRNI

SEQ ID NO: 23022 - protein, 25 aa, artificial
  peptide fold or domain or sub-domain
YKKAIQYMALDIAKPPPPEEFFTTL

SEQ ID NO: 23023 - protein, 21 aa, artificial
  peptide fold or domain or sub-domain
YKKFKSFFLKNGDFRSANSLV

SEQ ID NO: 23024 - protein, 20 aa, artificial
  peptide fold or domain or sub-domain
YKKLSSQLPFTEQQEGRIAE

SEQ ID NO: 23025 - protein, 25 aa, artificial
  peptide fold or domain or sub-domain
YKKNMFALLGKPGFEDEKAALMKRL

SEQ ID NO: 23026 - protein, 24 aa, artificial
  peptide fold or domain or sub-domain
YKKWMKNEWRNTKGEEVSNQDLIV

SEQ ID NO: 23027 - protein, 27 aa, artificial
  peptide fold or domain or sub-domain
YKLFLAPGARRWINIDGKTMDITVKGL

SEQ ID NO: 23028 - protein, 22 aa, artificial
  peptide fold or domain or sub-domain
YKLHYYHDGQAVRYFHSSANYT

SEQ ID NO: 23029 - protein, 24 aa, artificial
  peptide fold or domain or sub-domain
YKLIWPQFRAIPDSSLMNAVELRR

SEQ ID NO: 23030 - protein, 20 aa, artificial
  peptide fold or domain or sub-domain
YKLPVDQITGDQRSHVKAMS

SEQ ID NO: 23031 - protein, 25 aa, artificial
  peptide fold or domain or sub-domain
YKLRKITFKDRLDWAVNCSNDMEFD

SEQ ID NO: 23032 - protein, 25 aa, artificial
  peptide fold or domain or sub-domain
YKLRYQVYCEELHFEETNNHHIEQD

SEQ ID NO: 23033 - protein, 27 aa, artificial
  peptide fold or domain or sub-domain
YKLYLMIKQHMNGKYDVIKYNWCMRVS

SEQ ID NO: 23034 - protein, 26 aa, artificial
  peptide fold or domain or sub-domain
YKLYYMEKGTDKEQDVDVSSHSYTIN

SEQ ID NO: 23035 - protein, 24 aa, artificial
  peptide fold or domain or sub-domain
YKNGKLVGKFSDDKDKIFNHESWT

SEQ ID NO: 23036 - protein, 24 aa, artificial
  peptide fold or domain or sub-domain
YKNHGPIQHYLKPLRENQLPIVET

SEQ ID NO: 23037 - protein, 21 aa, artificial
  peptide fold or domain or sub-domain
YKNHQREPGDWLPNEFGGDAN

SEQ ID NO: 23038 - protein, 21 aa, artificial
  peptide fold or domain or sub-domain
YKNLLGNIIKRGKKVKAKLIL

SEQ ID NO: 23039 - protein, 24 aa, artificial
  peptide fold or domain or sub-domain
YKNRGNAKKELGVLKGACEDWKKA

SEQ ID NO: 23040 - protein, 27 aa, artificial
  peptide fold or domain or sub-domain
YKPASPLDDASYFHHAGDCLFNGLETQ

SEQ ID NO: 23041 - protein, 30 aa, artificial
  peptide fold or domain or sub-domain
YKPFEDLIQPARATDDHNKRVELYKQAQVV

SEQ ID NO: 23042 - protein, 28 aa, artificial
  peptide fold or domain or sub-domain
YKQEPGENPKLIIDIRSNMERKQTQGLI

SEQ ID NO: 23043 - protein, 27 aa, artificial
  peptide fold or domain or sub-domain
YKQHLASVEQELNDGLWAEAADRVRKL

SEQ ID NO: 23044 - protein, 20 aa, artificial
  peptide fold or domain or sub-domain
YKQIQRRNPEMLKQWEYCGQ

SEQ ID NO: 23045 - protein, 20 aa, artificial
  peptide fold or domain or sub-domain
YKQLLNDKHDLLQKWEGSGQ

SEQ ID NO: 23046 - protein, 28 aa, artificial
  peptide fold or domain or sub-domain
YKQPSSGGMILLIRQDSSNQQNATEGRY

SEQ ID NO: 23047 - protein, 30 aa, artificial
  peptide fold or domain or sub-domain
YKQVTEKVAHRIVEEHLAGGCSLKESLIYE

SEQ ID NO: 23048 - protein, 23 aa, artificial
  peptide fold or domain or sub-domain
YKRTLPEIGDELAKSVNNEFETL

SEQ ID NO: 23049 - protein, 27 aa, artificial
  peptide fold or domain or sub-domain
YKRYIENNSIVSKQLKPATKTYIRDGI

SEQ ID NO: 23050 - protein, 20 aa, artificial
  peptide fold or domain or sub-domain
YKTDEDGVLIKSADGKNIRD

SEQ ID NO: 23051 - protein, 20 aa, artificial
  peptide fold or domain or sub-domain
YKTLSLKLHEADLENVFYKI

SEQ ID NO: 23052 - protein, 27 aa, artificial
  peptide fold or domain or sub-domain
YKTYCLDESIDKIRFDPFIVEEIQRIA

SEQ ID NO: 23053 - protein, 24 aa, artificial
  peptide fold or domain or sub-domain
YKVGDNQNLPDSNRIYDYSEYEDV

SEQ ID NO: 23054 - protein, 23 aa, artificial
  peptide fold or domain or sub-domain
YKVIRVIDGDTIIVDKDGKQQNL

SEQ ID NO: 23055 - protein, 22 aa, artificial
  peptide fold or domain or sub-domain
YKVIYYKDGEALKYWYENHNIS

SEQ ID NO: 23056 - protein, 27 aa, artificial
  peptide fold or domain or sub-domain
YKVLWDGDGAAVIEEEGKTALYPHRHM

SEQ ID NO: 23057 - protein, 28 aa, artificial
  peptide fold or domain or sub-domain
YKVWEDAKHVQNYMKQNGLQTPADLQVN

SEQ ID NO: 23058 - protein, 26 aa, artificial
  peptide fold or domain or sub-domain
YKWLKNGQILPKEGEIYVEAGKLSIT

SEQ ID NO: 23059 - protein, 29 aa, artificial
  peptide fold or domain or sub-domain
YKYHIVGEDFEHDFVDPYCKALGVNGYRA

SEQ ID NO: 23060 - protein, 29 aa, artificial
  peptide fold or domain or sub-domain
YKYLVTTIDNKLLTKADPFAFYSNQYPYF

SEQ ID NO: 23061 - protein, 30 aa, artificial
  peptide fold or domain or sub-domain
YLAAYYPTSSPEDVLENTGFDLDVSKAVEL

SEQ ID NO: 23062 - protein, 28 aa, artificial
  peptide fold or domain or sub-domain
YLADLIQARGIAGMYEAISDTAEFGARQ

SEQ ID NO: 23063 - protein, 30 aa, artificial
  peptide fold or domain or sub-domain
YLAQWYSETNGRIPKTYKEKEDFRDLIRQG

SEQ ID NO: 23064 - protein, 26 aa, artificial
  peptide fold or domain or sub-domain
YLCATQSIGSLLSSHYDHVLKDSIPV

SEQ ID NO: 23065 - protein, 22 aa, artificial
  peptide fold or domain or sub-domain
YLDEKAPWKEIKVDKAAAARSL

SEQ ID NO: 23066 - protein, 27 aa, artificial
  peptide fold or domain or sub-domain
YLDKATLIWNGNAVSGLDALNNFFDTL

SEQ ID NO: 23067 - protein, 21 aa, artificial
  peptide fold or domain or sub-domain
YLDLKYLDMDDTIIAPRGITF

SEQ ID NO: 23068 - protein, 25 aa, artificial
  peptide fold or domain or sub-domain
YLDQVLRKSPKEMSQNELENIFNRS

SEQ ID NO: 23069 - protein, 25 aa, artificial
  peptide fold or domain or sub-domain
YLDSCLKLSIEKQKYKQVKQDLDAA

SEQ ID NO: 23070 - protein, 21 aa, artificial
  peptide fold or domain or sub-domain
YLDYGKKDGQWVPNKYGDNKN

SEQ ID NO: 23071 - protein, 25 aa, artificial
  peptide fold or domain or sub-domain
YLECGKLRLNINTCTLYKENIEVYL

SEQ ID NO: 23072 - protein, 26 aa, artificial
  peptide fold or domain or sub-domain
YLEDGATTDAVAEAKAAKLVLQDKVD

SEQ ID NO: 23073 - protein, 25 aa, artificial
  peptide fold or domain or sub-domain
YLEGYTYDSSLAATNPIVPRAGSKM

SEQ ID NO: 23074 - protein, 22 aa, artificial
  peptide fold or domain or sub-domain
YLEIAKVQIPREGVTERGRNTQ

SEQ ID NO: 23075 - protein, 30 aa, artificial
  peptide fold or domain or sub-domain
YLEKWKEAHNGNVPSNYKEKSEFREMVRSS

SEQ ID NO: 23076 - protein, 24 aa, artificial
  peptide fold or domain or sub-domain
YLESGKSKLEKKDFYGAIEDLNKE

SEQ ID NO: 23077 - protein, 30 aa, artificial
  peptide fold or domain or sub-domain
YLFAKLGIYVTISKSGEYYKVRVSRRGNLD

SEQ ID NO: 23078 - protein, 29 aa, artificial
  peptide fold or domain or sub-domain
YLFCICNNSEWMETVDQYAKAVTVNGEKG

SEQ ID NO: 23079 - protein, 27 aa, artificial
  peptide fold or domain or sub-domain
YLFGSSRSAGSVYSFKGKEYVVRELKD

SEQ ID NO: 23080 - protein, 29 aa, artificial
  peptide fold or domain or sub-domain
YLFKLITPDNSWWYGSAGLEAYMPTDTHM

SEQ ID NO: 23081 - protein, 21 aa, artificial
  peptide fold or domain or sub-domain
YLFPITKSTNSESVTFVKGII

SEQ ID NO: 23082 - protein, 24 aa, artificial
  peptide fold or domain or sub-domain
YLGYFDFSMDYEAKELKDNRSLHA

SEQ ID NO: 23083 - protein, 27 aa, artificial
  peptide fold or domain or sub-domain
YLHRDHVNYEEYGVDSLLFSYPEDSIQ

SEQ ID NO: 23084 - protein, 30 aa, artificial
  peptide fold or domain or sub-domain
YLHSIYPGFTAGAVQEEIGFKIDLTRAVEE

SEQ ID NO: 23085 - protein, 23 aa, artificial
  peptide fold or domain or sub-domain
YLHTYFLSERREGPLGKVALDGI

SEQ ID NO: 23086 - protein, 21 aa, artificial
  peptide fold or domain or sub-domain
YLIPISKCVSKSDEIFIRDVL

SEQ ID NO: 23087 - protein, 25 aa, artificial
  peptide fold or domain or sub-domain
YLIRLTKIAPQLSTEELVSLGEKMV

SEQ ID NO: 23088 - protein, 25 aa, artificial
  peptide fold or domain or sub-domain
YLKKVIALGTMPALETGNLAESEAG

SEQ ID NO: 23089 - protein, 30 aa, artificial
  peptide fold or domain or sub-domain
YLKLDEARLTFNADAFEGMAYIFKHRLVDN

SEQ ID NO: 23090 - protein, 21 aa, artificial
  peptide fold or domain or sub-domain
YLKPIVMSDNKEWSSIAKKIQ

SEQ ID NO: 23091 - protein, 21 aa, artificial
  peptide fold or domain or sub-domain
YLKPLREQNKLISSQVIQQIF

SEQ ID NO: 23092 - protein, 21 aa, artificial
  peptide fold or domain or sub-domain
YLKPLSDSKGILSSSEIKGLF

SEQ ID NO: 23093 - protein, 23 aa, artificial
  peptide fold or domain or sub-domain
YLKPSYAFGSVGKEKFQIPPNAE

SEQ ID NO: 23094 - protein, 26 aa, artificial
  peptide fold or domain or sub-domain
YLLAFDPQLGFNLYPDEPSGFREALE

SEQ ID NO: 23095 - protein, 26 aa, artificial
  peptide fold or domain or sub-domain
YLLDEVSLSMVSIVGRKSAYLGELYK

SEQ ID NO: 23096 - protein, 24 aa, artificial
  peptide fold or domain or sub-domain
YLLGDESLGRLGLPVVGEYPRKIM

SEQ ID NO: 23097 - protein, 22 aa, artificial
  peptide fold or domain or sub-domain
YLLRRYLESIYPGCEAKSTFLK

SEQ ID NO: 23098 - protein, 30 aa, artificial
  peptide fold or domain or sub-domain
YLMFQQVPMVEIDGMKLVQTRAILNYIASK

SEQ ID NO: 23099 - protein, 22 aa, artificial
  peptide fold or domain or sub-domain
YLNARAPWDLVKKDVDAANAVM

SEQ ID NO: 23100 - protein, 21 aa, artificial
  peptide fold or domain or sub-domain
YLNPIIKLVNKEHATTINELI

SEQ ID NO: 23101 - protein, 30 aa, artificial
  peptide fold or domain or sub-domain
YLNYVSGNNLLVKDGYEIPQEFDVFNKVVV

SEQ ID NO: 23102 - protein, 21 aa, artificial
  peptide fold or domain or sub-domain
YLPAMSKRIDIFSPNSIRLIF

SEQ ID NO: 23103 - protein, 27 aa, artificial
  peptide fold or domain or sub-domain
YLPNSSIVWNGTPVSGQQELTAMLNSM

SEQ ID NO: 23104 - protein, 25 aa, artificial
  peptide fold or domain or sub-domain
YLPPDKISPDVARVRGLAPGEGSYS

SEQ ID NO: 23105 - protein, 25 aa, artificial
  peptide fold or domain or sub-domain
YLQDLSTNGTFIFDRKLGKENKSKI

SEQ ID NO: 23106 - protein, 22 aa, artificial
  peptide fold or domain or sub-domain
YLQDTAAWKTIKSDKERAGDEI

SEQ ID NO: 23107 - protein, 20 aa, artificial
  peptide fold or domain or sub-domain
YLQENKNLSPNQIKTLLSDR

SEQ ID NO: 23108 - protein, 22 aa, artificial
  peptide fold or domain or sub-domain
YLQETEFWRLYKQNLSLCSLVM

SEQ ID NO: 23109 - protein, 30 aa, artificial
  peptide fold or domain or sub-domain
YLQIHSRTLSKARQVCDDMSADGATCAMRI

SEQ ID NO: 23110 - protein, 27 aa, artificial
  peptide fold or domain or sub-domain
YLQLQNDFEAQYIAANYNDALDTVARM

SEQ ID NO: 23111 - protein, 27 aa, artificial
  peptide fold or domain or sub-domain
YLQMYDEAEDMGGLNEKQRFHGRKLVA

SEQ ID NO: 23112 - protein, 20 aa, artificial
  peptide fold or domain or sub-domain
YLRAVPVDVIKASYGVNEEE

SEQ ID NO: 23113 - protein, 24 aa, artificial
  peptide fold or domain or sub-domain
YLRFGMGLAPRPAHLGYMDRRFVS

SEQ ID NO: 23114 - protein, 29 aa, artificial
  peptide fold or domain or sub-domain
YLRSECLNYSFTYDSPIPLNTLVNRLVLK

SEQ ID NO: 23115 - protein, 26 aa, artificial
  peptide fold or domain or sub-domain
YLSLCSMIIDTISEKGPCTGAMLAVS

SEQ ID NO: 23116 - protein, 26 aa, artificial
  peptide fold or domain or sub-domain
YLSSRTYAGKKLEEIFPSTLENSILS

SEQ ID NO: 23117 - protein, 29 aa, artificial
  peptide fold or domain or sub-domain
YLTGMHTPGRTGVWELYEKAVKEDPTLAY

SEQ ID NO: 23118 - protein, 28 aa, artificial
  peptide fold or domain or sub-domain
YLVLNKNDSYTADYVRSLDYKTEIIYQE

SEQ ID NO: 23119 - protein, 27 aa, artificial
  peptide fold or domain or sub-domain
YLVNFGIEGKTYTKNSDGTVSWTDEAN

SEQ ID NO: 23120 - protein, 21 aa, artificial
  peptide fold or domain or sub-domain
YLVPWKEDPDCLLCEHLPHLF

SEQ ID NO: 23121 - protein, 26 aa, artificial
  peptide fold or domain or sub-domain
YLVVKKVRDIYGAESVQTGFAKKSLA

SEQ ID NO: 23122 - protein, 24 aa, artificial
  peptide fold or domain or sub-domain
YLYGNDELRSLKLPVIYEYPLEFK

SEQ ID NO: 23123 - protein, 29 aa, artificial
  peptide fold or domain or sub-domain
YLYQLENYGKIRTTVDPYSKAVYANSKKS

SEQ ID NO: 23124 - protein, 29 aa, artificial
  peptide fold or domain or sub-domain
YLYRVTRDDGSVAWRSDMYSAQQCGTGDI

SEQ ID NO: 23125 - protein, 23 aa, artificial
  peptide fold or domain or sub-domain
YMCPATNQCTIDKNRRKSCQACR

SEQ ID NO: 23126 - protein, 25 aa, artificial
  peptide fold or domain or sub-domain
YMDDMLRSGLKCVSDAEMDNKLDNV

SEQ ID NO: 23127 - protein, 27 aa, artificial
  peptide fold or domain or sub-domain
YMDNGLLVWNGNGANGKDNIQKYFQEL

SEQ ID NO: 23128 - protein, 29 aa, artificial
  peptide fold or domain or sub-domain
YMFYLEDNYSIKWYSSDGFFDYMPQWGHF

SEQ ID NO: 23129 - protein, 27 aa, artificial
  peptide fold or domain or sub-domain
YMGTATLVWNGNAVSGQESLSEFFEML

SEQ ID NO: 23130 - protein, 25 aa, artificial
  peptide fold or domain or sub-domain
YMKLAIREGLAVPLQEGLQIEARYF

SEQ ID NO: 23131 - protein, 24 aa, artificial
  peptide fold or domain or sub-domain
YMLVNIDEGFLNLTNQDGTMKDNV

SEQ ID NO: 23132 - protein, 24 aa, artificial
  peptide fold or domain or sub-domain
YMNHGPLPKYLQAMEEGRRPVFES

SEQ ID NO: 23133 - protein, 23 aa, artificial
  peptide fold or domain or sub-domain
YMPVLKRVEDLRPKVAGNPEAEA

SEQ ID NO: 23134 - protein, 22 aa, artificial
  peptide fold or domain or sub-domain
YMQDNKPWDLSGKDNERCGQVL

SEQ ID NO: 23135 - protein, 22 aa, artificial
  peptide fold or domain or sub-domain
YMQKNEPWNKANQETGRHIVSL

SEQ ID NO: 23136 - protein, 20 aa, artificial
  peptide fold or domain or sub-domain
YMQKYPGYTNKQIRKLLQTN

SEQ ID NO: 23137 - protein, 29 aa, artificial
  peptide fold or domain or sub-domain
YMRNECSNYNYVYESQMRVERLVTKVADK

SEQ ID NO: 23138 - protein, 29 aa, artificial
  peptide fold or domain or sub-domain
YMRTECMAYRHSYNAEFPVRRLVSNLGNK

SEQ ID NO: 23139 - protein, 28 aa, artificial
  peptide fold or domain or sub-domain
YMSDKFQYKPSDFLQAGGNKEFVEKYNS

SEQ ID NO: 23140 - protein, 27 aa, artificial
  peptide fold or domain or sub-domain
YNAGRTIEALEKFVDRDQVPPVCGGTM

SEQ ID NO: 23141 - protein, 23 aa, artificial
  peptide fold or domain or sub-domain
YNAVHSDTTSHYRTFLLSLLGPN

SEQ ID NO: 23142 - protein, 23 aa, artificial
  peptide fold or domain or sub-domain
YNCKWSNNCFETSPYPLKCQSCR

SEQ ID NO: 23143 - protein, 25 aa, artificial
  peptide fold or domain or sub-domain
YNCSPSFNWKKHLDDATIAKFQKEL

SEQ ID NO: 23144 - protein, 20 aa, artificial
  peptide fold or domain or sub-domain
YNDAVENTLAIWNETLVDLE

SEQ ID NO: 23145 - protein, 20 aa, artificial
  peptide fold or domain or sub-domain
YNEAVRQGKMPADVRDKQME

SEQ ID NO: 23146 - protein, 27 aa, artificial
  peptide fold or domain or sub-domain
YNEFIKPDSPKEINLDYNMKEMLQQSL

SEQ ID NO: 23147 - protein, 27 aa, artificial
  peptide fold or domain or sub-domain
YNEFISVQATKEVNLDSCTREETSRNM

SEQ ID NO: 23148 - protein, 27 aa, artificial
  peptide fold or domain or sub-domain
YNEFVSTSAARQVNMDSSVRETTLQSL

SEQ ID NO: 23149 - protein, 20 aa, artificial
  peptide fold or domain or sub-domain
YNETIPSRMVTADLEPVSVE

SEQ ID NO: 23150 - protein, 20 aa, artificial
  peptide fold or domain or sub-domain
YNEVIATTTAVYNDDPLTPG

SEQ ID NO: 23151 - protein, 22 aa, artificial
  peptide fold or domain or sub-domain
YNFAGVEVPGAWRAPRITREDI

SEQ ID NO: 23152 - protein, 22 aa, artificial
  peptide fold or domain or sub-domain
YNHDTKISSELQKKEYKKEDLS

SEQ ID NO: 23153 - protein, 29 aa, artificial
  peptide fold or domain or sub-domain
YNIRQHTTDEDTIVLQPQEPGLPSFRIKP

SEQ ID NO: 23154 - protein, 28 aa, artificial
  peptide fold or domain or sub-domain
YNKEWCNKPSIMENVWNYVSLKYGMMLD

SEQ ID NO: 23155 - protein, 20 aa, artificial
  peptide fold or domain or sub-domain
YNKLKDKIKEYDMDELYYKV

SEQ ID NO: 23156 - protein, 22 aa, artificial
  peptide fold or domain or sub-domain
YNKSKEGSFYKTPGESTPPPSS

SEQ ID NO: 23157 - protein, 24 aa, artificial
  peptide fold or domain or sub-domain
YNKVKRALGSNAMEDGKGCFELYH

SEQ ID NO: 23158 - protein, 26 aa, artificial
  peptide fold or domain or sub-domain
YNLGWKLGQVLAGAPEALLDSYEEER

SEQ ID NO: 23159 - protein, 25 aa, artificial
  peptide fold or domain or sub-domain
YNLSPSFNWPKAMSVDEQHTFIQRL

SEQ ID NO: 23160 - protein, 27 aa, artificial
  peptide fold or domain or sub-domain
YNNGNPKPLFTHCHKSQIESTYNGDSK

SEQ ID NO: 23161 - protein, 24 aa, artificial
  peptide fold or domain or sub-domain
YNNLAMIYKQQGNCNHAITCFNEV

SEQ ID NO: 23162 - protein, 24 aa, artificial
  peptide fold or domain or sub-domain
YNNLGFVFQEKGNLSKASNYYQQA

SEQ ID NO: 23163 - protein, 24 aa, artificial
  peptide fold or domain or sub-domain
YNNRGLAKYDSKDYQGAIADYTKA

SEQ ID NO: 23164 - protein, 24 aa, artificial
  peptide fold or domain or sub-domain
YNNRGLAKYDSKDYQGTIADYNKA

SEQ ID NO: 23165 - protein, 27 aa, artificial
  peptide fold or domain or sub-domain
YNNRLIPISRGDVLPDRTKPEEFILYD

SEQ ID NO: 23166 - protein, 27 aa, artificial
  peptide fold or domain or sub-domain
YNPEHYPDWQVENSPEPGLYDIGAFGE

SEQ ID NO: 23167 - protein, 27 aa, artificial
  peptide fold or domain or sub-domain
YNPKGGCDEDGCVDFATIFSKSGGADK

SEQ ID NO: 23168 - protein, 20 aa, artificial
  peptide fold or domain or sub-domain
YNPLVEQGLMKVEAKERLAQ

SEQ ID NO: 23169 - protein, 27 aa, artificial
  peptide fold or domain or sub-domain
YNQHSSFVHGGLDSNRESTPAIGQKQI

SEQ ID NO: 23170 - protein, 20 aa, artificial
  peptide fold or domain or sub-domain
YNQKWAEQILTQDPTFFTEL

SEQ ID NO: 23171 - protein, 20 aa, artificial
  peptide fold or domain or sub-domain
YNQVVSGQHFDKATKQALAD

SEQ ID NO: 23172 - protein, 20 aa, artificial
  peptide fold or domain or sub-domain
YNRSASVNQAKLNLWLSEGQ

SEQ ID NO: 23173 - protein, 30 aa, artificial
  peptide fold or domain or sub-domain
YNRVLNYVLNHELNKNDSQLLEVNLLNQLK

SEQ ID NO: 23174 - protein, 26 aa, artificial
  peptide fold or domain or sub-domain
YNTGLERVWGPDSRDWVRYNQFRREL

SEQ ID NO: 23175 - protein, 27 aa, artificial
  peptide fold or domain or sub-domain
YNTYLAPSSQCELNIDHNLRNELAKYL

SEQ ID NO: 23176 - protein, 22 aa, artificial
  peptide fold or domain or sub-domain
YNVLYYRNGKAFKFFHWNSNLT

SEQ ID NO: 23177 - protein, 26 aa, artificial
  peptide fold or domain or sub-domain
YNVPIIVMTAKSQMEDMTKGFGLGAD

SEQ ID NO: 23178 - protein, 26 aa, artificial
  peptide fold or domain or sub-domain
YNWLGDRVQFIIDDKIVWTSTKNVPT

SEQ ID NO: 23179 - protein, 29 aa, artificial
  peptide fold or domain or sub-domain
YNYKVTVYGNTNIVIDPYAKTVGVNGLRG

SEQ ID NO: 23180 - protein, 24 aa, artificial
  peptide fold or domain or sub-domain
YNYNQSNIRNPGSEEYGRQTFTHE

SEQ ID NO: 23181 - protein, 22 aa, artificial
  peptide fold or domain or sub-domain
YPACGGQSSCGGASYSSSVAQG

SEQ ID NO: 23182 - protein, 20 aa, artificial
  peptide fold or domain or sub-domain
YPADSIHKAFRNDINEVYNF

SEQ ID NO: 23183 - protein, 29 aa, artificial
  peptide fold or domain or sub-domain
YPADTPLSAVDTNTMKGFQEWVSKAITDR

SEQ ID NO: 23184 - protein, 20 aa, artificial
  peptide fold or domain or sub-domain
YPAEGIESYYRNNMVDVAML

SEQ ID NO: 23185 - protein, 30 aa, artificial
  peptide fold or domain or sub-domain
YPAIYTYAKINGIRGIFRSDDAGMSWVRIN

SEQ ID NO: 23186 - protein, 26 aa, artificial
  peptide fold or domain or sub-domain
YPALDRFIARMAQQHGFPRDYLKGLF

SEQ ID NO: 23187 - protein, 27 aa, artificial
  peptide fold or domain or sub-domain
YPARHYAKLAARFPEAAAQLVIGSLGE

SEQ ID NO: 23188 - protein, 20 aa, artificial
  peptide fold or domain or sub-domain
YPATGIEANFRNSKVQTQQF

SEQ ID NO: 23189 - protein, 22 aa, artificial
  peptide fold or domain or sub-domain
YPAYEASAFNKGKTYGTSKASG

SEQ ID NO: 23190 - protein, 27 aa, artificial
  peptide fold or domain or sub-domain
YPDADHGFFCHERSSYNRLAAEDSWNE

SEQ ID NO: 23191 - protein, 27 aa, artificial
  peptide fold or domain or sub-domain
YPDAGHAFNADYRPSYHAESAKDGWQR

SEQ ID NO: 23192 - protein, 27 aa, artificial
  peptide fold or domain or sub-domain
YPDASHGFNCPDRASYHQRASALAHGR

SEQ ID NO: 23193 - protein, 25 aa, artificial
  peptide fold or domain or sub-domain
YPDIKHGGLYHENMRRPYFPVAVGK

SEQ ID NO: 23194 - protein, 24 aa, artificial
  peptide fold or domain or sub-domain
YPEEGAIIAAVDAGNTPVSGDFHQ

SEQ ID NO: 23195 - protein, 23 aa, artificial
  peptide fold or domain or sub-domain
YPEIITSTDGIHFKTASGHRMMD

SEQ ID NO: 23196 - protein, 30 aa, artificial
  peptide fold or domain or sub-domain
YPEKWIKDRDAEKKVRSGLYILTEDGYLRR

SEQ ID NO: 23197 - protein, 25 aa, artificial
  peptide fold or domain or sub-domain
YPELAIDGEMQVNFAMNRELRDAKY

SEQ ID NO: 23198 - protein, 28 aa, artificial
  peptide fold or domain or sub-domain
YPEQRRADLTHGLQRLALHLGVESFAQL

SEQ ID NO: 23199 - protein, 22 aa, artificial
  peptide fold or domain or sub-domain
YPERCWSHAPEQVQQPLLKAID

SEQ ID NO: 23200 - protein, 30 aa, artificial
  peptide fold or domain or sub-domain
YPFFLDGVAGQPGMQLEDGLHPSAKGVDLM

SEQ ID NO: 23201 - protein, 21 aa, artificial
  peptide fold or domain or sub-domain
YPFKEIAPQIGVTLERTRQLY

SEQ ID NO: 23202 - protein, 28 aa, artificial
  peptide fold or domain or sub-domain
YPFSPKQKHPPEYVREHLHLRSRVDFVA

SEQ ID NO: 23203 - protein, 27 aa, artificial
  peptide fold or domain or sub-domain
YPGAGHLYTDPGLDDYDAEAAEATWRV

SEQ ID NO: 23204 - protein, 27 aa, artificial
  peptide fold or domain or sub-domain
YPGAYHAFFNDRGRVYNKEASEDAWER

SEQ ID NO: 23205 - protein, 20 aa, artificial
  peptide fold or domain or sub-domain
YPGDIGDLWEDDPERLLEYN

SEQ ID NO: 23206 - protein, 27 aa, artificial
  peptide fold or domain or sub-domain
YPGGSHLFSDPLVADYRGDSAQLLLDR

SEQ ID NO: 23207 - protein, 22 aa, artificial
  peptide fold or domain or sub-domain
YPGLDEVEQLAAHVTGFKVSHH

SEQ ID NO: 23208 - protein, 27 aa, artificial
  peptide fold or domain or sub-domain
YPGLDHGFAATMGNRRNDEGARLADAR

SEQ ID NO: 23209 - protein, 24 aa, artificial
  peptide fold or domain or sub-domain
YPGLLWLMHDVTGNAFFKNQAEGW

SEQ ID NO: 23210 - protein, 21 aa, artificial
  peptide fold or domain or sub-domain
YPGLRVQGRFLYDKYGEKIIL

SEQ ID NO: 23211 - protein, 27 aa, artificial
  peptide fold or domain or sub-domain
YPGTHHGFAFPKRPVYDRDAAERHWER

SEQ ID NO: 23212 - protein, 27 aa, artificial
  peptide fold or domain or sub-domain
YPGTVHGFTMSDTGAFDAAALRLHWER

SEQ ID NO: 23213 - protein, 27 aa, artificial
  peptide fold or domain or sub-domain
YPGVNHGFHNDSTPRYDKSAADLAWQR

SEQ ID NO: 23214 - protein, 28 aa, artificial
  peptide fold or domain or sub-domain
YPGVVTQGVVRTAANVDDSWIGTNARDI

SEQ ID NO: 23215 - protein, 24 aa, artificial
  peptide fold or domain or sub-domain
YPHAFQINRQFQTLTVHLQKVAIE

SEQ ID NO: 23216 - protein, 26 aa, artificial
  peptide fold or domain or sub-domain
YPIVGLRAMISSIFGVDAQEAMMLLQ

SEQ ID NO: 23217 - protein, 23 aa, artificial
  peptide fold or domain or sub-domain
YPIVTYDELRRNLIRIEGPVRIQ

SEQ ID NO: 23218 - protein, 24 aa, artificial
  peptide fold or domain or sub-domain
YPKNGGYECGMINKAEPGATNPNS

SEQ ID NO: 23219 - protein, 23 aa, artificial
  peptide fold or domain or sub-domain
YPLAIKEAKGAILMDYDGNEIID

SEQ ID NO: 23220 - protein, 27 aa, artificial
  peptide fold or domain or sub-domain
YPLASSRSVGKTVTFRDQELDVLDLAE

SEQ ID NO: 23221 - protein, 24 aa, artificial
  peptide fold or domain or sub-domain
YPLCTLASNPRTLAHCIQYASIIL

SEQ ID NO: 23222 - protein, 30 aa, artificial
  peptide fold or domain or sub-domain
YPLFTNQKGNIRSEFTTDGLHLSPAGYVVW

SEQ ID NO: 23223 - protein, 23 aa, artificial
  peptide fold or domain or sub-domain
YPLIPVKAENAKVWDITGKEYID

SEQ ID NO: 23224 - protein, 29 aa, artificial
  peptide fold or domain or sub-domain
YPLNHLRRWAASPQSFTLDFGDYEDDYVS

SEQ ID NO: 23225 - protein, 29 aa, artificial
  peptide fold or domain or sub-domain
YPLSSIVTFGGCRDDFMLVVRKQTEDDAD

SEQ ID NO: 23226 - protein, 23 aa, artificial
  peptide fold or domain or sub-domain
YPLVAKRGHGVVIEDVDGNEFFD

SEQ ID NO: 23227 - protein, 23 aa, artificial
  peptide fold or domain or sub-domain
YPLVIDHGYGATLVDIEGKTYID

SEQ ID NO: 23228 - protein, 24 aa, artificial
  peptide fold or domain or sub-domain
YPMCSIINNPKTPEECILYVLNVS

SEQ ID NO: 23229 - protein, 27 aa, artificial
  peptide fold or domain or sub-domain
YPNAGHGFMNETQPAYNEAAANEAWKR

SEQ ID NO: 23230 - protein, 29 aa, artificial
  peptide fold or domain or sub-domain
YPPQWLKSSYIAYFQLPDIPEASLRENDY

SEQ ID NO: 23231 - protein, 27 aa, artificial
  peptide fold or domain or sub-domain
YPQAGHAFMRKESKTYQPQAAAAAFKE

SEQ ID NO: 23232 - protein, 27 aa, artificial
  peptide fold or domain or sub-domain
YPREHYLYWAREFPEQAELFVAPAFGE

SEQ ID NO: 23233 - protein, 27 aa, artificial
  peptide fold or domain or sub-domain
YPSEHYAHWRDAFPQMAEIYKPGGFGE

SEQ ID NO: 23234 - protein, 27 aa, artificial
  peptide fold or domain or sub-domain
YPSEHYPVWQQELGNKAIFQSAGAFGE

SEQ ID NO: 23235 - protein, 20 aa, artificial
  peptide fold or domain or sub-domain
YPVAEAARILDVPAGTIKSR

SEQ ID NO: 23236 - protein, 24 aa, artificial
  peptide fold or domain or sub-domain
YPVCTIRSTPSQPIHCVVWAKSYF

SEQ ID NO: 23237 - protein, 30 aa, artificial
  peptide fold or domain or sub-domain
YPVLFGFFTVDGVTGLFKTEDQGVNWQIIS

SEQ ID NO: 23238 - protein, 29 aa, artificial
  peptide fold or domain or sub-domain
YPVVQMATQSGKNVYLTVTKESGNSIVLL

SEQ ID NO: 23239 - protein, 29 aa, artificial
  peptide fold or domain or sub-domain
YPVVSAFQRVGGSISSLVDMIDTLKSECI

SEQ ID NO: 23240 - protein, 21 aa, artificial
  peptide fold or domain or sub-domain
YQAKYGKNSVACMDDGTMMYN

SEQ ID NO: 23241 - protein, 23 aa, artificial
  peptide fold or domain or sub-domain
YQAYREAPGRLSEPDQFVLQMLS

SEQ ID NO: 23242 - protein, 23 aa, artificial
  peptide fold or domain or sub-domain
YQCLRGAACPVTIATRKKCPACR

SEQ ID NO: 23243 - protein, 24 aa, artificial
  peptide fold or domain or sub-domain
YQDFFPKLEGKSGSALKGDPNMQA

SEQ ID NO: 23244 - protein, 26 aa, artificial
  peptide fold or domain or sub-domain
YQDLALKHGINDIFQGNGGKLLQVLL

SEQ ID NO: 23245 - protein, 21 aa, artificial
  peptide fold or domain or sub-domain
YQEIKDHFGLASFNSVQNYLK

SEQ ID NO: 23246 - protein, 29 aa, artificial
  peptide fold or domain or sub-domain
YQFKLIIQGEVIYYCNNDEKLGGQGMLKW

SEQ ID NO: 23247 - protein, 29 aa, artificial
  peptide fold or domain or sub-domain
YQFKLTDGSTIGYYVVANTSNTGPGVWSA

SEQ ID NO: 23248 - protein, 22 aa, artificial
  peptide fold or domain or sub-domain
YQFSEYIISSKDFNEVKKARIL

SEQ ID NO: 23249 - protein, 29 aa, artificial
  peptide fold or domain or sub-domain
YQFSITTQSGDVLKRNDPRARLLTNSVGA

SEQ ID NO: 23250 - protein, 27 aa, artificial
  peptide fold or domain or sub-domain
YQGEPHGFMIKEGELSESFVAQDAYDE

SEQ ID NO: 23251 - protein, 29 aa, artificial
  peptide fold or domain or sub-domain
YQIETSWGEKILKSDPYAFYSELRPQTAS

SEQ ID NO: 23252 - protein, 20 aa, artificial
  peptide fold or domain or sub-domain
YQKAVTRIPRLLRAWENCGC

SEQ ID NO: 23253 - protein, 28 aa, artificial
  peptide fold or domain or sub-domain
YQKIDAESYVFIPKEYSNSLYSQYVYYG

SEQ ID NO: 23254 - protein, 24 aa, artificial
  peptide fold or domain or sub-domain
YQKLGIALTKQGEFHQAAKIYLKA

SEQ ID NO: 23255 - protein, 24 aa, artificial
  peptide fold or domain or sub-domain
YQKMFSKFANVPQSELLGNGNFLA

SEQ ID NO: 23256 - protein, 20 aa, artificial
  peptide fold or domain or sub-domain
YQKWANTWQLSEDEIKQWKI

SEQ ID NO: 23257 - protein, 24 aa, artificial
  peptide fold or domain or sub-domain
YQLIDVKDGFLSLMSDDFCVLENI

SEQ ID NO: 23258 - protein, 25 aa, artificial
  peptide fold or domain or sub-domain
YQLRHRIFCNELKWVPRREDSQEVD

SEQ ID NO: 23259 - protein, 24 aa, artificial
  peptide fold or domain or sub-domain
YQLVGKQEANLEQQKISFTSPIGQ

SEQ ID NO: 23260 - protein, 26 aa, artificial
  peptide fold or domain or sub-domain
YQMPTGEEAEEKNDTGVKRTKSIPYA

SEQ ID NO: 23261 - protein, 24 aa, artificial
  peptide fold or domain or sub-domain
YQNCWNYIPGATPDWPAKKLEELT

SEQ ID NO: 23262 - protein, 28 aa, artificial
  peptide fold or domain or sub-domain
YQPTEILIPSSSLAPTVSKLATMIKFNV

SEQ ID NO: 23263 - protein, 25 aa, artificial
  peptide fold or domain or sub-domain
YQQEAGLQPTFEEMQILVSRNRVRP

SEQ ID NO: 23264 - protein, 27 aa, artificial
  peptide fold or domain or sub-domain
YQQHLCVGAPEGVNVDSHGRHCTEQAL

SEQ ID NO: 23265 - protein, 24 aa, artificial
  peptide fold or domain or sub-domain
YQQMFRFFQGVQLAFLVQSPKFAA

SEQ ID NO: 23266 - protein, 27 aa, artificial
  peptide fold or domain or sub-domain
YQQQTTLTWEGKFLSGADAIVKHIVEL

SEQ ID NO: 23267 - protein, 28 aa, artificial
  peptide fold or domain or sub-domain
YQQWRDNPKIQAFIKQHQLDGERGLQSY

SEQ ID NO: 23268 - protein, 26 aa, artificial
  peptide fold or domain or sub-domain
YQRSMPTEEFILFDSRIHFAGEHNDE

SEQ ID NO: 23269 - protein, 24 aa, artificial
  peptide fold or domain or sub-domain
YQRYFTAFMDTPLNELPANKRFQA

SEQ ID NO: 23270 - protein, 24 aa, artificial
  peptide fold or domain or sub-domain
YQSKFKAFKGLAVSALKGNPNAEK

SEQ ID NO: 23271 - protein, 22 aa, artificial
  peptide fold or domain or sub-domain
YQSLGQLERHFGRDGAVSWIDG

SEQ ID NO: 23272 - protein, 20 aa, artificial
  peptide fold or domain or sub-domain
YQTAVDNGFMTEEVKNTLVG

SEQ ID NO: 23273 - protein, 22 aa, artificial
  peptide fold or domain or sub-domain
YQTAVDNGFMTEEVKNTLVGQI

SEQ ID NO: 23274 - protein, 24 aa, artificial
  peptide fold or domain or sub-domain
YQTIRKCIAGKEQKSEAEVETFLL

SEQ ID NO: 23275 - protein, 24 aa, artificial
  peptide fold or domain or sub-domain
YQTNREGIYETRGDETGWARHHGF

SEQ ID NO: 23276 - protein, 28 aa, artificial
  peptide fold or domain or sub-domain
YQWASSGRPLVYDSLHANNVITKFRGKT

SEQ ID NO: 23277 - protein, 27 aa, artificial
  peptide fold or domain or sub-domain
YRAAKRDLPELEAHLGRGELLPLRDWL

SEQ ID NO: 23278 - protein, 25 aa, artificial
  peptide fold or domain or sub-domain
YRACKKCKRLTPEKTCPIHPDEKTT

SEQ ID NO: 23279 - protein, 26 aa, artificial
  peptide fold or domain or sub-domain
YRAFKALDRENTGQVQVRMPEWLKLT

SEQ ID NO: 23280 - protein, 29 aa, artificial
  peptide fold or domain or sub-domain
YRAFSQNFALSEDFGANLDALWDVVTGEI

SEQ ID NO: 23281 - protein, 26 aa, artificial
  peptide fold or domain or sub-domain
YRARAERQFRIVKPDATQQEIKAALD

SEQ ID NO: 23282 - protein, 23 aa, artificial
  peptide fold or domain or sub-domain
YRCKHTNTCLIDPDGRCACRSCR

SEQ ID NO: 23283 - protein, 28 aa, artificial
  peptide fold or domain or sub-domain
YRDELFTHPQIFNNKYPSNINGAFRGRT

SEQ ID NO: 23284 - protein, 29 aa, artificial
  peptide fold or domain or sub-domain
YRDFSQTFGLAKDKVRDLDSLWDVLMNDV

SEQ ID NO: 23285 - protein, 26 aa, artificial
  peptide fold or domain or sub-domain
YRDQIARQYRIVNPDASEEEVQEAAN

SEQ ID NO: 23286 - protein, 21 aa, artificial
  peptide fold or domain or sub-domain
YRDYSRPADAWVPNRYGGREN

SEQ ID NO: 23287 - protein, 28 aa, artificial
  peptide fold or domain or sub-domain
YREGSFTMDDSELVGAGMHRLGSVLVPL

SEQ ID NO: 23288 - protein, 21 aa, artificial
  peptide fold or domain or sub-domain
YREIMKHFSLASPASVHKHIQ

SEQ ID NO: 23289 - protein, 30 aa, artificial
  peptide fold or domain or sub-domain
YREKDIYGPGFKDNFQGDIDIAKNLAVLKI

SEQ ID NO: 23290 - protein, 26 aa, artificial
  peptide fold or domain or sub-domain
YRETVQRRYFTVTGENPDERTLDRLI

SEQ ID NO: 23291 - protein, 29 aa, artificial
  peptide fold or domain or sub-domain
YRFDIYDGTSFACLSGDGLHTSDDINNNF

SEQ ID NO: 23292 - protein, 29 aa, artificial
  peptide fold or domain or sub-domain
YRFQINDGTSTAWYNGNGPSSTEPNADDF

SEQ ID NO: 23293 - protein, 25 aa, artificial
  peptide fold or domain or sub-domain
YRFRHRVFVEHAGWELPCYGPLEFD

SEQ ID NO: 23294 - protein, 29 aa, artificial
  peptide fold or domain or sub-domain
YRFVMAVTKEKEMKALLAPYVDLPASFTF

SEQ ID NO: 23295 - protein, 30 aa, artificial
  peptide fold or domain or sub-domain
YRIKPDEIARVWGENPERIKNGIFILSKSV

SEQ ID NO: 23296 - protein, 24 aa, artificial
  peptide fold or domain or sub-domain
YRIMLSVPGLVDAFGEAGETVQNC

SEQ ID NO: 23297 - protein, 24 aa, artificial
  peptide fold or domain or sub-domain
YRIVGDDEADFKQNLISVNSPIAR

SEQ ID NO: 23298 - protein, 23 aa, artificial
  peptide fold or domain or sub-domain
YRLAVKWGWFDGETPDKTRANLK

SEQ ID NO: 23299 - protein, 26 aa, artificial
  peptide fold or domain or sub-domain
YRLFCTEVSTGKEQNIEVDGLSYKLE

SEQ ID NO: 23300 - protein, 23 aa, artificial
  peptide fold or domain or sub-domain
YRLIIKWGWFGWGDTVHKRRRLR

SEQ ID NO: 23301 - protein, 23 aa, artificial
  peptide fold or domain or sub-domain
YRLILKWCPIEASEPKTLQRRIR

SEQ ID NO: 23302 - protein, 20 aa, artificial
  peptide fold or domain or sub-domain
YRLPLVEVTDDMRRRAKTAN

SEQ ID NO: 23303 - protein, 23 aa, artificial
  peptide fold or domain or sub-domain
YRLYVKWISIEGANKQEMFAKRN

SEQ ID NO: 23304 - protein, 20 aa, artificial
  peptide fold or domain or sub-domain
YRMLYGRLGSHGLLPAFLKQ

SEQ ID NO: 23305 - protein, 20 aa, artificial
  peptide fold or domain or sub-domain
YRNFSRKILQAVEDGVIDLG

SEQ ID NO: 23306 - protein, 23 aa, artificial
  peptide fold or domain or sub-domain
YRPIENRLRSLQEKYAADRAGSE

SEQ ID NO: 23307 - protein, 27 aa, artificial
  peptide fold or domain or sub-domain
YRPNTLLTWQKEQVQGVDAIMARFANL

SEQ ID NO: 23308 - protein, 24 aa, artificial
  peptide fold or domain or sub-domain
YRPTGAEHLPEAFRGLDPDNTFHV

SEQ ID NO: 23309 - protein, 30 aa, artificial
  peptide fold or domain or sub-domain
YRQATPDVIERIIQEHLIGDQVVEDYAFCT

SEQ ID NO: 23310 - protein, 21 aa, artificial
  peptide fold or domain or sub-domain
YRQLIASTGEDLHRPGLEDTP

SEQ ID NO: 23311 - protein, 30 aa, artificial
  peptide fold or domain or sub-domain
YRQMTPERAKEVVRAHLGEGVPMREWATYE

SEQ ID NO: 23312 - protein, 29 aa, artificial
  peptide fold or domain or sub-domain
YRQPTIENLKLMMDIFVFDTSDLTDALFE

SEQ ID NO: 23313 - protein, 20 aa, artificial
  peptide fold or domain or sub-domain
YRQSSDLKPKTTRSWVRWGQ

SEQ ID NO: 23314 - protein, 25 aa, artificial
  peptide fold or domain or sub-domain
YRRAEERGDWNLLKKQEVARKRREK

SEQ ID NO: 23315 - protein, 27 aa, artificial
  peptide fold or domain or sub-domain
YRRFIKKDGQQVVRLHGSTRNHVAESI

SEQ ID NO: 23316 - protein, 27 aa, artificial
  peptide fold or domain or sub-domain
YRSEVHTLAIPQITDPALRAAASAVAE

SEQ ID NO: 23317 - protein, 29 aa, artificial
  peptide fold or domain or sub-domain
YRSYHGSTLGASAMTGVDRWRDPFPALPG

SEQ ID NO: 23318 - protein, 23 aa, artificial
  peptide fold or domain or sub-domain
YRTSAVNRRIGGARFSQHINGLA

SEQ ID NO: 23319 - protein, 24 aa, artificial
  peptide fold or domain or sub-domain
YRVLDMQDGSIVAMTETGDVKQNL

SEQ ID NO: 23320 - protein, 30 aa, artificial
  peptide fold or domain or sub-domain
YRVRDDGEVLRLVQQHLVQGEPVADLRIPA

SEQ ID NO: 23321 - protein, 29 aa, artificial
  peptide fold or domain or sub-domain
YRWKDISNVINHKKTFRIECQAEGEEPKQ

SEQ ID NO: 23322 - protein, 26 aa, artificial
  peptide fold or domain or sub-domain
YRWLKNGVPLSPQSRVEMVNGVLMIH

SEQ ID NO: 23323 - protein, 27 aa, artificial
  peptide fold or domain or sub-domain
YRWYVQNSSAVLCRLKPSTRTQVKECV

SEQ ID NO: 23324 - protein, 21 aa, artificial
  peptide fold or domain or sub-domain
YSAAEAKRLFPQFVFPDDHTV

SEQ ID NO: 23325 - protein, 25 aa, artificial
  peptide fold or domain or sub-domain
YSAFSDDVLEAAFNTNVQQLERIFG

SEQ ID NO: 23326 - protein, 23 aa, artificial
  peptide fold or domain or sub-domain
YSAIKSDTSGDYEITLLKICGGD

SEQ ID NO: 23327 - protein, 29 aa, artificial
  peptide fold or domain or sub-domain
YSCDANFQRIHDFDAVSGCEGGPAFSCAD

SEQ ID NO: 23328 - protein, 30 aa, artificial
  peptide fold or domain or sub-domain
YSCHLPDVDRKVNLEVCEYFGQRCRHYSDD

SEQ ID NO: 23329 - protein, 23 aa, artificial
  peptide fold or domain or sub-domain
YSCKAKKMCQLEGGGRSMCRYCR

SEQ ID NO: 23330 - protein, 27 aa, artificial
  peptide fold or domain or sub-domain
YSCPCPGASCKWQGSLDAVMPHLMHQH

SEQ ID NO: 23331 - protein, 27 aa, artificial
  peptide fold or domain or sub-domain
YSCPYAGSECGIVGDIPFLVAHLRDDH

SEQ ID NO: 23332 - protein, 23 aa, artificial
  peptide fold or domain or sub-domain
YSCRFGGDCPVVKEHRNVCRSCR

SEQ ID NO: 23333 - protein, 28 aa, artificial
  peptide fold or domain or sub-domain
YSCWNNSLRIVDWMKRENISSFQDAAIF

SEQ ID NO: 23334 - protein, 24 aa, artificial
  peptide fold or domain or sub-domain
YSDADEWEMWKSRSDPVLHIDLRR

SEQ ID NO: 23335 - protein, 23 aa, artificial
  peptide fold or domain or sub-domain
YSDLANTAQQSETFQFLADILPK

SEQ ID NO: 23336 - protein, 30 aa, artificial
  peptide fold or domain or sub-domain
YSDVSPDRVKRIIEQHIIGQQPVDEWILKR

SEQ ID NO: 23337 - protein, 29 aa, artificial
  peptide fold or domain or sub-domain
YSDWKEKKTYLNPWKKIDSAPLALLHKIL

SEQ ID NO: 23338 - protein, 24 aa, artificial
  peptide fold or domain or sub-domain
YSEEYHGSLEGFERMIDEDRKEYA

SEQ ID NO: 23339 - protein, 29 aa, artificial
  peptide fold or domain or sub-domain
YSEEYHGSLEGFERMIDEDRKEYASASML

SEQ ID NO: 23340 - protein, 27 aa, artificial
  peptide fold or domain or sub-domain
YSEFVAEHSPKEVNLDSDTRAATKAAV

SEQ ID NO: 23341 - protein, 30 aa, artificial
  peptide fold or domain or sub-domain
YSEGSTKKENNEFEFKGIIYKPRKDTHWKT

SEQ ID NO: 23342 - protein, 29 aa, artificial
  peptide fold or domain or sub-domain
YSEHTEPTCIKSIGWRRDGSNAIMISIVY

SEQ ID NO: 23343 - protein, 25 aa, artificial
  peptide fold or domain or sub-domain
YSELHPNISRPDIYPEMRNYTEDDI

SEQ ID NO: 23344 - protein, 26 aa, artificial
  peptide fold or domain or sub-domain
YSETWSEGDVRDRVLGDEFDSTMNYR

SEQ ID NO: 23345 - protein, 29 aa, artificial
  peptide fold or domain or sub-domain
YSEVVVRAEENKVRLFVVWEGKERPLTFL

SEQ ID NO: 23346 - protein, 28 aa, artificial
  peptide fold or domain or sub-domain
YSFEQAITQLFQQLSLSIPDTIEPVIGV

SEQ ID NO: 23347 - protein, 26 aa, artificial
  peptide fold or domain or sub-domain
YSFKEADYRNKKLFGGKGASLIQMTQ

SEQ ID NO: 23348 - protein, 27 aa, artificial
  peptide fold or domain or sub-domain
YSFNINETLSALMALGYTEKEAQKALE

SEQ ID NO: 23349 - protein, 30 aa, artificial
  peptide fold or domain or sub-domain
YSFNSVADLDEILETHIVGGGRVERLMLAP

SEQ ID NO: 23350 - protein, 28 aa, artificial
  peptide fold or domain or sub-domain
YSFVNLQGKLQHIYIDQKYTEAASYRLL

SEQ ID NO: 23351 - protein, 27 aa, artificial
  peptide fold or domain or sub-domain
YSGAPHAFSVFGSDRYDARADERSWKR

SEQ ID NO: 23352 - protein, 30 aa, artificial
  peptide fold or domain or sub-domain
YSGIQPHEVPLLVEQHLLGGQKVQQMLYYR

SEQ ID NO: 23353 - protein, 20 aa, artificial
  peptide fold or domain or sub-domain
YSGTKIRKKMLEGSAWEHLV

SEQ ID NO: 23354 - protein, 30 aa, artificial
  peptide fold or domain or sub-domain
YSHVSVNDVEEIVERTLMKGEAIERLLLTD

SEQ ID NO: 23355 - protein, 20 aa, artificial
  peptide fold or domain or sub-domain
YSIEHLCDLLHINTLVINQY

SEQ ID NO: 23356 - protein, 24 aa, artificial
  peptide fold or domain or sub-domain
YSIKELCLENPDQRLNQTQYTQPA

SEQ ID NO: 23357 - protein, 27 aa, artificial
  peptide fold or domain or sub-domain
YSISHFTTWSKELPDRTNRFRPGAFGE

SEQ ID NO: 23358 - protein, 27 aa, artificial
  peptide fold or domain or sub-domain
YSKFMGTIENGENCKTCDRDVWECPGH

SEQ ID NO: 23359 - protein, 22 aa, artificial
  peptide fold or domain or sub-domain
YSKFSEGASYSDHTLPMEKMDD

SEQ ID NO: 23360 - protein, 21 aa, artificial
  peptide fold or domain or sub-domain
YSKLESRGIASTIKAAKKMVE

SEQ ID NO: 23361 - protein, 26 aa, artificial
  peptide fold or domain or sub-domain
YSKNKDQCCNLLISKGINIAPFLQEI

SEQ ID NO: 23362 - protein, 25 aa, artificial
  peptide fold or domain or sub-domain
YSKVCQLYGEDTSKLPKSEDFFKNF

SEQ ID NO: 23363 - protein, 25 aa, artificial
  peptide fold or domain or sub-domain
YSKVQELSAEYDMVTSQQLPVDNSF

SEQ ID NO: 23364 - protein, 21 aa, artificial
  peptide fold or domain or sub-domain
YSLAEIGRALDLSRERVRQIE

SEQ ID NO: 23365 - protein, 30 aa, artificial
  peptide fold or domain or sub-domain
YSLALKNGKVIAWGSSRTAPSSVQSGVSSI

SEQ ID NO: 23366 - protein, 24 aa, artificial
  peptide fold or domain or sub-domain
YSLDASALASDADGTLLFKDPSDF

SEQ ID NO: 23367 - protein, 27 aa, artificial
  peptide fold or domain or sub-domain
YSLHGYETIIKRHPLMHRTVVMGSIGE

SEQ ID NO: 23368 - protein, 23 aa, artificial
  peptide fold or domain or sub-domain
YSLPLSLGGSKAAIDEWVANNCG

SEQ ID NO: 23369 - protein, 26 aa, artificial
  peptide fold or domain or sub-domain
YSLRNRSDMKTLQGVSVSGSTYRIGD

SEQ ID NO: 23370 - protein, 25 aa, artificial
  peptide fold or domain or sub-domain
YSMFDLAYGYAQNQMSAYVELQERE

SEQ ID NO: 23371 - protein, 28 aa, artificial
  peptide fold or domain or sub-domain
YSNGVVSSVTANKIVVNDKTGKRLTYKL

SEQ ID NO: 23372 - protein, 29 aa, artificial
  peptide fold or domain or sub-domain
YSNKLDLSEVAMPKDKFWPILAYGRSKLC

SEQ ID NO: 23373 - protein, 24 aa, artificial
  peptide fold or domain or sub-domain
YSNLGFIFLEKGQIESAIINSEKS

SEQ ID NO: 23374 - protein, 24 aa, artificial
  peptide fold or domain or sub-domain
YSNLGNILKELSNFTDAINQFKDA

SEQ ID NO: 23375 - protein, 24 aa, artificial
  peptide fold or domain or sub-domain
YSNLGNVLKDLGKLKDAELSYRKA

SEQ ID NO: 23376 - protein, 24 aa, artificial
  peptide fold or domain or sub-domain
YSNLGNVYKERGQLQEAIEHYRHA

SEQ ID NO: 23377 - protein, 24 aa, artificial
  peptide fold or domain or sub-domain
YSNMGNTLKEMQDVQGALQCYTRA

SEQ ID NO: 23378 - protein, 30 aa, artificial
  peptide fold or domain or sub-domain
YSNPELVLPLSEKWIKSENKWTRRFGVVTL

SEQ ID NO: 23379 - protein, 24 aa, artificial
  peptide fold or domain or sub-domain
YSNRGYAKSHLGDTQGAIADYTKA

SEQ ID NO: 23380 - protein, 24 aa, artificial
  peptide fold or domain or sub-domain
YSPKGADRVLPQFKDDKQPEKWVG

SEQ ID NO: 23381 - protein, 27 aa, artificial
  peptide fold or domain or sub-domain
YSPTAQMIFNGTHCRGIEAIQQQLERM

SEQ ID NO: 23382 - protein, 26 aa, artificial
  peptide fold or domain or sub-domain
YSQCGDVMRALGQNPTNAEVLKVLGN

SEQ ID NO: 23383 - protein, 27 aa, artificial
  peptide fold or domain or sub-domain
YSRDHYAIWREEIGENSRLDQPGAFGE

SEQ ID NO: 23384 - protein, 25 aa, artificial
  peptide fold or domain or sub-domain
YSRFFKENSEVSLPQIPPDLVKECK

SEQ ID NO: 23385 - protein, 20 aa, artificial
  peptide fold or domain or sub-domain
YSRYNNKKVFSQAQQHMMRR

SEQ ID NO: 23386 - protein, 23 aa, artificial
  peptide fold or domain or sub-domain
YSSDDGGDEFNASHILLESEEAA

SEQ ID NO: 23387 - protein, 20 aa, artificial
  peptide fold or domain or sub-domain
YSSGNLVQGESRPITDGKSI

SEQ ID NO: 23388 - protein, 23 aa, artificial
  peptide fold or domain or sub-domain
YSSLQDAVKGDCQSALLALCRAE

SEQ ID NO: 23389 - protein, 29 aa, artificial
  peptide fold or domain or sub-domain
YSSNNTGVATVNASGLVTAVANGTATITV

SEQ ID NO: 23390 - protein, 30 aa, artificial
  peptide fold or domain or sub-domain
YSSRQHATNVGIMFRGKENALLPNWLHLPV

SEQ ID NO: 23391 - protein, 22 aa, artificial
  peptide fold or domain or sub-domain
YSSVEAEAGLRERNVRGRARAE

SEQ ID NO: 23392 - protein, 30 aa, artificial
  peptide fold or domain or sub-domain
YSVETENSLLITSYGILIHNCFPKDVKALI

SEQ ID NO: 23393 - protein, 20 aa, artificial
  peptide fold or domain or sub-domain
YSVSKEHVTASMRNIAKIIN

SEQ ID NO: 23394 - protein, 26 aa, artificial
  peptide fold or domain or sub-domain
YSWIHSPNGSNENVNQLMALARKLLG

SEQ ID NO: 23395 - protein, 22 aa, artificial
  peptide fold or domain or sub-domain
YSWSCSSAQCINTSDPSEVLIK

SEQ ID NO: 23396 - protein, 28 aa, artificial
  peptide fold or domain or sub-domain
YSYNIYKGLQNQHRFTEESLYHFKLHSV

SEQ ID NO: 23397 - protein, 29 aa, artificial
  peptide fold or domain or sub-domain
YSYRLSLRGETIESVDPYARAVTANGTHG

SEQ ID NO: 23398 - protein, 29 aa, artificial
  peptide fold or domain or sub-domain
YTAASVIDTASKYKMLWKLPLEDADIIKG

SEQ ID NO: 23399 - protein, 29 aa, artificial
  peptide fold or domain or sub-domain
YTAESTASGGGRNGHVKSSDDKIDFDTRP

SEQ ID NO: 23400 - protein, 23 aa, artificial
  peptide fold or domain or sub-domain
YTALQKQFKAELLQGLLAICRAE

SEQ ID NO: 23401 - protein, 27 aa, artificial
  peptide fold or domain or sub-domain
YTASQSQQHINQYGYQSNVGPDASYYS

SEQ ID NO: 23402 - protein, 23 aa, artificial
  peptide fold or domain or sub-domain
YTCAESQDCKIDKTQRKRCPFCR

SEQ ID NO: 23403 - protein, 23 aa, artificial
  peptide fold or domain or sub-domain
YTCHRDKNCIINKVTRNRCQYCR

SEQ ID NO: 23404 - protein, 23 aa, artificial
  peptide fold or domain or sub-domain
YTCRRQESCYNMDGGNRKCKACR

SEQ ID NO: 23405 - protein, 26 aa, artificial
  peptide fold or domain or sub-domain
YTDCTESGQNLCLCEGSNVCGQGNKC

SEQ ID NO: 23406 - protein, 25 aa, artificial
  peptide fold or domain or sub-domain
YTDGLLKKSTKGLSETDLEAKLDSA

SEQ ID NO: 23407 - protein, 29 aa, artificial
  peptide fold or domain or sub-domain
YTDKIVEKLECLREVGLGYLKLGQSSSTL

SEQ ID NO: 23408 - protein, 30 aa, artificial
  peptide fold or domain or sub-domain
YTEEEVNHIFIKIKNKENISREERNKYATK

SEQ ID NO: 23409 - protein, 30 aa, artificial
  peptide fold or domain or sub-domain
YTEGEIKTIFNKIYGGSELTKEEVLKFKSA

SEQ ID NO: 23410 - protein, 21 aa, artificial
  peptide fold or domain or sub-domain
YTERYMGLPTPEDNLDHYRNS

SEQ ID NO: 23411 - protein, 25 aa, artificial
  peptide fold or domain or sub-domain
YTFHEVITAGSDASSKLRALQNRCL

SEQ ID NO: 23412 - protein, 21 aa, artificial
  peptide fold or domain or sub-domain
YTFLSDGNEYVTSGGSVVGVE

SEQ ID NO: 23413 - protein, 30 aa, artificial
  peptide fold or domain or sub-domain
YTFVSPTGEKVQLTNLEKFCAAYALDSAHM

SEQ ID NO: 23414 - protein, 21 aa, artificial
  peptide fold or domain or sub-domain
YTGDPKDASWLTDEQKAGFTP

SEQ ID NO: 23415 - protein, 30 aa, artificial
  peptide fold or domain or sub-domain
YTGGEVAFKERLLPLLGLEDLPQVTEPTVL

SEQ ID NO: 23416 - protein, 25 aa, artificial
  peptide fold or domain or sub-domain
YTGQSVAAIAKATGEDAWDTFFGLC

SEQ ID NO: 23417 - protein, 29 aa, artificial
  peptide fold or domain or sub-domain
YTIEMDRRFAEALEADFQGSNVTVIHGNA

SEQ ID NO: 23418 - protein, 30 aa, artificial
  peptide fold or domain or sub-domain
YTISSTEDVDQILMRHVSQGERVPELMLPA

SEQ ID NO: 23419 - protein, 24 aa, artificial
  peptide fold or domain or sub-domain
YTIVGSAESDPLSGKISNDSPMGK

SEQ ID NO: 23420 - protein, 22 aa, artificial
  peptide fold or domain or sub-domain
YTKANEGYPYADGIPANQVSGD

SEQ ID NO: 23421 - protein, 22 aa, artificial
  peptide fold or domain or sub-domain
YTKDAATTNVNGEVRDELRDLQ

SEQ ID NO: 23422 - protein, 22 aa, artificial
  peptide fold or domain or sub-domain
YTKDNEGSPYFGANSTDTLPGA

SEQ ID NO: 23423 - protein, 23 aa, artificial
  peptide fold or domain or sub-domain
YTLKDIANKINLSLTPVHDRVKR

SEQ ID NO: 23424 - protein, 29 aa, artificial
  peptide fold or domain or sub-domain
YTLLETMNTGDGMLLAKKQKEILDFYQGI

SEQ ID NO: 23425 - protein, 24 aa, artificial
  peptide fold or domain or sub-domain
YTLLGPWDADIDKNIISYLSPIGK

SEQ ID NO: 23426 - protein, 20 aa, artificial
  peptide fold or domain or sub-domain
YTLVNGCVLIEGDELTEERP

SEQ ID NO: 23427 - protein, 24 aa, artificial
  peptide fold or domain or sub-domain
YTNCYTGNEWDTSLCPDGKTCAAN

SEQ ID NO: 23428 - protein, 27 aa, artificial
  peptide fold or domain or sub-domain
YTNDSMMTFENNSFKGQAQILEKLLSN

SEQ ID NO: 23429 - protein, 25 aa, artificial
  peptide fold or domain or sub-domain
YTPFANGPNDTPEEILLRIGNGKFS

SEQ ID NO: 23430 - protein, 24 aa, artificial
  peptide fold or domain or sub-domain
YTPKGANELRANLNDPQAQQAWYG

SEQ ID NO: 23431 - protein, 24 aa, artificial
  peptide fold or domain or sub-domain
YTPKGFDQLTRKYSDANTPPHWVG

SEQ ID NO: 23432 - protein, 27 aa, artificial
  peptide fold or domain or sub-domain
YTPSAHVVHRFEKANGAAELSSLLTSL

SEQ ID NO: 23433 - protein, 23 aa, artificial
  peptide fold or domain or sub-domain
YTPVEERIHDFLKRHRGDLEAEE

SEQ ID NO: 23434 - protein, 20 aa, artificial
  peptide fold or domain or sub-domain
YTPYPEWKSWNWQSEKDYFL

SEQ ID NO: 23435 - protein, 27 aa, artificial
  peptide fold or domain or sub-domain
YTQNASFNHMGHKATDIMEIEDAVSKL

SEQ ID NO: 23436 - protein, 27 aa, artificial
  peptide fold or domain or sub-domain
YTQVSNAVWNGNPINGYDSICEFMKAL

SEQ ID NO: 23437 - protein, 30 aa, artificial
  peptide fold or domain or sub-domain
YTQVTPEDAEEIISEHIIGGRRIERLLYID

SEQ ID NO: 23438 - protein, 28 aa, artificial
  peptide fold or domain or sub-domain
YTSFCENNLRTTRKGDYFAVEDAVAPTS

SEQ ID NO: 23439 - protein, 28 aa, artificial
  peptide fold or domain or sub-domain
YTSRKEATEHILSGAVSLGHKPILDSNY

SEQ ID NO: 23440 - protein, 25 aa, artificial
  peptide fold or domain or sub-domain
YTSSDDDEILSVARDEGSKLIKRPL

SEQ ID NO: 23441 - protein, 26 aa, artificial
  peptide fold or domain or sub-domain
YTTAGSDAKREMLSRLGVEYVGDSRS

SEQ ID NO: 23442 - protein, 25 aa, artificial
  peptide fold or domain or sub-domain
YTTPSLSGSERSRGSRLRSDLFPQD

SEQ ID NO: 23443 - protein, 20 aa, artificial
  peptide fold or domain or sub-domain
YTTSTVAAAGACQDKLGYIC

SEQ ID NO: 23444 - protein, 22 aa, artificial
  peptide fold or domain or sub-domain
YTTVIARSVLEEVGVTGKKQRP

SEQ ID NO: 23445 - protein, 23 aa, artificial
  peptide fold or domain or sub-domain
YTVLHVADGDSFTLTKEREEVEI

SEQ ID NO: 23446 - protein, 30 aa, artificial
  peptide fold or domain or sub-domain
YTYIDKEDIDEIIDEHLVHGRIVTRLRLPD

SEQ ID NO: 23447 - protein, 29 aa, artificial
  peptide fold or domain or sub-domain
YTYKVKIGDKWTEAVDPYARAASVNGDKG

SEQ ID NO: 23448 - protein, 30 aa, artificial
  peptide fold or domain or sub-domain
YVAATNYQLDDFRPYLYKTTDYGKTWKKIV

SEQ ID NO: 23449 - protein, 23 aa, artificial
  peptide fold or domain or sub-domain
YVAEGADLLLSGSEVMRLLGCGP

SEQ ID NO: 23450 - protein, 24 aa, artificial
  peptide fold or domain or sub-domain
YVAGKPPEELERTYADAGVDGSIH

SEQ ID NO: 23451 - protein, 25 aa, artificial
  peptide fold or domain or sub-domain
YVATDDERIKSAVEGFGGKVVMTSP

SEQ ID NO: 23452 - protein, 25 aa, artificial
  peptide fold or domain or sub-domain
YVATDNQDIFDVVSQAGATAVMTSE

SEQ ID NO: 23453 - protein, 25 aa, artificial
  peptide fold or domain or sub-domain
YVATDSEEIANVIKKISGKVIFTDS

SEQ ID NO: 23454 - protein, 26 aa, artificial
  peptide fold or domain or sub-domain
YVCDMNFGAMADLEQQFPNVTALELN

SEQ ID NO: 23455 - protein, 30 aa, artificial
  peptide fold or domain or sub-domain
YVCPGSHRPREAKSCGGPDSFYCASWGCET

SEQ ID NO: 23456 - protein, 23 aa, artificial
  peptide fold or domain or sub-domain
YVCRESGQCPVDRRKRTRCQHCR

SEQ ID NO: 23457 - protein, 23 aa, artificial
  peptide fold or domain or sub-domain
YVCVRGGKCEISRQHRNRCPACR

SEQ ID NO: 23458 - protein, 21 aa, artificial
  peptide fold or domain or sub-domain
YVDFSDVHWNDWIVAPAGYQA

SEQ ID NO: 23459 - protein, 20 aa, artificial
  peptide fold or domain or sub-domain
YVDGIPVAGKTHRYVIDLMH

SEQ ID NO: 23460 - protein, 27 aa, artificial
  peptide fold or domain or sub-domain
YVDRFFKTLRAEQATQDVKNWMTDTLL

SEQ ID NO: 23461 - protein, 24 aa, artificial
  peptide fold or domain or sub-domain
YVEDLRALAYPNSLLTKYKEVAER

SEQ ID NO: 23462 - protein, 20 aa, artificial
  peptide fold or domain or sub-domain
YVFVNGVITVKGKEVLDISA

SEQ ID NO: 23463 - protein, 29 aa, artificial
  peptide fold or domain or sub-domain
YVFVYLDEQKDLKPGTAHFSVQTAGGNTA

SEQ ID NO: 23464 - protein, 27 aa, artificial
  peptide fold or domain or sub-domain
YVGANHGWTVPGSQAYNEPAAEKAWSE

SEQ ID NO: 23465 - protein, 27 aa, artificial
  peptide fold or domain or sub-domain
YVGMAHGWCVPDHSVYNQAGAERHWQR

SEQ ID NO: 23466 - protein, 25 aa, artificial
  peptide fold or domain or sub-domain
YVHELIMQMAKTDDLQQREENYDEI

SEQ ID NO: 23467 - protein, 27 aa, artificial
  peptide fold or domain or sub-domain
YVHGSNLEKLYQHIPKRLLPKEYGGEG

SEQ ID NO: 23468 - protein, 24 aa, artificial
  peptide fold or domain or sub-domain
YVHNLGETLRSKGLEFAENCKVFE

SEQ ID NO: 23469 - protein, 23 aa, artificial
  peptide fold or domain or sub-domain
YVHSTPTLCHAATNRSNYASCYL

SEQ ID NO: 23470 - protein, 28 aa, artificial
  peptide fold or domain or sub-domain
YVIAKVRNLQEMKHLHHLGADEIIPEEY

SEQ ID NO: 23471 - protein, 20 aa, artificial
  peptide fold or domain or sub-domain
YVIINGSLTVAQGKHTGSRT

SEQ ID NO: 23472 - protein, 20 aa, artificial
  peptide fold or domain or sub-domain
YVITPWPEKYKSILPTKCEW

SEQ ID NO: 23473 - protein, 27 aa, artificial
  peptide fold or domain or sub-domain
YVKEGNGLHLDSIYIDHINVRAYGYLI

SEQ ID NO: 23474 - protein, 28 aa, artificial
  peptide fold or domain or sub-domain
YVKKTSGLEWNIEDRICQFGGLVSSCNV

SEQ ID NO: 23475 - protein, 24 aa, artificial
  peptide fold or domain or sub-domain
YVKSRSRGPIEEAIQYGAIEVESY

SEQ ID NO: 23476 - protein, 25 aa, artificial
  peptide fold or domain or sub-domain
YVLDKSLNGTFVNDVKVTSQTKVPL

SEQ ID NO: 23477 - protein, 20 aa, artificial
  peptide fold or domain or sub-domain
YVLVNGKIALAGGKQTDVCA

SEQ ID NO: 23478 - protein, 20 aa, artificial
  peptide fold or domain or sub-domain
YVNDTCVLGFTHNEMVNVFK

SEQ ID NO: 23479 - protein, 22 aa, artificial
  peptide fold or domain or sub-domain
YVNGVSTQGMTLEEVNRALDMS

SEQ ID NO: 23480 - protein, 25 aa, artificial
  peptide fold or domain or sub-domain
YVNQSVAEIAKSRGTSEVQTFSDLL

SEQ ID NO: 23481 - protein, 29 aa, artificial
  peptide fold or domain or sub-domain
YVNREAIWKGIAAGNFLEHTEFLGNIYGT

SEQ ID NO: 23482 - protein, 24 aa, artificial
  peptide fold or domain or sub-domain
YVNSCQDCENCNSSLENHCSKCVV

SEQ ID NO: 23483 - protein, 20 aa, artificial
  peptide fold or domain or sub-domain
YVPFNSKGKKYHLTIQSDRW

SEQ ID NO: 23484 - protein, 24 aa, artificial
  peptide fold or domain or sub-domain
YVPQCYECKFCLNPKTNLCQKIRV

SEQ ID NO: 23485 - protein, 25 aa, artificial
  peptide fold or domain or sub-domain
YVRHHLLKQGFTKPNDLHKKSSRIV

SEQ ID NO: 23486 - protein, 27 aa, artificial
  peptide fold or domain or sub-domain
YVRKSYLENPDNPKPELRGKDEFVRVS

SEQ ID NO: 23487 - protein, 21 aa, artificial
  peptide fold or domain or sub-domain
YVRQCRKRADMFSEEQLRTIF

SEQ ID NO: 23488 - protein, 22 aa, artificial
  peptide fold or domain or sub-domain
YVRRNRRRFWKNEDALDREAAY

SEQ ID NO: 23489 - protein, 25 aa, artificial
  peptide fold or domain or sub-domain
YVRTKIVEKGNMKLAHLNEQTVKYV

SEQ ID NO: 23490 - protein, 30 aa, artificial
  peptide fold or domain or sub-domain
YVSFDGHRSDNRAPWLFRTTDGGKTWANLS

SEQ ID NO: 23491 - protein, 20 aa, artificial
  peptide fold or domain or sub-domain
YVSNESAIRFGSVSCLYYDN

SEQ ID NO: 23492 - protein, 24 aa, artificial
  peptide fold or domain or sub-domain
YVSPQTTKLEPLLGGPFMEGTVNG

SEQ ID NO: 23493 - protein, 29 aa, artificial
  peptide fold or domain or sub-domain
YVSQQEFQDLVQQGAFLEHAKFGGNRYGT

SEQ ID NO: 23494 - protein, 29 aa, artificial
  peptide fold or domain or sub-domain
YVSRETFESLMYGHRMLEFGEYKGHLYGT

SEQ ID NO: 23495 - protein, 25 aa, artificial
  peptide fold or domain or sub-domain
YVSTDDTEIRDVSQAAGAHVIHRPV

SEQ ID NO: 23496 - protein, 30 aa, artificial
  peptide fold or domain or sub-domain
YVVAVDPVEFKRDMALKFGATHAFATAEEA

SEQ ID NO: 23497 - protein, 28 aa, artificial
  peptide fold or domain or sub-domain
YVVLDHEDGVTKKFIEESYPDLHIIEQR

SEQ ID NO: 23498 - protein, 30 aa, artificial
  peptide fold or domain or sub-domain
YVVRNELDVRRIFEEHILKGRRVLDLEIPE

SEQ ID NO: 23499 - protein, 28 aa, artificial
  peptide fold or domain or sub-domain
YVVSKADEQVAMDKLLIAGADKVVSPYM

SEQ ID NO: 23500 - protein, 28 aa, artificial
  peptide fold or domain or sub-domain
YVVVEGRRRDFTLVGAKGIGEYEKALAQ

SEQ ID NO: 23501 - protein, 29 aa, artificial
  peptide fold or domain or sub-domain
YVVVFGASRDKDLERMLPELAPAVDALVL

SEQ ID NO: 23502 - protein, 29 aa, artificial
  peptide fold or domain or sub-domain
YWADGSDASRQALMKLVTLETTKFQYTDG

SEQ ID NO: 23503 - protein, 27 aa, artificial
  peptide fold or domain or sub-domain
YWFVLRPSELSYYKTRSEKDRCGSLPI

SEQ ID NO: 23504 - protein, 27 aa, artificial
  peptide fold or domain or sub-domain
YWFVLTAENLSWYKDDEEKEKKYMLSV

SEQ ID NO: 23505 - protein, 20 aa, artificial
  peptide fold or domain or sub-domain
YWKEGAEKEPEAYSAFFSSQ

SEQ ID NO: 23506 - protein, 26 aa, artificial
  peptide fold or domain or sub-domain
YWLDQIKLQDRAKVGDKAFYLSRIRQ

SEQ ID NO: 23507 - protein, 30 aa, artificial
  peptide fold or domain or sub-domain
YWRKWQAQDLATPLAFAHNPSRVWEFYHYR

SEQ ID NO: 23508 - protein, 23 aa, artificial
  peptide fold or domain or sub-domain
YWSGLVVTVDPSPDRFTRMAGEM

SEQ ID NO: 23509 - protein, 28 aa, artificial
  peptide fold or domain or sub-domain
YYAGTFNFGDEKLKDMNINRLGNVFVPD

SEQ ID NO: 23510 - protein, 26 aa, artificial
  peptide fold or domain or sub-domain
YYAPTRLDYYNVIKPELAPGALDDYL

SEQ ID NO: 23511 - protein, 24 aa, artificial
  peptide fold or domain or sub-domain
YYDDIRLAFYAQKKETIDFITQQF

SEQ ID NO: 23512 - protein, 25 aa, artificial
  peptide fold or domain or sub-domain
YYDLVPSDPSVEEMRKVVCEQKLRP

SEQ ID NO: 23513 - protein, 30 aa, artificial
  peptide fold or domain or sub-domain
YYDVTEANLDRIIREHLVGGTPVAELIYHQ

SEQ ID NO: 23514 - protein, 28 aa, artificial
  peptide fold or domain or sub-domain
YYDYSGKRQVVIHSGDPKLVDKRFRGRA

SEQ ID NO: 23515 - protein, 21 aa, artificial
  peptide fold or domain or sub-domain
YYELKKKKIITTISFIDDYYK

SEQ ID NO: 23516 - protein, 21 aa, artificial
  peptide fold or domain or sub-domain
YYEPLNENKGIIPKNKLDVIF

SEQ ID NO: 23517 - protein, 27 aa, artificial
  peptide fold or domain or sub-domain
YYFADVAQNVHCKCWNSQLPEFLGGSC

SEQ ID NO: 23518 - protein, 22 aa, artificial
  peptide fold or domain or sub-domain
YYFDTAMYEKYSLQLLDRENLN

SEQ ID NO: 23519 - protein, 29 aa, artificial
  peptide fold or domain or sub-domain
YYFKLVANDTSYYYFEDGFYTEAEMNHQD

SEQ ID NO: 23520 - protein, 27 aa, artificial
  peptide fold or domain or sub-domain
YYHIKKDIPDFEEKVAKAEFDPIKAWL

SEQ ID NO: 23521 - protein, 29 aa, artificial
  peptide fold or domain or sub-domain
YYILTYHSKNNERALQQVQVPNKKNSYLI

SEQ ID NO: 23522 - protein, 22 aa, artificial
  peptide fold or domain or sub-domain
YYISVLKNVRGRVDFERYGTCI

SEQ ID NO: 23523 - protein, 22 aa, artificial
  peptide fold or domain or sub-domain
YYKEHEGAIYPDNTTDFQRADD

SEQ ID NO: 23524 - protein, 23 aa, artificial
  peptide fold or domain or sub-domain
YYKTLSQRINLKHCSVDLEELKK

SEQ ID NO: 23525 - protein, 25 aa, artificial
  peptide fold or domain or sub-domain
YYLKHREYLDQMPAEDRSDKLAEIN

SEQ ID NO: 23526 - protein, 25 aa, artificial
  peptide fold or domain or sub-domain
YYLPFNFERVYNEFTGGVVDKGEGK

SEQ ID NO: 23527 - protein, 24 aa, artificial
  peptide fold or domain or sub-domain
YYNLGNVLQDLKRYREALDNYDKV

SEQ ID NO: 23528 - protein, 24 aa, artificial
  peptide fold or domain or sub-domain
YYNRGNAKRKLGDNQGAIADCSKA

SEQ ID NO: 23529 - protein, 24 aa, artificial
  peptide fold or domain or sub-domain
YYNRGYAKSHLGDTQGAITDYTKA

SEQ ID NO: 23530 - protein, 23 aa, artificial
  peptide fold or domain or sub-domain
YYPGKVVVPPGTEGLSYTGNEKV

SEQ ID NO: 23531 - protein, 23 aa, artificial
  peptide fold or domain or sub-domain
YYQNLKKRVGDVLSDDQIKECEE

SEQ ID NO: 23532 - protein, 23 aa, artificial
  peptide fold or domain or sub-domain
YYQQPGKERQIRAAGHEPHLLAR

SEQ ID NO: 23533 - protein, 23 aa, artificial
  peptide fold or domain or sub-domain
YYQQQRNSSYFNYASLDWDTLQC

SEQ ID NO: 23534 - protein, 21 aa, artificial
  peptide fold or domain or sub-domain
YYREMVKETSPFREEDVKQIF

SEQ ID NO: 23535 - protein, 24 aa, artificial
  peptide fold or domain or sub-domain
YYRGCGKCDFCINGQENLCTNPEM

SEQ ID NO: 23536 - protein, 29 aa, artificial
  peptide fold or domain or sub-domain
YYRITYGETGGNSPVQEFTVPGSKSTATI

SEQ ID NO: 23537 - protein, 30 aa, artificial
  peptide fold or domain or sub-domain
YYRVQPEHVPLIVTQHFVGNKPVDDLLNPR

SEQ ID NO: 23538 - protein, 23 aa, artificial
  peptide fold or domain or sub-domain
YYSETKKQKEIYSVGLEPQMLAQ

SEQ ID NO: 23539 - protein, 23 aa, artificial
  peptide fold or domain or sub-domain
YYSKLDERLKHLFPNSIPKILKE

SEQ ID NO: 23540 - protein, 25 aa, artificial
  peptide fold or domain or sub-domain
YYSVDGLKLYDSLTKRERLISRKQQ

SEQ ID NO: 23541 - protein, 24 aa, artificial
  peptide fold or domain or sub-domain
YYSWANILKQQGNLTEAKVLYEKC

SEQ ID NO: 23542 - protein, 24 aa, artificial
  peptide fold or domain or sub-domain
YYTDSSNDQIIEVFNEGTDTVRSA

SEQ ID NO: 23543 - protein, 23 aa, artificial
  peptide fold or domain or sub-domain
YYTEVGKLDEMKLVGKDPAILKE

SEQ ID NO: 23544 - protein, 24 aa, artificial
  peptide fold or domain or sub-domain
YYTFADAQEFGYTMGQIPGELPSY

SEQ ID NO: 23545 - protein, 23 aa, artificial
  peptide fold or domain or sub-domain
YYTQLKQRLEIPLSSAELEAIAQ

SEQ ID NO: 23546 - protein, 28 aa, artificial
  peptide fold or domain or sub-domain
YYVGRFEIDDVFLKELGIHRLGNILIPV

SEQ ID NO: 23547 - protein, 29 aa, artificial
  peptide fold or domain or sub-domain
YYVTERCQDGWFKGANRQQKSGVFPGNYV

SEQ ID NO: 23548 - protein, 29 aa, artificial
  peptide fold or domain or sub-domain
YYWPRIAKVYYKGRYFMLRISDKNLSTYG

SEQ ID NO: 23549 - protein, 29 aa, artificial
  peptide fold or domain or sub-domain
MIFDGKVAIITGGGKAKSIGYGIAVAYAK

SEQ ID NO: 23550 - protein, 13 aa, artificial
  peptide fold or domain or sub-domain
AGEPANNEDRFNY

SEQ ID NO: 23551 - protein, 20 aa, artificial
  peptide fold or domain or sub-domain
MKLIAKTRILNTLVFSAAGK

SEQ ID NO: 23552 - protein, 17 aa, artificial
  peptide fold or domain or sub-domain
PAQPFRIKKRQGPFERP

SEQ ID NO: 23553 - protein, 15 aa, artificial
  peptide fold or domain or sub-domain
MTKDEPLEGNVGVLT

SEQ ID NO: 23554 - protein, 18 aa, artificial
  peptide fold or domain or sub-domain
KPSGCGEQNMINFYPNVL

SEQ ID NO: 23555 - protein, 24 aa, artificial
  peptide fold or domain or sub-domain
MNGRPSVFTSQDYLSDHLWRALNA

SEQ ID NO: 23556 - protein, 25 aa, artificial
  peptide fold or domain or sub-domain
MFSLSNSQYTCQDYISDHIWKTSSH

SEQ ID NO: 23557 - protein, 19 aa, artificial
  peptide fold or domain or sub-domain
GIGGKPVQTAFVDNDGIYD

SEQ ID NO: 23558 - protein, 15 aa, artificial
  peptide fold or domain or sub-domain
MTYQTAIDAVRELKA

SEQ ID NO: 23559 - protein, 20 aa, artificial
  peptide fold or domain or sub-domain
WAENNMILTRVVSNSPEIIR

SEQ ID NO: 23560 - protein, 28 aa, artificial
  peptide fold or domain or sub-domain
VGLLGSCTNSSYEDMTRYTVSPGSVQQR

SEQ ID NO: 23561 - protein, 25 aa, artificial
  peptide fold or domain or sub-domain
SDTATRVQKIVVEHLGVESDKVTQE

SEQ ID NO: 23562 - protein, 22 aa, artificial
  peptide fold or domain or sub-domain
SAALAGTIIDGASLGFDILNKV

SEQ ID NO: 23563 - protein, 19 aa, artificial
  peptide fold or domain or sub-domain
MLKSEVSKQISMPLTAPAF

SEQ ID NO: 23564 - protein, 13 aa, artificial
  peptide fold or domain or sub-domain
YDDGSYKPHIYGF

SEQ ID NO: 23565 - protein, 22 aa, artificial
  peptide fold or domain or sub-domain
MKTKAAVLFETHKPFEIVELEL

SEQ ID NO: 23566 - protein, 23 aa, artificial
  peptide fold or domain or sub-domain
MLYANPNTESSPVGFRKKYDNFI

SEQ ID NO: 23567 - protein, 15 aa, artificial
  peptide fold or domain or sub-domain
ANDPQCLYGNVAAKF

SEQ ID NO: 23568 - protein, 15 aa, artificial
  peptide fold or domain or sub-domain
VAGPFRIPPLRREFQ

SEQ ID NO: 23569 - protein, 25 aa, artificial
  peptide fold or domain or sub-domain
QSERFEQQMQGQDFSHDERFLSQAA

SEQ ID NO: 23570 - protein, 16 aa, artificial
  peptide fold or domain or sub-domain
SDYSRKRDPPQKYEEE

SEQ ID NO: 23571 - protein, 25 aa, artificial
  peptide fold or domain or sub-domain
GLWDDLKAAAKKVVSSLASAAIEKL

SEQ ID NO: 23572 - protein, 18 aa, artificial
  peptide fold or domain or sub-domain
LAKTVPLNDGTNFPIFGG

SEQ ID NO: 23573 - protein, 25 aa, artificial
  peptide fold or domain or sub-domain
SVINTQIKPFKTQAFKNGKFIEVTE

SEQ ID NO: 23574 - protein, 27 aa, artificial
  peptide fold or domain or sub-domain
SFREQCVPGREITYECLNACAEYAVRQ

SEQ ID NO: 23575 - protein, 18 aa, artificial
  peptide fold or domain or sub-domain
EYDDMYTEKRPKVYAFGL

SEQ ID NO: 23576 - protein, 16 aa, artificial
  peptide fold or domain or sub-domain
DPLNEERRANRYGFGL

SEQ ID NO: 23577 - protein, 27 aa, artificial
  peptide fold or domain or sub-domain
GYEDEDEDRPFYALGLGKRPRTYSFGL

SEQ ID NO: 23578 - protein, 25 aa, artificial
  peptide fold or domain or sub-domain
TKSQTHVPIRPNKLVLKVQKDRATN

SEQ ID NO: 23579 - protein, 24 aa, artificial
  peptide fold or domain or sub-domain
AFANTGVEIVSIDTYLFSLYDEDK

SEQ ID NO: 23580 - protein, 17 aa, artificial
  peptide fold or domain or sub-domain
ANPTFGFTPLGLSSDAN

SEQ ID NO: 23581 - protein, 21 aa, artificial
  peptide fold or domain or sub-domain
APSQSTVTALLTSCVSYIDDQ

SEQ ID NO: 23582 - protein, 17 aa, artificial
  peptide fold or domain or sub-domain
VAVKATTTEEETEIPAK

SEQ ID NO: 23583 - protein, 14 aa, artificial
  peptide fold or domain or sub-domain
QGRLGTQWAVGHLM

SEQ ID NO: 23584 - protein, 15 aa, artificial
  peptide fold or domain or sub-domain
ESGINLQGDATLANN

SEQ ID NO: 23585 - protein, 12 aa, artificial
  peptide fold or domain or sub-domain
LRPAVIVRTKAL

SEQ ID NO: 23586 - protein, 26 aa, artificial
  peptide fold or domain or sub-domain
MNQKHLLRFIKKSYRVDADRVVYDAK

SEQ ID NO: 23587 - protein, 26 aa, artificial
  peptide fold or domain or sub-domain
DPAFRLPTTTRPRHYQAAIPDFSAGA

SEQ ID NO: 23588 - protein, 30 aa, artificial
  peptide fold or domain or sub-domain
AKLDETLTMLKALTDAKGVPGNEREARDVM

SEQ ID NO: 23589 - protein, 25 aa, artificial
  peptide fold or domain or sub-domain
RSVCRQIKICRRRGGCYYKCTNRPY

SEQ ID NO: 23590 - protein, 22 aa, artificial
  peptide fold or domain or sub-domain
GLSRSCFGVKLDRIGSMSGLGC

SEQ ID NO: 23591 - protein, 11 aa, artificial
  peptide fold or domain or sub-domain
APGDRIYVHPF

SEQ ID NO: 23592 - protein, 28 aa, artificial
  peptide fold or domain or sub-domain
APDFSTLELIPDKLKEFGNTLEEKARMA

SEQ ID NO: 23593 - protein, 20 aa, artificial
  peptide fold or domain or sub-domain
VYINKLTPPCGTMYYACEAV

SEQ ID NO: 23594 - protein, 25 aa, artificial
  peptide fold or domain or sub-domain
ANFPTVSLNTVGITRQIPQDFMNAV

SEQ ID NO: 23595 - protein, 20 aa, artificial
  peptide fold or domain or sub-domain
MKVFVLNGPNLGRLGKREPA

SEQ ID NO: 23596 - protein, 28 aa, artificial
  peptide fold or domain or sub-domain
TRRTAFLFDELSLWHSASQYALILPVGG

SEQ ID NO: 23597 - protein, 28 aa, artificial
  peptide fold or domain or sub-domain
MDVAEYAAHDATGLAELIREGQVSACEV

SEQ ID NO: 23598 - protein, 11 aa, artificial
  peptide fold or domain or sub-domain
TEFATNDGGQR

SEQ ID NO: 23599 - protein, 20 aa, artificial
  peptide fold or domain or sub-domain
TSAEVPATAQGVTHALEGTQ

SEQ ID NO: 23600 - protein, 14 aa, artificial
  peptide fold or domain or sub-domain
SPLEQFSILMLIPM

SEQ ID NO: 23601 - protein, 29 aa, artificial
  peptide fold or domain or sub-domain
MQLVLAAKYIGAAIATIGLIGADDKTSNM

SEQ ID NO: 23602 - protein, 29 aa, artificial
  peptide fold or domain or sub-domain
DIIMSTNTFSEEAEALLKEALETYLKEFA

SEQ ID NO: 23603 - protein, 16 aa, artificial
  peptide fold or domain or sub-domain
GLFDIVKKVVGTIAGL

SEQ ID NO: 23604 - protein, 16 aa, artificial
  peptide fold or domain or sub-domain
GLFDIAKKVIGVIGSL

SEQ ID NO: 23605 - protein, 17 aa, artificial
  peptide fold or domain or sub-domain
GLFDIVKKIAGHIVSSI

SEQ ID NO: 23606 - protein, 25 aa, artificial
  peptide fold or domain or sub-domain
GLLDIVTGLLGNLIVDVLKPKTPAS

SEQ ID NO: 23607 - protein, 15 aa, artificial
  peptide fold or domain or sub-domain
DSIDYSKVPGNWRTI

SEQ ID NO: 23608 - protein, 17 aa, artificial
  peptide fold or domain or sub-domain
ANEAKVVLVADNVQGDN

SEQ ID NO: 23609 - protein, 16 aa, artificial
  peptide fold or domain or sub-domain
MAVKAISGCDKDQELI

SEQ ID NO: 23610 - protein, 30 aa, artificial
  peptide fold or domain or sub-domain
LKDGYPTNSKGCKISGCLPGENKFCLNECQ

SEQ ID NO: 23611 - protein, 20 aa, artificial
  peptide fold or domain or sub-domain
KEEAKVLGTVIGIDLGTQYL

SEQ ID NO: 23612 - protein, 24 aa, artificial
  peptide fold or domain or sub-domain
APKNIVLFGATGMTGQVTLGQALE

SEQ ID NO: 23613 - protein, 25 aa, artificial
  peptide fold or domain or sub-domain
GIGAAILSAGKSIIKGLANGLAEHF

SEQ ID NO: 23614 - protein, 25 aa, artificial
  peptide fold or domain or sub-domain
VTIGPVCELPKEVGGPCRGHIIPRY

SEQ ID NO: 23615 - protein, 27 aa, artificial
  peptide fold or domain or sub-domain
EVHNFACLGKPDPGGCAHYIYRRYYYV

SEQ ID NO: 23616 - protein, 25 aa, artificial
  peptide fold or domain or sub-domain
TPLKESTCYLPKETGPCVGYFFRYY

SEQ ID NO: 23617 - protein, 17 aa, artificial
  peptide fold or domain or sub-domain
IKITTMLAKLGKVLAHV

SEQ ID NO: 23618 - protein, 17 aa, artificial
  peptide fold or domain or sub-domain
SKITDILAKLGKVLAHV

SEQ ID NO: 23619 - protein, 17 aa, artificial
  peptide fold or domain or sub-domain
IKIMDILAKLGKVLAHV

SEQ ID NO: 23620 - protein, 17 aa, artificial
  peptide fold or domain or sub-domain
INIKDILAKLVKVLGHV

SEQ ID NO: 23621 - protein, 13 aa, artificial
  peptide fold or domain or sub-domain
QRLGHQWAVGHLM

SEQ ID NO: 23622 - protein, 13 aa, artificial
  peptide fold or domain or sub-domain
QSFGNQWARGHFM

SEQ ID NO: 23623 - protein, 13 aa, artificial
  peptide fold or domain or sub-domain
ALFEESTVSAEPR

SEQ ID NO: 23624 - protein, 23 aa, artificial
  peptide fold or domain or sub-domain
VIPFVASVAAEMQHVYCAASRKC

SEQ ID NO: 23625 - protein, 23 aa, artificial
  peptide fold or domain or sub-domain
FLPLVRGAAKLIPSVVCAISKRC

SEQ ID NO: 23626 - protein, 24 aa, artificial
  peptide fold or domain or sub-domain
FLPVVAGLAAKVLPSIICAVTKKC

SEQ ID NO: 23627 - protein, 17 aa, artificial
  peptide fold or domain or sub-domain
FITLLLRKFICSITKKC

SEQ ID NO: 23628 - protein, 20 aa, artificial
  peptide fold or domain or sub-domain
VNPIILGVLPKFVCLITKKC

SEQ ID NO: 23629 - protein, 29 aa, artificial
  peptide fold or domain or sub-domain
GLWETIKNFGKKFTLNILHKLKCKIGGGC

SEQ ID NO: 23630 - protein, 16 aa, artificial
  peptide fold or domain or sub-domain
KIMAKPSKFYEQLRGR

SEQ ID NO: 23631 - protein, 13 aa, artificial
  peptide fold or domain or sub-domain
QZKRPPGFSPFRK

SEQ ID NO: 23632 - protein, 22 aa, artificial
  peptide fold or domain or sub-domain
ALPKKLKYLNLFNDGFNYMGVV

SEQ ID NO: 23633 - protein, 16 aa, artificial
  peptide fold or domain or sub-domain
SETGNTVTVKGFSPLR

SEQ ID NO: 23634 - protein, 11 aa, artificial
  peptide fold or domain or sub-domain
QQDYTGAHMDF

SEQ ID NO: 23635 - protein, 11 aa, artificial
  peptide fold or domain or sub-domain
QQDYGTGWMDF

SEQ ID NO: 23636 - protein, 11 aa, artificial
  peptide fold or domain or sub-domain
QQDYGTGWFDF

SEQ ID NO: 23637 - protein, 11 aa, artificial
  peptide fold or domain or sub-domain
QQDYTGSHFDF

SEQ ID NO: 23638 - protein, 25 aa, artificial
  peptide fold or domain or sub-domain
HEDNAGIAVYWGQDAREGDLVTACN

SEQ ID NO: 23639 - protein, 30 aa, artificial
  peptide fold or domain or sub-domain
KKMKDTDSEEEIREAFRVFDKDGNGFIRLA

SEQ ID NO: 23640 - protein, 20 aa, artificial
  peptide fold or domain or sub-domain
KVFFEERFEDGWENRWVKKD

SEQ ID NO: 23641 - protein, 24 aa, artificial
  peptide fold or domain or sub-domain
VGGLIAYDNIEISQIPVGDGVTLC

SEQ ID NO: 23642 - protein, 19 aa, artificial
  peptide fold or domain or sub-domain
GWSIDGIEGKLLEFAEEKK

SEQ ID NO: 23643 - protein, 20 aa, artificial
  peptide fold or domain or sub-domain
VKSTGRADDDLAVKTKYLPP

SEQ ID NO: 23644 - protein, 26 aa, artificial
  peptide fold or domain or sub-domain
IIGGREARPNSHPYMAFLLIQSPEGL

SEQ ID NO: 23645 - protein, 20 aa, artificial
  peptide fold or domain or sub-domain
AVPDKIDPRESGYVTGVKDQ

SEQ ID NO: 23646 - protein, 14 aa, artificial
  peptide fold or domain or sub-domain
AVPDKIDRRESGYV

SEQ ID NO: 23647 - protein, 15 aa, artificial
  peptide fold or domain or sub-domain
EPTPRSFNGDKVFRV

SEQ ID NO: 23648 - protein, 24 aa, artificial
  peptide fold or domain or sub-domain
MLDGFVPWPDHLADEYRRRGIWLG

SEQ ID NO: 23649 - protein, 30 aa, artificial
  peptide fold or domain or sub-domain
FVVETENQLMSQGGRYYILPVIYGKGGGLG

SEQ ID NO: 23650 - protein, 11 aa, artificial
  peptide fold or domain or sub-domain
SGQSWRPQGRF

SEQ ID NO: 23651 - protein, 20 aa, artificial
  peptide fold or domain or sub-domain
ARCENFADSYRQPPISSSQT

SEQ ID NO: 23652 - protein, 19 aa, artificial
  peptide fold or domain or sub-domain
MKITPLGDNVVIKKLLATA

SEQ ID NO: 23653 - protein, 25 aa, artificial
  peptide fold or domain or sub-domain
LRNVEQQCRADALVERAQELIHGQQ

SEQ ID NO: 23654 - protein, 17 aa, artificial
  peptide fold or domain or sub-domain
MFTFAILLLCVQGCLIQ

SEQ ID NO: 23655 - protein, 15 aa, artificial
  peptide fold or domain or sub-domain
EQPGGDKVNLGYFTN

SEQ ID NO: 23656 - protein, 20 aa, artificial
  peptide fold or domain or sub-domain
MLTYTGTVINVQTFAAKPDP

SEQ ID NO: 23657 - protein, 17 aa, artificial
  peptide fold or domain or sub-domain
LPTGPNNPTTLDNSSII

SEQ ID NO: 23658 - protein, 25 aa, artificial
  peptide fold or domain or sub-domain
FFGWLIKGAIHAGKAIHGLIHRRRH

SEQ ID NO: 23659 - protein, 20 aa, artificial
  peptide fold or domain or sub-domain
FIGLLISAGKAIHDLIRRRH

SEQ ID NO: 23660 - protein, 20 aa, artificial
  peptide fold or domain or sub-domain
SDNSVVLRYGDGEYSYPVVD

SEQ ID NO: 23661 - protein, 21 aa, artificial
  peptide fold or domain or sub-domain
SEKITVFQKNFQVTENSSHFV

SEQ ID NO: 23662 - protein, 14 aa, artificial
  peptide fold or domain or sub-domain
IVGGFTIGIDTVPY

SEQ ID NO: 23663 - protein, 17 aa, artificial
  peptide fold or domain or sub-domain
IVGGMEATPHSWPHQVA

SEQ ID NO: 23664 - protein, 20 aa, artificial
  peptide fold or domain or sub-domain
IVGGTEVTPGEIPYQLSFQD

SEQ ID NO: 23665 - protein, 15 aa, artificial
  peptide fold or domain or sub-domain
SHGKQETDEEFDANL

SEQ ID NO: 23666 - protein, 20 aa, artificial
  peptide fold or domain or sub-domain
SHGKVETDEEFDARWVTYFS

SEQ ID NO: 23667 - protein, 20 aa, artificial
  peptide fold or domain or sub-domain
SNTSHQDFHSFYGTNLMIGG

SEQ ID NO: 23668 - protein, 20 aa, artificial
  peptide fold or domain or sub-domain
SNTSHQDFHLFYGDNGMPVH

SEQ ID NO: 23669 - protein, 22 aa, artificial
  peptide fold or domain or sub-domain
PVLQVVRDIHGDILTPDSRYIL

SEQ ID NO: 23670 - protein, 25 aa, artificial
  peptide fold or domain or sub-domain
GLVSSIGRALGGLLADVVKSKGQPA

SEQ ID NO: 23671 - protein, 25 aa, artificial
  peptide fold or domain or sub-domain
GLVSSIGKALGGLLADVVKTKEQPA

SEQ ID NO: 23672 - protein, 29 aa, artificial
  peptide fold or domain or sub-domain
DVDFNSESTRRKNKQKEIVDLHNSLKKTV

SEQ ID NO: 23673 - protein, 23 aa, artificial
  peptide fold or domain or sub-domain
GLWQKIKSAAGDLASGIVEGIKS

SEQ ID NO: 23674 - protein, 14 aa, artificial
  peptide fold or domain or sub-domain
DSSNLPPNQKQIVD

SEQ ID NO: 23675 - protein, 11 aa, artificial
  peptide fold or domain or sub-domain
MRNIKVKPFLN

SEQ ID NO: 23676 - protein, 24 aa, artificial
  peptide fold or domain or sub-domain
SNGSNIDVAGAVNTLVETAGKLFQ

SEQ ID NO: 23677 - protein, 23 aa, artificial
  peptide fold or domain or sub-domain
LWTRDYAGVYEAIRGFDWSQDAK

SEQ ID NO: 23678 - protein, 18 aa, artificial
  peptide fold or domain or sub-domain
GLFDVIKKVASVIGLASQ

SEQ ID NO: 23679 - protein, 16 aa, artificial
  peptide fold or domain or sub-domain
GLFDVIKKVASVIGGL

SEQ ID NO: 23680 - protein, 16 aa, artificial
  peptide fold or domain or sub-domain
GLFDIIKKVASVVGGL

SEQ ID NO: 23681 - protein, 24 aa, artificial
  peptide fold or domain or sub-domain
DLFQVIKEKLKELTGGVIEGIQGV

SEQ ID NO: 23682 - protein, 19 aa, artificial
  peptide fold or domain or sub-domain
VIGGSDTTIGQYPHQLSLR

SEQ ID NO: 23683 - protein, 19 aa, artificial
  peptide fold or domain or sub-domain
PQRGEGGRAGNLLREEQEI

SEQ ID NO: 23684 - protein, 30 aa, artificial
  peptide fold or domain or sub-domain
AYPGNGVHCGKYSCTVDKQTAIGNIGNNAA

SEQ ID NO: 23685 - protein, 15 aa, artificial
  peptide fold or domain or sub-domain
EGKAIGLAKPRMDST

SEQ ID NO: 23686 - protein, 14 aa, artificial
  peptide fold or domain or sub-domain
AVNGGPATLPEYQI

SEQ ID NO: 23687 - protein, 15 aa, artificial
  peptide fold or domain or sub-domain
DLSNLLSRVPNERSN

SEQ ID NO: 23688 - protein, 20 aa, artificial
  peptide fold or domain or sub-domain
KVPVDDQFRRVNNGGATDTR

SEQ ID NO: 23689 - protein, 15 aa, artificial
  peptide fold or domain or sub-domain
AEYPNDVNLTVYWDP

SEQ ID NO: 23690 - protein, 15 aa, artificial
  peptide fold or domain or sub-domain
KSTDFDYNNKKANYD

SEQ ID NO: 23691 - protein, 14 aa, artificial
  peptide fold or domain or sub-domain
SEVGALVFQPKTRF

SEQ ID NO: 23692 - protein, 15 aa, artificial
  peptide fold or domain or sub-domain
AHSDAVTPLPARSKV

SEQ ID NO: 23693 - protein, 11 aa, artificial
  peptide fold or domain or sub-domain
EVLYIPVTTDA

SEQ ID NO: 23694 - protein, 15 aa, artificial
  peptide fold or domain or sub-domain
NFQRDVEITWGDMRR

SEQ ID NO: 23695 - protein, 14 aa, artificial
  peptide fold or domain or sub-domain
VAGKSFVPIAAGRQ

SEQ ID NO: 23696 - protein, 25 aa, artificial
  peptide fold or domain or sub-domain
SHDKPDHIRLFELKKDDLLISVHNA

SEQ ID NO: 23697 - protein, 23 aa, artificial
  peptide fold or domain or sub-domain
QYVKDPDKQVVARIFLDLQLVQR

SEQ ID NO: 23698 - protein, 24 aa, artificial
  peptide fold or domain or sub-domain
ATIEVYNILPYYYYVSKAWSWNGN

SEQ ID NO: 23699 - protein, 20 aa, artificial
  peptide fold or domain or sub-domain
ELPVNFYALNLTADNINIGY

SEQ ID NO: 23700 - protein, 13 aa, artificial
  peptide fold or domain or sub-domain
TGVNYGQLGNNLP

SEQ ID NO: 23701 - protein, 12 aa, artificial
  peptide fold or domain or sub-domain
NYDKNFYEDTLP

SEQ ID NO: 23702 - protein, 15 aa, artificial
  peptide fold or domain or sub-domain
EYPVVFVKGLFPGKG

SEQ ID NO: 23703 - protein, 18 aa, artificial
  peptide fold or domain or sub-domain
QNQPPDFANPFIIPQNAA

SEQ ID NO: 23704 - protein, 11 aa, artificial
  peptide fold or domain or sub-domain
EQCQDMAGGAR

SEQ ID NO: 23705 - protein, 15 aa, artificial
  peptide fold or domain or sub-domain
ANDPDFPYTVQANRP

SEQ ID NO: 23706 - protein, 15 aa, artificial
  peptide fold or domain or sub-domain
IWVGISYKIHSLYFQ

SEQ ID NO: 23707 - protein, 15 aa, artificial
  peptide fold or domain or sub-domain
AGVDPAIPAYVKTNG

SEQ ID NO: 23708 - protein, 15 aa, artificial
  peptide fold or domain or sub-domain
MGQGAVEGQLFYNVQ

SEQ ID NO: 23709 - protein, 15 aa, artificial
  peptide fold or domain or sub-domain
TIEEVLNLPPYVVAA

SEQ ID NO: 23710 - protein, 18 aa, artificial
  peptide fold or domain or sub-domain
STRTPEFLGLDNQCGVWA

SEQ ID NO: 23711 - protein, 14 aa, artificial
  peptide fold or domain or sub-domain
ANAKVPSHTISNPF

SEQ ID NO: 23712 - protein, 11 aa, artificial
  peptide fold or domain or sub-domain
AVPPRYGYTRG

SEQ ID NO: 23713 - protein, 15 aa, artificial
  peptide fold or domain or sub-domain
GPVEIYYLQSADAKG

SEQ ID NO: 23714 - protein, 14 aa, artificial
  peptide fold or domain or sub-domain
ALVEDPQMQKYHKH

SEQ ID NO: 23715 - protein, 13 aa, artificial
  peptide fold or domain or sub-domain
ARKFFVGRNWPEL

SEQ ID NO: 23716 - protein, 20 aa, artificial
  peptide fold or domain or sub-domain
SNPNFILTLVNNVPYTIWPA

SEQ ID NO: 23717 - protein, 14 aa, artificial
  peptide fold or domain or sub-domain
GYPRKTVDVFTFTN

SEQ ID NO: 23718 - protein, 15 aa, artificial
  peptide fold or domain or sub-domain
VKIGTYELLKGDFSV

SEQ ID NO: 23719 - protein, 20 aa, artificial
  peptide fold or domain or sub-domain
VAGKSFVPIALGRQSKQTPF

SEQ ID NO: 23720 - protein, 14 aa, artificial
  peptide fold or domain or sub-domain
APQEPNQFQLLKYH

SEQ ID NO: 23721 - protein, 14 aa, artificial
  peptide fold or domain or sub-domain
SDRELHRSKAAYFF

SEQ ID NO: 23722 - protein, 27 aa, artificial
  peptide fold or domain or sub-domain
GGLGRCIYNCMNSGGGLSFIQCKTMCY

SEQ ID NO: 23723 - protein, 27 aa, artificial
  peptide fold or domain or sub-domain
WDVNDCIHFCLIGVVGRSYTECHTMCT

SEQ ID NO: 23724 - protein, 27 aa, artificial
  peptide fold or domain or sub-domain
WDAYDCIQFCMRPEMRHTYAQCLSICT

SEQ ID NO: 23725 - protein, 27 aa, artificial
  peptide fold or domain or sub-domain
GCGGVCAYGESCPSSCNTCYSAQCTAQ

SEQ ID NO: 23726 - protein, 25 aa, artificial
  peptide fold or domain or sub-domain
DQSCPWCGFTCCLPNYCQGLTCTVI

SEQ ID NO: 23727 - protein, 15 aa, artificial
  peptide fold or domain or sub-domain
KMLGVVAKKPMSDYE

SEQ ID NO: 23728 - protein, 24 aa, artificial
  peptide fold or domain or sub-domain
FENKVPEKQKLFQEDNGIPVHLKG

SEQ ID NO: 23729 - protein, 27 aa, artificial
  peptide fold or domain or sub-domain
CGGYSTYCEVDSECCSDNCVRSYCTLF

SEQ ID NO: 23730 - protein, 30 aa, artificial
  peptide fold or domain or sub-domain
GCCGPYPNAACHPCGCKVGRPPYCDRPSGG

SEQ ID NO: 23731 - protein, 26 aa, artificial
  peptide fold or domain or sub-domain
CKQAGESCDIFSQNCCVGTCAFICIE

SEQ ID NO: 23732 - protein, 29 aa, artificial
  peptide fold or domain or sub-domain
VKPCRKEGQLCDPIFQNCCRGWNCVLFCV

SEQ ID NO: 23733 - protein, 25 aa, artificial
  peptide fold or domain or sub-domain
QGCCGEPNLCFTRWCRNNARCCRQQ

SEQ ID NO: 23734 - protein, 14 aa, artificial
  peptide fold or domain or sub-domain
AFVKGSAQRVAHGY

SEQ ID NO: 23735 - protein, 27 aa, artificial
  peptide fold or domain or sub-domain
CKPPGSPCRVSSYNCCSSCKSYNKKCG

SEQ ID NO: 23736 - protein, 28 aa, artificial
  peptide fold or domain or sub-domain
ACKPKNNLCAITEMAECCSGFCLIYRCS

SEQ ID NO: 23737 - protein, 29 aa, artificial
  peptide fold or domain or sub-domain
TRCKGKGAPCRKTMYDCCSGSCGRRGKCG

SEQ ID NO: 23738 - protein, 29 aa, artificial
  peptide fold or domain or sub-domain
CKSPGTPCSRGMRDCCTSCLLYSNKCRRY

SEQ ID NO: 23739 - protein, 19 aa, artificial
  peptide fold or domain or sub-domain
FNWRCCLIPACRRNHKKFC

SEQ ID NO: 23740 - protein, 29 aa, artificial
  peptide fold or domain or sub-domain
KFLSGGFKEIVCHRYCAKGIAKEFCNCPD

SEQ ID NO: 23741 - protein, 30 aa, artificial
  peptide fold or domain or sub-domain
ILQKAVLDCLKAAGSSLSKAAITAIYNKIT

SEQ ID NO: 23742 - protein, 30 aa, artificial
  peptide fold or domain or sub-domain
GTLPCESCVWIPCISSVVGCSCKSKVCYKN

SEQ ID NO: 23743 - protein, 15 aa, artificial
  peptide fold or domain or sub-domain
NVTELIGNTPLVELI

SEQ ID NO: 23744 - protein, 22 aa, artificial
  peptide fold or domain or sub-domain
LKCEWDGLVGTRGEIAKETIER

SEQ ID NO: 23745 - protein, 28 aa, artificial
  peptide fold or domain or sub-domain
GTACGESCYVLPCFTVGCTCTSSQCFKN

SEQ ID NO: 23746 - protein, 13 aa, artificial
  peptide fold or domain or sub-domain
GLFDIIKNIVSTL

SEQ ID NO: 23747 - protein, 13 aa, artificial
  peptide fold or domain or sub-domain
GLFDIIKNIFSGL

SEQ ID NO: 23748 - protein, 21 aa, artificial
  peptide fold or domain or sub-domain
GLLGSIGNAIGAFIANKLKPK

SEQ ID NO: 23749 - protein, 21 aa, artificial
  peptide fold or domain or sub-domain
GLLASLGKVFGGYLAEKLKPK

SEQ ID NO: 23750 - protein, 15 aa, artificial
  peptide fold or domain or sub-domain
MMIPGHFDYHRPKSV

SEQ ID NO: 23751 - protein, 25 aa, artificial
  peptide fold or domain or sub-domain
GLWSKIKEAAKTAGLMAMGFVNDMV

SEQ ID NO: 23752 - protein, 28 aa, artificial
  peptide fold or domain or sub-domain
ALWKTLLKNVGKAAGKAALNAVTDMVNQ

SEQ ID NO: 23753 - protein, 25 aa, artificial
  peptide fold or domain or sub-domain
GIFSSRKCKTVSKTFRGICTRNANC

SEQ ID NO: 23754 - protein, 13 aa, artificial
  peptide fold or domain or sub-domain
PYDRISGSAFSDF

SEQ ID NO: 23755 - protein, 13 aa, artificial
  peptide fold or domain or sub-domain
PFDRISNSAFSDF

SEQ ID NO: 23756 - protein, 20 aa, artificial
  peptide fold or domain or sub-domain
GVIAWELQHNEPGRKDSTAG

SEQ ID NO: 23757 - protein, 20 aa, artificial
  peptide fold or domain or sub-domain
MKKCAFVSDFDGTISKQDFY

SEQ ID NO: 23758 - protein, 21 aa, artificial
  peptide fold or domain or sub-domain
SINNTGGSGNRRLDKNGFAGQ

SEQ ID NO: 23759 - protein, 26 aa, artificial
  peptide fold or domain or sub-domain
MIPAQFTYRRVSSVDEALAAVAEHGD

SEQ ID NO: 23760 - protein, 24 aa, artificial
  peptide fold or domain or sub-domain
MNVQFTVNGRAASIDVPPNTLLVQ

SEQ ID NO: 23761 - protein, 30 aa, artificial
  peptide fold or domain or sub-domain
DIIVISGAATGIGAATCKVLEAAGSQIVSI

SEQ ID NO: 23762 - protein, 30 aa, artificial
  peptide fold or domain or sub-domain
SFSVNPAVDILQHRYMEKVAQNNRNFLNRV

SEQ ID NO: 23763 - protein, 24 aa, artificial
  peptide fold or domain or sub-domain
VGTRVVRIEDQQLITQGGTYVEDL

SEQ ID NO: 23764 - protein, 29 aa, artificial
  peptide fold or domain or sub-domain
AIAREKAEKFRKLQDASRSAQALVEQMVN

SEQ ID NO: 23765 - protein, 21 aa, artificial
  peptide fold or domain or sub-domain
ISDFDEYEPLNDADNNEVLDF

SEQ ID NO: 23766 - protein, 15 aa, artificial
  peptide fold or domain or sub-domain
ISALFDEYEPLNDAD

SEQ ID NO: 23767 - protein, 14 aa, artificial
  peptide fold or domain or sub-domain
IAIFNAYTPLPFAD

SEQ ID NO: 23768 - protein, 13 aa, artificial
  peptide fold or domain or sub-domain
SAIDPNPDTPDSE

SEQ ID NO: 23769 - protein, 11 aa, artificial
  peptide fold or domain or sub-domain
KYPLEKFQNIG

SEQ ID NO: 23770 - protein, 17 aa, artificial
  peptide fold or domain or sub-domain
HYQEVPRQIQEKLIKGQ

SEQ ID NO: 23771 - protein, 13 aa, artificial
  peptide fold or domain or sub-domain
NEEEKVKWQPDVP

SEQ ID NO: 23772 - protein, 20 aa, artificial
  peptide fold or domain or sub-domain
VVGGEVARAHSWPWQISLQY

SEQ ID NO: 23773 - protein, 25 aa, artificial
  peptide fold or domain or sub-domain
ATRVVYCNRRSGSVVGGDDTVYYEG

SEQ ID NO: 23774 - protein, 15 aa, artificial
  peptide fold or domain or sub-domain
NPVVRITNGAIRGQN

SEQ ID NO: 23775 - protein, 15 aa, artificial
  peptide fold or domain or sub-domain
RIPSTEEVVVRTESG

SEQ ID NO: 23776 - protein, 28 aa, artificial
  peptide fold or domain or sub-domain
AQNVIAPNTLSNSIRMLGSQSPLIQAYG

SEQ ID NO: 23777 - protein, 21 aa, artificial
  peptide fold or domain or sub-domain
MFFKIDLKNHPYLIRLKKQEE

SEQ ID NO: 23778 - protein, 12 aa, artificial
  peptide fold or domain or sub-domain
GYRKPPFNGSIF

SEQ ID NO: 23779 - protein, 11 aa, artificial
  peptide fold or domain or sub-domain
SVNTKNDFMRF

SEQ ID NO: 23780 - protein, 13 aa, artificial
  peptide fold or domain or sub-domain
SDIGISEPNFLRF

SEQ ID NO: 23781 - protein, 12 aa, artificial
  peptide fold or domain or sub-domain
APNQPSDNMIRF

SEQ ID NO: 23782 - protein, 24 aa, artificial
  peptide fold or domain or sub-domain
MRITVNVDGTSYTDEVEPRTLLVH

SEQ ID NO: 23783 - protein, 20 aa, artificial
  peptide fold or domain or sub-domain
SRLPPATRDKLADEITFFPA

SEQ ID NO: 23784 - protein, 27 aa, artificial
  peptide fold or domain or sub-domain
MVKTVAVMVGSLRKDSLAHKLMKVLQK

SEQ ID NO: 23785 - protein, 14 aa, artificial
  peptide fold or domain or sub-domain
PFNVGGLDKFGTLN

SEQ ID NO: 23786 - protein, 21 aa, artificial
  peptide fold or domain or sub-domain
MKVKVDADACIGCGVCVELCP

SEQ ID NO: 23787 - protein, 18 aa, artificial
  peptide fold or domain or sub-domain
TDPDADEGEFLAEGGGVR

SEQ ID NO: 23788 - protein, 13 aa, artificial
  peptide fold or domain or sub-domain
TDTEFEAAGGGVR

SEQ ID NO: 23789 - protein, 16 aa, artificial
  peptide fold or domain or sub-domain
TDTKESDFLAEGGGVR

SEQ ID NO: 23790 - protein, 16 aa, artificial
  peptide fold or domain or sub-domain
TDVKESEFIAEGAVGR

SEQ ID NO: 23791 - protein, 16 aa, artificial
  peptide fold or domain or sub-domain
TNVKESEFIAEGAAGR

SEQ ID NO: 23792 - protein, 17 aa, artificial
  peptide fold or domain or sub-domain
AEVQDKGEFLAEGGGVR

SEQ ID NO: 23793 - protein, 16 aa, artificial
  peptide fold or domain or sub-domain
VDPGESTFIDEGATGR

SEQ ID NO: 23794 - protein, 18 aa, artificial
  peptide fold or domain or sub-domain
QASTDYDDEDESTVPEAR

SEQ ID NO: 23795 - protein, 20 aa, artificial
  peptide fold or domain or sub-domain
ATDYEDEEFPGAVPPSVGAR

SEQ ID NO: 23796 - protein, 21 aa, artificial
  peptide fold or domain or sub-domain
QHLADYDEVEDDRAKLHLDAR

SEQ ID NO: 23797 - protein, 19 aa, artificial
  peptide fold or domain or sub-domain
EYYDDTDEEERIVSTVDAR

SEQ ID NO: 23798 - protein, 20 aa, artificial
  peptide fold or domain or sub-domain
LHSNLEYQYRYSGRVASGIP

SEQ ID NO: 23799 - protein, 27 aa, artificial
  peptide fold or domain or sub-domain
MIINHNMSAINAQRVQGBVTGVTKNMV

SEQ ID NO: 23800 - protein, 23 aa, artificial
  peptide fold or domain or sub-domain
LAGLDTAIILIAFIITASVLAYV

SEQ ID NO: 23801 - protein, 28 aa, artificial
  peptide fold or domain or sub-domain
MIINHNMSAMFAQRTLGVTNNAIGKDME

SEQ ID NO: 23802 - protein, 20 aa, artificial
  peptide fold or domain or sub-domain
SRIGIFYGSSSGVTGKVAEK

SEQ ID NO: 23803 - protein, 13 aa, artificial
  peptide fold or domain or sub-domain
AGPVSKLVSGIGL

SEQ ID NO: 23804 - protein, 19 aa, artificial
  peptide fold or domain or sub-domain
SLSINTNTSEMIALQTLDA

SEQ ID NO: 23805 - protein, 23 aa, artificial
  peptide fold or domain or sub-domain
DVNGGWSCATTVDAKFRPNGCTD

SEQ ID NO: 23806 - protein, 24 aa, artificial
  peptide fold or domain or sub-domain
GFLDKLKKGASDFANALVNSIKGT

SEQ ID NO: 23807 - protein, 22 aa, artificial
  peptide fold or domain or sub-domain
SASPGLPKGEKEQQEAIEHIDE

SEQ ID NO: 23808 - protein, 14 aa, artificial
  peptide fold or domain or sub-domain
MKQGINGFARRGRL

SEQ ID NO: 23809 - protein, 23 aa, artificial
  peptide fold or domain or sub-domain
FAGDHINTTEDRDTAQEVDDVLK

SEQ ID NO: 23810 - protein, 29 aa, artificial
  peptide fold or domain or sub-domain
GWTLNSAGYLLGPHAVDNHRSFNDKHGFT

SEQ ID NO: 23811 - protein, 29 aa, artificial
  peptide fold or domain or sub-domain
GWTLNSAGYLLGPHGIDGHRTLSDKHGLA

SEQ ID NO: 23812 - protein, 27 aa, artificial
  peptide fold or domain or sub-domain
AGETHTVMINHAGRGAPKLVVGGKKLS

SEQ ID NO: 23813 - protein, 14 aa, artificial
  peptide fold or domain or sub-domain
VSDSQNSQDGLDPE

SEQ ID NO: 23814 - protein, 25 aa, artificial
  peptide fold or domain or sub-domain
MNEQSMKPYVIGLDLGGTNSVFGIV

SEQ ID NO: 23815 - protein, 23 aa, artificial
  peptide fold or domain or sub-domain
TTPQEVLSRIKDQGIKLIDLKFI

SEQ ID NO: 23816 - protein, 14 aa, artificial
  peptide fold or domain or sub-domain
MSSSHIFIGETIGT

SEQ ID NO: 23817 - protein, 30 aa, artificial
  peptide fold or domain or sub-domain
AYPAAHQGYPAHVGYARVGYGGYPSYGYPA

SEQ ID NO: 23818 - protein, 17 aa, artificial
  peptide fold or domain or sub-domain
YKDQGLEILAFPCNQFG

SEQ ID NO: 23819 - protein, 25 aa, artificial
  peptide fold or domain or sub-domain
NWRKILGQIASVGAGLLGSLLAGYE

SEQ ID NO: 23820 - protein, 24 aa, artificial
  peptide fold or domain or sub-domain
LFGFLIPLLPHLIGAIPQVIGAIR

SEQ ID NO: 23821 - protein, 28 aa, artificial
  peptide fold or domain or sub-domain
WWRELLKKLAFTAAGHLGSVLAAKQSGW

SEQ ID NO: 23822 - protein, 25 aa, artificial
  peptide fold or domain or sub-domain
LFGFLIKLIPSLFGALSNIGRNRNQ

SEQ ID NO: 23823 - protein, 12 aa, artificial
  peptide fold or domain or sub-domain
FGFLPIYRRPAS

SEQ ID NO: 23824 - protein, 15 aa, artificial
  peptide fold or domain or sub-domain
MDYLITFYHSPQTNS

SEQ ID NO: 23825 - protein, 21 aa, artificial
  peptide fold or domain or sub-domain
MLKLHGFSVSNYYNMVKLALL

SEQ ID NO: 23826 - protein, 15 aa, artificial
  peptide fold or domain or sub-domain
MLLVIGSKNLSSTNM

SEQ ID NO: 23827 - protein, 30 aa, artificial
  peptide fold or domain or sub-domain
MLHLIGFDKLYSYNMVKLALLEKGVPFTEV

SEQ ID NO: 23828 - protein, 20 aa, artificial
  peptide fold or domain or sub-domain
ALGDQLLSVFVDHTLVDEVA

SEQ ID NO: 23829 - protein, 20 aa, artificial
  peptide fold or domain or sub-domain
WLSGVDKIRGVNLGSAFIIE

SEQ ID NO: 23830 - protein, 28 aa, artificial
  peptide fold or domain or sub-domain
SLQAATEWLKANNQRGFLGEMGAGSNAD

SEQ ID NO: 23831 - protein, 21 aa, artificial
  peptide fold or domain or sub-domain
MADENTPVMPEEVPAVEGVGM

SEQ ID NO: 23832 - protein, 15 aa, artificial
  peptide fold or domain or sub-domain
DIDITGCSACKYAAG

SEQ ID NO: 23833 - protein, 19 aa, artificial
  peptide fold or domain or sub-domain
FFGDFGNISSAAAITGNPK

SEQ ID NO: 23834 - protein, 14 aa, artificial
  peptide fold or domain or sub-domain
VEWTDAERKAIASL

SEQ ID NO: 23835 - protein, 21 aa, artificial
  peptide fold or domain or sub-domain
DQPGDVKTHKQYDVNYLFFKI

SEQ ID NO: 23836 - protein, 12 aa, artificial
  peptide fold or domain or sub-domain
DSPAGVSDAQKQ

SEQ ID NO: 23837 - protein, 30 aa, artificial
  peptide fold or domain or sub-domain
GADVAHKQQSVNHLLYLVTSHYPSLDYSLL

SEQ ID NO: 23838 - protein, 20 aa, artificial
  peptide fold or domain or sub-domain
DVVASSTAHKQQDINHLLDK

SEQ ID NO: 23839 - protein, 25 aa, artificial
  peptide fold or domain or sub-domain
GGPAGKQNAVNQLLVLIYDPKSYKD

SEQ ID NO: 23840 - protein, 23 aa, artificial
  peptide fold or domain or sub-domain
GFGEDIAMKQHQVNSLLDILFVF

SEQ ID NO: 23841 - protein, 22 aa, artificial
  peptide fold or domain or sub-domain
GAYGQGQNIGQLFVNILIFLFY

SEQ ID NO: 23842 - protein, 26 aa, artificial
  peptide fold or domain or sub-domain
DHAGTVSKAHKQHDVNSVLYKVYEDI

SEQ ID NO: 23843 - protein, 20 aa, artificial
  peptide fold or domain or sub-domain
SPAFQAQKQAKVNDVLDKLY

SEQ ID NO: 23844 - protein, 20 aa, artificial
  peptide fold or domain or sub-domain
DSVGSTTAHKQQNINHLLDK

SEQ ID NO: 23845 - protein, 20 aa, artificial
  peptide fold or domain or sub-domain
GKYGLFLGCNISFNRPDVEV

SEQ ID NO: 23846 - protein, 20 aa, artificial
  peptide fold or domain or sub-domain
MEMHEEGVPDVINLSYLAER

SEQ ID NO: 23847 - protein, 18 aa, artificial
  peptide fold or domain or sub-domain
YDIPEPFRWDESFKVFYE

SEQ ID NO: 23848 - protein, 18 aa, artificial
  peptide fold or domain or sub-domain
VIEVVYLRTPFSAGNATT

SEQ ID NO: 23849 - protein, 20 aa, artificial
  peptide fold or domain or sub-domain
KNWAVLVAGSNGWPNYRHHA

SEQ ID NO: 23850 - protein, 19 aa, artificial
  peptide fold or domain or sub-domain
DVLELTDENFESRVSSDTG

SEQ ID NO: 23851 - protein, 12 aa, artificial
  peptide fold or domain or sub-domain
VELQNRLSDESQ

SEQ ID NO: 23852 - protein, 24 aa, artificial
  peptide fold or domain or sub-domain
LSAMLEDTENWLYEELSLTQDPVV

SEQ ID NO: 23853 - protein, 15 aa, artificial
  peptide fold or domain or sub-domain
YFDPFSLDVWDPFQA

SEQ ID NO: 23854 - protein, 24 aa, artificial
  peptide fold or domain or sub-domain
MAPRGFSCLLLLTSEIDLPVKRRA

SEQ ID NO: 23855 - protein, 19 aa, artificial
  peptide fold or domain or sub-domain
FIGAILPAIAGLVGGLINR

SEQ ID NO: 23856 - protein, 11 aa, artificial
  peptide fold or domain or sub-domain
LRPAFIRPKGK

SEQ ID NO: 23857 - protein, 12 aa, artificial
  peptide fold or domain or sub-domain
LRPAVIVRTKGK

SEQ ID NO: 23858 - protein, 14 aa, artificial
  peptide fold or domain or sub-domain
FRPALIVRTKGTRL

SEQ ID NO: 23859 - protein, 15 aa, artificial
  peptide fold or domain or sub-domain
LGPALITRKPLKGKP

SEQ ID NO: 23860 - protein, 25 aa, artificial
  peptide fold or domain or sub-domain
AEIDFSGIPEDIIKQIKETNAKPPA

SEQ ID NO: 23861 - protein, 22 aa, artificial
  peptide fold or domain or sub-domain
MSKRAMKKIIPLITLFVVTLVG

SEQ ID NO: 23862 - protein, 23 aa, artificial
  peptide fold or domain or sub-domain
TQRLANFLIHSSNNFGAIFSPPN

SEQ ID NO: 23863 - protein, 13 aa, artificial
  peptide fold or domain or sub-domain
AIEVQTVTLIPGD

SEQ ID NO: 23864 - protein, 13 aa, artificial
  peptide fold or domain or sub-domain
DLAGEIHGLSNVK

SEQ ID NO: 23865 - protein, 29 aa, artificial
  peptide fold or domain or sub-domain
NYTIGNDNVLTEPLSEIKTAGLMYKMGVQ

SEQ ID NO: 23866 - protein, 14 aa, artificial
  peptide fold or domain or sub-domain
MDTKLGLVEEEAAN

SEQ ID NO: 23867 - protein, 24 aa, artificial
  peptide fold or domain or sub-domain
KFKVVTTFTVIQDIAQNVAGDAAT

SEQ ID NO: 23868 - protein, 15 aa, artificial
  peptide fold or domain or sub-domain
HPIQNLFQPSLVLDM

SEQ ID NO: 23869 - protein, 25 aa, artificial
  peptide fold or domain or sub-domain
FQPSLVLDTAKILLDNYTFPESLMG

SEQ ID NO: 23870 - protein, 20 aa, artificial
  peptide fold or domain or sub-domain
AKELLDSDGIILRNGANYYI

SEQ ID NO: 23871 - protein, 17 aa, artificial
  peptide fold or domain or sub-domain
ETLFDPCSTQDIKKVGV

SEQ ID NO: 23872 - protein, 28 aa, artificial
  peptide fold or domain or sub-domain
ACGPGCSGSCRQKGDRIKCINGSCHCYP

SEQ ID NO: 23873 - protein, 29 aa, artificial
  peptide fold or domain or sub-domain
GCTPEYCSMWCKVKVSQNYCVKNCKCPGR

SEQ ID NO: 23874 - protein, 21 aa, artificial
  peptide fold or domain or sub-domain
GFMKYIGPLIPHAVKAISDLI

SEQ ID NO: 23875 - protein, 29 aa, artificial
  peptide fold or domain or sub-domain
MSAGVITGVLLVFLLLGYLVYALINAEAF

SEQ ID NO: 23876 - protein, 23 aa, artificial
  peptide fold or domain or sub-domain
GHACYRNCWREGNDEETCKERCG

SEQ ID NO: 23877 - protein, 27 aa, artificial
  peptide fold or domain or sub-domain
GYQVDCVSYNYDNVNENLAQQFVDTQG

SEQ ID NO: 23878 - protein, 27 aa, artificial
  peptide fold or domain or sub-domain
DPCYEVCLQQHGNVKECEEACKHPVEY

SEQ ID NO: 23879 - protein, 24 aa, artificial
  peptide fold or domain or sub-domain
VTSWSLCTPGCTSPGGGSNCSFCC

SEQ ID NO: 23880 - protein, 19 aa, artificial
  peptide fold or domain or sub-domain
SSGWVCTLTIECGTVICAC

SEQ ID NO: 23881 - protein, 16 aa, artificial
  peptide fold or domain or sub-domain
LEIADLAQYVVDLTAR

SEQ ID NO: 23882 - protein, 15 aa, artificial
  peptide fold or domain or sub-domain
TETQSFNFNVFEPEN

SEQ ID NO: 23883 - protein, 20 aa, artificial
  peptide fold or domain or sub-domain
NEQSGKSQTVIVGSWGAKVS

SEQ ID NO: 23884 - protein, 20 aa, artificial
  peptide fold or domain or sub-domain
KQRSGESQNIIVGSWGAKVS

SEQ ID NO: 23885 - protein, 21 aa, artificial
  peptide fold or domain or sub-domain
NGPNGKSQSIIVGPWGDRVTN

SEQ ID NO: 23886 - protein, 15 aa, artificial
  peptide fold or domain or sub-domain
SQTQSFNFNKFEQNK

SEQ ID NO: 23887 - protein, 20 aa, artificial
  peptide fold or domain or sub-domain
NEQSGISQTVIVGPWGAQVT

SEQ ID NO: 23888 - protein, 20 aa, artificial
  peptide fold or domain or sub-domain
VDDTTPLSEETMMRIGGYMV

SEQ ID NO: 23889 - protein, 28 aa, artificial
  peptide fold or domain or sub-domain
IDPVNVKKLQCDGDTYKCTADLDFGDGR

SEQ ID NO: 23890 - protein, 24 aa, artificial
  peptide fold or domain or sub-domain
LEEQSFSFTKFSTDQQNLILQAHY

SEQ ID NO: 23891 - protein, 16 aa, artificial
  peptide fold or domain or sub-domain
EITKFPKDQQNLIGQG

SEQ ID NO: 23892 - protein, 25 aa, artificial
  peptide fold or domain or sub-domain
KEICFPRLGCFSDDAPWAGIAQRPL

SEQ ID NO: 23893 - protein, 13 aa, artificial
  peptide fold or domain or sub-domain
GFKNVALSTARGF

SEQ ID NO: 23894 - protein, 13 aa, artificial
  peptide fold or domain or sub-domain
RLHQNGMPFSPRL

SEQ ID NO: 23895 - protein, 12 aa, artificial
  peptide fold or domain or sub-domain
QLASDDYGHMRF

SEQ ID NO: 23896 - protein, 24 aa, artificial
  peptide fold or domain or sub-domain
MKKAERGASPKQIKPHRYYLLAVH

SEQ ID NO: 23897 - protein, 14 aa, artificial
  peptide fold or domain or sub-domain
MTHSMRLRFPTLNQ

SEQ ID NO: 23898 - protein, 20 aa, artificial [sequence omitted]

SEQ ID NO: 23899 - protein, 16 aa, artificial
  peptide fold or domain or sub-domain
QDSGDGWPQQPFVPRL

SEQ ID NO: 23900 - protein, 22 aa, artificial
  peptide fold or domain or sub-domain
MLHHMTSRANLLLLRRGGSQRS

SEQ ID NO: 23901 - protein, 28 aa, artificial
  peptide fold or domain or sub-domain
MTHIVRFIGLLLLNASSLRGRRVSGIQH

SEQ ID NO: 23902 - protein, 28 aa, artificial
  peptide fold or domain or sub-domain
MSHIVRFTGLLLLNAFIVRGRPVGGIQH

SEQ ID NO: 23903 - protein, 15 aa, artificial
  peptide fold or domain or sub-domain
MRRAVILVLDRAGPV

SEQ ID NO: 23904 - protein, 15 aa, artificial
  peptide fold or domain or sub-domain
MFDKTRLPYVALDVL

SEQ ID NO: 23905 - protein, 21 aa, artificial
  peptide fold or domain or sub-domain
MLISGTAFLRLRTNRKAFPTP

SEQ ID NO: 23906 - protein, 19 aa, artificial
  peptide fold or domain or sub-domain
MGIFSIFVISTVHYQPNKK

SEQ ID NO: 23907 - protein, 24 aa, artificial [sequence omitted]

SEQ ID NO: 23908 - protein, 20 aa, artificial
  peptide fold or domain or sub-domain
MKCNKMNRVQLKEGSVSMTL

SEQ ID NO: 23909 - protein, 17 aa, artificial
  peptide fold or domain or sub-domain
MIFVATSLSCRWWWPVM

SEQ ID NO: 23910 - protein, 14 aa, artificial
  peptide fold or domain or sub-domain
MKATFVLHGWWRTS

SEQ ID NO: 23911 - protein, 17 aa, artificial
  peptide fold or domain or sub-domain
MNNSCLSQSTQWWWRAN

SEQ ID NO: 23912 - protein, 14 aa, artificial
  peptide fold or domain or sub-domain
MKAIFVLKGWWRTS

SEQ ID NO: 23913 - protein, 14 aa, artificial
  peptide fold or domain or sub-domain
MANTQNISIWWWAR

SEQ ID NO: 23914 - protein, 14 aa, artificial
  peptide fold or domain or sub-domain
MAATFALHGWWRTS

SEQ ID NO: 23915 - protein, 28 aa, artificial
  peptide fold or domain or sub-domain
MRVNKESLQMNTYISLHGWWRTSLLRAV

SEQ ID NO: 23916 - protein, 11 aa, artificial
  peptide fold or domain or sub-domain
MALPSALWWPG

SEQ ID NO: 23917 - protein, 11 aa, artificial
  peptide fold or domain or sub-domain
EQFEDYGHMRF

SEQ ID NO: 23918 - protein, 27 aa, artificial
  peptide fold or domain or sub-domain
VAPFPHGKLVTYKYIADVKAGVDPSLV

SEQ ID NO: 23919 - protein, 18 aa, artificial
  peptide fold or domain or sub-domain
MKFGLFFQNFLSENQSSE

SEQ ID NO: 23920 - protein, 25 aa, artificial
  peptide fold or domain or sub-domain
IWLTALKFLGKHAAKHLAKQQLSKL

SEQ ID NO: 23921 - protein, 27 aa, artificial
  peptide fold or domain or sub-domain
ITFSKIYRSCKSNSVCGNQKCVRGRCV

SEQ ID NO: 23922 - protein, 28 aa, artificial
  peptide fold or domain or sub-domain
AQKAITSGFNALEKILQSTAGKYCVGDE

SEQ ID NO: 23923 - protein, 15 aa, artificial
  peptide fold or domain or sub-domain
MKKAWWKEGVVYQIY

SEQ ID NO: 23924 - protein, 23 aa, artificial
  peptide fold or domain or sub-domain
SIQVIVVTDGERGLIYPPLSNIR

SEQ ID NO: 23925 - protein, 14 aa, artificial
  peptide fold or domain or sub-domain
IDWKKLLDAAKQIL

SEQ ID NO: 23926 - protein, 14 aa, artificial
  peptide fold or domain or sub-domain
INWLKLGKKVSAIL

SEQ ID NO: 23927 - protein, 14 aa, artificial
  peptide fold or domain or sub-domain
INWLKLGKAVIDAL

SEQ ID NO: 23928 - protein, 17 aa, artificial
  peptide fold or domain or sub-domain
INWKKIAEVGGKILSSL

SEQ ID NO: 23929 - protein, 14 aa, artificial
  peptide fold or domain or sub-domain
INWKGIAAMAKKLL

SEQ ID NO: 23930 - protein, 17 aa, artificial
  peptide fold or domain or sub-domain
INWKKIAEIGKQVLSAL

SEQ ID NO: 23931 - protein, 13 aa, artificial
  peptide fold or domain or sub-domain
INWKGIAAMKKLL

SEQ ID NO: 23932 - protein, 14 aa, artificial
  peptide fold or domain or sub-domain
INWKALLDAAKKVL

SEQ ID NO: 23933 - protein, 14 aa, artificial
  peptide fold or domain or sub-domain
INWLKLGKAIIDAL

SEQ ID NO: 23934 - protein, 14 aa, artificial
  peptide fold or domain or sub-domain
INWKKMAATALKMI

SEQ ID NO: 23935 - protein, 14 aa, artificial
  peptide fold or domain or sub-domain
VDWKKIGQHILSVL

SEQ ID NO: 23936 - protein, 14 aa, artificial
  peptide fold or domain or sub-domain
INLKAIAALVKKVL

SEQ ID NO: 23937 - protein, 22 aa, artificial
  peptide fold or domain or sub-domain
IIGGYECKPHSQPWQAFLVDNK

SEQ ID NO: 23938 - protein, 28 aa, artificial
  peptide fold or domain or sub-domain
MCICKNGKPLPGFIGKICRKICMMQQTH

SEQ ID NO: 23939 - protein, 22 aa, artificial
  peptide fold or domain or sub-domain
FDESFGFQGPSTYEKTPLGEPA

SEQ ID NO: 23940 - protein, 15 aa, artificial
  peptide fold or domain or sub-domain
AADIFAKFKTSMEVK

SEQ ID NO: 23941 - protein, 18 aa, artificial
  peptide fold or domain or sub-domain
SDTVDIYDAGKILERVII

SEQ ID NO: 23942 - protein, 20 aa, artificial
  peptide fold or domain or sub-domain
AYERQFYPGATSVAENNIGH

SEQ ID NO: 23943 - protein, 23 aa, artificial
  peptide fold or domain or sub-domain
GLFGVLAKVASHVVPAIAEHFQA

SEQ ID NO: 23944 - protein, 18 aa, artificial
  peptide fold or domain or sub-domain
GFVDFLKKVAGTIANVVT

SEQ ID NO: 23945 - protein, 26 aa, artificial
  peptide fold or domain or sub-domain
GLLQTIKEKLESLESLAKGIVSGIQA

SEQ ID NO: 23946 - protein, 24 aa, artificial
  peptide fold or domain or sub-domain
AQTPVKVTVTGAAGQIGYALLFRI

SEQ ID NO: 23947 - protein, 23 aa, artificial
  peptide fold or domain or sub-domain
MSILPLVHAMANVRGDIEYLTEA

SEQ ID NO: 23948 - protein, 26 aa, artificial
  peptide fold or domain or sub-domain
GIGAILKVLSTGLPALISWIKRKRQE

SEQ ID NO: 23949 - protein, 26 aa, artificial
  peptide fold or domain or sub-domain
GIGAILKVLATGLPTLISWIKNKRKQ

SEQ ID NO: 23950 - protein, 19 aa, artificial
  peptide fold or domain or sub-domain
PIFTFASNVPADTITGFFL

SEQ ID NO: 23951 - protein, 15 aa, artificial
  peptide fold or domain or sub-domain
LPSFLYAEMVGYNIL

SEQ ID NO: 23952 - protein, 18 aa, artificial
  peptide fold or domain or sub-domain
BZIBYKMGHFRWGAPMDK

SEQ ID NO: 23953 - protein, 11 aa, artificial
  peptide fold or domain or sub-domain
YVMGHFRWDKF

SEQ ID NO: 23954 - protein, 15 aa, artificial
  peptide fold or domain or sub-domain
DTLKSEKNADFKDLY

SEQ ID NO: 23955 - protein, 11 aa, artificial
  peptide fold or domain or sub-domain
QPPGGSKVILF

SEQ ID NO: 23956 - protein, 22 aa, artificial
  peptide fold or domain or sub-domain
FVPFFTQSDIQKMQEKERNKGQ

SEQ ID NO: 23957 - protein, 13 aa, artificial
  peptide fold or domain or sub-domain
QWFGPYPPVNYIN

SEQ ID NO: 23958 - protein, 15 aa, artificial
  peptide fold or domain or sub-domain
TEVTFKVGEGSSGKS

SEQ ID NO: 23959 - protein, 20 aa, artificial
  peptide fold or domain or sub-domain
SATAAREEYQRKRSQFIEIG

SEQ ID NO: 23960 - protein, 23 aa, artificial
  peptide fold or domain or sub-domain
MFKPGYSEAKKPKITDEFSYKQT

SEQ ID NO: 23961 - protein, 15 aa, artificial
  peptide fold or domain or sub-domain
SEINGDWNTIALSAD

SEQ ID NO: 23962 - protein, 30 aa, artificial
  peptide fold or domain or sub-domain
LCVAHGITREKIEENGSMRENIIDVTKTNR

SEQ ID NO: 23963 - protein, 11 aa, artificial
  peptide fold or domain or sub-domain
AEDDIGIVGFN

SEQ ID NO: 23964 - protein, 14 aa, artificial
  peptide fold or domain or sub-domain
GFKDGAADRISHGF

SEQ ID NO: 23965 - protein, 14 aa, artificial
  peptide fold or domain or sub-domain
LEDNGRTHWAVLVA

SEQ ID NO: 23966 - protein, 13 aa, artificial
  peptide fold or domain or sub-domain
AQENETNESGSID

SEQ ID NO: 23967 - protein, 13 aa, artificial
  peptide fold or domain or sub-domain
QAIVSKARRPYIL

SEQ ID NO: 23968 - protein, 13 aa, artificial
  peptide fold or domain or sub-domain
QLYENKSRRPYIL

SEQ ID NO: 23969 - protein, 13 aa, artificial
  peptide fold or domain or sub-domain
QSHISKARRPYIL

SEQ ID NO: 23970 - protein, 20 aa, artificial
  peptide fold or domain or sub-domain
KLQLPTLDDPVPIGIAPAIT

SEQ ID NO: 23971 - protein, 20 aa, artificial
  peptide fold or domain or sub-domain
TPQIQKPAPQFSKTALLPDE

SEQ ID NO: 23972 - protein, 23 aa, artificial
  peptide fold or domain or sub-domain
MITVPHVVNLNLTGQWRENGGQI

SEQ ID NO: 23973 - protein, 20 aa, artificial
  peptide fold or domain or sub-domain
KRTKAPFSRVVKFSIDEIRN

SEQ ID NO: 23974 - protein, 20 aa, artificial
  peptide fold or domain or sub-domain
MKVYTDIFTRDEFLSDSYPM

SEQ ID NO: 23975 - protein, 20 aa, artificial
  peptide fold or domain or sub-domain
SHDVNINIQFGFENPQQVVD

SEQ ID NO: 23976 - protein, 26 aa, artificial
  peptide fold or domain or sub-domain
RWAEIVCRSPSCNECCEWHTCFAPED

SEQ ID NO: 23977 - protein, 21 aa, artificial
  peptide fold or domain or sub-domain
GLLSKVLGVGKKVLCGVSGLC

SEQ ID NO: 23978 - protein, 20 aa, artificial
  peptide fold or domain or sub-domain
ITCNDVTGNLTPCLPYLRSS

SEQ ID NO: 23979 - protein, 25 aa, artificial
  peptide fold or domain or sub-domain
FRLDEEFQGPIASQVRRQFLFRPRN

SEQ ID NO: 23980 - protein, 13 aa, artificial
  peptide fold or domain or sub-domain
MKFLCWQKSIHGS

SEQ ID NO: 23981 - protein, 12 aa, artificial
  peptide fold or domain or sub-domain
MKLCWQKSIHGS

SEQ ID NO: 23982 - protein, 12 aa, artificial
  peptide fold or domain or sub-domain
MELCWLTTIHGS

SEQ ID NO: 23983 - protein, 13 aa, artificial
  peptide fold or domain or sub-domain
MKLLCWQKSIHGS

SEQ ID NO: 23984 - protein, 23 aa, artificial
  peptide fold or domain or sub-domain
MVTMVKKWLLLMTFMAGCRGMIY

SEQ ID NO: 23985 - protein, 19 aa, artificial
  peptide fold or domain or sub-domain
MDETIVTDKGVAEFSFFKF

SEQ ID NO: 23986 - protein, 27 aa, artificial
  peptide fold or domain or sub-domain
MSKGYVWVVDDDSSIRWVMEKTSPLPT

SEQ ID NO: 23987 - protein, 30 aa, artificial
  peptide fold or domain or sub-domain
ASEALVEIKPGEIGMVSGIPDEHLRRFVVI

SEQ ID NO: 23988 - protein, 19 aa, artificial
  peptide fold or domain or sub-domain
GFIMEFAENLILRRMEDPK

SEQ ID NO: 23989 - protein, 11 aa, artificial
  peptide fold or domain or sub-domain
LTCYKGYRDTV

SEQ ID NO: 23990 - protein, 20 aa, artificial
  peptide fold or domain or sub-domain
DDIKLSQQYDVLDLFKYMHQ

SEQ ID NO: 23991 - protein, 28 aa, artificial
  peptide fold or domain or sub-domain
EVVRSNNFDPSKLSGKWYSILLASDRKE

SEQ ID NO: 23992 - protein, 25 aa, artificial
  peptide fold or domain or sub-domain
GVVDILKGAGKDLLAHLVGKISEKV

SEQ ID NO: 23993 - protein, 21 aa, artificial
  peptide fold or domain or sub-domain
GVLDIFKDAAKQILAHAAEQI

SEQ ID NO: 23994 - protein, 21 aa, artificial
  peptide fold or domain or sub-domain
ISAEAPLYAEVGMPALSPTMT

SEQ ID NO: 23995 - protein, 16 aa, artificial
  peptide fold or domain or sub-domain
ISAVKEMTVRDALNSA

SEQ ID NO: 23996 - protein, 15 aa, artificial
  peptide fold or domain or sub-domain
STIEVRNNSPYYSVD

SEQ ID NO: 23997 - protein, 24 aa, artificial
  peptide fold or domain or sub-domain
DEAVVHDSYAFDKNQLIPVGARAE

SEQ ID NO: 23998 - protein, 20 aa, artificial
  peptide fold or domain or sub-domain
AEVFKSEEGSVDFYGQLRPA

SEQ ID NO: 23999 - protein, 25 aa, artificial
  peptide fold or domain or sub-domain
AGDNDYNPIGEYGGVDKINDLTVYV

SEQ ID NO: 24000 - protein, 20 aa, artificial
  peptide fold or domain or sub-domain
VKVYNQFGTKVELGVSMRIF

SEQ ID NO: 24001 - protein, 21 aa, artificial
  peptide fold or domain or sub-domain
VTVYDAEGTKVQLDGSIRLVM

SEQ ID NO: 24002 - protein, 21 aa, artificial
  peptide fold or domain or sub-domain
VTVYDAEGTKVQIDGSLRVEL

SEQ ID NO: 24003 - protein, 21 aa, artificial
  peptide fold or domain or sub-domain
VTVYDAEGTKVQVDGSLRLVE

SEQ ID NO: 24004 - protein, 21 aa, artificial
  peptide fold or domain or sub-domain
TTVYDAEGSKVDFDGSLRIIV

SEQ ID NO: 24005 - protein, 21 aa, artificial
  peptide fold or domain or sub-domain
ATVYNQDGTQVNVGGRVEVAL

SEQ ID NO: 24006 - protein, 22 aa, artificial
  peptide fold or domain or sub-domain
ATVYNNDGTQVDVGGRFDVALG

SEQ ID NO: 24007 - protein, 19 aa, artificial
  peptide fold or domain or sub-domain
AAAELSLVQLESLREVCEQ

SEQ ID NO: 24008 - protein, 26 aa, artificial
  peptide fold or domain or sub-domain
VGTALGSLAEELNGYNRKKGGFSFRF

SEQ ID NO: 24009 - protein, 28 aa, artificial
  peptide fold or domain or sub-domain
ALFSILRGLKKLGNMGQAFVNCKIYKKC

SEQ ID NO: 24010 - protein, 12 aa, artificial
  peptide fold or domain or sub-domain
SLLBFKBMIEST

SEQ ID NO: 24011 - protein, 28 aa, artificial
  peptide fold or domain or sub-domain
NLQYLKNMIKCTNTRHWLSFTNYGCYCG

SEQ ID NO: 24012 - protein, 23 aa, artificial
  peptide fold or domain or sub-domain
SLVELGKMILQETGKNPVTYGAY

SEQ ID NO: 24013 - protein, 30 aa, artificial
  peptide fold or domain or sub-domain
NLLQFAFMIRQANKRRRPVIPYEEYGLYYM

SEQ ID NO: 24014 - protein, 19 aa, artificial [sequence omitted]

SEQ ID NO: 24015 - protein, 17 aa, artificial
  peptide fold or domain or sub-domain
NLIQFANMIGCANHGSR

SEQ ID NO: 24016 - protein, 25 aa, artificial
  peptide fold or domain or sub-domain
RGSNLTIHPLRNIKDLVYLGNMGIG

SEQ ID NO: 24017 - protein, 25 aa, artificial
  peptide fold or domain or sub-domain
RGSNLTIHPLRNIRDIFYVGNITIG

SEQ ID NO: 24018 - protein, 24 aa, artificial
  peptide fold or domain or sub-domain
FWGALAKGALKLIPSLFSSFSKKD

SEQ ID NO: 24019 - protein, 23 aa, artificial
  peptide fold or domain or sub-domain
ENFAGGCATGFLRTADGRCKPTF

SEQ ID NO: 24020 - protein, 23 aa, artificial
  peptide fold or domain or sub-domain
ENFAGGCTPGYQRTADGRCKPTF

SEQ ID NO: 24021 - protein, 17 aa, artificial
  peptide fold or domain or sub-domain
MKAIMLVNFCDERGSGR

SEQ ID NO: 24022 - protein, 15 aa, artificial
  peptide fold or domain or sub-domain
APLTNEYLNHLCHKC

SEQ ID NO: 24023 - protein, 30 aa, artificial
  peptide fold or domain or sub-domain
GLKDWVKIAGGWLKKKGPGILKAAMAAATQ

SEQ ID NO: 24024 - protein, 25 aa, artificial
  peptide fold or domain or sub-domain
WLGSALKIGAKLLPSVVGLFKKKKQ

SEQ ID NO: 24025 - protein, 26 aa, artificial
  peptide fold or domain or sub-domain
GIWGTLAKIGIKAVPRVISMLKKKKQ

SEQ ID NO: 24026 - protein, 20 aa, artificial
  peptide fold or domain or sub-domain
FIGTALGIASAIPAIVKLFK

SEQ ID NO: 24027 - protein, 18 aa, artificial
  peptide fold or domain or sub-domain
NSELINAILGSPTLFGEV

SEQ ID NO: 24028 - protein, 18 aa, artificial
  peptide fold or domain or sub-domain
NSGMINSILGIPRVMTEA

SEQ ID NO: 24029 - protein, 20 aa, artificial
  peptide fold or domain or sub-domain
NAIPGNYYRWPYAKVPYVID

SEQ ID NO: 24030 - protein, 29 aa, artificial
  peptide fold or domain or sub-domain
MWISYLGFLIFYFILAAASYKILKRIKWI

SEQ ID NO: 24031 - protein, 28 aa, artificial
  peptide fold or domain or sub-domain
MVEYLVILSGMFGLALACFFGLRSIKLI

SEQ ID NO: 24032 - protein, 29 aa, artificial
  peptide fold or domain or sub-domain
MDSVTIAWAALMAISTFSLSLVVRGRSGL

SEQ ID NO: 24033 - protein, 29 aa, artificial [sequence omitted]

SEQ ID NO: 24034 - protein, 29 aa, artificial
  peptide fold or domain or sub-domain
MDILSLGWSALMVVFTFSLALVVWGRNGF

SEQ ID NO: 24035 - protein, 29 aa, artificial
  peptide fold or domain or sub-domain
MDIITLGWVGVLSVFTLSIAFVVWGRHGM

SEQ ID NO: 24036 - protein, 20 aa, artificial
  peptide fold or domain or sub-domain
MNKKSIRNVNLKGKRVFDRV

SEQ ID NO: 24037 - protein, 24 aa, artificial
  peptide fold or domain or sub-domain
GVLSNVIGYLKKLGTGALNAVLKQ

SEQ ID NO: 24038 - protein, 18 aa, artificial
  peptide fold or domain or sub-domain
SDLTWTYQSPGDPTNSKN

SEQ ID NO: 24039 - protein, 17 aa, artificial
  peptide fold or domain or sub-domain
AFLTLTPGSHVDSYVEA

SEQ ID NO: 24040 - protein, 17 aa, artificial
  peptide fold or domain or sub-domain
TDPLWQLPGAHLEQYLS

SEQ ID NO: 24041 - protein, 20 aa, artificial
  peptide fold or domain or sub-domain
VKTPITEAIAAADTQGRFLS

SEQ ID NO: 24042 - protein, 12 aa, artificial
  peptide fold or domain or sub-domain
DEPDGVPTHQKQ

SEQ ID NO: 24043 - protein, 12 aa, artificial
  peptide fold or domain or sub-domain
DEPDGVPTRQKQ

SEQ ID NO: 24044 - protein, 12 aa, artificial
  peptide fold or domain or sub-domain
DEPDGVPTTQKQ

SEQ ID NO: 24045 - protein, 14 aa, artificial
  peptide fold or domain or sub-domain
VSTAPYGAWQSPID

SEQ ID NO: 24046 - protein, 23 aa, artificial
  peptide fold or domain or sub-domain
LPASVDWRKEGAVLPIRHQGQCG

SEQ ID NO: 24047 - protein, 19 aa, artificial
  peptide fold or domain or sub-domain
ASGENQAELKLATHNVYML

SEQ ID NO: 24048 - protein, 18 aa, artificial
  peptide fold or domain or sub-domain
KLSYDDKVFENVEFTPRL

SEQ ID NO: 24049 - protein, 19 aa, artificial
  peptide fold or domain or sub-domain
FLSLIPHAINAVGVHAKHF

SEQ ID NO: 24050 - protein, 28 aa, artificial
  peptide fold or domain or sub-domain
RDPTGCEVDQVIMVKRHGERYPSPSAGK

SEQ ID NO: 24051 - protein, 19 aa, artificial
  peptide fold or domain or sub-domain
FLSLIPHAINAVSAIAKHN

SEQ ID NO: 24052 - protein, 18 aa, artificial
  peptide fold or domain or sub-domain
FLSIPHAINAVSTLVHHF

SEQ ID NO: 24053 - protein, 19 aa, artificial
  peptide fold or domain or sub-domain
FLSLIPHAINAVSALANHG

SEQ ID NO: 24054 - protein, 22 aa, artificial
  peptide fold or domain or sub-domain
FIHHIFRGIVHAGRSIGRFLTG

SEQ ID NO: 24055 - protein, 29 aa, artificial
  peptide fold or domain or sub-domain
NLLIDQYGHIKLTDFGFAKRITENTKSMC

SEQ ID NO: 24056 - protein, 20 aa, artificial
  peptide fold or domain or sub-domain
SVFAFQDESTSTIAQARLFI

SEQ ID NO: 24057 - protein, 20 aa, artificial
  peptide fold or domain or sub-domain
SIFAFQDESPSAIAQAKLFK

SEQ ID NO: 24058 - protein, 15 aa, artificial
  peptide fold or domain or sub-domain
TLNKVYKFDRDRRFL

SEQ ID NO: 24059 - protein, 15 aa, artificial
  peptide fold or domain or sub-domain
ETFTVKMGGDAGTLQ

SEQ ID NO: 24060 - protein, 13 aa, artificial
  peptide fold or domain or sub-domain
VSDVPNNDDRFTY

SEQ ID NO: 24061 - protein, 14 aa, artificial
  peptide fold or domain or sub-domain
SADIVKKLWDNPAL

SEQ ID NO: 24062 - protein, 14 aa, artificial
  peptide fold or domain or sub-domain
SVDMVMKGIKLWPL

SEQ ID NO: 24063 - protein, 13 aa, artificial
  peptide fold or domain or sub-domain
RIKIGLFDQLSRL

SEQ ID NO: 24064 - protein, 25 aa, artificial
  peptide fold or domain or sub-domain
FLPLLILGSLLMTPPVIQAIHDAQR

SEQ ID NO: 24065 - protein, 20 aa, artificial
  peptide fold or domain or sub-domain
TDMLAVSVSSTDAIGHKYGT

SEQ ID NO: 24066 - protein, 11 aa, artificial
  peptide fold or domain or sub-domain
DEGGTQYTPRL

SEQ ID NO: 24067 - protein, 12 aa, artificial
  peptide fold or domain or sub-domain
DHLSHDVYSPRL

SEQ ID NO: 24068 - protein, 17 aa, artificial
  peptide fold or domain or sub-domain
SGDTSSQAKGMWFGPRL

SEQ ID NO: 24069 - protein, 17 aa, artificial
  peptide fold or domain or sub-domain
AGESSNEAKGMWFGPRL

SEQ ID NO: 24070 - protein, 15 aa, artificial
  peptide fold or domain or sub-domain
AGPSATTGVWFGPRL

SEQ ID NO: 24071 - protein, 26 aa, artificial
  peptide fold or domain or sub-domain
MAWNTPKVTEIPLGAEINSYVCGEKK

SEQ ID NO: 24072 - protein, 29 aa, artificial
  peptide fold or domain or sub-domain
MKWAAPIVSEICVGMEVTSYESAEIDTFN

SEQ ID NO: 24073 - protein, 24 aa, artificial
  peptide fold or domain or sub-domain
MMWTKPEVTEMRFGFEVTMYVCNR

SEQ ID NO: 24074 - protein, 24 aa, artificial
  peptide fold or domain or sub-domain
GLNTLKKVFQGLHEAIKLINNHVQ

SEQ ID NO: 24075 - protein, 24 aa, artificial
  peptide fold or domain or sub-domain
GLNALKKVFQGIHEAIKLINNHVQ

SEQ ID NO: 24076 - protein, 30 aa, artificial
  peptide fold or domain or sub-domain
MIYDSQVYTVLLIALLASVLAIRLGSTLYQ

SEQ ID NO: 24077 - protein, 30 aa, artificial
  peptide fold or domain or sub-domain
MVELKFLIAFFLAFTAGILAIKLGQALYDC

SEQ ID NO: 24078 - protein, 30 aa, artificial
  peptide fold or domain or sub-domain
AYGEGANVFGKRKETDQFFEISGDGWSGKL

SEQ ID NO: 24079 - protein, 16 aa, artificial
  peptide fold or domain or sub-domain
MLNAVDAKLTTDFGQR

SEQ ID NO: 24080 - protein, 18 aa, artificial
  peptide fold or domain or sub-domain
YLKGCWTKSYPPKPCFSR

SEQ ID NO: 24081 - protein, 20 aa, artificial
  peptide fold or domain or sub-domain
MVPYRNPRHQHVASVLRSGG

SEQ ID NO: 24082 - protein, 13 aa, artificial
  peptide fold or domain or sub-domain
AGGTSGLYAFPRV

SEQ ID NO: 24083 - protein, 12 aa, artificial
  peptide fold or domain or sub-domain
GSLTGLISMPRT

SEQ ID NO: 24084 - protein, 11 aa, artificial
  peptide fold or domain or sub-domain
GSSGMIPFPRV

SEQ ID NO: 24085 - protein, 11 aa, artificial
  peptide fold or domain or sub-domain
AKSDVAELKPR

SEQ ID NO: 24086 - protein, 17 aa, artificial
  peptide fold or domain or sub-domain
SAPRGCWTKSYPPKPCK

SEQ ID NO: 24087 - protein, 13 aa, artificial
  peptide fold or domain or sub-domain
FLSAIASMLGKFL

SEQ ID NO: 24088 - protein, 13 aa, artificial
  peptide fold or domain or sub-domain
FISAIASFLGKFL

SEQ ID NO: 24089 - protein, 11 aa, artificial
  peptide fold or domain or sub-domain
ZTPQWATGHFM

SEQ ID NO: 24090 - protein, 17 aa, artificial
  peptide fold or domain or sub-domain
SNTALRRYNQWATGHFM

SEQ ID NO: 24091 - protein, 28 aa, artificial
  peptide fold or domain or sub-domain
ALPNQQTVDYPSFKSNYNFEKPFLYLAR

SEQ ID NO: 24092 - protein, 16 aa, artificial
  peptide fold or domain or sub-domain
PQTETKASVGFKAGVK

SEQ ID NO: 24093 - protein, 24 aa, artificial
  peptide fold or domain or sub-domain
MPGKVQDFFLCSLLLCIVSAGWCG

SEQ ID NO: 24094 - protein, 12 aa, artificial
  peptide fold or domain or sub-domain
GPMGWVPVFYRF

SEQ ID NO: 24095 - protein, 30 aa, artificial
  peptide fold or domain or sub-domain
DVTFSLLGANTKSYAAFITNFRKDVASEKK

SEQ ID NO: 24096 - protein, 28 aa, artificial
  peptide fold or domain or sub-domain
ARTQPGNIAPVGDFTLYPNAPRQGHIVA

SEQ ID NO: 24097 - protein, 27 aa, artificial
  peptide fold or domain or sub-domain
LQLSYRPRVMIMAVMFVFCINKGYDIY

SEQ ID NO: 24098 - protein, 14 aa, artificial
  peptide fold or domain or sub-domain
LGAEISSLTLEEAR

SEQ ID NO: 24099 - protein, 29 aa, artificial
  peptide fold or domain or sub-domain
KESRIGKQPITVPNVAIAMEGQDLKVKGP

SEQ ID NO: 24100 - protein, 30 aa, artificial
  peptide fold or domain or sub-domain
SDDDGTVVLTTSGPIRGKRLQVGSAAVTAF

SEQ ID NO: 24101 - protein, 15 aa, artificial
  peptide fold or domain or sub-domain
AAKIKKGDNVVVLTG

SEQ ID NO: 24102 - protein, 18 aa, artificial
  peptide fold or domain or sub-domain
FEDAKKVRFFKSNSETIK

SEQ ID NO: 24103 - protein, 14 aa, artificial
  peptide fold or domain or sub-domain
MKYNPRVSSNRRKS

SEQ ID NO: 24104 - protein, 20 aa, artificial
  peptide fold or domain or sub-domain
CKPASIKIRLNSTADTGFYV

SEQ ID NO: 24105 - protein, 22 aa, artificial
  peptide fold or domain or sub-domain
SEADFHEMRDPRIEKVVVHMGV

SEQ ID NO: 24106 - protein, 20 aa, artificial
  peptide fold or domain or sub-domain
FLGGLMKAFPAIICAVTKKC

SEQ ID NO: 24107 - protein, 12 aa, artificial
  peptide fold or domain or sub-domain
VRPYLVAFYESH

SEQ ID NO: 24108 - protein, 28 aa, artificial
  peptide fold or domain or sub-domain
GIMDTIKDTAKTVAVGLLNKLKCKITGC

SEQ ID NO: 24109 - protein, 21 aa, artificial
  peptide fold or domain or sub-domain
CLGIGSCNNFAGCGYAVVCFW

SEQ ID NO: 24110 - protein, 24 aa, artificial
  peptide fold or domain or sub-domain
MAKEQQVQANDLQEKLIAVNRVAK

SEQ ID NO: 24111 - protein, 20 aa, artificial
  peptide fold or domain or sub-domain
PMPNSHADKRAQEVLLAAQK

SEQ ID NO: 24112 - protein, 19 aa, artificial
  peptide fold or domain or sub-domain
KGAAKGLLEVASCKLSKSC

SEQ ID NO: 24113 - protein, 13 aa, artificial
  peptide fold or domain or sub-domain
AGFVLKGYTKTSQ

SEQ ID NO: 24114 - protein, 20 aa, artificial
  peptide fold or domain or sub-domain
ZPIDLMGKVFVFDKELSPBI

SEQ ID NO: 24115 - protein, 21 aa, artificial
  peptide fold or domain or sub-domain
MANDVLVPDLMSPEGMDVIEA

SEQ ID NO: 24116 - protein, 14 aa, artificial
  peptide fold or domain or sub-domain
GLIDVRCYDSSQCE

SEQ ID NO: 24117 - protein, 27 aa, artificial
  peptide fold or domain or sub-domain
MIIGAVEAGGTKFVDGVGNEKGEIFER

SEQ ID NO: 24118 - protein, 24 aa, artificial
  peptide fold or domain or sub-domain
EDGYLLNRDTGCKVSCGTCRYCND

SEQ ID NO: 24119 - protein, 19 aa, artificial
  peptide fold or domain or sub-domain
GKEGYPTDKRGCKLTCFFT

SEQ ID NO: 24120 - protein, 27 aa, artificial
  peptide fold or domain or sub-domain
HSDGLFTSEYSKMRGNAQVQKFIQNLM

SEQ ID NO: 24121 - protein, 24 aa, artificial
  peptide fold or domain or sub-domain
RHHRKRIGHTIKQLAKLVKHIHEY

SEQ ID NO: 24122 - protein, 15 aa, artificial
  peptide fold or domain or sub-domain
ITKDFDALMKYIKRI

SEQ ID NO: 24123 - protein, 14 aa, artificial
  peptide fold or domain or sub-domain
AGCKNFFWKTFTSC

SEQ ID NO: 24124 - protein, 21 aa, artificial
  peptide fold or domain or sub-domain
SPLKAVAVLTGADVKGVVQFT

SEQ ID NO: 24125 - protein, 25 aa, artificial
  peptide fold or domain or sub-domain
ALKAVCVLKGAGETSGTVHFEQEDN

SEQ ID NO: 24126 - protein, 15 aa, artificial
  peptide fold or domain or sub-domain
AKFELPNLPTADDAL

SEQ ID NO: 24127 - protein, 13 aa, artificial
  peptide fold or domain or sub-domain
KHSLPDLPYDYGA

SEQ ID NO: 24128 - protein, 27 aa, artificial
  peptide fold or domain or sub-domain
SIFVLPDLPYAKDALPKISAKTFDFGK

SEQ ID NO: 24129 - protein, 18 aa, artificial
  peptide fold or domain or sub-domain
AEYTLPDLGWDYAASGPG

SEQ ID NO: 24130 - protein, 15 aa, artificial
  peptide fold or domain or sub-domain
ATYTLPEPPYDYAAL

SEQ ID NO: 24131 - protein, 13 aa, artificial
  peptide fold or domain or sub-domain
PKDSMLLLQVPVY

SEQ ID NO: 24132 - protein, 16 aa, artificial
  peptide fold or domain or sub-domain
IINDFTNLVNQVEPLK

SEQ ID NO: 24133 - protein, 17 aa, artificial
  peptide fold or domain or sub-domain
MERQVFIRLRHRLEADP

SEQ ID NO: 24134 - protein, 26 aa, artificial
  peptide fold or domain or sub-domain
MKFYTIKLPKFLGGIVRAMLGSFRKD

SEQ ID NO: 24135 - protein, 20 aa, artificial
  peptide fold or domain or sub-domain
AEQTDSTWGLDRISHEDYSA

SEQ ID NO: 24136 - protein, 21 aa, artificial
  peptide fold or domain or sub-domain
FVLPFDVLDSGRDLDRGWPYA

SEQ ID NO: 24137 - protein, 16 aa, artificial
  peptide fold or domain or sub-domain
QLYAPSALVLTVGQQD

SEQ ID NO: 24138 - protein, 26 aa, artificial
  peptide fold or domain or sub-domain
MSNFHNEHVMQFYRNNLKTKGVFGRQ

SEQ ID NO: 24139 - protein, 21 aa, artificial
  peptide fold or domain or sub-domain
GAGEEDLIMLDIYAIEELARA

SEQ ID NO: 24140 - protein, 11 aa, artificial
  peptide fold or domain or sub-domain
ISVDELSNYNF

SEQ ID NO: 24141 - protein, 12 aa, artificial
  peptide fold or domain or sub-domain
EHDPSAPGNGYC

SEQ ID NO: 24142 - protein, 18 aa, artificial
  peptide fold or domain or sub-domain
GTGNSQHSGQVQIGTTKS

SEQ ID NO: 24143 - protein, 14 aa, artificial
  peptide fold or domain or sub-domain
NFLGTLINLAKKIM

SEQ ID NO: 24144 - protein, 13 aa, artificial
  peptide fold or domain or sub-domain
FVQWFSKFLGRIL

SEQ ID NO: 24145 - protein, 21 aa, artificial
  peptide fold or domain or sub-domain
ALCNCNRIIIPHMCWKKCGKK

SEQ ID NO: 24146 - protein, 21 aa, artificial
  peptide fold or domain or sub-domain
GSKKPVPIIYCNRRTGKCQRM

SEQ ID NO: 24147 - protein, 20 aa, artificial
  peptide fold or domain or sub-domain
VKQIEFKYAFQEALNSAGDK

SEQ ID NO: 24148 - protein, 11 aa, artificial
  peptide fold or domain or sub-domain
FCTMIPIPRCY

SEQ ID NO: 24149 - protein, 12 aa, artificial
  peptide fold or domain or sub-domain
RVCFAIPLPICH

SEQ ID NO: 24150 - protein, 12 aa, artificial
  peptide fold or domain or sub-domain
RVCYAIPLPICY

SEQ ID NO: 24151 - protein, 25 aa, artificial
  peptide fold or domain or sub-domain
EAEPKPFNPVCYEPKEVGPCKAYVP

SEQ ID NO: 24152 - protein, 12 aa, artificial
  peptide fold or domain or sub-domain
DEPKPDQFVGLM

SEQ ID NO: 24153 - protein, 11 aa, artificial
  peptide fold or domain or sub-domain
QPHPDEFVGLM

SEQ ID NO: 24154 - protein, 14 aa, artificial
  peptide fold or domain or sub-domain
GNTKKAVPGFYGTR

SEQ ID NO: 24155 - protein, 11 aa, artificial
  peptide fold or domain or sub-domain
QPDPNAFYGLM

SEQ ID NO: 24156 - protein, 11 aa, artificial
  peptide fold or domain or sub-domain
QPNPDEFVGLM

SEQ ID NO: 24157 - protein, 18 aa, artificial
  peptide fold or domain or sub-domain
SPSNSKCPDGPDCFVGLM

SEQ ID NO: 24158 - protein, 11 aa, artificial
  peptide fold or domain or sub-domain
QADPKTFYGLM

SEQ ID NO: 24159 - protein, 11 aa, artificial
  peptide fold or domain or sub-domain
QPHPNEFVGLM

SEQ ID NO: 24160 - protein, 11 aa, artificial
  peptide fold or domain or sub-domain
QPNPDEFFGLM

SEQ ID NO: 24161 - protein, 11 aa, artificial
  peptide fold or domain or sub-domain
QPNPNEFFGLM

SEQ ID NO: 24162 - protein, 11 aa, artificial
  peptide fold or domain or sub-domain
RPRPQQFFGLM

SEQ ID NO: 24163 - protein, 11 aa, artificial
  peptide fold or domain or sub-domain
KPRPHQFFGLM

SEQ ID NO: 24164 - protein, 11 aa, artificial
  peptide fold or domain or sub-domain
KPSPDRFYGLM

SEQ ID NO: 24165 - protein, 11 aa, artificial
  peptide fold or domain or sub-domain
KPNPERFYGLM

SEQ ID NO: 24166 - protein, 11 aa, artificial
  peptide fold or domain or sub-domain
KPRPGQFFGLM

SEQ ID NO: 24167 - protein, 21 aa, artificial
  peptide fold or domain or sub-domain
SPANAQITRKRHKINSFVGLM

SEQ ID NO: 24168 - protein, 14 aa, artificial
  peptide fold or domain or sub-domain
DDASDRAKKFYGLM

SEQ ID NO: 24169 - protein, 11 aa, artificial
  peptide fold or domain or sub-domain
QPSKDAFIGLM

SEQ ID NO: 24170 - protein, 12 aa, artificial
  peptide fold or domain or sub-domain
DVPKSDQFVGLM

SEQ ID NO: 24171 - protein, 11 aa, artificial
  peptide fold or domain or sub-domain
QADPNKFYGLM

SEQ ID NO: 24172 - protein, 21 aa, artificial
  peptide fold or domain or sub-domain
LDEFRVYSDDANKYKISIPQD

SEQ ID NO: 24173 - protein, 20 aa, artificial
  peptide fold or domain or sub-domain
KTGVNKPELLPKEETTVIDV

SEQ ID NO: 24174 - protein, 30 aa, artificial
  peptide fold or domain or sub-domain
APLEDEDDLELLEKVKRDRKKRLERQGAIN

SEQ ID NO: 24175 - protein, 23 aa, artificial
  peptide fold or domain or sub-domain
ANQRLPPLSNDPDRCERAFVGNT

SEQ ID NO: 24176 - protein, 20 aa, artificial
  peptide fold or domain or sub-domain
EQSAGFREYIDFFDGYSLTY

SEQ ID NO: 24177 - protein, 19 aa, artificial
  peptide fold or domain or sub-domain
VVGGDECNINEHRSLVAIF

SEQ ID NO: 24178 - protein, 24 aa, artificial
  peptide fold or domain or sub-domain
KASSSAPKGWTHHGSRFTFHRGSM

SEQ ID NO: 24179 - protein, 18 aa, artificial
  peptide fold or domain or sub-domain
ATGWSAFFIDGKWTEAKK

SEQ ID NO: 24180 - protein, 17 aa, artificial
  peptide fold or domain or sub-domain
TFDVCYEQLFFVGGNWK

SEQ ID NO: 24181 - protein, 20 aa, artificial
  peptide fold or domain or sub-domain
MKEPKSNIRKLIDIGGLIGR

SEQ ID NO: 24182 - protein, 19 aa, artificial
  peptide fold or domain or sub-domain
NGERAPGSKKAPSGFLGTR

SEQ ID NO: 24183 - protein, 26 aa, artificial
  peptide fold or domain or sub-domain
MIAPIFAELAKTVGADKDGLPTLVAK

SEQ ID NO: 24184 - protein, 21 aa, artificial
  peptide fold or domain or sub-domain
IVGGTAADISQFPHQLSLQTT

SEQ ID NO: 24185 - protein, 23 aa, artificial
  peptide fold or domain or sub-domain
RDFTHTIIDNSDLFSESRNTRLG

SEQ ID NO: 24186 - protein, 15 aa, artificial
  peptide fold or domain or sub-domain
RKRHPDCDKAADTRI

SEQ ID NO: 24187 - protein, 15 aa, artificial
  peptide fold or domain or sub-domain
RQRHPDCDKPPDTGN

SEQ ID NO: 24188 - protein, 29 aa, artificial
  peptide fold or domain or sub-domain
AKKELCTCQQPKHLKYIEKGLQKAKDYAT

SEQ ID NO: 24189 - protein, 24 aa, artificial
  peptide fold or domain or sub-domain
EDTEKVEVKAKPSKTSRGAIGQGF

SEQ ID NO: 24190 - protein, 27 aa, artificial
  peptide fold or domain or sub-domain
RSCCPCYWGGCPWGQNCYPEGCSGPKV

SEQ ID NO: 24191 - protein, 26 aa, artificial
  peptide fold or domain or sub-domain
DDLHPFNENNMYYGCKGLSNSNKFED

SEQ ID NO: 24192 - protein, 20 aa, artificial
  peptide fold or domain or sub-domain
ADVPGNYPLNSYGASYYCTI

SEQ ID NO: 24193 - protein, 21 aa, artificial
  peptide fold or domain or sub-domain
AKTGILDSDGPTVAGNSLSGT

SEQ ID NO: 24194 - protein, 13 aa, artificial
  peptide fold or domain or sub-domain
FHGGSWYRFPWGY

SEQ ID NO: 24195 - protein, 18 aa, artificial
  peptide fold or domain or sub-domain
AAVSLLQNKLAYDGFLSK

SEQ ID NO: 24196 - protein, 14 aa, artificial
  peptide fold or domain or sub-domain
ADEGFSATVRNGAV

SEQ ID NO: 24197 - protein, 22 aa, artificial
  peptide fold or domain or sub-domain
IILELAAVDSASGKLLINGNFK

SEQ ID NO: 24198 - protein, 15 aa, artificial
  peptide fold or domain or sub-domain
NDWRNAMYPVVPGHE

SEQ ID NO: 24199 - protein, 14 aa, artificial
  peptide fold or domain or sub-domain
VSTLLPVVAAEEPA

SEQ ID NO: 24200 - protein, 15 aa, artificial
  peptide fold or domain or sub-domain
QVWYDREVTAFVEPG

SEQ ID NO: 24201 - protein, 15 aa, artificial
  peptide fold or domain or sub-domain
ALSVPVFAVAPLNKK

SEQ ID NO: 24202 - protein, 14 aa, artificial
  peptide fold or domain or sub-domain
DVHSNTGIFGIHTS

SEQ ID NO: 24203 - protein, 15 aa, artificial
  peptide fold or domain or sub-domain
NGRRYTTYGCSPPVT

SEQ ID NO: 24204 - protein, 15 aa, artificial
  peptide fold or domain or sub-domain
AIGGLSRSFPVEAFE

SEQ ID NO: 24205 - protein, 15 aa, artificial
  peptide fold or domain or sub-domain
EREQLRDQVYDAMAE

SEQ ID NO: 24206 - protein, 15 aa, artificial
  peptide fold or domain or sub-domain
SGTSPLLPAITFILD

SEQ ID NO: 24207 - protein, 20 aa, artificial
  peptide fold or domain or sub-domain
QKVAVRLKEVVYTLSPHQQN

SEQ ID NO: 24208 - protein, 23 aa, artificial
  peptide fold or domain or sub-domain
RLKVIPEKLKDVKLVCTDVFGDN

SEQ ID NO: 24209 - protein, 12 aa, artificial
  peptide fold or domain or sub-domain
SGHTKIKVAVDT

SEQ ID NO: 24210 - protein, 23 aa, artificial
  peptide fold or domain or sub-domain
DINGEVINELAATAGAIMETNLK

SEQ ID NO: 24211 - protein, 19 aa, artificial
  peptide fold or domain or sub-domain
HIGLVRLTPTEVQEPIITA

SEQ ID NO: 24212 - protein, 13 aa, artificial
  peptide fold or domain or sub-domain
FYSAPTRDNVFEL

SEQ ID NO: 24213 - protein, 13 aa, artificial
  peptide fold or domain or sub-domain
MYVLQEINPGITS

SEQ ID NO: 24214 - protein, 13 aa, artificial
  peptide fold or domain or sub-domain
MIYSTEVSNMAGV

SEQ ID NO: 24215 - protein, 20 aa, artificial
  peptide fold or domain or sub-domain
LLSTLTDTSIKEAVATDKAP

SEQ ID NO: 24216 - protein, 15 aa, artificial
  peptide fold or domain or sub-domain
TQAGSQNPNDLSPGP

SEQ ID NO: 24217 - protein, 21 aa, artificial
  peptide fold or domain or sub-domain
ADETCTDLTILTTQYIAGDFD

SEQ ID NO: 24218 - protein, 14 aa, artificial
  peptide fold or domain or sub-domain
VAANLGVTEELEAS

SEQ ID NO: 24219 - protein, 19 aa, artificial
  peptide fold or domain or sub-domain
GIVDFAKKVVGGIRNALGI

SEQ ID NO: 24220 - protein, 19 aa, artificial
  peptide fold or domain or sub-domain
GFFDLAKKVVGGIRNALGI

SEQ ID NO: 24221 - protein, 19 aa, artificial
  peptide fold or domain or sub-domain
GIVDFAKGVLGKIKNVLGI

SEQ ID NO: 24222 - protein, 19 aa, artificial
  peptide fold or domain or sub-domain
GILDIAKKLVGGIRNVLGI

SEQ ID NO: 24223 - protein, 19 aa, artificial
  peptide fold or domain or sub-domain
GILDVAKTLVGKLRNVLGI

SEQ ID NO: 24224 - protein, 17 aa, artificial
  peptide fold or domain or sub-domain
GVLDAFKKIATVVKNLV

SEQ ID NO: 24225 - protein, 17 aa, artificial
  peptide fold or domain or sub-domain
GVGDLIRKAVAAIKNIV

SEQ ID NO: 24226 - protein, 17 aa, artificial
  peptide fold or domain or sub-domain
GVGDLIRKAVSVIKNIV

SEQ ID NO: 24227 - protein, 17 aa, artificial
  peptide fold or domain or sub-domain
GVIDAAKKVVNVLKNLP

SEQ ID NO: 24228 - protein, 17 aa, artificial
  peptide fold or domain or sub-domain
GVGDIFRKIVSTIKNVV

SEQ ID NO: 24229 - protein, 17 aa, artificial
  peptide fold or domain or sub-domain
GVGSFIHKVVSAIKNVA

SEQ ID NO: 24230 - protein, 13 aa, artificial
  peptide fold or domain or sub-domain
FQFVNPSDIVFGS

SEQ ID NO: 24231 - protein, 30 aa, artificial
  peptide fold or domain or sub-domain
GLAGAISSALDKLKQSQLIKNYAKKLGYPR

SEQ ID NO: 24232 - protein, 13 aa, artificial
  peptide fold or domain or sub-domain
GWFDVVKHIASAV

SEQ ID NO: 24233 - protein, 30 aa, artificial
  peptide fold or domain or sub-domain
MKTISRQAYADMFGPTTGDRLRLADTELFL

SEQ ID NO: 24234 - protein, 15 aa, artificial
  peptide fold or domain or sub-domain
PQISRQEYGGLFGPT

SEQ ID NO: 24235 - protein, 15 aa, artificial
  peptide fold or domain or sub-domain
SNTKQPTPLGGVIFA

SEQ ID NO: 24236 - protein, 14 aa, artificial
  peptide fold or domain or sub-domain
ATKGSSDNRVLTGV

SEQ ID NO: 24237 - protein, 14 aa, artificial
  peptide fold or domain or sub-domain
SPTEQPYSSAAPLI

SEQ ID NO: 24238 - protein, 12 aa, artificial
  peptide fold or domain or sub-domain
AGTADCFWKYCV

SEQ ID NO: 24239 - protein, 12 aa, artificial
  peptide fold or domain or sub-domain
GSTSECFWKYCV

SEQ ID NO: 24240 - protein, 22 aa, artificial
  peptide fold or domain or sub-domain
MSIADLKSRLIKASTSKMTAEL

SEQ ID NO: 24241 - protein, 12 aa, artificial
  peptide fold or domain or sub-domain
MEFGNLTNLDVA

SEQ ID NO: 24242 - protein, 12 aa, artificial
  peptide fold or domain or sub-domain
MDLSFTLSVVTA

SEQ ID NO: 24243 - protein, 28 aa, artificial
  peptide fold or domain or sub-domain
KPTADFDYIVVGAGNAGNVVAYRTVQAL

SEQ ID NO: 24244 - protein, 29 aa, artificial
  peptide fold or domain or sub-domain
GLPVCGETCVGGTCNTPGCSCSWPVCTRN

SEQ ID NO: 24245 - protein, 30 aa, artificial
  peptide fold or domain or sub-domain
GVPVCGETCFGGTCNTPGCSCDPWPVCSRN

SEQ ID NO: 24246 - protein, 30 aa, artificial
  peptide fold or domain or sub-domain
AEVPMPLRQLTMTLPDGREESVMERTTLVA

SEQ ID NO: 24247 - protein, 28 aa, artificial
  peptide fold or domain or sub-domain
ASDVTLNSFAEDVTVGECCDCVDLTTVY

SEQ ID NO: 24248 - protein, 30 aa, artificial
  peptide fold or domain or sub-domain
MLRYLSLFAVGLATGYAWGWIDGLAASLTV

SEQ ID NO: 24249 - protein, 26 aa, artificial
  peptide fold or domain or sub-domain
MMCLIIYLSIFLIIVSRMLTGLPMMD

SEQ ID NO: 24250 - protein, 28 aa, artificial
  peptide fold or domain or sub-domain
HSDAVFTDNYSRFRKQMAVKKYLNSVLT

SEQ ID NO: 24251 - protein, 28 aa, artificial
  peptide fold or domain or sub-domain
HSDAIFTDNYSRFRKQMAVKKYLNSVLT

SEQ ID NO: 24252 - protein, 29 aa, artificial
  peptide fold or domain or sub-domain
GAPICGESCFTGKCYTVQCSCSWPVCTRN

SEQ ID NO: 24253 - protein, 14 aa, artificial
  peptide fold or domain or sub-domain
INWLKLGKMVIDAL

SEQ ID NO: 24254 - protein, 14 aa, artificial
  peptide fold or domain or sub-domain
IDWLKLGKMVMDVL

SEQ ID NO: 24255 - protein, 16 aa, artificial
  peptide fold or domain or sub-domain
NSATTAVYSFQDWVSA

SEQ ID NO: 24256 - protein, 13 aa, artificial
  peptide fold or domain or sub-domain
QNARIAVVYFAGY

SEQ ID NO: 24257 - protein, 27 aa, artificial
  peptide fold or domain or sub-domain
GFLGPLLKLAAKGVAKVIPHLIPSRQQ

SEQ ID NO: 24258 - protein, 25 aa, artificial
  peptide fold or domain or sub-domain
GLASTLGSFLGKFAKGGAQAFLQPK

SEQ ID NO: 24259 - protein, 23 aa, artificial
  peptide fold or domain or sub-domain
PNIQTKIIEQIWKEHIFQGTVVK

SEQ ID NO: 24260 - protein, 28 aa, artificial
  peptide fold or domain or sub-domain
MVGNFPGANYSRDTRRAEIDIQIDIQKI

SEQ ID NO: 24261 - protein, 26 aa, artificial
  peptide fold or domain or sub-domain
MRLKELFDAQMEYFGEVFEKTEWPYW

SEQ ID NO: 24262 - protein, 21 aa, artificial
  peptide fold or domain or sub-domain
MCLGVPIKLSKLMKILFNLPQ

SEQ ID NO: 24263 - protein, 30 aa, artificial
  peptide fold or domain or sub-domain
MSELSAAPLRPGKTQESEKGIYYAREGCVS

SEQ ID NO: 24264 - protein, 28 aa, artificial
  peptide fold or domain or sub-domain
MSSLWWCFVWLISIPVICLTFTFVMRLL

SEQ ID NO: 24265 - protein, 25 aa, artificial
  peptide fold or domain or sub-domain
MDSKAVLKGMLEKAYRIEAGFEKRG

SEQ ID NO: 24266 - protein, 30 aa, artificial
  peptide fold or domain or sub-domain
MEDERREELSKVKSQKNKQNLLIFLNKKIK

SEQ ID NO: 24267 - protein, 29 aa, artificial
  peptide fold or domain or sub-domain
MLNIALHGYSLSKSAMDSRLTRKQSKSCT

SEQ ID NO: 24268 - protein, 30 aa, artificial
  peptide fold or domain or sub-domain
MGFNGILALKQRTSFLIGIYVFLLEERVCV

SEQ ID NO: 24269 - protein, 30 aa, artificial
  peptide fold or domain or sub-domain
MQTFSLLVAYKIFTDGTETKRVHASKAKHA

SEQ ID NO: 24270 - protein, 27 aa, artificial
  peptide fold or domain or sub-domain
MRDVTVVATSKFNIVKNRIKAERWVKI

SEQ ID NO: 24271 - protein, 30 aa, artificial
  peptide fold or domain or sub-domain
MPVCTSRSLQGGKVDTHFPLHVLHSVACDV

SEQ ID NO: 24272 - protein, 26 aa, artificial
  peptide fold or domain or sub-domain
MRLNYSRCYYSSQRRRQSLPKRFSLI

SEQ ID NO: 24273 - protein, 30 aa, artificial
  peptide fold or domain or sub-domain
MSISFPKMQHLIVMTTIGDKKVNNNIILFL

SEQ ID NO: 24274 - protein, 27 aa, artificial
  peptide fold or domain or sub-domain
MLFKKISKFVGWLSGSSVGSITSKTHE

SEQ ID NO: 24275 - protein, 29 aa, artificial
  peptide fold or domain or sub-domain
MTKNKFVLLRYLCLFCTNIDQIDFNSVLK

SEQ ID NO: 24276 - protein, 25 aa, artificial
  peptide fold or domain or sub-domain
MFEISFYIALKNFNSLGILKMWRFI

SEQ ID NO: 24277 - protein, 27 aa, artificial
  peptide fold or domain or sub-domain
MKIFLYLLRKKIAEVWIFQNPANFLSL

SEQ ID NO: 24278 - protein, 29 aa, artificial
  peptide fold or domain or sub-domain
MLYPLSYMLLWTDSIVEQYKKFYLFRFDL

SEQ ID NO: 24279 - protein, 26 aa, artificial
  peptide fold or domain or sub-domain
MVLVKTIKKLDGFIECLLMLNYKFLY

SEQ ID NO: 24280 - protein, 29 aa, artificial
  peptide fold or domain or sub-domain
MKRSYKTLPTYFFSFFGPFKERAVFLLVL

SEQ ID NO: 24281 - protein, 28 aa, artificial
  peptide fold or domain or sub-domain
MLPRKYKPAYKKQAHRVKSNPQPAYTFQ

SEQ ID NO: 24282 - protein, 23 aa, artificial
  peptide fold or domain or sub-domain
MRKLRKNWRKSIVSPVLYTNEKW

SEQ ID NO: 24283 - protein, 28 aa, artificial
  peptide fold or domain or sub-domain
MLPSISFDYIKRPNIVLFSNVLSLSSNI

SEQ ID NO: 24284 - protein, 28 aa, artificial
  peptide fold or domain or sub-domain
MNLNAYFEAYQAIFPFLLEAFLRKEQKV

SEQ ID NO: 24285 - protein, 27 aa, artificial
  peptide fold or domain or sub-domain
MTAFASLREPLVLANLKIKVHIYRMKR

SEQ ID NO: 24286 - protein, 29 aa, artificial
  peptide fold or domain or sub-domain
MKIKFSRGARFSATFSFDKYPFLLYEVVR

SEQ ID NO: 24287 - protein, 27 aa, artificial
  peptide fold or domain or sub-domain
MTRCISKKMLLEVDALSLIYSPHLYMS

SEQ ID NO: 24288 - protein, 16 aa, artificial
  peptide fold or domain or sub-domain
MLSLIFYLRFPSYIRG

SEQ ID NO: 24289 - protein, 28 aa, artificial
  peptide fold or domain or sub-domain
MRKPSAFHACNIIFLPLVKCASATIMLN

SEQ ID NO: 24290 - protein, 29 aa, artificial
  peptide fold or domain or sub-domain
MFKMKFGDTLPRSDFGTGGNKQAPGLELG

SEQ ID NO: 24291 - protein, 27 aa, artificial
  peptide fold or domain or sub-domain
MYSYIYKALLYHGYEKFDLDIWEYFNK

SEQ ID NO: 24292 - protein, 30 aa, artificial
  peptide fold or domain or sub-domain
MPIIGVPRCLENPFCAPAKFPLSVKKKIRI

SEQ ID NO: 24293 - protein, 13 aa, artificial
  peptide fold or domain or sub-domain
TTAIEPFISLGDK

SEQ ID NO: 24294 - protein, 28 aa, artificial
  peptide fold or domain or sub-domain
MAKFEDKVDDNSPKVLCESSNQPVKEHS

SEQ ID NO: 24295 - protein, 23 aa, artificial
  peptide fold or domain or sub-domain
MKRKNASVQETPFHFVKQAVSIA

SEQ ID NO: 24296 - protein, 30 aa, artificial
  peptide fold or domain or sub-domain
MKLITCIEIIEDERRKRETWLQKEMKKTKI

SEQ ID NO: 24297 - protein, 29 aa, artificial
  peptide fold or domain or sub-domain
ASNEYFDIHGIDGEIISTRANNTAFELTR

SEQ ID NO: 24298 - protein, 30 aa, artificial
  peptide fold or domain or sub-domain
ARMHTRRRGSSGSDRPTADEPPZGSBVBZB

SEQ ID NO: 24299 - protein, 26 aa, artificial
  peptide fold or domain or sub-domain
AEYTPKELYALKQQVDMPAVFTQTAV

SEQ ID NO: 24300 - protein, 24 aa, artificial
  peptide fold or domain or sub-domain
MVSEMTPTRRVMAAVLGGRVDYVP

SEQ ID NO: 24301 - protein, 15 aa, artificial
  peptide fold or domain or sub-domain
MNQLFGEKLAKAEKM

SEQ ID NO: 24302 - protein, 15 aa, artificial
  peptide fold or domain or sub-domain
MEYKPIKKVVSGNYA

SEQ ID NO: 24303 - protein, 22 aa, artificial
  peptide fold or domain or sub-domain
MIRLSKVKTDPIENLKKHAEAI

SEQ ID NO: 24304 - protein, 19 aa, artificial
  peptide fold or domain or sub-domain
MIAETLKELIDDFEVINAN

SEQ ID NO: 24305 - protein, 16 aa, artificial
  peptide fold or domain or sub-domain
MEYVKNVVPFGTLDII

SEQ ID NO: 24306 - protein, 22 aa, artificial
  peptide fold or domain or sub-domain
MEYIIKNGFVYPLNNVDGEMDI

SEQ ID NO: 24307 - protein, 15 aa, artificial
  peptide fold or domain or sub-domain
AKLYPEEFYNSADWF

SEQ ID NO: 24308 - protein, 20 aa, artificial
  peptide fold or domain or sub-domain
MSGPEANGAPGSTNTDSDRS

SEQ ID NO: 24309 - protein, 30 aa, artificial
  peptide fold or domain or sub-domain
MSGNHNHPPHRTTPIEVMCNPPTKEVNYNE

SEQ ID NO: 24310 - protein, 29 aa, artificial
  peptide fold or domain or sub-domain
MLDNCQCVCPFCGERDKCDCAVDDAGTGG

SEQ ID NO: 24311 - protein, 30 aa, artificial
  peptide fold or domain or sub-domain
MIAIVLVVMAVTLIGGFYLVKYLVERTFNS

SEQ ID NO: 24312 - protein, 27 aa, artificial
  peptide fold or domain or sub-domain
MLQEGLPLRISKKGKIFPNLEVKFPRK

SEQ ID NO: 24313 - protein, 30 aa, artificial
  peptide fold or domain or sub-domain
MAYSHSRGLLYTTPTDSDQSDTTPAQPADD

SEQ ID NO: 24314 - protein, 30 aa, artificial
  peptide fold or domain or sub-domain
MQGEEKKENAERKVVKQIETTRVVMKFSVF

SEQ ID NO: 24315 - protein, 30 aa, artificial
  peptide fold or domain or sub-domain
MPTRDIYVLVNGAKVDKTVCSQRRRTVSAP

SEQ ID NO: 24316 - protein, 28 aa, artificial
  peptide fold or domain or sub-domain
MTVAEIKASVAELKVAVGSLGRRWGRDT

SEQ ID NO: 24317 - protein, 16 aa, artificial
  peptide fold or domain or sub-domain
MEKCFNPCFNGSCSRI

SEQ ID NO: 24318 - protein, 24 aa, artificial
  peptide fold or domain or sub-domain
MSHYRHRDYAVIIEGCTRREGLKV

SEQ ID NO: 24319 - protein, 26 aa, artificial
  peptide fold or domain or sub-domain
MALVGPGKTTLTEEVLALDGKGLLPS

SEQ ID NO: 24320 - protein, 25 aa, artificial
  peptide fold or domain or sub-domain
MHVWGFHEAKDYVKARLSYVRRMAE

SEQ ID NO: 24321 - protein, 25 aa, artificial
  peptide fold or domain or sub-domain
MGREASFLVMEREAISKWGSMRLRF

SEQ ID NO: 24322 - protein, 30 aa, artificial
  peptide fold or domain or sub-domain
MSEAKASIIMAIVTTAVVALDNAVASLRKL

SEQ ID NO: 24323 - protein, 30 aa, artificial
  peptide fold or domain or sub-domain
MSQKELLFLVLTGIALMMFVTAMVLVSGAS

SEQ ID NO: 24324 - protein, 30 aa, artificial
  peptide fold or domain or sub-domain
MHWKSLRDKRFSSTVNPQSERRYDVYAEPT

SEQ ID NO: 24325 - protein, 29 aa, artificial
  peptide fold or domain or sub-domain
MDYGLLALLYIAALAASIHFVPRTAGARR

SEQ ID NO: 24326 - protein, 28 aa, artificial
  peptide fold or domain or sub-domain
MGLDETLRADWQFRRYVETPMTQRIEEY

SEQ ID NO: 24327 - protein, 23 aa, artificial
  peptide fold or domain or sub-domain
MGQGGVDRDYIKTLILDIKTAVE

SEQ ID NO: 24328 - protein, 30 aa, artificial
  peptide fold or domain or sub-domain
MADFFRGVAGLTIGNERGLIPDTESATDGR

SEQ ID NO: 24329 - protein, 29 aa, artificial
  peptide fold or domain or sub-domain
MEFGAYDSGSLKEISIELRLVTAFVGVYR

SEQ ID NO: 24330 - protein, 30 aa, artificial
  peptide fold or domain or sub-domain
MFITGMPLLNNDWDLPAQLSLKSSTYHLST

SEQ ID NO: 24331 - protein, 29 aa, artificial
  peptide fold or domain or sub-domain
MLRLLGTVAAVGLSAWALETAGYIDVLPV

SEQ ID NO: 24332 - protein, 23 aa, artificial
  peptide fold or domain or sub-domain
MPSNTQTSNSSMGVNGYSYCVVM

SEQ ID NO: 24333 - protein, 13 aa, artificial
  peptide fold or domain or sub-domain
MSTLDLIDRDACT

SEQ ID NO: 24334 - protein, 16 aa, artificial
  peptide fold or domain or sub-domain
QSNCPEEGIKYLPKSD

SEQ ID NO: 24335 - protein, 20 aa, artificial
  peptide fold or domain or sub-domain
WSDPAYRCKNPQGTKSSDYS

SEQ ID NO: 24336 - protein, 29 aa, artificial
  peptide fold or domain or sub-domain
IITYIMRCSPIFVTQKKMQSYLDFTPTAS

SEQ ID NO: 24337 - protein, 16 aa, artificial
  peptide fold or domain or sub-domain
MAIPEEFDIIVCGGGS

SEQ ID NO: 24338 - protein, 17 aa, artificial
  peptide fold or domain or sub-domain
MHQQHSVCFTSYFLPWQ

SEQ ID NO: 24339 - protein, 24 aa, artificial
  peptide fold or domain or sub-domain
MLLKVHGRKISAGHLYKIGLFFHI

SEQ ID NO: 24340 - protein, 24 aa, artificial
  peptide fold or domain or sub-domain
AMTTNLVLGQQQKESKPTHTIDSN

SEQ ID NO: 24341 - protein, 28 aa, artificial
  peptide fold or domain or sub-domain
MKLPSILNPTAQNKNLQETKINHVESYI

SEQ ID NO: 24342 - protein, 23 aa, artificial
  peptide fold or domain or sub-domain
RIVATAASRSTCKFASSSTTHIK

SEQ ID NO: 24343 - protein, 30 aa, artificial
  peptide fold or domain or sub-domain
MVEGTWEHNDTSLRLLFQFRYWDFVNGSSD

SEQ ID NO: 24344 - protein, 30 aa, artificial
  peptide fold or domain or sub-domain
MPVDETERGEDKATMLPRNCRIMLQYLTVS

SEQ ID NO: 24345 - protein, 30 aa, artificial
  peptide fold or domain or sub-domain
MPTTQFKGVTQTCSELCPVHRWVTRDSFML

SEQ ID NO: 24346 - protein, 30 aa, artificial
  peptide fold or domain or sub-domain
MLPSPLTFQTPRKRKTSDDGSDSGQKRVKA

SEQ ID NO: 24347 - protein, 29 aa, artificial
  peptide fold or domain or sub-domain
MSSRRPGVPRPEAWAGASIWIRRLKSNGQ

SEQ ID NO: 24348 - protein, 30 aa, artificial
  peptide fold or domain or sub-domain
MPTKGAARARWTVMVGLNETDASSSCASML

SEQ ID NO: 24349 - protein, 30 aa, artificial
  peptide fold or domain or sub-domain
MRLALAVRIHSYILHSVVPSFINNYDNNIT

SEQ ID NO: 24350 - protein, 29 aa, artificial
  peptide fold or domain or sub-domain
MTKEYVLIEYFWVTGRSKYFRMTRSLQMQ

SEQ ID NO: 24351 - protein, 30 aa, artificial
  peptide fold or domain or sub-domain
MTCLKIAFNTHAQNFCLQIERLKSFATMHA

SEQ ID NO: 24352 - protein, 29 aa, artificial
  peptide fold or domain or sub-domain
MLAILTGYLRQDACTDYLRAEGQYLSGAG

SEQ ID NO: 24353 - protein, 29 aa, artificial
  peptide fold or domain or sub-domain
MAKDSLDESERLLIANPKKVNIPPVEIRC

SEQ ID NO: 24354 - protein, 29 aa, artificial
  peptide fold or domain or sub-domain
MPIFTSKNEWQDADMLVLHRDNGDAGSFE

SEQ ID NO: 24355 - protein, 30 aa, artificial
  peptide fold or domain or sub-domain
MYNLGEVEGWAYTLPSRNLFIDRQDIDGSS

SEQ ID NO: 24356 - protein, 30 aa, artificial
  peptide fold or domain or sub-domain
MLKEVRDDNRENDAEHMKPGVPGAETVQNR

SEQ ID NO: 24357 - protein, 30 aa, artificial
  peptide fold or domain or sub-domain
MYIYYLNETSESIKKLRPPKANRKTAQHSM

SEQ ID NO: 24358 - protein, 30 aa, artificial
  peptide fold or domain or sub-domain
MDNIILPYQLQMQKKPQDSCNDGNYEYMRL

SEQ ID NO: 24359 - protein, 29 aa, artificial
  peptide fold or domain or sub-domain
MPDIKLMPGLVETPETKLPLPERSHDSGN

SEQ ID NO: 24360 - protein, 29 aa, artificial
  peptide fold or domain or sub-domain
MALVRTGKAEDTDRVSPAIEGQPTRHISQ

SEQ ID NO: 24361 - protein, 30 aa, artificial
  peptide fold or domain or sub-domain
MSVISGICTLTTWCCLLTATAHGSQDAAVE

SEQ ID NO: 24362 - protein, 30 aa, artificial
  peptide fold or domain or sub-domain
MANENVLQQIPLVFGVSDMRGPTELIDEKA

SEQ ID NO: 24363 - protein, 30 aa, artificial
  peptide fold or domain or sub-domain
MLHQALELVVYFIELEVVIREFRVTEEIRR

SEQ ID NO: 24364 - protein, 30 aa, artificial
  peptide fold or domain or sub-domain
MAISHLNCGRSAAKPSSKGLAEEVEARRAE

SEQ ID NO: 24365 - protein, 29 aa, artificial
  peptide fold or domain or sub-domain
MAPSIGSDRHLEMQEARGRSMRVRDSRTR

SEQ ID NO: 24366 - protein, 29 aa, artificial
  peptide fold or domain or sub-domain
MTLECDRDSVLMIARFSSDVALLCERKAK

SEQ ID NO: 24367 - protein, 29 aa, artificial
  peptide fold or domain or sub-domain
MAKESYKGSPGSPGCSYVDMSNRNIVEAL

SEQ ID NO: 24368 - protein, 30 aa, artificial
  peptide fold or domain or sub-domain
MQLTADALETSRPADNFGRTNRIGYDRRNG

SEQ ID NO: 24369 - protein, 30 aa, artificial
  peptide fold or domain or sub-domain
MHGDFNAAQLPEVRVSAVPDGKPSGELVTQ

SEQ ID NO: 24370 - protein, 30 aa, artificial
  peptide fold or domain or sub-domain
MGLAHSGVVTPPPRKDILTPEHTMKNQVFI

SEQ ID NO: 24371 - protein, 30 aa, artificial
  peptide fold or domain or sub-domain
MNWPMKVASEDLTHEGRLVMVLVRPTLGPQ

SEQ ID NO: 24372 - protein, 30 aa, artificial
  peptide fold or domain or sub-domain
MPVLPSRQEKRGVGKKPCRDDFNLFGVFTV

SEQ ID NO: 24373 - protein, 30 aa, artificial
  peptide fold or domain or sub-domain
MVFGYSGQLHVSTPLDEKGERAMQMYQFGY

SEQ ID NO: 24374 - protein, 30 aa, artificial
  peptide fold or domain or sub-domain
MSRITENPLIGTRRVISDGASVPESRKQDP

SEQ ID NO: 24375 - protein, 30 aa, artificial
  peptide fold or domain or sub-domain
MATAFASGTEENAEIVPRDEGSTWLHHGGL

SEQ ID NO: 24376 - protein, 29 aa, artificial
  peptide fold or domain or sub-domain
MSVQHPHAVYPARMLSDARRGAQDPGFDV

SEQ ID NO: 24377 - protein, 29 aa, artificial
  peptide fold or domain or sub-domain
MMTTGMIGEDGIHVDMDHLKKGEVKYEIP

SEQ ID NO: 24378 - protein, 29 aa, artificial
  peptide fold or domain or sub-domain
MSWLLALLFNLSHSEQDGPASSSAELVLW

SEQ ID NO: 24379 - protein, 29 aa, artificial
  peptide fold or domain or sub-domain
MPCMLWHHARYLHPTVSQVPAFVFVIIVL

SEQ ID NO: 24380 - protein, 29 aa, artificial
  peptide fold or domain or sub-domain
MAGKQVTPGAPLWFGHVFLGDHQRSEASR

SEQ ID NO: 24381 - protein, 29 aa, artificial
  peptide fold or domain or sub-domain
MTSPLQPPYRELHAQSHAVLNLSNGISGF

SEQ ID NO: 24382 - protein, 29 aa, artificial
  peptide fold or domain or sub-domain
MTPQGTVVDLHRGYVVSVNFLFQKERYCP

SEQ ID NO: 24383 - protein, 30 aa, artificial
  peptide fold or domain or sub-domain
MKAVKKRRQDQDPSGNIIISNPGSKQVPRK

SEQ ID NO: 24384 - protein, 30 aa, artificial
  peptide fold or domain or sub-domain
MAGIARRLPRFAKYLDLCQTMVVMAVAART

SEQ ID NO: 24385 - protein, 30 aa, artificial
  peptide fold or domain or sub-domain
MTKSRAIIKEESSTCSSVPLYMTNRGQGPA

SEQ ID NO: 24386 - protein, 17 aa, artificial
  peptide fold or domain or sub-domain
MLQSSKILGAGLATVAV

SEQ ID NO: 24387 - protein, 17 aa, artificial
  peptide fold or domain or sub-domain
MLQSSKILGAGLRTVGV

SEQ ID NO: 24388 - protein, 29 aa, artificial
  peptide fold or domain or sub-domain
MPCPAAQRFQHQEIANTMYPGDLTIHSGK

SEQ ID NO: 24389 - protein, 29 aa, artificial
  peptide fold or domain or sub-domain
MQHGHKMSTKNTGEVNIRQKGIWQEEIQN

SEQ ID NO: 24390 - protein, 29 aa, artificial
  peptide fold or domain or sub-domain
MAIQVDPTVSEKLPKRANKRNFPNKQAKT

SEQ ID NO: 24391 - protein, 30 aa, artificial
  peptide fold or domain or sub-domain
MASRKKMEIPDSALGSMQHSVEMQGAFEPE

SEQ ID NO: 24392 - protein, 29 aa, artificial
  peptide fold or domain or sub-domain
MSSTEFHHLYQFFSIYYKAKLLQSDNYKS

SEQ ID NO: 24393 - protein, 30 aa, artificial
  peptide fold or domain or sub-domain
MSEDIAGLDVADLAGWFEGVVRGADGPSPG

SEQ ID NO: 24394 - protein, 29 aa, artificial
  peptide fold or domain or sub-domain
MNVSEFPVEISLQSMLLSDSLYEVLVMVK

SEQ ID NO: 24395 - protein, 29 aa, artificial
  peptide fold or domain or sub-domain
MGGYADQLEGLASHPLPHFKVEAGTTLDL

SEQ ID NO: 24396 - protein, 30 aa, artificial
  peptide fold or domain or sub-domain
MKVHLASGEAKMMQVGWNAEISNWKVEFSS

SEQ ID NO: 24397 - protein, 29 aa, artificial
  peptide fold or domain or sub-domain
MALIAWLEAQGSIGDLTERDQRTLKVPDM

SEQ ID NO: 24398 - protein, 30 aa, artificial
  peptide fold or domain or sub-domain
MASHSERKEHGEILGRVGETHARVNSSEGL

SEQ ID NO: 24399 - protein, 30 aa, artificial
  peptide fold or domain or sub-domain
MNQKAIYKDFTIFLSHESKSSQAMSYLRES

SEQ ID NO: 24400 - protein, 30 aa, artificial
  peptide fold or domain or sub-domain
MPCIYSETASHCIRSRLKRYTAEDHINPPN

SEQ ID NO: 24401 - protein, 30 aa, artificial
  peptide fold or domain or sub-domain
MVHCVRRPPADALAVVDGGRWRGRDHEVPI

SEQ ID NO: 24402 - protein, 30 aa, artificial
  peptide fold or domain or sub-domain
MLNVASPYRSGKWQLPTKPLRRRAAAKIQS

SEQ ID NO: 24403 - protein, 30 aa, artificial
  peptide fold or domain or sub-domain
MPPAHISDNRPDTQPADYEGIIQGALHFAA

SEQ ID NO: 24404 - protein, 28 aa, artificial
  peptide fold or domain or sub-domain
KMLREPYAMKVARTVTTGGKTVKVYTSG

SEQ ID NO: 24405 - protein, 30 aa, artificial
  peptide fold or domain or sub-domain
MFLNHPKKKHFISGMVSFLFKYFQNQLGTN

SEQ ID NO: 24406 - protein, 27 aa, artificial
  peptide fold or domain or sub-domain
MMNKKMSGSHDKLLLKMMIGTPPHNKM

SEQ ID NO: 24407 - protein, 11 aa, artificial
  peptide fold or domain or sub-domain
MELILCNIVSF

SEQ ID NO: 24408 - protein, 21 aa, artificial
  peptide fold or domain or sub-domain
MARWYCQIHLPRVTKHRASHL

SEQ ID NO: 24409 - protein, 28 aa, artificial
  peptide fold or domain or sub-domain
MYRGTRGEIGEGRWAVKTSLSVNFVLES

SEQ ID NO: 24410 - protein, 28 aa, artificial
  peptide fold or domain or sub-domain
RCCFLGLLCMMPARAYYPIINRHTHGGS

SEQ ID NO: 24411 - protein, 16 aa, artificial
  peptide fold or domain or sub-domain
RCCFLVCSPSSPFYVI

SEQ ID NO: 24412 - protein, 15 aa, artificial
  peptide fold or domain or sub-domain
VLLSGVFTLESFYVI

SEQ ID NO: 24413 - protein, 28 aa, artificial
  peptide fold or domain or sub-domain
MVDGIVHCLSSLESGSLPPWPDFGGCRS

SEQ ID NO: 24414 - protein, 28 aa, artificial
  peptide fold or domain or sub-domain
MTINSSQGKSSILQIFIHHFKKQLLLGL

SEQ ID NO: 24415 - protein, 28 aa, artificial
  peptide fold or domain or sub-domain
MFILLLKSQLITLDFDSCSVMIINGCTK

SEQ ID NO: 24416 - protein, 11 aa, artificial
  peptide fold or domain or sub-domain
HVWMPRKQSFL

SEQ ID NO: 24417 - protein, 18 aa, artificial
  peptide fold or domain or sub-domain
MPRVHVSSNQNCYKKEGL

SEQ ID NO: 24418 - protein, 28 aa, artificial
  peptide fold or domain or sub-domain
MSYTLTPLTGEYGYDRDGHIKRQACRNW

SEQ ID NO: 24419 - protein, 30 aa, artificial
  peptide fold or domain or sub-domain
MNQNHDKQIQNTGHKVWKTSTFQGRVSRVS

SEQ ID NO: 24420 - protein, 21 aa, artificial
  peptide fold or domain or sub-domain
MSQHQAVVVFNILQITAKDED

SEQ ID NO: 24421 - protein, 26 aa, artificial
  peptide fold or domain or sub-domain
MDTDGLGTEKRSPEEQEDAGAAQPES

SEQ ID NO: 24422 - protein, 24 aa, artificial
  peptide fold or domain or sub-domain
MDCCWLCTKRLRGKSNDSSTALGQ

SEQ ID NO: 24423 - protein, 21 aa, artificial
  peptide fold or domain or sub-domain
MLIKYSQNRPDSHFYPLLTMV

SEQ ID NO: 24424 - protein, 29 aa, artificial
  peptide fold or domain or sub-domain
MMMCEVGVYLAGPSRVDDEVHAYYGLSNI

SEQ ID NO: 24425 - protein, 29 aa, artificial
  peptide fold or domain or sub-domain
MRQEKLELKFTESGKSAKELSHYWTSYTY

SEQ ID NO: 24426 - protein, 17 aa, artificial
  peptide fold or domain or sub-domain
MLSGYAVNSRYFKRNIE

SEQ ID NO: 24427 - protein, 24 aa, artificial
  peptide fold or domain or sub-domain
MPSTTAQTKVPQTSTNFNSYCVVM

SEQ ID NO: 24428 - protein, 24 aa, artificial
  peptide fold or domain or sub-domain
EFIISLYIVFGGCCSTTITMECIV

SEQ ID NO: 24429 - protein, 30 aa, artificial
  peptide fold or domain or sub-domain
LHIYWASARDPQSFLFGFPFARCTSNPCNI

SEQ ID NO: 24430 - protein, 28 aa, artificial
  peptide fold or domain or sub-domain
DFPLLEADVRGLGGCPVCFSYFLCSSHI

SEQ ID NO: 24431 - protein, 22 aa, artificial
  peptide fold or domain or sub-domain
MEILSKFFVEQIGTLSHEVSFL

SEQ ID NO: 24432 - protein, 17 aa, artificial
  peptide fold or domain or sub-domain
MAKYWIFIIRRSLNSFF

SEQ ID NO: 24433 - protein, 28 aa, artificial
  peptide fold or domain or sub-domain
MRALMESAHAFKFTNRGDKNRPFSNMGT

SEQ ID NO: 24434 - protein, 30 aa, artificial
  peptide fold or domain or sub-domain
MVDADRVAHHGIIRVRSSMASITTCLILLQ

SEQ ID NO: 24435 - protein, 15 aa, artificial
  peptide fold or domain or sub-domain
MELRKSKIGTKMYEL

SEQ ID NO: 24436 - protein, 26 aa, artificial
  peptide fold or domain or sub-domain
MRDRNHIRHCSLPLWPAQQLYGGVQL

SEQ ID NO: 24437 - protein, 30 aa, artificial
  peptide fold or domain or sub-domain
MMPGADSLQMAMFSPLPRPALSRIPLPVRL

SEQ ID NO: 24438 - protein, 30 aa, artificial
  peptide fold or domain or sub-domain
MLTIMAQNMKRHGAETQTISNVYGNRFSKS

SEQ ID NO: 24439 - protein, 29 aa, artificial
  peptide fold or domain or sub-domain
MPVALANPEPVTKLFLRHPNAQQLRQAAG

SEQ ID NO: 24440 - protein, 25 aa, artificial
  peptide fold or domain or sub-domain
MFHHIENLLIETEKRCKQKEQRYML

SEQ ID NO: 24441 - protein, 26 aa, artificial
  peptide fold or domain or sub-domain
MEHSHWFRKMSSLHQEFVCFLFWPLT

SEQ ID NO: 24442 - protein, 26 aa, artificial
  peptide fold or domain or sub-domain
MLQMRATLAFLGQTLTYNTSCQRRQK

SEQ ID NO: 24443 - protein, 27 aa, artificial
  peptide fold or domain or sub-domain
MHLNESLIYLFLETSCVAGAHFESLLD

SEQ ID NO: 24444 - protein, 30 aa, artificial
  peptide fold or domain or sub-domain
MPFSPDIAYSINYALGKYFFHRISHFLESA

SEQ ID NO: 24445 - protein, 30 aa, artificial
  peptide fold or domain or sub-domain
MHLSTLPNVPWPNRSFTTKRPPLPNMSFSW

SEQ ID NO: 24446 - protein, 28 aa, artificial
  peptide fold or domain or sub-domain
MPGIAFKGKDMVKAIQFLEIVVPCHCTT

SEQ ID NO: 24447 - protein, 30 aa, artificial
  peptide fold or domain or sub-domain
MTLSLINRSTACIQAVEQKYCRVPLPENNR

SEQ ID NO: 24448 - protein, 29 aa, artificial
  peptide fold or domain or sub-domain
MTLRHYFFLQDYKRNVENLPFYKNQATLQ

SEQ ID NO: 24449 - protein, 29 aa, artificial
  peptide fold or domain or sub-domain
MLSKSNNTLFNHDCSLSFCKEKVYSKLLV

SEQ ID NO: 24450 - protein, 25 aa, artificial
  peptide fold or domain or sub-domain
PLEGCGVDPCVLEGPPQRPQGQRPL

SEQ ID NO: 24451 - protein, 11 aa, artificial
  peptide fold or domain or sub-domain
MAGSDLVDIPP

SEQ ID NO: 24452 - protein, 30 aa, artificial
  peptide fold or domain or sub-domain
GIVVMGESNGTEGQSAYPPGTIAKLVRSSH

SEQ ID NO: 24453 - protein, 30 aa, artificial
  peptide fold or domain or sub-domain
MSAFRSIQRSTNVAKSTFKNSIRTYASAEP

SEQ ID NO: 24454 - protein, 30 aa, artificial
  peptide fold or domain or sub-domain
CPLLMIHHLYLSHHKHHQDSNKGEKVIQEV

SEQ ID NO: 24455 - protein, 28 aa, artificial
  peptide fold or domain or sub-domain
MANRTPACGKQRFGPGHVQDNAAICDYQ

SEQ ID NO: 24456 - protein, 28 aa, artificial
  peptide fold or domain or sub-domain
TSGLFADFLAVGVGNSVTDPLGCAFAIV

SEQ ID NO: 24457 - protein, 27 aa, artificial
  peptide fold or domain or sub-domain
MSGGVRALRIAYKRSLRIQLQNIYGQN

SEQ ID NO: 24458 - protein, 26 aa, artificial
  peptide fold or domain or sub-domain
MIALRSAARIRGSEDASGMEGTKIVS

SEQ ID NO: 24459 - protein, 23 aa, artificial
  peptide fold or domain or sub-domain
MPQIDEPITGRLRIQVPDTTLKV

SEQ ID NO: 24460 - protein, 21 aa, artificial
  peptide fold or domain or sub-domain
MGTKVFGRRDFTPGENPSERP

SEQ ID NO: 24461 - protein, 27 aa, artificial
  peptide fold or domain or sub-domain
MEKSPEAEESDGTNGLSVEQPVGSESL

SEQ ID NO: 24462 - protein, 22 aa, artificial
  peptide fold or domain or sub-domain
MTPQRFKVTCYRAAFAVQLAHL

SEQ ID NO: 24463 - protein, 17 aa, artificial
  peptide fold or domain or sub-domain
MTADIPPFWVYGYYVKD

SEQ ID NO: 24464 - protein, 29 aa, artificial
  peptide fold or domain or sub-domain
MGPGRFGVSYLFGESQAGIKTGVTVLHWS

SEQ ID NO: 24465 - protein, 14 aa, artificial
  peptide fold or domain or sub-domain
MGANDRIKNFLVGR

SEQ ID NO: 24466 - protein, 29 aa, artificial
  peptide fold or domain or sub-domain
MYLRKDLRISISIKKYPGPTNKSSNIVGP

SEQ ID NO: 24467 - protein, 21 aa, artificial
  peptide fold or domain or sub-domain
MSWHGGTLSIIICAEKASKKA

SEQ ID NO: 24468 - protein, 24 aa, artificial
  peptide fold or domain or sub-domain
MFEMFIVRVYVYINDIVIEDLDIL

SEQ ID NO: 24469 - protein, 20 aa, artificial
  peptide fold or domain or sub-domain
MYTGRPGEEEYAVDPAVDLD

SEQ ID NO: 24470 - protein, 25 aa, artificial
  peptide fold or domain or sub-domain
MAKWAGKGVCFFFFSNISMQTEPMQ

SEQ ID NO: 24471 - protein, 15 aa, artificial
  peptide fold or domain or sub-domain
MPQSCRYITPPSLSK

SEQ ID NO: 24472 - protein, 16 aa, artificial
  peptide fold or domain or sub-domain
MWVSSNFVRGDNILGR

SEQ ID NO: 24473 - protein, 25 aa, artificial
  peptide fold or domain or sub-domain
MARSSAGGLNSYGYSHGCEYGHSEL

SEQ ID NO: 24474 - protein, 27 aa, artificial
  peptide fold or domain or sub-domain
MYSINSNAIITPVLLLRPNPDYKRIKS

SEQ ID NO: 24475 - protein, 21 aa, artificial
  peptide fold or domain or sub-domain
MTVEKQWTVRSSLVNWSREGK

SEQ ID NO: 24476 - protein, 27 aa, artificial
  peptide fold or domain or sub-domain
MFLLLWYSGLGDSCSQMWDGNDERGSS

SEQ ID NO: 24477 - protein, 19 aa, artificial
  peptide fold or domain or sub-domain
MERNWCSISWQDAVENLLQ

SEQ ID NO: 24478 - protein, 26 aa, artificial
  peptide fold or domain or sub-domain
MPAWAKHEWYSAYRVMWNRPKHKNGR

SEQ ID NO: 24479 - protein, 23 aa, artificial
  peptide fold or domain or sub-domain
MEGIVALLVVGTIINRRLFWAII

SEQ ID NO: 24480 - protein, 18 aa, artificial
  peptide fold or domain or sub-domain
MGLALSDQYQDAKRPASS

SEQ ID NO: 24481 - protein, 26 aa, artificial
  peptide fold or domain or sub-domain
MAWLQGKNCTCLKIQAYVDATAYLAP

SEQ ID NO: 24482 - protein, 28 aa, artificial
  peptide fold or domain or sub-domain
MVGETKLVRYSGKIFEVLIIKKFTKYNS

SEQ ID NO: 24483 - protein, 26 aa, artificial
  peptide fold or domain or sub-domain
MLELIVEVGNIIVGGGGEKVEGYTLE

SEQ ID NO: 24484 - protein, 12 aa, artificial
  peptide fold or domain or sub-domain
MQIRKNIATTLV

SEQ ID NO: 24485 - protein, 26 aa, artificial
  peptide fold or domain or sub-domain
MAEKASKKRVEEMVRRCGRLHLEAPL

SEQ ID NO: 24486 - protein, 24 aa, artificial
  peptide fold or domain or sub-domain
MGYYDDEEHVEVDVVRHDANHSRR

SEQ ID NO: 24487 - protein, 23 aa, artificial
  peptide fold or domain or sub-domain
MSPRATRGAMALYYLGSFPGSCS

SEQ ID NO: 24488 - protein, 28 aa, artificial
  peptide fold or domain or sub-domain
MVIDMLNLDGESSYQWTMVEIPDISVHK

SEQ ID NO: 24489 - protein, 30 aa, artificial
  peptide fold or domain or sub-domain
MNQWRLTWRGERASPVRRVQGTVSSTRFPR

SEQ ID NO: 24490 - protein, 11 aa, artificial
  peptide fold or domain or sub-domain
MDNKFVTLGII

SEQ ID NO: 24491 - protein, 18 aa, artificial
  peptide fold or domain or sub-domain
MVLSITQFNTGYFLDFIS

SEQ ID NO: 24492 - protein, 29 aa, artificial
  peptide fold or domain or sub-domain
MLNALAYPLYYRGFNIGCQINIGSRGGTA

SEQ ID NO: 24493 - protein, 15 aa, artificial
  peptide fold or domain or sub-domain
MFFDSHTSCLNFEDY

SEQ ID NO: 24494 - protein, 20 aa, artificial
  peptide fold or domain or sub-domain
MKVHYTTYDMAPIDAAKPLP

SEQ ID NO: 24495 - protein, 24 aa, artificial
  peptide fold or domain or sub-domain
MSADMWGRVRLGTVGVRVNSYIPQ

SEQ ID NO: 24496 - protein, 27 aa, artificial
  peptide fold or domain or sub-domain
MLFPHSIACTVLARAIIRTVVLGCLIR

SEQ ID NO: 24497 - protein, 14 aa, artificial
  peptide fold or domain or sub-domain
MQIISKQWMVPCLG

SEQ ID NO: 24498 - protein, 27 aa, artificial
  peptide fold or domain or sub-domain
MSTTSLIEPQYIDSDLPSYTQDSRECT

SEQ ID NO: 24499 - protein, 23 aa, artificial
  peptide fold or domain or sub-domain
MQDVEYQGKILESTDYTIKTGAG

SEQ ID NO: 24500 - protein, 22 aa, artificial
  peptide fold or domain or sub-domain
MTSNRTHFQIKSFLWVTATICC

SEQ ID NO: 24501 - protein, 28 aa, artificial
  peptide fold or domain or sub-domain
MDVEDQKKDKKDDEESSEKKWNGLVVAW

SEQ ID NO: 24502 - protein, 24 aa, artificial
  peptide fold or domain or sub-domain
MLQHQMCARHNTRLKESQDIFYNQ

SEQ ID NO: 24503 - protein, 27 aa, artificial
  peptide fold or domain or sub-domain
MAGCLREPARIEYLGRNSPNWQTLNPL

SEQ ID NO: 24504 - protein, 23 aa, artificial
  peptide fold or domain or sub-domain
MERGSSMADEPEIYITLSQVSLF

SEQ ID NO: 24505 - protein, 24 aa, artificial
  peptide fold or domain or sub-domain
MAVCKRREFGSNGGGKAQRERIPK

SEQ ID NO: 24506 - protein, 15 aa, artificial
  peptide fold or domain or sub-domain
MNVFEYTNTSRLFLP

SEQ ID NO: 24507 - protein, 28 aa, artificial
  peptide fold or domain or sub-domain
MGQAREGYILCAAEPCRLFSYFYFNNLG

SEQ ID NO: 24508 - protein, 28 aa, artificial
  peptide fold or domain or sub-domain
MEILQPTAFWRKTVIDLLSQKFEERRPT

SEQ ID NO: 24509 - protein, 28 aa, artificial
  peptide fold or domain or sub-domain
MAERLTTNQEVPAFGSYENRARTIVIQD

SEQ ID NO: 24510 - protein, 28 aa, artificial
  peptide fold or domain or sub-domain
MLLEVFLILKEAWKSVIQLDRGDNKDNI

SEQ ID NO: 24511 - protein, 28 aa, artificial
  peptide fold or domain or sub-domain
MDASNTRARTQNISFKLLNLIFGCSVYM

SEQ ID NO: 24512 - protein, 21 aa, artificial
  peptide fold or domain or sub-domain
MPVLVLRVREILGGKGKRREE

SEQ ID NO: 24513 - protein, 27 aa, artificial
  peptide fold or domain or sub-domain
MSQGWRPEVMPSFKLLFEPKDKYCVWL

SEQ ID NO: 24514 - protein, 29 aa, artificial
  peptide fold or domain or sub-domain
MPLNIGRRSLRIISSLAARIFIITITSDY

SEQ ID NO: 24515 - protein, 22 aa, artificial
  peptide fold or domain or sub-domain
MRKGFRPSDAACNPGALTILED

SEQ ID NO: 24516 - protein, 15 aa, artificial
  peptide fold or domain or sub-domain
MSAAWRVFGCAQVIG

SEQ ID NO: 24517 - protein, 28 aa, artificial
  peptide fold or domain or sub-domain
MTNLNKNDVAQEKQKKICEISSISPIRC

SEQ ID NO: 24518 - protein, 14 aa, artificial
  peptide fold or domain or sub-domain
MHMEEDMEGARVTS

SEQ ID NO: 24519 - protein, 29 aa, artificial
  peptide fold or domain or sub-domain
MTNRLTRLRYLYGGIPSPELESTWQRRLG

SEQ ID NO: 24520 - protein, 26 aa, artificial
  peptide fold or domain or sub-domain
MVPEKMSEMDVNAPVTSVLPHTDHIP

SEQ ID NO: 24521 - protein, 26 aa, artificial
  peptide fold or domain or sub-domain
MPGLRTHCRFQRLDAIFDDSVVDALT

SEQ ID NO: 24522 - protein, 27 aa, artificial
  peptide fold or domain or sub-domain
MRQVYTFILMNTVEREFQTLDPHPLCK

SEQ ID NO: 24523 - protein, 25 aa, artificial
  peptide fold or domain or sub-domain
MKRRPGQLITKLSITTLRKVSLYYL

SEQ ID NO: 24524 - protein, 25 aa, artificial
  peptide fold or domain or sub-domain
MWVSSNFVRGVMQPQSYGKYMLRMA

SEQ ID NO: 24525 - protein, 28 aa, artificial
  peptide fold or domain or sub-domain
MTTSGIELHIVIGGTQIDQSEPSIEQLS

SEQ ID NO: 24526 - protein, 26 aa, artificial
  peptide fold or domain or sub-domain
MQNYWPRPRGIRAEQLWFGSSVRAAP

SEQ ID NO: 24527 - protein, 29 aa, artificial
  peptide fold or domain or sub-domain
MTSDRYCQAEEPVCRPLPYKMSDEMEILG

SEQ ID NO: 24528 - protein, 28 aa, artificial
  peptide fold or domain or sub-domain
MTAEHLKHAVRAHGVSWVFRVCRACQLK

SEQ ID NO: 24529 - protein, 29 aa, artificial
  peptide fold or domain or sub-domain
MEQYILHGRGVGDIPLPACNGAVDSGDEN

SEQ ID NO: 24530 - protein, 27 aa, artificial
  peptide fold or domain or sub-domain
MAWKVVSDQANDYAFGSTDYTVREKLQ

SEQ ID NO: 24531 - protein, 16 aa, artificial
  peptide fold or domain or sub-domain
MCGHQVKLGLADNSPY

SEQ ID NO: 24532 - protein, 30 aa, artificial
  peptide fold or domain or sub-domain
MTRQSIQSYRNRGLGGTRKMFLYYFFNYLG

SEQ ID NO: 24533 - protein, 22 aa, artificial
  peptide fold or domain or sub-domain
MVSEAPYYIRKYRGRSTLYILA

SEQ ID NO: 24534 - protein, 17 aa, artificial
  peptide fold or domain or sub-domain
MSVPVYAEDTVDKLRTT

SEQ ID NO: 24535 - protein, 30 aa, artificial
  peptide fold or domain or sub-domain
MTAAGGPAGGGCADCSAENEQLSVRVHMYG

SEQ ID NO: 24536 - protein, 22 aa, artificial
  peptide fold or domain or sub-domain
MFSTDENPVLYYLSKTISSLLI

SEQ ID NO: 24537 - protein, 20 aa, artificial
  peptide fold or domain or sub-domain
MTSKFLIVRKGRERRSFILK

SEQ ID NO: 24538 - protein, 30 aa, artificial
  peptide fold or domain or sub-domain
MVYEFGGNCRSFNSLRIIGNDDITLSLRSL

SEQ ID NO: 24539 - protein, 28 aa, artificial
  peptide fold or domain or sub-domain
MSRRSKLRVQGGSLGLCFDREHKPSTVR

SEQ ID NO: 24540 - protein, 19 aa, artificial
  peptide fold or domain or sub-domain
MERWWRHAVGSVLTRPNST

SEQ ID NO: 24541 - protein, 20 aa, artificial
  peptide fold or domain or sub-domain
MPVRCYEIIGELKPINSQSS

SEQ ID NO: 24542 - protein, 21 aa, artificial
  peptide fold or domain or sub-domain
MKGELTYLARSQSDFQDISST

SEQ ID NO: 24543 - protein, 13 aa, artificial
  peptide fold or domain or sub-domain
MYVHTYINCTALN

SEQ ID NO: 24544 - protein, 30 aa, artificial
  peptide fold or domain or sub-domain
METQVDFHPRPFEPLLCHYNAVSGMPEVVK

SEQ ID NO: 24545 - protein, 24 aa, artificial
  peptide fold or domain or sub-domain
MMVGWYAKRRWWRGAGGSREAQKG

SEQ ID NO: 24546 - protein, 28 aa, artificial
  peptide fold or domain or sub-domain
MYDAGTVCFQVRLGSLGKVRYENHGDAR

SEQ ID NO: 24547 - protein, 15 aa, artificial
  peptide fold or domain or sub-domain
MPTISTFVLETLILD

SEQ ID NO: 24548 - protein, 29 aa, artificial
  peptide fold or domain or sub-domain
MPIDFTQRASIPDTGEKYGTGKSLVWSPR

SEQ ID NO: 24549 - protein, 21 aa, artificial
  peptide fold or domain or sub-domain
MYTSRTGRSVEAEVPVVQHLP

SEQ ID NO: 24550 - protein, 28 aa, artificial
  peptide fold or domain or sub-domain
MTTSRRNSRRDPGRSRTFGGFPVQELDV

SEQ ID NO: 24551 - protein, 22 aa, artificial
  peptide fold or domain or sub-domain
MRPIFEAYTQEGTKRFPSSAAT

SEQ ID NO: 24552 - protein, 27 aa, artificial
  peptide fold or domain or sub-domain
MKISFADDLEESVQWDPHIFLASAFGT

SEQ ID NO: 24553 - protein, 30 aa, artificial
  peptide fold or domain or sub-domain
MTGKKLAADPRRNLTLMIANAMQKAIVSAD

SEQ ID NO: 24554 - protein, 21 aa, artificial
  peptide fold or domain or sub-domain
MNPYQSAFPPCQNTDFGELQT

SEQ ID NO: 24555 - protein, 17 aa, artificial
  peptide fold or domain or sub-domain
VKYNTCLRKSPPFVHNT

SEQ ID NO: 24556 - protein, 14 aa, artificial
  peptide fold or domain or sub-domain
AAIVPEWYLLPSML

SEQ ID NO: 24557 - protein, 29 aa, artificial
  peptide fold or domain or sub-domain
MNQLFDQNLNEIVRRLYWLFKTEKAPPLS

SEQ ID NO: 24558 - protein, 28 aa, artificial
  peptide fold or domain or sub-domain
MAQVAQMVQCKWFKWSVGGAETASLYEI

SEQ ID NO: 24559 - protein, 18 aa, artificial
  peptide fold or domain or sub-domain
MPTARIIKPGYGHQKDLP

SEQ ID NO: 24560 - protein, 23 aa, artificial
  peptide fold or domain or sub-domain
MSLWLEARGDVKANKTKTKLNRF

SEQ ID NO: 24561 - protein, 24 aa, artificial
  peptide fold or domain or sub-domain
MPGMMMHQRLMTQRSARQAKNNGL

SEQ ID NO: 24562 - protein, 30 aa, artificial
  peptide fold or domain or sub-domain
MSSDNLQAAALTKAFLPMRGKAVGAQCVEE

SEQ ID NO: 24563 - protein, 28 aa, artificial
  peptide fold or domain or sub-domain
METRQAPGLAREWLILCWSEWADSKPPG

SEQ ID NO: 24564 - protein, 26 aa, artificial
  peptide fold or domain or sub-domain
MLLRDVRERDYILNQPIWAASAATNI

SEQ ID NO: 24565 - protein, 27 aa, artificial
  peptide fold or domain or sub-domain
MDRQTSTDVSRNIHEPIAQDFESACSL

SEQ ID NO: 24566 - protein, 23 aa, artificial
  peptide fold or domain or sub-domain
MTERNHGKEDAEDQVFKKLILVI

SEQ ID NO: 24567 - protein, 30 aa, artificial
  peptide fold or domain or sub-domain
HSSIFKICFYRNVQVLLDSFELLPVSDLSP

SEQ ID NO: 24568 - protein, 28 aa, artificial
  peptide fold or domain or sub-domain
RFIEKRAGLVQRFFSQRDQKREGLVLSS

SEQ ID NO: 24569 - protein, 21 aa, artificial
  peptide fold or domain or sub-domain
FLRKAHHGLLSLRNTGQSLST

SEQ ID NO: 24570 - protein, 17 aa, artificial
  peptide fold or domain or sub-domain
MWPLTSLRRSGSACSLI

SEQ ID NO: 24571 - protein, 20 aa, artificial
  peptide fold or domain or sub-domain
CQFHDGGNPFVFAHHCIPST

SEQ ID NO: 24572 - protein, 22 aa, artificial [sequence omitted]

SEQ ID NO: 24573 - protein, 20 aa, artificial
  peptide fold or domain or sub-domain
SPPEKKNGERVQLAHHFSEP

SEQ ID NO: 24574 - protein, 11 aa, artificial
  peptide fold or domain or sub-domain
QSLLGTQTREA

SEQ ID NO: 24575 - protein, 19 aa, artificial
  peptide fold or domain or sub-domain
DRQGNSRMALGSGKLLSEH

SEQ ID NO: 24576 - protein, 27 aa, artificial
  peptide fold or domain or sub-domain
MPSFRTDIWILLRYGRLGPRDTVTVSS

SEQ ID NO: 24577 - protein, 22 aa, artificial
  peptide fold or domain or sub-domain
AVVLNDQLVRPWGQGNPGHRLL

SEQ ID NO: 24578 - protein, 19 aa, artificial
  peptide fold or domain or sub-domain
HQVQRGSEEKGSTENMQKA

SEQ ID NO: 24579 - protein, 28 aa, artificial
  peptide fold or domain or sub-domain
QGEPLDDYVNTQGASCSVSLRRSWGQEV

SEQ ID NO: 24580 - protein, 17 aa, artificial [sequence omitted]

SEQ ID NO: 24581 - protein, 27 aa, artificial
  peptide fold or domain or sub-domain
KAKAGLESGAEPGDGVCGNTFRFLGLA

SEQ ID NO: 24582 - protein, 14 aa, artificial
  peptide fold or domain or sub-domain
MDELFPLIFPQSQP

SEQ ID NO: 24583 - protein, 19 aa, artificial
  peptide fold or domain or sub-domain
MSQKTCFIETSRKLQTKKT

SEQ ID NO: 24584 - protein, 27 aa, artificial
  peptide fold or domain or sub-domain
LRTSTCAGHYLRARLSWLTAACCSSLA

SEQ ID NO: 24585 - protein, 18 aa, artificial
  peptide fold or domain or sub-domain
PFDGGIYVCGGIYVCRAT

SEQ ID NO: 24586 - protein, 12 aa, artificial
  peptide fold or domain or sub-domain
MESCSVTQNGVQ

SEQ ID NO: 24587 - protein, 29 aa, artificial
  peptide fold or domain or sub-domain
NELGRKATRGISSQELGQGLSGGLTSLFY

SEQ ID NO: 24588 - protein, 14 aa, artificial
  peptide fold or domain or sub-domain
EYLQSFLEDYFQRS

SEQ ID NO: 24589 - protein, 16 aa, artificial
  peptide fold or domain or sub-domain
KWSSKTGRFWPGQIFW

SEQ ID NO: 24590 - protein, 16 aa, artificial
  peptide fold or domain or sub-domain
RWCCGAREGTDKLIFG

SEQ ID NO: 24591 - protein, 18 aa, artificial
  peptide fold or domain or sub-domain
SAYDPRICRQLLSSLVFS

SEQ ID NO: 24592 - protein, 23 aa, artificial
  peptide fold or domain or sub-domain
VPLPAGGGTVLNQDVPARQPLGG

SEQ ID NO: 24593 - protein, 14 aa, artificial
  peptide fold or domain or sub-domain
TQKIVKQDVSEFEF

SEQ ID NO: 24594 - protein, 23 aa, artificial
  peptide fold or domain or sub-domain
RGCVCIDICYMYAFIYVLINWCS

SEQ ID NO: 24595 - protein, 13 aa, artificial
  peptide fold or domain or sub-domain
FRRDSAVYINTPE

SEQ ID NO: 24596 - protein, 15 aa, artificial
  peptide fold or domain or sub-domain
MPLNVSFTSRNYDLD

SEQ ID NO: 24597 - protein, 19 aa, artificial
  peptide fold or domain or sub-domain
GGSQPHLIGILPLRWAPRL

SEQ ID NO: 24598 - protein, 24 aa, artificial
  peptide fold or domain or sub-domain
EGPVGAGPLLRPADLISSKNIHSS

SEQ ID NO: 24599 - protein, 15 aa, artificial
  peptide fold or domain or sub-domain
ILTSSCTFQRDGLQG

SEQ ID NO: 24600 - protein, 16 aa, artificial
  peptide fold or domain or sub-domain
REIFVSDFAKKHCEVG

SEQ ID NO: 24601 - protein, 22 aa, artificial
  peptide fold or domain or sub-domain
WSLVVLAIEWYVVVCKPMSNFR

SEQ ID NO: 24602 - protein, 26 aa, artificial
  peptide fold or domain or sub-domain
MGASNTSMAMQALHWVPLSEQQLLEV

SEQ ID NO: 24603 - protein, 27 aa, artificial
  peptide fold or domain or sub-domain
HRDEIQYIFWEPFATPLRATAPRQDSL

SEQ ID NO: 24604 - protein, 30 aa, artificial
  peptide fold or domain or sub-domain
GMDVLGRPKIPLETPAYTGQPWHCQHCFLL

SEQ ID NO: 24605 - protein, 23 aa, artificial
  peptide fold or domain or sub-domain
KRQKKKAARLLEPCKVNERFYIA

SEQ ID NO: 24606 - protein, 25 aa, artificial [sequence omitted]

SEQ ID NO: 24607 - protein, 17 aa, artificial [sequence omitted]

SEQ ID NO: 24608 - protein, 18 aa, artificial
  peptide fold or domain or sub-domain
LEQAKSECHFFNGTERYL

SEQ ID NO: 24609 - protein, 11 aa, artificial [sequence omitted]

SEQ ID NO: 24610 - protein, 27 aa, artificial [sequence omitted]

SEQ ID NO: 24611 - protein, 13 aa, artificial
  peptide fold or domain or sub-domain
MATGTLYTYPKGS

SEQ ID NO: 24612 - protein, 19 aa, artificial
  peptide fold or domain or sub-domain
MPALFYREPWRSWDRGHID

SEQ ID NO: 24613 - protein, 22 aa, artificial
  peptide fold or domain or sub-domain
MVHLTPEEKSAVTALWGQGERG

SEQ ID NO: 24614 - protein, 12 aa, artificial
  peptide fold or domain or sub-domain
PGHAILVEELGS

SEQ ID NO: 24615 - protein, 16 aa, artificial
  peptide fold or domain or sub-domain
ACFLAKVNNSSLIGLG

SEQ ID NO: 24616 - protein, 22 aa, artificial
  peptide fold or domain or sub-domain
LDLGVSGRLGCDSEGSCVLLPA

SEQ ID NO: 24617 - protein, 26 aa, artificial [sequence omitted]

SEQ ID NO: 24618 - protein, 29 aa, artificial
  peptide fold or domain or sub-domain
AAWQLLIWEREREDCLKPVEKVLMTWRLI

SEQ ID NO: 24619 - protein, 28 aa, artificial
  peptide fold or domain or sub-domain
MSCQPTTSINCQSAFDAIVSDIILTGSN

SEQ ID NO: 24620 - protein, 25 aa, artificial
  peptide fold or domain or sub-domain
MAQTNSCFMLISCLMFLSLSQGGPC

SEQ ID NO: 24621 - protein, 29 aa, artificial
  peptide fold or domain or sub-domain
MSVSMTCILPDLNHRWVLNLSEFLCHSSL

SEQ ID NO: 24622 - protein, 30 aa, artificial
  peptide fold or domain or sub-domain
GRWGRVGPEHDPLPLWRRAGELGSWKKEPG

SEQ ID NO: 24623 - protein, 24 aa, artificial
  peptide fold or domain or sub-domain
MENERLIMLSGEFDAKVGETEKRR

SEQ ID NO: 24624 - protein, 17 aa, artificial
  peptide fold or domain or sub-domain
LPNYPLCSKFDQERKAC

SEQ ID NO: 24625 - protein, 11 aa, artificial
  peptide fold or domain or sub-domain
YAPEDIIEYDL

SEQ ID NO: 24626 - protein, 18 aa, artificial
  peptide fold or domain or sub-domain
MHLWNPPFCGSVSQHQTN

SEQ ID NO: 24627 - protein, 24 aa, artificial
  peptide fold or domain or sub-domain
MALEIPECETQRSASSWDTSGKCL

SEQ ID NO: 24628 - protein, 20 aa, artificial
  peptide fold or domain or sub-domain
DDEAAELMQQEKPPPVNKQE

SEQ ID NO: 24629 - protein, 15 aa, artificial
  peptide fold or domain or sub-domain
MLVYKFARKHHITFN

SEQ ID NO: 24630 - protein, 16 aa, artificial
  peptide fold or domain or sub-domain
SNFERRCWKKTDFLIK

SEQ ID NO: 24631 - protein, 30 aa, artificial
  peptide fold or domain or sub-domain
VSNGCVSKILGGITRLAPSDPGQSVVVNRE

SEQ ID NO: 24632 - protein, 30 aa, artificial
  peptide fold or domain or sub-domain
GCQQRKEGERIPTPSVPTEKIQMRLKCDFS

SEQ ID NO: 24633 - protein, 18 aa, artificial
  peptide fold or domain or sub-domain
VPAACHISPARRLSGKQQ

SEQ ID NO: 24634 - protein, 26 aa, artificial
  peptide fold or domain or sub-domain
MDLANEFNMNITYINRKNYQCSSEVK

SEQ ID NO: 24635 - protein, 13 aa, artificial
  peptide fold or domain or sub-domain
THSYFNDLAAETD

SEQ ID NO: 24636 - protein, 13 aa, artificial
  peptide fold or domain or sub-domain
TNTLRPNFAETAK

SEQ ID NO: 24637 - protein, 20 aa, artificial
  peptide fold or domain or sub-domain
TQSLHYSSPRETLTDTIMAA

SEQ ID NO: 24638 - protein, 11 aa, artificial
  peptide fold or domain or sub-domain
TRKIALITFAF

SEQ ID NO: 24639 - protein, 20 aa, artificial
  peptide fold or domain or sub-domain
MLQSQLSQTPRLALADTVID

SEQ ID NO: 24640 - protein, 20 aa, artificial
  peptide fold or domain or sub-domain
VDPAPTPTLGGSGKITFTGV

SEQ ID NO: 24641 - protein, 18 aa, artificial
  peptide fold or domain or sub-domain
DPGSATDYRTYAAVGSDT

SEQ ID NO: 24642 - protein, 22 aa, artificial
  peptide fold or domain or sub-domain
EPPTAQREKQYLINGQCCTLCQ

SEQ ID NO: 24643 - protein, 19 aa, artificial
  peptide fold or domain or sub-domain
QFYTVFDRANNKEGLAPVA

SEQ ID NO: 24644 - protein, 15 aa, artificial
  peptide fold or domain or sub-domain
TKLEEVLEGIYSIFF

SEQ ID NO: 24645 - protein, 15 aa, artificial
  peptide fold or domain or sub-domain
EHPQGDAAQKTDTSL

SEQ ID NO: 24646 - protein, 13 aa, artificial
  peptide fold or domain or sub-domain
SAQDDSKGFVEDS

SEQ ID NO: 24647 - protein, 20 aa, artificial
  peptide fold or domain or sub-domain
MFSIPEQFSSATKTNLEAQF

SEQ ID NO: 24648 - protein, 20 aa, artificial [sequence omitted]

SEQ ID NO: 24649 - protein, 20 aa, artificial
  peptide fold or domain or sub-domain
VNLRNAVNSFQQISGLNFLP

SEQ ID NO: 24650 - protein, 30 aa, artificial
  peptide fold or domain or sub-domain
ENKTNFFSQFSLPFSFFCSPLSLPEALQRP

SEQ ID NO: 24651 - protein, 27 aa, artificial
  peptide fold or domain or sub-domain
MKFFIFTCLLAVALAHHEIKHSSSSSE

SEQ ID NO: 24652 - protein, 25 aa, artificial
  peptide fold or domain or sub-domain
MRLVEACGDSEQSMDNWLSRLDGCR

SEQ ID NO: 24653 - protein, 15 aa, artificial
  peptide fold or domain or sub-domain
SSDDFRQAPGNLPEG

SEQ ID NO: 24654 - protein, 24 aa, artificial
  peptide fold or domain or sub-domain
STSANLVHLGFVSAVEGNHNLVKP

SEQ ID NO: 24655 - protein, 29 aa, artificial
  peptide fold or domain or sub-domain
DSLSRTADYSGTSLIRLNLQPMLVLTQVS

SEQ ID NO: 24656 - protein, 26 aa, artificial
  peptide fold or domain or sub-domain
TLGRWSLREDSEAVSCSSFRRIRFRK

SEQ ID NO: 24657 - protein, 30 aa, artificial [sequence omitted]

SEQ ID NO: 24658 - protein, 17 aa, artificial
  peptide fold or domain or sub-domain
FTKCFPVHLNLMQRCEL

SEQ ID NO: 24659 - protein, 12 aa, artificial
  peptide fold or domain or sub-domain
GYENKIYRKNLI

SEQ ID NO: 24660 - protein, 24 aa, artificial
  peptide fold or domain or sub-domain
AEAVATISNPGHPSKRVVMHVHVF

SEQ ID NO: 24661 - protein, 27 aa, artificial
  peptide fold or domain or sub-domain
TDPGSRPRCLKPRSQLKHCLGRKHHKL

SEQ ID NO: 24662 - protein, 28 aa, artificial
  peptide fold or domain or sub-domain
MPRTCRPHRGLVLNRGGAGGTLMWHQMK

SEQ ID NO: 24663 - protein, 30 aa, artificial
  peptide fold or domain or sub-domain
MYIFFCVLFLLLLLFETGSCSVAQAGVQWH

SEQ ID NO: 24664 - protein, 29 aa, artificial [sequence omitted]

SEQ ID NO: 24665 - protein, 19 aa, artificial
  peptide fold or domain or sub-domain
KTKDIGRDPDVHHLVQPRT

SEQ ID NO: 24666 - protein, 19 aa, artificial
  peptide fold or domain or sub-domain
LYSIPLSIPETTPAALAST

SEQ ID NO: 24667 - protein, 17 aa, artificial [sequence omitted]

SEQ ID NO: 24668 - protein, 21 aa, artificial
  peptide fold or domain or sub-domain
GAPNRPPAALGGSGPDRDLGP

SEQ ID NO: 24669 - protein, 27 aa, artificial
  peptide fold or domain or sub-domain
PPIPIQNPDLTGNILVATAYLSLAPFA

SEQ ID NO: 24670 - protein, 27 aa, artificial
  peptide fold or domain or sub-domain
GGLRKLTITAEGKREEGTFFTRWQERQ

SEQ ID NO: 24671 - protein, 23 aa, artificial
  peptide fold or domain or sub-domain
QRSDWDLGTYCGAAAGPSASTSV

SEQ ID NO: 24672 - protein, 20 aa, artificial
  peptide fold or domain or sub-domain
NSPLNMALNLSPSQAGLRQR

SEQ ID NO: 24673 - protein, 15 aa, artificial
  peptide fold or domain or sub-domain
RPCAWSSPDSCTVGI

SEQ ID NO: 24674 - protein, 23 aa, artificial
  peptide fold or domain or sub-domain
RFLEQAKCECHFLNGTEPDQIHL

SEQ ID NO: 24675 - protein, 30 aa, artificial
  peptide fold or domain or sub-domain
PRPLSFYEGDDGQCPMVSWGYRASYPKTSS

SEQ ID NO: 24676 - protein, 25 aa, artificial
  peptide fold or domain or sub-domain
GNASPCFGSRTVRAPTDLRPLSGTP

SEQ ID NO: 24677 - protein, 23 aa, artificial [sequence omitted]

SEQ ID NO: 24678 - protein, 29 aa, artificial
  peptide fold or domain or sub-domain
QFWGSSDPAGSVRVGGEVQPSALPAAPVT

SEQ ID NO: 24679 - protein, 19 aa, artificial
  peptide fold or domain or sub-domain
GDSTDSKFTQLFIPCLMYW

SEQ ID NO: 24680 - protein, 30 aa, artificial
  peptide fold or domain or sub-domain
LLAPGSHRLGGYCKARSSRQLPRTAAASLP

SEQ ID NO: 24681 - protein, 27 aa, artificial
  peptide fold or domain or sub-domain
MHSAKRWLVKDQWHGEVSPGCTAFAAV

SEQ ID NO: 24682 - protein, 25 aa, artificial
  peptide fold or domain or sub-domain
MIMLMNFDIYRHDALHKGCTNLDHL

SEQ ID NO: 24683 - protein, 27 aa, artificial
  peptide fold or domain or sub-domain
MSAMTTHKAIQTSKKNKQNYTKPTTSV

SEQ ID NO: 24684 - protein, 22 aa, artificial [sequence omitted]

SEQ ID NO: 24685 - protein, 28 aa, artificial [sequence omitted]

SEQ ID NO: 24686 - protein, 22 aa, artificial
  peptide fold or domain or sub-domain
GTRISDMLKLIADTWQRNCCPA

SEQ ID NO: 24687 - protein, 22 aa, artificial [sequence omitted]

SEQ ID NO: 24688 - protein, 29 aa, artificial
  peptide fold or domain or sub-domain
MYVAESTRKTLLYHMEFSELTSRYIKIIN

SEQ ID NO: 24689 - protein, 22 aa, artificial
  peptide fold or domain or sub-domain
MGTVGKNTEEQFGNIVVIYKSS

SEQ ID NO: 24690 - protein, 18 aa, artificial
  peptide fold or domain or sub-domain
CNKDIYVDLDMKGINYTA

SEQ ID NO: 24691 - protein, 16 aa, artificial
  peptide fold or domain or sub-domain
PYSVNITRHEKTIFLK

SEQ ID NO: 24692 - protein, 30 aa, artificial
  peptide fold or domain or sub-domain
PGLAAVPAGEQGQVGCRRSRGQALELRGPG

SEQ ID NO: 24693 - protein, 28 aa, artificial
  peptide fold or domain or sub-domain
MGPRWFAKRTLAQRNTQNKIPLLQRVVY

SEQ ID NO: 24694 - protein, 29 aa, artificial
  peptide fold or domain or sub-domain
MAAGGSAPEPRVLVCLGALLAGWVAVAQG

SEQ ID NO: 24695 - protein, 24 aa, artificial
  peptide fold or domain or sub-domain
AAVAGSGVRILCLRTQSPATSGRS

SEQ ID NO: 24696 - protein, 18 aa, artificial
  peptide fold or domain or sub-domain
DTPPMLFVFIALGLWLEH

SEQ ID NO: 24697 - protein, 21 aa, artificial [sequence omitted]

SEQ ID NO: 24698 - protein, 29 aa, artificial
  peptide fold or domain or sub-domain
VRAILTQSINSNANLSGNSLTDTPKIMFS

SEQ ID NO: 24699 - protein, 18 aa, artificial [sequence omitted]

SEQ ID NO: 24700 - protein, 30 aa, artificial
  peptide fold or domain or sub-domain
HLSVIMSTLTLVVWIVIGFIDFGVVQRYFP

SEQ ID NO: 24701 - protein, 22 aa, artificial
  peptide fold or domain or sub-domain
MTATEALPARPLAPAGFRPQHL

SEQ ID NO: 24702 - protein, 18 aa, artificial
  peptide fold or domain or sub-domain
GQDGKDNTKRFLFQDSKT

SEQ ID NO: 24703 - protein, 14 aa, artificial
  peptide fold or domain or sub-domain
MLPFGDKTREMVNA

SEQ ID NO: 24704 - protein, 18 aa, artificial
  peptide fold or domain or sub-domain
MAPPSTREPRVLSADQRN

SEQ ID NO: 24705 - protein, 21 aa, artificial
  peptide fold or domain or sub-domain
EFGTRFSLILFVVTHRPDLTE

SEQ ID NO: 24706 - protein, 15 aa, artificial [sequence omitted]

SEQ ID NO: 24707 - protein, 24 aa, artificial [sequence omitted]

SEQ ID NO: 24708 - protein, 24 aa, artificial [sequence omitted]

SEQ ID NO: 24709 - protein, 24 aa, artificial [sequence omitted]

SEQ ID NO: 24710 - protein, 17 aa, artificial [sequence omitted]

SEQ ID NO: 24711 - protein, 28 aa, artificial [sequence omitted]

SEQ ID NO: 24712 - protein, 19 aa, artificial [sequence omitted]

SEQ ID NO: 24713 - protein, 21 aa, artificial [sequence omitted]

SEQ ID NO: 24714 - protein, 16 aa, artificial [sequence omitted]

SEQ ID NO: 24715 - protein, 22 aa, artificial [sequence omitted]

SEQ ID NO: 24716 - protein, 19 aa, artificial
  peptide fold or domain or sub-domain
SPLPLVVNTWPFKATEAAW

SEQ ID NO: 24717 - protein, 18 aa, artificial [sequence omitted]

SEQ ID NO: 24718 - protein, 22 aa, artificial [sequence omitted]

SEQ ID NO: 24719 - protein, 18 aa, artificial [sequence omitted]

SEQ ID NO: 24720 - protein, 15 aa, artificial [sequence omitted]

SEQ ID NO: 24721 - protein, 20 aa, artificial [sequence omitted]

SEQ ID NO: 24722 - protein, 16 aa, artificial [sequence omitted]

SEQ ID NO: 24723 - protein, 17 aa, artificial [sequence omitted]

SEQ ID NO: 24724 - protein, 30 aa, artificial
  peptide fold or domain or sub-domain
RPWCHPINAILAVEKVVCTYRDVRFESIRL

SEQ ID NO: 24725 - protein, 28 aa, artificial
  peptide fold or domain or sub-domain
TFIAIKPDGVQRFMQASEDLLKVMLGET

SEQ ID NO: 24726 - protein, 15 aa, artificial
  peptide fold or domain or sub-domain
MAVREPDHLQRISLP

SEQ ID NO: 24727 - protein, 27 aa, artificial
  peptide fold or domain or sub-domain
MLYLESPARQKPLHRIELLPYKCKMVL

SEQ ID NO: 24728 - protein, 29 aa, artificial
  peptide fold or domain or sub-domain
RARYPGSVLPRACAWTDPRQCSAQDWNIS

SEQ ID NO: 24729 - protein, 25 aa, artificial
  peptide fold or domain or sub-domain
MKQVKKKQHNHINRRVFVPDAVQES

SEQ ID NO: 24730 - protein, 14 aa, artificial
  peptide fold or domain or sub-domain
MIAKPPEMESRSVT

SEQ ID NO: 24731 - protein, 19 aa, artificial
  peptide fold or domain or sub-domain
MRLRFNNDRMKTTIKETST

SEQ ID NO: 24732 - protein, 29 aa, artificial
  peptide fold or domain or sub-domain
EKPYQCDFKDCERRFSRSDQLKRHQRRHT

SEQ ID NO: 24733 - protein, 28 aa, artificial
  peptide fold or domain or sub-domain
HDFEVRGDVGNGRNHQGAKRARESQDRK

SEQ ID NO: 24734 - protein, 22 aa, artificial
  peptide fold or domain or sub-domain
MPLAQLADPWQKMAVESPIDSA

SEQ ID NO: 24735 - protein, 20 aa, artificial
  peptide fold or domain or sub-domain
TLVPRVPLLSGSQPRLVPEA

SEQ ID NO: 24736 - protein, 25 aa, artificial [sequence omitted]

SEQ ID NO: 24737 - protein, 21 aa, artificial
  peptide fold or domain or sub-domain
FMSSHQSQASLELAIKQWGSQ

SEQ ID NO: 24738 - protein, 26 aa, artificial
  peptide fold or domain or sub-domain
MAALKILSSGFGLCGLCPRIWGNLVQ

SEQ ID NO: 24739 - protein, 29 aa, artificial
  peptide fold or domain or sub-domain
METAWQTPISPGAISGAESGAPRWRPRPH

SEQ ID NO: 24740 - protein, 26 aa, artificial
  peptide fold or domain or sub-domain
MGVEESLWYEPSLEELLGCVDAARPR

SEQ ID NO: 24741 - protein, 17 aa, artificial
  peptide fold or domain or sub-domain
ASRPWERRLFIPTLPLF

SEQ ID NO: 24742 - protein, 14 aa, artificial
  peptide fold or domain or sub-domain
EGGGSSSQDQVRKP

SEQ ID NO: 24743 - protein, 25 aa, artificial
  peptide fold or domain or sub-domain
VCSCTEGYRLAEVLRDIDLQKTRSP

SEQ ID NO: 24744 - protein, 24 aa, artificial
  peptide fold or domain or sub-domain
QFFDLMKLFEVGGSPSNARYLFLG

SEQ ID NO: 24745 - protein, 24 aa, artificial
  peptide fold or domain or sub-domain
AGHGAPNRPPAALGSPGPDRDLGR

SEQ ID NO: 24746 - protein, 26 aa, artificial
  peptide fold or domain or sub-domain
MSQLQCCGAWFLHTWNDWNPKDSRRS

SEQ ID NO: 24747 - protein, 22 aa, artificial
  peptide fold or domain or sub-domain
RCAPGRRGWLFEDCARSSVAGV

SEQ ID NO: 24748 - protein, 24 aa, artificial [sequence omitted]

SEQ ID NO: 24749 - protein, 23 aa, artificial
  peptide fold or domain or sub-domain
MPRGRNESAAGKPGRPWTFAAVW

SEQ ID NO: 24750 - protein, 18 aa, artificial
  peptide fold or domain or sub-domain
HLYPGEVCPGMDIRNNLT

SEQ ID NO: 24751 - protein, 29 aa, artificial
  peptide fold or domain or sub-domain
HTCLHLASIHGYLGIVELLVSLGAMSMLR

SEQ ID NO: 24752 - protein, 29 aa, artificial [sequence omitted]

SEQ ID NO: 24753 - protein, 27 aa, artificial
  peptide fold or domain or sub-domain
FSPVLRVAARLWVSSTLSGAEELPAAA

SEQ ID NO: 24754 - protein, 26 aa, artificial
  peptide fold or domain or sub-domain
MSIPDEMLHQNSSGLASSENGPARFA

SEQ ID NO: 24755 - protein, 21 aa, artificial [sequence omitted]

SEQ ID NO: 24756 - protein, 29 aa, artificial
  peptide fold or domain or sub-domain
RPGVQDAALIEAIQDRLSNTLQTTSAAAT

SEQ ID NO: 24757 - protein, 21 aa, artificial
  peptide fold or domain or sub-domain
KSLYFWSSCPCAGIVGQADST

SEQ ID NO: 24758 - protein, 19 aa, artificial
  peptide fold or domain or sub-domain
ENLLRQGDIWARDKLISHS

SEQ ID NO: 24759 - protein, 25 aa, artificial
  peptide fold or domain or sub-domain
FYKADGVVFSIYDVPGRQVPLSARG

SEQ ID NO: 24760 - protein, 14 aa, artificial
  peptide fold or domain or sub-domain
PFEVRGANQSVDQV

SEQ ID NO: 24761 - protein, 24 aa, artificial [sequence omitted]

SEQ ID NO: 24762 - protein, 20 aa, artificial
  peptide fold or domain or sub-domain
EQVRTQNSLASPDSHMQYVQ

SEQ ID NO: 24763 - protein, 15 aa, artificial
  peptide fold or domain or sub-domain
PMFSEQFRVQVHSVS

SEQ ID NO: 24764 - protein, 18 aa, artificial
  peptide fold or domain or sub-domain
SEVFLPNSNHVAASSGEA

SEQ ID NO: 24765 - protein, 18 aa, artificial
  peptide fold or domain or sub-domain
GHSIEARQTGRQVGRWVG

SEQ ID NO: 24766 - protein, 19 aa, artificial
  peptide fold or domain or sub-domain
MYLCASSLTSGGYNEQFFG

SEQ ID NO: 24767 - protein, 21 aa, artificial [sequence omitted]

SEQ ID NO: 24768 - protein, 11 aa, artificial
  peptide fold or domain or sub-domain
DHKWELPRNRL

SEQ ID NO: 24769 - protein, 28 aa, artificial
  peptide fold or domain or sub-domain
RWQLCPGTAGCGQCPLQHCGARLGPRAR

SEQ ID NO: 24770 - protein, 23 aa, artificial
  peptide fold or domain or sub-domain
CASSLLRGGTEAFFGQGTRLTVV

SEQ ID NO: 24771 - protein, 26 aa, artificial
  peptide fold or domain or sub-domain
MSTRPCITVSPGQWVLRVTIGAKGTL

SEQ ID NO: 24772 - protein, 15 aa, artificial
  peptide fold or domain or sub-domain
IATYRKLLGGEECRL

SEQ ID NO: 24773 - protein, 23 aa, artificial
  peptide fold or domain or sub-domain
SCGYRVNRKLTFGANTRGIMKLS

SEQ ID NO: 24774 - protein, 23 aa, artificial
  peptide fold or domain or sub-domain
VLWCNSGSPEAGIWPRNQADYQP

SEQ ID NO: 24775 - protein, 18 aa, artificial
  peptide fold or domain or sub-domain
MDEGPDLDLDLPYEPPRR

SEQ ID NO: 24776 - protein, 18 aa, artificial
  peptide fold or domain or sub-domain
AGESQFSGRQVGRWVGQW

SEQ ID NO: 24777 - protein, 18 aa, artificial
  peptide fold or domain or sub-domain
WEKTRPGQLICELLKSKC

SEQ ID NO: 24778 - protein, 18 aa, artificial
  peptide fold or domain or sub-domain
IGRIAECILGMNPSRDVH

SEQ ID NO: 24779 - protein, 20 aa, artificial
  peptide fold or domain or sub-domain
SAHSDHCRPCLPRLQLSDCS

SEQ ID NO: 24780 - protein, 22 aa, artificial
  peptide fold or domain or sub-domain
ARAWGADGLTFGKGTHLIIQPY

SEQ ID NO: 24781 - protein, 22 aa, artificial
  peptide fold or domain or sub-domain
VIAQGAQKLVFGQGTRLTINPN

SEQ ID NO: 24782 - protein, 15 aa, artificial
  peptide fold or domain or sub-domain
CASSSDRANTEAFFG

SEQ ID NO: 24783 - protein, 14 aa, artificial
  peptide fold or domain or sub-domain
IVITAEMLMINTSL

SEQ ID NO: 24784 - protein, 30 aa, artificial
  peptide fold or domain or sub-domain
VFLKYLNFATLYLKIYHLSYLHNCETRRGQ

SEQ ID NO: 24785 - protein, 12 aa, artificial
  peptide fold or domain or sub-domain
LCLRNWDQGHRP

SEQ ID NO: 24786 - protein, 13 aa, artificial
  peptide fold or domain or sub-domain
KYTEKSEGYRIHL

SEQ ID NO: 24787 - protein, 22 aa, artificial
  peptide fold or domain or sub-domain
MVHLTPEEKSCRYCPVGQGERG

SEQ ID NO: 24788 - protein, 14 aa, artificial
  peptide fold or domain or sub-domain
TCELIYLTQPNPAV

SEQ ID NO: 24789 - protein, 17 aa, artificial
  peptide fold or domain or sub-domain
VHLRILILEQICLSHGF

SEQ ID NO: 24790 - protein, 20 aa, artificial
  peptide fold or domain or sub-domain
KKSSGDKLTFGTGTRLAVRP

SEQ ID NO: 24791 - protein, 20 aa, artificial
  peptide fold or domain or sub-domain
CQTGANNLFFGTGTRLTVIP

SEQ ID NO: 24792 - protein, 14 aa, artificial
  peptide fold or domain or sub-domain
PPVQAAYQKVGRAN

SEQ ID NO: 24793 - protein, 21 aa, artificial
  peptide fold or domain or sub-domain
HCQKACCAPHAWVPVPRCATS

SEQ ID NO: 24794 - protein, 18 aa, artificial
  peptide fold or domain or sub-domain
TATTWPVAPQSIDGNRPP

SEQ ID NO: 24795 - protein, 19 aa, artificial
  peptide fold or domain or sub-domain
MYLCASSALAAIYNEQFFG

SEQ ID NO: 24796 - protein, 23 aa, artificial
  peptide fold or domain or sub-domain
ASQGRKLDSYIWKRKPALLFHPY

SEQ ID NO: 24797 - protein, 22 aa, artificial
  peptide fold or domain or sub-domain
VKMDSSYKLIFGSGTRLLVRPD

SEQ ID NO: 24798 - protein, 18 aa, artificial
  peptide fold or domain or sub-domain
DLDEMSFTFTELQKNRNQ

SEQ ID NO: 24799 - protein, 17 aa, artificial
  peptide fold or domain or sub-domain
TVMNTIQQLMIDFKFSK

SEQ ID NO: 24800 - protein, 16 aa, artificial
  peptide fold or domain or sub-domain
EGRKQEIYIWNGDASE

SEQ ID NO: 24801 - protein, 19 aa, artificial
  peptide fold or domain or sub-domain
GIWKQTGLWRRNHSESQVL

SEQ ID NO: 24802 - protein, 15 aa, artificial
  peptide fold or domain or sub-domain
HVSSEAFRMCDVCLE

SEQ ID NO: 24803 - protein, 11 aa, artificial
  peptide fold or domain or sub-domain
SFMMVHDAYKC

SEQ ID NO: 24804 - protein, 18 aa, artificial
  peptide fold or domain or sub-domain
FYEHCQAGSQPLVFPCFL

SEQ ID NO: 24805 - protein, 18 aa, artificial
  peptide fold or domain or sub-domain
QMLLVIDGFYCYCFYVLE

SEQ ID NO: 24806 - protein, 18 aa, artificial
  peptide fold or domain or sub-domain
DCRRFQTLGSCGHQLSHC

SEQ ID NO: 24807 - protein, 18 aa, artificial
  peptide fold or domain or sub-domain
SGENLLGWGWPGSSCQAS

SEQ ID NO: 24808 - protein, 30 aa, artificial
  peptide fold or domain or sub-domain
NSPCVCQRMLLLCPESTKTAPVSSRAVGKV

SEQ ID NO: 24809 - protein, 21 aa, artificial
  peptide fold or domain or sub-domain
AYGGNTPLVFGKGTRLSVIAN

SEQ ID NO: 24810 - protein, 23 aa, artificial
  peptide fold or domain or sub-domain
VKQKPKEKDLEFHGVMRFYFQDK

SEQ ID NO: 24811 - protein, 22 aa, artificial
  peptide fold or domain or sub-domain
GVYYCATSGYFAEGTKLIVTSP

SEQ ID NO: 24812 - protein, 20 aa, artificial
  peptide fold or domain or sub-domain
MYLCASSLGIVSRPYDGDFG

SEQ ID NO: 24813 - protein, 16 aa, artificial
  peptide fold or domain or sub-domain
MTMVKEGLSSAKTSRI

SEQ ID NO: 24814 - protein, 21 aa, artificial
  peptide fold or domain or sub-domain
TIENARIVLQINNAQLAADDF

SEQ ID NO: 24815 - protein, 22 aa, artificial
  peptide fold or domain or sub-domain
MTFPEADILLKSGNCLQKGHCA

SEQ ID NO: 24816 - protein, 22 aa, artificial
  peptide fold or domain or sub-domain
MYYCDNNNDMRFGAGTRLTVKP

SEQ ID NO: 24817 - protein, 21 aa, artificial
  peptide fold or domain or sub-domain
NYGGSQGNLIFGKGTKLSVKP

SEQ ID NO: 24818 - protein, 21 aa, artificial
  peptide fold or domain or sub-domain
GTQIPGMHSTSAKAPRCWSHP

SEQ ID NO: 24819 - protein, 20 aa, artificial
  peptide fold or domain or sub-domain
DRLWECAALRVRHSSDCFTT

SEQ ID NO: 24820 - protein, 23 aa, artificial
  peptide fold or domain or sub-domain
ELWRCYKQAHLWNWHSACCPAKY

SEQ ID NO: 24821 - protein, 18 aa, artificial
  peptide fold or domain or sub-domain
NNNARLMFGDGTQLVVKP

SEQ ID NO: 24822 - protein, 18 aa, artificial
  peptide fold or domain or sub-domain
NRDDKIIFGKGTRLHILP

SEQ ID NO: 24823 - protein, 19 aa, artificial
  peptide fold or domain or sub-domain
EFRKHTSCLWKGHKTFCDC

SEQ ID NO: 24824 - protein, 20 aa, artificial
  peptide fold or domain or sub-domain
GITMVRILSLVPEPDCPCCP

SEQ ID NO: 24825 - protein, 20 aa, artificial
  peptide fold or domain or sub-domain
QKDKASPLSLGRGQGCLSSQ

SEQ ID NO: 24826 - protein, 20 aa, artificial
  peptide fold or domain or sub-domain
IYNQGGKLIFGQGTELSVKP

SEQ ID NO: 24827 - protein, 25 aa, artificial
  peptide fold or domain or sub-domain
ANHSVSSGSARQLTFGSGTQLTVLP

SEQ ID NO: 24828 - protein, 18 aa, artificial
  peptide fold or domain or sub-domain
SNDYKLSFGAGTTVTVRA

SEQ ID NO: 24829 - protein, 20 aa, artificial
  peptide fold or domain or sub-domain
AIKDFTISPLERDPNIMSLQ

SEQ ID NO: 24830 - protein, 20 aa, artificial
  peptide fold or domain or sub-domain
IKAAGNKLTFGGGTRVLVKP

SEQ ID NO: 24831 - protein, 19 aa, artificial [sequence omitted]

SEQ ID NO: 24832 - protein, 17 aa, artificial
  peptide fold or domain or sub-domain
IYSTFIFGSGTRLSVKP

SEQ ID NO: 24833 - protein, 20 aa, artificial
  peptide fold or domain or sub-domain
NSGGYQKVTFGIGTKLQVIP

SEQ ID NO: 24834 - protein, 20 aa, artificial
  peptide fold or domain or sub-domain
VNSGYSTLTFGKGTMLLVSP

SEQ ID NO: 24835 - protein, 21 aa, artificial
  peptide fold or domain or sub-domain
ILTGGGNKLTFGTGTQLKVEL

SEQ ID NO: 24836 - protein, 19 aa, artificial
  peptide fold or domain or sub-domain
EHRLSETCIWNWHPTSGQS

SEQ ID NO: 24837 - protein, 19 aa, artificial
  peptide fold or domain or sub-domain
DYGNNRLAFGKGNQVVVIP

SEQ ID NO: 24838 - protein, 21 aa, artificial
  peptide fold or domain or sub-domain
CIRRKLHTYIWKRNQPYCSSV

SEQ ID NO: 24839 - protein, 20 aa, artificial
  peptide fold or domain or sub-domain
FSGGYNKLIFGAGTRLAVHP

SEQ ID NO: 24840 - protein, 21 aa, artificial
  peptide fold or domain or sub-domain
NTGGTIDKLTFGKGTHVFIIS

SEQ ID NO: 24841 - protein, 20 aa, artificial
  peptide fold or domain or sub-domain
YESITSQLQFGKGTRVSTSP

SEQ ID NO: 24842 - protein, 16 aa, artificial
  peptide fold or domain or sub-domain
ADLAKYICEKSRFDLQ

SEQ ID NO: 24843 - protein, 16 aa, artificial
  peptide fold or domain or sub-domain
FWLLNVLFPPAHHAQG

SEQ ID NO: 24844 - protein, 26 aa, artificial
  peptide fold or domain or sub-domain
PWYLNRISILWPCWKDFYVVEPLAFE

SEQ ID NO: 24845 - protein, 28 aa, artificial
  peptide fold or domain or sub-domain
VCMLEKARATASSPSCPMSMAPTGTRSS

SEQ ID NO: 24846 - protein, 23 aa, artificial
  peptide fold or domain or sub-domain
ACHHHRWPLRHCLNHICTCERPV

SEQ ID NO: 24847 - protein, 28 aa, artificial
  peptide fold or domain or sub-domain
TDSLVTHLLNVSSQAILPIGARSRQFVN

SEQ ID NO: 24848 - protein, 14 aa, artificial
  peptide fold or domain or sub-domain
MRMEEGMNVLHDFG

SEQ ID NO: 24849 - protein, 15 aa, artificial
  peptide fold or domain or sub-domain
INFNEKLSQLQTYMI

SEQ ID NO: 24850 - protein, 15 aa, artificial
  peptide fold or domain or sub-domain
MLHRKTYHVKDLQGE

SEQ ID NO: 24851 - protein, 19 aa, artificial
  peptide fold or domain or sub-domain
MASLFSGRILIRNNSDQDE

SEQ ID NO: 24852 - protein, 24 aa, artificial
  peptide fold or domain or sub-domain
MADLSNKKERGPQTPGSHHMQYKV

SEQ ID NO: 24853 - protein, 17 aa, artificial
  peptide fold or domain or sub-domain
PAQIKVRWFRNGQEETA

SEQ ID NO: 24854 - protein, 27 aa, artificial
  peptide fold or domain or sub-domain
MKTRINKSTFLWDSRLYSNSSGAPRCL

SEQ ID NO: 24855 - protein, 22 aa, artificial [sequence omitted]

SEQ ID NO: 24856 - protein, 22 aa, artificial [sequence omitted]

SEQ ID NO: 24857 - protein, 13 aa, artificial
  peptide fold or domain or sub-domain
MGQPDGRQPLPMD

SEQ ID NO: 24858 - protein, 30 aa, artificial
  peptide fold or domain or sub-domain
EVCPANWTPDSPTIKPSPAASKEYFQKVNQ

SEQ ID NO: 24859 - protein, 13 aa, artificial
  peptide fold or domain or sub-domain
LNKNQLPPICYNY

SEQ ID NO: 24860 - protein, 20 aa, artificial
  peptide fold or domain or sub-domain
VKKNRYKDILPYHCNGLPRI

SEQ ID NO: 24861 - protein, 11 aa, artificial
  peptide fold or domain or sub-domain
MVMPSRILKLT

SEQ ID NO: 24862 - protein, 14 aa, artificial
  peptide fold or domain or sub-domain
ELSNFECLHPCSQE

SEQ ID NO: 24863 - protein, 24 aa, artificial
  peptide fold or domain or sub-domain
LPPADSSFMLPPTSFSSNYFHFLP

SEQ ID NO: 24864 - protein, 26 aa, artificial
  peptide fold or domain or sub-domain
FSGTQFFFNFRFQLLQKVKIHSQWIV

SEQ ID NO: 24865 - protein, 27 aa, artificial
  peptide fold or domain or sub-domain
MTREAVIHLLSLGIEFAWGKIRTLVHQ

SEQ ID NO: 24866 - protein, 21 aa, artificial
  peptide fold or domain or sub-domain
MSYSSLYPLNPTQCLAQRQRP

SEQ ID NO: 24867 - protein, 29 aa, artificial
  peptide fold or domain or sub-domain
MKPPARSLRTCPHQEPEFRPEEESYLVPL

SEQ ID NO: 24868 - protein, 28 aa, artificial
  peptide fold or domain or sub-domain
MVAYDPDERIAAHQALQHPYFQEQRNSP

SEQ ID NO: 24869 - protein, 17 aa, artificial
  peptide fold or domain or sub-domain
GLHVLRTESRENTEPTG

SEQ ID NO: 24870 - protein, 19 aa, artificial
  peptide fold or domain or sub-domain
MYFYVGHKKINCPLMEVLR

SEQ ID NO: 24871 - protein, 12 aa, artificial
  peptide fold or domain or sub-domain
MGVQVETISPGD

SEQ ID NO: 24872 - protein, 23 aa, artificial
  peptide fold or domain or sub-domain
DLSENQIQAIPRKAFRGAVDIKN

SEQ ID NO: 24873 - protein, 21 aa, artificial
  peptide fold or domain or sub-domain
MDRPGFVAALVLLHFLSPMNM

SEQ ID NO: 24874 - protein, 29 aa, artificial
  peptide fold or domain or sub-domain
GFGFITFEDEQSVDQAVNMHFHDIMGKKV

SEQ ID NO: 24875 - protein, 29 aa, artificial
  peptide fold or domain or sub-domain
MVPSLNGKTRNIEGKMDCDPNALALRPGL

SEQ ID NO: 24876 - protein, 24 aa, artificial
  peptide fold or domain or sub-domain
LLLNLKIWKAPHVAKYFDDQVFWK

SEQ ID NO: 24877 - protein, 24 aa, artificial
  peptide fold or domain or sub-domain
MENQEKASIAGHMFDVVVIGGGIS

SEQ ID NO: 24878 - protein, 17 aa, artificial
  peptide fold or domain or sub-domain
FHEDNIPQLEDVSQFLP

SEQ ID NO: 24879 - protein, 28 aa, artificial
  peptide fold or domain or sub-domain
ITVLLSLTVFMLLVAEIMPATSDSVPLI

SEQ ID NO: 24880 - protein, 17 aa, artificial
  peptide fold or domain or sub-domain
ADTLLHFATESTPDGFS

SEQ ID NO: 24881 - protein, 23 aa, artificial
  peptide fold or domain or sub-domain
MARRPCSLPSPAHLEHPGYTGVG

SEQ ID NO: 24882 - protein, 29 aa, artificial
  peptide fold or domain or sub-domain
MASREDELRNCVENSQQKHWSHLPLCWKL

SEQ ID NO: 24883 - protein, 18 aa, artificial
  peptide fold or domain or sub-domain
MYSFNTLRLYLSGAIVFF

SEQ ID NO: 24884 - protein, 17 aa, artificial
  peptide fold or domain or sub-domain
FVVQSSSVFTSAITPLI

SEQ ID NO: 24885 - protein, 21 aa, artificial
  peptide fold or domain or sub-domain
NEGLIPSNYVTENKITNLEIY

SEQ ID NO: 24886 - protein, 13 aa, artificial
  peptide fold or domain or sub-domain
MRRYKLFLMFCMA

SEQ ID NO: 24887 - protein, 13 aa, artificial
  peptide fold or domain or sub-domain
MAGACRLRSASGS

SEQ ID NO: 24888 - protein, 25 aa, artificial
  peptide fold or domain or sub-domain
MVDTSMWFSYWCKQVQMWMQQITAR

SEQ ID NO: 24889 - protein, 19 aa, artificial
  peptide fold or domain or sub-domain
MSAKDERAREILRGFKLNG

SEQ ID NO: 24890 - protein, 15 aa, artificial
  peptide fold or domain or sub-domain
PLYPGALEYDQDRRY

SEQ ID NO: 24891 - protein, 19 aa, artificial
  peptide fold or domain or sub-domain
AGVSSQPVSLADRLIGPMM

SEQ ID NO: 24892 - protein, 21 aa, artificial
  peptide fold or domain or sub-domain
MIAAQLLAYYFTELKDDQVKK

SEQ ID NO: 24893 - protein, 14 aa, artificial
  peptide fold or domain or sub-domain
CAERHYDTAKFNCR

SEQ ID NO: 24894 - protein, 20 aa, artificial
  peptide fold or domain or sub-domain
MGQFLSSTFLEGSPATVSTI

SEQ ID NO: 24895 - protein, 22 aa, artificial
  peptide fold or domain or sub-domain
MPLLQRNRQPSNATPTPSSIKH

SEQ ID NO: 24896 - protein, 17 aa, artificial
  peptide fold or domain or sub-domain
STRSFPSYYTSHVQEEQ

SEQ ID NO: 24897 - protein, 23 aa, artificial
  peptide fold or domain or sub-domain
MAVSESQLKKMVSKFLTMAVPGN

SEQ ID NO: 24898 - protein, 20 aa, artificial
  peptide fold or domain or sub-domain
QTPDSSGCFREGSTYTWWSF

SEQ ID NO: 24899 - protein, 23 aa, artificial
  peptide fold or domain or sub-domain
FNSNLLLKRLNLKRKWTQNMKRK

SEQ ID NO: 24900 - protein, 14 aa, artificial
  peptide fold or domain or sub-domain
MVIETELSWGLYSK

SEQ ID NO: 24901 - protein, 24 aa, artificial
  peptide fold or domain or sub-domain
RNKDMSWPEEMSFIANSSKIDRHK

SEQ ID NO: 24902 - protein, 30 aa, artificial
  peptide fold or domain or sub-domain
EEAQSKRQEKLVEKHKEIRQQILDEKPKVP

SEQ ID NO: 24903 - protein, 26 aa, artificial
  peptide fold or domain or sub-domain
MWWHQHNLCFRRPIEEDYSSGDVEEK

SEQ ID NO: 24904 - protein, 24 aa, artificial
  peptide fold or domain or sub-domain
MDLSSEMNRHGKNPVSHKLEDQKK

SEQ ID NO: 24905 - protein, 29 aa, artificial
  peptide fold or domain or sub-domain
EPTRKLEPSVGYATFWKPQHRVLTSVFTK

SEQ ID NO: 24906 - protein, 25 aa, artificial
  peptide fold or domain or sub-domain
PRVRGSGKVARAIDWELGTGMKRKS

SEQ ID NO: 24907 - protein, 18 aa, artificial
  peptide fold or domain or sub-domain
AVVLSARPSETWETRGRK

SEQ ID NO: 24908 - protein, 22 aa, artificial
  peptide fold or domain or sub-domain
ECQIYNVSESEDLRTDSWSHGP

SEQ ID NO: 24909 - protein, 23 aa, artificial
  peptide fold or domain or sub-domain
MTTEPKHSLPEVHFTSPQTKYAV

SEQ ID NO: 24910 - protein, 21 aa, artificial
  peptide fold or domain or sub-domain
RERNANLVACEECLYLDTIVT

SEQ ID NO: 24911 - protein, 19 aa, artificial
  peptide fold or domain or sub-domain
GGSSQVYFMTLNRNCIMNW

SEQ ID NO: 24912 - protein, 27 aa, artificial
  peptide fold or domain or sub-domain
DILQHNHPVVGLLQVGSEHGSEEAALS

SEQ ID NO: 24913 - protein, 21 aa, artificial
  peptide fold or domain or sub-domain
PFTALCPQRVWLRDLKILGNP

SEQ ID NO: 24914 - protein, 20 aa, artificial
  peptide fold or domain or sub-domain
GGATYTSLVYECKIHFKPDT

SEQ ID NO: 24915 - protein, 20 aa, artificial
  peptide fold or domain or sub-domain
KDGVLGAGRAAEPAKLYSRK

SEQ ID NO: 24916 - protein, 21 aa, artificial
  peptide fold or domain or sub-domain
CGIDLTKHEDIPSVCLIIFCI

SEQ ID NO: 24917 - protein, 21 aa, artificial
  peptide fold or domain or sub-domain
MSSNSDTGDLQESLKHGLTPI

SEQ ID NO: 24918 - protein, 13 aa, artificial
  peptide fold or domain or sub-domain
HNVGSLFHMADDL

SEQ ID NO: 24919 - protein, 14 aa, artificial
  peptide fold or domain or sub-domain
MEIHCKHDPFASMH

SEQ ID NO: 24920 - protein, 20 aa, artificial
  peptide fold or domain or sub-domain
WGEGTPDNTTLGSVFPGTAL

SEQ ID NO: 24921 - protein, 19 aa, artificial
  peptide fold or domain or sub-domain
KHTTAPLITSLHPGPDDLL

SEQ ID NO: 24922 - protein, 25 aa, artificial
  peptide fold or domain or sub-domain
PFWEIISVHTNHIIQGSCHMCGVSY

SEQ ID NO: 24923 - protein, 21 aa, artificial [sequence omitted]

SEQ ID NO: 24924 - protein, 21 aa, artificial
  peptide fold or domain or sub-domain
MKLMTVDPVVQEATLHVSSRL

SEQ ID NO: 24925 - protein, 29 aa, artificial
  peptide fold or domain or sub-domain
HLVASAASHEGPEQKQDSCSASAGTFPQT

SEQ ID NO: 24926 - protein, 23 aa, artificial
  peptide fold or domain or sub-domain
FHVFSGEAIFMDDLHLLHNGAFS

SEQ ID NO: 24927 - protein, 28 aa, artificial
  peptide fold or domain or sub-domain
VSQPGSCRHGADRVGHVGQRAGAGVRPE

SEQ ID NO: 24928 - protein, 23 aa, artificial
  peptide fold or domain or sub-domain
MHWEKVDVNNSIKQPYFLIKNDK

SEQ ID NO: 24929 - protein, 26 aa, artificial
  peptide fold or domain or sub-domain
MTICILLPAFSLNTTVLNPEPSRESY

SEQ ID NO: 24930 - protein, 30 aa, artificial
  peptide fold or domain or sub-domain
MHPRWAARLPLFISLLERADSVTAAYAKQH

SEQ ID NO: 24931 - protein, 22 aa, artificial
  peptide fold or domain or sub-domain
MEGSLCSSYPSSALGLATAPAF

SEQ ID NO: 24932 - protein, 25 aa, artificial [sequence omitted]

SEQ ID NO: 24933 - protein, 22 aa, artificial
  peptide fold or domain or sub-domain
APEVIPCVAGLLGLDRQEKPKD

SEQ ID NO: 24934 - protein, 18 aa, artificial
  peptide fold or domain or sub-domain
MPTMTSEPSQPQGMGKAS

SEQ ID NO: 24935 - protein, 20 aa, artificial
  peptide fold or domain or sub-domain
MDAQISEEYPAGTGQLSPGE

SEQ ID NO: 24936 - protein, 14 aa, artificial
  peptide fold or domain or sub-domain
MLLDSKISRSWNWF

SEQ ID NO: 24937 - protein, 25 aa, artificial
  peptide fold or domain or sub-domain
VFLATRPCRRLRSPSLPSFSSRRVS

SEQ ID NO: 24938 - protein, 26 aa, artificial [sequence omitted]

SEQ ID NO: 24939 - protein, 26 aa, artificial
  peptide fold or domain or sub-domain
MAVEGQALPSAHVWKANSRVDAEHTC

SEQ ID NO: 24940 - protein, 28 aa, artificial
  peptide fold or domain or sub-domain
SEVTAFAVLDQDQKEIIDTNGAGDAFVG

SEQ ID NO: 24941 - protein, 17 aa, artificial
  peptide fold or domain or sub-domain
LLRSCQDLGRQAWAGAG

SEQ ID NO: 24942 - protein, 24 aa, artificial
  peptide fold or domain or sub-domain
KNRVEQQLHEHLQDAMSFLKDVCE

SEQ ID NO: 24943 - protein, 30 aa, artificial
  peptide fold or domain or sub-domain
SWGAQLPTPRLAPAASTQSVCGEVTRNTVP

SEQ ID NO: 24944 - protein, 14 aa, artificial
  peptide fold or domain or sub-domain
TDSRTSTIEIYSEI

SEQ ID NO: 24945 - protein, 30 aa, artificial
  peptide fold or domain or sub-domain
MLSGDPHLPQPLCHCLDHCPCCFSGTTRTS

SEQ ID NO: 24946 - protein, 13 aa, artificial [sequence omitted]

SEQ ID NO: 24947 - protein, 15 aa, artificial [sequence omitted]

SEQ ID NO: 24948 - protein, 19 aa, artificial [sequence omitted]

SEQ ID NO: 24949 - protein, 25 aa, artificial
  peptide fold or domain or sub-domain
MDASERGRLLDKLADLVERDRAVLA

SEQ ID NO: 24950 - protein, 26 aa, artificial
  peptide fold or domain or sub-domain
TRKCTGQARNASAGTPPTSRRARCSL

SEQ ID NO: 24951 - protein, 29 aa, artificial
  peptide fold or domain or sub-domain
RSLLLADLDKEEKEKDWYYAQLQNLTKRI

SEQ ID NO: 24952 - protein, 24 aa, artificial
  peptide fold or domain or sub-domain
QFFDLMKLFEVGGSPANTRYLFLG

SEQ ID NO: 24953 - protein, 20 aa, artificial
  peptide fold or domain or sub-domain
MSLRSGGRRRADPGADGEAS

SEQ ID NO: 24954 - protein, 16 aa, artificial
  peptide fold or domain or sub-domain
SLQMADEESRLSAYYN

SEQ ID NO: 24955 - protein, 22 aa, artificial
  peptide fold or domain or sub-domain
CAFSGICTLHFHSCSEINSSLA

SEQ ID NO: 24956 - protein, 26 aa, artificial
  peptide fold or domain or sub-domain
MLFSNFPDPAGKLNQFRKNLQESQQL

SEQ ID NO: 24957 - protein, 26 aa, artificial
  peptide fold or domain or sub-domain
DMFPETFWGQIVGAMAVVSGVLTIAL

SEQ ID NO: 24958 - protein, 23 aa, artificial
  peptide fold or domain or sub-domain
GRIHINDYLDTNHNADYYLKGRK

SEQ ID NO: 24959 - protein, 27 aa, artificial
  peptide fold or domain or sub-domain
HYSRYITIRRKSELAQALNLSERQVKI

SEQ ID NO: 24960 - protein, 27 aa, artificial
  peptide fold or domain or sub-domain
MPGGYHCGHWIACTLLSAVPMNSSSLS

SEQ ID NO: 24961 - protein, 25 aa, artificial
  peptide fold or domain or sub-domain
MISCNANAGSFIKVNRAASNTETSG

SEQ ID NO: 24962 - protein, 27 aa, artificial
  peptide fold or domain or sub-domain
KAQQYLTRDRRARLSQSLSLSERQVKI

SEQ ID NO: 24963 - protein, 26 aa, artificial
  peptide fold or domain or sub-domain
MKIDCFIMDIHQFVIKLTKKKNYENY

SEQ ID NO: 24964 - protein, 26 aa, artificial
  peptide fold or domain or sub-domain
DLSPTSAVGRLIGSVAVVLGIVILAL

SEQ ID NO: 24965 - protein, 30 aa, artificial
  peptide fold or domain or sub-domain
MFRYLNKKCKIYNSLNFLKDYKLYFSSTES

SEQ ID NO: 24966 - protein, 30 aa, artificial
  peptide fold or domain or sub-domain
MPHLSPLSWFMYFTCLNCVILLVIISAEMK

SEQ ID NO: 24967 - protein, 30 aa, artificial
  peptide fold or domain or sub-domain
MLQRNKHSRLVSPSGGMSKMWGLMLLCWTR

SEQ ID NO: 24968 - protein, 21 aa, artificial
  peptide fold or domain or sub-domain
IVTGTDVDYASRGRLPPISNV

SEQ ID NO: 24969 - protein, 27 aa, artificial
  peptide fold or domain or sub-domain
RPGHTSSQRSKSASVKKAKMIPHSENP

SEQ ID NO: 24970 - protein, 22 aa, artificial
  peptide fold or domain or sub-domain
STSSPWRTPIHVRIPHLLPRKP

SEQ ID NO: 24971 - protein, 30 aa, artificial
  peptide fold or domain or sub-domain
MLYFGTSPSSFQCSQLHMHQGYYAYENNKQ

SEQ ID NO: 24972 - protein, 23 aa, artificial
  peptide fold or domain or sub-domain
MNENVVPIKNLRALGSHNFSCTL

SEQ ID NO: 24973 - protein, 21 aa, artificial
  peptide fold or domain or sub-domain
MQNQMVGEIADVPIEKTRKNL

SEQ ID NO: 24974 - protein, 27 aa, artificial
  peptide fold or domain or sub-domain
MNEIKPRANPFPALFLGLTSKPFQLQA

SEQ ID NO: 24975 - protein, 29 aa, artificial
  peptide fold or domain or sub-domain
MKIEQVRRKIQITDEEKSRIKEEYKTRKT

SEQ ID NO: 24976 - protein, 22 aa, artificial
  peptide fold or domain or sub-domain
MARKEISSTFIQFIKIFEGNSS

SEQ ID NO: 24977 - protein, 28 aa, artificial
  peptide fold or domain or sub-domain
MGNQNKGQKQQKEQIKCLFLKKNEWIAF

SEQ ID NO: 24978 - protein, 25 aa, artificial
  peptide fold or domain or sub-domain
MLNQLSYSKQQSKCYFQFENSEQEL

SEQ ID NO: 24979 - protein, 24 aa, artificial
  peptide fold or domain or sub-domain
MGQSVKVSASKLFHNQISYLKIYL

SEQ ID NO: 24980 - protein, 30 aa, artificial
  peptide fold or domain or sub-domain
MHVYLLIYQLKFKAIRTQDQSIHPFKRDFI

SEQ ID NO: 24981 - protein, 29 aa, artificial
  peptide fold or domain or sub-domain
MIVYSIQLILQLNLVFPDHQFNCYFKNHY

SEQ ID NO: 24982 - protein, 19 aa, artificial
  peptide fold or domain or sub-domain
MVCYKNNWHLTLVNQKEKI

SEQ ID NO: 24983 - protein, 28 aa, artificial
  peptide fold or domain or sub-domain
MEVNKQSKHITIQWQQEIVKNCINLFKN

SEQ ID NO: 24984 - protein, 26 aa, artificial
  peptide fold or domain or sub-domain
MRICAGKIAHFLFKKQLLIRFQVIVM

SEQ ID NO: 24985 - protein, 21 aa, artificial
  peptide fold or domain or sub-domain
MHESYHISYHFGVGEMRQFQG

SEQ ID NO: 24986 - protein, 27 aa, artificial
  peptide fold or domain or sub-domain
MTKLNRLSCLQYMSQEVEKSWGESQTN

SEQ ID NO: 24987 - protein, 29 aa, artificial
  peptide fold or domain or sub-domain
MSQMKLGTDPQPSTGERGNQQNKLKSQRA

SEQ ID NO: 24988 - protein, 25 aa, artificial
  peptide fold or domain or sub-domain
MHVDSNILNFLFEYFLSILFVLFDF

SEQ ID NO: 24989 - protein, 24 aa, artificial
  peptide fold or domain or sub-domain
MHSQQGGFNYVISIQYDDKHFSQI

SEQ ID NO: 24990 - protein, 27 aa, artificial
  peptide fold or domain or sub-domain
MGYRVKKLWEWWDMNVLMMNCGLINYL

SEQ ID NO: 24991 - protein, 23 aa, artificial
  peptide fold or domain or sub-domain
MAKNISFHIDENVQFGMASIQKK

SEQ ID NO: 24992 - protein, 27 aa, artificial
  peptide fold or domain or sub-domain
MNELFLQEVQLQVQETAAVLQSRAQNL

SEQ ID NO: 24993 - protein, 28 aa, artificial
  peptide fold or domain or sub-domain
MNFLPSKKRAMTEVRQKIYDFREQSKQF

SEQ ID NO: 24994 - protein, 27 aa, artificial
  peptide fold or domain or sub-domain
MSSGRINLDTRNEQRLIGAVKAKYAVG

SEQ ID NO: 24995 - protein, 19 aa, artificial
  peptide fold or domain or sub-domain
MRARFIQKRLKTVFKGDNY

SEQ ID NO: 24996 - protein, 25 aa, artificial
  peptide fold or domain or sub-domain
MTINKGKKQNKPEEQIPIYNIYITK

SEQ ID NO: 24997 - protein, 26 aa, artificial
  peptide fold or domain or sub-domain
MNSEQLKIESENKDNSQKSICMYKQS

SEQ ID NO: 24998 - protein, 25 aa, artificial
  peptide fold or domain or sub-domain
MRIPDDTRTQWMLDGFDQLDIQTTK

SEQ ID NO: 24999 - protein, 26 aa, artificial
  peptide fold or domain or sub-domain
MRDLCLITHRRANSGLRQTRFALLCK

SEQ ID NO: 25000 - protein, 30 aa, artificial
  peptide fold or domain or sub-domain
MEMIDFQLNSRSKRRYHIDKLFSQKQGNFV

SEQ ID NO: 25001 - protein, 25 aa, artificial
  peptide fold or domain or sub-domain
MKIQFKENRNFEQIQGEFNKKSRKN

SEQ ID NO: 25002 - protein, 25 aa, artificial
  peptide fold or domain or sub-domain
MDNKYINKIRIFYAIPIHPNNPVQN

SEQ ID NO: 25003 - protein, 30 aa, artificial
  peptide fold or domain or sub-domain
MLTLNEVCFVLDIKTISQPRGSRLIRFIPN

SEQ ID NO: 25004 - protein, 23 aa, artificial
  peptide fold or domain or sub-domain
MNQASKTLHKLKSSFLFSKIDLQ

SEQ ID NO: 25005 - protein, 28 aa, artificial
  peptide fold or domain or sub-domain
MFYNPPKSSVPEEFDETDPINHKYIHTV

SEQ ID NO: 25006 - protein, 24 aa, artificial
  peptide fold or domain or sub-domain
MNESQSALKEEEEQKQNTACKIKK

SEQ ID NO: 25007 - protein, 29 aa, artificial
  peptide fold or domain or sub-domain
MDTYFYAFLQQCNAKIFQKTCQDIKNHFV

SEQ ID NO: 25008 - protein, 16 aa, artificial
  peptide fold or domain or sub-domain
MTLVCNFNYLAINLDG

SEQ ID NO: 25009 - protein, 23 aa, artificial
  peptide fold or domain or sub-domain
MQAHQGGVKKEQLNMPLMICDRL

SEQ ID NO: 25010 - protein, 27 aa, artificial
  peptide fold or domain or sub-domain
MKAIFRVFQQYEEGINNYSKQFKLKFY

SEQ ID NO: 25011 - protein, 27 aa, artificial
  peptide fold or domain or sub-domain
MNGLNIEFFANREQEQLQYMQMIAMLA

SEQ ID NO: 25012 - protein, 30 aa, artificial
  peptide fold or domain or sub-domain
MVRGNPQGLAKYLMQIQKLMRIFLCVYVLL

SEQ ID NO: 25013 - protein, 19 aa, artificial
  peptide fold or domain or sub-domain
MTIKKDRETNRIDTFCNIF

SEQ ID NO: 25014 - protein, 29 aa, artificial
  peptide fold or domain or sub-domain
MSKNRIKLFANQLQLTRILNSTVSIYLLF

SEQ ID NO: 25015 - protein, 19 aa, artificial
  peptide fold or domain or sub-domain
MEYDIFYFRIQYITEILKF

SEQ ID NO: 25016 - protein, 28 aa, artificial
  peptide fold or domain or sub-domain
MLNVNFFPLDHIFENNIQSKTHRQDFHL

SEQ ID NO: 25017 - protein, 26 aa, artificial
  peptide fold or domain or sub-domain
MRDQRDRFEQQVINLQVQERSRLSKD

SEQ ID NO: 25018 - protein, 28 aa, artificial
  peptide fold or domain or sub-domain
MMFAKGQSRSRIDFGLVFKSINGTTIQT

SEQ ID NO: 25019 - protein, 25 aa, artificial
  peptide fold or domain or sub-domain
MAFSSKKAIFSILYQQNVQIKHPTF

SEQ ID NO: 25020 - protein, 28 aa, artificial
  peptide fold or domain or sub-domain
MIKEMQDKQGSMYQCIIAGCSVRNQGYI

SEQ ID NO: 25021 - protein, 26 aa, artificial
  peptide fold or domain or sub-domain
MCKIQKLENLGIDPSASRMLNERSTI

SEQ ID NO: 25022 - protein, 28 aa, artificial
  peptide fold or domain or sub-domain
MIEIFYQDSKMLNQLINLSKKAVINKYD

SEQ ID NO: 25023 - protein, 27 aa, artificial
  peptide fold or domain or sub-domain
MRTNKNPNISCQYIFDRKYLLVAGSVG

SEQ ID NO: 25024 - protein, 25 aa, artificial
  peptide fold or domain or sub-domain
MFNKNAHKTIIATTNALICYLDYLQ

SEQ ID NO: 25025 - protein, 21 aa, artificial
  peptide fold or domain or sub-domain
MITHPCESEAIQIQKLVQNNF

SEQ ID NO: 25026 - protein, 29 aa, artificial
  peptide fold or domain or sub-domain
MKSNNILKSNSTLAHFLQIFIKRFYFRVY

SEQ ID NO: 25027 - protein, 19 aa, artificial
  peptide fold or domain or sub-domain
MLVKFMIQNQMMVNITNTC

SEQ ID NO: 25028 - protein, 13 aa, artificial
  peptide fold or domain or sub-domain
MAQSIINNDENFK

SEQ ID NO: 25029 - protein, 24 aa, artificial
  peptide fold or domain or sub-domain
MCKCANNVIAYAKLWIIKYIDFVN

SEQ ID NO: 25030 - protein, 27 aa, artificial
  peptide fold or domain or sub-domain
MGFYEDYQIALFAFNLIKLYKKAKEKV

SEQ ID NO: 25031 - protein, 23 aa, artificial
  peptide fold or domain or sub-domain
MFNQKKVRSQSKSGYHPNFIKLV

SEQ ID NO: 25032 - protein, 29 aa, artificial
  peptide fold or domain or sub-domain
MHPHNQFDFPFLNIKELICQQEGKNDEQI

SEQ ID NO: 25033 - protein, 27 aa, artificial
  peptide fold or domain or sub-domain
MGRQKLCRLQKPKATGINLKKQKEFST

SEQ ID NO: 25034 - protein, 27 aa, artificial
  peptide fold or domain or sub-domain
MEKAYMNPAQCCQQATNTSNNIQKLMN

SEQ ID NO: 25035 - protein, 23 aa, artificial
  peptide fold or domain or sub-domain
MLKKLEENQLNNICQKNGWVFEN

SEQ ID NO: 25036 - protein, 23 aa, artificial
  peptide fold or domain or sub-domain
MINYSDANQAKKEQTQSGFKFFI

SEQ ID NO: 25037 - protein, 27 aa, artificial
  peptide fold or domain or sub-domain
MIFTTPTGDLLAAEKAKEGTTKTAVYS

SEQ ID NO: 25038 - protein, 13 aa, artificial
  peptide fold or domain or sub-domain
MEEHISNNLELHQ

SEQ ID NO: 25039 - protein, 25 aa, artificial
  peptide fold or domain or sub-domain
MDNLMRLERRIKDQLFYIFTVDDFF

SEQ ID NO: 25040 - protein, 23 aa, artificial
  peptide fold or domain or sub-domain
MKCKQQFKYINLIFYSLKALFYE

SEQ ID NO: 25041 - protein, 28 aa, artificial
  peptide fold or domain or sub-domain
MFVNAIKNLSKLFDVIFINQNNQIISNK

SEQ ID NO: 25042 - protein, 27 aa, artificial
  peptide fold or domain or sub-domain
MGDINKQLLFNQMSCKGLVVKEKNKGG

SEQ ID NO: 25043 - protein, 23 aa, artificial
  peptide fold or domain or sub-domain
MKNSSQIHKNQNPILVEKFLDEN

SEQ ID NO: 25044 - protein, 28 aa, artificial
  peptide fold or domain or sub-domain
MKKYYPTTLLGIQFLFHIHKNLIQLYCE

SEQ ID NO: 25045 - protein, 26 aa, artificial
  peptide fold or domain or sub-domain
MEILEYMTPNLAHSSFSMHIVVGLIK

SEQ ID NO: 25046 - protein, 23 aa, artificial
  peptide fold or domain or sub-domain
MYQNTFFNLPSKQANSQDDQYQT

SEQ ID NO: 25047 - protein, 30 aa, artificial
  peptide fold or domain or sub-domain
MIDYCQMRISISVLKNIVETRGWIQRIMTM

SEQ ID NO: 25048 - protein, 25 aa, artificial
  peptide fold or domain or sub-domain
MKDQNTYKFIFYQNKFTLKQIKYQV

SEQ ID NO: 25049 - protein, 28 aa, artificial
  peptide fold or domain or sub-domain
MIEYIFMFEVRSISTQDKQLFLSRQVIN

SEQ ID NO: 25050 - protein, 29 aa, artificial
  peptide fold or domain or sub-domain
MKIIVIIKVNNAAQKLYKVFIFPFLLNRN

SEQ ID NO: 25051 - protein, 28 aa, artificial
  peptide fold or domain or sub-domain
MKAYNNQQISSIIIGSPCIIQETNQVRM

SEQ ID NO: 25052 - protein, 29 aa, artificial
  peptide fold or domain or sub-domain
MATKSVLDDKYVKLGPSAQQGSYSYCLIY

SEQ ID NO: 25053 - protein, 28 aa, artificial
  peptide fold or domain or sub-domain
MKFYGAKLISITVQNKQIVFTSEQLSTF

SEQ ID NO: 25054 - protein, 22 aa, artificial
  peptide fold or domain or sub-domain
MLIINQKMQCFDEVSQQKDQNV

SEQ ID NO: 25055 - protein, 25 aa, artificial
  peptide fold or domain or sub-domain
MKNKQILKCILCKLADQQCIILSEV

SEQ ID NO: 25056 - protein, 26 aa, artificial
  peptide fold or domain or sub-domain
MMKKQEIIQLANKDILMGGGRGHTHF

SEQ ID NO: 25057 - protein, 22 aa, artificial
  peptide fold or domain or sub-domain
MDIRIQQNQKPKNDIANEILID

SEQ ID NO: 25058 - protein, 23 aa, artificial
  peptide fold or domain or sub-domain
MKEQNQLNSQVAQNISLIYYIIK

SEQ ID NO: 25059 - protein, 25 aa, artificial
  peptide fold or domain or sub-domain
MAKNKEPSNHKLRVQKYLSALIIFN

SEQ ID NO: 25060 - protein, 13 aa, artificial
  peptide fold or domain or sub-domain
MKRKLFLNSTNSL

SEQ ID NO: 25061 - protein, 21 aa, artificial
  peptide fold or domain or sub-domain
MDKQEQKQQFNFNFNGKYFIL

SEQ ID NO: 25062 - protein, 26 aa, artificial
  peptide fold or domain or sub-domain
MKCRFILLTKQEKDQNRNIKIQGSYW

SEQ ID NO: 25063 - protein, 28 aa, artificial
  peptide fold or domain or sub-domain
MINLILIVKKFIPPFNIDSLLKKSRYDD

SEQ ID NO: 25064 - protein, 25 aa, artificial
  peptide fold or domain or sub-domain
MTLQIALVILKEQVENQASSKKDQH

SEQ ID NO: 25065 - protein, 28 aa, artificial
  peptide fold or domain or sub-domain
MHNLNYYQSNKKKYLLEELNTESHIRIK

SEQ ID NO: 25066 - protein, 27 aa, artificial
  peptide fold or domain or sub-domain
MEANKKQFQVKKIYHFQKKCTNPSISE

SEQ ID NO: 25067 - protein, 23 aa, artificial
  peptide fold or domain or sub-domain
MENILQNIYERGNQSHYSTKFVN

SEQ ID NO: 25068 - protein, 23 aa, artificial
  peptide fold or domain or sub-domain
MKYTLAQYGEPNEIKGDGIGENQ

SEQ ID NO: 25069 - protein, 28 aa, artificial
  peptide fold or domain or sub-domain
MTISIDKYGPLGYPKLLIQNTEDSSVQI

SEQ ID NO: 25070 - protein, 26 aa, artificial
  peptide fold or domain or sub-domain
MEKNSLDLKDVKQANMLEEFYEEKKY

SEQ ID NO: 25071 - protein, 26 aa, artificial
  peptide fold or domain or sub-domain
MVQQEEQNMDDFLFFLKTILFKKMKV

SEQ ID NO: 25072 - protein, 29 aa, artificial
  peptide fold or domain or sub-domain
MRQQSGAPYLVKSKQITSMYFAQPLKIGN

SEQ ID NO: 25073 - protein, 27 aa, artificial
  peptide fold or domain or sub-domain
MHGLHLKLNKFSDTLILFSIQQKYIIK

SEQ ID NO: 25074 - protein, 28 aa, artificial
  peptide fold or domain or sub-domain
MNKFNQAINLTFLVFFYQSNIQYIPYPC

SEQ ID NO: 25075 - protein, 29 aa, artificial
  peptide fold or domain or sub-domain
MGGYQRGKQVKVLNPLNQYKEQDGQKIQN

SEQ ID NO: 25076 - protein, 21 aa, artificial
  peptide fold or domain or sub-domain
MGVFIFLDGMEKKGFFLLNEP

SEQ ID NO: 25077 - protein, 29 aa, artificial
  peptide fold or domain or sub-domain
MSVYDYILIQIIMIEFILLNNRKVSKKMQ

SEQ ID NO: 25078 - protein, 12 aa, artificial
  peptide fold or domain or sub-domain
MANSKKSTAMNL

SEQ ID NO: 25079 - protein, 26 aa, artificial
  peptide fold or domain or sub-domain
MYVDTILKVQFESQKGLENTQKYIQI

SEQ ID NO: 25080 - protein, 26 aa, artificial
  peptide fold or domain or sub-domain
MSCEQQQQQEEVQILNVFISLNTESI

SEQ ID NO: 25081 - protein, 24 aa, artificial
  peptide fold or domain or sub-domain
MQINFQLNLENYFIEQKLIDNQVK

SEQ ID NO: 25082 - protein, 26 aa, artificial
  peptide fold or domain or sub-domain
MKKLSKYKLLSLQRQFMKQIYKHQDI

SEQ ID NO: 25083 - protein, 28 aa, artificial
  peptide fold or domain or sub-domain
MSNKSIPSNSNIYVLCLVYFLEKEDDII

SEQ ID NO: 25084 - protein, 23 aa, artificial
  peptide fold or domain or sub-domain
MANYNIFSRNLEEFSCQDEIKIN

SEQ ID NO: 25085 - protein, 26 aa, artificial
  peptide fold or domain or sub-domain
MQTDRLSDIHLEYQKLKEENIFEGIH

SEQ ID NO: 25086 - protein, 28 aa, artificial
  peptide fold or domain or sub-domain
MRLNDQKKHPSQKIISQQEQHNYYYFQL

SEQ ID NO: 25087 - protein, 27 aa, artificial
  peptide fold or domain or sub-domain
MNGNIAISEQEECLRDFETAANKAQNP

SEQ ID NO: 25088 - protein, 27 aa, artificial
  peptide fold or domain or sub-domain
MECIFVPKVSTVYQNISSFTKKNSYLM

SEQ ID NO: 25089 - protein, 26 aa, artificial
  peptide fold or domain or sub-domain
MTFHSEIKETCQPTYNQNKCQLLNKN

SEQ ID NO: 25090 - protein, 30 aa, artificial
  peptide fold or domain or sub-domain
MTMDLSLNHLITYACLLQKNQFFLEREVSV

SEQ ID NO: 25091 - protein, 28 aa, artificial
  peptide fold or domain or sub-domain
MSKCSILFKFLISKQLINISFKATIKLT

SEQ ID NO: 25092 - protein, 24 aa, artificial
  peptide fold or domain or sub-domain
MARAFYLLTLPFSQEFIAFTGILK

SEQ ID NO: 25093 - protein, 30 aa, artificial
  peptide fold or domain or sub-domain
MKQTCVVPGGKPAQAKVEIWKFSKIQHFTS

SEQ ID NO: 25094 - protein, 21 aa, artificial
  peptide fold or domain or sub-domain
MYIEMAMFIRAMWRTLQANQI

SEQ ID NO: 25095 - protein, 30 aa, artificial
  peptide fold or domain or sub-domain
MTIDPLTLGAGYSGSLLYSHYEDFKSKKNS

SEQ ID NO: 25096 - protein, 22 aa, artificial
  peptide fold or domain or sub-domain
MNQPQNANFKMQQINQTIVTVG

SEQ ID NO: 25097 - protein, 30 aa, artificial
  peptide fold or domain or sub-domain
MDQIPKQLDTEMISDILSSSKSSSKPLRMK

SEQ ID NO: 25098 - protein, 12 aa, artificial
  peptide fold or domain or sub-domain
MTIYICGQVNQK

SEQ ID NO: 25099 - protein, 22 aa, artificial
  peptide fold or domain or sub-domain
MSFTNFWLIKRASRYLCKPQAG

SEQ ID NO: 25100 - protein, 30 aa, artificial
  peptide fold or domain or sub-domain
MLAHKSYAMDQQNETKEYKTQAKEQANLKN

SEQ ID NO: 25101 - protein, 26 aa, artificial
  peptide fold or domain or sub-domain
MRIRFQFEQFPRKKYVNSITYALIQS

SEQ ID NO: 25102 - protein, 26 aa, artificial
  peptide fold or domain or sub-domain
MEDYISLIHQQSTGVSQSLYDDGNPL

SEQ ID NO: 25103 - protein, 24 aa, artificial
  peptide fold or domain or sub-domain
MNEQSFKKIGSFKTSDFRGFKCEK

SEQ ID NO: 25104 - protein, 28 aa, artificial
  peptide fold or domain or sub-domain
MPVEPLYQLLSRRQNKIKEEKKQQQFSN

SEQ ID NO: 25105 - protein, 25 aa, artificial
  peptide fold or domain or sub-domain
MKSADLDDQNHNLQGRHFDQRMKIT

SEQ ID NO: 25106 - protein, 30 aa, artificial
  peptide fold or domain or sub-domain
MNENNQPNFKFKVGYKQTLKRKDNQMLLNQ

SEQ ID NO: 25107 - protein, 24 aa, artificial
  peptide fold or domain or sub-domain
MSANKINNSQLFLENLNFCIKVCY

SEQ ID NO: 25108 - protein, 30 aa, artificial
  peptide fold or domain or sub-domain
MIEKECQQLCLQSRNNNKDYFSAKYSKITF

SEQ ID NO: 25109 - protein, 21 aa, artificial
  peptide fold or domain or sub-domain
MLNANLFFALTLLEGSEGAFM

SEQ ID NO: 25110 - protein, 29 aa, artificial
  peptide fold or domain or sub-domain
MAYMTNNFDQMAHYKFDRKYDMEDTNYLE

SEQ ID NO: 25111 - protein, 12 aa, artificial
  peptide fold or domain or sub-domain
MQNEYFINLDKF

SEQ ID NO: 25112 - protein, 29 aa, artificial
  peptide fold or domain or sub-domain
MNEKRKNERFFKKIDKFEKFTFIKILSDF

SEQ ID NO: 25113 - protein, 28 aa, artificial
  peptide fold or domain or sub-domain
MAIYRKNRLKKYFYCLNQNTELKKILCD

SEQ ID NO: 25114 - protein, 29 aa, artificial
  peptide fold or domain or sub-domain
MNERIIKILKQKRQLHIHTNINKRQSIID

SEQ ID NO: 25115 - protein, 30 aa, artificial
  peptide fold or domain or sub-domain
MIMNQPTLVFAFDQHFLMVLLKFSRKIKIV

SEQ ID NO: 25116 - protein, 29 aa, artificial
  peptide fold or domain or sub-domain
MKIATNNFIQQNKANNKINALSSNKLPMI

SEQ ID NO: 25117 - protein, 21 aa, artificial
  peptide fold or domain or sub-domain
MINQYTVKTNFAIRHISNEIN

SEQ ID NO: 25118 - protein, 23 aa, artificial
  peptide fold or domain or sub-domain
MKTELGENHIMIAYIKFKMHLIE

SEQ ID NO: 25119 - protein, 23 aa, artificial
  peptide fold or domain or sub-domain
MRIKVYIYFCIDYSFHLIQIKDP

SEQ ID NO: 25120 - protein, 28 aa, artificial
  peptide fold or domain or sub-domain
MKYELHQMKKRQKIFEDEVSLYNLQKIN

SEQ ID NO: 25121 - protein, 23 aa, artificial
  peptide fold or domain or sub-domain
MKNKEKRNSCKFNFENHDQRQVK

SEQ ID NO: 25122 - protein, 30 aa, artificial
  peptide fold or domain or sub-domain
MQTHSRRRCNDDDNYDEDDTRCFYDEQFQI

SEQ ID NO: 25123 - protein, 27 aa, artificial
  peptide fold or domain or sub-domain
PLQQVSMSSATNRNSSYIGSHRAPGEG

SEQ ID NO: 25124 - protein, 27 aa, artificial
  peptide fold or domain or sub-domain
QIQPLPNSSTPHRTVPHAVPDRETDQN

SEQ ID NO: 25125 - protein, 27 aa, artificial
  peptide fold or domain or sub-domain
PQQEILVTDGTIAHRASPETDRGSGEN

SEQ ID NO: 25126 - protein, 25 aa, artificial
  peptide fold or domain or sub-domain
VQQVHHHPAQGRVVARHRAVRAPSE

SEQ ID NO: 25127 - protein, 27 aa, artificial
  peptide fold or domain or sub-domain
RQPEIPVSARAQEAGKTTGVDRETGED

SEQ ID NO: 25128 - protein, 25 aa, artificial
  peptide fold or domain or sub-domain
MDIFKKQQLFFSISSIEDVLQFFLR

SEQ ID NO: 25129 - protein, 27 aa, artificial
  peptide fold or domain or sub-domain
MDNSDESQQNEQQQTKNDELVEDQFFK

SEQ ID NO: 25130 - protein, 30 aa, artificial
  peptide fold or domain or sub-domain
MKTEEQDLLQSLRQNKNKLIQKLSKTQLPN

SEQ ID NO: 25131 - protein, 22 aa, artificial
  peptide fold or domain or sub-domain
MKVQRQKEPFTQNEDISKGNYG

SEQ ID NO: 25132 - protein, 14 aa, artificial
  peptide fold or domain or sub-domain
MVMNPAQLTYDLFE

SEQ ID NO: 25133 - protein, 30 aa, artificial
  peptide fold or domain or sub-domain
MSQLKTNKLFLLKSKYYEKIVYENIEEKRF

SEQ ID NO: 25134 - protein, 25 aa, artificial
  peptide fold or domain or sub-domain
MNNQKNLAIKKDTLKLNFSELTAFS

SEQ ID NO: 25135 - protein, 28 aa, artificial
  peptide fold or domain or sub-domain
MERDKNMNDGQAFIKRKKKDDENQRAIY

SEQ ID NO: 25136 - protein, 27 aa, artificial
  peptide fold or domain or sub-domain
MNNQSKHTEQIRKEDEEERTKAAIYLN

SEQ ID NO: 25137 - protein, 14 aa, artificial
  peptide fold or domain or sub-domain
MQSLKQLKQIIANI

SEQ ID NO: 25138 - protein, 24 aa, artificial
  peptide fold or domain or sub-domain
MERRARRQKSQYAKENSAQSQANV

SEQ ID NO: 25139 - protein, 22 aa, artificial
  peptide fold or domain or sub-domain
MQHQNINETLLNIHQNQRKIIS

SEQ ID NO: 25140 - protein, 27 aa, artificial
  peptide fold or domain or sub-domain
MIYNTSRKNIAINLQIFQKFELMQQEY

SEQ ID NO: 25141 - protein, 27 aa, artificial
  peptide fold or domain or sub-domain
MDNRNKQKNIISIKVLIQSNLFDNNYV

SEQ ID NO: 25142 - protein, 22 aa, artificial
  peptide fold or domain or sub-domain
MTEKQQKNKKAKNGQQLERYTF

SEQ ID NO: 25143 - protein, 27 aa, artificial
  peptide fold or domain or sub-domain
MIKVQYYKNNGNKNGLKTIKIDNQKID

SEQ ID NO: 25144 - protein, 22 aa, artificial
  peptide fold or domain or sub-domain
MALQPVKEDSFFISGACQPDTI

SEQ ID NO: 25145 - protein, 23 aa, artificial
  peptide fold or domain or sub-domain
MFPVCNLSEGLTQAQIIQQLIKL

SEQ ID NO: 25146 - protein, 22 aa, artificial
  peptide fold or domain or sub-domain
MTQVSMINLQNHISTILKSKHI

SEQ ID NO: 25147 - protein, 17 aa, artificial
  peptide fold or domain or sub-domain
MCFQQEQKFKKITLEIN

SEQ ID NO: 25148 - protein, 19 aa, artificial
  peptide fold or domain or sub-domain
MKTNLFDLRHLRFSFNFYE

SEQ ID NO: 25149 - protein, 28 aa, artificial
  peptide fold or domain or sub-domain
MNQNEPQNSQQISYEFLLTVSIYYFKVF

SEQ ID NO: 25150 - protein, 18 aa, artificial
  peptide fold or domain or sub-domain
MSSIKLDLVHQFDMNGLR

SEQ ID NO: 25151 - protein, 24 aa, artificial
  peptide fold or domain or sub-domain
MQVCECENMTSFTITHQTFSQPLY

SEQ ID NO: 25152 - protein, 30 aa, artificial
  peptide fold or domain or sub-domain
MAQNSNFVLIINSIYQYFGSTQLGLKNGLV

SEQ ID NO: 25153 - protein, 27 aa, artificial
  peptide fold or domain or sub-domain
MENQYEITTSFYQDSCFQGEIKVLYIK

SEQ ID NO: 25154 - protein, 21 aa, artificial
  peptide fold or domain or sub-domain
MKEIEKKSILQIRKFIYKFQY

SEQ ID NO: 25155 - protein, 26 aa, artificial
  peptide fold or domain or sub-domain
MPTNTDESVSNFLIQISFQLQLPIIH

SEQ ID NO: 25156 - protein, 19 aa, artificial
  peptide fold or domain or sub-domain
MHQYERFYAQQRIENYSPL

SEQ ID NO: 25157 - protein, 26 aa, artificial
  peptide fold or domain or sub-domain
MESAEHNYKIMQLKQQREENFYVLIT

SEQ ID NO: 25158 - protein, 26 aa, artificial
  peptide fold or domain or sub-domain
MNGWILLKCKKMISFLYFPYLALRIV

SEQ ID NO: 25159 - protein, 19 aa, artificial
  peptide fold or domain or sub-domain
MKTHILFRHLTDKIQHNTE

SEQ ID NO: 25160 - protein, 18 aa, artificial
  peptide fold or domain or sub-domain
MKRLGWLSENKRKIRNVD

SEQ ID NO: 25161 - protein, 16 aa, artificial
  peptide fold or domain or sub-domain
MISLKKKMGESGGTNQ

SEQ ID NO: 25162 - protein, 25 aa, artificial
  peptide fold or domain or sub-domain
MRNIFLLLEEINILNQQKNFGKYKQ

SEQ ID NO: 25163 - protein, 30 aa, artificial
  peptide fold or domain or sub-domain
MYYEFYQLQKYHINLDPFLIIKFSQENNLK

SEQ ID NO: 25164 - protein, 27 aa, artificial
  peptide fold or domain or sub-domain
MINLLLATLQTKSCYYSKPNCEGLIYP

SEQ ID NO: 25165 - protein, 27 aa, artificial
  peptide fold or domain or sub-domain
MTLKNWKNNENPVLIKIYLGQKEKIKI

SEQ ID NO: 25166 - protein, 27 aa, artificial
  peptide fold or domain or sub-domain
MEKNSFVDQKSHQKDQIRQIYDITKIQ

SEQ ID NO: 25167 - protein, 23 aa, artificial
  peptide fold or domain or sub-domain
MVTDINQPFKLKKQSQKLKCDSL

SEQ ID NO: 25168 - protein, 29 aa, artificial
  peptide fold or domain or sub-domain
MSIYLKNMIKMDFNRSQIGNKSFNILNLV

SEQ ID NO: 25169 - protein, 29 aa, artificial
  peptide fold or domain or sub-domain
MCHSKLEQREGGYIMKEFILNPNDAGLIV

SEQ ID NO: 25170 - protein, 27 aa, artificial
  peptide fold or domain or sub-domain
MNDDENHLARLDVKMKRKYAKEVCMNE

SEQ ID NO: 25171 - protein, 23 aa, artificial
  peptide fold or domain or sub-domain
MKQLKIEAKNLFTCQYIEERKKY

SEQ ID NO: 25172 - protein, 27 aa, artificial
  peptide fold or domain or sub-domain
MAFGYTSNNNFQSSYNIYQYFFQSSNK

SEQ ID NO: 25173 - protein, 28 aa, artificial
  peptide fold or domain or sub-domain
MKQHELTNLAFKQSNDFLNTKLFFYLIK

SEQ ID NO: 25174 - protein, 28 aa, artificial
  peptide fold or domain or sub-domain
MRELNKYNCKKNNCVAQQQLISGDTLKQ

SEQ ID NO: 25175 - protein, 29 aa, artificial
  peptide fold or domain or sub-domain
MITNLQEKSKNLAFTYQTNPFATHFKINR

SEQ ID NO: 25176 - protein, 30 aa, artificial
  peptide fold or domain or sub-domain
MSPFPPSLLLEPSLSYSTPEVWGGGGCENQ

SEQ ID NO: 25177 - protein, 29 aa, artificial
  peptide fold or domain or sub-domain
MRKVKKKVEVGSTFKYYKLIEICFHIDKH

SEQ ID NO: 25178 - protein, 26 aa, artificial
  peptide fold or domain or sub-domain
MKIEDDYINYQYSDLLFTQISLNKLQ

SEQ ID NO: 25179 - protein, 28 aa, artificial
  peptide fold or domain or sub-domain
MNIRNTCVYQQKDQLVDVTYKILFYIQL

SEQ ID NO: 25180 - protein, 28 aa, artificial
  peptide fold or domain or sub-domain
MRKCKVKQIRKQIIKQFTHRDSIEISRF

SEQ ID NO: 25181 - protein, 30 aa, artificial
  peptide fold or domain or sub-domain
MLCRQVGNCNMQNKNLVNLDLKNNKKEEGQ

SEQ ID NO: 25182 - protein, 25 aa, artificial
  peptide fold or domain or sub-domain
MNGWIEGWMDGCLQKNFFKIEGQLH

SEQ ID NO: 25183 - protein, 23 aa, artificial
  peptide fold or domain or sub-domain
MKENKSTTILQNIQTGEEFVICY

SEQ ID NO: 25184 - protein, 23 aa, artificial
  peptide fold or domain or sub-domain
MMNLKNTQMDLYYASKKYQNVHN

SEQ ID NO: 25185 - protein, 28 aa, artificial
  peptide fold or domain or sub-domain
MLKLKTFKAPLKINQPKSSLHYLCLIYE

SEQ ID NO: 25186 - protein, 28 aa, artificial
  peptide fold or domain or sub-domain
MRNSLMIQHNIDFFSLKYSIIPIKYQLR

SEQ ID NO: 25187 - protein, 27 aa, artificial
  peptide fold or domain or sub-domain
MNQQMIEILANLSYFICNKFNPSIDIC

SEQ ID NO: 25188 - protein, 20 aa, artificial
  peptide fold or domain or sub-domain
MSTFTVQNKTNYPQFARQPR

SEQ ID NO: 25189 - protein, 24 aa, artificial
  peptide fold or domain or sub-domain
MDGLFYKANVFLDLTQKETKEQSS

SEQ ID NO: 25190 - protein, 26 aa, artificial
  peptide fold or domain or sub-domain
MRKNSFTKFNQEQLCFFYCAQIIHKL

SEQ ID NO: 25191 - protein, 25 aa, artificial
  peptide fold or domain or sub-domain
MENFFTLRYKIKSEKFAQLFWCLVY

SEQ ID NO: 25192 - protein, 26 aa, artificial
  peptide fold or domain or sub-domain
MMMFQFWLNQNWMFQFVYSNQNQENI

SEQ ID NO: 25193 - protein, 27 aa, artificial
  peptide fold or domain or sub-domain
MQAQQKEKEKQIKLVQFTKAELKPDAS

SEQ ID NO: 25194 - protein, 30 aa, artificial
  peptide fold or domain or sub-domain
MQQIFNQLSTLQIAIIVNQTSKKCCAVDID

SEQ ID NO: 25195 - protein, 21 aa, artificial
  peptide fold or domain or sub-domain
MRNLNSNIIYQCHLQILLQKS

SEQ ID NO: 25196 - protein, 24 aa, artificial
  peptide fold or domain or sub-domain
MKDGCMIIQNKSDTFINRKQARSN

SEQ ID NO: 25197 - protein, 30 aa, artificial
  peptide fold or domain or sub-domain
MKKINRFEIFGKKLFQKLALEVNVAIKLQN

SEQ ID NO: 25198 - protein, 29 aa, artificial
  peptide fold or domain or sub-domain
MHAQNKLESLLTKISSTQYVQWIQQYTIA

SEQ ID NO: 25199 - protein, 23 aa, artificial
  peptide fold or domain or sub-domain
MKQFNSYKEKQMLLDWKQEGLIT

SEQ ID NO: 25200 - protein, 21 aa, artificial
  peptide fold or domain or sub-domain
MFEGKNHKVALQNWEDNPPNF

SEQ ID NO: 25201 - protein, 27 aa, artificial
  peptide fold or domain or sub-domain
MSSIALLAFILATTLCGVKLLFQNHCI

SEQ ID NO: 25202 - protein, 26 aa, artificial
  peptide fold or domain or sub-domain
MPIVDLETVNLCINLIAADQQIEARL

SEQ ID NO: 25203 - protein, 29 aa, artificial
  peptide fold or domain or sub-domain
MNNLSQECDEIAEKIKQCVQQAEMSQVQK

SEQ ID NO: 25204 - protein, 26 aa, artificial
  peptide fold or domain or sub-domain
MQHGCQYSVIISEQIRFLIWAVLFFF

SEQ ID NO: 25205 - protein, 25 aa, artificial
  peptide fold or domain or sub-domain
MNVRMNDQCQISKEQSCSKQKNHTK

SEQ ID NO: 25206 - protein, 27 aa, artificial
  peptide fold or domain or sub-domain
MNFSNEQNRKIDQIQRNEYSFISFQII

SEQ ID NO: 25207 - protein, 27 aa, artificial
  peptide fold or domain or sub-domain
MCSKNQLDNFQDESYDMDQIETQLNLQ

SEQ ID NO: 25208 - protein, 28 aa, artificial
  peptide fold or domain or sub-domain
MMFNISKPTTQVQKNFNFEADRWTIPSL

SEQ ID NO: 25209 - protein, 23 aa, artificial
  peptide fold or domain or sub-domain
MYQFANLLEEQNCQICLVNLALN

SEQ ID NO: 25210 - protein, 28 aa, artificial
  peptide fold or domain or sub-domain
MVLDALNGKSANMNSLLQSLFLSITKVD

SEQ ID NO: 25211 - protein, 29 aa, artificial
  peptide fold or domain or sub-domain
MHINSCLLKVYVLTQLIQLQRAVLLFYGI

SEQ ID NO: 25212 - protein, 29 aa, artificial
  peptide fold or domain or sub-domain
MQEILHSRKLVVQDLFTQPSCVKMKNKEN

SEQ ID NO: 25213 - protein, 23 aa, artificial
  peptide fold or domain or sub-domain
MNDILTPKKQKPKTRQSNQKLQE

SEQ ID NO: 25214 - protein, 29 aa, artificial
  peptide fold or domain or sub-domain
MILNIYSPFYSVEKEEKCQIQQINEFFIQ

SEQ ID NO: 25215 - protein, 22 aa, artificial
  peptide fold or domain or sub-domain
MGKERLFFDRPSQKITLQQYIY

SEQ ID NO: 25216 - protein, 22 aa, artificial
  peptide fold or domain or sub-domain
MTKQTSLEEKHPSNEFIHQKRT

SEQ ID NO: 25217 - protein, 30 aa, artificial
  peptide fold or domain or sub-domain
MCQNSTISAQNKSFQLHSHLKQICYYLLGR

SEQ ID NO: 25218 - protein, 23 aa, artificial
  peptide fold or domain or sub-domain
MRVKYIFHDISKLKINKLNKQHL

SEQ ID NO: 25219 - protein, 22 aa, artificial
  peptide fold or domain or sub-domain
MFKFIETKEQNEEKDDIGNIVI

SEQ ID NO: 25220 - protein, 27 aa, artificial
  peptide fold or domain or sub-domain
MHNFENTTKINSLKYILQPKSVQFNQF

SEQ ID NO: 25221 - protein, 21 aa, artificial
  peptide fold or domain or sub-domain
MKTFQHSFHEIEEDCKLFPLF

SEQ ID NO: 25222 - protein, 29 aa, artificial
  peptide fold or domain or sub-domain
MYKTHGKRFVVNPTEPRVKPSLDESIPIV

SEQ ID NO: 25223 - protein, 27 aa, artificial
  peptide fold or domain or sub-domain
MEKCKNRVPADEQQQYEYCKMQGQGPT

SEQ ID NO: 25224 - protein, 22 aa, artificial
  peptide fold or domain or sub-domain
MVNIVEAYYFEFKEEKQNWSKN

SEQ ID NO: 25225 - protein, 25 aa, artificial
  peptide fold or domain or sub-domain
MQRQVSRLAYTQTKFAFSYFVWKFT

SEQ ID NO: 25226 - protein, 22 aa, artificial
  peptide fold or domain or sub-domain
MYNINKCIVFYYCIIDANCKHT

SEQ ID NO: 25227 - protein, 21 aa, artificial
  peptide fold or domain or sub-domain
MGNQCCQGNSPGEGVLVYFSF

SEQ ID NO: 25228 - protein, 25 aa, artificial
  peptide fold or domain or sub-domain
MDCIKQSGYFNISLNKFVNYKTGQL

SEQ ID NO: 25229 - protein, 26 aa, artificial
  peptide fold or domain or sub-domain
MSFTLIQASKLANKHAKQQCKIENNK

SEQ ID NO: 25230 - protein, 27 aa, artificial
  peptide fold or domain or sub-domain
MKQGNGRSSIQFKNFLNFRVDDKLKEI

SEQ ID NO: 25231 - protein, 13 aa, artificial
  peptide fold or domain or sub-domain
MCQSSQLDIRYAA

SEQ ID NO: 25232 - protein, 29 aa, artificial
  peptide fold or domain or sub-domain
MKPYIELLDFEIQEMLIEYVKDNEDMDED

SEQ ID NO: 25233 - protein, 29 aa, artificial
  peptide fold or domain or sub-domain
MNQQKTQAKIETNSQDEWQELEEFDEIYF

SEQ ID NO: 25234 - protein, 25 aa, artificial
  peptide fold or domain or sub-domain
MKKEKAVNLRSQKCSQLEHYLKKYD

SEQ ID NO: 25235 - protein, 24 aa, artificial
  peptide fold or domain or sub-domain
MQLELIRVQFFLYIKCTLTSKKNT

SEQ ID NO: 25236 - protein, 29 aa, artificial
  peptide fold or domain or sub-domain
MTNYYLQCLFICVQSKKYQQKQIKRGENN

SEQ ID NO: 25237 - protein, 23 aa, artificial
  peptide fold or domain or sub-domain
MTKQEYTLFPQQKQFQYLLSYCK

SEQ ID NO: 25238 - protein, 25 aa, artificial
  peptide fold or domain or sub-domain
MNTNKKVVQKCSTASGNRFDWQSER

SEQ ID NO: 25239 - protein, 24 aa, artificial
  peptide fold or domain or sub-domain
MKNLSNNIRINRQSVYAVISQIMC

SEQ ID NO: 25240 - protein, 19 aa, artificial
  peptide fold or domain or sub-domain
MDSSNFQEIQQHEFIYFFQ

SEQ ID NO: 25241 - protein, 24 aa, artificial
  peptide fold or domain or sub-domain
MEKCGKRVVNAKQRPYSSMATTPT

SEQ ID NO: 25242 - protein, 29 aa, artificial
  peptide fold or domain or sub-domain
MKYQIKIKTREEKEQNPFESTIINFKIYN

SEQ ID NO: 25243 - protein, 30 aa, artificial
  peptide fold or domain or sub-domain
MNEIIMISKFFKVFQRAWTAKFLIRLSQII

SEQ ID NO: 25244 - protein, 21 aa, artificial
  peptide fold or domain or sub-domain
MKKSEEINIEEDLIDTQHLLM

SEQ ID NO: 25245 - protein, 30 aa, artificial
  peptide fold or domain or sub-domain
MNKFENNFSIQNFLKRKIGIIYGKKGKVIF

SEQ ID NO: 25246 - protein, 25 aa, artificial
  peptide fold or domain or sub-domain
MYFQFTNKYIGKFIDIDKSERKNSD

SEQ ID NO: 25247 - protein, 27 aa, artificial
  peptide fold or domain or sub-domain
MKNKRLSLNDIYNVRSSQKTKKRRTRP

SEQ ID NO: 25248 - protein, 28 aa, artificial
  peptide fold or domain or sub-domain
MQRINQLQYLTIERGHIFELYKIERQIE

SEQ ID NO: 25249 - protein, 22 aa, artificial
  peptide fold or domain or sub-domain
MFGHLRERILHVKLYGLIDQAL

SEQ ID NO: 25250 - protein, 22 aa, artificial
  peptide fold or domain or sub-domain
MDKSNKADQPLKCSFRISHITD

SEQ ID NO: 25251 - protein, 28 aa, artificial
  peptide fold or domain or sub-domain
MVIDNKNFYKDGLAYDIFNIHKVYPIIY

SEQ ID NO: 25252 - protein, 28 aa, artificial
  peptide fold or domain or sub-domain
MNGTCSSKSDEIQQIELSPILSSQKYEK

SEQ ID NO: 25253 - protein, 26 aa, artificial
  peptide fold or domain or sub-domain
MDEIIQSILDENDLVVKQIPEVRYFY

SEQ ID NO: 25254 - protein, 24 aa, artificial
  peptide fold or domain or sub-domain
MNELFSLFFEIQSIIKRFFQNQKK

SEQ ID NO: 25255 - protein, 26 aa, artificial
  peptide fold or domain or sub-domain
MFNQAELNDKDQTIQRIDRKIDGIHA

SEQ ID NO: 25256 - protein, 29 aa, artificial
  peptide fold or domain or sub-domain
MCVFFINYKHYKVQFQENPFFISQIVNKL

SEQ ID NO: 25257 - protein, 28 aa, artificial
  peptide fold or domain or sub-domain
MIELNIRFYNFKQPAQYLNYKLSQSLNC

SEQ ID NO: 25258 - protein, 25 aa, artificial
  peptide fold or domain or sub-domain
MKNYKEYPQHLEEKYPYAKAFIYQS

SEQ ID NO: 25259 - protein, 25 aa, artificial
  peptide fold or domain or sub-domain
MIPHIFYKPYYFMLKNMKCMYLQKM

SEQ ID NO: 25260 - protein, 28 aa, artificial
  peptide fold or domain or sub-domain
MYRSIEWYGMPLFISEYRPSLNFIKKFI

SEQ ID NO: 25261 - protein, 28 aa, artificial
  peptide fold or domain or sub-domain
MNKQKVFVIVFALRGRYFLQTEMINSER

SEQ ID NO: 25262 - protein, 23 aa, artificial
  peptide fold or domain or sub-domain
MKVIPTLLTHANQVNASCNPKIN

SEQ ID NO: 25263 - protein, 28 aa, artificial
  peptide fold or domain or sub-domain
MIQIILICLKTKKENNFKKNIFKEISPN

SEQ ID NO: 25264 - protein, 23 aa, artificial
  peptide fold or domain or sub-domain
MKQKHISTLFNFAQNILMHSQNI

SEQ ID NO: 25265 - protein, 25 aa, artificial
  peptide fold or domain or sub-domain
MRKVFASFNQAMQKHKLSPVIEQEN

SEQ ID NO: 25266 - protein, 30 aa, artificial
  peptide fold or domain or sub-domain
MDTILLSFQSTIANRRANKRIPRLQPSLFL

SEQ ID NO: 25267 - protein, 28 aa, artificial
  peptide fold or domain or sub-domain
MELIQILAREITVSINLSSKQQKVKKFL

SEQ ID NO: 25268 - protein, 26 aa, artificial
  peptide fold or domain or sub-domain
MRLICFKISKEDQVYLFWSPFTNYLV

SEQ ID NO: 25269 - protein, 17 aa, artificial
  peptide fold or domain or sub-domain
MAMYAQITVLGISRLIK

SEQ ID NO: 25270 - protein, 20 aa, artificial
  peptide fold or domain or sub-domain
MDCPLENSLKCQKIERSKLV

SEQ ID NO: 25271 - protein, 25 aa, artificial
  peptide fold or domain or sub-domain
MIYLKYFIYFTITNNLIVFDYSKIQ

SEQ ID NO: 25272 - protein, 27 aa, artificial
  peptide fold or domain or sub-domain
MRLNGRVQKLYYKQNRCFNIKLKSLLT

SEQ ID NO: 25273 - protein, 29 aa, artificial
  peptide fold or domain or sub-domain
MKKVKIFAQAFGNLNQCFFNSFQNKRKSE

SEQ ID NO: 25274 - protein, 25 aa, artificial
  peptide fold or domain or sub-domain
MSFKVESLAQSYKAETITVRHSFEI

SEQ ID NO: 25275 - protein, 25 aa, artificial
  peptide fold or domain or sub-domain
MFKTNQNEIKIKRNQPQIIKREAQS

SEQ ID NO: 25276 - protein, 23 aa, artificial
  peptide fold or domain or sub-domain
MTSFKLDSLFNLAKDGIMDEASF

SEQ ID NO: 25277 - protein, 29 aa, artificial
  peptide fold or domain or sub-domain
MYGCKNLYQLLEKFTFSQLVKKEVKKVRN

SEQ ID NO: 25278 - protein, 23 aa, artificial
  peptide fold or domain or sub-domain
MNSPFFFQQKFAKNKRIEISYNE

SEQ ID NO: 25279 - protein, 25 aa, artificial
  peptide fold or domain or sub-domain
MRLSKIYPALKTVSEIQDGISLAKI

SEQ ID NO: 25280 - protein, 25 aa, artificial
  peptide fold or domain or sub-domain
MCIATFKYLPLTYSGNKISFTIPKK

SEQ ID NO: 25281 - protein, 28 aa, artificial
  peptide fold or domain or sub-domain
MKNPFLQLALCKLLIEFTDQKYKNLIGR

SEQ ID NO: 25282 - protein, 23 aa, artificial
  peptide fold or domain or sub-domain
MENLMRLELRFSYINNPPPLINF

SEQ ID NO: 25283 - protein, 22 aa, artificial
  peptide fold or domain or sub-domain
MQLISFENDELTKQKQLTKKTN

SEQ ID NO: 25284 - protein, 24 aa, artificial
  peptide fold or domain or sub-domain
MSPKEIQNREDNYYSTEDKLICNV

SEQ ID NO: 25285 - protein, 29 aa, artificial
  peptide fold or domain or sub-domain
MSDQLQQKKLNNCNQQSKNQLGGKNEEKI

SEQ ID NO: 25286 - protein, 30 aa, artificial
  peptide fold or domain or sub-domain
MQNVQLKLEYSTKSFTQIEMTFYSISKISY

SEQ ID NO: 25287 - protein, 24 aa, artificial
  peptide fold or domain or sub-domain
MPTSNNQIYLLYKKLYLDIPNIKI

SEQ ID NO: 25288 - protein, 23 aa, artificial
  peptide fold or domain or sub-domain
MQRSGIIYLNEQNEWKMENGNGK

SEQ ID NO: 25289 - protein, 25 aa, artificial
  peptide fold or domain or sub-domain
MPVKFAFIASGFCISLSSMPTYIID

SEQ ID NO: 25290 - protein, 29 aa, artificial
  peptide fold or domain or sub-domain
MVNMLMKELLTKRKRERKNECVKDQMKDR

SEQ ID NO: 25291 - protein, 25 aa, artificial
  peptide fold or domain or sub-domain
MGKIKKEIKKGNIYFSHYPFFFPLS

SEQ ID NO: 25292 - protein, 29 aa, artificial
  peptide fold or domain or sub-domain
MYTNIKDRTVRQIDRSQNEINQKFEKQKQ

SEQ ID NO: 25293 - protein, 25 aa, artificial
  peptide fold or domain or sub-domain
MNIGDIHLALKTLHIQKLKLSIEIY

SEQ ID NO: 25294 - protein, 19 aa, artificial
  peptide fold or domain or sub-domain
MNAGMHVCMLYMNEKKKHF

SEQ ID NO: 25295 - protein, 21 aa, artificial
  peptide fold or domain or sub-domain
MFSIRQQQLVLYTSFSSKMEI

SEQ ID NO: 25296 - protein, 26 aa, artificial
  peptide fold or domain or sub-domain
MGREKAKNKKQKSKEEVAIFSYSNQS

SEQ ID NO: 25297 - protein, 23 aa, artificial
  peptide fold or domain or sub-domain
MVNKTYKKQINFMWGGGGGYVNL

SEQ ID NO: 25298 - protein, 29 aa, artificial
  peptide fold or domain or sub-domain
MNLVSEIINNIRMRRLDKEGESEYIEQEE

SEQ ID NO: 25299 - protein, 30 aa, artificial
  peptide fold or domain or sub-domain
EFSVRSSRTFQSLRRYIYNISFFFILELHM

SEQ ID NO: 25300 - protein, 27 aa, artificial
  peptide fold or domain or sub-domain
LNEVQTRFEVAISEMPNKIDCNEYINQ

SEQ ID NO: 25301 - protein, 11 aa, artificial
  peptide fold or domain or sub-domain
KSEFMKVYRNI

SEQ ID NO: 25302 - protein, 15 aa, artificial
  peptide fold or domain or sub-domain
DQPGQHSETLVSTKK

SEQ ID NO: 25303 - protein, 30 aa, artificial
  peptide fold or domain or sub-domain
DMYEVATTRIGTGGLAGRCQHHPRNCPGFN

SEQ ID NO: 25304 - protein, 29 aa, artificial
  peptide fold or domain or sub-domain
MKPHLCDQPMNLTRRACCQLVLFLNDTER

SEQ ID NO: 25305 - protein, 14 aa, artificial
  peptide fold or domain or sub-domain
MFQFSFDIVDVYRK

SEQ ID NO: 25306 - protein, 19 aa, artificial
  peptide fold or domain or sub-domain
MNTWLMALQNSNSPIYDMM

SEQ ID NO: 25307 - protein, 26 aa, artificial
  peptide fold or domain or sub-domain
KLALILVAALAVASRPPHPWQVPGSG

SEQ ID NO: 25308 - protein, 22 aa, artificial
  peptide fold or domain or sub-domain
GVLQPFSDGIKLFSKEVSLPLT

SEQ ID NO: 25309 - protein, 26 aa, artificial
  peptide fold or domain or sub-domain
FVQRLMSDPVVFDFLARMCDRPDQLK

SEQ ID NO: 25310 - protein, 25 aa, artificial
  peptide fold or domain or sub-domain
MPLIVSLSIILHAKLTYTFEDAQLD

SEQ ID NO: 25311 - protein, 14 aa, artificial
  peptide fold or domain or sub-domain
MNNFFEYISVLHCS

SEQ ID NO: 25312 - protein, 25 aa, artificial
  peptide fold or domain or sub-domain
MLACQFEIDKFECLPPTLAIFIFPS

SEQ ID NO: 25313 - protein, 30 aa, artificial
  peptide fold or domain or sub-domain
MTETFAFPGGDQSVDVADLHHFQFEPRRPS

SEQ ID NO: 25314 - protein, 25 aa, artificial
  peptide fold or domain or sub-domain
HFNRYLCRPRRIELASLLSLSERQI

SEQ ID NO: 25315 - protein, 26 aa, artificial
  peptide fold or domain or sub-domain
MARFLKKLLTNKTDEEGDSFTSAHVS

SEQ ID NO: 25316 - protein, 27 aa, artificial
  peptide fold or domain or sub-domain
MMEHGDKALTDMQENNNLKLEKDTRTQ

SEQ ID NO: 25317 - protein, 28 aa, artificial
  peptide fold or domain or sub-domain
MELVRFDGVEWISCHFVISKLVFSQPWM

SEQ ID NO: 25318 - protein, 24 aa, artificial
  peptide fold or domain or sub-domain
MDKASVFGTEDCGFESRRRCMQQI

SEQ ID NO: 25319 - protein, 25 aa, artificial
  peptide fold or domain or sub-domain
MSGNSDSTPDVTNIHDDSTNTKKQE

SEQ ID NO: 25320 - protein, 24 aa, artificial
  peptide fold or domain or sub-domain
MQRDEIHTPCLAFAKGGSHEYVDF

SEQ ID NO: 25321 - protein, 30 aa, artificial
  peptide fold or domain or sub-domain
MLNSINYFKFSGSLEKNFGGIQCYCANVTE

SEQ ID NO: 25322 - protein, 27 aa, artificial
  peptide fold or domain or sub-domain
MKKFPSKHVVDHYYHNTKYAITIKLMC

SEQ ID NO: 25323 - protein, 16 aa, artificial
  peptide fold or domain or sub-domain
LTAHQRKVGADIGEIA

SEQ ID NO: 25324 - protein, 30 aa, artificial
  peptide fold or domain or sub-domain
MFCLTKILDIGFKKRLNEFLAQINAEAKRV

SEQ ID NO: 25325 - protein, 30 aa, artificial
  peptide fold or domain or sub-domain
MCTIFRRIRANIYLKSPMQQLHCHQELIDY

SEQ ID NO: 25326 - protein, 27 aa, artificial
  peptide fold or domain or sub-domain
MIFLFFKKVAQIEKNFYVYIVGDIFQN

SEQ ID NO: 25327 - protein, 26 aa, artificial
  peptide fold or domain or sub-domain
KRKIFLSNENKKCDDQKKIPEINILV

SEQ ID NO: 25328 - protein, 25 aa, artificial
  peptide fold or domain or sub-domain
IIFFQMKNVKNMKIRMDLLVKKIQM

SEQ ID NO: 25329 - protein, 29 aa, artificial
  peptide fold or domain or sub-domain
VYSMYVFPHIPFFRHTHKHIRSVPVCSKV

SEQ ID NO: 25330 - protein, 27 aa, artificial
  peptide fold or domain or sub-domain
MLVFLKYLCFFIFNKICCLFYKYYKNH

SEQ ID NO: 25331 - protein, 29 aa, artificial
  peptide fold or domain or sub-domain
MPLTINTRRFCIIKKRNNKTIFYREKKML

SEQ ID NO: 25332 - protein, 30 aa, artificial
  peptide fold or domain or sub-domain
MKCSILVLFCKHISILSYFLIFILYNISIV

SEQ ID NO: 25333 - protein, 28 aa, artificial
  peptide fold or domain or sub-domain
MLTFFIRKYSITKDKKYLYDQRSLCNLM

SEQ ID NO: 25334 - protein, 27 aa, artificial
  peptide fold or domain or sub-domain
MYFFFFLRTWIFLAFLEKTNKTRHIQN

SEQ ID NO: 25335 - protein, 27 aa, artificial
  peptide fold or domain or sub-domain
MTKVNNFFHKQVTLLMWQPKTILHLHA

SEQ ID NO: 25336 - protein, 28 aa, artificial
  peptide fold or domain or sub-domain
SVNPFFFKSGKPEEKIIKYKINNKCYII

SEQ ID NO: 25337 - protein, 29 aa, artificial
  peptide fold or domain or sub-domain
MFIDRLFKIRMTLCIYQKCLMALPLFANT

SEQ ID NO: 25338 - protein, 28 aa, artificial
  peptide fold or domain or sub-domain
MQLFSISIQYNWGYAVLYSKKLDRWRKG

SEQ ID NO: 25339 - protein, 26 aa, artificial
  peptide fold or domain or sub-domain
MISDTPDALIEIQTGYAYEYVTENIN

SEQ ID NO: 25340 - protein, 29 aa, artificial
  peptide fold or domain or sub-domain
IKNYEQDYKEIMQHALYLLLLEKGILCAN

SEQ ID NO: 25341 - protein, 26 aa, artificial
  peptide fold or domain or sub-domain
MKSNIHLLYEIGVMCLWVYILNRVSI

SEQ ID NO: 25342 - protein, 24 aa, artificial
  peptide fold or domain or sub-domain
RKQQKEIFYNKNKISFNNLFFQNP

SEQ ID NO: 25343 - protein, 22 aa, artificial
  peptide fold or domain or sub-domain
YTFEIVCLYLNLVLCTFIIFIH

SEQ ID NO: 25344 - protein, 29 aa, artificial
  peptide fold or domain or sub-domain
MFPLIDFFFVFLNLMSTHKYNFVHISVCF

SEQ ID NO: 25345 - protein, 28 aa, artificial
  peptide fold or domain or sub-domain
KNRIIYQNFGNEYLNYIFFFFSQIHNSI

SEQ ID NO: 25346 - protein, 26 aa, artificial
  peptide fold or domain or sub-domain
MFINSNIYMTLMCAYLFTCVPLKLHR

SEQ ID NO: 25347 - protein, 28 aa, artificial
  peptide fold or domain or sub-domain
MLEIETEKFLFSFIYINGFSNLYYCTYI

SEQ ID NO: 25348 - protein, 24 aa, artificial
  peptide fold or domain or sub-domain
IFNKYTHLYNNLGTNKNRVCKKFL

SEQ ID NO: 25349 - protein, 30 aa, artificial
  peptide fold or domain or sub-domain
RNVVKTINSKYLKLYWEYAHTVSFRGYHKN

SEQ ID NO: 25350 - protein, 27 aa, artificial
  peptide fold or domain or sub-domain
MRSHTIFIMTTTPCCNLIILLIFYSTI

SEQ ID NO: 25351 - protein, 23 aa, artificial
  peptide fold or domain or sub-domain
IILPSSPKKNAHYITHMNSSYFF

SEQ ID NO: 25352 - protein, 27 aa, artificial
  peptide fold or domain or sub-domain
MVYTINDNKKITRTNNKENKQLKKYIY

SEQ ID NO: 25353 - protein, 23 aa, artificial
  peptide fold or domain or sub-domain
MYTSVCIYIVQACEENKKIIKHI

SEQ ID NO: 25354 - protein, 25 aa, artificial
  peptide fold or domain or sub-domain
MHKFKYFFEYVRLVVELHKKTSQKN

SEQ ID NO: 25355 - protein, 30 aa, artificial
  peptide fold or domain or sub-domain
GEPNIHLASCTHTHINIGTHAWVNKIHYKQ

SEQ ID NO: 25356 - protein, 28 aa, artificial
  peptide fold or domain or sub-domain
PLDYNRYITYKLLAVLAFGVALKLIYEK

SEQ ID NO: 25357 - protein, 22 aa, artificial
  peptide fold or domain or sub-domain
MHVHKFIICSSPCTFLSRGVTI

SEQ ID NO: 25358 - protein, 29 aa, artificial
  peptide fold or domain or sub-domain
HIYITNNSNVIFAKPWGEKNKNAFLRKRC

SEQ ID NO: 25359 - protein, 28 aa, artificial
  peptide fold or domain or sub-domain
ASKKHFLNPPVLKHGPRSLTNVQAYICF

SEQ ID NO: 25360 - protein, 29 aa, artificial
  peptide fold or domain or sub-domain
YEKIRSVFHIKKVCLYLSATDSILFCCCI

SEQ ID NO: 25361 - protein, 28 aa, artificial
  peptide fold or domain or sub-domain
SDFVWKLYFASKTKNVLNNSKLKIIMTK

SEQ ID NO: 25362 - protein, 26 aa, artificial
  peptide fold or domain or sub-domain
MCIHTTGTSLYFTIMCIKNIYVQHQN

SEQ ID NO: 25363 - protein, 29 aa, artificial
  peptide fold or domain or sub-domain
PRLILIISQVHNLHAYMCIFFNNSRGSCL

SEQ ID NO: 25364 - protein, 30 aa, artificial
  peptide fold or domain or sub-domain
MYVLVCKRGIYNRHRFASMILSKSFLFLYV

SEQ ID NO: 25365 - protein, 30 aa, artificial
  peptide fold or domain or sub-domain
VEVAFVEPMYVSGLCIMGYRFVLWNIPFWL

SEQ ID NO: 25366 - protein, 29 aa, artificial
  peptide fold or domain or sub-domain
RCARGTCASMRFYVRAGLMWNKLYFDHSI

SEQ ID NO: 25367 - protein, 27 aa, artificial
  peptide fold or domain or sub-domain
AYNENMIYYFIFCIILLSSFNKNKYNV

SEQ ID NO: 25368 - protein, 28 aa, artificial
  peptide fold or domain or sub-domain
LVILFTNSEHIMKNGQFLIPHIFEFHSI

SEQ ID NO: 25369 - protein, 27 aa, artificial
  peptide fold or domain or sub-domain
CVVQLYYYKSKNVLLFCNINNSFLYHK

SEQ ID NO: 25370 - protein, 29 aa, artificial
  peptide fold or domain or sub-domain
CQISHNIMFVWKRFSTYEIAKRIYVKNFF

SEQ ID NO: 25371 - protein, 25 aa, artificial
  peptide fold or domain or sub-domain
CTTYFNTLFILYLSVFLFLKTILTY

SEQ ID NO: 25372 - protein, 27 aa, artificial
  peptide fold or domain or sub-domain
CIKYKNEKIIVFVIGVLKSYYNVEIYS

SEQ ID NO: 25373 - protein, 26 aa, artificial
  peptide fold or domain or sub-domain
VFNIEFNKKIIKIHILYAYVYVVNVW

SEQ ID NO: 25374 - protein, 29 aa, artificial
  peptide fold or domain or sub-domain
EEREKKIDKITHVYMCIYLLCTSLKYVHL

SEQ ID NO: 25375 - protein, 26 aa, artificial
  peptide fold or domain or sub-domain
CFHCLYDIKNIYLYFYMNIYCVLIMS

SEQ ID NO: 25376 - protein, 23 aa, artificial
  peptide fold or domain or sub-domain
ESRWLKTQTGLSIFLCILKIVKN

SEQ ID NO: 25377 - protein, 25 aa, artificial
  peptide fold or domain or sub-domain
VKNCECINVLSDFKRAKRNSPYTLD

SEQ ID NO: 25378 - protein, 24 aa, artificial
  peptide fold or domain or sub-domain
GKNEIAYNQRNCYLMFLYQKGYCK

SEQ ID NO: 25379 - protein, 24 aa, artificial
  peptide fold or domain or sub-domain
MITVRKTEYFLCNKQKSRIFFICK

SEQ ID NO: 25380 - protein, 21 aa, artificial
  peptide fold or domain or sub-domain
MFINKMISYVEVIYKFVFVVM

SEQ ID NO: 25381 - protein, 27 aa, artificial
  peptide fold or domain or sub-domain
MILFVENVMKNNYFFEHDECKFAKHMI

SEQ ID NO: 25382 - protein, 26 aa, artificial
  peptide fold or domain or sub-domain
TLFLHNKWLYIYIFCIMCRYRKLEQN

SEQ ID NO: 25383 - protein, 27 aa, artificial
  peptide fold or domain or sub-domain
MNEIFTNLYTTWNFTIYFVLKNLFNGL

SEQ ID NO: 25384 - protein, 28 aa, artificial
  peptide fold or domain or sub-domain
MEILFHAHKYVTTYGNKHSLVVKKYSKN

SEQ ID NO: 25385 - protein, 25 aa, artificial
  peptide fold or domain or sub-domain
PFLYASTHAICEYVILSLPLFWLSI

SEQ ID NO: 25386 - protein, 29 aa, artificial
  peptide fold or domain or sub-domain
FMFILGINKQYYIYVKKKYIYINQLVYIV

SEQ ID NO: 25387 - protein, 25 aa, artificial
  peptide fold or domain or sub-domain
CPCAHAKPKNWGQSYLEETRHTTPY

SEQ ID NO: 25388 - protein, 28 aa, artificial
  peptide fold or domain or sub-domain
CHALESHSIWKLLTILNGGERRFTVNYK

SEQ ID NO: 25389 - protein, 20 aa, artificial
  peptide fold or domain or sub-domain
LPIYKCLRKNKIVTSFGIHI

SEQ ID NO: 25390 - protein, 23 aa, artificial
  peptide fold or domain or sub-domain
MNLYVLPILFPSQYVDNIKKFKL

SEQ ID NO: 25391 - protein, 30 aa, artificial
  peptide fold or domain or sub-domain
CLFHKFHFLDFYYIIGILIYLCLDYSFLAC

SEQ ID NO: 25392 - protein, 25 aa, artificial
  peptide fold or domain or sub-domain
MLMKVMKKSDNKRYFFYFDVITNIF

SEQ ID NO: 25393 - protein, 28 aa, artificial
  peptide fold or domain or sub-domain
MLIKLANNDILRIYFYVVVSKKNIKFLF

SEQ ID NO: 25394 - protein, 28 aa, artificial
  peptide fold or domain or sub-domain
LHFYKKKTNYLRYKHIYTTLVFLLWLDI

SEQ ID NO: 25395 - protein, 23 aa, artificial
  peptide fold or domain or sub-domain
MCAHGHEHPYIHFMSVRFFSLQR

SEQ ID NO: 25396 - protein, 23 aa, artificial
  peptide fold or domain or sub-domain
TRISKLKQEHQLIILLNICSNSF

SEQ ID NO: 25397 - protein, 25 aa, artificial
  peptide fold or domain or sub-domain
GFIEDINECIFLFLISVFIYVQKKL

SEQ ID NO: 25398 - protein, 29 aa, artificial
  peptide fold or domain or sub-domain
CIMYKYEISMKCSGVFGMEKNSNKIYMLL

SEQ ID NO: 25399 - protein, 19 aa, artificial
  peptide fold or domain or sub-domain
NSRNTRIILYNSGIQKGDK

SEQ ID NO: 25400 - protein, 25 aa, artificial
  peptide fold or domain or sub-domain
KNARISILNIHIFVFELAVYRFKKL

SEQ ID NO: 25401 - protein, 29 aa, artificial
  peptide fold or domain or sub-domain
MRHYVLASIYELYHSLFSIFLPMPIHCWN

SEQ ID NO: 25402 - protein, 28 aa, artificial
  peptide fold or domain or sub-domain
MRCKIIWVSTIAFEILYLNFPKIFLKYL

SEQ ID NO: 25403 - protein, 24 aa, artificial
  peptide fold or domain or sub-domain
DAHFFYINTSYKPPFNNKTKYIYN

SEQ ID NO: 25404 - protein, 25 aa, artificial
  peptide fold or domain or sub-domain
GFIIRIETQYTHTHTPKNLYTDKAM

SEQ ID NO: 25405 - protein, 15 aa, artificial
  peptide fold or domain or sub-domain
VISLKLTNKFLIVKN

SEQ ID NO: 25406 - protein, 28 aa, artificial
  peptide fold or domain or sub-domain
MGTKIGIYFCDTCGFMTFFTQIYTCLTW

SEQ ID NO: 25407 - protein, 22 aa, artificial
  peptide fold or domain or sub-domain
MNTNNIILMHAMTNCRHVKTIC

SEQ ID NO: 25408 - protein, 23 aa, artificial
  peptide fold or domain or sub-domain
YHLEHMNAKFPHMKIYSIFFYKN

SEQ ID NO: 25409 - protein, 30 aa, artificial
  peptide fold or domain or sub-domain
CSAIISKSLILFGTIFIVKIAFFIVKGVSD

SEQ ID NO: 25410 - protein, 29 aa, artificial
  peptide fold or domain or sub-domain
MHFLFFTIINIMKCVFDRYYIIALFFFLN

SEQ ID NO: 25411 - protein, 21 aa, artificial
  peptide fold or domain or sub-domain
LHVYYNNITNRKQIIRNKKNV

SEQ ID NO: 25412 - protein, 29 aa, artificial
  peptide fold or domain or sub-domain
SKFYFLRTYQKSQQIEIYMCAYLLLHPLI

SEQ ID NO: 25413 - protein, 27 aa, artificial
  peptide fold or domain or sub-domain
ERIHPYQKRGRSKCRSICKRAKGKPID

SEQ ID NO: 25414 - protein, 27 aa, artificial
  peptide fold or domain or sub-domain
INMHNIVFQIMCALSCAHHLYSFLLFL

SEQ ID NO: 25415 - protein, 21 aa, artificial
  peptide fold or domain or sub-domain
EMMYFLKETCECLCVHKVERN

SEQ ID NO: 25416 - protein, 30 aa, artificial
  peptide fold or domain or sub-domain
MIINIIIKNVSLFFFNKFKFLSQYKRHYIL

SEQ ID NO: 25417 - protein, 28 aa, artificial
  peptide fold or domain or sub-domain
MKKRKCNNRSFFIIAVNNNTLLILFINT

SEQ ID NO: 25418 - protein, 29 aa, artificial
  peptide fold or domain or sub-domain
FLFCSYARTISVEKGLEIFCEKIFITNIG

SEQ ID NO: 25419 - protein, 20 aa, artificial
  peptide fold or domain or sub-domain
VVTHLARHSIKIIMMKKILE

SEQ ID NO: 25420 - protein, 26 aa, artificial
  peptide fold or domain or sub-domain
MIFIYFQANTNLCYHIKKQNENEQTY

SEQ ID NO: 25421 - protein, 25 aa, artificial
  peptide fold or domain or sub-domain
YFFLKDVDYPWVNKFKNKNAYLKKL

SEQ ID NO: 25422 - protein, 28 aa, artificial
  peptide fold or domain or sub-domain
ASLSLYGIALSFINKKNKLINDIGSTCI

SEQ ID NO: 25423 - protein, 22 aa, artificial
  peptide fold or domain or sub-domain
FSCIYYNSLYMRACNNIKGYFL

SEQ ID NO: 25424 - protein, 21 aa, artificial
  peptide fold or domain or sub-domain
NCRFHLQNKADFWIFNNIILI

SEQ ID NO: 25425 - protein, 28 aa, artificial
  peptide fold or domain or sub-domain
KQPEQDIIFFPFLAYSQFKYVNLFSEIA

SEQ ID NO: 25426 - protein, 23 aa, artificial
  peptide fold or domain or sub-domain
IIVIINKWSKEELFKMPKMQTNM

SEQ ID NO: 25427 - protein, 27 aa, artificial
  peptide fold or domain or sub-domain
EIKFEYITYIFHFVQQYRLHFSELSIL

SEQ ID NO: 25428 - protein, 24 aa, artificial
  peptide fold or domain or sub-domain
VWRISGIYHFFLQNQNLLTLFFSY

SEQ ID NO: 25429 - protein, 22 aa, artificial
  peptide fold or domain or sub-domain
MPSTNWGGDSFLLFILTFPCGQ

SEQ ID NO: 25430 - protein, 30 aa, artificial
  peptide fold or domain or sub-domain
LNFMSIVFFLCILKEKNIYKGMHKYVGISI

SEQ ID NO: 25431 - protein, 29 aa, artificial
  peptide fold or domain or sub-domain
YFLSIIYITTKLCSVAILKNSQNYEILQL

SEQ ID NO: 25432 - protein, 21 aa, artificial
  peptide fold or domain or sub-domain
YRIIIYKQIEFHFKKYIKKNQ

SEQ ID NO: 25433 - protein, 29 aa, artificial
  peptide fold or domain or sub-domain
KLKSMFPIYYMYKYIIYFFNIFPIKNVAA

SEQ ID NO: 25434 - protein, 29 aa, artificial
  peptide fold or domain or sub-domain
MLSKFNKKETLKNTHMQIKLIIMNRKSIE

SEQ ID NO: 25435 - protein, 28 aa, artificial
  peptide fold or domain or sub-domain
MTVIYEFVRHDRIHFPCVLLRRNIIGML

SEQ ID NO: 25436 - protein, 26 aa, artificial
  peptide fold or domain or sub-domain
PHYGTKKFPTPFITYFKNLRNILISI

SEQ ID NO: 25437 - protein, 22 aa, artificial
  peptide fold or domain or sub-domain
ASCHYNYVNINQNQKEGMHLFK

SEQ ID NO: 25438 - protein, 19 aa, artificial
  peptide fold or domain or sub-domain
PLHGITQNYQIKQDMAEYK

SEQ ID NO: 25439 - protein, 24 aa, artificial
  peptide fold or domain or sub-domain
MLRNRLFGNKQNLTIILGFIKAFK

SEQ ID NO: 25440 - protein, 29 aa, artificial
  peptide fold or domain or sub-domain
PHHFIWIIKKLKKKRRNGKEKVNEIARIL

SEQ ID NO: 25441 - protein, 29 aa, artificial
  peptide fold or domain or sub-domain
MYTLLYTFRYIYIINTTNLCRHIQLLKKV

SEQ ID NO: 25442 - protein, 30 aa, artificial
  peptide fold or domain or sub-domain
QWSSTQNNLHFFIAYMFYYLFFQTQRQQHE

SEQ ID NO: 25443 - protein, 24 aa, artificial
  peptide fold or domain or sub-domain
MPVGDAGSIYICYRKNILFYFRYL

SEQ ID NO: 25444 - protein, 28 aa, artificial
  peptide fold or domain or sub-domain
MGLTHSKTSMNIHKKINIFLNKICELNY

SEQ ID NO: 25445 - protein, 25 aa, artificial
  peptide fold or domain or sub-domain
LTIKLINIVYVLQFYIRSLLKMLDA

SEQ ID NO: 25446 - protein, 27 aa, artificial
  peptide fold or domain or sub-domain
NHFCYSGLFVFLDEFENCSLGIFEELC

SEQ ID NO: 25447 - protein, 29 aa, artificial
  peptide fold or domain or sub-domain
KIMCYREIKNIYTYMCKFKVKTKRFLYEL

SEQ ID NO: 25448 - protein, 29 aa, artificial
  peptide fold or domain or sub-domain
FDTNIKMSCKTEYTLNMHNHVFYKYTYKM

SEQ ID NO: 25449 - protein, 27 aa, artificial
  peptide fold or domain or sub-domain
SLTTSDYSELFYLATHEFIYTYICIQS

SEQ ID NO: 25450 - protein, 23 aa, artificial
  peptide fold or domain or sub-domain
IFYRRKTALFISFDHIIFFLQYK

SEQ ID NO: 25451 - protein, 26 aa, artificial
  peptide fold or domain or sub-domain
HVNPAIGTYIFYTLGNFEFLFLNLYF

SEQ ID NO: 25452 - protein, 28 aa, artificial
  peptide fold or domain or sub-domain
GLLIKTLYHKGLASTDRKTRFTFMFTAP

SEQ ID NO: 25453 - protein, 28 aa, artificial
  peptide fold or domain or sub-domain
KIISFYLYTIYSNINMHIKTFLNISKPF

SEQ ID NO: 25454 - protein, 28 aa, artificial
  peptide fold or domain or sub-domain
LIILKYAFRMHTHLWKIILLYLRRKYYN

SEQ ID NO: 25455 - protein, 30 aa, artificial
  peptide fold or domain or sub-domain
CWRNYVFLSLKKIYLNDKDNDGIKEIKKNI

SEQ ID NO: 25456 - protein, 27 aa, artificial
  peptide fold or domain or sub-domain
FIKKYLFGLEKNIYHNKNTLCSHFYII

SEQ ID NO: 25457 - protein, 29 aa, artificial
  peptide fold or domain or sub-domain
YISRSVETTLLYIIDRAQNNMYMLINIYE

SEQ ID NO: 25458 - protein, 28 aa, artificial
  peptide fold or domain or sub-domain
NAIYTQIWGLKNIHIGLLFFGKYIHNNF

SEQ ID NO: 25459 - protein, 26 aa, artificial
  peptide fold or domain or sub-domain
CALHYFIHNYIRQHCFIFLLFIIKKT

SEQ ID NO: 25460 - protein, 29 aa, artificial
  peptide fold or domain or sub-domain
MGFYIIKTWVNRKNCKDPINVKVLFLPQS

SEQ ID NO: 25461 - protein, 27 aa, artificial
  peptide fold or domain or sub-domain
PVVKSPGYLQIFSYLFVCNRAKKPINV

SEQ ID NO: 25462 - protein, 27 aa, artificial
  peptide fold or domain or sub-domain
GIMISQHKLYKLNKQYINNIRKIVCIK

SEQ ID NO: 25463 - protein, 25 aa, artificial
  peptide fold or domain or sub-domain
FNFEFYVSWVVFFLRFIYLLYVSTL

SEQ ID NO: 25464 - protein, 29 aa, artificial
  peptide fold or domain or sub-domain
MNPNETKLNVMKLSDVKPNETKLSGMKLK

SEQ ID NO: 25465 - protein, 29 aa, artificial
  peptide fold or domain or sub-domain
MIDKRKITVFPILFLYVFFILLLFYHTLS

SEQ ID NO: 25466 - protein, 28 aa, artificial
  peptide fold or domain or sub-domain
MLKIRKIFAENNEINYEQKNIYKNQCKY

SEQ ID NO: 25467 - protein, 30 aa, artificial
  peptide fold or domain or sub-domain
MPFPLDKYPLVGLFDFLRNLFAVLQNGNDN

SEQ ID NO: 25468 - protein, 25 aa, artificial
  peptide fold or domain or sub-domain
IINNKTNTNISYKTDYTYNAQLCIL

SEQ ID NO: 25469 - protein, 21 aa, artificial
  peptide fold or domain or sub-domain
GKQWWHLPRGKIYEQAKKIKI

SEQ ID NO: 25470 - protein, 26 aa, artificial
  peptide fold or domain or sub-domain
CRYIFKLIHIALQWKYYLNKDALIDK

SEQ ID NO: 25471 - protein, 29 aa, artificial
  peptide fold or domain or sub-domain
FCKIILSIYLYEKADKDVNHMTIFQYILC

SEQ ID NO: 25472 - protein, 25 aa, artificial
  peptide fold or domain or sub-domain
CYYSWYINRNLFFFYLMLVFLHLYL

SEQ ID NO: 25473 - protein, 25 aa, artificial
  peptide fold or domain or sub-domain
DKENLLYAKRKGIYLVNYLKKQYGI

SEQ ID NO: 25474 - protein, 25 aa, artificial
  peptide fold or domain or sub-domain
IFFICKISFLILKGTKTNKKCACNV

SEQ ID NO: 25475 - protein, 26 aa, artificial
  peptide fold or domain or sub-domain
NADILIYFANLYIYLHIHSNDGILAC

SEQ ID NO: 25476 - protein, 21 aa, artificial
  peptide fold or domain or sub-domain
TTQFSMTKSTYSYLHFIFQKI

SEQ ID NO: 25477 - protein, 29 aa, artificial
  peptide fold or domain or sub-domain
SLPSLLSWSCLKVSTHFLLKIAPNCSMLS

SEQ ID NO: 25478 - protein, 26 aa, artificial
  peptide fold or domain or sub-domain
FQYKIFRENLKVHFWIYNFLNYIVLA

SEQ ID NO: 25479 - protein, 30 aa, artificial
  peptide fold or domain or sub-domain
MYRESLYAHINFVHFFFSFLVILKMKQLFD

SEQ ID NO: 25480 - protein, 26 aa, artificial
  peptide fold or domain or sub-domain
EIKIDDKNPIPPIQIRFIMEKKFSKV

SEQ ID NO: 25481 - protein, 22 aa, artificial
  peptide fold or domain or sub-domain
MYICLSICIHVNRKNCHPFKFY

SEQ ID NO: 25482 - protein, 29 aa, artificial
  peptide fold or domain or sub-domain
MFFFFLIQSVIYNGWKKDKSKGYFKIEAD

SEQ ID NO: 25483 - protein, 26 aa, artificial
  peptide fold or domain or sub-domain
KAKCNVPLFSHEINTLFACFKYVQYI

SEQ ID NO: 25484 - protein, 24 aa, artificial
  peptide fold or domain or sub-domain
LIWEFMCSHNILMVISAHHVATVG

SEQ ID NO: 25485 - protein, 27 aa, artificial
  peptide fold or domain or sub-domain
EQIMLTPFFFYSNIKKKYNFHMLMMLL

SEQ ID NO: 25486 - protein, 25 aa, artificial
  peptide fold or domain or sub-domain
NINDNVFYHPIRYHSNYTCYAYIFI

SEQ ID NO: 25487 - protein, 25 aa, artificial
  peptide fold or domain or sub-domain
MYHIYSCLMLIILTTYYQGKYKRKT

SEQ ID NO: 25488 - protein, 28 aa, artificial
  peptide fold or domain or sub-domain
EKTTKKYTLYISYLLFSYCFIIPFNLLY

SEQ ID NO: 25489 - protein, 30 aa, artificial
  peptide fold or domain or sub-domain
MQLHNKRKCQFKYAKNIVLLFSPLEAKVGF

SEQ ID NO: 25490 - protein, 29 aa, artificial
  peptide fold or domain or sub-domain
MLAYQFGYTNNTLYCVIEQLRSVDIITKK

SEQ ID NO: 25491 - protein, 26 aa, artificial
  peptide fold or domain or sub-domain
PRIHCYIPRSAHQAAQNEIPKRKGLK

SEQ ID NO: 25492 - protein, 29 aa, artificial
  peptide fold or domain or sub-domain
IVRFYYIDIYFKCNNLHTNKKIKNNIYIY

SEQ ID NO: 25493 - protein, 28 aa, artificial
  peptide fold or domain or sub-domain
YNIYITFDVININLERFYYLFLLLTCKI

SEQ ID NO: 25494 - protein, 24 aa, artificial
  peptide fold or domain or sub-domain
YKVLYVEIKFNQEYLIKRDYKQFI

SEQ ID NO: 25495 - protein, 29 aa, artificial
  peptide fold or domain or sub-domain
YLFITSNDETQLKNVFYFYFDMASIFKFV

SEQ ID NO: 25496 - protein, 25 aa, artificial
  peptide fold or domain or sub-domain
SVSNPTYWILISCISSSPPLLRKYQ

SEQ ID NO: 25497 - protein, 30 aa, artificial
  peptide fold or domain or sub-domain
LFICMYVCKYQFSLNVKTATSLCILNKKRK

SEQ ID NO: 25498 - protein, 23 aa, artificial
  peptide fold or domain or sub-domain
ITHICKHISLNFVYGIVQVYYFT

SEQ ID NO: 25499 - protein, 27 aa, artificial
  peptide fold or domain or sub-domain
FHYPCVIFFSFRIYFLKNILCRFLIYH

SEQ ID NO: 25500 - protein, 26 aa, artificial
  peptide fold or domain or sub-domain
KLLVLMGNIYYSEIIKYNSIYFCVYI

SEQ ID NO: 25501 - protein, 30 aa, artificial
  peptide fold or domain or sub-domain
YIFLINFWKGYSAFLYCGCGLIFYANKLYL

SEQ ID NO: 25502 - protein, 20 aa, artificial
  peptide fold or domain or sub-domain
FPVLYFEFAEMIVLWSLEFL

SEQ ID NO: 25503 - protein, 29 aa, artificial
  peptide fold or domain or sub-domain
SHHKCILLIFQCFSFISLLVFTHCESYIK

SEQ ID NO: 25504 - protein, 27 aa, artificial
  peptide fold or domain or sub-domain
LNISIKNDKYVNSFITIIICKQTHKYN

SEQ ID NO: 25505 - protein, 26 aa, artificial
  peptide fold or domain or sub-domain
PLYWAFLKRQTIIEMAPPKSRRIIKT

SEQ ID NO: 25506 - protein, 13 aa, artificial
  peptide fold or domain or sub-domain
MYIYTYVCEFICV

SEQ ID NO: 25507 - protein, 25 aa, artificial
  peptide fold or domain or sub-domain
MCYKNFPLNIKSIQITYSLLKKNIM

SEQ ID NO: 25508 - protein, 30 aa, artificial
  peptide fold or domain or sub-domain
MFCFLIKFVHICVHFFYFYRTHKFSLKKNL

SEQ ID NO: 25509 - protein, 29 aa, artificial
  peptide fold or domain or sub-domain
NNHTLASSFIHVSNKIYPTYAIINVFFFP

SEQ ID NO: 25510 - protein, 26 aa, artificial
  peptide fold or domain or sub-domain
SFYICKRMRKLIYLIYIFNSYDISYM

SEQ ID NO: 25511 - protein, 29 aa, artificial
  peptide fold or domain or sub-domain
IHYIYFYNVLYTFVIILNKKWKKYICTKC

SEQ ID NO: 25512 - protein, 22 aa, artificial
  peptide fold or domain or sub-domain
NIVIILFQYHPYVILTHQQICS

SEQ ID NO: 25513 - protein, 23 aa, artificial
  peptide fold or domain or sub-domain
YHRRNIFIFSLFLLINNCTFTTL

SEQ ID NO: 25514 - protein, 25 aa, artificial
  peptide fold or domain or sub-domain
NQKCIRQRKIIYYYKKNMGECTKHI

SEQ ID NO: 25515 - protein, 29 aa, artificial
  peptide fold or domain or sub-domain
MVAFFLSAKWGNATIPLAQITFEKKIGSK

SEQ ID NO: 25516 - protein, 28 aa, artificial
  peptide fold or domain or sub-domain
DTKHGIGVKESIDTILAFTSTKKRDIVR

SEQ ID NO: 25517 - protein, 30 aa, artificial
  peptide fold or domain or sub-domain
MYYLAYFFKLLKEYPFHFHLFIINIAIYRA

SEQ ID NO: 25518 - protein, 30 aa, artificial
  peptide fold or domain or sub-domain
MQTYFHIEYIHGMYIHIYTEYESILYGGHA

SEQ ID NO: 25519 - protein, 29 aa, artificial
  peptide fold or domain or sub-domain
LFPTIFNRPIAHIFTYMTNLKRIINVSKN

SEQ ID NO: 25520 - protein, 24 aa, artificial
  peptide fold or domain or sub-domain
MYFILMCSLCNLRKRRRKWRYMFK

SEQ ID NO: 25521 - protein, 22 aa, artificial
  peptide fold or domain or sub-domain
MFIFFFIYYVTMIGAIMLCPIF

SEQ ID NO: 25522 - protein, 27 aa, artificial
  peptide fold or domain or sub-domain
ISKEDLEDPLSHGLTNILYNDIPPNYI

SEQ ID NO: 25523 - protein, 29 aa, artificial
  peptide fold or domain or sub-domain
LNNIYPCIYNQIKIIDLFVFNMFIYCNHD

SEQ ID NO: 25524 - protein, 29 aa, artificial
  peptide fold or domain or sub-domain
VDIFCFSQFIYSRHMHICCAVFFLFFLII

SEQ ID NO: 25525 - protein, 25 aa, artificial
  peptide fold or domain or sub-domain
QSYYFFLLNNNLLYCIKLCIVCTFF

SEQ ID NO: 25526 - protein, 23 aa, artificial
  peptide fold or domain or sub-domain
MLFLYMIMFISFNIKMQICVLVL

SEQ ID NO: 25527 - protein, 27 aa, artificial
  peptide fold or domain or sub-domain
SHYLTILGSVLVLLNCKSERYGHILYK

SEQ ID NO: 25528 - protein, 27 aa, artificial
  peptide fold or domain or sub-domain
NALMEYIHFFFKMHVSKRIHNPIYDIL

SEQ ID NO: 25529 - protein, 30 aa, artificial
  peptide fold or domain or sub-domain
MCLYLLCYENKSDLWICLNNKSNIFFHLKT

SEQ ID NO: 25530 - protein, 26 aa, artificial
  peptide fold or domain or sub-domain
NLPFRYKTFYLASYNVIILNIKKIKI

SEQ ID NO: 25531 - protein, 25 aa, artificial
  peptide fold or domain or sub-domain
MIKIKKRENNNNVFCIYTMCAYDQN

SEQ ID NO: 25532 - protein, 21 aa, artificial
  peptide fold or domain or sub-domain
TLVNGNNMGMCAHIFVYMVIP

SEQ ID NO: 25533 - protein, 29 aa, artificial
  peptide fold or domain or sub-domain
DMYIIYFYIFIANSGDYNLLYEQMAANNL

SEQ ID NO: 25534 - protein, 27 aa, artificial
  peptide fold or domain or sub-domain
NYVLINKNSEHMCKKIVYLFKKQTKIA

SEQ ID NO: 25535 - protein, 27 aa, artificial
  peptide fold or domain or sub-domain
GERLHLAKRVAHQTITTVCGKLEVSNF

SEQ ID NO: 25536 - protein, 30 aa, artificial
  peptide fold or domain or sub-domain
ILICYDYPLFECRKLYINFIWYHTLNIISL

SEQ ID NO: 25537 - protein, 30 aa, artificial
  peptide fold or domain or sub-domain
IFFSKYNLTLFRYSFILTILLNIYFIFFKL

SEQ ID NO: 25538 - protein, 26 aa, artificial
  peptide fold or domain or sub-domain
FVIFLFILVNKYIRLVLLYHIRLFSQ

SEQ ID NO: 25539 - protein, 21 aa, artificial
  peptide fold or domain or sub-domain
IPSVFSYVSKSENNKNKPCIR

SEQ ID NO: 25540 - protein, 23 aa, artificial
  peptide fold or domain or sub-domain
YKIVYFRKNLYAYAKYIIKKNCG

SEQ ID NO: 25541 - protein, 26 aa, artificial
  peptide fold or domain or sub-domain
LSNINLSCFTIFVCAHSTKNNACRQI

SEQ ID NO: 25542 - protein, 21 aa, artificial
  peptide fold or domain or sub-domain
IVFHLVISTSSCIMCILFLFT

SEQ ID NO: 25543 - protein, 30 aa, artificial
  peptide fold or domain or sub-domain
NHIYFFCITPLDKLLDDEIIENSIDKAEHK

SEQ ID NO: 25544 - protein, 30 aa, artificial
  peptide fold or domain or sub-domain
ALSASDGGTLPGSDRNIFSDRECIFLLWPR

SEQ ID NO: 25545 - protein, 28 aa, artificial
  peptide fold or domain or sub-domain
INTYRKLVHIMTECIVCLQYYIITVNYQ

SEQ ID NO: 25546 - protein, 28 aa, artificial
  peptide fold or domain or sub-domain
QPIRCFLILASLISFYFFHPFREFSAKR

SEQ ID NO: 25547 - protein, 29 aa, artificial
  peptide fold or domain or sub-domain
SIHLIQSKFTHAPGTSLVHVTDRMTGLDS

SEQ ID NO: 25548 - protein, 27 aa, artificial
  peptide fold or domain or sub-domain
FYLIIFVPMIFGINYVDLLYYNSIAYL

SEQ ID NO: 25549 - protein, 23 aa, artificial
  peptide fold or domain or sub-domain
KKHANSLNFYPQIFGLMKTLFPI

SEQ ID NO: 25550 - protein, 30 aa, artificial
  peptide fold or domain or sub-domain
MHFSMYIVCIKKGSKNVIQICSPFYILLIL

SEQ ID NO: 25551 - protein, 29 aa, artificial
  peptide fold or domain or sub-domain
FYDVVSVDMHIFLVFSFLYINLESIYNNL

SEQ ID NO: 25552 - protein, 27 aa, artificial
  peptide fold or domain or sub-domain
RYRIERIMSLKIFFPIFMHCIYLSNFL

SEQ ID NO: 25553 - protein, 25 aa, artificial
  peptide fold or domain or sub-domain
NNYHLSKDHFCNMIYLNHQSTDFLL

SEQ ID NO: 25554 - protein, 29 aa, artificial
  peptide fold or domain or sub-domain
MNRIKKTTLIKLKRGLAYQYKYIFSIVIL

SEQ ID NO: 25555 - protein, 30 aa, artificial
  peptide fold or domain or sub-domain
YFCIIIYTIYLCDFIYYQKKKYAIAYLIAQ

SEQ ID NO: 25556 - protein, 26 aa, artificial
  peptide fold or domain or sub-domain
IKGCVLKFFRVSTRMNCTYGLQKKSD

SEQ ID NO: 25557 - protein, 28 aa, artificial
  peptide fold or domain or sub-domain
LIIKKKTTSFKGPFKRYFKSHFFIFIII

SEQ ID NO: 25558 - protein, 24 aa, artificial
  peptide fold or domain or sub-domain
HIIAIYFMYRYMQHYNKLYNPATN

SEQ ID NO: 25559 - protein, 30 aa, artificial
  peptide fold or domain or sub-domain
LSEDDVRNYPSITRLPYSLGHGISLKPRTR

SEQ ID NO: 25560 - protein, 28 aa, artificial
  peptide fold or domain or sub-domain
LYLYIIFKHIISYSPMCKIVNSYIFYKK

SEQ ID NO: 25561 - protein, 22 aa, artificial
  peptide fold or domain or sub-domain
GFIMLFPLSMTFAYFCLREKCG

SEQ ID NO: 25562 - protein, 30 aa, artificial
  peptide fold or domain or sub-domain
VQNDALYLNELWDLIDKDICDPVESYAENE

SEQ ID NO: 25563 - protein, 29 aa, artificial
  peptide fold or domain or sub-domain
TEYKYTITCVHYAKVKHFKKGCAYYILKK

SEQ ID NO: 25564 - protein, 22 aa, artificial
  peptide fold or domain or sub-domain
YFTNTITNINRICNTNEQHLPA

SEQ ID NO: 25565 - protein, 27 aa, artificial
  peptide fold or domain or sub-domain
VKAMQQCIYKADVWECEYIMHTNMNNS

SEQ ID NO: 25566 - protein, 28 aa, artificial
  peptide fold or domain or sub-domain
FCVKNALFPSFLKKLLSPFKWPLPSLKI

SEQ ID NO: 25567 - protein, 23 aa, artificial
  peptide fold or domain or sub-domain
LFNYFEIKTWNFSKKNDSLPYMK

SEQ ID NO: 25568 - protein, 30 aa, artificial
  peptide fold or domain or sub-domain
MLMLIIYYMGAYCNSNVLFIYICAVYKPSL

SEQ ID NO: 25569 - protein, 25 aa, artificial
  peptide fold or domain or sub-domain
KYLKWIYLIYSFIYKILLEFVWGKL

SEQ ID NO: 25570 - protein, 27 aa, artificial
  peptide fold or domain or sub-domain
GLLSYLLSWERKQQFSTVSNFQLYLKG

SEQ ID NO: 25571 - protein, 26 aa, artificial
  peptide fold or domain or sub-domain
NINMPIQRCVYEHVISLKFWIFLIFK

SEQ ID NO: 25572 - protein, 30 aa, artificial
  peptide fold or domain or sub-domain
LLCIKDAQNIPKNMKWFFLFLSNCSTMDTK

SEQ ID NO: 25573 - protein, 24 aa, artificial
  peptide fold or domain or sub-domain
IITRQAYLSFVFDTYVHICMCTSR

SEQ ID NO: 25574 - protein, 25 aa, artificial
  peptide fold or domain or sub-domain
PFDSTSIVTYMHMCMFTPLCWSNPS

SEQ ID NO: 25575 - protein, 29 aa, artificial
  peptide fold or domain or sub-domain
VSNARMYFPSIYSAYFATLIFFKTEIKIT

SEQ ID NO: 25576 - protein, 27 aa, artificial
  peptide fold or domain or sub-domain
KIRRLFIILRKKIDTVTENFFSYLYHP

SEQ ID NO: 25577 - protein, 30 aa, artificial
  peptide fold or domain or sub-domain
TFTHFQYILIFIFFHVYIKINIYTYFIYLV

SEQ ID NO: 25578 - protein, 23 aa, artificial
  peptide fold or domain or sub-domain
AQTHRYTHYTKHTFSYKDILNTS

SEQ ID NO: 25579 - protein, 21 aa, artificial
  peptide fold or domain or sub-domain
ILGLISYLKIKKCSSIDCNFP

SEQ ID NO: 25580 - protein, 23 aa, artificial
  peptide fold or domain or sub-domain
KRKPYVERQRMTSKTKYDALCLD

SEQ ID NO: 25581 - protein, 26 aa, artificial
  peptide fold or domain or sub-domain
VIQHLNSRKKHIIFKKIIYPFLRHYR

SEQ ID NO: 25582 - protein, 26 aa, artificial
  peptide fold or domain or sub-domain
QNLREKNIKKGNKSLINYSEYDDWCI

SEQ ID NO: 25583 - protein, 28 aa, artificial
  peptide fold or domain or sub-domain
AIEKKIDLLVEREYIQKEENSQVYVYIP

SEQ ID NO: 25584 - protein, 30 aa, artificial
  peptide fold or domain or sub-domain
MNPYLLAFYAYLVPLIIHIPHYYRFLFSIF

SEQ ID NO: 25585 - protein, 24 aa, artificial
  peptide fold or domain or sub-domain
KYIRVICYPSFPRKNCSETVQKPF

SEQ ID NO: 25586 - protein, 28 aa, artificial
  peptide fold or domain or sub-domain
NYLKLKFYIFKKASQNISLFSDLADGPL

SEQ ID NO: 25587 - protein, 23 aa, artificial
  peptide fold or domain or sub-domain
SKMDLINTYLKRQIHVPLLSHYI

SEQ ID NO: 25588 - protein, 23 aa, artificial
  peptide fold or domain or sub-domain
MPPSTLSGCRKPYSCFLRFSCFR

SEQ ID NO: 25589 - protein, 25 aa, artificial
  peptide fold or domain or sub-domain
LYKNENVIQDKSDTGEMGNNSRRRR

SEQ ID NO: 25590 - protein, 22 aa, artificial
  peptide fold or domain or sub-domain
LFMKKVPSSQNRDTFTCTCLNA

SEQ ID NO: 25591 - protein, 26 aa, artificial
  peptide fold or domain or sub-domain
AYIIYKRKTRIVLMVVNFILIYGFCY

SEQ ID NO: 25592 - protein, 28 aa, artificial
  peptide fold or domain or sub-domain
EILHFFYIISNKYKTNFVFKFNIIPFSR

SEQ ID NO: 25593 - protein, 23 aa, artificial
  peptide fold or domain or sub-domain
REVLSHISVHLPHEIRACLQRVL

SEQ ID NO: 25594 - protein, 23 aa, artificial
  peptide fold or domain or sub-domain
HCEGINVTYCVLVYNWGYTVLYL

SEQ ID NO: 25595 - protein, 25 aa, artificial
  peptide fold or domain or sub-domain
QKADLYSKDHDLLSADNVLHANMEL

SEQ ID NO: 25596 - protein, 23 aa, artificial
  peptide fold or domain or sub-domain
HFYISIKNIRINRVKKGIFRLHK

SEQ ID NO: 25597 - protein, 26 aa, artificial
  peptide fold or domain or sub-domain
MLHFPTLTGHSNRSISTIIKLNKYPV

SEQ ID NO: 25598 - protein, 29 aa, artificial
  peptide fold or domain or sub-domain
MPDAPIIAKNTYAHAYIFMYTYLYSLFSF

SEQ ID NO: 25599 - protein, 27 aa, artificial
  peptide fold or domain or sub-domain
LQGFNYADSIAIQLAKNKSAKKIIRKI

SEQ ID NO: 25600 - protein, 30 aa, artificial
  peptide fold or domain or sub-domain
LISSPNITLNHMINEESNGDNKEVAELRRK

SEQ ID NO: 25601 - protein, 28 aa, artificial
  peptide fold or domain or sub-domain
MNINEKYSIKYSQTKSRNTSKTSSIKIK

SEQ ID NO: 25602 - protein, 30 aa, artificial
  peptide fold or domain or sub-domain
VSPSSLRSEQGSLGPCIPEGTKCKETTVGF

SEQ ID NO: 25603 - protein, 29 aa, artificial
  peptide fold or domain or sub-domain
MRSSCKAFSQLVIKGGTIPGLAVLGSIRK

SEQ ID NO: 25604 - protein, 23 aa, artificial
  peptide fold or domain or sub-domain
TICIHSTFEHKKENEKKNKNSWL

SEQ ID NO: 25605 - protein, 25 aa, artificial
  peptide fold or domain or sub-domain
FKGKNNFIRLVKIVMHNEDTIVLRM

SEQ ID NO: 25606 - protein, 24 aa, artificial
  peptide fold or domain or sub-domain
EMKCQKEQMFTNIHIYNWMHQNIA

SEQ ID NO: 25607 - protein, 24 aa, artificial
  peptide fold or domain or sub-domain
IVKLYNYQNLEENTVKTDYNIKFK

SEQ ID NO: 25608 - protein, 27 aa, artificial
  peptide fold or domain or sub-domain
MLILNTLLFYLLTDKMDSEDWICTDEK

SEQ ID NO: 25609 - protein, 26 aa, artificial
  peptide fold or domain or sub-domain
YIYRNVYNMYMCAYVIMCIYSLKLHD

SEQ ID NO: 25610 - protein, 22 aa, artificial
  peptide fold or domain or sub-domain
MNVSCSLPHLKHAMYLRMTLVF

SEQ ID NO: 25611 - protein, 24 aa, artificial
  peptide fold or domain or sub-domain
YIFHIPGDTTHIYVHTYYLYDNFE

SEQ ID NO: 25612 - protein, 23 aa, artificial
  peptide fold or domain or sub-domain
AYAPDIYRDKIIKANKIIYAYMY

SEQ ID NO: 25613 - protein, 26 aa, artificial
  peptide fold or domain or sub-domain
RSFFSGKITNCENYFGYKKYIIYLND

SEQ ID NO: 25614 - protein, 26 aa, artificial
  peptide fold or domain or sub-domain
IINSSTNTGLVLIVVINHRKGAQNIL

SEQ ID NO: 25615 - protein, 30 aa, artificial
  peptide fold or domain or sub-domain
MLDSIYLYLQNEYAYSFVGISMNIYGYTIL

SEQ ID NO: 25616 - protein, 29 aa, artificial
  peptide fold or domain or sub-domain
TTLYYQHYFINSFYMCKLGNFNIYKINAF

SEQ ID NO: 25617 - protein, 30 aa, artificial
  peptide fold or domain or sub-domain
SIKKICTCDTLSLFVETPKCDIYSYTIIYD

SEQ ID NO: 25618 - protein, 29 aa, artificial
  peptide fold or domain or sub-domain
MCKHHNYIYNLIFLSLCSLFHTYIFLFYV

SEQ ID NO: 25619 - protein, 25 aa, artificial
  peptide fold or domain or sub-domain
EGFLSFRKYTFKTIKNKKQSDYFLL

SEQ ID NO: 25620 - protein, 26 aa, artificial
  peptide fold or domain or sub-domain
IYFYNNFLLREVFDEAKNFERIYIFD

SEQ ID NO: 25621 - protein, 21 aa, artificial
  peptide fold or domain or sub-domain
KKVHNDNSNIMYFQLFANRHT

SEQ ID NO: 25622 - protein, 30 aa, artificial
  peptide fold or domain or sub-domain
MYTRMYIYFFLGAKRKTMKMDVILPQLYNV

SEQ ID NO: 25623 - protein, 26 aa, artificial
  peptide fold or domain or sub-domain
YVKLIEYYIFFNKYFLNNIIIYAFFL

SEQ ID NO: 25624 - protein, 24 aa, artificial
  peptide fold or domain or sub-domain
VEPTPILQFDTSLFYNTLTISYAF

SEQ ID NO: 25625 - protein, 28 aa, artificial
  peptide fold or domain or sub-domain
YNFVSIAIYSYLNIVIIWKKKLIQEKRG

SEQ ID NO: 25626 - protein, 30 aa, artificial
  peptide fold or domain or sub-domain
NYKVIQYMSIPFLKYIYIFFKKKKHYFIFM

SEQ ID NO: 25627 - protein, 22 aa, artificial
  peptide fold or domain or sub-domain
YYSFIRKILICIYVCTNRHVYF

SEQ ID NO: 25628 - protein, 23 aa, artificial
  peptide fold or domain or sub-domain
NLVEGAYKKYAYIFMYLFISINK

SEQ ID NO: 25629 - protein, 23 aa, artificial
  peptide fold or domain or sub-domain
NTKSQFVRFVCLWCIPFIYSYNK

SEQ ID NO: 25630 - protein, 23 aa, artificial
  peptide fold or domain or sub-domain
MYINLSGYIIKKNNIFRLPVFTL

SEQ ID NO: 25631 - protein, 25 aa, artificial
  peptide fold or domain or sub-domain
NNREDQRPKKLLNHGKSKIISFAFP

SEQ ID NO: 25632 - protein, 29 aa, artificial
  peptide fold or domain or sub-domain
FLCINIFNMVDYKTNGQSNVSNLSKNKIS

SEQ ID NO: 25633 - protein, 25 aa, artificial
  peptide fold or domain or sub-domain
MPTGNKLSGIAFSLTAFESTSLFSS

SEQ ID NO: 25634 - protein, 26 aa, artificial
  peptide fold or domain or sub-domain
YFLIQKSVTQLVSENWQYSLAYNKKK

SEQ ID NO: 25635 - protein, 25 aa, artificial
  peptide fold or domain or sub-domain
SSNTSISIVCIQKGKLLKLTKYENI

SEQ ID NO: 25636 - protein, 23 aa, artificial
  peptide fold or domain or sub-domain
ILVSSFMENIVCMTCVCIYPNNE

SEQ ID NO: 25637 - protein, 22 aa, artificial
  peptide fold or domain or sub-domain
YVNMFYCKFPEAGAPLRKITVF

SEQ ID NO: 25638 - protein, 27 aa, artificial
  peptide fold or domain or sub-domain
MGIPLELCLFIHKSIPSDFYFHICIKK

SEQ ID NO: 25639 - protein, 30 aa, artificial
  peptide fold or domain or sub-domain
NIRKKKKNTKYNQTIYKYKMINIYFSYSLN

SEQ ID NO: 25640 - protein, 30 aa, artificial
  peptide fold or domain or sub-domain
KKFFLLCILYKTKLYRQKIKSKMQINIAYN

SEQ ID NO: 25641 - protein, 27 aa, artificial
  peptide fold or domain or sub-domain
MLLYNFESLSPVLIHVYYSFFTCNVCT

SEQ ID NO: 25642 - protein, 26 aa, artificial
  peptide fold or domain or sub-domain
MFTIHKSLPTPISTYTYIFIMYIKNI

SEQ ID NO: 25643 - protein, 21 aa, artificial
  peptide fold or domain or sub-domain
CWHGLKKCIHAYTHKVTIIIN

SEQ ID NO: 25644 - protein, 30 aa, artificial
  peptide fold or domain or sub-domain
CKFYACEMHNKNCIERGTYMSGNTTMQTYI

SEQ ID NO: 25645 - protein, 25 aa, artificial
  peptide fold or domain or sub-domain
VYYIPTICFKFSYFHLRLTQIIISF

SEQ ID NO: 25646 - protein, 12 aa, artificial
  peptide fold or domain or sub-domain
MKGVAYHIFHKV

SEQ ID NO: 25647 - protein, 23 aa, artificial
  peptide fold or domain or sub-domain
KTKQKCAISKIADCVCPQECKCD

SEQ ID NO: 25648 - protein, 26 aa, artificial
  peptide fold or domain or sub-domain
YVYYYCAPSLKMGTTYIPPPHFENFP

SEQ ID NO: 25649 - protein, 26 aa, artificial
  peptide fold or domain or sub-domain
WNIHILLFFFLKKLTYKTTKKKDNFN

SEQ ID NO: 25650 - protein, 29 aa, artificial
  peptide fold or domain or sub-domain
KSLNNIFLVKNINNIVYNHMNKERTVFFF

SEQ ID NO: 25651 - protein, 30 aa, artificial
  peptide fold or domain or sub-domain
MECLLPVVSFNININSIFMLKMGKLQFGEL

SEQ ID NO: 25652 - protein, 29 aa, artificial
  peptide fold or domain or sub-domain
SCLIFFYSYIYVVSYIYSVTTFIYFYFFK

SEQ ID NO: 25653 - protein, 29 aa, artificial
  peptide fold or domain or sub-domain
CRENIKKKKKKIPTFCISILVIHTDQLYK

SEQ ID NO: 25654 - protein, 29 aa, artificial
  peptide fold or domain or sub-domain
LWLKEKCICWLCYLIWHKIEIVLFLQIKI

SEQ ID NO: 25655 - protein, 30 aa, artificial
  peptide fold or domain or sub-domain
SKSMGSYIMFCRKRLNNLEIKTERHKECIL

SEQ ID NO: 25656 - protein, 21 aa, artificial
  peptide fold or domain or sub-domain
KMLITKPMKCLKGILLYKSAI

SEQ ID NO: 25657 - protein, 30 aa, artificial
  peptide fold or domain or sub-domain
MRYHKACIYINKKFTMCDLFKCYIYDYKDL

SEQ ID NO: 25658 - protein, 30 aa, artificial
  peptide fold or domain or sub-domain
REKIKLNPKFYKIQIKIEWCKLFEKNQSQN

SEQ ID NO: 25659 - protein, 26 aa, artificial
  peptide fold or domain or sub-domain
MTLYYRTMQVPETSDFPLCKHNDINC

SEQ ID NO: 25660 - protein, 21 aa, artificial
  peptide fold or domain or sub-domain
ETKEIINIICVYACLYIQGLV

SEQ ID NO: 25661 - protein, 30 aa, artificial
  peptide fold or domain or sub-domain
RQMEVGGPIILLQRIIISQKFIKNINKKHK

SEQ ID NO: 25662 - protein, 30 aa, artificial
  peptide fold or domain or sub-domain
ANFSKYINMHIRHIKIYNLTKKTKKINHPK

SEQ ID NO: 25663 - protein, 28 aa, artificial
  peptide fold or domain or sub-domain
YIQRFANYIHILQKKRSACGIFTFFVTS

SEQ ID NO: 25664 - protein, 28 aa, artificial
  peptide fold or domain or sub-domain
YEIMSTKCVSYTYYYYPTKLSVTNNKEK

SEQ ID NO: 25665 - protein, 29 aa, artificial
  peptide fold or domain or sub-domain
DHLYVFICEYYNITVVIYEDLLFMIFLSY

SEQ ID NO: 25666 - protein, 21 aa, artificial
  peptide fold or domain or sub-domain
RKKCLTLQMDFILFKKNSYTY

SEQ ID NO: 25667 - protein, 26 aa, artificial
  peptide fold or domain or sub-domain
GHIYTIHTYKTKKKIIFFSFFVDLMC

SEQ ID NO: 25668 - protein, 24 aa, artificial
  peptide fold or domain or sub-domain
RCHFQGLLMPNYYFFFQNFMNNNS

SEQ ID NO: 25669 - protein, 29 aa, artificial
  peptide fold or domain or sub-domain
ALCLFFSFEKYKSELFVLYFIFSHKKIKT

SEQ ID NO: 25670 - protein, 30 aa, artificial
  peptide fold or domain or sub-domain
KIQLYKSLFLFPHGTDKLNRYLNKLFRILR

SEQ ID NO: 25671 - protein, 29 aa, artificial
  peptide fold or domain or sub-domain
MRAFHGVRQKIEFIFYTFLWIILIHLICI

SEQ ID NO: 25672 - protein, 27 aa, artificial
  peptide fold or domain or sub-domain
YSHKCNILEKGSRSSKIIYVHKQRIGI

SEQ ID NO: 25673 - protein, 28 aa, artificial
  peptide fold or domain or sub-domain
NIFYVVYQKGREKKKYMKMFLKNELILN

SEQ ID NO: 25674 - protein, 27 aa, artificial
  peptide fold or domain or sub-domain
YIFNRCIVNFVNIFPPLLIKISKILVL

SEQ ID NO: 25675 - protein, 30 aa, artificial
  peptide fold or domain or sub-domain
FFLKLCIYKMRCVVPFFNYIYICLNYFYLI

SEQ ID NO: 25676 - protein, 22 aa, artificial
  peptide fold or domain or sub-domain
SINMGSVLIDALNRIKDAKNIL

SEQ ID NO: 25677 - protein, 24 aa, artificial
  peptide fold or domain or sub-domain
SSLDCYIFIICIMKTKKYIHYFLS

SEQ ID NO: 25678 - protein, 22 aa, artificial
  peptide fold or domain or sub-domain
MHLNYTHMINYTPINRTRCKKI

SEQ ID NO: 25679 - protein, 30 aa, artificial
  peptide fold or domain or sub-domain
QIISYHFKELPYMWFFKNILRIFVYFELNE

SEQ ID NO: 25680 - protein, 23 aa, artificial
  peptide fold or domain or sub-domain
KIGLSIFRVCNLYLFLFKNRGKI

SEQ ID NO: 25681 - protein, 26 aa, artificial
  peptide fold or domain or sub-domain
MHIMHKLYRNVPNIQSGRKYLELHVK

SEQ ID NO: 25682 - protein, 21 aa, artificial
  peptide fold or domain or sub-domain
IIFLYDQARIRIYDLKNTKKK

SEQ ID NO: 25683 - protein, 22 aa, artificial
  peptide fold or domain or sub-domain
FTHIRNANPWSMIQSIYIIRHP

SEQ ID NO: 25684 - protein, 24 aa, artificial
  peptide fold or domain or sub-domain
MHGNASIYQKCIIRKALDYFLPHK

SEQ ID NO: 25685 - protein, 27 aa, artificial
  peptide fold or domain or sub-domain
QLIMINKNIISSNYNYLRSTKIKKNFT

SEQ ID NO: 25686 - protein, 30 aa, artificial
  peptide fold or domain or sub-domain
RKMDEAIKGQLSKSSKINTNSIQLERLTSI

SEQ ID NO: 25687 - protein, 28 aa, artificial
  peptide fold or domain or sub-domain
DNNIANRHDIRHNISNKTEMEIVCFKQI

SEQ ID NO: 25688 - protein, 29 aa, artificial
  peptide fold or domain or sub-domain
MKNIKQFLFLYYYITLYKYVFFSNHIWSM

SEQ ID NO: 25689 - protein, 27 aa, artificial
  peptide fold or domain or sub-domain
YCQNTVVISSRLTIFNYIYIYRYLQKK

SEQ ID NO: 25690 - protein, 22 aa, artificial
  peptide fold or domain or sub-domain
MEFEPQNKRCTEERNHFKCPFS

SEQ ID NO: 25691 - protein, 21 aa, artificial
  peptide fold or domain or sub-domain
PTNKIYSIPLHPSLPMRNNYN

SEQ ID NO: 25692 - protein, 27 aa, artificial
  peptide fold or domain or sub-domain
IINKCVITCYYFRWWCRLRNICRYKFN

SEQ ID NO: 25693 - protein, 25 aa, artificial
  peptide fold or domain or sub-domain
YNLTKLTLFNCFYYIKKLFIYLFEN

SEQ ID NO: 25694 - protein, 23 aa, artificial
  peptide fold or domain or sub-domain
EANKNITRQVVYENAHIYTHTHR

SEQ ID NO: 25695 - protein, 25 aa, artificial
  peptide fold or domain or sub-domain
IHISDDKVTCYFCVIVFIFSEQRWE

SEQ ID NO: 25696 - protein, 28 aa, artificial
  peptide fold or domain or sub-domain
LHNAMNLRKTAYIINALSFIISTCLLSI

SEQ ID NO: 25697 - protein, 29 aa, artificial
  peptide fold or domain or sub-domain
MFRFYGLWLCVMKYISVLWVTVHFLEYAF

SEQ ID NO: 25698 - protein, 27 aa, artificial
  peptide fold or domain or sub-domain
PIKIESCLLMWGFKKNYVKSPNKIVNE

SEQ ID NO: 25699 - protein, 30 aa, artificial
  peptide fold or domain or sub-domain
HNFTRVICVCSIYDIIKAELCHFKLGRANS

SEQ ID NO: 25700 - protein, 29 aa, artificial
  peptide fold or domain or sub-domain
HYSYACHIFQHIFFELSFILKNNNIHNLS

SEQ ID NO: 25701 - protein, 29 aa, artificial
  peptide fold or domain or sub-domain
MYKEKYAHIYIFFACLSISCKYMYVCVHS

SEQ ID NO: 25702 - protein, 27 aa, artificial
  peptide fold or domain or sub-domain
VCIYLLVYIKDGGGEWEKFSYAFLHLY

SEQ ID NO: 25703 - protein, 27 aa, artificial
  peptide fold or domain or sub-domain
VISIWCVEKFSRAYSSYTFIPLLKVKY

SEQ ID NO: 25704 - protein, 26 aa, artificial
  peptide fold or domain or sub-domain
MLYYYFNTHNIYGKIYKIKEGLIFAV

SEQ ID NO: 25705 - protein, 29 aa, artificial
  peptide fold or domain or sub-domain
KKLRENFLGLDWLIFFEVLLIISSSVEYF

SEQ ID NO: 25706 - protein, 23 aa, artificial
  peptide fold or domain or sub-domain
NIVYKFEYLGPSRIVQIHMHTTI

SEQ ID NO: 25707 - protein, 30 aa, artificial
  peptide fold or domain or sub-domain
KILKKINPHVLLHVINNFSFISIFPYYEEK

SEQ ID NO: 25708 - protein, 30 aa, artificial
  peptide fold or domain or sub-domain
HLIFIKCVYLFKLMDLIFVSFNCLEMQTKV

SEQ ID NO: 25709 - protein, 26 aa, artificial
  peptide fold or domain or sub-domain
MIQFYRLYRFLKHTLQQIIYIGYGKP

SEQ ID NO: 25710 - protein, 26 aa, artificial
  peptide fold or domain or sub-domain
LHIFYIKNRLLAFYHFVDIYHFFKIV

SEQ ID NO: 25711 - protein, 23 aa, artificial
  peptide fold or domain or sub-domain
IKNETNMPTFCVFIQGFNLFQVI

SEQ ID NO: 25712 - protein, 30 aa, artificial
  peptide fold or domain or sub-domain
MFYVILTIIDSYDICMCVHAYFFFSLYVSF

SEQ ID NO: 25713 - protein, 29 aa, artificial
  peptide fold or domain or sub-domain
TLIDYPLFIVILYACSIFKTILWIYKLIV

SEQ ID NO: 25714 - protein, 30 aa, artificial
  peptide fold or domain or sub-domain
VFQIIFHFGEGPYNIHISKFVKKSFQRTLK

SEQ ID NO: 25715 - protein, 29 aa, artificial
  peptide fold or domain or sub-domain
LWGCYIFHKREFTYMCTMIAGYDSISKIK

SEQ ID NO: 25716 - protein, 29 aa, artificial
  peptide fold or domain or sub-domain
CFLIPIIFIEEYKYIAIYILAFKDMDNLL

SEQ ID NO: 25717 - protein, 27 aa, artificial
  peptide fold or domain or sub-domain
HTYNYQKKENNTHTICVIIFNRTYDTI

SEQ ID NO: 25718 - protein, 24 aa, artificial
  peptide fold or domain or sub-domain
RYDIAIFFSCILKKCNKGVGTMNA

SEQ ID NO: 25719 - protein, 26 aa, artificial
  peptide fold or domain or sub-domain
FIVARFDVIIFHAYYTAVFIFQFHKS

SEQ ID NO: 25720 - protein, 30 aa, artificial
  peptide fold or domain or sub-domain
MLIFCIFFELHKEVKKLNILIKFKKNCSNG

SEQ ID NO: 25721 - protein, 22 aa, artificial
  peptide fold or domain or sub-domain
EKASNWTTQPTILTMYVCIYTV

SEQ ID NO: 25722 - protein, 27 aa, artificial
  peptide fold or domain or sub-domain
LCLYIYDHRQHRKMALTNYKGVFFYIE

SEQ ID NO: 25723 - protein, 28 aa, artificial
  peptide fold or domain or sub-domain
MKIKSICSKMSNAKMHTTHDYIIDHEVR

SEQ ID NO: 25724 - protein, 24 aa, artificial
  peptide fold or domain or sub-domain
AFFDILIKTLKVVPISPQNVYAKI

SEQ ID NO: 25725 - protein, 26 aa, artificial
  peptide fold or domain or sub-domain
MQHAKGITRINIFHFKSCELHAYIHS

SEQ ID NO: 25726 - protein, 28 aa, artificial
  peptide fold or domain or sub-domain
QRNCKKENTIIFCFIKKATLSHKRNISY

SEQ ID NO: 25727 - protein, 25 aa, artificial
  peptide fold or domain or sub-domain
MLNYNFHIVNICVSCPIYCKHNITF

SEQ ID NO: 25728 - protein, 25 aa, artificial
  peptide fold or domain or sub-domain
IIFINSLRMYVYTLFCVFHTKNGTL

SEQ ID NO: 25729 - protein, 25 aa, artificial
  peptide fold or domain or sub-domain
GLFKIDEKRLFISYSVWGELYQEKF

SEQ ID NO: 25730 - protein, 23 aa, artificial
  peptide fold or domain or sub-domain
GKDTILKANSHAQVYNYVSRYML

SEQ ID NO: 25731 - protein, 25 aa, artificial
  peptide fold or domain or sub-domain
KYTQKIYENFFFFFFHGINSIKKIC

SEQ ID NO: 25732 - protein, 23 aa, artificial
  peptide fold or domain or sub-domain
MSLFIYYRRVLLIICFSFPLLCV

SEQ ID NO: 25733 - protein, 27 aa, artificial
  peptide fold or domain or sub-domain
HYKTYKQFQIKIQTTIMASYFALIYFF

SEQ ID NO: 25734 - protein, 25 aa, artificial
  peptide fold or domain or sub-domain
QSFEYLYFGVINLSKAWKSVNFGSG

SEQ ID NO: 25735 - protein, 27 aa, artificial
  peptide fold or domain or sub-domain
KHLSCDFFEPCFTNLYIIQLMAIPLFF

SEQ ID NO: 25736 - protein, 29 aa, artificial
  peptide fold or domain or sub-domain
MPKIHYTIFVIFDMRFCGVSKKKQLKGWP

SEQ ID NO: 25737 - protein, 29 aa, artificial
  peptide fold or domain or sub-domain
SQDLIIMLKLNQQMEILLPPKLKITKLHF

SEQ ID NO: 25738 - protein, 29 aa, artificial
  peptide fold or domain or sub-domain
QPYFKLRLYYIFFSFFNIIYKCKIYENML

SEQ ID NO: 25739 - protein, 26 aa, artificial
  peptide fold or domain or sub-domain
MWKYSKPIMRICIIVCILKSSKKLKE

SEQ ID NO: 25740 - protein, 28 aa, artificial
  peptide fold or domain or sub-domain
NDLTIGCEVLLPLHTLGICHSQRFIGSI

SEQ ID NO: 25741 - protein, 30 aa, artificial
  peptide fold or domain or sub-domain
LIQIYTYVYLYSSIVTTKLRNFLFSYIIVT

SEQ ID NO: 25742 - protein, 29 aa, artificial
  peptide fold or domain or sub-domain
NIKFNNKEKKEIAHSAISSSRMALFQKVL

SEQ ID NO: 25743 - protein, 26 aa, artificial
  peptide fold or domain or sub-domain
MASRQSVMHHLLLHTNSLIYSIIYAF

SEQ ID NO: 25744 - protein, 23 aa, artificial
  peptide fold or domain or sub-domain
IFWSCWVWLNIFSTINTFCNVTI

SEQ ID NO: 25745 - protein, 24 aa, artificial
  peptide fold or domain or sub-domain
FVIFHRNRKKMCISFRILIMYVIY

SEQ ID NO: 25746 - protein, 24 aa, artificial
  peptide fold or domain or sub-domain
CNFLLQILTIMQNMINSLQFPKIK

SEQ ID NO: 25747 - protein, 26 aa, artificial
  peptide fold or domain or sub-domain
YTYYTMTLFPFVNLFLIYNIFYKMQI

SEQ ID NO: 25748 - protein, 26 aa, artificial
  peptide fold or domain or sub-domain
LILLCIFLMYQNACTNICNFCTFIQI

SEQ ID NO: 25749 - protein, 17 aa, artificial
  peptide fold or domain or sub-domain
MYILIKIYYASMKFKNI

SEQ ID NO: 25750 - protein, 29 aa, artificial
  peptide fold or domain or sub-domain
KYFYSNLKNNTQISQIAQSSVNMPFFLSS

SEQ ID NO: 25751 - protein, 21 aa, artificial
  peptide fold or domain or sub-domain
MYTFMLQLIQNYHKNLFQFEY

SEQ ID NO: 25752 - protein, 30 aa, artificial
  peptide fold or domain or sub-domain
LICILLSNYNIIQPICEFYVYIYYFIFFFV

SEQ ID NO: 25753 - protein, 23 aa, artificial
  peptide fold or domain or sub-domain
MLLFGCLHGYFIFRLFPLHCKVV

SEQ ID NO: 25754 - protein, 23 aa, artificial
  peptide fold or domain or sub-domain
RTKKNRQPKNIFLSLLLYNNKYI

SEQ ID NO: 25755 - protein, 26 aa, artificial
  peptide fold or domain or sub-domain
GEWLSHKFLNNLHSVGYQKEMKKKST

SEQ ID NO: 25756 - protein, 28 aa, artificial
  peptide fold or domain or sub-domain
PTYMSYELLSDSCCIYSVAFVKKYSQNN

SEQ ID NO: 25757 - protein, 24 aa, artificial
  peptide fold or domain or sub-domain
DKIWPASHFLFYNLAILASFFFYS

SEQ ID NO: 25758 - protein, 29 aa, artificial
  peptide fold or domain or sub-domain
MTSRLCSLPILTLENCILQKIAYTTIAYM

SEQ ID NO: 25759 - protein, 28 aa, artificial
  peptide fold or domain or sub-domain
TINEYVYNAIFAIIFNYFGFILKLNGRI

SEQ ID NO: 25760 - protein, 29 aa, artificial
  peptide fold or domain or sub-domain
YPRNKKYAYWIIYNYSTLIFNRKNRRNNN

SEQ ID NO: 25761 - protein, 23 aa, artificial
  peptide fold or domain or sub-domain
EDPLFAGRNQNCGMKGSVRYIQF

SEQ ID NO: 25762 - protein, 30 aa, artificial
  peptide fold or domain or sub-domain
MFLKFSITPPDGDRESKLYYLYVIFFFKSG

SEQ ID NO: 25763 - protein, 24 aa, artificial
  peptide fold or domain or sub-domain
PFNNFLCNIFNTRTKLSAFYVKYV

SEQ ID NO: 25764 - protein, 19 aa, artificial
  peptide fold or domain or sub-domain
EIWMCNNIYTHVSMQSILG

SEQ ID NO: 25765 - protein, 27 aa, artificial
  peptide fold or domain or sub-domain
AWLNFFKTISSRPYIYFGLFKKKKNIF

SEQ ID NO: 25766 - protein, 19 aa, artificial
  peptide fold or domain or sub-domain
TVSIVFWSINTCNTDTVYI

SEQ ID NO: 25767 - protein, 27 aa, artificial
  peptide fold or domain or sub-domain
MLFFMFILRKKGVIKNNAIIPSNCKTP

SEQ ID NO: 25768 - protein, 22 aa, artificial
  peptide fold or domain or sub-domain
ECSLFVFLCIVNKKICINYKKK

SEQ ID NO: 25769 - protein, 21 aa, artificial
  peptide fold or domain or sub-domain
ELQKDKNGAVVKNYIFYTYFK

SEQ ID NO: 25770 - protein, 23 aa, artificial
  peptide fold or domain or sub-domain
NILSSISIIFPSNKFANTFPNQM

SEQ ID NO: 25771 - protein, 26 aa, artificial
  peptide fold or domain or sub-domain
MIILFWAEKEEKKYMHIIPALAYMYV

SEQ ID NO: 25772 - protein, 27 aa, artificial
  peptide fold or domain or sub-domain
YLQLFEYYIFFTFTYKFLLLKVATKVL

SEQ ID NO: 25773 - protein, 30 aa, artificial
  peptide fold or domain or sub-domain
MNNINNHPIAIKEVKNTISIIYLLHQANNS

SEQ ID NO: 25774 - protein, 20 aa, artificial
  peptide fold or domain or sub-domain
HDPTQRLGNMMLYLGKDQVK

SEQ ID NO: 25775 - protein, 29 aa, artificial
  peptide fold or domain or sub-domain
MFYIYHILINAFLFDIQEKKERRGITHLL

SEQ ID NO: 25776 - protein, 27 aa, artificial
  peptide fold or domain or sub-domain
HAEDVAKHVAKHVAKHVMWFHKTMSDT

SEQ ID NO: 25777 - protein, 25 aa, artificial
  peptide fold or domain or sub-domain
KFVNLKSKYVQNTRWKAHSNSRQHI

SEQ ID NO: 25778 - protein, 28 aa, artificial
  peptide fold or domain or sub-domain
KGKTTGEKIISNNMKLPIHKFYWVYILG

SEQ ID NO: 25779 - protein, 23 aa, artificial
  peptide fold or domain or sub-domain
SFHFIYNLIHLCVKFIYFKCVIR

SEQ ID NO: 25780 - protein, 28 aa, artificial
  peptide fold or domain or sub-domain
MIKMKGLIGFEWASAGGVGVQNKKKNVM

SEQ ID NO: 25781 - protein, 25 aa, artificial
  peptide fold or domain or sub-domain
FIIALIRFEEGKRKRETCIYDPMNT

SEQ ID NO: 25782 - protein, 24 aa, artificial
  peptide fold or domain or sub-domain
HKICECVKFCSKDIIFEFVIRTIA

SEQ ID NO: 25783 - protein, 25 aa, artificial
  peptide fold or domain or sub-domain
IIEIYVQLGCYIALEEEKHMTYFLF

SEQ ID NO: 25784 - protein, 21 aa, artificial
  peptide fold or domain or sub-domain
KSKNYLRLHQFLIFHLDPLKN

SEQ ID NO: 25785 - protein, 29 aa, artificial
  peptide fold or domain or sub-domain
MNIFMCNKEKRKNKKITAIIMRYIIIQGK

SEQ ID NO: 25786 - protein, 27 aa, artificial
  peptide fold or domain or sub-domain
MISLHEQVAIYYSQTIIKKKHKVKHIL

SEQ ID NO: 25787 - protein, 24 aa, artificial
  peptide fold or domain or sub-domain
HQKFLKIKIFTKYYHHCLYALISN

SEQ ID NO: 25788 - protein, 26 aa, artificial
  peptide fold or domain or sub-domain
ERFIFLHKKEDKMISRLHLIKQWVLQ

SEQ ID NO: 25789 - protein, 27 aa, artificial
  peptide fold or domain or sub-domain
NFVIMSKQVVYIIFLILFGCYVGYKLY

SEQ ID NO: 25790 - protein, 21 aa, artificial
  peptide fold or domain or sub-domain
LHKMITAITFYRYHYNIKINT

SEQ ID NO: 25791 - protein, 23 aa, artificial
  peptide fold or domain or sub-domain
ICKEGFHFILNKVIGKWAYNNML

SEQ ID NO: 25792 - protein, 30 aa, artificial
  peptide fold or domain or sub-domain
TVIISLYMRFGINYKMIHWNCSLHYNASSS

SEQ ID NO: 25793 - protein, 28 aa, artificial
  peptide fold or domain or sub-domain
TYYIFCLCIINYMKFVKICYSLFLTLTC

SEQ ID NO: 25794 - protein, 29 aa, artificial
  peptide fold or domain or sub-domain
MGVQQKCIYIIYICIYNIYVYEKGEGNNY

SEQ ID NO: 25795 - protein, 29 aa, artificial
  peptide fold or domain or sub-domain
LSNGYKKKITSRKAKLYILTPFYSLFFTA

SEQ ID NO: 25796 - protein, 25 aa, artificial
  peptide fold or domain or sub-domain
FLYNGVLFLQIMCAKVLFGIIFQNI

SEQ ID NO: 25797 - protein, 24 aa, artificial
  peptide fold or domain or sub-domain
KKDTKGIEGAHPDRDFYKSEYKPQ

SEQ ID NO: 25798 - protein, 26 aa, artificial
  peptide fold or domain or sub-domain
NSYILNSEEIRYSFETRSRLKMLEIE

SEQ ID NO: 25799 - protein, 20 aa, artificial
  peptide fold or domain or sub-domain
FYVSEHISVAYTHTYIIIYT

SEQ ID NO: 25800 - protein, 29 aa, artificial
  peptide fold or domain or sub-domain
MTQKIPLMMDPLPIWKMIFQKIDIEKSIQ

SEQ ID NO: 25801 - protein, 28 aa, artificial
  peptide fold or domain or sub-domain
KLILTLYFYILFIFFFLQIIMNIKHMKA

SEQ ID NO: 25802 - protein, 25 aa, artificial
  peptide fold or domain or sub-domain
TNKYTLYNHILYKQFNNNTRLRPPF

SEQ ID NO: 25803 - protein, 21 aa, artificial
  peptide fold or domain or sub-domain
YYNSEWKEKFFLCPLFMHTQM

SEQ ID NO: 25804 - protein, 24 aa, artificial
  peptide fold or domain or sub-domain
IMYIHTLTKTGKCTYFFFIFLYVG

SEQ ID NO: 25805 - protein, 24 aa, artificial
  peptide fold or domain or sub-domain
MRQHSIYFNVISYSMTYITNLFIL

SEQ ID NO: 25806 - protein, 25 aa, artificial
  peptide fold or domain or sub-domain
QIYVCKNAHYCIWVGYYFPSYLSIS

SEQ ID NO: 25807 - protein, 27 aa, artificial
  peptide fold or domain or sub-domain
MYLSHPLNYWIQIVYCLIEKYRMNSIG

SEQ ID NO: 25808 - protein, 26 aa, artificial
  peptide fold or domain or sub-domain
MILIFYFDYFLMFFWHICLYPNKLLI

SEQ ID NO: 25809 - protein, 28 aa, artificial
  peptide fold or domain or sub-domain
IHKKKKRKNFFCTLYVCVIFFGGKIGFS

SEQ ID NO: 25810 - protein, 26 aa, artificial
  peptide fold or domain or sub-domain
EIKDKLLNEIKFTQNEHTTKYLITYI

SEQ ID NO: 25811 - protein, 27 aa, artificial
  peptide fold or domain or sub-domain
MLYAFIRTHIIYIYLIYIYCSSTHTKK

SEQ ID NO: 25812 - protein, 22 aa, artificial
  peptide fold or domain or sub-domain
YAYIKYAFYLFFKNNASLYAQM

SEQ ID NO: 25813 - protein, 23 aa, artificial
  peptide fold or domain or sub-domain
HKSENNNMHYICANYYPRTNQFP

SEQ ID NO: 25814 - protein, 24 aa, artificial
  peptide fold or domain or sub-domain
MKKKSKYDLHTSMSYIHTYIIMHT

SEQ ID NO: 25815 - protein, 23 aa, artificial
  peptide fold or domain or sub-domain
VFFYLNHLCKCRGVERDIGNVYI

SEQ ID NO: 25816 - protein, 29 aa, artificial
  peptide fold or domain or sub-domain
MLLKKINISCKNESQINTNKKIIMMKLRL

SEQ ID NO: 25817 - protein, 29 aa, artificial
  peptide fold or domain or sub-domain
IYAIPYVMGCFINSKLSLIHYKNIKPVYS

SEQ ID NO: 25818 - protein, 30 aa, artificial
  peptide fold or domain or sub-domain
QLNEKSIYFINTIKPYAFIIFCLNTCLNVF

SEQ ID NO: 25819 - protein, 30 aa, artificial
  peptide fold or domain or sub-domain
KKITVFYFGIDFFFELCNRKKHPYIKFNLI

SEQ ID NO: 25820 - protein, 19 aa, artificial
  peptide fold or domain or sub-domain
WPSNVTLLFDAKFTSLFIG

SEQ ID NO: 25821 - protein, 23 aa, artificial
  peptide fold or domain or sub-domain
NYSSNFFFINIASTCDVIGLAIP

SEQ ID NO: 25822 - protein, 27 aa, artificial
  peptide fold or domain or sub-domain
NFNNYQQQFSLGKNIGISQIKIKFAGQ

SEQ ID NO: 25823 - protein, 22 aa, artificial
  peptide fold or domain or sub-domain
INHLRRYTFIYAKYIITKLLYI

SEQ ID NO: 25824 - protein, 27 aa, artificial
  peptide fold or domain or sub-domain
MRINTQPKWKPQKNYILFTYTYYTYDC

SEQ ID NO: 25825 - protein, 24 aa, artificial
  peptide fold or domain or sub-domain
CMHMPNAILCFYVTRGGEKYKGQK

SEQ ID NO: 25826 - protein, 28 aa, artificial
  peptide fold or domain or sub-domain
FLLNPKKAGTHINLSYCAHYIYVMAKVV

SEQ ID NO: 25827 - protein, 23 aa, artificial
  peptide fold or domain or sub-domain
DEKNYRKHDLSSYIFYHTIIMMR

SEQ ID NO: 25828 - protein, 30 aa, artificial
  peptide fold or domain or sub-domain
IAPIYFTGSLYIFILLIIKTNYVLNTCYKN

SEQ ID NO: 25829 - protein, 26 aa, artificial
  peptide fold or domain or sub-domain
IELTDLNSNSSNHNVKMTIDIQTKMA

SEQ ID NO: 25830 - protein, 28 aa, artificial
  peptide fold or domain or sub-domain
FLSMCKKNFFYLRMKISNSLFLYNFVDI

SEQ ID NO: 25831 - protein, 21 aa, artificial
  peptide fold or domain or sub-domain
KNNTNVFKLYNGKFHLAVVYI

SEQ ID NO: 25832 - protein, 22 aa, artificial
  peptide fold or domain or sub-domain
NAEHMKRVCTNTCNYLGEYVHK

SEQ ID NO: 25833 - protein, 25 aa, artificial
  peptide fold or domain or sub-domain
PYWHRVKKNMFYKYIINFKKIEYIK

SEQ ID NO: 25834 - protein, 23 aa, artificial
  peptide fold or domain or sub-domain
FHKSTDNYSLILKNRKGRRLQTQ

SEQ ID NO: 25835 - protein, 26 aa, artificial
  peptide fold or domain or sub-domain
MFTVKSTLFNDHTHCKSLMHPSFTYF

SEQ ID NO: 25836 - protein, 26 aa, artificial
  peptide fold or domain or sub-domain
FYSKNICVIMIYSYKNILNNAIFLCT

SEQ ID NO: 25837 - protein, 30 aa, artificial
  peptide fold or domain or sub-domain
KMKMMTTMTMILKRVDQMQKKIVTTKGLTN

SEQ ID NO: 25838 - protein, 25 aa, artificial
  peptide fold or domain or sub-domain
SLWIVTHFFSFPIIMHIVFIHLAYS

SEQ ID NO: 25839 - protein, 29 aa, artificial
  peptide fold or domain or sub-domain
EQIKKKLKTKLILNIFLLFHIRMCYIISC

SEQ ID NO: 25840 - protein, 28 aa, artificial
  peptide fold or domain or sub-domain
MLYNYSFYYIMMYLIYKHCVPSCSTFIM

SEQ ID NO: 25841 - protein, 27 aa, artificial
  peptide fold or domain or sub-domain
MYVHVNILFSISCFTICFNFKVNNFFL

SEQ ID NO: 25842 - protein, 17 aa, artificial
  peptide fold or domain or sub-domain
MNGANNKMRYTYMCVVK

SEQ ID NO: 25843 - protein, 29 aa, artificial
  peptide fold or domain or sub-domain
IIFCYYNYIFFYYFTLTSNKIKRHYVSFG

SEQ ID NO: 25844 - protein, 30 aa, artificial
  peptide fold or domain or sub-domain
KIYNVAYLIIILFIFSLKNYFIYFYSISYL

SEQ ID NO: 25845 - protein, 29 aa, artificial
  peptide fold or domain or sub-domain
MAKEKMKDMKQIIKLISYHYNGDQIKKIY

SEQ ID NO: 25846 - protein, 26 aa, artificial
  peptide fold or domain or sub-domain
MEILISYNIYNAHIWMPTYTHLHIFL

SEQ ID NO: 25847 - protein, 24 aa, artificial
  peptide fold or domain or sub-domain
LANIKFMACLCIFFSIYFFGVIKI

SEQ ID NO: 25848 - protein, 26 aa, artificial
  peptide fold or domain or sub-domain
TSKNWSNNITCHCMKSNSSNHRYHWK

SEQ ID NO: 25849 - protein, 28 aa, artificial
  peptide fold or domain or sub-domain
MVARRNMCDFMIKYKNSYTQQKTSKKLN

SEQ ID NO: 25850 - protein, 25 aa, artificial
  peptide fold or domain or sub-domain
KLYFYDIFLFALLINISQFLFKSIR

SEQ ID NO: 25851 - protein, 30 aa, artificial
  peptide fold or domain or sub-domain
FFICFFWFLPHLYSIYMSLIISSYRIRMYL

SEQ ID NO: 25852 - protein, 30 aa, artificial
  peptide fold or domain or sub-domain
AITPYPYIFFLIYKTGNVCFFCFFGDFINI

SEQ ID NO: 25853 - protein, 26 aa, artificial
  peptide fold or domain or sub-domain
FFCKIASFYPEEMLKNGQLISMKNTL

SEQ ID NO: 25854 - protein, 26 aa, artificial
  peptide fold or domain or sub-domain
MSKQLYANTIIVISFHFKYKTYFIVF

SEQ ID NO: 25855 - protein, 21 aa, artificial
  peptide fold or domain or sub-domain
NVANCYDMIRNVLPRNKCNEI

SEQ ID NO: 25856 - protein, 24 aa, artificial
  peptide fold or domain or sub-domain
IDGYNSIYHECMIGTVFKCEFLPT

SEQ ID NO: 25857 - protein, 26 aa, artificial
  peptide fold or domain or sub-domain
GYNRVINHQGLTVKSLGSIHQTLAGK

SEQ ID NO: 25858 - protein, 30 aa, artificial
  peptide fold or domain or sub-domain
TVRYFFNRTALFVIYRYLCIFSCHILIHFL

SEQ ID NO: 25859 - protein, 28 aa, artificial
  peptide fold or domain or sub-domain
MNFPLYYYCYLFFFMDMFLINLRLLKNS

SEQ ID NO: 25860 - protein, 29 aa, artificial
  peptide fold or domain or sub-domain
TPICHTYRQVASTMIRNKKEDKSKFLIRN

SEQ ID NO: 25861 - protein, 23 aa, artificial
  peptide fold or domain or sub-domain
LALQNDTQPFQLLFWVQLVNVAS

SEQ ID NO: 25862 - protein, 26 aa, artificial
  peptide fold or domain or sub-domain
LINCILQTVSKTNFKEQNTNNKDKRK

SEQ ID NO: 25863 - protein, 29 aa, artificial
  peptide fold or domain or sub-domain
IKFRSLKQKLHGQKIVKKRGEIIIYFSVI

SEQ ID NO: 25864 - protein, 29 aa, artificial
  peptide fold or domain or sub-domain
KKIFVKKEREANSSHALLNNLSTKNMKKN

SEQ ID NO: 25865 - protein, 23 aa, artificial
  peptide fold or domain or sub-domain
NNTLELLVFFIMLYCFKYPMCIT

SEQ ID NO: 25866 - protein, 25 aa, artificial
  peptide fold or domain or sub-domain
VKYGYKTILDNSFADPNVYINNFIL

SEQ ID NO: 25867 - protein, 23 aa, artificial
  peptide fold or domain or sub-domain
RKPVCDRTYNIYTYFISLKWTIF

SEQ ID NO: 25868 - protein, 28 aa, artificial
  peptide fold or domain or sub-domain
IYLYAYFISCTYYCNILFIGILCVFLSP

SEQ ID NO: 25869 - protein, 29 aa, artificial
  peptide fold or domain or sub-domain
KRGVIYMCVNLNDHTMFGFIFMRFFLFDF

SEQ ID NO: 25870 - protein, 30 aa, artificial
  peptide fold or domain or sub-domain
LFLYGCYIFFFIQFIITFLVNVIIHIYGYA

SEQ ID NO: 25871 - protein, 28 aa, artificial
  peptide fold or domain or sub-domain
LNKVYLLIIIRFYIENKNVFFRFLNKII

SEQ ID NO: 25872 - protein, 27 aa, artificial
  peptide fold or domain or sub-domain
QTRHNICSIYEQPFLKNDNCGDINEIL

SEQ ID NO: 25873 - protein, 29 aa, artificial
  peptide fold or domain or sub-domain
MMNIYISIFFMYYSYILIFFFYLHVKLFN

SEQ ID NO: 25874 - protein, 26 aa, artificial
  peptide fold or domain or sub-domain
IFILFNTTKYALRLNKYIKQNYDTFI

SEQ ID NO: 25875 - protein, 23 aa, artificial
  peptide fold or domain or sub-domain
MCSPFLMITYVSIWYCIFKWFYL

SEQ ID NO: 25876 - protein, 30 aa, artificial
  peptide fold or domain or sub-domain
MTRGNLLLFFDFFNSRVIRKHYYISYTEIS

SEQ ID NO: 25877 - protein, 26 aa, artificial
  peptide fold or domain or sub-domain
YWNCYNFVPYYLLINFLFAIIRKFIY

SEQ ID NO: 25878 - protein, 23 aa, artificial
  peptide fold or domain or sub-domain
SFKIGFIESEPQNKRYQLNLSYK

SEQ ID NO: 25879 - protein, 29 aa, artificial
  peptide fold or domain or sub-domain
NYGKYLIPPFYNNEYSPLEGAYLRHHLKD

SEQ ID NO: 25880 - protein, 28 aa, artificial
  peptide fold or domain or sub-domain
HYLGCHFSNDGLCGIRKNTMINLRKTKN

SEQ ID NO: 25881 - protein, 30 aa, artificial
  peptide fold or domain or sub-domain
HVDDFMFMNNQNEHNEFNNMSIYKRKIINK

SEQ ID NO: 25882 - protein, 30 aa, artificial
  peptide fold or domain or sub-domain
KSNLTNLFDIYNCFASHNAGIYIRKQYRNE

SEQ ID NO: 25883 - protein, 25 aa, artificial
  peptide fold or domain or sub-domain
INVFSIKKINKIIFLVQNYAYCLHA

SEQ ID NO: 25884 - protein, 25 aa, artificial
  peptide fold or domain or sub-domain
DEFNRSIVSNEDNCLVSIHHIILYM

SEQ ID NO: 25885 - protein, 29 aa, artificial
  peptide fold or domain or sub-domain
MLNPTKSIAYVNFFFRHLHCKYYERVHNF

SEQ ID NO: 25886 - protein, 26 aa, artificial
  peptide fold or domain or sub-domain
NMYKSNVHKSIIFYISYSGLKIINTI

SEQ ID NO: 25887 - protein, 27 aa, artificial
  peptide fold or domain or sub-domain
MNGKVSICEYASFSLTTFYFYFPTICA

SEQ ID NO: 25888 - protein, 30 aa, artificial
  peptide fold or domain or sub-domain
MTSELLDTALWILFELICSYLITFVGLCYF

SEQ ID NO: 25889 - protein, 24 aa, artificial
  peptide fold or domain or sub-domain
CVCKHTNTCIDACENTFYVFIYDN

SEQ ID NO: 25890 - protein, 27 aa, artificial
  peptide fold or domain or sub-domain
VYRYVCWHVATVRTSYFVPSLKKKKIK

SEQ ID NO: 25891 - protein, 27 aa, artificial
  peptide fold or domain or sub-domain
YWKIIIFNKSAFPLEYYFIFYGKSRKK

SEQ ID NO: 25892 - protein, 20 aa, artificial
  peptide fold or domain or sub-domain
NMQQILLRLQFTNTPKHSNF

SEQ ID NO: 25893 - protein, 25 aa, artificial
  peptide fold or domain or sub-domain
YVHKNKNSKHFIFFNIITVKKKCNA

SEQ ID NO: 25894 - protein, 29 aa, artificial
  peptide fold or domain or sub-domain
DADRHIYSNLKMFIKKYIKQINSKTIYIV

SEQ ID NO: 25895 - protein, 18 aa, artificial
  peptide fold or domain or sub-domain
SNIFYFSVYAHKTEVKMG

SEQ ID NO: 25896 - protein, 24 aa, artificial
  peptide fold or domain or sub-domain
QNENFTKNMKLVLYVNISFQIFFL

SEQ ID NO: 25897 - protein, 25 aa, artificial
  peptide fold or domain or sub-domain
IILLYNTNSLHAYINKNHKKYVTKN

SEQ ID NO: 25898 - protein, 28 aa, artificial
  peptide fold or domain or sub-domain
EPFQQHHIYADHNNINIFFNCTYEFSYL

SEQ ID NO: 25899 - protein, 26 aa, artificial
  peptide fold or domain or sub-domain
HTSRVSLLEEIILGNLPTPFPYFIFL

SEQ ID NO: 25900 - protein, 27 aa, artificial
  peptide fold or domain or sub-domain
KLYVYKGNINIILCTRVQCDITYSSTS

SEQ ID NO: 25901 - protein, 26 aa, artificial
  peptide fold or domain or sub-domain
YNYFFICILNLHNLYIAICIYKKNYV

SEQ ID NO: 25902 - protein, 25 aa, artificial
  peptide fold or domain or sub-domain
LPTFLLTSNVVPPPLNHKGTWEKNI

SEQ ID NO: 25903 - protein, 21 aa, artificial
  peptide fold or domain or sub-domain
MSFLKIAFHNMTNKNVSKKAL

SEQ ID NO: 25904 - protein, 29 aa, artificial
  peptide fold or domain or sub-domain
MCIIKTKLMTFIYNTISKNAYTIFSAIIM

SEQ ID NO: 25905 - protein, 30 aa, artificial
  peptide fold or domain or sub-domain
MTTHKCVPIKKYTFLHDHFFFFNKMLIKKL

SEQ ID NO: 25906 - protein, 24 aa, artificial
  peptide fold or domain or sub-domain
MYVDAFLQLCFVYFINSFLNVDIN

SEQ ID NO: 25907 - protein, 30 aa, artificial
  peptide fold or domain or sub-domain
KAFIHNKLNECMYIYINKLTNKPRNISLQQ

SEQ ID NO: 25908 - protein, 27 aa, artificial
  peptide fold or domain or sub-domain
HNITLFKEYNRKIIKINRYKQINFFTI

SEQ ID NO: 25909 - protein, 30 aa, artificial
  peptide fold or domain or sub-domain
FYVVALAITNNMHLIFYLTLILCNQSLSYK

SEQ ID NO: 25910 - protein, 23 aa, artificial
  peptide fold or domain or sub-domain
KYIYPFVFLKNTKGMRDLNSYLF

SEQ ID NO: 25911 - protein, 28 aa, artificial
  peptide fold or domain or sub-domain
MYLLCNISGLYLHVLYSSEQKYVMSELN

SEQ ID NO: 25912 - protein, 24 aa, artificial
  peptide fold or domain or sub-domain
MTMLHFLFYTYMLPFPLIFSFYDT

SEQ ID NO: 25913 - protein, 27 aa, artificial
  peptide fold or domain or sub-domain
LIVIKDLTVLDRLQKCLEYIFAVPIHS

SEQ ID NO: 25914 - protein, 26 aa, artificial
  peptide fold or domain or sub-domain
MTNAILYSQTILLTRLYLSYKQLFIY

SEQ ID NO: 25915 - protein, 25 aa, artificial
  peptide fold or domain or sub-domain
KIMKYICEYIYLIFGVCIKIFFSFF

SEQ ID NO: 25916 - protein, 22 aa, artificial
  peptide fold or domain or sub-domain
VKNQRLNTEVRVMCDGVDDPQL

SEQ ID NO: 25917 - protein, 29 aa, artificial
  peptide fold or domain or sub-domain
MHTKFIYKEKRKREKNYIIYIYMFPFLGT

SEQ ID NO: 25918 - protein, 23 aa, artificial
  peptide fold or domain or sub-domain
MGQVYIISLNYCSELYRYVHKSF

SEQ ID NO: 25919 - protein, 25 aa, artificial
  peptide fold or domain or sub-domain
KKKKIHMLILLKIASYTHVHIIRNS

SEQ ID NO: 25920 - protein, 24 aa, artificial
  peptide fold or domain or sub-domain
MYIYMLEAFIVFTVCLFFMKLKKM

SEQ ID NO: 25921 - protein, 25 aa, artificial
  peptide fold or domain or sub-domain
PKYLPIMLWLFFFHIKRYKITQKNV

SEQ ID NO: 25922 - protein, 25 aa, artificial
  peptide fold or domain or sub-domain
MAYSSNKHPDHSFFYLFVRFFFYIS

SEQ ID NO: 25923 - protein, 25 aa, artificial
  peptide fold or domain or sub-domain
SLFKMGIALYLYTFPNIMPIISNVS

SEQ ID NO: 25924 - protein, 24 aa, artificial
  peptide fold or domain or sub-domain
WSTINNIFVYTYTHNTFFKKQAEI

SEQ ID NO: 25925 - protein, 30 aa, artificial
  peptide fold or domain or sub-domain
MQCIIKFVLSLFFIYYMQKKWEQKLYANFN

SEQ ID NO: 25926 - protein, 23 aa, artificial
  peptide fold or domain or sub-domain
YDIQQSRTVTNYKNKDYIFILYL

SEQ ID NO: 25927 - protein, 24 aa, artificial
  peptide fold or domain or sub-domain
KEENDVKINKPTVGFEAKSLKIRR

SEQ ID NO: 25928 - protein, 26 aa, artificial
  peptide fold or domain or sub-domain
HSYNGIIVTICICKIAATFLLPLMLK

SEQ ID NO: 25929 - protein, 15 aa, artificial
  peptide fold or domain or sub-domain
LIRIFHFPTVHYIYP

SEQ ID NO: 25930 - protein, 25 aa, artificial
  peptide fold or domain or sub-domain
WAYKNEDTELNTKTMVKNISYRRTT

SEQ ID NO: 25931 - protein, 25 aa, artificial
  peptide fold or domain or sub-domain
NKEGGISCSLKKKYICILYIYCANY

SEQ ID NO: 25932 - protein, 29 aa, artificial
  peptide fold or domain or sub-domain
HNMFPFLNSYPLVYYNFASASKKKKVTHL

SEQ ID NO: 25933 - protein, 30 aa, artificial
  peptide fold or domain or sub-domain
KCVCVDDFVKFYVFKKKKNNIGYSYIILYL

SEQ ID NO: 25934 - protein, 30 aa, artificial
  peptide fold or domain or sub-domain
RLGRIGTIIDLRKKMNKYIKYVNILRVNII

SEQ ID NO: 25935 - protein, 29 aa, artificial
  peptide fold or domain or sub-domain
DYNKLKTKCTAKLIILYNYQTLQHKEQQN

SEQ ID NO: 25936 - protein, 29 aa, artificial
  peptide fold or domain or sub-domain
KKKFISRYRKLRETYIPTNIHMYRWNKIR

SEQ ID NO: 25937 - protein, 24 aa, artificial
  peptide fold or domain or sub-domain
MVEEYIKIYSNLIILAFYLRFYNF

SEQ ID NO: 25938 - protein, 26 aa, artificial
  peptide fold or domain or sub-domain
MPLLIFFYPYFSFSRFLTNLIYNISI

SEQ ID NO: 25939 - protein, 25 aa, artificial
  peptide fold or domain or sub-domain
IVSCMPFYRRIKNVPPKGSKYTGTA

SEQ ID NO: 25940 - protein, 29 aa, artificial
  peptide fold or domain or sub-domain
MWINKIGNKSASFINHKHFHPGTYLYINT

SEQ ID NO: 25941 - protein, 26 aa, artificial
  peptide fold or domain or sub-domain
VNTLKKFMTPSPQYSLFICRTCICIN

SEQ ID NO: 25942 - protein, 22 aa, artificial
  peptide fold or domain or sub-domain
CFIAIIDIINFLVSQNYKNVSS

SEQ ID NO: 25943 - protein, 30 aa, artificial
  peptide fold or domain or sub-domain
LYYYMTWFNYKISPHPLGNFLFLKINSKIL

SEQ ID NO: 25944 - protein, 25 aa, artificial
  peptide fold or domain or sub-domain
FHYPSQLFRTTDYLKIPKKKKKYTQ

SEQ ID NO: 25945 - protein, 23 aa, artificial
  peptide fold or domain or sub-domain
MLKNICTCFKNFYPYYCTYICPL

SEQ ID NO: 25946 - protein, 28 aa, artificial
  peptide fold or domain or sub-domain
VFARRAVLCVHLNVYVHNLYFHIFILVN

SEQ ID NO: 25947 - protein, 25 aa, artificial
  peptide fold or domain or sub-domain
PNINCYPNCSKRVCVSSLDTLNALI

SEQ ID NO: 25948 - protein, 25 aa, artificial
  peptide fold or domain or sub-domain
PFFSLFFMNKWICIEKMIAQRYYIV

SEQ ID NO: 25949 - protein, 24 aa, artificial
  peptide fold or domain or sub-domain
YFTRKFKNKYFYILIRLYIQYPRA

SEQ ID NO: 25950 - protein, 27 aa, artificial
  peptide fold or domain or sub-domain
RPINAPFDMGLSILILNKDHGSPIDKF

SEQ ID NO: 25951 - protein, 20 aa, artificial
  peptide fold or domain or sub-domain
DYMYVYFSVYIPFQKIINNT

SEQ ID NO: 25952 - protein, 29 aa, artificial
  peptide fold or domain or sub-domain
SFLIFITFFIYHPVQVATSKGIVLTVILV

SEQ ID NO: 25953 - protein, 30 aa, artificial
  peptide fold or domain or sub-domain
YENNFFRFIIFFIFIFIKVAIITVPLCATV

SEQ ID NO: 25954 - protein, 28 aa, artificial
  peptide fold or domain or sub-domain
MKNIDRNQLTIKIAPFIRDFDNFDNFDK

SEQ ID NO: 25955 - protein, 26 aa, artificial
  peptide fold or domain or sub-domain
IVYSNKICLSVIFRICFFRSLFLIIK

SEQ ID NO: 25956 - protein, 25 aa, artificial
  peptide fold or domain or sub-domain
VIKLNFIKHTQHVSVPFLVIRMCIL

SEQ ID NO: 25957 - protein, 26 aa, artificial
  peptide fold or domain or sub-domain
GWCFFPFICIYGEKLFKHPLKNIKVY

SEQ ID NO: 25958 - protein, 30 aa, artificial
  peptide fold or domain or sub-domain
FLQQKKQLTISVNTSNDAKKLYYIYSYLFL

SEQ ID NO: 25959 - protein, 27 aa, artificial
  peptide fold or domain or sub-domain
NIDIYFYNWEIVLAGPQNITSDYMLFI

SEQ ID NO: 25960 - protein, 18 aa, artificial
  peptide fold or domain or sub-domain
SIMGGIRYKHCIEINQFV

SEQ ID NO: 25961 - protein, 30 aa, artificial
  peptide fold or domain or sub-domain
EYLANGSFLCLINKQIYIYVFIYICINVYV

SEQ ID NO: 25962 - protein, 23 aa, artificial
  peptide fold or domain or sub-domain
MSLWWRTPLQCALCSPYHIVLRM

SEQ ID NO: 25963 - protein, 24 aa, artificial
  peptide fold or domain or sub-domain
MDIQFITYCVQLSTPFCACILIVG

SEQ ID NO: 25964 - protein, 23 aa, artificial
  peptide fold or domain or sub-domain
NTHKNNTTIYINMHTHIYKTYKF

SEQ ID NO: 25965 - protein, 27 aa, artificial
  peptide fold or domain or sub-domain
YIIAHYFKHITLKRYTPILSSFLIYML

SEQ ID NO: 25966 - protein, 30 aa, artificial
  peptide fold or domain or sub-domain
MALYIEYSFKFIVKREKRKNMATALFICVS

SEQ ID NO: 25967 - protein, 25 aa, artificial
  peptide fold or domain or sub-domain
EETNYINSFEKKYVKRVNGIIIVNI

SEQ ID NO: 25968 - protein, 26 aa, artificial
  peptide fold or domain or sub-domain
YQKGRRYYRQSFKGRLQISYQQHRHN

SEQ ID NO: 25969 - protein, 25 aa, artificial
  peptide fold or domain or sub-domain
QCFTRISNLYTYFFFHLIELKMGDY

SEQ ID NO: 25970 - protein, 28 aa, artificial
  peptide fold or domain or sub-domain
NFFLHFLYSMIITNLMSNNKKNINKIMT

SEQ ID NO: 25971 - protein, 30 aa, artificial
  peptide fold or domain or sub-domain
VESMIEYALNISKETKRKKEKKQYDNIVSS

SEQ ID NO: 25972 - protein, 29 aa, artificial
  peptide fold or domain or sub-domain
MRLFVVISRNVQNEIWQILWKHMYCFPKS

SEQ ID NO: 25973 - protein, 23 aa, artificial
  peptide fold or domain or sub-domain
QMIEIKIVKYVPNGKAIHLIFLK

SEQ ID NO: 25974 - protein, 29 aa, artificial
  peptide fold or domain or sub-domain
TYLYVLWLQFDEYSSLQPSINSFFIFENI

SEQ ID NO: 25975 - protein, 24 aa, artificial
  peptide fold or domain or sub-domain
FYLNVNSFIKILVLRKYLDRVKLF

SEQ ID NO: 25976 - protein, 29 aa, artificial
  peptide fold or domain or sub-domain
MNTQNTSMHSPHVIYIHIIYKRERAKKYN

SEQ ID NO: 25977 - protein, 23 aa, artificial
  peptide fold or domain or sub-domain
GCSLRICTYIHIHSVNRKINNKL

SEQ ID NO: 25978 - protein, 24 aa, artificial
  peptide fold or domain or sub-domain
MAIVNISELCSIGKGTFKFEKKYK

SEQ ID NO: 25979 - protein, 30 aa, artificial
  peptide fold or domain or sub-domain
NLIFYKNMLIYFTMHIYKQCKDKNICSPLF

SEQ ID NO: 25980 - protein, 23 aa, artificial
  peptide fold or domain or sub-domain
NIIMNMINVLFSNFSKSVKTEEE

SEQ ID NO: 25981 - protein, 25 aa, artificial
  peptide fold or domain or sub-domain
AINKKNIFFQKPYFSSKINKFFYKG

SEQ ID NO: 25982 - protein, 30 aa, artificial
  peptide fold or domain or sub-domain
IIRALLYDYLFFLWKIMKFDSMNKYSFIWS

SEQ ID NO: 25983 - protein, 23 aa, artificial
  peptide fold or domain or sub-domain
IEKKRDEYGAYTKNSVKNLTLIF

SEQ ID NO: 25984 - protein, 24 aa, artificial
  peptide fold or domain or sub-domain
MLLIYMKVSHVLLILYVHTNQWKK

SEQ ID NO: 25985 - protein, 26 aa, artificial
  peptide fold or domain or sub-domain
MCIPSLYIWNNIICIYILPFHLFLLM

SEQ ID NO: 25986 - protein, 30 aa, artificial
  peptide fold or domain or sub-domain
HEIFVYVYISHVCTIIYKILSVVYFLKLNL

SEQ ID NO: 25987 - protein, 30 aa, artificial
  peptide fold or domain or sub-domain
EAYEINYSPHVPAYIYMNFFIIILWIGLPT

SEQ ID NO: 25988 - protein, 20 aa, artificial
  peptide fold or domain or sub-domain
MARHFLFNLHLVCFRFGTCK

SEQ ID NO: 25989 - protein, 21 aa, artificial
  peptide fold or domain or sub-domain
PNWYCCNLFIKYFFFHKLYIL

SEQ ID NO: 25990 - protein, 30 aa, artificial
  peptide fold or domain or sub-domain
MYVLIITTLLCIYKIYYDFYALKKSSEQIC

SEQ ID NO: 25991 - protein, 23 aa, artificial
  peptide fold or domain or sub-domain
SFDFIQDRMVLRKYIKKFQNVNV

SEQ ID NO: 25992 - protein, 26 aa, artificial
  peptide fold or domain or sub-domain
NELANMLYLFYISNGFQRENKIARLY

SEQ ID NO: 25993 - protein, 29 aa, artificial
  peptide fold or domain or sub-domain
IVLIFFYFIFFMSKYIPLLYICVGYCFGH

SEQ ID NO: 25994 - protein, 30 aa, artificial
  peptide fold or domain or sub-domain
DRNIFINKYIYIQYFKFGNEPTIKMHISFL

SEQ ID NO: 25995 - protein, 29 aa, artificial
  peptide fold or domain or sub-domain
IQFKGTIGGINRLFIFASHIYTNMQKKKY

SEQ ID NO: 25996 - protein, 24 aa, artificial
  peptide fold or domain or sub-domain
MHISKNDKPLIFYVSYLSINLLKS

SEQ ID NO: 25997 - protein, 30 aa, artificial
  peptide fold or domain or sub-domain
KKYNNYLDIELYKIMYNWIIYVVDLFTKIK

SEQ ID NO: 25998 - protein, 29 aa, artificial
  peptide fold or domain or sub-domain
LYFMVDPFLLWCFIKILLSYIYNPIKKGD

SEQ ID NO: 25999 - protein, 30 aa, artificial
  peptide fold or domain or sub-domain
MFRIRQTQEKILFTASMGGTKKSQKNVRKK

SEQ ID NO: 26000 - protein, 26 aa, artificial
  peptide fold or domain or sub-domain
NENMKNIPKKHIIYYFYATFTYTLKF

SEQ ID NO: 26001 - protein, 25 aa, artificial
  peptide fold or domain or sub-domain
MGMHYAIATHFKGITNSDIHKNVKK

SEQ ID NO: 26002 - protein, 29 aa, artificial
  peptide fold or domain or sub-domain
NKRNINKHQNMRICLNSLYSCIVFLLYSV

SEQ ID NO: 26003 - protein, 27 aa, artificial
  peptide fold or domain or sub-domain
GEKHGTNLHWISLLFIISCWHSNFSYY

SEQ ID NO: 26004 - protein, 29 aa, artificial
  peptide fold or domain or sub-domain
KKNNYIVIHYFLFNAVVINVNTSLGNKEY

SEQ ID NO: 26005 - protein, 26 aa, artificial
  peptide fold or domain or sub-domain
MKMVNAFRDEIKMIFPFAPYEVRKKK

SEQ ID NO: 26006 - protein, 23 aa, artificial
  peptide fold or domain or sub-domain
LFVYIKKIMLITTLRVQIMKLLN

SEQ ID NO: 26007 - protein, 26 aa, artificial
  peptide fold or domain or sub-domain
MIIANESSYNSYPSPIYNAIITVQLV

SEQ ID NO: 26008 - protein, 26 aa, artificial
  peptide fold or domain or sub-domain
MYIGRKAIAKCSLKVFFRNVFFVNFC

SEQ ID NO: 26009 - protein, 27 aa, artificial
  peptide fold or domain or sub-domain
SIFFKHLLIFVILYYFPEHVHVNLLFL

SEQ ID NO: 26010 - protein, 24 aa, artificial
  peptide fold or domain or sub-domain
MDFFVENNNPSIYTMIGTKIRCKK

SEQ ID NO: 26011 - protein, 25 aa, artificial
  peptide fold or domain or sub-domain
KIVNTFYYFLKVEAINKYIFYINII

SEQ ID NO: 26012 - protein, 25 aa, artificial
  peptide fold or domain or sub-domain
MNLSYFFYENCCFCIYTSFYEILKC

SEQ ID NO: 26013 - protein, 25 aa, artificial
  peptide fold or domain or sub-domain
FMSIACGFSFDIIYWTNRTYKQATY

SEQ ID NO: 26014 - protein, 27 aa, artificial
  peptide fold or domain or sub-domain
LNIFDSHNYSCLFYKALFSHNYRCSIK

SEQ ID NO: 26015 - protein, 26 aa, artificial
  peptide fold or domain or sub-domain
MAKNPTKSSPKKCGNIICSKFVMALH

SEQ ID NO: 26016 - protein, 29 aa, artificial
  peptide fold or domain or sub-domain
MKKKKQKKNLWVFYDFSISYLTVLINEVN

SEQ ID NO: 26017 - protein, 28 aa, artificial
  peptide fold or domain or sub-domain
GLKFKNFAFIYCFTYCHYYCVHSLIYWH

SEQ ID NO: 26018 - protein, 28 aa, artificial
  peptide fold or domain or sub-domain
IGIPPIICAYLHKTYNFKTLCSKIENAK

SEQ ID NO: 26019 - protein, 26 aa, artificial
  peptide fold or domain or sub-domain
NFLDAFTYLPSIYKIYGWNILYFKTK

SEQ ID NO: 26020 - protein, 26 aa, artificial
  peptide fold or domain or sub-domain
WHFITFILFHNNIYLNYFKVCIYIIT

SEQ ID NO: 26021 - protein, 30 aa, artificial
  peptide fold or domain or sub-domain
MCRRFNLLILIKKHFKVCNNIFFVLILFSI

SEQ ID NO: 26022 - protein, 27 aa, artificial
  peptide fold or domain or sub-domain
ACIIKMGVTNLLEWIKNNKKQKNLRYL

SEQ ID NO: 26023 - protein, 29 aa, artificial
  peptide fold or domain or sub-domain
LIYHADSMLNIYYTVGGDYIFIYYFFRLI

SEQ ID NO: 26024 - protein, 28 aa, artificial
  peptide fold or domain or sub-domain
TFNLCTLEVGKKGSIIHIYIFVFCFDEL

SEQ ID NO: 26025 - protein, 23 aa, artificial
  peptide fold or domain or sub-domain
PYMHIKDNFAEYMCANIRAYMQT

SEQ ID NO: 26026 - protein, 27 aa, artificial
  peptide fold or domain or sub-domain
MFCSFIFLYASINMIFYFKDVLQCFNS

SEQ ID NO: 26027 - protein, 26 aa, artificial
  peptide fold or domain or sub-domain
ILSHKHHFLSRIFVINMIHRKSAYNA

SEQ ID NO: 26028 - protein, 25 aa, artificial
  peptide fold or domain or sub-domain
FIHLKYFEINHKWNNVTNIKKYTCI

SEQ ID NO: 26029 - protein, 25 aa, artificial
  peptide fold or domain or sub-domain
YFFFKIKLPYTVGKPFHFQNFLSTW

SEQ ID NO: 26030 - protein, 22 aa, artificial
  peptide fold or domain or sub-domain
DCAFKTWKKATNNSMHTNNSKY

SEQ ID NO: 26031 - protein, 30 aa, artificial
  peptide fold or domain or sub-domain
MDNTWRCEACLVENSTNAEECECCMQKRGS

SEQ ID NO: 26032 - protein, 23 aa, artificial
  peptide fold or domain or sub-domain
QVSLICVKICIINFFLFLASLFF

SEQ ID NO: 26033 - protein, 26 aa, artificial
  peptide fold or domain or sub-domain
MLNYYFRYIKCSVLILFSFTPVNIVP

SEQ ID NO: 26034 - protein, 26 aa, artificial
  peptide fold or domain or sub-domain
KKKQTSFFVTIFQWYTFYFTPHSNIK

SEQ ID NO: 26035 - protein, 27 aa, artificial
  peptide fold or domain or sub-domain
HIKKTLIQICFIFFWETFLKLYKCLYK

SEQ ID NO: 26036 - protein, 24 aa, artificial
  peptide fold or domain or sub-domain
HSLFNDNTENPIIDRRSQVKGASY

SEQ ID NO: 26037 - protein, 27 aa, artificial
  peptide fold or domain or sub-domain
CYYILYTITHIMYYKNLKLKKLINMCY

SEQ ID NO: 26038 - protein, 27 aa, artificial
  peptide fold or domain or sub-domain
HTKNEFFYLKQKSGYAHVYIENRDDAA

SEQ ID NO: 26039 - protein, 29 aa, artificial
  peptide fold or domain or sub-domain
LVNSKMADFLKLKLRMKSVTFSTYTYIYI

SEQ ID NO: 26040 - protein, 29 aa, artificial
  peptide fold or domain or sub-domain
RFSEKQTPFWKKLLIFIKHITAIGVIIQT

SEQ ID NO: 26041 - protein, 27 aa, artificial
  peptide fold or domain or sub-domain
MGNNRSIIVLTHFHWIINADTFTINIG

SEQ ID NO: 26042 - protein, 28 aa, artificial
  peptide fold or domain or sub-domain
SNKIGFIKCKLCCTAPKLIDHSNQRVQL

SEQ ID NO: 26043 - protein, 27 aa, artificial
  peptide fold or domain or sub-domain
MGNTQKIIFTINNIRIYKRNKGMRKIL

SEQ ID NO: 26044 - protein, 30 aa, artificial
  peptide fold or domain or sub-domain
YKDIITLTSFYHLQWIFPTKHIFHYGRNAM

SEQ ID NO: 26045 - protein, 26 aa, artificial
  peptide fold or domain or sub-domain
MQYNKHMYELNTIYNNILSKGYNLKI

SEQ ID NO: 26046 - protein, 28 aa, artificial
  peptide fold or domain or sub-domain
LKYTPLNTPTKYASLNTLFVSSIRYQYA

SEQ ID NO: 26047 - protein, 23 aa, artificial
  peptide fold or domain or sub-domain
FSIYIMKNSSHIYMYLHFINKKT

SEQ ID NO: 26048 - protein, 26 aa, artificial
  peptide fold or domain or sub-domain
IKIGKFLFRNSILFCLRRIIHIGRCN

SEQ ID NO: 26049 - protein, 30 aa, artificial
  peptide fold or domain or sub-domain
QSYKWESIENVHIFYIKNKTMIFFKKIVIN

SEQ ID NO: 26050 - protein, 18 aa, artificial
  peptide fold or domain or sub-domain
MNHKHYMLCTFFTFWVMP

SEQ ID NO: 26051 - protein, 27 aa, artificial
  peptide fold or domain or sub-domain
MLFDLNLEKLLENTICHKQYCGVIELS

SEQ ID NO: 26052 - protein, 23 aa, artificial
  peptide fold or domain or sub-domain
KEKQRSDSIDQKFHPAHHLLTII

SEQ ID NO: 26053 - protein, 29 aa, artificial
  peptide fold or domain or sub-domain
RPNTFYKAPKNIRLYIFMVQLFYKLSKMS

SEQ ID NO: 26054 - protein, 27 aa, artificial
  peptide fold or domain or sub-domain
YTFFSFQPIHISPSHFYIIVNKSKLKN

SEQ ID NO: 26055 - protein, 30 aa, artificial
  peptide fold or domain or sub-domain
NIYIIIAFVLSTILFVLYLFLYFFFNGYFI

SEQ ID NO: 26056 - protein, 25 aa, artificial
  peptide fold or domain or sub-domain
DNILISVEDKVIRKEKTDSYPFICA

SEQ ID NO: 26057 - protein, 22 aa, artificial
  peptide fold or domain or sub-domain
MNFKFFTKIYTTVCCCIYLFVD

SEQ ID NO: 26058 - protein, 30 aa, artificial
  peptide fold or domain or sub-domain
MVKCIRMNAYIHKNVLFVAQYNIFPVFSKY

SEQ ID NO: 26059 - protein, 26 aa, artificial
  peptide fold or domain or sub-domain
GKKNYILYTFIYFYFLIAYNICIMHI

SEQ ID NO: 26060 - protein, 24 aa, artificial
  peptide fold or domain or sub-domain
MYQYSILFFYLNYFSSIKIFCTHS

SEQ ID NO: 26061 - protein, 27 aa, artificial
  peptide fold or domain or sub-domain
YNLYRDPFPIQFIFYNFVQIIRQSYFI

SEQ ID NO: 26062 - protein, 30 aa, artificial
  peptide fold or domain or sub-domain
MYGLYIYDLFQNVVICISSWKDSEFILINF

SEQ ID NO: 26063 - protein, 28 aa, artificial
  peptide fold or domain or sub-domain
NDDVFFKSFMTQQNTCTLQKGEHAKYTY

SEQ ID NO: 26064 - protein, 23 aa, artificial
  peptide fold or domain or sub-domain
KYVKRINAIIRVYYNNKIKNKIQ

SEQ ID NO: 26065 - protein, 23 aa, artificial
  peptide fold or domain or sub-domain
MTFDVVLKLTYEKLKYIFHSDAT

SEQ ID NO: 26066 - protein, 27 aa, artificial
  peptide fold or domain or sub-domain
IKYERQRNGGKPHLYIVCFREFKAQFF

SEQ ID NO: 26067 - protein, 23 aa, artificial
  peptide fold or domain or sub-domain
YIHTDILLYEWKKKKIVIKQIAY

SEQ ID NO: 26068 - protein, 29 aa, artificial
  peptide fold or domain or sub-domain
LIFLAVFFYKTLFNFLYPIFNHIQFKTLN

SEQ ID NO: 26069 - protein, 27 aa, artificial
  peptide fold or domain or sub-domain
DILYICLYKYIHPKKRVFFRRCWGDDI

SEQ ID NO: 26070 - protein, 21 aa, artificial
  peptide fold or domain or sub-domain
AHLSQTNISFNVFLFKRRISK

SEQ ID NO: 26071 - protein, 24 aa, artificial
  peptide fold or domain or sub-domain
LRVAHVKQIYIDDVICESYKSMHM

SEQ ID NO: 26072 - protein, 25 aa, artificial
  peptide fold or domain or sub-domain
KIFKFFNVYYYLLIYFNINNKIQDT

SEQ ID NO: 26073 - protein, 29 aa, artificial
  peptide fold or domain or sub-domain
HIIFILYNLQYKHTKKQMLYQIFNKNLWI

SEQ ID NO: 26074 - protein, 28 aa, artificial
  peptide fold or domain or sub-domain
LFEKENKFVCRIWARGVVTPNGQVKTCQ

SEQ ID NO: 26075 - protein, 25 aa, artificial
  peptide fold or domain or sub-domain
YFYHYIFWHPSTYFKINKNKKKLNK

SEQ ID NO: 26076 - protein, 26 aa, artificial
  peptide fold or domain or sub-domain
YILIYAHNFVDYLNQGSFFFLFLFVS

SEQ ID NO: 26077 - protein, 25 aa, artificial
  peptide fold or domain or sub-domain
IISYIYPPSSKSSINDLFYRSFLIF

SEQ ID NO: 26078 - protein, 28 aa, artificial
  peptide fold or domain or sub-domain
SRKCYPSFSSLPTNLPSILAERQNKIVL

SEQ ID NO: 26079 - protein, 23 aa, artificial
  peptide fold or domain or sub-domain
EKIHALFYINNFLRLYKIIHIYM

SEQ ID NO: 26080 - protein, 24 aa, artificial
  peptide fold or domain or sub-domain
NYAIYFIRCTHIYNTICASPILKL

SEQ ID NO: 26081 - protein, 21 aa, artificial
  peptide fold or domain or sub-domain
RSCRFIDSCTCIYVRTCRTRN

SEQ ID NO: 26082 - protein, 28 aa, artificial
  peptide fold or domain or sub-domain
MIKRKLENSKTQYYLKHTASRKHFLLIK

SEQ ID NO: 26083 - protein, 21 aa, artificial
  peptide fold or domain or sub-domain
YLTINKKKLYIYIVSISPKCL

SEQ ID NO: 26084 - protein, 29 aa, artificial
  peptide fold or domain or sub-domain
SLRFVFETVCRIQLINTNVHIKKYKSYNF

SEQ ID NO: 26085 - protein, 29 aa, artificial
  peptide fold or domain or sub-domain
EKLNKANQVYVDLWKINHSYEIIKIEKRH

SEQ ID NO: 26086 - protein, 21 aa, artificial
  peptide fold or domain or sub-domain
MARDAYMYYILKHHFHLYTYV

SEQ ID NO: 26087 - protein, 22 aa, artificial
  peptide fold or domain or sub-domain
SQNNDNEKYGIQYNRKRQKRNS

SEQ ID NO: 26088 - protein, 25 aa, artificial
  peptide fold or domain or sub-domain
TAIKGFTIENELAKFSYIYNTYTYI

SEQ ID NO: 26089 - protein, 30 aa, artificial
  peptide fold or domain or sub-domain
MNFKKDITCDIYRLFFYKYISVFKRNSEGK

SEQ ID NO: 26090 - protein, 25 aa, artificial
  peptide fold or domain or sub-domain
NFSHKEAINEIKKKKNKIYILFDTA

SEQ ID NO: 26091 - protein, 30 aa, artificial
  peptide fold or domain or sub-domain
NLCDCSLVSHNIFRCPFVYKELGRMIGEKK

SEQ ID NO: 26092 - protein, 27 aa, artificial
  peptide fold or domain or sub-domain
MDLTNPNQCICKKKKKIQRKSNLESYI

SEQ ID NO: 26093 - protein, 27 aa, artificial
  peptide fold or domain or sub-domain
NMLIFHILYKRKPKKISNVCVYKYMFN

SEQ ID NO: 26094 - protein, 27 aa, artificial
  peptide fold or domain or sub-domain
NYNLMIKNIVTPFGAYFGTLPTHLLSY

SEQ ID NO: 26095 - protein, 26 aa, artificial
  peptide fold or domain or sub-domain
KNHPLMEPVIPNKIYFSIVQRDFHKK

SEQ ID NO: 26096 - protein, 30 aa, artificial
  peptide fold or domain or sub-domain
MKKCAYTYHAQYLFYEATKSRSVNPFALQH

SEQ ID NO: 26097 - protein, 25 aa, artificial
  peptide fold or domain or sub-domain
LVKYYMQAYTQMYDLYHFISNCLFS

SEQ ID NO: 26098 - protein, 28 aa, artificial
  peptide fold or domain or sub-domain
NSQEYMITSNIEYINAYLRGIFNYLPNH

SEQ ID NO: 26099 - protein, 25 aa, artificial
  peptide fold or domain or sub-domain
LLFERKRIKGKKYMDKLIFFYYIYI

SEQ ID NO: 26100 - protein, 30 aa, artificial
  peptide fold or domain or sub-domain
INSKHCKVCKILHTHFAMPQMHIIIIFKQA

SEQ ID NO: 26101 - protein, 28 aa, artificial
  peptide fold or domain or sub-domain
IIKLYYESQTFCNFFVIFNTHFTKYYFM

SEQ ID NO: 26102 - protein, 25 aa, artificial
  peptide fold or domain or sub-domain
TKPVFVELFIILNKSLNPDYFLNNT

SEQ ID NO: 26103 - protein, 29 aa, artificial
  peptide fold or domain or sub-domain
NFTYYTSKVFSPCYIDNNIKFVKISQKIK

SEQ ID NO: 26104 - protein, 27 aa, artificial
  peptide fold or domain or sub-domain
TSLLCNACYNSVNQILFYIKIFVFEKI

SEQ ID NO: 26105 - protein, 26 aa, artificial
  peptide fold or domain or sub-domain
MQLFENNKLYYMLFVLYFFVYAHILN

SEQ ID NO: 26106 - protein, 27 aa, artificial
  peptide fold or domain or sub-domain
MYISLIYNVHDCIPIIHTHTPNIHTYA

SEQ ID NO: 26107 - protein, 29 aa, artificial
  peptide fold or domain or sub-domain
YLLSQLYTLHIFFNFSIHKKYRTVLLLRG

SEQ ID NO: 26108 - protein, 25 aa, artificial
  peptide fold or domain or sub-domain
YNDIVKMFYETKDLYSFGSNDNKGI

SEQ ID NO: 26109 - protein, 25 aa, artificial
  peptide fold or domain or sub-domain
IMVPFQLIVRFVVPILFVPYAMDNT

SEQ ID NO: 26110 - protein, 24 aa, artificial
  peptide fold or domain or sub-domain
MHTNEWIEYFTKIKNKNSSKLFFC

SEQ ID NO: 26111 - protein, 28 aa, artificial
  peptide fold or domain or sub-domain
TYIYINILKSISIYFVRYFAFGQIATYV

SEQ ID NO: 26112 - protein, 28 aa, artificial
  peptide fold or domain or sub-domain
QQIGSFQIYQVKFSLKYFQQTSKKIIIV

SEQ ID NO: 26113 - protein, 29 aa, artificial
  peptide fold or domain or sub-domain
SDHNIVLFQIVGYETIDIIKKKWYLNVFH

SEQ ID NO: 26114 - protein, 29 aa, artificial
  peptide fold or domain or sub-domain
LKSLSLTIHNKFKILEKNKYFPLYHIPQK

SEQ ID NO: 26115 - protein, 25 aa, artificial
  peptide fold or domain or sub-domain
MLYIHLTQVFILLFYYFNNYQSRQL

SEQ ID NO: 26116 - protein, 30 aa, artificial
  peptide fold or domain or sub-domain
EENCLYIIFFTYKKIVVKTYKFSKHNLKNK

SEQ ID NO: 26117 - protein, 24 aa, artificial
  peptide fold or domain or sub-domain
HYVHTYKIGMAWAGENVIFGKNVK

SEQ ID NO: 26118 - protein, 27 aa, artificial
  peptide fold or domain or sub-domain
HSFRLLSQHTTIHSICSYLCSILRRKK

SEQ ID NO: 26119 - protein, 26 aa, artificial
  peptide fold or domain or sub-domain
SNFIYNSTIFYYITDACTYIFFFLCL

SEQ ID NO: 26120 - protein, 30 aa, artificial
  peptide fold or domain or sub-domain
QVWTVDIMSAQGFRSGSTVDLKISISDAEP

SEQ ID NO: 26121 - protein, 30 aa, artificial
  peptide fold or domain or sub-domain
FLTYINHYYYSWNNTYSNHILMVNFLLYFS

SEQ ID NO: 26122 - protein, 28 aa, artificial
  peptide fold or domain or sub-domain
NINYISSIFNMAFKIKTVLCIEVMYICF

SEQ ID NO: 26123 - protein, 23 aa, artificial
  peptide fold or domain or sub-domain
MVCLRFNYIEYIIFCLLYFFKPI

SEQ ID NO: 26124 - protein, 25 aa, artificial
  peptide fold or domain or sub-domain
DIILYVDNIKKYLVCEILQSEDKIS

SEQ ID NO: 26125 - protein, 21 aa, artificial
  peptide fold or domain or sub-domain
KQLYVAYNKIYRVIFCFLTKL

SEQ ID NO: 26126 - protein, 28 aa, artificial
  peptide fold or domain or sub-domain
FEEKKCIPIIVILYMHQYSCLFRIRSTL

SEQ ID NO: 26127 - protein, 29 aa, artificial
  peptide fold or domain or sub-domain
CIPKNTTWSALLFMKDYQHLKNEAFKKFL

SEQ ID NO: 26128 - protein, 24 aa, artificial
  peptide fold or domain or sub-domain
YIVYIYDFRASQFAQNNLLKKKKN

SEQ ID NO: 26129 - protein, 30 aa, artificial
  peptide fold or domain or sub-domain
LVAIILLQLFSYSYAVFIYYMFFLDFFSSK

SEQ ID NO: 26130 - protein, 22 aa, artificial
  peptide fold or domain or sub-domain
FFMAIYNFPPNTHKKNYSTKYK

SEQ ID NO: 26131 - protein, 23 aa, artificial
  peptide fold or domain or sub-domain
ISFLFFYNTLIYMTCFIKVLIIF

SEQ ID NO: 26132 - protein, 27 aa, artificial
  peptide fold or domain or sub-domain
QWHGIKTYDTKYYYRNVVNYEKKNMKF

SEQ ID NO: 26133 - protein, 17 aa, artificial
  peptide fold or domain or sub-domain
PNMASYVCSYFICIHFM

SEQ ID NO: 26134 - protein, 21 aa, artificial
  peptide fold or domain or sub-domain
NIFSHNILLVTHLHDNYMIIT

SEQ ID NO: 26135 - protein, 25 aa, artificial
  peptide fold or domain or sub-domain
CIETLELIKKSQYHIILFLCSPRAA

SEQ ID NO: 26136 - protein, 27 aa, artificial
  peptide fold or domain or sub-domain
MFALLLIILQNIIVSNTVNRITSTHPS

SEQ ID NO: 26137 - protein, 22 aa, artificial
  peptide fold or domain or sub-domain
KLNIIPCALPYMHAHIHMAIIE

SEQ ID NO: 26138 - protein, 19 aa, artificial
  peptide fold or domain or sub-domain
HMHIKHSGRKSVIKMNYVE

SEQ ID NO: 26139 - protein, 30 aa, artificial
  peptide fold or domain or sub-domain
MFSPLYIKKMGCAYLFILKNLKIIHNFQIL

SEQ ID NO: 26140 - protein, 30 aa, artificial
  peptide fold or domain or sub-domain
MSMLGYHEYEQCGAYTGEKNDYSIEKQETN

SEQ ID NO: 26141 - protein, 29 aa, artificial
  peptide fold or domain or sub-domain
NIYNIPYIVHFSSIFSNFLITCINLFQSN

SEQ ID NO: 26142 - protein, 25 aa, artificial
  peptide fold or domain or sub-domain
CSFEEIKTKETGNPQKCIFLSSYYF

SEQ ID NO: 26143 - protein, 30 aa, artificial
  peptide fold or domain or sub-domain
RKTIFKQSMIIFLQYQAIQIIVKVMNKIVL

SEQ ID NO: 26144 - protein, 30 aa, artificial
  peptide fold or domain or sub-domain
MKNIKLCYLIFGKSENKIVPLKFFIIKVYL

SEQ ID NO: 26145 - protein, 27 aa, artificial
  peptide fold or domain or sub-domain
FSFFFDELYSPILGQKIFRCHLCPFLC

SEQ ID NO: 26146 - protein, 30 aa, artificial
  peptide fold or domain or sub-domain
EKKGFIELFTKFNFFVKAQIIIIFLLFIYK

SEQ ID NO: 26147 - protein, 25 aa, artificial
  peptide fold or domain or sub-domain
MIRIGNFTSLKVKQDRIKLCVLNAA

SEQ ID NO: 26148 - protein, 30 aa, artificial
  peptide fold or domain or sub-domain
MHLLIHFTISYMLINTLLYFEKYFNASCAS

SEQ ID NO: 26149 - protein, 24 aa, artificial
  peptide fold or domain or sub-domain
MISRILSTEEKCLEDLGGNGVTFF

SEQ ID NO: 26150 - protein, 25 aa, artificial
  peptide fold or domain or sub-domain
MVKYITKNVLNMQIGELFKAHMFKL

SEQ ID NO: 26151 - protein, 23 aa, artificial
  peptide fold or domain or sub-domain
IKDRMRNKILLTKNYEQTGNWTQ

SEQ ID NO: 26152 - protein, 27 aa, artificial
  peptide fold or domain or sub-domain
WYDFHNDNNSKLQEQERNLFEYWQCLQ

SEQ ID NO: 26153 - protein, 23 aa, artificial
  peptide fold or domain or sub-domain
MAAATDFCYLYIISYSEKRFMLK

SEQ ID NO: 26154 - protein, 29 aa, artificial
  peptide fold or domain or sub-domain
DLFIYSLFLYIYFQQLLKHKRFETSLKKN

SEQ ID NO: 26155 - protein, 29 aa, artificial
  peptide fold or domain or sub-domain
MAIKSIRVFKIYYYMHGAVLMKMEKKKDG

SEQ ID NO: 26156 - protein, 28 aa, artificial
  peptide fold or domain or sub-domain
VTVTFANVFSQSCQCPGTTGFYREEVGF

SEQ ID NO: 26157 - protein, 29 aa, artificial
  peptide fold or domain or sub-domain
NIFTAEFPENEEKQIHIFDKFSYFFISLM

SEQ ID NO: 26158 - protein, 21 aa, artificial
  peptide fold or domain or sub-domain
HLIRLNNLHDNLASSTKGENM

SEQ ID NO: 26159 - protein, 29 aa, artificial
  peptide fold or domain or sub-domain
MDILYSRYNTFSLFCVTHLLYIPTVQINL

SEQ ID NO: 26160 - protein, 28 aa, artificial
  peptide fold or domain or sub-domain
MIFIFLSQREYHILVACYNFSFYFNLIF

SEQ ID NO: 26161 - protein, 29 aa, artificial
  peptide fold or domain or sub-domain
CFFVLDISIVHKHINDFIYIRKSILDMCE

SEQ ID NO: 26162 - protein, 26 aa, artificial
  peptide fold or domain or sub-domain
GKRNILYNTKYNHYTNLTSYILNKLL

SEQ ID NO: 26163 - protein, 30 aa, artificial
  peptide fold or domain or sub-domain
MSSIKKNKNIENYINKTNVKIMVTKRDVRD

SEQ ID NO: 26164 - protein, 23 aa, artificial
  peptide fold or domain or sub-domain
TKLKNKISYDKTQEEFDFMVTLL

SEQ ID NO: 26165 - protein, 26 aa, artificial
  peptide fold or domain or sub-domain
FHAQEHFIRSFLIPYHYCYIFHSLTN

SEQ ID NO: 26166 - protein, 25 aa, artificial
  peptide fold or domain or sub-domain
LCTYVYATFLFWILFKQRSRHIYEN

SEQ ID NO: 26167 - protein, 25 aa, artificial
  peptide fold or domain or sub-domain
TLIFKSTISLMKKGIIYACLYLNIY

SEQ ID NO: 26168 - protein, 29 aa, artificial
  peptide fold or domain or sub-domain
MEYLSKFYIKDMRKEKENVYYDEDIVKKV

SEQ ID NO: 26169 - protein, 28 aa, artificial
  peptide fold or domain or sub-domain
MIIMNNKYNHRLICCVSDLMYMPFKHYI

SEQ ID NO: 26170 - protein, 30 aa, artificial
  peptide fold or domain or sub-domain
SFLNIYIFDEFTSNNLHLHMYCSLRFTHIC

SEQ ID NO: 26171 - protein, 24 aa, artificial
  peptide fold or domain or sub-domain
VFNYLFLALIAQCLSKQQTFHINK

SEQ ID NO: 26172 - protein, 28 aa, artificial
  peptide fold or domain or sub-domain
MFPLYRYIQKGEFHTLNPAYYYLKPKLN

SEQ ID NO: 26173 - protein, 23 aa, artificial
  peptide fold or domain or sub-domain
EINLNNGKLSFIHIRIKRLYHIL

SEQ ID NO: 26174 - protein, 27 aa, artificial
  peptide fold or domain or sub-domain
MSRIYGVGSDNNSGCKSSYVTASVLLY

SEQ ID NO: 26175 - protein, 29 aa, artificial
  peptide fold or domain or sub-domain
MQGYSKFNNLHITLYNTTFVYICFFFVYL

SEQ ID NO: 26176 - protein, 26 aa, artificial
  peptide fold or domain or sub-domain
FLVTIRKFYLLYSRFDFSFWLVLKSN

SEQ ID NO: 26177 - protein, 26 aa, artificial
  peptide fold or domain or sub-domain
MRLHHRASAQKFKQCSDRFVNFIIVS

SEQ ID NO: 26178 - protein, 23 aa, artificial
  peptide fold or domain or sub-domain
MQYIRSFMLLIIDVLSLSYIVFK

SEQ ID NO: 26179 - protein, 24 aa, artificial
  peptide fold or domain or sub-domain
ILKPKRTEKSLHHISQAYFNLHQL

SEQ ID NO: 26180 - protein, 28 aa, artificial
  peptide fold or domain or sub-domain
SLGNLFFQNQSAIRSLYVSNFTAFEFSS

SEQ ID NO: 26181 - protein, 21 aa, artificial
  peptide fold or domain or sub-domain
YFFVASLCDIFPYVGHGMNGS

SEQ ID NO: 26182 - protein, 29 aa, artificial
  peptide fold or domain or sub-domain
KSFTNIYSSCLLSFLFTFLIIKYFLIRLF

SEQ ID NO: 26183 - protein, 18 aa, artificial
  peptide fold or domain or sub-domain
DEFEARRLVQVIDTASGV

SEQ ID NO: 26184 - protein, 25 aa, artificial
  peptide fold or domain or sub-domain
MATQGCRVPLFYRCKYISFVIMNAM

SEQ ID NO: 26185 - protein, 23 aa, artificial
  peptide fold or domain or sub-domain
MCIPMISTKRLNILFAYIQSIFL

SEQ ID NO: 26186 - protein, 29 aa, artificial
  peptide fold or domain or sub-domain
LVIFPNFFAYLYFRQYTFLQSYIYMKYII

SEQ ID NO: 26187 - protein, 29 aa, artificial
  peptide fold or domain or sub-domain
MLKIVKWSNVDFRESLKLKIVYYITFSKE

SEQ ID NO: 26188 - protein, 19 aa, artificial
  peptide fold or domain or sub-domain
VDIYTRWEWKIEKCEDKDF

SEQ ID NO: 26189 - protein, 24 aa, artificial
  peptide fold or domain or sub-domain
ALHIISNILMYVYWGYIEYQILNF

SEQ ID NO: 26190 - protein, 28 aa, artificial
  peptide fold or domain or sub-domain
MCMNVFTYAMYIFVYIHGWKKNIYPFID

SEQ ID NO: 26191 - protein, 29 aa, artificial
  peptide fold or domain or sub-domain
CHFVLVLIEVVYAHAYNLKREKKQINKIY

SEQ ID NO: 26192 - protein, 27 aa, artificial
  peptide fold or domain or sub-domain
KLHIYDFCRRFKYIFGLWERKGGKIGN

SEQ ID NO: 26193 - protein, 21 aa, artificial
  peptide fold or domain or sub-domain
MPSFYLVQNYKCSQNVYGVIF

SEQ ID NO: 26194 - protein, 29 aa, artificial
  peptide fold or domain or sub-domain
MHTFSYLFAGSLNKIYFFLLFAHLIRYIS

SEQ ID NO: 26195 - protein, 30 aa, artificial
  peptide fold or domain or sub-domain
MIIKLNGFLYFAIIYNTWVFLLYTKYNWLT

SEQ ID NO: 26196 - protein, 29 aa, artificial
  peptide fold or domain or sub-domain
WKMLPQVYFFTNVLYRHIYIHNTCLVYGL

SEQ ID NO: 26197 - protein, 22 aa, artificial
  peptide fold or domain or sub-domain
YMHMCSIYRYMKHCRRSRWCYF

SEQ ID NO: 26198 - protein, 29 aa, artificial
  peptide fold or domain or sub-domain
YIHFMQKTKTFTIQNALLKGKVIYKYIYF

SEQ ID NO: 26199 - protein, 28 aa, artificial
  peptide fold or domain or sub-domain
MYRIFLMPEEFITKKHVHSHIYMKRNNC

SEQ ID NO: 26200 - protein, 27 aa, artificial
  peptide fold or domain or sub-domain
SCINPSSCIIVFNFRRVRNSIYYFIST

SEQ ID NO: 26201 - protein, 21 aa, artificial
  peptide fold or domain or sub-domain
MRLCVKIVLLIFTLIKAYSII

SEQ ID NO: 26202 - protein, 20 aa, artificial
  peptide fold or domain or sub-domain
MYRTKVENFKKIILTYDNFK

SEQ ID NO: 26203 - protein, 19 aa, artificial
  peptide fold or domain or sub-domain
LNIYVYTWKNKVPPLSYMA

SEQ ID NO: 26204 - protein, 23 aa, artificial
  peptide fold or domain or sub-domain
MQGHLYELFSNNVYIHSLIFFSL

SEQ ID NO: 26205 - protein, 27 aa, artificial
  peptide fold or domain or sub-domain
MFRIFVIKKREKKNDKIIAATCILIHT

SEQ ID NO: 26206 - protein, 27 aa, artificial
  peptide fold or domain or sub-domain
AFYFRLFRFRYSQTRLIVNLGSLFFTI

SEQ ID NO: 26207 - protein, 29 aa, artificial
  peptide fold or domain or sub-domain
RDAIAIWALYVSLYYGIYRGPIYTYMLSE

SEQ ID NO: 26208 - protein, 27 aa, artificial
  peptide fold or domain or sub-domain
EVLLDIYGNEKPLIHKKRLYSLSHIER

SEQ ID NO: 26209 - protein, 30 aa, artificial
  peptide fold or domain or sub-domain
MYIYPLKVDKRNIYAFFLFIVPYFLYYHTT

SEQ ID NO: 26210 - protein, 24 aa, artificial
  peptide fold or domain or sub-domain
FMTKIGFTYLQNYKFIELAIDKNM

SEQ ID NO: 26211 - protein, 30 aa, artificial
  peptide fold or domain or sub-domain
MEFILNILIYFNLYIFVKKKEKMSTNNELF

SEQ ID NO: 26212 - protein, 30 aa, artificial
  peptide fold or domain or sub-domain
MHFLFIIILNFYYSYFVILLYFFKYEKKVI

SEQ ID NO: 26213 - protein, 29 aa, artificial
  peptide fold or domain or sub-domain
IILHMYVIHYLILLHTSEQFSIFFINLEY

SEQ ID NO: 26214 - protein, 29 aa, artificial
  peptide fold or domain or sub-domain
AIHVRKIPTKININKIIGTIDQALKSVVK

SEQ ID NO: 26215 - protein, 25 aa, artificial
  peptide fold or domain or sub-domain
MRIKSMDIYMCVNGNVYKKTNIFMD

SEQ ID NO: 26216 - protein, 30 aa, artificial
  peptide fold or domain or sub-domain
KDNIIFNKNNNPTDISFDVYKEILTFYKSF

SEQ ID NO: 26217 - protein, 22 aa, artificial
  peptide fold or domain or sub-domain
ENMNKLMGGNTCIHTFIYSSFF

SEQ ID NO: 26218 - protein, 28 aa, artificial
  peptide fold or domain or sub-domain
MLFPINSFICRGSFSPPLSKGKITIKQK

SEQ ID NO: 26219 - protein, 30 aa, artificial
  peptide fold or domain or sub-domain
MRNNKHFYSRNCMYHITNCHIEILFLSYKL

SEQ ID NO: 26220 - protein, 30 aa, artificial
  peptide fold or domain or sub-domain
MLREKLYIIFPAYRTFHIFPSIHILHIFVN

SEQ ID NO: 26221 - protein, 30 aa, artificial
  peptide fold or domain or sub-domain
MLNIRLYIEIYRVPTFAQTCVCILLMIILS

SEQ ID NO: 26222 - protein, 30 aa, artificial
  peptide fold or domain or sub-domain
NHNLEICLIHQVNTISNDETFHTNKAFKKV

SEQ ID NO: 26223 - protein, 26 aa, artificial
  peptide fold or domain or sub-domain
QTKQKVHIYITHHIINPYIFHFWLLN

SEQ ID NO: 26224 - protein, 28 aa, artificial
  peptide fold or domain or sub-domain
KGQKGKRSKRSWENLHIYTRMVYILIPA

SEQ ID NO: 26225 - protein, 21 aa, artificial
  peptide fold or domain or sub-domain
NDHKKEKFFTYLVLYIYHTYG

SEQ ID NO: 26226 - protein, 27 aa, artificial
  peptide fold or domain or sub-domain
AKVLSVHTGCFFVNLTQARVIRERSHG

SEQ ID NO: 26227 - protein, 27 aa, artificial
  peptide fold or domain or sub-domain
MALPSVSATLFIPAFPFDRMNSRLIFL

SEQ ID NO: 26228 - protein, 29 aa, artificial
  peptide fold or domain or sub-domain
RWKKQHIYIFLFSGTHTHISLTIFAHANI

SEQ ID NO: 26229 - protein, 30 aa, artificial
  peptide fold or domain or sub-domain
YILNTEQQGTHAHYHLIITLKNILFFSKSA

SEQ ID NO: 26230 - protein, 29 aa, artificial
  peptide fold or domain or sub-domain
MHPFFLLTGFFKYDKKVSEECPSIVESKK

SEQ ID NO: 26231 - protein, 30 aa, artificial
  peptide fold or domain or sub-domain
NILQEIINSFIDSLTKQLKCFIINNQNTKL

SEQ ID NO: 26232 - protein, 30 aa, artificial
  peptide fold or domain or sub-domain
HKIYKYILLIFKKYQQRKHILIHLFIFVFF

SEQ ID NO: 26233 - protein, 26 aa, artificial
  peptide fold or domain or sub-domain
NASTDMSQVNLMEAIPQLRCSLSRCV

SEQ ID NO: 26234 - protein, 21 aa, artificial
  peptide fold or domain or sub-domain
HVENIVFKINTNGCVEVNING

SEQ ID NO: 26235 - protein, 21 aa, artificial
  peptide fold or domain or sub-domain
KLINKKQVYNMGTYKMYENFN

SEQ ID NO: 26236 - protein, 26 aa, artificial
  peptide fold or domain or sub-domain
TLTNSFPICISFTSYKCLLAQAKNFK

SEQ ID NO: 26237 - protein, 26 aa, artificial
  peptide fold or domain or sub-domain
PSRPGTRNPPASAALSARIICKHHCP

SEQ ID NO: 26238 - protein, 27 aa, artificial
  peptide fold or domain or sub-domain
NMAQYKLYGSKTKDHVSGDMRITCSYT

SEQ ID NO: 26239 - protein, 17 aa, artificial
  peptide fold or domain or sub-domain
MFYLNHFVKMRRPTKFI

SEQ ID NO: 26240 - protein, 29 aa, artificial
  peptide fold or domain or sub-domain
FICRLFTSSNYISLFLQHEMNKVHKKYKF

SEQ ID NO: 26241 - protein, 21 aa, artificial
  peptide fold or domain or sub-domain
QVDGTKKYHPELGHPDPKEHT

SEQ ID NO: 26242 - protein, 26 aa, artificial
  peptide fold or domain or sub-domain
YNCVFFLETFPNYCDYQMCGKKYNRL

SEQ ID NO: 26243 - protein, 30 aa, artificial
  peptide fold or domain or sub-domain
IPKKHYYLFIYLFSHRIYIVIIYVFYTRNC

SEQ ID NO: 26244 - protein, 24 aa, artificial
  peptide fold or domain or sub-domain
NNYNTIYFFCESFHKDDESCYIIF

SEQ ID NO: 26245 - protein, 21 aa, artificial
  peptide fold or domain or sub-domain
LFLFYWKLISDYLICVNSRKA

SEQ ID NO: 26246 - protein, 30 aa, artificial
  peptide fold or domain or sub-domain
YREYNCNNMIMIIKLPFNPLQLSYFCPSYT

SEQ ID NO: 26247 - protein, 30 aa, artificial
  peptide fold or domain or sub-domain
LEFGSLQIQHLMYFLYNYNRFIQRIVFRLK

SEQ ID NO: 26248 - protein, 22 aa, artificial
  peptide fold or domain or sub-domain
MYHLFLYTKTKEYAYSSMYIKI

SEQ ID NO: 26249 - protein, 22 aa, artificial
  peptide fold or domain or sub-domain
CTRICVGGDVTNKNYKNNHTQY

SEQ ID NO: 26250 - protein, 25 aa, artificial
  peptide fold or domain or sub-domain
FIHTPLKKYICINSNLYKVIYVITL

SEQ ID NO: 26251 - protein, 26 aa, artificial
  peptide fold or domain or sub-domain
SDGAHLCSQHTGGRDRWISEFEANLL

SEQ ID NO: 26252 - protein, 26 aa, artificial
  peptide fold or domain or sub-domain
YSTRITRDTWKASNIYHYFNITFTYL

SEQ ID NO: 26253 - protein, 28 aa, artificial
  peptide fold or domain or sub-domain
YLILSSLVSQREFDSHHHDHVHLRLNFH

SEQ ID NO: 26254 - protein, 29 aa, artificial
  peptide fold or domain or sub-domain
TIIRPRKARMPVKGQEWGRAYLVSSLGPV

SEQ ID NO: 26255 - protein, 22 aa, artificial
  peptide fold or domain or sub-domain
MYILQFPHPFFKKLYKKTLFDS

SEQ ID NO: 26256 - protein, 28 aa, artificial
  peptide fold or domain or sub-domain
MLIFMLMCCHPLTSKMLNTNKIYFSIFY

SEQ ID NO: 26257 - protein, 26 aa, artificial
  peptide fold or domain or sub-domain
MYNRKFSYIENSNNCMSILVFYMTYI

SEQ ID NO: 26258 - protein, 28 aa, artificial
  peptide fold or domain or sub-domain
HKSRNACSFTSQLLSLIYQPNKAVIIKS

SEQ ID NO: 26259 - protein, 19 aa, artificial
  peptide fold or domain or sub-domain
MYKRTMQQYFNHTKFYCLV

SEQ ID NO: 26260 - protein, 30 aa, artificial
  peptide fold or domain or sub-domain
YIYNGYYNVLIHYIHLLKKNSAQKYLNDNF

SEQ ID NO: 26261 - protein, 28 aa, artificial
  peptide fold or domain or sub-domain
MPTCMIRNDLNNTSKTIISDKRRKFFKL

SEQ ID NO: 26262 - protein, 27 aa, artificial
  peptide fold or domain or sub-domain
PLKRRAGILIYGIKIAAIEYARKESMI

SEQ ID NO: 26263 - protein, 30 aa, artificial
  peptide fold or domain or sub-domain
ALGCIYLLEVGSLKRRRLSHWGSQELVVRG

SEQ ID NO: 26264 - protein, 29 aa, artificial
  peptide fold or domain or sub-domain
MLFLCIYQLLLIVPCIQTHIRIVYSNIQV

SEQ ID NO: 26265 - protein, 21 aa, artificial
  peptide fold or domain or sub-domain
TSSKWHNIIHTIKTKGSIVVY

SEQ ID NO: 26266 - protein, 26 aa, artificial
  peptide fold or domain or sub-domain
FCSEKYPKTIKLLNFFLFIIRKSRKL

SEQ ID NO: 26267 - protein, 28 aa, artificial
  peptide fold or domain or sub-domain
KLFISSLKAAIIFISWDLMSESCSTGVL

SEQ ID NO: 26268 - protein, 25 aa, artificial
  peptide fold or domain or sub-domain
MSISVFIKTLSLDIGTTLVLYGYFS

SEQ ID NO: 26269 - protein, 24 aa, artificial
  peptide fold or domain or sub-domain
NKQTSNKQNKKPGTDFLASRMSGD

SEQ ID NO: 26270 - protein, 24 aa, artificial
  peptide fold or domain or sub-domain
NLTRFQIIRGRVNIYIYAKFYTIC

SEQ ID NO: 26271 - protein, 26 aa, artificial
  peptide fold or domain or sub-domain
CCGTRTVNCLWVKCLTIKKAQGRGFW

SEQ ID NO: 26272 - protein, 26 aa, artificial
  peptide fold or domain or sub-domain
LNELGEIILTISCIPAVAITIMNCAT

SEQ ID NO: 26273 - protein, 30 aa, artificial
  peptide fold or domain or sub-domain
IIREDLYMFHNSHFSPVCRTRKVVILASLL

SEQ ID NO: 26274 - protein, 29 aa, artificial
  peptide fold or domain or sub-domain
MLFIGSNILFEAFFMIIYISSTTANLLMF

SEQ ID NO: 26275 - protein, 29 aa, artificial
  peptide fold or domain or sub-domain
MKSLNSLSYEIRRAPNSKSTLMGTFEIKL

SEQ ID NO: 26276 - protein, 29 aa, artificial
  peptide fold or domain or sub-domain
NYIFTSNNLFSIVLKKRNINKGDEIYSIC

SEQ ID NO: 26277 - protein, 25 aa, artificial
  peptide fold or domain or sub-domain
MSDFHYTGMCSVHMGNETIEGIVCI

SEQ ID NO: 26278 - protein, 26 aa, artificial
  peptide fold or domain or sub-domain
NKQPYIEDVDMCFYLFMSFGGCLAVL

SEQ ID NO: 26279 - protein, 28 aa, artificial
  peptide fold or domain or sub-domain
KINKKIYFFMAPQMWSFICSKHFAHNKN

SEQ ID NO: 26280 - protein, 26 aa, artificial
  peptide fold or domain or sub-domain
TGVFFFCHLINFYNVSTRYQKCKKDF

SEQ ID NO: 26281 - protein, 21 aa, artificial
  peptide fold or domain or sub-domain
MKFNFLTIFLYQNYMRTYAMS

SEQ ID NO: 26282 - protein, 29 aa, artificial
  peptide fold or domain or sub-domain
YSLVKVIPIAGKMSLPQRLTGSGKTRQKE

SEQ ID NO: 26283 - protein, 27 aa, artificial
  peptide fold or domain or sub-domain
MINKIYMNKTYKYIYIHMWKLFYMEFF

SEQ ID NO: 26284 - protein, 27 aa, artificial
  peptide fold or domain or sub-domain
ISRTYIYHILCDFLSLFGHINFNCYIN

SEQ ID NO: 26285 - protein, 23 aa, artificial
  peptide fold or domain or sub-domain
SFLPRKGLLQNHTMEPRSSTTVS

SEQ ID NO: 26286 - protein, 30 aa, artificial
  peptide fold or domain or sub-domain
NEDQSQHTSPFVRIGNKTPMEGVTKHKVWS

SEQ ID NO: 26287 - protein, 29 aa, artificial
  peptide fold or domain or sub-domain
LICFKNFQFLSNIFVEKGMETCIEKRLKP

SEQ ID NO: 26288 - protein, 28 aa, artificial
  peptide fold or domain or sub-domain
QFFLIYIFHNFEYLLNTYMNKNICHNFI

SEQ ID NO: 26289 - protein, 27 aa, artificial
  peptide fold or domain or sub-domain
MAKTNVFNAYLFMYFTQYFIFGIFLNV

SEQ ID NO: 26290 - protein, 30 aa, artificial
  peptide fold or domain or sub-domain
RYNNCCFWTLHIFKVCLKWIIKSQIFNINF

SEQ ID NO: 26291 - protein, 28 aa, artificial
  peptide fold or domain or sub-domain
VPIILRDSLFLLLYSVGDANVCSSCSLS

SEQ ID NO: 26292 - protein, 26 aa, artificial
  peptide fold or domain or sub-domain
FTNIHTYNLPLNDPWHGGSMRERTSN

SEQ ID NO: 26293 - protein, 29 aa, artificial
  peptide fold or domain or sub-domain
MCLSLEGLENRYLEHLYIYFLNYYNQLIK

SEQ ID NO: 26294 - protein, 29 aa, artificial
  peptide fold or domain or sub-domain
GMSQDQLDILYLIHYIIFNFQDWIPVMIM

SEQ ID NO: 26295 - protein, 27 aa, artificial
  peptide fold or domain or sub-domain
KEKNEKLKKYKMIFIPLLYVYMPYFGR

SEQ ID NO: 26296 - protein, 23 aa, artificial
  peptide fold or domain or sub-domain
CSMPVCLICTWSLYMHQNKGFCH

SEQ ID NO: 26297 - protein, 26 aa, artificial
  peptide fold or domain or sub-domain
SFCIVSFHLVDISPELDYFLLSIPLG

SEQ ID NO: 26298 - protein, 28 aa, artificial
  peptide fold or domain or sub-domain
LNWISSNLYKYIHTIFFIYLFAELFVLY

SEQ ID NO: 26299 - protein, 26 aa, artificial
  peptide fold or domain or sub-domain
FKFQVISFTKGNNLKCSLVLLVIMPK

SEQ ID NO: 26300 - protein, 25 aa, artificial
  peptide fold or domain or sub-domain
VPYNNNIYAYVKTPMHIRIYIYNNM

SEQ ID NO: 26301 - protein, 25 aa, artificial
  peptide fold or domain or sub-domain
NHGVFIYTVPNMWRKYFNPININCL

SEQ ID NO: 26302 - protein, 30 aa, artificial
  peptide fold or domain or sub-domain
HINNKNHMFATDHIIYSSQILAPPVLTQYI

SEQ ID NO: 26303 - protein, 29 aa, artificial
  peptide fold or domain or sub-domain
MLIILKLKQFKQVQNATMKEILLHSTFRI

SEQ ID NO: 26304 - protein, 24 aa, artificial
  peptide fold or domain or sub-domain
MQKVNNSTDLPLSYINMKCNSYNL

SEQ ID NO: 26305 - protein, 26 aa, artificial
  peptide fold or domain or sub-domain
FFRFSFHKLNLLNAVTINYLWILFFS

SEQ ID NO: 26306 - protein, 23 aa, artificial
  peptide fold or domain or sub-domain
MSISKKSKDVWCINDTINKTKDI

SEQ ID NO: 26307 - protein, 24 aa, artificial
  peptide fold or domain or sub-domain
FNKRRFYYIQCMRSRILKKIHFTK

SEQ ID NO: 26308 - protein, 30 aa, artificial
  peptide fold or domain or sub-domain
TERGKCCGWAWCCLYSDTSSALLDGAEDKE

SEQ ID NO: 26309 - protein, 21 aa, artificial
  peptide fold or domain or sub-domain
HWDLESPWNKGDSQGHNHLSF

SEQ ID NO: 26310 - protein, 24 aa, artificial
  peptide fold or domain or sub-domain
NVLHVRLSLPYRCIAVADAHIYDS

SEQ ID NO: 26311 - protein, 26 aa, artificial
  peptide fold or domain or sub-domain
CINYIFFLHFIICSEQRVNIYNYNKE

SEQ ID NO: 26312 - protein, 25 aa, artificial
  peptide fold or domain or sub-domain
MIYKSMYTTCLYIIITYWVNGDNKI

SEQ ID NO: 26313 - protein, 19 aa, artificial
  peptide fold or domain or sub-domain
YPKRKKERTLNGVILLAAI

SEQ ID NO: 26314 - protein, 28 aa, artificial
  peptide fold or domain or sub-domain
ANLKCLWLLKYFYPLCNDSWETGAESVL

SEQ ID NO: 26315 - protein, 28 aa, artificial
  peptide fold or domain or sub-domain
YNHINRIFVFPLPVNKYRSTILYESRVK

SEQ ID NO: 26316 - protein, 25 aa, artificial
  peptide fold or domain or sub-domain
FLLQMFELWGICFVYVLTQTYFKAY

SEQ ID NO: 26317 - protein, 24 aa, artificial
  peptide fold or domain or sub-domain
QDSQEFKRTPNVLVNACVNQFYSI

SEQ ID NO: 26318 - protein, 26 aa, artificial
  peptide fold or domain or sub-domain
MLIKTKCDILFINIRYICSYLVILFL

SEQ ID NO: 26319 - protein, 27 aa, artificial
  peptide fold or domain or sub-domain
TIFIISVDLERRFMSYIIQIEYHTFSD

SEQ ID NO: 26320 - protein, 26 aa, artificial
  peptide fold or domain or sub-domain
HVEKCKSIHSYLPVQNSSLIGSRTST

SEQ ID NO: 26321 - protein, 30 aa, artificial
  peptide fold or domain or sub-domain
IPTLDLKRFYIIFNFAQLCIINLTIEINVY

SEQ ID NO: 26322 - protein, 25 aa, artificial
  peptide fold or domain or sub-domain
MKKRTKYTLKTLNALCTYIYDIVWM

SEQ ID NO: 26323 - protein, 28 aa, artificial
  peptide fold or domain or sub-domain
HEKIDNILTHYYEKCHNNIYIFYYFLFI

SEQ ID NO: 26324 - protein, 22 aa, artificial
  peptide fold or domain or sub-domain
RLYVQSDEDICIVFSYENLNKR

SEQ ID NO: 26325 - protein, 27 aa, artificial
  peptide fold or domain or sub-domain
HFYSYTIQKSGKGKQHLYKICVGTYIY

SEQ ID NO: 26326 - protein, 22 aa, artificial
  peptide fold or domain or sub-domain
MNSYFVYNLLIYSLYKDSYAGI

SEQ ID NO: 26327 - protein, 27 aa, artificial
  peptide fold or domain or sub-domain
FCYQLHTIGSYWGDHWFLLFSYKEQFK

SEQ ID NO: 26328 - protein, 22 aa, artificial
  peptide fold or domain or sub-domain
FSSRTKSIPIFDQFPHKPLTQN

SEQ ID NO: 26329 - protein, 25 aa, artificial
  peptide fold or domain or sub-domain
KHLILTYILLVNVLFRFGFNFIFFI

SEQ ID NO: 26330 - protein, 29 aa, artificial
  peptide fold or domain or sub-domain
KRISVRMYTLAKQDDLEEGKNNFVEIRDK

SEQ ID NO: 26331 - protein, 30 aa, artificial
  peptide fold or domain or sub-domain
MEMLEKRVGSGFGQCTFDASLNSQTIRHEK

SEQ ID NO: 26332 - protein, 25 aa, artificial
  peptide fold or domain or sub-domain
GTINSCYIYYVSNTLNFIENTKAYQ

SEQ ID NO: 26333 - protein, 30 aa, artificial
  peptide fold or domain or sub-domain
TFFLNKDSFSTTNFIWVLANNNFNKYLTLV

SEQ ID NO: 26334 - protein, 27 aa, artificial
  peptide fold or domain or sub-domain
MDFSYLLYIFFFTTLERTHNKISKIYI

SEQ ID NO: 26335 - protein, 25 aa, artificial
  peptide fold or domain or sub-domain
KPQPLHSYSSSNLNNFKSPTVFTYS

SEQ ID NO: 26336 - protein, 19 aa, artificial
  peptide fold or domain or sub-domain
MMRQCFMTRITKIYNYFSV

SEQ ID NO: 26337 - protein, 26 aa, artificial
  peptide fold or domain or sub-domain
CPNIRKGMPTRHLHDCNMDEASAMNK

SEQ ID NO: 26338 - protein, 29 aa, artificial
  peptide fold or domain or sub-domain
HGPKYSKDSSNIQNGSTHSGTDIKMNKKP

SEQ ID NO: 26339 - protein, 27 aa, artificial
  peptide fold or domain or sub-domain
MELQNNFEYSNHIYLKKTLTNILYNNE

SEQ ID NO: 26340 - protein, 27 aa, artificial
  peptide fold or domain or sub-domain
SSLMSERNLTTKKKYTNCRRLFNLGVL

SEQ ID NO: 26341 - protein, 26 aa, artificial
  peptide fold or domain or sub-domain
IFEKSVVHFPCESWLSIIYVVIEDQP

SEQ ID NO: 26342 - protein, 23 aa, artificial
  peptide fold or domain or sub-domain
NTIQYIYLFICLLFFFTFPLKLN

SEQ ID NO: 26343 - protein, 29 aa, artificial
  peptide fold or domain or sub-domain
KKGAYILRLNLYTYFVQNYVKNENNLYQF

SEQ ID NO: 26344 - protein, 28 aa, artificial
  peptide fold or domain or sub-domain
MRHFDNSVVSIFKAFPFSNNKTNSLKKS

SEQ ID NO: 26345 - protein, 21 aa, artificial
  peptide fold or domain or sub-domain
YRLFIYFEYFKKDINHTYIYL

SEQ ID NO: 26346 - protein, 30 aa, artificial
  peptide fold or domain or sub-domain
ILSLSINSIRYVFINLFLRFLNVIGTVTSI

SEQ ID NO: 26347 - protein, 28 aa, artificial
  peptide fold or domain or sub-domain
FIYLFYVCTLSLSSDTAEEGIRFHYRWL

SEQ ID NO: 26348 - protein, 24 aa, artificial
  peptide fold or domain or sub-domain
FQAWHHGHPDSPITVLKVLGISKN

SEQ ID NO: 26349 - protein, 25 aa, artificial
  peptide fold or domain or sub-domain
SDKSFSNEQQSCTLLHFLKAVPEGL

SEQ ID NO: 26350 - protein, 26 aa, artificial
  peptide fold or domain or sub-domain
CPQQSIKEIQKGDKKNSELRHHRKKN

SEQ ID NO: 26351 - protein, 30 aa, artificial
  peptide fold or domain or sub-domain
RSETLFRFRSPFWRHCLNINVLLKSICSII

SEQ ID NO: 26352 - protein, 22 aa, artificial
  peptide fold or domain or sub-domain
PEMIMMMTMKIVTSKNIPVKII

SEQ ID NO: 26353 - protein, 27 aa, artificial
  peptide fold or domain or sub-domain
FYDRDALSLHFNFITNFGINLIGEQVC

SEQ ID NO: 26354 - protein, 27 aa, artificial
  peptide fold or domain or sub-domain
MNCEDWSLSNPSPHHFVLVNHVGVLSL

SEQ ID NO: 26355 - protein, 28 aa, artificial
  peptide fold or domain or sub-domain
SSFAYLHKILFFFKNSNTKKLIPIFSDN

SEQ ID NO: 26356 - protein, 23 aa, artificial
  peptide fold or domain or sub-domain
IYVVFKDTYSKSQVNYVKKKIYL

SEQ ID NO: 26357 - protein, 30 aa, artificial
  peptide fold or domain or sub-domain
HLFGRERGRERCHGRIKLRALKGCMAFSDT

SEQ ID NO: 26358 - protein, 24 aa, artificial
  peptide fold or domain or sub-domain
EFYIFFDCIHYSMHICKKNITYMC

SEQ ID NO: 26359 - protein, 25 aa, artificial
  peptide fold or domain or sub-domain
FLNDEVFTTDLGPKFNFFVKKKLNL

SEQ ID NO: 26360 - protein, 24 aa, artificial
  peptide fold or domain or sub-domain
YILYVRMENNIYISYVLHFEHFIN

SEQ ID NO: 26361 - protein, 29 aa, artificial
  peptide fold or domain or sub-domain
PSLSQESPTKVVLKAIVQLHDIFSSHLSL

SEQ ID NO: 26362 - protein, 29 aa, artificial
  peptide fold or domain or sub-domain
QLLQGPSASYMQTCVFPCNFGSQINTNSI

SEQ ID NO: 26363 - protein, 27 aa, artificial
  peptide fold or domain or sub-domain
NHVLAVSMRSHEAQKSACLCLPSAGLK

SEQ ID NO: 26364 - protein, 29 aa, artificial
  peptide fold or domain or sub-domain
DNLKSIKIIKNTHTLHSTYILQYEIKNAF

SEQ ID NO: 26365 - protein, 24 aa, artificial
  peptide fold or domain or sub-domain
LSYTHEEIKYIFVETFQHICMLML

SEQ ID NO: 26366 - protein, 30 aa, artificial
  peptide fold or domain or sub-domain
TIIKTSADIPPIQQLLYKKSSLCIKHFSNT

SEQ ID NO: 26367 - protein, 26 aa, artificial
  peptide fold or domain or sub-domain
FCSKFYEYIYKKTMKFISFINFLHFL

SEQ ID NO: 26368 - protein, 22 aa, artificial
  peptide fold or domain or sub-domain
IFPFMPLFKMNSPPLKHVVYKN

SEQ ID NO: 26369 - protein, 29 aa, artificial
  peptide fold or domain or sub-domain
HRDHFLFNVNCSYGFNKFPCVCYYIRRML

SEQ ID NO: 26370 - protein, 23 aa, artificial
  peptide fold or domain or sub-domain
HLSGRGRQTSEFEASLFDRMSSR

SEQ ID NO: 26371 - protein, 26 aa, artificial
  peptide fold or domain or sub-domain
LKIYVSYDNRKYVDKYSITIFGSLSG

SEQ ID NO: 26372 - protein, 29 aa, artificial
  peptide fold or domain or sub-domain
YGLIPQISHIIFRCYSKCPNYKKTNKIAK

SEQ ID NO: 26373 - protein, 24 aa, artificial
  peptide fold or domain or sub-domain
YKTKGSYMYIGISEFNFIYLFITF

SEQ ID NO: 26374 - protein, 23 aa, artificial
  peptide fold or domain or sub-domain
ICHFLKKYSLPHRETKDKQCMHM

SEQ ID NO: 26375 - protein, 26 aa, artificial
  peptide fold or domain or sub-domain
MPLLRSGNKTSLQGVTKSGAEMKGWT

SEQ ID NO: 26376 - protein, 28 aa, artificial
  peptide fold or domain or sub-domain
MEQRIMYRLLFLCRHIATYGDSSLFSQV

SEQ ID NO: 26377 - protein, 30 aa, artificial
  peptide fold or domain or sub-domain
HFLITKNANIHILILFIVFYFLSYCYNKLL

SEQ ID NO: 26378 - protein, 24 aa, artificial
  peptide fold or domain or sub-domain
GGPNTRYLRTFPVRELASRECSEH

SEQ ID NO: 26379 - protein, 25 aa, artificial
  peptide fold or domain or sub-domain
QQTKWCTHASEDDEARKVKNKIYSG

SEQ ID NO: 26380 - protein, 28 aa, artificial
  peptide fold or domain or sub-domain
RDVFPFFVKKKAIGKFNIYIYILLFYKK

SEQ ID NO: 26381 - protein, 25 aa, artificial
  peptide fold or domain or sub-domain
TVIHVFTLGTLMSPFMYCDLFPANI

SEQ ID NO: 26382 - protein, 28 aa, artificial
  peptide fold or domain or sub-domain
KNKHTYTYMHISVYIVLLFFLTHYHISI

SEQ ID NO: 26383 - protein, 23 aa, artificial
  peptide fold or domain or sub-domain
MNNPIYVPRPPKKKILEKVKCNL

SEQ ID NO: 26384 - protein, 24 aa, artificial
  peptide fold or domain or sub-domain
LYILAMKKYANIFKAAKVPKLCTF

SEQ ID NO: 26385 - protein, 21 aa, artificial
  peptide fold or domain or sub-domain
LHILYFISNCWLTIYKNPYHL

SEQ ID NO: 26386 - protein, 21 aa, artificial
  peptide fold or domain or sub-domain
DIISSTYFFSYISKFFFNICL

SEQ ID NO: 26387 - protein, 26 aa, artificial
  peptide fold or domain or sub-domain
YTLKNKDNFFTHILNLRAHIKKINII

SEQ ID NO: 26388 - protein, 27 aa, artificial
  peptide fold or domain or sub-domain
TNILSAAQVYQDTGESNLVEICPCCPD

SEQ ID NO: 26389 - protein, 30 aa, artificial
  peptide fold or domain or sub-domain
EFPNFCHKAGCFLNDYVRINKYLFTFSLAV

SEQ ID NO: 26390 - protein, 28 aa, artificial
  peptide fold or domain or sub-domain
LPPHPAVTMSRITSVLSNEGNQLSSLNP

SEQ ID NO: 26391 - protein, 23 aa, artificial
  peptide fold or domain or sub-domain
GCYNNYQCVLSCTKKTHAFMQLC

SEQ ID NO: 26392 - protein, 26 aa, artificial
  peptide fold or domain or sub-domain
STFPLGHCKYVCIYSGFSFGLKLPSS

SEQ ID NO: 26393 - protein, 23 aa, artificial
  peptide fold or domain or sub-domain
RKKQKEKMFYMINREFNCVPINI

SEQ ID NO: 26394 - protein, 26 aa, artificial
  peptide fold or domain or sub-domain
CFICVINNKKEISTCTIQGKKNKNIN

SEQ ID NO: 26395 - protein, 25 aa, artificial
  peptide fold or domain or sub-domain
YYVVKYTKINFVLQVNYAFLFLKSR

SEQ ID NO: 26396 - protein, 25 aa, artificial
  peptide fold or domain or sub-domain
EMAIVSLSFCKELNGDFLFIFLLSK

SEQ ID NO: 26397 - protein, 26 aa, artificial
  peptide fold or domain or sub-domain
MIVGSLPITTIHKMDDTYDISYFYLS

SEQ ID NO: 26398 - protein, 28 aa, artificial
  peptide fold or domain or sub-domain
MNHICEMSTHKDILLVHIIGTNNYKKWQ

SEQ ID NO: 26399 - protein, 21 aa, artificial
  peptide fold or domain or sub-domain
MGEFCKTRRAKQIDSLALDQR

SEQ ID NO: 26400 - protein, 21 aa, artificial
  peptide fold or domain or sub-domain
LYGCIIKFKTMYNKKTQISIF

SEQ ID NO: 26401 - protein, 27 aa, artificial
  peptide fold or domain or sub-domain
LFIKLCTVFFAWHVHNFIVVVYYILIC

SEQ ID NO: 26402 - protein, 28 aa, artificial
  peptide fold or domain or sub-domain
MCMKTVCLKVRLGWSPLIEMYLYYFYTM

SEQ ID NO: 26403 - protein, 28 aa, artificial
  peptide fold or domain or sub-domain
YNYNFGRSNLVIFKINIGRHQLSMLAEV

SEQ ID NO: 26404 - protein, 30 aa, artificial
  peptide fold or domain or sub-domain
SIMGVRQSRACAHFYTYYINAMSNQQPAKI

SEQ ID NO: 26405 - protein, 29 aa, artificial
  peptide fold or domain or sub-domain
NKNIGSISYFVNCQVKKRKYERKKIFLFI

SEQ ID NO: 26406 - protein, 26 aa, artificial
  peptide fold or domain or sub-domain
MVYLISLHIFLQSFFFFFKTDLKHKS

SEQ ID NO: 26407 - protein, 26 aa, artificial
  peptide fold or domain or sub-domain
RIMGENKVNFYDHQSLRIRFFSSIIY

SEQ ID NO: 26408 - protein, 30 aa, artificial
  peptide fold or domain or sub-domain
MRVSMISYLCFLRARPVDSIALQHMPRAHL

SEQ ID NO: 26409 - protein, 26 aa, artificial
  peptide fold or domain or sub-domain
TVNVSSLVLYQVVCSIIKAMSFTSSR

SEQ ID NO: 26410 - protein, 26 aa, artificial
  peptide fold or domain or sub-domain
HRRKTRTVCKILLSTDSLPARMEALV

SEQ ID NO: 26411 - protein, 27 aa, artificial
  peptide fold or domain or sub-domain
FSVWICIPPNFFETGFICVTAPGCPGT

SEQ ID NO: 26412 - protein, 30 aa, artificial
  peptide fold or domain or sub-domain
MNTPIVTVFTHFCLQWTFTFVVLWSFNSPS

SEQ ID NO: 26413 - protein, 26 aa, artificial
  peptide fold or domain or sub-domain
VDYLTLTWTILDSISECPLILTWTSI

SEQ ID NO: 26414 - protein, 21 aa, artificial
  peptide fold or domain or sub-domain
SWVVIKKPQPGKGTQESQSSM

SEQ ID NO: 26415 - protein, 24 aa, artificial
  peptide fold or domain or sub-domain
GGLPWLSPHPGTLSLYRTRCILSH

SEQ ID NO: 26416 - protein, 26 aa, artificial
  peptide fold or domain or sub-domain
EGGPKARYLFTFHVRGELACRECSDH

SEQ ID NO: 26417 - protein, 28 aa, artificial
  peptide fold or domain or sub-domain
MFCLYKVVVYVSYKEGVTLPLNYAHFLI

SEQ ID NO: 26418 - protein, 24 aa, artificial
  peptide fold or domain or sub-domain
MTANHYEAEYFISLPWVGNLLIGY

SEQ ID NO: 26419 - protein, 30 aa, artificial
  peptide fold or domain or sub-domain
PTMKFSRLYPLVMVLKVMEDSLLNVSRKPF

SEQ ID NO: 26420 - protein, 25 aa, artificial
  peptide fold or domain or sub-domain
KRTYKLLVPRGRVSTDFHECLFCYG

SEQ ID NO: 26421 - protein, 25 aa, artificial
  peptide fold or domain or sub-domain
IFIYNIKDCETNPFTKFENIINKNF

SEQ ID NO: 26422 - protein, 27 aa, artificial
  peptide fold or domain or sub-domain
LFKKKKIYIYVLHNFFFVIYAYGYAYT

SEQ ID NO: 26423 - protein, 29 aa, artificial
  peptide fold or domain or sub-domain
DYIFFISPFKQNSYALYIIIAFSQIKKMQ

SEQ ID NO: 26424 - protein, 23 aa, artificial
  peptide fold or domain or sub-domain
KNNFNFICSLLFIITSKIYYEKL

SEQ ID NO: 26425 - protein, 26 aa, artificial
  peptide fold or domain or sub-domain
MDNGIEADKPTCENIFRNMCKVICYA

SEQ ID NO: 26426 - protein, 24 aa, artificial
  peptide fold or domain or sub-domain
FILPYGSQSLIFYTFCSFNLVTAM

SEQ ID NO: 26427 - protein, 21 aa, artificial
  peptide fold or domain or sub-domain
EVSKNPSSSLVKSQKENFEQV

SEQ ID NO: 26428 - protein, 19 aa, artificial
  peptide fold or domain or sub-domain
MHTNKPFLYVSFFIHTLSL

SEQ ID NO: 26429 - protein, 29 aa, artificial
  peptide fold or domain or sub-domain
QQVHLLRFIGRRYGIERKFLLKLGNHFFN

SEQ ID NO: 26430 - protein, 28 aa, artificial
  peptide fold or domain or sub-domain
MRDAEVRTVASIFFFPTKCQKMSYLYHQ

SEQ ID NO: 26431 - protein, 30 aa, artificial
  peptide fold or domain or sub-domain
ALGERKGCRSPSSYKPSRLCICANPSKITG

SEQ ID NO: 26432 - protein, 29 aa, artificial
  peptide fold or domain or sub-domain
MREDTVTLRAIKPLMKAASLVKVFEKRVN

SEQ ID NO: 26433 - protein, 24 aa, artificial
  peptide fold or domain or sub-domain
LEERGSLFTKCPRLPHHIRILAKW

SEQ ID NO: 26434 - protein, 25 aa, artificial
  peptide fold or domain or sub-domain
MMDLFPFLFFLLKYPFISLSAYSHI

SEQ ID NO: 26435 - protein, 30 aa, artificial
  peptide fold or domain or sub-domain
ISPCTLILGALLNRVYMPYLNPFTNRNGDH

SEQ ID NO: 26436 - protein, 27 aa, artificial
  peptide fold or domain or sub-domain
SAKPHFHNRQHTSLQIHPYKLSSYYVF

SEQ ID NO: 26437 - protein, 29 aa, artificial
  peptide fold or domain or sub-domain
SLIFYRSSTCNPTHAVSSCVLNPERTHTP

SEQ ID NO: 26438 - protein, 28 aa, artificial
  peptide fold or domain or sub-domain
GKQKLLKIEMRKDGCRYRHERGYKDIFF

SEQ ID NO: 26439 - protein, 28 aa, artificial
  peptide fold or domain or sub-domain
LESLKKRVSQLSFYLCQMSLGHVCVYFL

SEQ ID NO: 26440 - protein, 29 aa, artificial
  peptide fold or domain or sub-domain
NKKSDQQSHLYIRKLNPELTPERQMIFRP

SEQ ID NO: 26441 - protein, 30 aa, artificial
  peptide fold or domain or sub-domain
FEKYWYWVFFEVLIEFCTKIICPWPFFLWF

SEQ ID NO: 26442 - protein, 15 aa, artificial
  peptide fold or domain or sub-domain
CLGIVCWKRYIRIHS

SEQ ID NO: 26443 - protein, 30 aa, artificial
  peptide fold or domain or sub-domain
MDFCDFNSSLSFLQKIKDYVYVDYDFHILL

SEQ ID NO: 26444 - protein, 26 aa, artificial
  peptide fold or domain or sub-domain
LKININNSWPVAGGTLDMKAIQFYTW

SEQ ID NO: 26445 - protein, 26 aa, artificial
  peptide fold or domain or sub-domain
MSSIKNYLPDILMNMMTGPMVLRPTA

SEQ ID NO: 26446 - protein, 23 aa, artificial
  peptide fold or domain or sub-domain
LTLETKALSLSLDFFMFKESVSG

SEQ ID NO: 26447 - protein, 27 aa, artificial
  peptide fold or domain or sub-domain
QMLRYQNRQRLVVIFNIAPFCSLYIIF

SEQ ID NO: 26448 - protein, 21 aa, artificial
  peptide fold or domain or sub-domain
IIRILNEEWNTEYNRKKRDVA

SEQ ID NO: 26449 - protein, 27 aa, artificial
  peptide fold or domain or sub-domain
HYYQILYLKYMNLMHMSKILISSLTYL

SEQ ID NO: 26450 - protein, 30 aa, artificial
  peptide fold or domain or sub-domain
CQIMQPELFNAFIVNKHWLTLIVKILYMDK

SEQ ID NO: 26451 - protein, 30 aa, artificial
  peptide fold or domain or sub-domain
MMMCLKLLDILTNNTSYTPNLGSRNKQYKW

SEQ ID NO: 26452 - protein, 26 aa, artificial
  peptide fold or domain or sub-domain
AINIYICNFKLKYIDNMHTGHWALSI

SEQ ID NO: 26453 - protein, 25 aa, artificial
  peptide fold or domain or sub-domain
MNHMLYGVIHFPIALNHVLLVPLNL

SEQ ID NO: 26454 - protein, 28 aa, artificial
  peptide fold or domain or sub-domain
FFFNLIFSCNKRLTNITIVKLLLSIKQE

SEQ ID NO: 26455 - protein, 25 aa, artificial
  peptide fold or domain or sub-domain
MSFQGCLHAPQLDNNGLNLSNVSKS

SEQ ID NO: 26456 - protein, 25 aa, artificial
  peptide fold or domain or sub-domain
LSLTHHFVCPSIRHHFQTWLLPSTN

SEQ ID NO: 26457 - protein, 26 aa, artificial
  peptide fold or domain or sub-domain
MSCCHSKLRSHSVTGQVSHHVHHCGL

SEQ ID NO: 26458 - protein, 29 aa, artificial
  peptide fold or domain or sub-domain
MHMWYIYMCMHFLFISNISLNAQYREIRN

SEQ ID NO: 26459 - protein, 29 aa, artificial
  peptide fold or domain or sub-domain
STDSNLYCSYIHEYEAIPWRLVGLAVVTL

SEQ ID NO: 26460 - protein, 27 aa, artificial
  peptide fold or domain or sub-domain
PYVSSPMDVNFPIYLATYFFDGKFAHF

SEQ ID NO: 26461 - protein, 19 aa, artificial
  peptide fold or domain or sub-domain
KCLLTGAWYGCSLRGSAST

SEQ ID NO: 26462 - protein, 21 aa, artificial
  peptide fold or domain or sub-domain
VINMSVVYKASKLDKFIWKGD

SEQ ID NO: 26463 - protein, 30 aa, artificial
  peptide fold or domain or sub-domain
AQVAEELLFYPHFLVPFFVIRFEFSTRYIC

SEQ ID NO: 26464 - protein, 21 aa, artificial
  peptide fold or domain or sub-domain
YKEYMSYDSIHPFFFFFKGKL

SEQ ID NO: 26465 - protein, 27 aa, artificial
  peptide fold or domain or sub-domain
LSQEQPLNSSFHRGGHEVSFPSFSILP

SEQ ID NO: 26466 - protein, 26 aa, artificial
  peptide fold or domain or sub-domain
SHVGQVGTCLQSEELVWLNELRPQES

SEQ ID NO: 26467 - protein, 30 aa, artificial
  peptide fold or domain or sub-domain
REITPFRFKKKENIYIVKKVLCKIRNIFFS

SEQ ID NO: 26468 - protein, 28 aa, artificial
  peptide fold or domain or sub-domain
MTGVCTFTCLIIYFLLPNLKRYNINIMV

SEQ ID NO: 26469 - protein, 30 aa, artificial
  peptide fold or domain or sub-domain
LPRNFFKKPFVSWIRGRRFYLHSSWGLSRR

SEQ ID NO: 26470 - protein, 23 aa, artificial
  peptide fold or domain or sub-domain
IKYDLFLHQRFFFSSSHALITSA

SEQ ID NO: 26471 - protein, 30 aa, artificial
  peptide fold or domain or sub-domain
TGLIDKRLKIQYRAKCHPTIPYKRVEHHHS

SEQ ID NO: 26472 - protein, 27 aa, artificial
  peptide fold or domain or sub-domain
MHVHLLQLLQLGSQSVIEISSDTILAG

SEQ ID NO: 26473 - protein, 23 aa, artificial
  peptide fold or domain or sub-domain
LKNAQTGSQPKNYCEASDRASVF

SEQ ID NO: 26474 - protein, 28 aa, artificial
  peptide fold or domain or sub-domain
KFLFFFLEISFCYRWKLLQRSPTSQNAK

SEQ ID NO: 26475 - protein, 24 aa, artificial
  peptide fold or domain or sub-domain
QDLPPRPGIRGMHHHTQPSIYFTF

SEQ ID NO: 26476 - protein, 27 aa, artificial
  peptide fold or domain or sub-domain
LFLTLSHGLMVHIHLSSTIGQFFCRSI

SEQ ID NO: 26477 - protein, 26 aa, artificial
  peptide fold or domain or sub-domain
LLKSLITQARGPKHNPQNPYSKNKKK

SEQ ID NO: 26478 - protein, 30 aa, artificial
  peptide fold or domain or sub-domain
MTTNKFNNKEGASIIGNVYQKFNVHNTYNG

SEQ ID NO: 26479 - protein, 25 aa, artificial
  peptide fold or domain or sub-domain
MSFCPTQRGDPQHNIGYRLVFMSTS

SEQ ID NO: 26480 - protein, 28 aa, artificial
  peptide fold or domain or sub-domain
PDFGPHVSRCPLLCSLYNSPLTSPIFPA

SEQ ID NO: 26481 - protein, 29 aa, artificial
  peptide fold or domain or sub-domain
MHMDIFKKYIKKNAHQCDIMHALKIPHCT

SEQ ID NO: 26482 - protein, 29 aa, artificial
  peptide fold or domain or sub-domain
LGVWSIFVRGYIYLQGFYTINYIFLKNKV

SEQ ID NO: 26483 - protein, 28 aa, artificial
  peptide fold or domain or sub-domain
MTYIIYWGFFIMTFQLFNMATTPNLLIC

SEQ ID NO: 26484 - protein, 26 aa, artificial
  peptide fold or domain or sub-domain
CACTHSNQSNDFQMILFTFPISMKIT

SEQ ID NO: 26485 - protein, 22 aa, artificial
  peptide fold or domain or sub-domain
GSLCSPGCPQSPSCPCLPECWE

SEQ ID NO: 26486 - protein, 25 aa, artificial
  peptide fold or domain or sub-domain
SEIDALAIFFDPHFKYLGIFSNKLS

SEQ ID NO: 26487 - protein, 27 aa, artificial
  peptide fold or domain or sub-domain
DARISASSELLILCDHIPYIIFMYGLL

SEQ ID NO: 26488 - protein, 30 aa, artificial
  peptide fold or domain or sub-domain
THPAVVPMGPSGSLAGSFENPAFCVLEWAR

SEQ ID NO: 26489 - protein, 28 aa, artificial
  peptide fold or domain or sub-domain
IQMYEPMWVIFTEATIHKENLKNTNETP

SEQ ID NO: 26490 - protein, 27 aa, artificial
  peptide fold or domain or sub-domain
SLHSHSPAFCLPLLTYAEQFELVKSIA

SEQ ID NO: 26491 - protein, 29 aa, artificial
  peptide fold or domain or sub-domain
IVPLLPPHICNYRNTVPHSKLCLSIYFYS

SEQ ID NO: 26492 - protein, 29 aa, artificial
  peptide fold or domain or sub-domain
MGFCCVTQAGLELVIPLPQCWDYKLVALY

SEQ ID NO: 26493 - protein, 24 aa, artificial
  peptide fold or domain or sub-domain
FFPQETKFTLKADPRKFNLKGILQ

SEQ ID NO: 26494 - protein, 21 aa, artificial
  peptide fold or domain or sub-domain
FNFISRHTHFYLYVIVLHYLL

SEQ ID NO: 26495 - protein, 27 aa, artificial
  peptide fold or domain or sub-domain
HDTEILATLHISLLPCFMGSLFLRPSA

SEQ ID NO: 26496 - protein, 20 aa, artificial
  peptide fold or domain or sub-domain
CVHDACAIQKRAQFSWNSWL

SEQ ID NO: 26497 - protein, 23 aa, artificial
  peptide fold or domain or sub-domain
LNLEPLYKVQHRSAQSQTHLYVQ

SEQ ID NO: 26498 - protein, 30 aa, artificial
  peptide fold or domain or sub-domain
AHICACMHTYIHTYIHTHVCWIVLCQLDTN

SEQ ID NO: 26499 - protein, 27 aa, artificial
  peptide fold or domain or sub-domain
MRKHTHADTCSHTDRPTCARRHIYINM

SEQ ID NO: 26500 - protein, 24 aa, artificial
  peptide fold or domain or sub-domain
PGFLTPGPSLNSFPRHCEAAGSCV

SEQ ID NO: 26501 - protein, 29 aa, artificial
  peptide fold or domain or sub-domain
MTPACWINKPLPFCIDLHLCISVSGTSQI

SEQ ID NO: 26502 - protein, 27 aa, artificial
  peptide fold or domain or sub-domain
MKNCVCAYTSKLWCHNSIGINLSPGYR

SEQ ID NO: 26503 - protein, 28 aa, artificial
  peptide fold or domain or sub-domain
SFPRFPLEGLFAEGSHVPKLLVPKLVVT

SEQ ID NO: 26504 - protein, 22 aa, artificial
  peptide fold or domain or sub-domain
WGASGTESADTHKVPTGPSTGS

SEQ ID NO: 26505 - protein, 16 aa, artificial
  peptide fold or domain or sub-domain
SEKDIGAKENKARLVS

SEQ ID NO: 26506 - protein, 24 aa, artificial
  peptide fold or domain or sub-domain
MQPWLVLNSVRSSCFCLQNAGIKD

SEQ ID NO: 26507 - protein, 27 aa, artificial
  peptide fold or domain or sub-domain
VKDKLSNLRNGKELLGIYFSDMFILQP

SEQ ID NO: 26508 - protein, 23 aa, artificial
  peptide fold or domain or sub-domain
TYYNYYKVAKSFQLNFSYIIKKR

SEQ ID NO: 26509 - protein, 21 aa, artificial
  peptide fold or domain or sub-domain
MQKRKLNSDNYKSRDWMEISK

SEQ ID NO: 26510 - protein, 25 aa, artificial
  peptide fold or domain or sub-domain
SLEHRFKKNYIHRYINLRENKTFFM

SEQ ID NO: 26511 - protein, 22 aa, artificial
  peptide fold or domain or sub-domain
ELNFLHKHMLNINIFLATCRRK

SEQ ID NO: 26512 - protein, 29 aa, artificial
  peptide fold or domain or sub-domain
NIKNICTHICQNSIFLCILCFNNFFTLKF

SEQ ID NO: 26513 - protein, 28 aa, artificial
  peptide fold or domain or sub-domain
IHMAQFNKNNDVINVPHAHLEKLWNIGF

SEQ ID NO: 26514 - protein, 28 aa, artificial
  peptide fold or domain or sub-domain
MKKINNNKVNKKHVSIFSPKINNLQTLL

SEQ ID NO: 26515 - protein, 28 aa, artificial
  peptide fold or domain or sub-domain
FFSYLIQYFFNLQIFQKSKKIILMIKFR

SEQ ID NO: 26516 - protein, 29 aa, artificial
  peptide fold or domain or sub-domain
MRYINNFVFFILLCSFILSINIFVVSLHF

SEQ ID NO: 26517 - protein, 25 aa, artificial
  peptide fold or domain or sub-domain
MLTPEEYTNYKDNSSQKQIIYMYKN

SEQ ID NO: 26518 - protein, 29 aa, artificial
  peptide fold or domain or sub-domain
FIIILSCYFLSLVNATLSYFMFKENRPRN

SEQ ID NO: 26519 - protein, 30 aa, artificial
  peptide fold or domain or sub-domain
MLISIHRYAEYMCILLCIKHPFSYQICIFS

SEQ ID NO: 26520 - protein, 27 aa, artificial
  peptide fold or domain or sub-domain
VYFYMAISDLSIILKSKRALIISKYIS

SEQ ID NO: 26521 - protein, 30 aa, artificial
  peptide fold or domain or sub-domain
LVIFYIFFVLIHIYLSIYCIWLHEEFLLIA

SEQ ID NO: 26522 - protein, 25 aa, artificial
  peptide fold or domain or sub-domain
VYICVTILNSFYIFIWGGVNNNILN

SEQ ID NO: 26523 - protein, 23 aa, artificial
  peptide fold or domain or sub-domain
CKYVSFSNTLIIQYIFLYIFLFY

SEQ ID NO: 26524 - protein, 23 aa, artificial
  peptide fold or domain or sub-domain
SFIFPFLQYYYIFSNYFCSYTIK

SEQ ID NO: 26525 - protein, 28 aa, artificial
  peptide fold or domain or sub-domain
VLLSQPHICNICMINISYLKNRDKVVIL

SEQ ID NO: 26526 - protein, 29 aa, artificial
  peptide fold or domain or sub-domain
MTLSPCVFVEDILYIMILTLKYYAHKKKF

SEQ ID NO: 26527 - protein, 23 aa, artificial
  peptide fold or domain or sub-domain
PDFYHLFYFKLKKNEKLLKTACL

SEQ ID NO: 26528 - protein, 30 aa, artificial
  peptide fold or domain or sub-domain
MFFTKTYFKSYDSDKKNIIRVQTQIWQKTK

SEQ ID NO: 26529 - protein, 26 aa, artificial
  peptide fold or domain or sub-domain
HGKIELKKNTNNILHMLDKMCKIRRL

SEQ ID NO: 26530 - protein, 27 aa, artificial
  peptide fold or domain or sub-domain
ENASNVYICMRLFLKNKIFIKVKKYSD

SEQ ID NO: 26531 - protein, 30 aa, artificial
  peptide fold or domain or sub-domain
KNIFYYSTNAKILFSVSSSVFLIVFFMAFK

SEQ ID NO: 26532 - protein, 26 aa, artificial
  peptide fold or domain or sub-domain
HYVDYTTYNFNMYSSIFCTYILNVYE

SEQ ID NO: 26533 - protein, 29 aa, artificial
  peptide fold or domain or sub-domain
MNKYYKFTNIILKKAESQDTNSYTIYIFL

SEQ ID NO: 26534 - protein, 30 aa, artificial
  peptide fold or domain or sub-domain
LLFYPKGTQKTFINLLIDNTNLIEQGKAIK

SEQ ID NO: 26535 - protein, 26 aa, artificial
  peptide fold or domain or sub-domain
TSRVIVFPEKKNYYVYKFAYKNVYIH

SEQ ID NO: 26536 - protein, 23 aa, artificial
  peptide fold or domain or sub-domain
PITYTTIYQLKYFKDILKYELIS

SEQ ID NO: 26537 - protein, 30 aa, artificial
  peptide fold or domain or sub-domain
KLQKDKNVVVYLQMLYILKQNSPFQPYNFF

SEQ ID NO: 26538 - protein, 30 aa, artificial
  peptide fold or domain or sub-domain
MKKTIYVLPYFPNILYNIKLEKYYKKYNGF

SEQ ID NO: 26539 - protein, 29 aa, artificial
  peptide fold or domain or sub-domain
NNMFLKPIQNYIWKIYIFNFWAVHINKRI

SEQ ID NO: 26540 - protein, 15 aa, artificial
  peptide fold or domain or sub-domain
MYNAYFLFAHINFHV

SEQ ID NO: 26541 - protein, 30 aa, artificial
  peptide fold or domain or sub-domain
NFYLFSTRVPFICRRKIYIHAYKIIIMYIM

SEQ ID NO: 26542 - protein, 25 aa, artificial
  peptide fold or domain or sub-domain
KIFKILLILLCLMLHFKKKCTMTKC

SEQ ID NO: 26543 - protein, 21 aa, artificial
  peptide fold or domain or sub-domain
KHLKNIIYFFVFFKYIIQNYK

SEQ ID NO: 26544 - protein, 28 aa, artificial
  peptide fold or domain or sub-domain
MHKIYVIHWICKHNMSHSFLQYILYNVV

SEQ ID NO: 26545 - protein, 30 aa, artificial
  peptide fold or domain or sub-domain
KNHKYRKEGELSYFQVAISDTHVTKEIKIN

SEQ ID NO: 26546 - protein, 23 aa, artificial
  peptide fold or domain or sub-domain
KIKVRNIQYYGNVFICLCVYDKY

SEQ ID NO: 26547 - protein, 30 aa, artificial
  peptide fold or domain or sub-domain
NIMVYTSRALSFFFYLFICYIVLYFGRKKL

SEQ ID NO: 26548 - protein, 26 aa, artificial
  peptide fold or domain or sub-domain
KEVGSKLLGIEWAYVYLKKIIYLTSF

SEQ ID NO: 26549 - protein, 20 aa, artificial
  peptide fold or domain or sub-domain
YVSSLQQFCHIMTNILYNTY

SEQ ID NO: 26550 - protein, 30 aa, artificial
  peptide fold or domain or sub-domain
CLCTNFLMYTQKKKLYQNGDETKQWKIKRG

SEQ ID NO: 26551 - protein, 26 aa, artificial
  peptide fold or domain or sub-domain
RVIYTLFHIIKFYFFSFCNITRNIYH

SEQ ID NO: 26552 - protein, 30 aa, artificial
  peptide fold or domain or sub-domain
KKIILHFAFNLYSNCRIYIFIFMNNLISIG

SEQ ID NO: 26553 - protein, 25 aa, artificial
  peptide fold or domain or sub-domain
AKINSLFFILLKFSLIFKTSFSVCK

SEQ ID NO: 26554 - protein, 28 aa, artificial
  peptide fold or domain or sub-domain
RIVVNATLMFNNFVPRDYISYTFDESQY

SEQ ID NO: 26555 - protein, 29 aa, artificial
  peptide fold or domain or sub-domain
GKLLIICIFCFQLYCITNYFLMLIIKRAQ

SEQ ID NO: 26556 - protein, 29 aa, artificial
  peptide fold or domain or sub-domain
WHKKNFCFIIKLRRFNKYKYFFVCTQGTY

SEQ ID NO: 26557 - protein, 26 aa, artificial
  peptide fold or domain or sub-domain
IMYEKLYLQCATTNGDLGSNNYNHLC

SEQ ID NO: 26558 - protein, 26 aa, artificial
  peptide fold or domain or sub-domain
IKICALFLHYEDSVADYIFEHVVFTF

SEQ ID NO: 26559 - protein, 28 aa, artificial
  peptide fold or domain or sub-domain
MLQEKKIIINTSGKKYYKNSHKISGRVS

SEQ ID NO: 26560 - protein, 30 aa, artificial
  peptide fold or domain or sub-domain
MLLQLCVYYASHHIHIANVSHLLIIFFKKM

SEQ ID NO: 26561 - protein, 24 aa, artificial
  peptide fold or domain or sub-domain
MKELSKCEFLFLIFFHVYKIFLSV

SEQ ID NO: 26562 - protein, 21 aa, artificial
  peptide fold or domain or sub-domain
NQRKKQIKIYYPISKGYNYMR

SEQ ID NO: 26563 - protein, 20 aa, artificial
  peptide fold or domain or sub-domain
LVVTFIQGNLQKNIYIQNIN

SEQ ID NO: 26564 - protein, 26 aa, artificial
  peptide fold or domain or sub-domain
IKFDIIFYSPCYIQLQGWMKFGKKNI

SEQ ID NO: 26565 - protein, 29 aa, artificial
  peptide fold or domain or sub-domain
DYATQRSCTINSEHILFVFFINLKQMKTL

SEQ ID NO: 26566 - protein, 21 aa, artificial
  peptide fold or domain or sub-domain
STYIYMLKLMKMYSKSKEKNS

SEQ ID NO: 26567 - protein, 26 aa, artificial
  peptide fold or domain or sub-domain
IAVYNHMPSVFYSFIIIYHLFFQKNP

SEQ ID NO: 26568 - protein, 28 aa, artificial
  peptide fold or domain or sub-domain
RSYYIQMSHDLNNWGNKLFAELTLHNNL

SEQ ID NO: 26569 - protein, 29 aa, artificial
  peptide fold or domain or sub-domain
SSVIWEKTEVELLVNGIKVQNKYVHAYYL

SEQ ID NO: 26570 - protein, 23 aa, artificial
  peptide fold or domain or sub-domain
LKSSQIVYINKNSFKYMKYPPEF

SEQ ID NO: 26571 - protein, 28 aa, artificial
  peptide fold or domain or sub-domain
NDLKNIFILKRERACEKTNYTCKLKCLC

SEQ ID NO: 26572 - protein, 22 aa, artificial
  peptide fold or domain or sub-domain
QFPSPIYELMYLYIPLSKNCIP

SEQ ID NO: 26573 - protein, 23 aa, artificial
  peptide fold or domain or sub-domain
SVNMYAWFPPDIGLVNKKRCFIF

SEQ ID NO: 26574 - protein, 25 aa, artificial
  peptide fold or domain or sub-domain
YNIYDIFIFKYYNKFLQIHIGLLFK

SEQ ID NO: 26575 - protein, 21 aa, artificial
  peptide fold or domain or sub-domain
KYMKNKFPSIASYVVCAYKLY

SEQ ID NO: 26576 - protein, 24 aa, artificial
  peptide fold or domain or sub-domain
SIEGNQIKDKIKKEMEKVTFHINN

SEQ ID NO: 26577 - protein, 30 aa, artificial
  peptide fold or domain or sub-domain
TRFFFYFSYHTSIKLYKIYGYIFSLLSLIY

SEQ ID NO: 26578 - protein, 21 aa, artificial
  peptide fold or domain or sub-domain
MHFMGQNTHSIYIYMAPNYRS

SEQ ID NO: 26579 - protein, 29 aa, artificial
  peptide fold or domain or sub-domain
TCINRFVCFSLDDLQILKYNSSIFVYKKN

SEQ ID NO: 26580 - protein, 29 aa, artificial
  peptide fold or domain or sub-domain
KIIFVAKKTNKRMNKALIITPMLNNICQH

SEQ ID NO: 26581 - protein, 30 aa, artificial
  peptide fold or domain or sub-domain
IYELKEEMEVRKKHEQVVNCIDEKMRLLNI

SEQ ID NO: 26582 - protein, 25 aa, artificial
  peptide fold or domain or sub-domain
RFKFICFPFYHAYKFSYYVENCFTL

SEQ ID NO: 26583 - protein, 29 aa, artificial
  peptide fold or domain or sub-domain
MICIYRLLICLHVIIPFFVAVCECLFIFI

SEQ ID NO: 26584 - protein, 24 aa, artificial
  peptide fold or domain or sub-domain
KIKVFLHYIYISIKYRQSTLYFIL

SEQ ID NO: 26585 - protein, 26 aa, artificial
  peptide fold or domain or sub-domain
NFMVHLNNYVTCIMKLMQTNQHARNI

SEQ ID NO: 26586 - protein, 24 aa, artificial
  peptide fold or domain or sub-domain
VNKPLANRFYAKKYMQSLTFNALI

SEQ ID NO: 26587 - protein, 28 aa, artificial
  peptide fold or domain or sub-domain
IHFISIFMHTYSYYIYVHFPLKNMNCAC

SEQ ID NO: 26588 - protein, 22 aa, artificial
  peptide fold or domain or sub-domain
MSNYVYYRSVNFCGEQNKNYST

SEQ ID NO: 26589 - protein, 22 aa, artificial
  peptide fold or domain or sub-domain
KKKYICICCGYNRGIFALNKYY

SEQ ID NO: 26590 - protein, 27 aa, artificial
  peptide fold or domain or sub-domain
SKYLHILYLLFRWVCIFIIKLINNIKL

SEQ ID NO: 26591 - protein, 27 aa, artificial
  peptide fold or domain or sub-domain
TFNDEVLKFLLCKHYTYIYKHQIFIFS

SEQ ID NO: 26592 - protein, 23 aa, artificial
  peptide fold or domain or sub-domain
KVYNLCALIQLRKKKNCDKEHNI

SEQ ID NO: 26593 - protein, 30 aa, artificial
  peptide fold or domain or sub-domain
YLNKAFIFLFNFLKYLSLFLLIRKYKQKIV

SEQ ID NO: 26594 - protein, 25 aa, artificial
  peptide fold or domain or sub-domain
YQKNNFIKFFTDIFDFKHVLDYKGT

SEQ ID NO: 26595 - protein, 23 aa, artificial
  peptide fold or domain or sub-domain
ALSPKSEKRVHMYIMHMLLKKIT

SEQ ID NO: 26596 - protein, 25 aa, artificial
  peptide fold or domain or sub-domain
YIYFTYMKSSMFQVINDNFQTKKIR

SEQ ID NO: 26597 - protein, 26 aa, artificial
  peptide fold or domain or sub-domain
MFLKFTKLSISSRCTYIDVHVYFFLS

SEQ ID NO: 26598 - protein, 30 aa, artificial
  peptide fold or domain or sub-domain
ETFGDEMEKSGKEWYEQNLVNDVPRKLTIM

SEQ ID NO: 26599 - protein, 21 aa, artificial
  peptide fold or domain or sub-domain
LKTSIKTFKSLRLTLTFFKLN

SEQ ID NO: 26600 - protein, 22 aa, artificial
  peptide fold or domain or sub-domain
YFCFFLNICKRNEFYMKECIYK

SEQ ID NO: 26601 - protein, 25 aa, artificial
  peptide fold or domain or sub-domain
SAIKSLNFNSPEKKKKKNIANYFSY

SEQ ID NO: 26602 - protein, 26 aa, artificial
  peptide fold or domain or sub-domain
YTHDLWNMCVYLLICFLLIFFKIKFY

SEQ ID NO: 26603 - protein, 28 aa, artificial
  peptide fold or domain or sub-domain
VEYLKHKVTQQFMKSVSFTYSYVAVKNI

SEQ ID NO: 26604 - protein, 22 aa, artificial
  peptide fold or domain or sub-domain
MNFSHSSSYFVTIWRILLFFSL

SEQ ID NO: 26605 - protein, 27 aa, artificial
  peptide fold or domain or sub-domain
ALNACMRFVFSFPIIYFFGLFKYYACA

SEQ ID NO: 26606 - protein, 21 aa, artificial
  peptide fold or domain or sub-domain
QFKDSFTRYILSVYIFYIKTI

SEQ ID NO: 26607 - protein, 27 aa, artificial
  peptide fold or domain or sub-domain
EFLMSVYIICDEQSMRACILKIKFIFK

SEQ ID NO: 26608 - protein, 29 aa, artificial
  peptide fold or domain or sub-domain
MEKNIIYENPKKDENCDKNKDSNNGEDVI

SEQ ID NO: 26609 - protein, 29 aa, artificial
  peptide fold or domain or sub-domain
DMQIFDLIWAHFSKAGTKEVYRYFTTHQV

SEQ ID NO: 26610 - protein, 30 aa, artificial
  peptide fold or domain or sub-domain
FGSKIYKNNLENISKNKTLGFIFIQTYSIL

SEQ ID NO: 26611 - protein, 29 aa, artificial
  peptide fold or domain or sub-domain
DTHTMHRYMRIFRKKKIILKQMETHSSNL

SEQ ID NO: 26612 - protein, 29 aa, artificial
  peptide fold or domain or sub-domain
ISRKETDIFNIFSYYFFVCARKDITGSSF

SEQ ID NO: 26613 - protein, 27 aa, artificial
  peptide fold or domain or sub-domain
YLLFRDDILSVHCWGGVTYEKGAVKRK

SEQ ID NO: 26614 - protein, 25 aa, artificial
  peptide fold or domain or sub-domain
KYYYGKANNEKSESLSKVIVKKMFY

SEQ ID NO: 26615 - protein, 26 aa, artificial
  peptide fold or domain or sub-domain
MSELYHRYMLQYPFISYPNCLLVLLN

SEQ ID NO: 26616 - protein, 30 aa, artificial
  peptide fold or domain or sub-domain
DYRYLSIVLFLLKSFHILFSLKMKIYFILT

SEQ ID NO: 26617 - protein, 26 aa, artificial
  peptide fold or domain or sub-domain
IKMNLFIRKYSFFHNYMCACIKTHNN

SEQ ID NO: 26618 - protein, 25 aa, artificial
  peptide fold or domain or sub-domain
MQICKNIKTINREKIRSDKKRQRFY

SEQ ID NO: 26619 - protein, 23 aa, artificial
  peptide fold or domain or sub-domain
YLFICMYIDYINILKRLHNNMFL

SEQ ID NO: 26620 - protein, 21 aa, artificial
  peptide fold or domain or sub-domain
HLYAPFYYAVHTFSIFNIIII

SEQ ID NO: 26621 - protein, 22 aa, artificial
  peptide fold or domain or sub-domain
KNFVMEKKHSVYFFCILNKIYM

SEQ ID NO: 26622 - protein, 21 aa, artificial
  peptide fold or domain or sub-domain
MSKGNNCLVYILYLQYFGNLS

SEQ ID NO: 26623 - protein, 27 aa, artificial
  peptide fold or domain or sub-domain
KTNEQEKIVTLIKSIKKINGQPPFSEL

SEQ ID NO: 26624 - protein, 26 aa, artificial
  peptide fold or domain or sub-domain
MENYRITLCTHASLLAIFFASLYVKF

SEQ ID NO: 26625 - protein, 24 aa, artificial
  peptide fold or domain or sub-domain
HSNRKTNKLQTFVIPHTFPLFKEQ

SEQ ID NO: 26626 - protein, 21 aa, artificial
  peptide fold or domain or sub-domain
NFLEERLRPYIAIIIGFPFFP

SEQ ID NO: 26627 - protein, 23 aa, artificial
  peptide fold or domain or sub-domain
MATHESVDNNKKALIVFFLETLI

SEQ ID NO: 26628 - protein, 29 aa, artificial
  peptide fold or domain or sub-domain
KQIYKKNMHIIEQIFMTCTGTGMKKKIYL

SEQ ID NO: 26629 - protein, 28 aa, artificial
  peptide fold or domain or sub-domain
PIVTFNFMYIRGGKQGLHNHIHFCFSFR

SEQ ID NO: 26630 - protein, 25 aa, artificial
  peptide fold or domain or sub-domain
ISIIREFHRGEHIAHSGLVFCKNIK

SEQ ID NO: 26631 - protein, 26 aa, artificial
  peptide fold or domain or sub-domain
MFINLIYSILHRYYILHISTLKEETK

SEQ ID NO: 26632 - protein, 28 aa, artificial
  peptide fold or domain or sub-domain
AFCYFFISLYFFNHVITISKLNYITFDL

SEQ ID NO: 26633 - protein, 29 aa, artificial
  peptide fold or domain or sub-domain
ISHNLYWVIFVLYKILLFIFLTHNLWLMP

SEQ ID NO: 26634 - protein, 28 aa, artificial
  peptide fold or domain or sub-domain
MVTINVRVEKKIIYIYIKNYSKCTSERI

SEQ ID NO: 26635 - protein, 25 aa, artificial
  peptide fold or domain or sub-domain
NCISLFVTSLLLSVYIFILTFVKSF

SEQ ID NO: 26636 - protein, 27 aa, artificial
  peptide fold or domain or sub-domain
MHRLRKNMLQIRKCYKYFFHFSPSLIV

SEQ ID NO: 26637 - protein, 23 aa, artificial
  peptide fold or domain or sub-domain
HVYNNIFYVFNYYKIIFKSDNIY

SEQ ID NO: 26638 - protein, 23 aa, artificial
  peptide fold or domain or sub-domain
KKRYFGAIYKYLHLILKRGILKA

SEQ ID NO: 26639 - protein, 26 aa, artificial
  peptide fold or domain or sub-domain
FIHSVYFFILQNDYMHTLKKKKEYKR

SEQ ID NO: 26640 - protein, 22 aa, artificial
  peptide fold or domain or sub-domain
MQNVKGKSFHFFGVYIWEYIYS

SEQ ID NO: 26641 - protein, 30 aa, artificial
  peptide fold or domain or sub-domain
QIKNVCIELKYLNKQYLFFILKKKCHFSYI

SEQ ID NO: 26642 - protein, 19 aa, artificial
  peptide fold or domain or sub-domain
NKYTYILYMDLMELTNTRQ

SEQ ID NO: 26643 - protein, 26 aa, artificial
  peptide fold or domain or sub-domain
MGKDEIKSNYKDSYYFFMSCIEVMHW

SEQ ID NO: 26644 - protein, 27 aa, artificial
  peptide fold or domain or sub-domain
ITKCNVITICKQISKETSHEYILHIYP

SEQ ID NO: 26645 - protein, 29 aa, artificial
  peptide fold or domain or sub-domain
SNFELFFFFSSYGSHILVLYNHKTQDKKK

SEQ ID NO: 26646 - protein, 30 aa, artificial
  peptide fold or domain or sub-domain
FCTIFCTIFCTFLCTIFLFARSLMEQISIL

SEQ ID NO: 26647 - protein, 27 aa, artificial
  peptide fold or domain or sub-domain
LYYFFKQKIRNKNLRIIILYIVKKKYI

SEQ ID NO: 26648 - protein, 29 aa, artificial
  peptide fold or domain or sub-domain
MYIHLFLYMYLFILCIVFYLYKFKCRFVC

SEQ ID NO: 26649 - protein, 23 aa, artificial
  peptide fold or domain or sub-domain
LIYKISEKKYNSLESNHPYIDME

SEQ ID NO: 26650 - protein, 29 aa, artificial
  peptide fold or domain or sub-domain
MHVCACNTFCIYMYYHIFLLNGCLLNFKF

SEQ ID NO: 26651 - protein, 26 aa, artificial
  peptide fold or domain or sub-domain
YAHKYIQFFKLYDNIVVCFPYFILIK

SEQ ID NO: 26652 - protein, 28 aa, artificial
  peptide fold or domain or sub-domain
SLLFFLVFFNGNKKNVRELFYFSSNIII

SEQ ID NO: 26653 - protein, 21 aa, artificial
  peptide fold or domain or sub-domain
MKECDVDAWILIPVPFGGLHI

SEQ ID NO: 26654 - protein, 24 aa, artificial
  peptide fold or domain or sub-domain
MNLFFNIYFFNERHYFPLLRASHM

SEQ ID NO: 26655 - protein, 28 aa, artificial
  peptide fold or domain or sub-domain
YKMYSFSFCFLSSYMFLILYVLTNYCII

SEQ ID NO: 26656 - protein, 23 aa, artificial
  peptide fold or domain or sub-domain
YSNKSINCFPFGIFFIYDELKRE

SEQ ID NO: 26657 - protein, 27 aa, artificial
  peptide fold or domain or sub-domain
KIHKPIYCLLKITYICEITIQPQMKKL

SEQ ID NO: 26658 - protein, 28 aa, artificial
  peptide fold or domain or sub-domain
LFCGFVEMDKICTRKRYFHDCVLSASKI

SEQ ID NO: 26659 - protein, 27 aa, artificial
  peptide fold or domain or sub-domain
MQTRLYICIHAFLFSFYIDICTEGIKW

SEQ ID NO: 26660 - protein, 27 aa, artificial
  peptide fold or domain or sub-domain
KLKNRTCALSVYIYIYNEHIDEYSLYI

SEQ ID NO: 26661 - protein, 24 aa, artificial
  peptide fold or domain or sub-domain
VRNNNTAFWSILGYEVKKERAKNC

SEQ ID NO: 26662 - protein, 24 aa, artificial
  peptide fold or domain or sub-domain
YMSVFLYISESVTFDDNFFFNSKN

SEQ ID NO: 26663 - protein, 28 aa, artificial
  peptide fold or domain or sub-domain
MNEEREQFIFYYKYVKQFELKKKIYIYI

SEQ ID NO: 26664 - protein, 21 aa, artificial
  peptide fold or domain or sub-domain
LRKNKCLSTHLIAPLDKKSKI

SEQ ID NO: 26665 - protein, 24 aa, artificial
  peptide fold or domain or sub-domain
EHLEKYANNINIRVMFFLLFYNTF

SEQ ID NO: 26666 - protein, 30 aa, artificial
  peptide fold or domain or sub-domain
FLLLFHFRDYLNYNYYFHFPIDHQDSQYID

SEQ ID NO: 26667 - protein, 25 aa, artificial
  peptide fold or domain or sub-domain
HTFLFCVFKEIKKCVIYYASATINI

SEQ ID NO: 26668 - protein, 22 aa, artificial
  peptide fold or domain or sub-domain
INLVHFTINNDSILIFLGGCRG

SEQ ID NO: 26669 - protein, 26 aa, artificial
  peptide fold or domain or sub-domain
WVIYIFFFCETFFSANIIYVMFRVYE

SEQ ID NO: 26670 - protein, 28 aa, artificial
  peptide fold or domain or sub-domain
MLNRKENYLQNCIMYILFLYLKVNKWVY

SEQ ID NO: 26671 - protein, 29 aa, artificial
  peptide fold or domain or sub-domain
IFLFMHSIKLVLICLLLYFYYIYNIFFSG

SEQ ID NO: 26672 - protein, 24 aa, artificial
  peptide fold or domain or sub-domain
GKSMITGKNYKCGTRPHIYIYMYI

SEQ ID NO: 26673 - protein, 27 aa, artificial
  peptide fold or domain or sub-domain
IYFLKRKNYPDISFVILLYIGTKFTEN

SEQ ID NO: 26674 - protein, 23 aa, artificial
  peptide fold or domain or sub-domain
MFSHIYYFIFNPCIHRKNIFIHN

SEQ ID NO: 26675 - protein, 26 aa, artificial
  peptide fold or domain or sub-domain
LTFYEYYFFLFIFLMNKYARICIDIF

SEQ ID NO: 26676 - protein, 15 aa, artificial
  peptide fold or domain or sub-domain
NTIFPNTFYKQTPVL

SEQ ID NO: 26677 - protein, 25 aa, artificial
  peptide fold or domain or sub-domain
LYIYIVNIKHATCHIYVSLKTNCIG

SEQ ID NO: 26678 - protein, 27 aa, artificial
  peptide fold or domain or sub-domain
TCICACIQYVYTDVYKIYKLFNNNKNI

SEQ ID NO: 26679 - protein, 30 aa, artificial
  peptide fold or domain or sub-domain
LKNNILLFNLTMYIYFINDIALRLFFLFII

SEQ ID NO: 26680 - protein, 30 aa, artificial
  peptide fold or domain or sub-domain
MKSNLSIILHIFKAVLFLVNMHFCIFIACV

SEQ ID NO: 26681 - protein, 21 aa, artificial
  peptide fold or domain or sub-domain
KMVHLCDNKNILYCRMDFIKI

SEQ ID NO: 26682 - protein, 29 aa, artificial
  peptide fold or domain or sub-domain
YLYRTKKENTLLVHANMRMHKDIKKCINL

SEQ ID NO: 26683 - protein, 29 aa, artificial
  peptide fold or domain or sub-domain
IFSSSIGIVHFFQAYEICTFLYAHFSLLL

SEQ ID NO: 26684 - protein, 29 aa, artificial
  peptide fold or domain or sub-domain
MVFFFFVFIYLKYTHLCKQNKGFVYYKFI

SEQ ID NO: 26685 - protein, 30 aa, artificial
  peptide fold or domain or sub-domain
LDICIRTNINKYLCKDEMNYYTFPQNIYNK

SEQ ID NO: 26686 - protein, 29 aa, artificial
  peptide fold or domain or sub-domain
YWEIITINVYIFIWIMEEVSKHSFKLSLY

SEQ ID NO: 26687 - protein, 24 aa, artificial
  peptide fold or domain or sub-domain
EFIIYAIKNCGSFHIFSKNYALGQ

SEQ ID NO: 26688 - protein, 26 aa, artificial
  peptide fold or domain or sub-domain
HQVNMLLMCETFHTKKTFKNYNKNIC

SEQ ID NO: 26689 - protein, 22 aa, artificial
  peptide fold or domain or sub-domain
IYIYIHKNGYNYKFKVGEVEHF

SEQ ID NO: 26690 - protein, 29 aa, artificial
  peptide fold or domain or sub-domain
ILFFLCTKQTNGKDSLINNISSGQIYLII

SEQ ID NO: 26691 - protein, 30 aa, artificial
  peptide fold or domain or sub-domain
YFIYNIFTCTDVPLEFLIYQMVISCHIISI

SEQ ID NO: 26692 - protein, 29 aa, artificial
  peptide fold or domain or sub-domain
CIFFSIKENPLRYKKIKHHFNSRQILCYP

SEQ ID NO: 26693 - protein, 22 aa, artificial
  peptide fold or domain or sub-domain
MSIIRDKYISVMSQIVGLTTVK

SEQ ID NO: 26694 - protein, 29 aa, artificial
  peptide fold or domain or sub-domain
MSELNEFNKCPNNKIINLCNRQNHIKKAL

SEQ ID NO: 26695 - protein, 22 aa, artificial
  peptide fold or domain or sub-domain
MYKQSVCCACCNIHTNMHLFYG

SEQ ID NO: 26696 - protein, 28 aa, artificial
  peptide fold or domain or sub-domain
FIAEISTFMKRKKKNIHIYTCFIFFICS

SEQ ID NO: 26697 - protein, 25 aa, artificial
  peptide fold or domain or sub-domain
MGNKIRDVLIKIQVLNSMMNSNIYI

SEQ ID NO: 26698 - protein, 24 aa, artificial
  peptide fold or domain or sub-domain
MSEIVLKRTIKNKNTLNKNIKLCN

SEQ ID NO: 26699 - protein, 24 aa, artificial
  peptide fold or domain or sub-domain
MHIPILGLGTYIFLRYNANVCIFH

SEQ ID NO: 26700 - protein, 19 aa, artificial
  peptide fold or domain or sub-domain
LGYCFFSFTTYIEHKEIKN

SEQ ID NO: 26701 - protein, 29 aa, artificial
  peptide fold or domain or sub-domain
LEKNIYIYLSIDQILNYLHKMGKKQRLKI

SEQ ID NO: 26702 - protein, 28 aa, artificial
  peptide fold or domain or sub-domain
CKGVARGNIFFNIKSTKFKESYNNIYIY

SEQ ID NO: 26703 - protein, 30 aa, artificial
  peptide fold or domain or sub-domain
MMVDDVIAITNYNSSTKKKTFKINLIYLKR

SEQ ID NO: 26704 - protein, 26 aa, artificial
  peptide fold or domain or sub-domain
LKEIELELIVIKIQKMKFYPPKQIYK

SEQ ID NO: 26705 - protein, 23 aa, artificial
  peptide fold or domain or sub-domain
KNHRATHTYMHVALTVYIYIFYR

SEQ ID NO: 26706 - protein, 25 aa, artificial
  peptide fold or domain or sub-domain
NIHTYKKGIIYNCSNTTSGKNIKYI

SEQ ID NO: 26707 - protein, 29 aa, artificial
  peptide fold or domain or sub-domain
YKCAHISIYLHKYPNIRILKRIYIAMHIR

SEQ ID NO: 26708 - protein, 30 aa, artificial
  peptide fold or domain or sub-domain
ENTILFIIILKLRKEKTFHIIGVQWNFTFL

SEQ ID NO: 26709 - protein, 22 aa, artificial
  peptide fold or domain or sub-domain
DTTSVLHKESFELPSRYVKYIF

SEQ ID NO: 26710 - protein, 22 aa, artificial
  peptide fold or domain or sub-domain
FNICIGNHYKHVEFNKNKYAYI

SEQ ID NO: 26711 - protein, 30 aa, artificial
  peptide fold or domain or sub-domain
MKSVQTNVKKMGTSSIHKPFKLGFQFRLLQ

SEQ ID NO: 26712 - protein, 25 aa, artificial
  peptide fold or domain or sub-domain
MHNNFKYILQNIYRTDINNICMSYF

SEQ ID NO: 26713 - protein, 26 aa, artificial
  peptide fold or domain or sub-domain
MYAYFYFSLHNVIYIFFSFLTIRFSW

SEQ ID NO: 26714 - protein, 24 aa, artificial
  peptide fold or domain or sub-domain
NTLKKNLRYTFRYVVNVTYINPLL

SEQ ID NO: 26715 - protein, 26 aa, artificial
  peptide fold or domain or sub-domain
MYILHSSSFSFLQWGVGGNQTNKNGM

SEQ ID NO: 26716 - protein, 21 aa, artificial
  peptide fold or domain or sub-domain
IFTYSSKKNLTIVSTHDYAYA

SEQ ID NO: 26717 - protein, 22 aa, artificial
  peptide fold or domain or sub-domain
NINMPTTTTHNGYKYLFFYCVN

SEQ ID NO: 26718 - protein, 26 aa, artificial
  peptide fold or domain or sub-domain
ISRNHCCVFIFHKSKISQIPCVLLIM

SEQ ID NO: 26719 - protein, 30 aa, artificial
  peptide fold or domain or sub-domain
HKCCKFICYTYTCTVYIIVLLIKDMYSCSH

SEQ ID NO: 26720 - protein, 26 aa, artificial
  peptide fold or domain or sub-domain
GVFNLYTNMYNVCVWYILKKNDFMYF

SEQ ID NO: 26721 - protein, 27 aa, artificial
  peptide fold or domain or sub-domain
TVNLTTGNKPPYSPRKIARTANSCFHV

SEQ ID NO: 26722 - protein, 30 aa, artificial
  peptide fold or domain or sub-domain
YIHFMFVLSYDPCLCAFGLRMYANENYWER

SEQ ID NO: 26723 - protein, 29 aa, artificial
  peptide fold or domain or sub-domain
VCRPLNFRLYYICIYIFYFGGVLKYYIDI

SEQ ID NO: 26724 - protein, 27 aa, artificial
  peptide fold or domain or sub-domain
ICVHVSFLLIVEHAITILVGYFKKNSN

SEQ ID NO: 26725 - protein, 29 aa, artificial
  peptide fold or domain or sub-domain
QLFIFQYMDIYMFAFVYIPFPLCTFFLYI

SEQ ID NO: 26726 - protein, 25 aa, artificial
  peptide fold or domain or sub-domain
KGFIVHIYEDAYKKKKNFNIKFIHF

SEQ ID NO: 26727 - protein, 29 aa, artificial
  peptide fold or domain or sub-domain
HIFILTTGMSDKSGLKKAKKYLHLHDIYI

SEQ ID NO: 26728 - protein, 28 aa, artificial
  peptide fold or domain or sub-domain
VNMHFVYIVYDIYKYIHIKNALAFLYIF

SEQ ID NO: 26729 - protein, 29 aa, artificial
  peptide fold or domain or sub-domain
FIIKEKYIFFINTNTKELQKRKLQLNCIL

SEQ ID NO: 26730 - protein, 29 aa, artificial
  peptide fold or domain or sub-domain
WLQHESIASHLFSVNNKNYMYINFFFFFY

SEQ ID NO: 26731 - protein, 24 aa, artificial
  peptide fold or domain or sub-domain
EIIYNYLKRSHKVTGKNKKNNDLF

SEQ ID NO: 26732 - protein, 23 aa, artificial
  peptide fold or domain or sub-domain
KEQILDATYKYIYMHFHSHIYNE

SEQ ID NO: 26733 - protein, 29 aa, artificial
  peptide fold or domain or sub-domain
YKLFLFKKLYFLYKYIHISTVKIQAYKTL

SEQ ID NO: 26734 - protein, 30 aa, artificial
  peptide fold or domain or sub-domain
NNQQFCYIQIVQSTTPPLNKMKHVSELCSY

SEQ ID NO: 26735 - protein, 28 aa, artificial
  peptide fold or domain or sub-domain
MVCIYCMCICMCLFKFYKLSYYFFLYFV

SEQ ID NO: 26736 - protein, 28 aa, artificial
  peptide fold or domain or sub-domain
MFITLIKYTHKHYICILFIHYHKNALRK

SEQ ID NO: 26737 - protein, 29 aa, artificial
  peptide fold or domain or sub-domain
CFYINTYMHTNGHIYLSVSACTFFDYKYI

SEQ ID NO: 26738 - protein, 30 aa, artificial
  peptide fold or domain or sub-domain
YLPTNYIHNTYITSYPNKHIIKELTYSYRK

SEQ ID NO: 26739 - protein, 17 aa, artificial
  peptide fold or domain or sub-domain
TFCLILYHKWVNNWMDK

SEQ ID NO: 26740 - protein, 25 aa, artificial
  peptide fold or domain or sub-domain
EKIKYVKMWNPFLSIILFIIYFFFT

SEQ ID NO: 26741 - protein, 25 aa, artificial
  peptide fold or domain or sub-domain
KNKYLSFCKAILKKPHKYIFYVYYI

SEQ ID NO: 26742 - protein, 29 aa, artificial
  peptide fold or domain or sub-domain
FYNQHTIAFIILFFFNYSNYIFSNHIILK

SEQ ID NO: 26743 - protein, 23 aa, artificial
  peptide fold or domain or sub-domain
LHKIYIVLFPFSYVYRYSLYTQL

SEQ ID NO: 26744 - protein, 26 aa, artificial
  peptide fold or domain or sub-domain
VREQIFPPNFPLFSRHIKMTCTYIQK

SEQ ID NO: 26745 - protein, 26 aa, artificial
  peptide fold or domain or sub-domain
ENIHIYLYSSSAENQYLSHTFATLII

SEQ ID NO: 26746 - protein, 30 aa, artificial
  peptide fold or domain or sub-domain
MIYEYIKYNTDLWTHTKSILMYIKAHKDKV

SEQ ID NO: 26747 - protein, 26 aa, artificial
  peptide fold or domain or sub-domain
NSHEFKYIIKNDYEHIRQQQKYILIY

SEQ ID NO: 26748 - protein, 30 aa, artificial
  peptide fold or domain or sub-domain
MEKNIYENPLNLNMNKEMCMDLKPSTNITS

SEQ ID NO: 26749 - protein, 21 aa, artificial
  peptide fold or domain or sub-domain
HKMCVEKNFNIYIFHVIINKI

SEQ ID NO: 26750 - protein, 25 aa, artificial
  peptide fold or domain or sub-domain
ERFYIHICRTIKKLTLFNFLNKQIN

SEQ ID NO: 26751 - protein, 29 aa, artificial
  peptide fold or domain or sub-domain
LKIQTAIKILTKFKKRKENFYIMMKIITF

SEQ ID NO: 26752 - protein, 26 aa, artificial
  peptide fold or domain or sub-domain
KYNIYVRVSFFNIIIYSEFKKYMIFT

SEQ ID NO: 26753 - protein, 27 aa, artificial
  peptide fold or domain or sub-domain
IYAHIKKTKLSIIVVFNVEKVEIVVNY

SEQ ID NO: 26754 - protein, 24 aa, artificial
  peptide fold or domain or sub-domain
GAIFSQHFHDLFFIKYLYLYFTIT

SEQ ID NO: 26755 - protein, 21 aa, artificial
  peptide fold or domain or sub-domain
DLSKSHGTIKLDEYPLFQYNT

SEQ ID NO: 26756 - protein, 29 aa, artificial
  peptide fold or domain or sub-domain
FIVFTKNYFMICIQNDNIYFLLNLEISFL

SEQ ID NO: 26757 - protein, 30 aa, artificial
  peptide fold or domain or sub-domain
MRHICITLRNASYEQKMDRYVFPFSDNIHP

SEQ ID NO: 26758 - protein, 29 aa, artificial
  peptide fold or domain or sub-domain
NVDLFGISITSGFYYDFMILHIYNIEMIF

SEQ ID NO: 26759 - protein, 21 aa, artificial
  peptide fold or domain or sub-domain
GLMGKCIIYKNIISHLIQFPM

SEQ ID NO: 26760 - protein, 29 aa, artificial
  peptide fold or domain or sub-domain
HIFVEFINGFIILLLLVNFFLTQSLILKG

SEQ ID NO: 26761 - protein, 29 aa, artificial
  peptide fold or domain or sub-domain
MCICALYILCIYILKPLERGHRYIAVLLE

SEQ ID NO: 26762 - protein, 28 aa, artificial
  peptide fold or domain or sub-domain
KTYYLCLYYFDLVISFQPNYIVILYIRL

SEQ ID NO: 26763 - protein, 29 aa, artificial
  peptide fold or domain or sub-domain
MLYGPFILMAVPFRGRYFDFCQKLNIRKW

SEQ ID NO: 26764 - protein, 29 aa, artificial
  peptide fold or domain or sub-domain
YVYLCTHNIITQFIHAINQNARVGRGKLS

SEQ ID NO: 26765 - protein, 23 aa, artificial
  peptide fold or domain or sub-domain
GGFFFYKGILLNVTITYISLKLG

SEQ ID NO: 26766 - protein, 21 aa, artificial
  peptide fold or domain or sub-domain
NTVICFFPFINYKSRVIFNGF

SEQ ID NO: 26767 - protein, 25 aa, artificial
  peptide fold or domain or sub-domain
SLYSSYLCKLIFLYNILFLNCRTSR

SEQ ID NO: 26768 - protein, 27 aa, artificial
  peptide fold or domain or sub-domain
HRYCYNYFSNFFITLLLLIFFYSKKIS

SEQ ID NO: 26769 - protein, 30 aa, artificial
  peptide fold or domain or sub-domain
SSTFFKKHFLSRYIYTTICILIQIIYYNYL

SEQ ID NO: 26770 - protein, 27 aa, artificial
  peptide fold or domain or sub-domain
MGYENEVTKKIVWKIINNMNSQKYITL

SEQ ID NO: 26771 - protein, 19 aa, artificial
  peptide fold or domain or sub-domain
IYVHVSLCVCLHPFIVIFG

SEQ ID NO: 26772 - protein, 28 aa, artificial
  peptide fold or domain or sub-domain
LRKNGDKSAHKFGYAKCHNSHIYKCIHQ

SEQ ID NO: 26773 - protein, 23 aa, artificial
  peptide fold or domain or sub-domain
MNMDIHIMQSRYHYMFYLIYAGF

SEQ ID NO: 26774 - protein, 26 aa, artificial
  peptide fold or domain or sub-domain
DFQALLNQQVCIKYNYIILYMYILVF

SEQ ID NO: 26775 - protein, 27 aa, artificial
  peptide fold or domain or sub-domain
MKFIFFFYKRNIFTCVSHIPFIKHIWL

SEQ ID NO: 26776 - protein, 30 aa, artificial
  peptide fold or domain or sub-domain
MEFIFWGVNAHHLLYHKLIKRRISTNLCNF

SEQ ID NO: 26777 - protein, 18 aa, artificial
  peptide fold or domain or sub-domain
HRNVMVYCNFVHFFFNIN

SEQ ID NO: 26778 - protein, 30 aa, artificial
  peptide fold or domain or sub-domain
SFIAIFFNSNCLSHFYFENSINIILGKYTE

SEQ ID NO: 26779 - protein, 30 aa, artificial
  peptide fold or domain or sub-domain
MCVHEKYEIVYYCFLKGAITTTIIIKFVNI

SEQ ID NO: 26780 - protein, 25 aa, artificial
  peptide fold or domain or sub-domain
MLYNCPSNIYIFCPLMIFLFIFYIS

SEQ ID NO: 26781 - protein, 25 aa, artificial
  peptide fold or domain or sub-domain
QISTNNYLYLYGYILNTLYLFLEKI

SEQ ID NO: 26782 - protein, 25 aa, artificial
  peptide fold or domain or sub-domain
ISNLCFLIIMNICCFCRYMHMLLNL

SEQ ID NO: 26783 - protein, 28 aa, artificial
  peptide fold or domain or sub-domain
MFFISFLKTSFWLNSTLHHIDNLLVLIV

SEQ ID NO: 26784 - protein, 28 aa, artificial
  peptide fold or domain or sub-domain
YTIYFLIKKYRTYKQNGNTSLICSPVFF

SEQ ID NO: 26785 - protein, 21 aa, artificial
  peptide fold or domain or sub-domain
MFLNFLNIIIMCSGLCCLFHS

SEQ ID NO: 26786 - protein, 21 aa, artificial
  peptide fold or domain or sub-domain
SIYMYTQSMDKKIMICYQNIL

SEQ ID NO: 26787 - protein, 28 aa, artificial
  peptide fold or domain or sub-domain
MTLPVLLCILMNGTNVKYKKNEKKCRIK

SEQ ID NO: 26788 - protein, 26 aa, artificial
  peptide fold or domain or sub-domain
DIYIFFFNYKNKQIYFFTNKSLCKYL

SEQ ID NO: 26789 - protein, 24 aa, artificial
  peptide fold or domain or sub-domain
ELFRHSSYYIYVYIDIILFYFFNI

SEQ ID NO: 26790 - protein, 26 aa, artificial
  peptide fold or domain or sub-domain
IYSDIIQVLKKKTTNRTFKKRYTCAM

SEQ ID NO: 26791 - protein, 29 aa, artificial
  peptide fold or domain or sub-domain
RLYFSTIYTSEIFDIFHCCFSLIILFILL

SEQ ID NO: 26792 - protein, 24 aa, artificial
  peptide fold or domain or sub-domain
YTVVYILLNVWENQNCGHTKSHEI

SEQ ID NO: 26793 - protein, 26 aa, artificial
  peptide fold or domain or sub-domain
YYLFFLFINTFSKYASYIILECLKNK

SEQ ID NO: 26794 - protein, 24 aa, artificial
  peptide fold or domain or sub-domain
LNTHFCINIIVRRYNLKSHLSLCV

SEQ ID NO: 26795 - protein, 29 aa, artificial
  peptide fold or domain or sub-domain
MLSNFMVYYFVNSTMFALGLLISSFILKK

SEQ ID NO: 26796 - protein, 30 aa, artificial
  peptide fold or domain or sub-domain
KNVITFFLLSHSELSKHENNFIKFWNTKRG

SEQ ID NO: 26797 - protein, 28 aa, artificial
  peptide fold or domain or sub-domain
MKLIMLFFNIFNVAQLYNYFFHYIVYIF

SEQ ID NO: 26798 - protein, 30 aa, artificial
  peptide fold or domain or sub-domain
MDIIKYNRKLCVLGCYIFLLDRRDKGSMFF

SEQ ID NO: 26799 - protein, 29 aa, artificial
  peptide fold or domain or sub-domain
SEPVKSRWDTLKNDDMHVYNTDVQVFLYE

SEQ ID NO: 26800 - protein, 26 aa, artificial
  peptide fold or domain or sub-domain
IAPCDKKKIQNSNESTNKAHIRGNNK

SEQ ID NO: 26801 - protein, 28 aa, artificial
  peptide fold or domain or sub-domain
MRCFPVFQFEIKLCQLYQIIEKIKLYFL

SEQ ID NO: 26802 - protein, 27 aa, artificial
  peptide fold or domain or sub-domain
LTVLIKKTIQTKIKTNGLIIVKSAMGM

SEQ ID NO: 26803 - protein, 29 aa, artificial
  peptide fold or domain or sub-domain
MAFNIIIWKCSKIKKGTKTNILQKHKMVR

SEQ ID NO: 26804 - protein, 26 aa, artificial
  peptide fold or domain or sub-domain
MINLIAKSGKIICVHICCWFLKETYT

SEQ ID NO: 26805 - protein, 23 aa, artificial
  peptide fold or domain or sub-domain
LLMMIYIHYVAIVTKVQKKVIFM

SEQ ID NO: 26806 - protein, 25 aa, artificial
  peptide fold or domain or sub-domain
SNDYKLSNVNWNHWDNHHETFKYNL

SEQ ID NO: 26807 - protein, 25 aa, artificial
  peptide fold or domain or sub-domain
SHFMINCLFILLVIKHLFFLKNCQG

SEQ ID NO: 26808 - protein, 21 aa, artificial
  peptide fold or domain or sub-domain
SFYLRIREGYVQTFNMYLSFK

SEQ ID NO: 26809 - protein, 23 aa, artificial
  peptide fold or domain or sub-domain
MSLDLIFKNQPVERQNSNRDQTF

SEQ ID NO: 26810 - protein, 22 aa, artificial
  peptide fold or domain or sub-domain
MPVSARSMRENGRHSTPEHENY

SEQ ID NO: 26811 - protein, 18 aa, artificial
  peptide fold or domain or sub-domain
HMRLIFPRHVIFPVNELN

SEQ ID NO: 26812 - protein, 30 aa, artificial
  peptide fold or domain or sub-domain
MFKVTYASYFTVKMPLVISFIRLLKLYIWL

SEQ ID NO: 26813 - protein, 28 aa, artificial
  peptide fold or domain or sub-domain
MDASTMDTLCYTTMWSYCNQIRSVSVVD

SEQ ID NO: 26814 - protein, 29 aa, artificial
  peptide fold or domain or sub-domain
MRTRFKVIFECLQSIGMHVGSTNCRTVAN

SEQ ID NO: 26815 - protein, 27 aa, artificial
  peptide fold or domain or sub-domain
MVIIIRRLNVCIIRKYMLLLLTMMFRR

SEQ ID NO: 26816 - protein, 27 aa, artificial
  peptide fold or domain or sub-domain
MILVLCVFYKKLMKSLLISARINQLNF

SEQ ID NO: 26817 - protein, 28 aa, artificial
  peptide fold or domain or sub-domain
MAGESIESSVKRIVARKPVLILKAFFLV

SEQ ID NO: 26818 - protein, 29 aa, artificial
  peptide fold or domain or sub-domain
MVVRYLTTTFRRSLLYTLFSVYVVVCRSL

SEQ ID NO: 26819 - protein, 30 aa, artificial
  peptide fold or domain or sub-domain
MYCEPTAQIISSETRFHVIEPAICSRSVIR

SEQ ID NO: 26820 - protein, 27 aa, artificial
  peptide fold or domain or sub-domain
MYSLIRLSNILTLSGFSFCKRSFMAFK

SEQ ID NO: 26821 - protein, 23 aa, artificial
  peptide fold or domain or sub-domain
MTAFFNAILKDEKICKFLMFLRL

SEQ ID NO: 26822 - protein, 30 aa, artificial
  peptide fold or domain or sub-domain
MADLVTTLTNLYKTDWVILMQLVAKHSNTL

SEQ ID NO: 26823 - protein, 24 aa, artificial
  peptide fold or domain or sub-domain
MHRFLRELRIIPKRPHPFSLVSSA

SEQ ID NO: 26824 - protein, 29 aa, artificial
  peptide fold or domain or sub-domain
MSERSVQVFSLVPYLYCLPDLIKASALSF

SEQ ID NO: 26825 - protein, 28 aa, artificial
  peptide fold or domain or sub-domain
MQQLLMECLELVYFKLLICMNYVICHKF

SEQ ID NO: 26826 - protein, 26 aa, artificial
  peptide fold or domain or sub-domain
MEHLINSRVHRFHQSVLNHLTIYQNH

SEQ ID NO: 26827 - protein, 27 aa, artificial
  peptide fold or domain or sub-domain
MNGSRTVSLLRNSTLVTAVNLLLHIQK

SEQ ID NO: 26828 - protein, 30 aa, artificial
  peptide fold or domain or sub-domain
MITNNTLELKIRRGSSSTLQQTNNNVKIEF

SEQ ID NO: 26829 - protein, 29 aa, artificial
  peptide fold or domain or sub-domain
MVGAPLFESEAERNVNRVHQPPTTKSPYY

SEQ ID NO: 26830 - protein, 25 aa, artificial
  peptide fold or domain or sub-domain
MAMQVVEQFQLLKQKIMMWDSHLQK

SEQ ID NO: 26831 - protein, 29 aa, artificial
  peptide fold or domain or sub-domain
MVKAPFCTKMLISLSEKFSDVIRLHKLKW

SEQ ID NO: 26832 - protein, 23 aa, artificial
  peptide fold or domain or sub-domain
VTVPNRGSWVVMRPRLEDRAEFR

SEQ ID NO: 26833 - protein, 29 aa, artificial
  peptide fold or domain or sub-domain
KRSNCGTKWNNRAHFHHSHDELQNTSRYF

SEQ ID NO: 26834 - protein, 29 aa, artificial
  peptide fold or domain or sub-domain
VMMVEAGFGTHGCPLLQGTCDSHCRGMDA

SEQ ID NO: 26835 - protein, 30 aa, artificial
  peptide fold or domain or sub-domain
VTMVEAGFMAGFGCPLFQGSCDSHCRGMGR

SEQ ID NO: 26836 - protein, 28 aa, artificial
  peptide fold or domain or sub-domain
MHARAAASVMDICRIRPWSCRIPVRCDA

SEQ ID NO: 26837 - protein, 25 aa, artificial
  peptide fold or domain or sub-domain
MNTVKATHYTSDREMFPLQDKSKTL

SEQ ID NO: 26838 - protein, 17 aa, artificial
  peptide fold or domain or sub-domain
LSSYPPFNHSYNEIPSI

SEQ ID NO: 26839 - protein, 21 aa, artificial
  peptide fold or domain or sub-domain
MAEKNSSKKVTTKKPAAHPPA

SEQ ID NO: 26840 - protein, 27 aa, artificial
  peptide fold or domain or sub-domain
MSSARSTTAPMPMKDSRLSWTRRWKPS

SEQ ID NO: 26841 - protein, 27 aa, artificial
  peptide fold or domain or sub-domain
VKFGIIRLSEKSVVQLIVVSAVGPRLD

SEQ ID NO: 26842 - protein, 27 aa, artificial
  peptide fold or domain or sub-domain
HWFGRGWRIIGGILLLINQVQNYIFRQ

SEQ ID NO: 26843 - protein, 23 aa, artificial
  peptide fold or domain or sub-domain
AGIFDRIQDLSTCILIKPKHWNG

SEQ ID NO: 26844 - protein, 21 aa, artificial
  peptide fold or domain or sub-domain
MTDMWSLKICAWLGFLLLFKP

SEQ ID NO: 26845 - protein, 15 aa, artificial
  peptide fold or domain or sub-domain
MFAERSFTSYYTHFN

SEQ ID NO: 26846 - protein, 24 aa, artificial
  peptide fold or domain or sub-domain
MHNCNFTFLIYTDCQSGFVLLNSH

SEQ ID NO: 26847 - protein, 27 aa, artificial
  peptide fold or domain or sub-domain
MIPQLAPLNWLLSYLAIWMTISFVRDN

SEQ ID NO: 26848 - protein, 14 aa, artificial
  peptide fold or domain or sub-domain
FNHSFNEIPIMNKI

SEQ ID NO: 26849 - protein, 15 aa, artificial
  peptide fold or domain or sub-domain
LNHTYDETPIIMKNF

SEQ ID NO: 26850 - protein, 14 aa, artificial
  peptide fold or domain or sub-domain
FNHSFNEIPLITKF

SEQ ID NO: 26851 - protein, 15 aa, artificial
  peptide fold or domain or sub-domain
FNHSVNEIPMITQNI

SEQ ID NO: 26852 - protein, 14 aa, artificial
  peptide fold or domain or sub-domain
FNHSFNEIPIMTKN

SEQ ID NO: 26853 - protein, 15 aa, artificial
  peptide fold or domain or sub-domain
MNHSFNEIPIMVIKT

SEQ ID NO: 26854 - protein, 15 aa, artificial
  peptide fold or domain or sub-domain
VNHSFNEIPIMTTKI

SEQ ID NO: 26855 - protein, 14 aa, artificial
  peptide fold or domain or sub-domain
LNHSFNEIPIMLKN

SEQ ID NO: 26856 - protein, 14 aa, artificial
  peptide fold or domain or sub-domain
FNHSFNEIPVIASF

SEQ ID NO: 26857 - protein, 23 aa, artificial
  peptide fold or domain or sub-domain
MHRFCGDHGDCKHVDKNNGEECI

SEQ ID NO: 26858 - protein, 11 aa, artificial
  peptide fold or domain or sub-domain
GLTPNMNSLFF

SEQ ID NO: 26859 - protein, 20 aa, artificial
  peptide fold or domain or sub-domain
GSNEHDRQSIGDRQNLLSME

SEQ ID NO: 26860 - protein, 19 aa, artificial
  peptide fold or domain or sub-domain
GQNEIKGLKVKLQWAQSFG

SEQ ID NO: 26861 - protein, 13 aa, artificial
  peptide fold or domain or sub-domain
GPIVEHNYGKVEG

SEQ ID NO: 26862 - protein, 29 aa, artificial
  peptide fold or domain or sub-domain
HAHRAIHVLHCARHAFHLRTVLVVVLHIP

SEQ ID NO: 26863 - protein, 25 aa, artificial
  peptide fold or domain or sub-domain
PRSPSKGSPRKGSPRKGSPRKGSPR

SEQ ID NO: 26864 - protein, 20 aa, artificial
  peptide fold or domain or sub-domain
GWEYLPYASMISKTSQADNP

SEQ ID NO: 26865 - protein, 24 aa, artificial
  peptide fold or domain or sub-domain
AANCTLCEDGSYTPVYGQKKNFLL

SEQ ID NO: 26866 - protein, 20 aa, artificial
  peptide fold or domain or sub-domain
HITNLPFVLHGSLYFIIEQM

SEQ ID NO: 26867 - protein, 14 aa, artificial
  peptide fold or domain or sub-domain
APINIQRRILSLFE

SEQ ID NO: 26868 - protein, 24 aa, artificial
  peptide fold or domain or sub-domain
VLGALEKQLRVLPLFEYASIPTKE

SEQ ID NO: 26869 - protein, 24 aa, artificial
  peptide fold or domain or sub-domain
VLSVLQKQLRVLPLFEEATIPTKE

SEQ ID NO: 26870 - protein, 19 aa, artificial
  peptide fold or domain or sub-domain
KQQITKDYRKQIEKELNGI

SEQ ID NO: 26871 - protein, 18 aa, artificial
  peptide fold or domain or sub-domain
GETYSDKYDTIDVNEVLQ

SEQ ID NO: 26872 - protein, 30 aa, artificial
  peptide fold or domain or sub-domain
MGAATALAPCCLEEPRSTAKDGGSVAELNS

SEQ ID NO: 26873 - protein, 25 aa, artificial
  peptide fold or domain or sub-domain
MACCWCVAFVPALVLPQEKKAFGQI

SEQ ID NO: 26874 - protein, 26 aa, artificial
  peptide fold or domain or sub-domain
MQRVEVEGSNVTLIKPRGSHILYSKF

SEQ ID NO: 26875 - protein, 28 aa, artificial
  peptide fold or domain or sub-domain
MNMDCKSVIDHGRRRLHHPNYLVFNVPE

SEQ ID NO: 26876 - protein, 30 aa, artificial
  peptide fold or domain or sub-domain
MIAQFISEELFLKKVADYAWYDTLRERSIA

SEQ ID NO: 26877 - protein, 29 aa, artificial
  peptide fold or domain or sub-domain
NFVNINKSKYNIPLLILLYYYSILILNCY

SEQ ID NO: 26878 - protein, 22 aa, artificial
  peptide fold or domain or sub-domain
MYIYCICVCFCIIFMLWNPYSG

SEQ ID NO: 26879 - protein, 26 aa, artificial
  peptide fold or domain or sub-domain
LGYQDLYNRQLWYSIIRLHIQSIYCI

SEQ ID NO: 26880 - protein, 29 aa, artificial
  peptide fold or domain or sub-domain
VPAPFVENAVFFPLDGFSSLVKDQVTIGV

SEQ ID NO: 26881 - protein, 23 aa, artificial
  peptide fold or domain or sub-domain
MLCVRVEVMFSEPIFGVHIDFIW

SEQ ID NO: 26882 - protein, 26 aa, artificial
  peptide fold or domain or sub-domain
DTWCRILGPHSDYVDHGIKLILIDTS

SEQ ID NO: 26883 - protein, 21 aa, artificial
  peptide fold or domain or sub-domain
HAYTHYIIHNQSCYKGIYFFF

SEQ ID NO: 26884 - protein, 27 aa, artificial
  peptide fold or domain or sub-domain
MNIKPYVRKFNKNTRGLINNLLFKTFF

SEQ ID NO: 26885 - protein, 28 aa, artificial
  peptide fold or domain or sub-domain
SKTNKYKKQILHMQKFSLFFFVLSAYLI

SEQ ID NO: 26886 - protein, 25 aa, artificial
  peptide fold or domain or sub-domain
TIYIYIMFYEFRHSLQLYIVYFCLY

SEQ ID NO: 26887 - protein, 29 aa, artificial
  peptide fold or domain or sub-domain
MVAKIGKTHVSGHLHNYNKYNDKFYNLNF

SEQ ID NO: 26888 - protein, 24 aa, artificial
  peptide fold or domain or sub-domain
YIFYALLKISIFYEPILLHFSWIT

SEQ ID NO: 26889 - protein, 24 aa, artificial
  peptide fold or domain or sub-domain
MGQLTKCWNWLDHRRGVDLNNYNI

SEQ ID NO: 26890 - protein, 30 aa, artificial
  peptide fold or domain or sub-domain
MYLFNFFATLSICVPLDVFLFQVFFNNLKG

SEQ ID NO: 26891 - protein, 27 aa, artificial
  peptide fold or domain or sub-domain
YKSFSHDFYKTLNQKNTIMKLTKINFH

SEQ ID NO: 26892 - protein, 28 aa, artificial
  peptide fold or domain or sub-domain
MFYQTKKHIMLCIIQYNYDIFFNHIKSI

SEQ ID NO: 26893 - protein, 29 aa, artificial
  peptide fold or domain or sub-domain
YMVLFILTCAHFLLHIWLLNFISKLNIRI

SEQ ID NO: 26894 - protein, 26 aa, artificial
  peptide fold or domain or sub-domain
MIQGSDLKKKQTKAIRREMSQLNSYI

SEQ ID NO: 26895 - protein, 25 aa, artificial
  peptide fold or domain or sub-domain
MRQTKMINLTILKVCQYKQHFPYLF

SEQ ID NO: 26896 - protein, 29 aa, artificial
  peptide fold or domain or sub-domain
VNGSILYGFIFPMNWEMMETINFYIIIKI

SEQ ID NO: 26897 - protein, 25 aa, artificial
  peptide fold or domain or sub-domain
LMPLFGAYLDFLTLSVIKNTGWYIY

SEQ ID NO: 26898 - protein, 25 aa, artificial
  peptide fold or domain or sub-domain
MNVLTPGSNNYVEENPEIINKIKKC

SEQ ID NO: 26899 - protein, 25 aa, artificial
  peptide fold or domain or sub-domain
LNNNKALIIQVTLRNKEAIIVYLIS

SEQ ID NO: 26900 - protein, 26 aa, artificial
  peptide fold or domain or sub-domain
NCLFLFYNYVLFNNTFSQRGVTTVEK

SEQ ID NO: 26901 - protein, 24 aa, artificial
  peptide fold or domain or sub-domain
MSEVKFLDFLETNNCESICLKYFH

SEQ ID NO: 26902 - protein, 27 aa, artificial
  peptide fold or domain or sub-domain
MLLTFLVIHKNYTINMCTLSFYISIIY

SEQ ID NO: 26903 - protein, 26 aa, artificial
  peptide fold or domain or sub-domain
MALAFPCTGAYKVCVSNGPLFPVMAD

SEQ ID NO: 26904 - protein, 30 aa, artificial
  peptide fold or domain or sub-domain
MQLESRAPGYWLVHNVLLHWGPCDPSNSRL

SEQ ID NO: 26905 - protein, 21 aa, artificial
  peptide fold or domain or sub-domain
MIMDEKHFHLFVFLKIRYFLF

SEQ ID NO: 26906 - protein, 27 aa, artificial
  peptide fold or domain or sub-domain
AYTLYTHNLNNFNLQVKKKIRKNKKGE

SEQ ID NO: 26907 - protein, 19 aa, artificial
  peptide fold or domain or sub-domain
MHVFVASIYILILYINFMY

SEQ ID NO: 26908 - protein, 25 aa, artificial
  peptide fold or domain or sub-domain
MNFFIGLYLIETLRNRQVNREIIDK

SEQ ID NO: 26909 - protein, 30 aa, artificial
  peptide fold or domain or sub-domain
YNNNAILYFILFIIIRTKHEILLIYLYFVF

SEQ ID NO: 26910 - protein, 27 aa, artificial
  peptide fold or domain or sub-domain
MMNMKIYIFHLILITLFCLQTWTSSVS

SEQ ID NO: 26911 - protein, 30 aa, artificial
  peptide fold or domain or sub-domain
KHSIICIITYEKMFVALLILMEAPLFWLHI

SEQ ID NO: 26912 - protein, 15 aa, artificial
  peptide fold or domain or sub-domain
KQVYNFRTLQISKCQ

SEQ ID NO: 26913 - protein, 26 aa, artificial
  peptide fold or domain or sub-domain
MSAIAPPENAEQPEKKKQKIVYKKVY

SEQ ID NO: 26914 - protein, 25 aa, artificial
  peptide fold or domain or sub-domain
CSNLFGGYHILYDLNRNNIFDVTYS

SEQ ID NO: 26915 - protein, 30 aa, artificial
  peptide fold or domain or sub-domain
TFCKFFCISNASLERNLLLFEDFSVILLYG

SEQ ID NO: 26916 - protein, 24 aa, artificial
  peptide fold or domain or sub-domain
MYYTRMFNHEMKFKSQNMHPKRSI

SEQ ID NO: 26917 - protein, 28 aa, artificial
  peptide fold or domain or sub-domain
MSTLFYKLIQIINSLLIVKHSVLVLWVK

SEQ ID NO: 26918 - protein, 27 aa, artificial
  peptide fold or domain or sub-domain
IMPFGVHILTFELYFLIKHIRMMHIFN

SEQ ID NO: 26919 - protein, 25 aa, artificial
  peptide fold or domain or sub-domain
MSSIILATVQKKIEIETNRQTGKEA

SEQ ID NO: 26920 - protein, 23 aa, artificial
  peptide fold or domain or sub-domain
MIYDDSYNMSIYLTNEIHNLLLG

SEQ ID NO: 26921 - protein, 24 aa, artificial
  peptide fold or domain or sub-domain
RLIYLTFANIKCICMKYVRTFVFS

SEQ ID NO: 26922 - protein, 28 aa, artificial
  peptide fold or domain or sub-domain
MLQDIEEVAPQKRSTIRGTKENNKKGII

SEQ ID NO: 26923 - protein, 29 aa, artificial
  peptide fold or domain or sub-domain
HNLEIKHMGMVNIFDQHLQTNKYYKFIQN

SEQ ID NO: 26924 - protein, 29 aa, artificial
  peptide fold or domain or sub-domain
AQKKLQYFFRPNSLQHHKFFFICKKKNIK

SEQ ID NO: 26925 - protein, 27 aa, artificial
  peptide fold or domain or sub-domain
NELFYPYIHNIYNIIKTFNLLHFFLSY

SEQ ID NO: 26926 - protein, 28 aa, artificial
  peptide fold or domain or sub-domain
MHMMHSNDVKNQESINKTNEAKGSQKKY

SEQ ID NO: 26927 - protein, 27 aa, artificial
  peptide fold or domain or sub-domain
MPFLERHNNYRERKKKKKIYINTYQCT

SEQ ID NO: 26928 - protein, 27 aa, artificial
  peptide fold or domain or sub-domain
MNMQGKKKKNSYIYELDIYWKNTYNIF

SEQ ID NO: 26929 - protein, 29 aa, artificial
  peptide fold or domain or sub-domain
MLTNCLFGSNFCTIFMLWVMVMFMYPQLG

SEQ ID NO: 26930 - protein, 21 aa, artificial
  peptide fold or domain or sub-domain
MFILFFFLRKLIISTQKCKEM

SEQ ID NO: 26931 - protein, 16 aa, artificial
  peptide fold or domain or sub-domain
MVILNYHHKIYFSILN

SEQ ID NO: 26932 - protein, 24 aa, artificial
  peptide fold or domain or sub-domain
TNWGGTYFEHHLEIKHAWMVHILN

SEQ ID NO: 26933 - protein, 21 aa, artificial
  peptide fold or domain or sub-domain
IILFNMVYWFVLIFYIHIFEK

SEQ ID NO: 26934 - protein, 26 aa, artificial
  peptide fold or domain or sub-domain
MQIDTRLLHVQASSLYANNETLGQIN

SEQ ID NO: 26935 - protein, 30 aa, artificial
  peptide fold or domain or sub-domain
KEAASCILKNAAIKYCLNFFFQFFRGHKIY

SEQ ID NO: 26936 - protein, 27 aa, artificial
  peptide fold or domain or sub-domain
MSAGGTVIFALFYDNVNIFFKFVCNNV

SEQ ID NO: 26937 - protein, 29 aa, artificial
  peptide fold or domain or sub-domain
MTIKRYKQIFIILFTFRIFFENRNLFIKK

SEQ ID NO: 26938 - protein, 27 aa, artificial
  peptide fold or domain or sub-domain
AKTKKRNNKINEECEIDKQNQLHYKII

SEQ ID NO: 26939 - protein, 20 aa, artificial
  peptide fold or domain or sub-domain
IKKKMHTHYIYSISQYMKFS

SEQ ID NO: 26940 - protein, 30 aa, artificial
  peptide fold or domain or sub-domain
EQNICNMRTSIYFTQNEIKGKKGIIKNKFK

SEQ ID NO: 26941 - protein, 29 aa, artificial
  peptide fold or domain or sub-domain
MIFLIYRIMNTHIFITDHTQFKIYKTFHY

SEQ ID NO: 26942 - protein, 27 aa, artificial
  peptide fold or domain or sub-domain
SHASSLIYYNIYNYIINPYEFDKDIFI

SEQ ID NO: 26943 - protein, 29 aa, artificial
  peptide fold or domain or sub-domain
LFIIFFQNTCNFLQFFFLNVECLLKMKGT

SEQ ID NO: 26944 - protein, 26 aa, artificial
  peptide fold or domain or sub-domain
MIYFIFLKFYLWNSFEFQMMNTNIFL

SEQ ID NO: 26945 - protein, 30 aa, artificial
  peptide fold or domain or sub-domain
NIFVLKILLTFMPHMFIKIYIFDCFKYLIL

SEQ ID NO: 26946 - protein, 26 aa, artificial
  peptide fold or domain or sub-domain
MINEESDEGMFLNGIEVQSTIWREYI

SEQ ID NO: 26947 - protein, 23 aa, artificial
  peptide fold or domain or sub-domain
MSYITCKQVSKQATNQATNQPSK

SEQ ID NO: 26948 - protein, 30 aa, artificial
  peptide fold or domain or sub-domain
ERRTDERKKQRYFTPHYKKKKKNDISAFIV

SEQ ID NO: 26949 - protein, 23 aa, artificial
  peptide fold or domain or sub-domain
MRLDINYKMTHLEKLVYNIIYLQ

SEQ ID NO: 26950 - protein, 27 aa, artificial
  peptide fold or domain or sub-domain
MYTYLLYAFEYNYSPACNLCVVPYPPP

SEQ ID NO: 26951 - protein, 23 aa, artificial
  peptide fold or domain or sub-domain
MVYVIKEKMEIYTNHILLSKWIK

SEQ ID NO: 26952 - protein, 27 aa, artificial
  peptide fold or domain or sub-domain
IKKKKKIGNIISGRSTYLCILHRYMFP

(The sequence listing continues in the following parts.)

We claim:

1. A method for producing a library of independent protein secondary structures, said method consisting essentially of the following sequential steps:
    (i) executing a computer program to thereby obtain a plurality of amino acid sequences of different proteins from bioinformatic data source(s) wherein the sequences are predicted to form secondary structures and/or assemblies of secondary structures in their native contexts;
    (ii) executing a computer program to simultaneously select from (i) a plurality of amino acid sequences of the different proteins, wherein the simultaneously-selected sequences each consist of a single segment of a protein corresponding to a hydrophobic folding unit is predicted to form a secondary structures independent of any other part of the protein from which it is derived when isolated from those other parts of the protein;
    (iii) chemically-synthesizing a plurality of peptides that each consist essentially of a sequence selected at (ii) that is predicted to form a secondary structure independent of any other part of the protein from which it is derived when isolated from other parts of the protein; and
    (iv) displaying a plurality of chemically-synthesized peptides that each consists essentially of a sequence selected at (iii) that is predicted to independently-form a secondary structure such that the displayed peptides form secondary structures independent of other parts of the proteins from which they are derived, thereby producing a peptide library of independent protein secondary structures.

2. The method of claim 1 wherein said method further comprises predicting that the plurality of different proteins will independently-form secondary structures and/or assemblies of secondary structures by determining one or more criteria selected from compactness, non-polar buried surface area, and degree of independence.

3. The method of claim 1 wherein the amino acid sequences are predicted to form secondary structures and wherein the peptides having said sequences are displayed so as to form secondary structures.

4. The method of claim 1 wherein the secondary structures of the displayed peptides form autonomously.

5. The method of claim 1 wherein formation of the secondary structures is induced.

6. The method of claim 1 wherein the peptides mimic tertiary structures produced by interaction of non-contiguous portions of native proteins.

7. The method of claim 1 further comprising size-selecting the sequences to thereby identify a sub-set of sequences having the average length of an independent protein fold.

8. The method of claim 1 further comprising identifying redundant sequences and removing or deleting redundant sequences to thereby leave a non-redundant or normalized plurality of amino acid sequences.

9. The method of claim 1 further comprising identifying related sequences to the obtained plurality of amino acid sequences and adding those sequences to the plurality of amino acid sequences.

10. The method of claim 9 wherein the related sequences are identified from a data source that is different to the bioinformatic data source(s) of the plurality of amino acid sequences.

11. The method of claim 1 further comprising mutating peptides having sequences that are predicted to form secondary structures.

12. The method of claim 11 wherein mutating of the peptides produces peptides having different affinities for particular ligands.

13. The method of claim 1 further comprising producing and mutating nucleic acids encoding the amino acid sequences and producing and displaying the encoded peptides.

14. The method of claim 1 further comprising (a) mutating peptides having sequences that are predicted to form secondary structures and (b) identifying redundant sequences in the mutated peptides and removing or deleting redundant sequences to thereby leave a plurality of peptides comprising non-redundant or normalized amino acid sequences.

15. The method of claim 14 comprising performing iterations of (a) and (b) to thereby produce a non-redundant yet highly diverse set of peptides.

16. The method of claim 1 wherein the displayed peptides are produced by synthetic means.

17. The method of claim 1 wherein the displayed peptides are displayed as a microarray on one solid surface.

18. The method of claim 1 further comprising providing the peptide library comprising the displayed peptides.

19. The method of claim 1 wherein the displayed peptides are displayed on a plurality of solid surfaces.

20. A process comprising: (i) performing the method of claim 1 to thereby produce a peptide library; and (ii) screening the peptide library so produced to thereby identify a peptide.

21. A process comprising: (i) obtaining a peptide library produced by the method of claim 1; and (ii) screening the peptide library to thereby identify a peptide.

22. The process of claim 20 further comprising isolating the identified peptide.

23. The process of claim 22 further comprising subjecting the isolated peptide to mutation or an affinity maturation.

24. The process of claim 20 further comprising identifying a mimetic of the structure formed by a peptide.

25. A process comprising: (i) performing the method of claim 1 to thereby produce a peptide library; (ii) screening the peptide library so produced to thereby identify a peptide having a desired structure; and (iii) optionally, providing the peptide or the structure of the peptide to a person.

26. The process of claim 25 further comprising identifying one or more chemical compounds having the secondary structure and/or activity of the peptide.

27. A method for producing a library of independent protein secondary structures having low structural redundancy, said method consisting essentially of the following sequential steps:

(i) executing a computer program to thereby obtain a plurality of amino acid sequences of different proteins from bioinformatic data source(s) wherein the sequences are predicted to form secondary structures and/or assemblies of secondary structures in their native contexts;

(ii) executing a computer program to simultaneously select from (i) a plurality of amino acid sequences of the different proteins, wherein the simultaneously-selected sequences each consist of a single segment of a protein corresponding to a hydrophobic folding unit is predicted to form a secondary structures independent of any other part of the protein from which it is derived when isolated from those other parts of the protein;

(iii) executing a computer program to thereby identify sequences in the plurality at (ii) that are predicted to form redundant secondary structures and removing or deleting sufficient sequences predicted to form the redundant secondary structures to thereby select a plurality of amino acid sequences predicted to form non-redundant secondary structures independent of any other part of the proteins from which they are derived when isolated from those other parts of the proteins, wherein no more than five of said sequences are predicted to form the same secondary structure; and (iv) chemically-synthesizing a plurality of peptides that each consist essentially of a sequence selected at (iii) that is predicted to form a non-redundant secondary structure independent of any other part of the protein from which it is derived when isolated from those other parts of the protein; and (v) displaying the plurality of peptides chemically-synthesized at (iv) such that the displayed peptides form secondary structures independent of other parts of the proteins, thereby producing a library of independent protein secondary structures having low structural redundancy.

28. The method according to claim 27 wherein the displayed peptides comprise related secondary structures that differ in their ability to fold autonomously.

29. The method according to claim 27 wherein the displayed peptides comprise related secondary structures that differ in their ligand-binding affinities and/or association/dissociation constants for a ligand.

30. The method according to claim 27 wherein the displayed peptides comprise related secondary structures that differ in their chemical modifications.

31. A method for producing a library of independent protein secondary structures having low structural redundancy, said method consisting essentially of the following sequential steps:

(i) executing a computer program to thereby obtain a plurality of amino acid sequences of different proteins from bioinformatic data source(s) wherein the sequences are predicted to form secondary structures and/or assemblies of secondary structures in their native contexts;

(ii) executing a computer program to simultaneously select from (i) a plurality of amino acid sequences of the different proteins, wherein the simultaneously-selected sequences each consist of a single segment of a protein corresponding to a hydrophobic folding unit is predicted to form a secondary structures independent of any other part of the protein from which it is derived when isolated from those other parts of the protein;

(iii) executing a computer program to identify sequences in the plurality at (ii) which are redundant and removing or deleting the redundant sequences to thereby select for a non-redundant plurality of sequences;

(iv) chemically-synthesizing a plurality of peptides that each consist essentially of a sequence selected at (iii) which is non-redundant and that is predicted to form a secondary structure independent of any other part of the protein from which it is derived when isolated from those other parts of the protein; and (v) displaying the plurality of peptides chemically-synthesized at (iv) such that the displayed peptides form secondary structures independent of their native contexts, thereby producing a library of independent protein secondary structures having low structural redundancy.

32. A method for producing a library of independent protein secondary structures, said method comprising:

(i) executing a computer program to thereby identify a plurality of amino acid sequences of different proteins from bioinformatic data source(s) wherein the sequences are capable of folding independently from other parts of the proteins in which they are contained in their native contexts;

(ii) executing a computer program to simultaneously select from (i) a plurality of amino acid sequences of different proteins that arc each consist of a single segment of a protein corresponding to a hydrophobic folding unit capable of folding independently from other parts of the proteins from which they are derived when isolated from those other parts of the proteins;

(iii) size-selecting those sequences selected at (ii) to thereby select a sub-set of sequences having the average length of an independent protein fold;

(iv) executing a computer program to identify redundant sequences in the sub-set of sequences selected at (iii) and removing or deleting redundant sequences to thereby select for a non-redundant plurality of amino acid sequences;

(v) chemically-synthesizing a plurality of peptides that each consist essentially of a sequence selected at (iv) which is non-redundant and capable of folding independently of any other part of the protein from which it is derived when isolated from other parts of the protein; and;

(vi) displaying the plurality of peptides chemically-synthesized at (v) such that the displayed peptides form secondary structures and/or folds independent of other parts of the proteins, thereby producing a library of independent protein secondary structures.

33. A method for producing a library of independent protein secondary structures, said method comprising:

(i) executing a computer program to thereby identify a plurality of amino acid sequences of different proteins from bioinformatic data source(s) wherein the sequences are capable of folding independently from other parts of the proteins in which they are contained in their native contexts;

(ii) executing a computer program to simultaneously select from (i) a plurality of amino acid sequences of the different proteins that each consist of a single segment of a protein corresponding to a hydrophobic folding unit and are each capable of folding independently from other parts of the proteins from which they are derived when isolated from those other parts of the proteins;

(iii) size-selecting those sequences at (ii) to thereby select a sub-set of sequences having the average length of an independent protein fold;

(iv) executing a computer program to identify redundant sequences in the sub-set of sequences selected at (iii) and removing or deleting redundant sequences to thereby select for a non-redundant plurality of amino acid sequences;

(v) identifying related sequences to the non-redundant plurality of amino acid sequences at (iv) and adding those related sequences to the non-redundant plurality of amino acid sequences to thereby produce a diverse pool of amino acid sequences;

(vi) chemically-synthesizing a plurality of peptides that each consist essentially of a sequence selected from the diverse pool of amino acid sequences produced at (v); and (vii) displaying the plurality of peptides chemically-synthesized at (vi) such that the displayed peptides form secondary structures and/or folds independent of any other parts of the protein from which they are derived when isolated from those other parts of the proteins their native contexts, thereby producing a library of independent protein secondary structures.

* * * * *

UNITED STATES PATENT AND TRADEMARK OFFICE
CERTIFICATE OF CORRECTION

| | | |
|---|---|---|
| PATENT NO. | : 8,575,070 B2 | Page 1 of 1 |
| APPLICATION NO. | : 11/672419 | |
| DATED | : November 5, 2013 | |
| INVENTOR(S) | : Watt et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 323 days.

Signed and Sealed this
Twenty-sixth Day of May, 2015

Michelle K. Lee
*Director of the United States Patent and Trademark Office*